United States Patent 9,782,462 (MODIFIED POLYNUCLEOTIDES FOR THE PRODUCTION OF PROTEINS ASSOCIATED WITH HUMAN DISEASE) - sequence listing, part 81

SEQ ID NO: 156899 - DNA, 1518 bp, Artificial Sequence
  Description of Artificial Sequence: Synthetic coding sequence
atgacctgtggcagcggctttggaggccgggccttcagctgcatcagcgcctgtggcccccggcccggccgctgctgcatcacagctgccccctaccggggcatcagctgctaccggggcctgaccggcggcttcggcagccacagcgtgtgtggcggcttccgggccggcagctgtggccgcagctttggctacagaagtggaggagtgtgtggccccagccccccctgcatcaccaccgtgtctgtgaatgaaagcctgctgacccccctgaacctggagattgaccccaatgcccagtgtgtgaagcaggaggagaaggagcagatcaagagcctgaacagcagatttgctgccttcatcgacaaggtgcgcttcctggagcagcagaacaagctgctggagaccaagctgcagttctaccagaaccgggagtgctgccagagcaacctggagcccctgtttgagggctacatcgagaccctgcggcgggaggctgaatgtgtggaggccgacagcggccgcctggccagcgagctgaaccacgtgcaggaggtgctggagggctacaagaagaagtatgaggaggaggtgtccctgcgggccacagcagaaaatgaatttgtggccctgaagaaggatgtggactgtgcctacctgaggaagagtgacctggaggccaacgtggaggccctgatccaggagattgacttcctgcggcggctgtatgaggaggagatcctgatcctgcagagccacatcagtgacacctctgtggtggtgaagctggacaacagccgggacctgaacatggactgcatcatcgccgagatcaaggcccagtatgatgacatcgtgaccaggagcagagctgaggccgagagctggtaccgcagcaaatgtgaggagatgaaggccaccgtcatcagacatggagagaccctgcggaggaccaaggaggagatcaatgagctgaacaggatgatccagaggctgacagctgaggtggagaatgccaagtgccagaacagcaagctggaggccgctgtggcccagagcgagcagcagggcgaggccgccctgagtgatgcccgctgcaagctggccgagctggagggcgccctgcagaaggccaagcaggacatggcctgcctgatccgggagtaccaggaggtgatgaacagcaagctgggcctggacattgaaattgccacctacagaaggctgctggagggggaggagcagaggctgtgtgagggcattggagctgtgaatgtgtgtgtgagcagcagcagaggaggagtggtgtgtggggacctgtgtgtgtctggcagcaggcctgtgactggatctgtgtgcagcgccccctgcaatggaaatgtggccgtgtccacaggcctgtgtgccccctgtggccagctgaacaccacctgtggcggcggcagctgtggggtgggcagctgtggcatcagcagcctgggcgtgggcagctgtggcagcagctgcaggaagtgctag

SEQ ID NO: 156900 - DNA, 1455 bp, Artificial Sequence
  Description of Artificial Sequence: Synthetic coding sequence
atgacctgtggcagcggctttggaggccgggccttcagctgcatcagcgcctgtggcccccggcccggccgctgctgcatcacagctgccccctaccggggcatcagctgctaccggggcctgaccggcggcttcggcagccacagcgtgtgtggcggcttccgggccggcagctgtggccgcagctttggctacagaagtggaggagtgtgtggccccagccccccctgcatcaccaccgtgtctgtgaatgaaagcctgctgacccccctgaacctggagattgaccccaatgcccagtgtgtgaagcaggaggagaaggagcagatcaagagcctgaacagcagatttgctgccttcatcgacaaggtgcgcttcctggagcagcagaacaagctgctggagaccaagctgcagttctaccagaaccgggagtgctgccagagcaacctggagcccctgtttgagggctacatcgagaccctgcggcgggaggctgaatgtgtggaggccgacagcggccgcctggccagcgagctgaaccacgtgcaggaggtgctggagggctacaagaagaagtatgaggaggaggtgtccctgcgggccacagcagaaaatgaatttgtggccctgaagaaggatgtggactgtgcctacctgaggaagagtgacctggaggccaacgtggaggccctgatccaggagattgacttcctgcggcggctgtatgaggaggagatcctgatcctgcagagccacatcagtgacacctctgtggtggtgaagctggacaacagccgggacctgaacatggactgcatcatcgccgagatcaaggcccagtatgatgacatcgtgaccaggagcagagctgaggccgagagctggtaccgcagcaaatgtgaggagatgaaggccaccgtcatcagacatggagagaccctgcggaggaccaaggaggagatcaatgagctgaacaggatgatccagaggctgacagctgaggtggagaatgccaagtgccagaacagcaagctggaggccgctgtggcccagagcgagcagcagggcgaggccgccctgagtgatgcccgctgcaagctggccgagctggagggcgccctgcagaaggccaagcaggacatggcctgcctgatccgggagtaccaggaggtgatgaacagcaagctgggcctggacattgaaattgccacctacagaaggctgctggagggggaggagcagaggctgtgtgagggcattggagctgtgaatgtgtgtgtgagcagcagcagaggaggagtggtgtgtggggacctgtgtgtgtctggcagcaggcctgtgactggatctgtgtgcagcgccccctgcaatggaaatgtggccgtgtccacaggcctgtgtgccccctgtggccaggtgggcagctgtggcagcagctgcaggaaatgttag

SEQ ID NO: 156901 - DNA, 1482 bp, Artificial Sequence
  Description of Artificial Sequence: Synthetic coding sequence
atgacctgtggcttcaacagcatcggctgcggcttccggcccggcaacttcagctgtgtgtctgcctgtggcccccggcccagccgctgctgcatcacagctgccccctaccggggcatcagctgctaccggggcctgactggaggcttcggcagccacagcgtgtgtggcggcttccgggccggcagctgtggccgcagctttggctaccgcagcggcggcgtgtgtggccccagccccccctgcatcaccaccgtgtctgtgaatgaaagcctgctgacccccctgaacctggagattgaccccaatgcccagtgtgtgaagcaggaggagaaggagcagatcaagagcctgaacagcagatttgctgccttcatcgacaaggtgcgcttcctggagcagcagaacaagctgctggagaccaagctgcagttctaccagaaccgggagtgctgccagagcaacctggagcccctgtttgctggctacatcgagaccctgcggcgggaggccgagtgtgtggaggccgacagcggccgcctggccagcgagctgaaccacgtgcaggaggtgctggagggctacaagaagaagtatgaggaggaggtggccctgcgggccacagcagaaaatgaatttgtggccctgaagaaggatgtggactgtgcctacctgaggaagagtgacctggaggccaacgtggaggccctgatccaggagattgacttcctgcggcggctgtatgaggaggagatccgcatcctgcagagccacatcagtgacacctctgtggtggtgaagctggacaacagccgggacctgaacatggactgcatcgtggccgagatcaaggcccagtatgatgacatcgccaccaggagcagagctgaggccgagagctggtaccgcagcaaatgtgaggagatgaaggccaccgtcatccgccacggggagaccctgcggaggaccaaggaggagatcaatgagctgaacaggatgatccagaggctgacagctgaggtggagaatgccaagtgccagaacagcaagctggaggccgctgtggcccagagcgagcagcagggcgaggccgccctgagtgatgcccgctgcaagctggccgagctggagggcgccctgcagaaggccaagcaggacatggcctgcctgatccgggagtaccaggaggtgatgaacagcaagctgggcctggacatcgagatcgccacctaccgccgcctgctggagggggaggagcagaggctgtgtgaaggagtggaggccgtgaatgtgtgtgtgagcagcagccggggcggcgtggtgtgtggggacctgtgtgtgtctggcagcaggcctgtgacaggctctgtgtgcagcgccccctgcaatggaaacctggtggtgtccacaggcctgtgcaagccctgtggccagctgaacaccacctgtggcggcggcagctgtggccagggccgccactag

SEQ ID NO: 156902 - DNA, 1524 bp, Artificial Sequence
  Description of Artificial Sequence: Synthetic coding sequence
atgagctgccgcagctaccgcatcagcagcggctgcggcgtgaccaggaacttcagcagctgcagcgctgtggcccccaagacaggcaaccgctgctgcatctctgctgccccctacagaggagtgtcctgctaccggggcctgactggatttggcagccgcagcctgtgcaacctgggcagctgtggccccagaattgctgtgggcggcttccgggccggcagctgtggccgcagctttggctaccgcagcggcggcgtgtgtggccccagccccccctgcatcaccaccgtgtctgtgaatgaaagcctgctgacccccctgaacctggagattgaccccaatgcccagtgtgtgaagcaggaggagaaggagcagatcaagagcctgaacagcagatttgctgccttcatcgacaaggtgcgcttcctggagcagcagaacaagctgctggagaccaagtggcagttctaccagaaccagcgctgctgtgagagcaacctggagcccctcttcagcggctacatcgagaccctgcggcgggaggccgagtgtgtggaggccgacagcggccgcctggccagcgagctgaaccacgtgcaggaggtgctggagggctacaagaagaagtatgaggaggaggtggccctgcgggccacagcagaaaatgaatttgtggtgctgaagaaggatgtggactgtgcctacctgaggaagagtgacctggaggccaacgtggaggccctggtggaggagagcagcttcctgcggcggctgtatgaggaggagatccgggtgctgcaggcccacatcagtgacacctctgtgattgtgaagatggacaacagccgggacctgaacatggactgcatcatcgccgagatcaaggcccagtatgatgatgtggccagccgcagcagagctgaggccgagagctggtaccgcagcaaatgtgaggagatgaaggccaccgtcatccgccacggggagaccctgcggaggaccaaggaggagatcaatgagctgaacaggatgatccagaggctgacagctgagattgaaaatgccaagtgccagagggccaagctggaggccgctgtggccgaggccgagcagcagggcgaggccgccctgagtgatgcccgctgcaagctggccgagctggagggcgccctgcagaaggccaagcaggacatggcctgcctgctgaaggagtaccaggaggtgatgaacagcaagctgggcctggacatcgagatcgccacctaccgccgcctgctggagggggaggagcaccggctgtgtgaaggagtgggctctgtgaatgtgtgtgtgagcagcagccggggcggcgtgtcctgtggcggcctgagctacagcaccaccccaggccggcagatcaccagcggccccagcgccatcggcggcagcatcaccgtggtggccccagacagctgtgccccctgccagcccaggagcagcagcttcagctgtggcagcagccgctctgtgcgctttgcctag

SEQ ID NO: 156903 - DNA, 888 bp, Artificial Sequence
  Description of Artificial Sequence: Synthetic coding sequence
atggtgttcaaggtgcagttcctgagcagccggcccagcctgagccacacccaggatgtggactgtgcctacctgaggaagagtgacctggaggccaacgtggaggccctggtggaggagagcagcttcctgcggcggctgtatgaggaggagatccgggtgctgcaggcccacatcagtgacacctctgtgattgtgaagatggacaacagccgggacctgaacatggactgcatcatcgccgagatcaaggcccagtatgatgatgtggccagccgcagcagagctgaggccgagagctggtaccgcagcaaatgtgaggagatgaaggccaccgtcatccgccacggggagaccctgcggaggaccaaggaggagatcaatgagctgaacaggatgatccagaggctgacagctgagattgaaaatgccaagtgccagagggccaagctggaggccgctgtggccgaggccgagcagcagggcgaggccgccctgagtgatgcccgctgcaagctggccgagctggagggcgccctgcagaaggccaagcaggacatggcctgcctgctgaaggagtaccaggaggtgatgaacagcaagctgggcctggacatcgagatcgccacctaccgccgcctgctggagggggaggagcaccggctgtgtgaaggagtgggctctgtgaatgtgtgtgtgagcagcagccggggcggcgtgtcctgtggcggcctgagctacagcaccaccccaggccggcagatcaccagcggccccagcgccatcggcggcagcatcaccgtggtggccccagacagctgtgccccctgccagcccaggagcagcagcttcagctgtggcagcagccgctctgtgcgctttgcctag

SEQ ID NO: 156904 - DNA, 1461 bp, Artificial Sequence
  Description of Artificial Sequence: Synthetic coding sequence
atgacctgtggcagctactgcggcggccgggccttcagctgcatcagcgcctgtggcccccggcccggccgctgctgcatcacagctgccccctaccggggcatcagctgctaccggggcctgaccggcggcttcggcagccacagcgtgtgtggcggcttccgggccggcagctgtggccgcagctttggctacagaagtggaggagtgtgtggccccagccccccctgcatcaccaccgtgtctgtgaatgaaagcctgctgacccccctgaacctggagattgaccccaatgcccagtgtgtgaagcaggaggagaaggagcagatcaagagcctgaacagcagatttgctgccttcatcgacaaggtgcgcttcctggagcagcagaacaagctgctggagaccaagctgcagttctaccagaaccgggagtgctgccagagcaacctggagcccctgtttgagggctacatcgagaccctgcggcgggaggctgaatgtgtggaggccgacagcggccgcctggccagcgagctgaaccacgtgcaggaggtgctggagggctacaagaagaagtatgaggaggaggtgtccctgcgggccacagcagaaaatgaatttgtggccctgaagaaggatgtggactgtgcctacctgaggaagagtgacctggaggccaacgtggaggccctgatccaggagattgacttcctgcggcggctgtatgaggaggagatccgggtgctgcagagccacatcagtgacacctctgtggtggtgaagctggacaacagccgggacctgaacatggactgcatcatcgccgagatcaaggcccagtatgatgacatcgtgaccaggagcagagctgaggccgagagctggtaccgcagcaaatgtgaggagatgaaggccaccgtcatcagacatggagagaccctgcggaggaccaaggaggagatcaatgagctgaacaggatgatccagaggctgacagctgaggtggagaatgccaagtgccagaacagcaagctggaggccgctgtggcccagagcgagcagcagggcgaggccgccctgagtgatgcccgctgcaagctggccgagctggagggcgccctgcagaaggccaagcaggacatggcctgcctgatccgggagtaccaggaggtgatgaacagcaagctgggcctggacattgaaattgccacctacagaaggctgctggagggggaggagcagaggctgtgtgagggcgtgggctctgtgaatgtgtgtgtgagcagcagcagaggaggagtggtgtgtggggacctgtgtgccagcaccacagcccctgtggtgtccaccagggtgtcctctgtgcccagcaacagcaatgtggtggtgggcaccaccaatgcctgtgcccccagcgcccgggtgggcgtgtgtggcggcagctgcaagcgctgctag

SEQ ID NO: 156905 - DNA, 1872 bp, Artificial Sequence
  Description of Artificial Sequence: Synthetic coding sequence
atgagctgccggcagttcagcagcagctacctgagccgcagcggcggcggcggcggcggcggcctgggcagcggcggcagcatccgcagcagctacagccgcttcagcagcagcggcggcggcggcggcggcggccgcttcagcagcagcagcggctatggaggcggcagcagccgggtgtgtggccggggcggcggcggcagctttggctacagctatggaggcggcagcggcggcggcttcagcgccagcagcctgggcggcggctttggaggcggcagccggggctttggaggagccagcggcggcggctacagcagcagcggcggctttggaggcggctttggaggcggcagcggcggcggctttggaggcggctacggcagcggctttggaggctttggaggctttggaggaggagctggaggaggagatggcggcatcctgacagccaatgagaagagcaccatgcaggagctgaacagccggctggccagctacctggacaaggtgcaggccctggaggaggccaacaatgacctggagaacaagatccaggactggtatgacaagaagggccctgctgccatccagaagaactacagcccctactacaacaccattgatgacctgaaggaccagatcgtggacctgactgtgggcaacaacaagaccctgctggacatcgacaacaccaggatgaccctggatgacttccgcatcaagtttgagatggagcagaacctgcggcagggcgtggatgctgacatcaatggcctgcggcaggtgctggacaacctgaccatggagaagagtgacctggagatgcagtatgagaccctgcaggaggagctgatggccctgaagaagaaccacaaggaggagatgagccagctgaccggccagaacagcggagatgtgaatgtggagatcaacgtggcccctgggaaggacctgaccaagaccctgaatgacatgaggcaggagtatgagcagctgattgccaagaacaggaaggacatcgagaaccagtatgagacccagatcacccagatcgagcacgaggtgagcagcagcggccaggaggtgcagagcagcgccaaggaggtgacccagctgcggcatggagtgcaggagctggagattgagctgcagagccagctgagcaagaaggccgccctggagaagagcctggaggacaccaagaaccgctactgcggccagctgcagatgatccaggagcagatcagcaacctggaggcccagatcacagatgtgcggcaggagattgagtgccagaaccaggagtacagcctgctgctgagcatcaagatgaggctggagaaggagattgagacctaccacaacctgctggagggcggccaggaggactttgagagcagcggggccggcaagattggcctgggcggccggggcggcagcggcggcagctatggccggggcagcagaggaggcagcggcggcagctatggaggcggcggcagcggcggcggctacggcggcggcagcggcagccggggcggcagcggcggcagctatggaggcggcagcggcagcggcggcggcagcggcggcggctacggcggcggcagcggcggcggccacagcggcggcagcggcggcggccacagcggcggcagcggcggcaactacggcggcggcagcggcagcggcggcggcagcggcggcggctacggcggcggcagcggcagccggggcggcagcggcggcagccacggcggcggcagcggctttggaggagagagcggcggcagctatggaggaggagaggaggccagcggcagcggcggcggctatggaggcggcagcggcaagagcagccacagctag

SEQ ID NO: 156906 - DNA, 534 bp, Artificial Sequence
  Description of Artificial Sequence: Synthetic coding sequence
atggcctgctgccagaccagcttctgtggcttccccagctgcagcaccagcggcacctgtggcagcagctgctgccagcccagctgctgtgagaccagcagctgccagccccgctgctgtgagaccagctgctgccagcccagctgctgccagaccagcttctgtggcttccccagcttcagcactggaggcacctgtgacagcagctgctgccagcccagctgctgtgagaccagctgctgccagcccagctgctaccagaccagcagctgtggcaccggctgcggcattggaggcggcatcggctacggccaggagggcagcagtggagctgtgtccacccgcatccgctggtgcaggccagactgccgggtggagggcacctgcctgcccccctgctgcgtggtgtcctgcaccccacccagctgctgccagctgcaccacgccgaggccagctgctgccggcccagctactgcggccagagctgctgcaggcctgtgtgctgctgctactgcagcgagcccacctgctag

SEQ ID NO: 156907 - DNA, 504 bp, Artificial Sequence
  Description of Artificial Sequence: Synthetic coding sequence
atggcctgctgccagaccagcttctgtggcttccccagctgcagcaccagcggcacctgtggcagcagctgctgccagccccgctgctgtgagaccagctgctgccagcccagctgctgccagaccagcttctgtggcttccccagcttcagcactggaggcacctgtgacagcagctgctgccagcccagctgctgtgagaccagctgctgccagcccagctgctaccagaccagcagctgtggcaccggctgcggcattggaggcggcatcggctacggccaggagggcagcagtggagctgtgtccacccgcatccgctggtgcaggccagactgccgggtggagggcacctgcctgcccccctgctgcgtggtgtcctgcaccccacccagctgctgccagctgcaccacgccgaggccagctgctgccggcccagctactgcggccagagctgctgcaggcctgtgtgctgctgctactgcagcgagcccacctgctag

SEQ ID NO: 156908 - DNA, 492 bp, Artificial Sequence
  Description of Artificial Sequence: Synthetic coding sequence
atgtccttcaactgcagcaccaggaactgcagcagccggcccatcggcggccgctgcatcgtgcctgtggcccaggtgaccaccaccagcaccacagatgctgactgcctgggcggcatctgcctgcccagcagcttccagacaggctcctggctgctggaccactgccaggagacctgctgtgagcccacagcctgccagcccacctgctacagaaggaccagctgtgtgagcaacccctgccaggtgacctgcagccggcagaccacctgcatcagcaacccctgcagcaccacctacagccggcccctgacctttgtgagcagcggctgccagcccctgggcggcatcagctctgtgtgccagcctgtgggcggcatcagcacagtgtgccagcctgtgggcggcgtgtccacagtgtgccagcctgcctgtggggtgtccaggacctaccagcagagctgtgtgagcagctgcaggaggacctgctag

SEQ ID NO: 156909 - DNA, 504 bp, Artificial Sequence
  Description of Artificial Sequence: Synthetic coding sequence
atgacctgctgccagaccagcttctgtggctaccccagctgcagcaccagcggcacctgtggcagcagctgctgccagcccagctgctgtgagaccagctgctgccagcccagctgctgccagaccagcttctgtggcttccccagcttcagcaccagcggcacctgcagcagcagctgctgccagcccagctgctgtgagaccagctgctgccagcccagctgctgccagaccagcagctgtggcaccggctgcggcattggaggcggcatcggctacggccaggagggcagcagtggagctgtgtccacccgcatccgctggtgcaggccagactgccgggtggagggcacctgcctgcccccctgctgcgtggtgtcctgcaccccacccacctgctgccagctgcaccacgccgaggccagctgctgccggcccagctactgcggccagagctgctgcaggcctgtgtgctgctgctacagctgtgagcccacctgctag

SEQ ID NO: 156910 - DNA, 366 bp, Artificial Sequence
  Description of Artificial Sequence: Synthetic coding sequence
atggccagctgcagcaccagcggcacctgtggcagcagctgctgccagcccagctgctgtgagaccagctgctgccagcccagctgctgccagaccagcagctgtggcaccggctgcggcattggaggcggcatcggctacggccaggagggcagcggcggctctgtgtccacccgcatccgctggtgccacccagactgccacgtggagggcacctgcctgcccccctgctacctggtgtcctgcaccccacccagctgctgccagctgcaccacgccgaggccagctgctgccggcccagctactgcggccagagctgctgcaggcctgcctgctgctgccactgctgtgagcccacctgctag

SEQ ID NO: 156911 - DNA, 837 bp, Artificial Sequence
  Description of Artificial Sequence: Synthetic coding sequence
atgggctgctgcggctgcagcggcggctgcggcagcagctgtggcggctgcggcagcggctgcggcggctgcggcagcggctgcggcggctgcggcagcggctgcggcggcagcggcagcagctgctgcgtgcctgtgtgctgctgcaagcctgtgtgctgccgggtgcccacctgcagctgcagcagctgtgggaagggcggctgcggcagcagcggcggcagcaagggcggctgcggcagctgtggcggctgcaagggcggctgcggcagctgtggcggcagcaagggcggctgcggcagctgtggcggcagcaagggcggctgcggcagctgtggcggcagcaagggcggctgcggcagcggctgcggcggctgcggcagcagctgctgcgtgcctgtgtgctgctgcaagcccatgtgctgctgcgtgcctgcctgcagctgcagcagctgtgggaagggcggctgcggcagctgtggctgcagcaagggggcctgtggcagctgtggcggcagcaagggcggctgcggcagctgtggcggctgcaagggcggctgcggcagctgtggcggcagcaagggcggctgcggcagcggctgcggcggctgcggcagcggctgcggcgtgcctgtgtgctgctgcagctgcagcagctgtggcagctgtgccggcagcaaaggaggctgcggcagcagctgcagccagtgcagctgctgcaagccctgctgctgcagcagcggctgcggcagcagctgctgccagagcagctgctgcaagccctgctgcagccagagcagctgctgcgtgcctgtgtgctgccagtgcaagatctag

SEQ ID NO: 156912 - DNA, 510 bp, Artificial Sequence
  Description of Artificial Sequence: Synthetic coding sequence
atgggctgctgcggctgcagcggcggctgcggcagcagctgtggcggctgtgacagcagctgtggcagctgtggcagcggctgccggggctgcggccccagctgctgtgcccctgtgtactgctgcaagcctgtgtgctgctgcgtgcctgcctgcagctgcagcagctgtgggaagaggggctgcggcagctgtggcggcagcaaaggaggctgcggcagctgtggctgcagccagtgcagctgctgcaagccctgctgctgcagcagcggctgcggcagcagctgctgccagtgcagctgctgcaagccctactgcagccagtgcagctgctgcaagccctgctgcagcagcagcggccggggcagcagctgctgccagagcagctgctgcaagccctgctgcagcagcagcggctgcggcagcagctgctgccagagcagctgctgcaagccctgctgcagccagagccgctgctgcgtgcctgtgtgctaccagtgcaagatctag

SEQ ID NO: 156913 - DNA, 1740 bp, Artificial Sequence
  Description of Artificial Sequence: Synthetic coding sequence
atgtgtgaccagcagcagatccagtgccgcctgcccctgcagcagtgctgcgtgaagggccccagcttctgcagcagccagagcccctttgcccagagccaggtggtggtgcaggccccctgtgagatgcagatcgtggactgcccagccagctgccctgtgcaggtgtgccaggtgtctgaccaggccccctgccagagccagaccacccaggtgaagtgccagagcaagaccaagcaggtgaagggccaggcccagtgccagagcaagaccacccaggtgaagggccaggccgccagccagagccagaccagctctgtgcagagccaggccccctgccagagcgaggtgtcctatgtgcagtgtgaggccagccagcctgtgcagacctgctttgtggagtgtgcccctgtgtgctacacagagacctgctacgtggagtgccctgtgcagaactacgtgccctgcccagccccccagcctgtgcagatgtaccggggccggcctgctgtgtgccagccccagggccgcttcagcacccagtgccagtaccagggcagctacagcagctgtggcccccagttccagagccgggccacctgcaacaactacaccccccagttccagctgcggcccagctacagcagctgcttcccccagtaccgcagcaggaccagcttcagcccctgtgtgccccagtgccagacccagggcagctatggcagcttcacagagcagcacaggagccgcagcaccagccgctgcctgcccccaccccggcggctgcagctgttccccaggagctgcagccccccaagaagatttgagccctgcagcagcagctacctgcccctgcggcccagcgagggcttccccaactactgcaccccaccaagaagaagtgagcccatctacaacagccgctgcccccggcggcccatcagcagctgcagccagaggcggggccccaagtgcagaattgagatcagcagcccctgctgcccccggcaggtgcccccccagcgctgccctgtggagatcccccccatcagaagaagaagccagagctgtggcccccagcccagctggggcgccagctgcccagagctgcggccccacgtggagccccggcccctgcccagcttctgccccccccggcggctggaccagtgcccagagagccccctgcagcgctgccccccaccagccccccggccccggctgcggcctgagccctgcatcagcctggagccccggccccggcccctgccccggcagctgtctgagccctgcctgtacccagagcccctgcctgccctgcggcccacccccaggcctgtgcccctgccccggcccggccagtgtgagatccctgagccccggccctgcctgcagccctgtgagcaccctgagccctgccccaggcctgagcccatccccctgcctgccccctgccccagccctgagccctgccgggagacctggaggagccccagcccctgctggggccccaaccctgtgccctacccaggggacctgggctgccacgagagcagcccccaccggctggacacagaggccccctactgcggccccagcagctacaaccagggccaggagagcggggccggctgcggccctggagatgtgtttcctgagcggcggggccaggacggccacggggaccagggcaatgcctttgctggggtgaagggggaggccaagagcgcctacttctag

SEQ ID NO: 156914 - DNA, 1059 bp, Artificial Sequence
  Description of Artificial Sequence: Synthetic coding sequence
atggccggcaccatctgcttcatcatgtgggtgctcttcatcacagacacagtgtggagccgctctgtgcggcaggtgtatgaggtgcatgacagtgatgactggaccatccatgactttgaatgtcccatggagtgcttctgccccccatccttccccacagccctgtactgtgaaaatagaggcctgaaggagatcccagccatccccagccgcatctggtacctgtacctgcagaacaacctgattgagaccatccctgagaagccctttgaaaatgccacccagctgcgctggatcaacctgaacaagaacaagatcaccaactacggcatcgagaagggggccctgagccagctgaagaagctgctcttcctgttcctggaggacaatgagctggaggaggtgcccagccccctgcccaggagcctggagcagctgcagctggccaggaacaaggtgagccgcatcccccagggcaccttcagcaacctggagaacctgaccctgctggacctgcagaacaacaagctggtggacaatgccttccagagggacaccttcaagggcctgaagaacctgatgcagctgaacatggccaagaatgccctgaggaacatgccaccccggctgcctgccaacaccatgcagctgttcctggacaacaacagcattgagggcatccctgagaactacttcaacgtcatccccaaggtggccttcctgcggctgaaccacaacaagctgagtgatgagggcctgcccagccggggctttgatgtgagcagcatcctggacctgcagctgagccacaaccagctgaccaaggtgccccgcatcagcgcccacctgcagcacctgcacctggaccacaacaagatcaagtctgtgaatgtgtctgtcatctgccccagccccagcatgctgcctgctgagcgggacagcttctcctatggcccccacctgcgctacctgcggctggatggaaatgagatcaagccacccatccccatggccctgatgacctgcttccggctgctgcaggccgtcatcatctag

SEQ ID NO: 156915 - DNA, 897 bp, Artificial Sequence
  Description of Artificial Sequence: Synthetic coding sequence
atggaggagaagcagatcctgtgtgtgggcctggtggtgctggatgtgatcagcctggtggacaagtaccccaaggaggacagcgagatccgctgcctgagccagcgctggcagaggggcggcaatgccagcaacagctgcaccgtgctgagcctgctgggcgccccctgtgccttcatgggctccatggcccctggccacgtggccgacttcctggtggccgacttcagaagaagaggagtggatgtgtcccaggtggcctggcagagcaaaggagacacccccagcagctgctgcatcatcaacaacagcaatggaaacagaaccatcgtgctgcatgacaccagcctgcctgatgtgtctgccacagactttgagaaggtggacctgacccagttcaagtggatccacatcgagggcagaaatgccagcgagcaggtgaagatgctgcagagaattgatgcccacaacacccggcagcccccagagcagaagatccgggtgtctgtggaggtggagaagccccgggaggagctgttccagctgtttggctatggagatgtggtgtttgtgtccaaggatgtggccaagcacctgggcttccagagcgctgaggaggccctgcggggcctgtatggccgggtgaggaaaggagctgtgctggtgtgtgcctgggccgaggagggcgcagatgccctgggcccagatggcaagctgctgcacagtgatgccttccccccaccccgggtggtggacaccctgggcgctggggacaccttcaatgccagcgtcatcttcagcctgagccagggccgctctgtgcaggaggccctgcgcttcggctgccaggtggccggcaagaagtgtggcctgcagggctttgatggcatcgtgtag

SEQ ID NO: 156916 - DNA, 897 bp, Artificial Sequence
  Description of Artificial Sequence: Synthetic coding sequence
atggaggagaagcagatcctgtgtgtgggcctggtggtgctggatgtgatcagcctggtggacaagtaccccaaggaggacagcgagatccgctgcctgagccagcgctggcagaggggcggcaatgccagcaacagctgcaccgtgctgagcctgctgggcgccccctgtgccttcatgggctccatggcccctggccacgtggccgactttgtgctggatgacctgcggcgctacagcgtggacctgcgctacaccgtcttccagaccactggatctgtgcccatcgccaccgtcatcatcaatgaggccagcggcagcaggaccatcctgtactatgacaggagcctgcctgatgtgtctgccacagactttgagaaggtggacctgacccagttcaagtggatccacatcgagggcagaaatgccagcgagcaggtgaagatgctgcagagaattgatgcccacaacacccggcagcccccagagcagaagatccgggtgtctgtggaggtggagaagccccgggaggagctgttccagctgtttggctatggagatgtggtgtttgtgtccaaggatgtggccaagcacctgggcttccagagcgctgaggaggccctgcggggcctgtatggccgggtgaggaaaggagctgtgctggtgtgtgcctgggccgaggagggcgcagatgccctgggcccagatggcaagctgctgcacagtgatgccttccccccaccccgggtggtggacaccctgggcgctggggacaccttcaatgccagcgtcatcttcagcctgagccagggccgctctgtgcaggaggccctgcgcttcggctgccaggtggccggcaagaagtgtggcctgcagggctttgatggcatcgtgtag

SEQ ID NO: 156917 - DNA, 1041 bp, Artificial Sequence
  Description of Artificial Sequence: Synthetic coding sequence
atggaggagaagtacctgcctgagctgatggccgagaaggacagcctggaccccagcttcacccacgccctgcggctggtgaaccaggagattgagaagttccagaagggggagggcaaggatgaggagaagtacattgatgtggtgatcaacaagaacatgaagctgggccagaaggtgctgatccctgtgaagcagttccccaagttcaactttgtgggcaagctgctgggcccccggggcaacagcctgaagaggctgcaggaggagaccctgaccaagatgagcatcctgggcaagggctccatgagggacaaggccaaggaggaggagctgaggaagtctggagaggccaagtacttccacctgaatgatgacctgcacgtgctgattgaggtgtttgcccccccagctgaggcctatgccaggatgggccacgccctggaggagatcaagaagttcctgatcccagactacaatgatgagatccggcaggcccagctgcaggagctgacctacctgaatggaggctctgaaaatgctgatgtgcctgtggtgcggggcaagcccaccctgcggacccggggcgtgcctgccccagccatcacccggggccggggcggcgtgacagcccggcctgtgggcgtggtggtgccccggggcacccccaccccccggggcgtgctgagcacccggggccctgtgtcccggggccggggcctgctgaccccccgggcccggggcgtgccccccaccggctaccggcccccacctcctccacccacccaggagacctacggggagtatgactatgatgatggctatggaacagcctatgatgagcagagctatgacagctatgacaacagctacagcaccccagcccagagcggggctgactactatgactatggccacggcctgtctgaggagacctatgacagctatggccaggaggagtggaccaacagccgccacaaggcccccagcgccaggacagccaagggcgtgtacagagaccagccctacggccgctactag

SEQ ID NO: 156918 - DNA, 495 bp, Artificial Sequence
  Description of Artificial Sequence: Synthetic coding sequence
atggacatgggcaccagcgccctgagcaagaagccctggtggaccctgccccagaacttccacgcccccatggtgttccacatggaggaggaccaggaggagctgatctttggacatggagacacctacctgcgctgcatcgaggtgcacagccacaccctcatccagctggagagctggttcaccgccaccggccagaccagggtgacagtggtgggcccccaccgggcccggcagtggctgctgcacatgttctgctgcgtgggcagccaggacagctaccaccacgcccggggcctggagatgctggagcgggtgcgcagccagcccctgaccaatgatgacctggtgaccagcatctctgtgcccccctacaccggggacctgagcctggccccccgcatcagcggcaccgtgtgcctgtctgtgccccagcccagcccctaccaggtgattggctgcagcggcttccacctgagcagcctgtacccctag

SEQ ID NO: 156919 - DNA, 714 bp, Artificial Sequence
  Description of Artificial Sequence: Synthetic coding sequence
atgctgagcgccttccagaggctcttccgggtgctgtttgtgattgaaacagtgtctgaatatggagtgctgatcttcatctacggctggcccttcctgcagaccctggccatgctgctgattggaacagtgtccttccacctgtggatcagaagaaaccgggagaggaacagccgcagcggcaagacccgctgccgcagcaagaggtctgagcagagcatggacatgggcaccagcgccctgagcaagaagccctggtggaccctgccccagaacttccacgcccccatggtgttccacatggaggaggaccaggaggagctgatcttcggccacggggacacctacctgcgctgcatcgaggtgcacagccacaccctcatccagctggagagctggttcaccgccaccggccagaccagggtgacagtggtgggcccccaccgggcccggcagtggctgctgcacatgttctgctgcgtgggcagccaggacagctaccaccacgcccggggcctggagatgctggagcgggtgcgcagccagcccctgaccaatgatgacctggtgaccagcatctctgtgcccccctacacaggagacctgagcctggccccccgcatctctggaacagtgtgcctgtctgtgccccagcccagcccctaccaggtgattggctgcagcggcttccacctgagcagcctgtacccctag

SEQ ID NO: 156920 - DNA, 297 bp, Artificial Sequence
  Description of Artificial Sequence: Synthetic coding sequence
atggacatgggcaccagcgccctgagcaagaagccctggtggaccctgccccagaacttccacgcccccatggtgttccacatggaggaggaccaggaggagctgatctttggacatggagacacctacctgcgctgcatcgaggtgcacagccacaccctcatccagctggagagctggttcaccgccaccggccagaccagggtgacagtggtgggcccccaccgggcccggcagtggctgctgcacatgttctgctgcgtgggcagccaggacagctaccaccacgccaggtag

SEQ ID NO: 156921 - DNA, 2133 bp, Artificial Sequence
  Description of Artificial Sequence: Synthetic coding sequence
atgtctgactacagcactggaggccccccacctggccccccacctcctgctgggggcggcggcggggccggcggggccggcggcggccccccacctggccccccaggagctggggacagaggaggcggcggccctgggggcggcggccctgggggcggcagcgctgggggccccagccagcccccaggcggcggcggccctggcatcaggaaggatgcctttgctgatgctgtgcagagggcccggcagattgctgccaagattggaggagatgctgccaccaccgtgaacaacagcaccccagactttggatttggaggccagaagaggcagctggaggatggagaccagcctgagagcaagaagctggccagccagggcgacagcatcagcagccagctgggccccatccaccccccacccaggacctccatgacagaggagtacagagtgcctgatggcatggtgggcctcatcatcggccggggcggggagcagatcaacaagatccagcaggacagcggctgcaaggtgcagatcagcccagacagcggcggcctgcctgagaggtctgtgtccctgactggagcccctgagagcgtgcagaaggccaagatgatgctggatgacatcgtgtcccggggccggggcggccccccaggccagttccatgacaatgccaacggcggccagaatggcaccgtgcaggagatcatgatcccagctgggaaggccggcctggtgattggaaaaggaggagagaccatcaagcagctgcaggagagagctggggtgaagatgatcctgatccaggacggcagccagaacaccaacgtggacaagcccctgcgcatcatcggggacccctacaaggtgcagcaggcctgtgagatggtgatggacatcctgcgggagcgggaccagggcggctttggagacagaaatgaatatggcagcagaattggaggcggcattgatgtgcctgtgcccaggcacagcgtgggcgtggtgattggccgctctggagagatgatcaagaagatccagaatgatgctggggtgcgcatccagttcaagcaggatgatggcaccggccctgagaagatcgcccacatcatgggccccccagacagatgtgaacatgctgcccgcatcatcaatgacctgctgcagagcctgcggagcggccccccaggccccccaggcggccctggcatgcctcctgggggccggggccggggccggggccagggcaactggggccccccaggaggagagatgaccttcagcatccccacccacaagtgtggcctggtgattggaagaggaggagaaaatgtgaaggccatcaaccagcagacaggagcctttgtggagatcagccggcagctgcccccaaatggagaccccaacttcaagctgttcatcatccggggcagcccccagcagattgaccacgccaagcagctgattgaggagaagattgagggccccctgtgccctgtgggccctggccctgggggccctggccctgctggccccatgggccccttcaaccctggccccttcaaccagggccccccaggggcccctcctcatgctgggggccccccaccccaccagtacccaccccagggctggggcaacacctacccccagtggcagcccccagcccctcatgaccccagcaaggctgctgctgctgctgctgaccccaatgctgcctgggccgcctactacagccactactaccagcagcccccaggccctgtgcccggccctgccccagccccagctgcccccccagcccagggcgagcccccccagcccccacccaccggccagagcgactacaccaaggcctgggaggagtactacaagaagattggccagcagccccagcagcccggggccccaccccagcaggactacaccaaggcctgggaggagtactacaagaagcaggcccaggtggccaccggcggcggccctggggcccctcctggcttcctggcccccccaacagtgttccagcccctgctgagcagcgccctggcccagctgccccggccccggcccagccccctgcccggcctggtgtgctgcctcttcatctgcagcagaggagactag

SEQ ID NO: 156922 - DNA, 2136 bp, Artificial Sequence
  Description of Artificial Sequence: Synthetic coding sequence
atgtctgactacagcactggaggccccccacctggccccccacctcctgctgggggcggcggcggggccggcggggccggcggcggccccccacctggccccccaggagctggggacagaggaggcggcggccctgggggcggcggccctgggggcggcagcgctgggggccccagccagcccccaggcggcggcggccctggcatcaggaaggatgcctttgctgatgctgtgcagagggcccggcagattgctgccaagattggaggagatgctgccaccaccgtgaacaacagcaccccagactttggatttggaggccagaagaggcagctggaggatggagaccagcctgagagcaagaagctggccagccagggcgacagcatcagcagccagctgggccccatccaccccccacccaggacctccatgacagaggagtacagagtgcctgatggcatggtgggcctcatcatcggccggggcggggagcagatcaacaagatccagcaggacagcggctgcaaggtgcagatcagcccagacagcggcggcctgcctgagaggtctgtgtccctgactggagcccctgagagcgtgcagaaggccaagatgatgctggatgacatcgtgtcccggggccggggcggccccccaggccagttccatgacaatgccaacggcggccagaatggcaccgtgcaggagatcatgatcccagctgggaaggccggcctggtgattggaaaaggaggagagaccatcaagcagctgcaggagagagctggggtgaagatgatcctgatccaggacggcagccagaacaccaacgtggacaagcccctgcgcatcatcggggacccctacaaggtgcagcaggcctgtgagatggtgatggacatcctgcgggagcgggaccagggcggctttggagacagaaatgaatatggcagcagaattggaggcggcattgatgtgcctgtgcccaggcacagcgtgggcgtggtgattggccgctctggagagatgatcaagaagatccagaatgatgctggggtgcgcatccagttcaagcaggatgatggcaccggccctgagaagatcgcccacatcatgggccccccagacagatgtgaacatgctgcccgcatcatcaatgacctgctgcagagcctgcggagcggccccccaggccccccaggcggccctggcatgcctcctgggggccggggccggggccggggccagggcaactggggccccccaggaggagagatgaccttcagcatccccacccacaagtgtggcctggtgattggaagaggaggagaaaatgtgaaggccatcaaccagcagacaggagcctttgtggagatcagccggcagctgcccccaaatggagaccccaacttcaagctgttcatcatccggggcagcccccagcagattgaccacgccaagcagctgattgaggagaagattgagggccccctgtgccctgtgggccctggccctgggggccctggccctgctggccccatgggccccttcaaccctggccccttcaaccagggccccccaggggcccctcctcatgctgggggccccccaccccaccagtacccaccccagggctggggcaacacctacccccagtggcagcccccagcccctcatgaccccagcaaggctgctgctgctgctgctgaccccaatgctgcctgggccgcctactacagccactactaccagcagcccccaggccctgtgcccggccctgccccagccccagctgcccccccagcccagggcgagcccccccagcccccacccaccggccagagcgactacaccaaggcctgggaggagtactacaagaagattggccagcagccccagcagcccggggccccaccccagcaggactacaccaaggcctgggaggagtactacaagaagcaggcccaggtggccaccggcggcggccctggggcccctcctggcagccagcctgactacagcgctgcctgggccgagtactaccggcagcaggccgcctactacggccagaccccaggccctgggggcccccagcccccacccacccagcagggccagcagcaggcccagtag

SEQ ID NO: 156923 - DNA, 1095 bp, Artificial Sequence
  Description of Artificial Sequence: Synthetic coding sequence
atgtctgactacagccctgggggcggcagcgctgggggccccagccagcccccaggcggcggcggccctggcatcaggaaggatgcctttgctgatgctgtgcagagggcccggcagattgctgccaagattggaggagatgctgccaccaccgtgaacaacagcaccccagactttggatttggaggccagaagaggcagctggaggatggagaccagcctgagagcaagaagctggccagccagggcgacagcatcagcagccagctgggccccatccaccccccacccaggacctccatgacagaggagtacagagtgcctgatggcatggtgggcctcatcatcggccggggcggggagcagatcaacaagatccagcaggacagcggctgcaaggtgcagatcagcccagacagcggcggcctgcctgagaggtctgtgtccctgactggagcccctgagagcgtgcagaaggccaagatgatgctggatgacatcgtgtcccggggccggggcggccccccaggccagttccatgacaatgccaacggcggccagaatggcaccgtgcaggagatcatgatcccagctgggaaggccggcctggtgattggaaaaggaggagagaccatcaagcagctgcaggagagagctggggtgaagatgatcctgatccaggacggcagccagaacaccaacgtggacaagcccctgcgcatcatcggggacccctacaaggtgcagcaggcctgtgagatggtgatggacatcctgcgggagcgggaccagggcggctttggagacagaaatgaatatggcagcagaattggaggcggcattgatgtgcctgtgcccaggcacagcgtgggcgtggtgattggccgctctggagagatgatcaagaagatccagaatgatgctggggtgcgcatccagttcaagcaggatgatggcaccggccctgagaagatcgcccacatcatgggccccccagacagatgtgaacatgctgcccgcatcatcaatgaccccagcagcagcagcttcctgctgcccaccccaggccaccggcccagctgcctgtctggatag

SEQ ID NO: 156924 - DNA, 255 bp, Artificial Sequence
  Description of Artificial Sequence: Synthetic coding sequence
atggatgatgatgctgccccccgggtggagggcgtgcctgtggccgtgcacaagcacgccctgcatgatggcctgcggcaggtggccggccctggagctgctgctgcccacctgccccgctggcccccaccccagctggccgccagccggcgggaggccccacccctgagccagaggccccacaggacccagggcgccggcagccccccagagaccaatgagaagctgaccaacccccaggtgaaggagaagtag

SEQ ID NO: 156925 - DNA, 822 bp, Artificial Sequence
  Description of Artificial Sequence: Synthetic coding sequence
atgtccatgagccccaccgtcatcatcctggcctgcctgggcttcttcctggaccagagcgtgtgggcccacgtgggcggccaggacaagcccttctgcagcgcctggcccagcgctgtggtgccccagggcggccacgtgaccctgcgctgccactaccgccggggcttcaacatcttcaccctgtacaagaaggatggagtgcctgtgcctgagctgtacaaccgcatcttctggaacagcttcctgatcagccctgtgaccccagcccacgccggcacctaccgctgccggggcttccacccccacagccccacagagtggagcgcccccagcaaccccctggtgatcatggtgacaggcctgtatgagaagcccagcctgacagcccggcccggccccaccgtgcgggccggggagaatgtgaccctgagctgcagcagccagagcagctttgacatctaccacctgagccgggagggggaggcccacgagctgcggctgcctgctgtgcccagcatcaatggcaccttccaggccgacttccccctgggccctgccacccatggagagacctaccgctgcttcggcagcttccacggcagcccctatgagtggagcgaccccagcgaccccctgcctgtgtctgtgacaggcaaccccagcagctcctggcccagccccacagagcccagcttcaagacaggaattgcccggcacctgcatgctgtgatccgctacagcgtggccatcatcctcttcaccatcctgcccttcttcctgctgcaccgctggtgcagcaagaagaagatgctgctgtag

SEQ ID NO: 156926 - DNA, 1269 bp, Artificial Sequence
  Description of Artificial Sequence: Synthetic coding sequence
atgggcggccaggacaagcccttcctgagcgcctggcccagcgctgtggtgccccggggcggccacgtgaccctgcgctgccactaccgccaccgcttcaacaacttcatgctgtacaaggaggaccgcatccacatccccatcttccacggccgcatcttccaggagagcttcaacatgagccctgtgaccacagcccacgccggcaactacacctgccggggcagccacccccacagccccaccggctggagcgcccccagcaaccctgtggtgatcatggtgacaggcaaccacaggaagcccagcctgctggcccaccctggccccctggtgaagagcggggagagggtcatcctgcagtgctggagcgacatcatgtttgagcacttcttcctgcacaaggagggcatcagcaaggaccccagccggctggtgggccagatccatgatggagtgtccaaggccaacttcagcatcggccccatgatgctggccctggccggcacctaccgctgctacggctctgtgacccacaccccctaccagctgagcgcccccagcgaccccctggacatcgtggtgacaggcccctatgagaagcccagcctgagcgcccagcccggccccaaggtgcaggccggggagagcgtgaccctgagctgcagcagccgcagcagctatgacatgtaccacctgagccgggagggcggggcccacgagcggcggctgcctgctgtgaggaaggtgaacagaaccttccaggccgacttccccctgggccctgccacccatggaggcacctaccgctgcttcggcagcttccgccacagcccctatgagtggagcgaccccagcgaccccctgctggtgtctgtgacaggcaaccccagcagctcctggcccagccccacagagcccagcagcaagagcggcaaccccaggcacctgcacatcctgattggcacctctgtggtgatcatcctcttcatcctgctgctcttcttcctgctgcacctgtggtgcagcaacaagaagaatgctgctgtgatggaccaggagcccgccggcaacagaacagccaacagcgaggacagtgatgagcaggaccctgaggaggtgacctacgcccagctggaccactgtgtgttcacccagaggaagatcacccggcccagccagaggcccaagaccccacccacagacaccatcctgtacacagagctgcccaatgccaagcccaggagcaaggtggtgtcctgcccctag

SEQ ID NO: 156927 - DNA, 1050 bp, Artificial Sequence
  Description of Artificial Sequence: Synthetic coding sequence
atgagcctgatggtggtgtccatggcctgtgtgggcctcttcctggtgcagagagctggcccccacatgggcaaccacaggaagcccagcctgctggcccaccctggccccctggtgaagtctggagagagggtcatcctgcagtgctggagcgacatcatgtttgagcacttcttcctgcacaaggagggcatcagcaaggaccccagccggctggtgggccagatccatgatggagtgtccaaggccaacttcagcatcggccccatgatgctggccctggccggcacctaccgctgctacggctctgtgacccacaccccctaccagctgagcgcccccagcgaccccctggacatcgtggtgacaggcccctatgagaagcccagcctgagcgcccagcccggccccaaggtgcaggccggggagagcgtgaccctgagctgcagcagccgcagcagctatgacatgtaccacctgagccgggagggcggggcccatgaaagaaggctgcctgctgtgaggaaggtgaacagaaccttccaggccgacttccccctgggccctgccacccacggcggcacctaccgctgcttcggcagcttccgccacagcccctatgagtggagcgaccccagcgaccccctgctggtgtctgtgactggaaaccccagcagctcctggcccagccccacagagcccagcagcaagagcggcaaccccaggcacctgcacatcctgattggcacctctgtggtgatcatcctcttcatcctgctgctcttcttcctgctgcacctgtggtgcagcaacaagaagaatgctgctgtgatggaccaggagcctgctggcaacagaacagccaacagtgaagattctgatgagcaggaccctgaggaggtgacctacgcccagctggaccactgtgtgttcacccagaggaagatcacccggcccagccagaggcccaagaccccacccacagacaccatcctgtacacagagctgcccaatgccaagcccaggagcaaggtggtgtcctgcccctag

SEQ ID NO: 156928 - DNA, 1335 bp, Artificial Sequence
  Description of Artificial Sequence: Synthetic coding sequence
atgagcctgatggtggtgtccatggcctgtgtgggcctcttcctggtgcagagagctggcccccacatgggcggccaggacaagcccttcctgagcgcctggcccagcgctgtggtgccccggggcggccacgtgaccctgcgctgccactaccgccaccgcttcaacaacttcatgctgtacaaggaggaccgcatccacatccccatcttccacggccgcatcttccaggagagcttcaacatgagccctgtgaccacagcccacgccggcaactacacctgccggggcagccacccccacagccccaccggctggagcgcccccagcaaccctgtggtgatcatggtgacaggcaaccacaggaagcccagcctgctggcccaccctggccccctggtgaagagcggggagagggtcatcctgcagtgctggagcgacatcatgtttgagcacttcttcctgcacaaggagggcatcagcaaggaccccagccggctggtgggccagatccatgatggagtgtccaaggccaacttcagcatcggccccatgatgctggccctggccggcacctaccgctgctacggctctgtgacccacaccccctaccagctgagcgcccccagcgaccccctggacatcgtggtgacaggcccctatgagaagcccagcctgagcgcccagcccggccccaaggtgcaggccggggagagcgtgaccctgagctgcagcagccgcagcagctatgacatgtaccacctgagccgggagggcggggcccacgagcggcggctgcctgctgtgaggaaggtgaacagaaccttccaggccgacttccccctgggccctgccacccatggaggcacctaccgctgcttcggcagcttccgccacagcccctatgagtggagcgaccccagcgaccccctgctggtgtctgtgacaggcaaccccagcagctcctggcccagccccacagagcccagcagcaagagcggcaaccccaggcacctgcacatcctgattggcacctctgtggtgatcatcctcttcatcctgctgctcttcttcctgctgcacctgtggtgcagcaacaagaagaatgctgctgtgatggaccaggagcccgccggcaacagaacagccaacagcgaggacagtgatgagcaggaccctgaggaggtgacctacgcccagctggaccactgtgtgttcacccagaggaagatcacccggcccagccagaggcccaagaccccacccacagacaccatcctgtacacagagctgcccaatgccaagcccaggagcaaggtggtgtcctgcccctag

SEQ ID NO: 156929 - DNA, 1368 bp, Artificial Sequence
  Description of Artificial Sequence: Synthetic coding sequence
atgagcctgatggtggtgtccatggcctgtgtgggcctcttcctggtgcagagagctggcccccacatgggcggccaggacaagcccttcctgagcgcctggcccagcgctgtggtgccccggggcggccacgtgaccctgcgctgccactaccgccaccgcttcaacaacttcatgctgtacaaggaggaccgcatccacatccccatcttccacggccgcatcttccaggagagcttcaacatgagccctgtgaccacagcccacgccggcaactacacctgccggggcagccacccccacagccccaccggctggagcgcccccagcaaccctgtggtgatcatggtgacaggcaaccacaggaagcccagcctgctggcccaccctggccccctggtgaagagcggggagagggtcatcctgcagtgctggagcgacatcatgtttgagcacttcttcctgcacaaggagggcatcagcaaggaccccagccggctggtgggccagatccatgatggagtgtccaaggccaacttcagcatcggccccatgatgctggccctggccggcacctaccgctgctacggctctgtgacccacaccccctaccagctgagcgcccccagcgaccccctggacatcgtggtgacaggcccctatgagaagcccagcctgagcgcccagcccggccccaaggtgcaggccggggagagcgtgaccctgagctgcagcagccgcagcagctatgacatgtaccacctgagccgggagggcggggcccacgagcggcggctgcctgctgtgaggaaggtgaacagaaccttccaggccgacttccccctgggccctgccacccatggaggcacctaccgctgcttcggcagcttccgccacagcccctatgagtggagcgaccccagcgaccccctgctggtgtctgtgacaggcaaccccagcagctcctggcccagccccacagagcccagcagcaagagcggcatctgccgccacctgcacgtgctgattggcacctctgtggtgatcttcctgttcatcctgctgctcttcttcctgctgtaccgctggtgcagcaacaagaagaatgctgctgtgatggaccaggagcctgctggggacagaacagtgaaccggcaggacagtgatgagcaggacccccaggaggtgacctacgcccagctggaccactgtgtgttcatccagaggaagatcagccggcccagccagaggcccaagacccccctgacagacacctctgtgtacacagagctgcccaatgctgagcccaggagcaaggtggtgtcctgcccccgggccccccagagcggcctggagggcgtcttctag

SEQ ID NO: 156930 - DNA, 1335 bp, Artificial Sequence; identical to SEQ ID NO: 156928
  Description of Artificial Sequence: Synthetic coding sequence

SEQ ID NO: 156931 - DNA, 1284 bp, Artificial Sequence
  Description of Artificial Sequence: Synthetic coding sequence
atgagcctgatggtggtgtccatggcctgtgtgggcctcttcctggtgcagagagctggcccccacatgggcggccaggacaagcccttcctgagcgcctggcccagcgctgtggtgccccggggcggccacgtgaccctgcgctgccactaccgccaccgcttcaacaacttcatgctgtacaaggaggaccgcatccacatccccatcttccacggccgcatcttccaggagagcttcaacatgagccctgtgaccacagcccacgccggcaactacacctgccggggcagccacccccacagccccaccggctggagcgcccccagcaaccctgtggtgatcatggtgacaggcaaccacaggaagcccagcctgctggcccaccctggccccctggtgaagagcggggagagggtcatcctgcagtgctggagcgacatcatgtttgagcacttcttcctgcacaaggagggcatcagcaaggaccccagccggctggtgggccagatccatgatggagtgtccaaggccaacttcagcatcggccccatgatgctggccctggccggcacctaccgctgctacggctctgtgacccacaccccctaccagctgagcgcccccagcgaccccctggacatcgtggtgacaggcccctatgagaagcccagcctgagcgcccagcccggccccaaggtgcaggccggggagagcgtgaccctgagctgcagcagccgcagcagctatgacatgtaccacctgagccgggagggcggggcccacgagcggcggctgcctgctgtgaggaaggtgaacagaaccttccaggccgacttccccctgggccctgccacccatggaggcacctaccgctgcttcggcagcttccgccacagcccctatgagtggagcgaccccagcgaccccctgctggtgtctgtgacaggcaaccccaggcacctgcacatcctgattggcacctctgtggtgatcatcctcttcatcctgctgctcttcttcctgctgcacctgtggtgcagcaacaagaagaatgctgctgtgatggaccaggagcctgctggcaacagaacagccaacagtgaagattctgatgagcaggaccctgaggaggtgacctacgcccagctggaccactgtgtgttcacccagaggaagatcacccggcccagccagaggcccaagaccccacccacagacaccatcctgtacacagagctgcccaatgccaagcccaggagcaaggtggtgtcctgcccctag

SEQ ID NO: 156932 - DNA, 1368 bp, Artificial Sequence
  Description of Artificial Sequence: Synthetic coding sequence
atgagcctgactgtggtgtccatggcctgtgtgggcttcttcctgctgcagggcgcctggcccctgatgggcggccaggacaagcccttcctgagcgcccggcccagcacagtggtgccccggggcggccacgtggccctgcagtgccactaccgccggggcttcaacaacttcatgctgtacaaggaggacaggagccacgtgcccatcttccacggccgcatcttccaggagagcttcatcatgggccctgtgaccccagcccacgccggcacctaccgctgccggggcagccggccccacagcctgaccggctggagcgcccccagcaaccccctggtgatcatggtgacaggcaaccacaggaagcccagcctgctggcccaccctggccccctgctgaagagcggggagaccgtcatcctgcagtgctggagcgatgtgatgtttgagcacttcttcctgcaccgggagggcatcagcgaggaccccagccggctggtgggccagatccatgatggagtgtccaaggccaacttcagcatcggccccctgatgcctgtgctggccggcacctaccgctgctacggctctgtgccccacagcccctaccagctgagcgcccccagcgaccccctggacatcgtcatcaccggcctgtatgagaagcccagcctgagcgcccagcccggccccaccgtgcaggccggggagaatgtgaccctgagctgcagctcctggagcagctatgacatctaccacctgagccgggagggggaggcccacgagcggcggctgcgggctgtgcccaaggtgaacagaaccttccaggccgacttccccctgggccctgccacccatggaggcacctaccgctgcttcggcagcttccgggccctgccctgtgtgtggagcaacagcagtgaccccctgctggtgtctgtgacaggcaaccccagcagctcctggcccagccccacagagcccagcagcaagagcggcatctgccgccacctgcacgtgctgattggcacctctgtggtgatcttcctgttcatcctgctgctcttcttcctgctgtaccgctggtgcagcaacaagaagaatgctgctgtgatggaccaggagcctgctggggacagaacagtgaaccggcaggacagtgatgagcaggacccccaggaggtgacctacgcccagctggaccactgtgtgttcatccagaggaagatcagccggcccagccagaggcccaagacccccctgacagacacctctgtgtacacagagctgcccaatgctgagcccaggagcaaggtggtgtcctgcccccgggccccccagagcggcctggagggcgtcttctag

SEQ ID NO: 156933 - DNA, 1047 bp, Artificial Sequence
  Description of Artificial Sequence: Synthetic coding sequence
atgagcctgatggtggtgtccatggcctgtgtgggcttcttcctgctgcagggcgcctggccccatgagggcgtgcacaggaagcccagcctgctggcccaccctggccgcctggtgaagtctgaggagaccgtcatcctgcagtgctggagcgatgtgcgctttgagcacttcctgctgcaccgggagggcaagttcaaggacaccctgcacctgattggagagcaccatgatggagtgtccaaggccaacttcagcatcggccccatgatgcaggacctggccggcacctaccgctgctacggctctgtgacccacagcccctaccagctgagcgcccccagcgaccccctggacatcgtcatcaccggcctgtatgagaagcccagcctgagcgcccagcccggccccaccgtgctggccggggagagcgtgaccctgagctgcagcagccgcagcagctatgacatgtaccacctgagccgggagggggaggcccacgagtgccgcttctctgctggccccaaggtgaatggcaccttccaggccgacttccccctgggccctgccacccacggcggcacctaccgctgcttcggcagcttccgggacagcccctatgagtggagcaacagcagtgaccccctgctggtgtctgtgactggaaaccccagcaacagctggcccagccccacagagcccagcagcaagacaggcaaccccaggcacctgcacatcctgattggcacctctgtggtgatcatcctcttcatcctgctcttcttcctgctgcaccgctggtgcagcaacaagaagaatgctgctgtgatggaccaggagagcgctggcaacagaacagccaacagcgaggacagtgatgagcaggacccccaggaggtgacctacacccagctgaaccactgtgtgttcacccagaggaagatcacccggcccagccagaggcccaagaccccacccacagacatcatcgtgtacacagagctgcccaatgctgagagccgcagcaaggtggtgtcctgcccctag

SEQ ID NO: 156934 - DNA, 1128 bp, Artificial Sequence
  Description of Artificial Sequence: Synthetic coding sequence
atgagcctgatggtggtgtccatggcctgtgtgggcttcttcctgctgcagggcgcctggccccatgagggcggccaggacaagcccctgctgagcgcctggcccagcgctgtggtgccccggggcggccacgtgaccctgctgtgccgcagccggctgggcttcaccatcttcagcctgtacaaggaggatggagtgcctgtgcctgagctgtacaacaagatcttctggaagagcatcctgatgggccctgtgaccccagcccacgccggcacctaccgctgccggggcagccaccccaggagccccatcgagtggagcgcccccagcaaccccctggtgattgtggtgacaggcctgtttgggaagcccagcctgagcgcccagcccggccccaccgtgaggactggagaaaatgtgaccctgagctgcagcagccgcagcagctttgacatgtaccacctgagccgggagggccgggcccacgagccccggctgcctgctgtgcccagcgtgaatggcaccttccaggccgacttccccctgggccctgccacccatggaggcacctacacctgcttcggcagcctgcatgacagcccctatgagtggagcgaccccagcgaccccctgctggtgtctgtgacaggcaacagcagcagcagcagcagcagccccacagagcccagcagcaagacaggcatccgccgccacctgcacatcctgattggcacctctgtggccatcatcctcttcatcatcctcttcttcttcctgctgcactgctgctgcagcaacaagaagaatgctgctgtgatggaccaggagcctgctggggacagaacagtgaaccgggaggacagtgatgaccaggacccccaggaggtgacctacgcccagctggaccactgtgtgttcacccagaccaagatcaccagccccagccagaggcccaagaccccacccacagacaccaccatgtacatggagctgcccaatgccaagcccaggagcctgagccctgcccacaagcaccacagccaggccctgcggggcagcagccgggagaccacagccctgagccagaacagagtggccagcagccacgtgcctgctgctggcatctag

SEQ ID NO: 156935 - DNA, 1128 bp, Artificial Sequence
  Description of Artificial Sequence: Synthetic coding sequence
atgagcctgatggtgatctccatggcctgtgtgggcttcttcctgctgcagggcgcctggacccatgagggcggccaggacaagcccctgctgagcgcctggcccagcgctgtggtgccccggggcggccacgtgaccctgctgtgccgcagccggctgggcttcaccatcttcagcctgtacaaggaggatggagtgcctgtgcctgagctgtacaacaagatcttctggaagagcatcctgatgggccctgtgaccccagcccacgccggcacctaccgctgccggggcagccaccccaggagccccatcgagtggagcgcccccagcaaccccctggtgattgtggtgacaggcctgtttgggaagcccagcctgagcgcccagcccggccccaccgtgaggactggagaaaatgtgaccctgagctgcagcagccgcagcagctttgacatgtaccacctgagccgggagggccgggcccacgagccccggctgcctgctgtgcccagcgtgaatggcaccttccaggccgacttccccctgggccctgccacccatggaggcacctacacctgcttcggcagcctgcatgacagcccctatgagtggagcgaccccagcgaccccctgctggtgtctgtgacaggcaacagcagcagcagcagcagcagccccacagagcccagcagcaagacaggcatccgccgccacctgcacatcctgattggcacctctgtggccatcatcctcttcatcatcctcttcttcttcctgctgcactgctgctgcagcaacaagaagaatgctgctgtgatggaccaggagcctgctggggacagaacagtgaaccgggaggacagtgatgaccaggacccccaggaggtgacctacgcccagctggaccactgtgtgttcacccagaccaagatcaccagccccagccagaggcccaagaccccacccacagacaccaccatgtacatggagctgcccaatgccaagcccaggagcctgagccctgcccacaagcaccacagccaggccctgcggggcagcagccgggagaccacagccctgagccagaacagagtggccagcagccacgtgcctgctgctggcatctag

SEQ ID NO: 156936 - DNA, 1164 bp, Artificial Sequence
  Description of Artificial Sequence: Synthetic coding sequence
atgagcctgatggtggtgtccatggcctgtgtgggcctcttcctggtgcagagagctggcccccacatgggcggccaggacaagcccttcctgagcgcctggcccagcgctgtggtgccccggggcggccacgtgaccctgcgctgccactaccgccaccgcttcaacaacttcatgctgtacaaggaggaccgcatccacgtgcccatcttccacggccgcatcttccaggagggcttcaacatgagccctgtgaccacagcccacgccggcaactacacctgccggggcagccacccccacagccccaccggctggagcgcccccagcaaccccatggtgatcatggtgacaggcaaccacaggaagcccagcctgctggcccaccctggccccctggtgaagagcggggagagggtcatcctgcagtgctggagcgacatcatgtttgagcacttcttcctgcacaaggagtggatcagcaaggaccccagccggctggtgggccagatccatgatggagtgtccaaggccaacttcagcatcggctccatgatgagggccctggccggcacctaccgctgctacggctctgtgacccacaccccctaccagctgagcgcccccagcgaccccctggacatcgtggtgacaggcctgtatgagaagcccagcctgagcgcccagcccggccccaaggtgcaggccggggagagcgtgaccctgagctgcagcagccgcagcagctatgacatgtaccacctgagccgggagggcggggcccacgagcggcggctgcctgctgtgaggaaggtgaacagaaccttccaggccgacttccccctgggccctgccacccatggaggcacctaccgctgcttcggcagcttccgccacagcccctatgagtggagcgaccccagcgaccccctgctggtgtctgtgacaggcaaccccagcagctcctggcccagccccacagagcccagcagcaagagcggcaacctgcggcacctgcacatcctgattggcacctctgtggtgaagatccccttcaccatcctgctcttcttcctgctgcaccgctggtgcagcaacaagaagaatgctgctgtgatggaccaggagcccgccggcaacagaagtgagcagaggggcttctag

SEQ ID NO: 156937 - DNA, 1149 bp, Artificial Sequence
  Description of Artificial Sequence: Synthetic coding sequence
atgctgctgatggtggtgtccatggcctgtgtgggcctcttcctggtgcagagagctggcccccacatgggcggccaggacaagcccttcctgagcgcctggcccagcgctgtggtgccccggggcggccacgtgaccctgcgctgccactaccgccaccgcttcaacaacttcatgctgtacaaggaggaccgcatccacgtgcccatcttccacggccgcatcttccaggagggcttcaacatgagccctgtgaccacagcccacgccggcaactacacctgccggggcagccacccccacagccccaccggctggagcgcccccagcaaccccatggtgatcatggtgacaggcaaccacaggaagcccagcctgctggcccaccctggccccctggtgaagagcggggagagggtcatcctgcagtgctggagcgacatcatgtttgagcacttcttcctgcacaaggagtggatcagcaaggaccccagccggctggtgggccagatccatgatggagtgtccaaggccaacttcagcatcggctccatgatgagggccctggccggcacctaccgctgctacggctctgtgacccacaccccctaccagctgagcgcccccagcgaccccctggacatcgtggtgacaggcctgtatgagaagcccagcctgagcgcccagcccggccccaaggtgcaggccggggagagcgtgaccctgagctgcagcagccgcagcagctatgacatgtaccacctgagccgggagggcggggcccacgagcggcggctgcctgctgtgaggaaggtgaacagaaccttccaggccgacttccccctgggccctgccacccatggaggcacctaccgctgcttcggcagcttccgccacagcccctatgagtggagcgaccccagcgaccccctgctggtgtctgtgacaggcaaccccagcagctcctggcccagccccacagagcccagcagcaagagcggcaacctgcggcacctgcacatcctgattggcacctctgtggtgaagatccccttcaccatcctgctcttcttcctgctgcaccgctggtgcagcaacaagaagaagtgctgctgcaatggcccccgggcctgccgggagcagaagtag

SEQ ID NO: 156938 - DNA, 1194 bp, Artificial Sequence
  Description of Artificial Sequence: Synthetic coding sequence
atgagcctgatggtggtgtccatggcctgtgtgggcttcttcctggaccagagcgtgtgggcccacgtgggcggccaggacaagcccttctgcagcgcctggcccagcgctgtggtgccccagggcggccacgtgaccctgcgctgccactgccggcggggcttcaacatcttcaccctgtacaagaaggatggagtgcctgtgcctgagctgtacaaccgcatcttctggaacagcttcctgatcagccctgtgaccccagcccacgccggcacctaccgctgccggggcttccacccccacagccccacagagtggagcgcccccagcaaccccctggtgatcatggtgacaggcctgtatgagaagcccagcctgacagcccggcccggccccaccgtgcgggccggggagaatgtgaccctgagctgcagcagccagagcagctttgacatctaccacctgagccgggagggggaggcccacgagctgcggctgcctgctgtgcccagcatcaatggcaccttccaggccgacttccccctgggccctgccacccatggagagacctaccgctgcttcggcagcttccacggcagcccctatgagtggagcgaccccagcgaccccctgcctgtgtctgtgacaggcaaccccagcagctcctggcccagccccacagagcccagcttcaagacaggaattgcccggcacctgcatgctgtgatccgctacagcgtggccatcatcctcttcaccatcctgcccttcttcctgctgcaccgctggtgcagcaagaagaaggtgtccctgaccaagcagaggccagaaaattctggcccctgtgccgaggccggctgggagcacgcagatgctgctgtgatgaaccaggagcccgccggccacaggacagtgaaccgggaggacagtgatgagcaggacccccaggaggtgacctacgcccagctggaccactgcatcttcacccagaggaagatcaccggccccagccagaggagcaagaggcccagcacagacacctctgtgtgcatcgagctgcccaatgctgagccccgggccctgagccctgcccacgagcaccacagccaggccctgatgggcagcagccgggagaccacagccctgagccagacccagctggccagcagcaatgtgcctgctgctggcatctag

SEQ ID NO: 156939 - DNA, 1029 bp, Artificial Sequence
  Description of Artificial Sequence: Synthetic coding sequence
atgtccatgagccccaccgtcatcatcctggcctgcctgggcttcttcctggaccagagcgtgtgggcccacgtgggcggccaggacaagcccttctgcagcgcctggcccagcgctgtggtgccccagggcggccacgtgaccctgcgctgccactgccggcggggcttcaacatcttcaccctgtacaagaaggatggagtgcctgtgcctgagctgtacaaccgcatcttctggaacagcttcctgatcagccctgtgaccccagcccacgccggcacctaccgctgccggggcttccacccccacagccccacagagtggagcgcccccagcaaccccctggtgatcatggtgacaggcctgtatgagaagcccagcctgacagcccggcccggccccaccgtgcgggccggggagaatgtgaccctgagctgcagcagccagagcagctttgacatctaccacctgagccgggagggggaggcccacgagctgcggctgcctgctgtgcccagcatcaatggcaccttccaggccgacttccccctgggccctgccacccatggagagacctaccgctgcttcggcagcttccacggcagcccctatgagtggagcgaccccagcgaccccctgcctgtgtctgtgacaggcaaccccagcagctcctggcccagccccacagagcccagcttcaagacagatgctgctgtgatgaaccaggagcctgctggccacaggacagtgaacagagaagattctgatgagcaggacccccaggaggtgacctacgcccagctggaccactgcatcttcacccagaggaagatcaccggccccagccagaggagcaagaggcccagcacagacacctctgtgtgcatcgagctgcccaatgctgagccccgggccctgagccctgcccacgagcaccacagccaggccctgatgggcagcagccgggagaccacagccctgagccagacccagctggccagcagcaatgtgcctgctgctggcatctag

SEQ ID NO: 156940 - DNA, 1083 bp, Artificial Sequence
  Description of Artificial Sequence: Synthetic coding sequence
atgtccatgagccccaccgtcatcatcctggcctgcctgggcttcttcctggaccagagcgtgtgggcccacgtgggcggccaggacaagcccttctgcagcgcctggcccagcgctgtggtgccccagggcggccacgtgaccctgcgctgccactgccggcggggcttcaacatcttcaccctgtacaagaaggatggagtgcctgtgcctgagctgtacaaccgcatcttctggaacagcttcctgatcagccctgtgaccccagcccacgccggcacctaccgctgccggggcttccacccccacagccccacagagtggagcgcccccagcaaccccctggtgatcatggtgacaggcctgtatgagaagcccagcctgacagcccggcccggccccaccgtgcgggccggggagaatgtgaccctgagctgcagcagccagagcagctttgacatctaccacctgagccgggagggggaggcccacgagctgcggctgcctgctgtgcccagcatcaatggcaccttccaggccgacttccccctgggccctgccacccatggagagacctaccgctgcttcggcagcttccacggcagcccctatgagtggagcgaccccagcgaccccctgcctgtgtctgtgacaggcatcgcccggcacctgcacgccgtcatccgctacagcgtggccatcatcctcttcaccatcctgcccttcttcctgctgcaccgctggtgcagcaagaagaagaatgctgctgtgatgaaccaggagcctgctggccacaggacagtgaacagagaagattctgatgagcaggacccccaggaggtgacctacgcccagctggaccactgcatcttcacccagaggaagatcaccggccccagccagaggagcaagaggcccagcacagacacctctgtgtgcatcgagctgcccaatgctgagccccgggccctgagccctgcccacgagcaccacagccaggccctgatgggcagcagccgggagaccacagccctgagccagacccagctggccagcagcaatgtgcctgctgctggcatctag

SEQ ID NO: 156941 - DNA, 1134 bp, Artificial Sequence
  Description of Artificial Sequence: Synthetic coding sequence
atgtccatgagccccaccgtcatcatcctggcctgcctgggcttcttcctggaccagagcgtgtgggcccacgtgggcggccaggacaagcccttctgcagcgcctggcccagcgctgtggtgccccagggcggccacgtgaccctgcgctgccactgccggcggggcttcaacatcttcaccctgtacaagaaggatggagtgcctgtgcctgagctgtacaaccgcatcttctggaacagcttcctgatcagccctgtgaccccagcccacgccggcacctaccgctgccggggcttccacccccacagccccacagagtggagcgcccccagcaaccccctggtgatcatggtgacaggcctgtatgagaagcccagcctgacagcccggcccggccccaccgtgcgggccggggagaatgtgaccctgagctgcagcagccagagcagctttgacatctaccacctgagccgggagggggaggcccacgagctgcggctgcctgctgtgcccagcatcaatggcaccttccaggccgacttccccctgggccctgccacccatggagagacctaccgctgcttcggcagcttccacggcagcccctatgagtggagcgaccccagcgaccccctgcctgtgtctgtgacaggcaaccccagcagctcctggcccagccccacagagcccagcttcaagacaggaattgcccggcacctgcatgctgtgatccgctacagcgtggccatcatcctcttcaccatcctgcccttcttcctgctgcaccgctggtgcagcaagaagaagaatgctgctgtgatgaaccaggagcccgccggccacaggacagtgaaccgggaggacagtgatgagcaggacccccaggaggtgacctacgcccagctggaccactgcatcttcacccagaggaagatcaccggccccagccagaggagcaagaggcccagcacagacacctctgtgtgcatcgagctgcccaatgctgagccccgggccctgagccctgcccacgagcaccacagccaggccctgatgggcagcagccgggagaccacagccctgagccagacccagctggccagcagcaatgtgcctgctgctggcatctag

SEQ ID NO: 156942 - DNA, 1233 bp, Artificial Sequence
  Description of Artificial Sequence: Synthetic coding sequence
atgagcctgatggtggtgtccatggcctgtgtgggcttcttcctgctggagggcccctggccccacgtgggcggccaggacaagcccttcctgagcgcctggccaggcaccgtggtgtctgagggccagcacgtgaccctgcagtgccgcagccggctgggcttcaatgagttcagcctgagcaaagaagatggcatgcctgtgcctgagctgtacaaccgcatcttcagaaattccttcctgatgggccctgtgaccccagcccacgccggcacctaccgctgctgcagcagccacccccacagccccaccggctggagcgcccccagcaaccctgtggtgatcatggtgactggagtgcacaggaagcccagcctgctggcccaccctggccccctggtgaagagcggggagaccgtcatcctgcagtgctggagcgatgtgcgctttgagcgcttcctgctgcaccgggagggcatcacagaggaccccctgcggctcatcggccagctgcatgatgctggcagccaggtgaactacagcatgggccccatgaccccagccctggccggcacctaccgctgcttcggctctgtgacccacctgccctatgagctgagcgcccccagcgaccccctggacatcgtggtggtgggcctgtatggcaagcccagcctgagcgcccagcccggccccaccgtgcaggccggggagaatgtgaccctgagctgcagcagccgcagcctgtttgacatctaccacctgagccgggaggccgaggccggggagctgcggctgacagctgtgctgcgggtgaatggcaccttccaggccaacttccccctgggccctgtgacccatggaggcaactaccgctgcttcggcagcttccgggccctgccccacgcctggagcgaccccagcgaccccctgcctgtgtctgtgacaggcaacagccgctacctgcacgccctgattggcacctctgtggtgatcatcccctttgccatcctgctcttcttcctgctgcaccgctggtgtgccaacaagaagaatgctgtggtgatggaccaggagcctgctggcaacagaacagtgaacagagaagattctgatgagcaggacccccaggaggtgacctacgcccagctgaaccactgtgtgttcacccagaggaagatcacccggcccagccagaggcccaagaccccacccacagacacctctgtgtag

SEQ ID NO: 156943 - DNA, 1047 bp, Artificial Sequence
  Description of Artificial Sequence: Synthetic coding sequence
atgagcctgctggtggtgtccatggcctgtgtgggcttcttcctgctgcagggcgcctggccccatgagggcgtgcacaggaagcccagcctgctggcccaccctggccgcctggtgaagtctgaggagaccgtcatcctgcagtgctggagcgatgtgatgtttgagcacttcctgctgcaccgggagggcatgtttaatgacaccctgcggctgattggagagcaccatgatggagtgtccaaggccaacttcagcatcagcaggatgacccaggacctggccggcacctaccgctgctacggctctgtgacccacagcccctaccaggtgtctgcccccagcgaccccctggacatcgtcatcatcggcctgtatgagaagcccagcctgagcgcccagctgggccccaccgtgctggccggagaaaatgtgaccctgagctgcagcagccgcagcagctatgacatgtaccacctgagccgggagggggaggcccatgaaagaaggctgcctgctggccccaaggtgaatggcaccttccaggccgacttccccctgggccctgccacccacggcggcacctaccgctgcttcggcagcttccatgacagcccctatgagtggagcaagagcagtgaccccctgctggtgtctgtgactggaaaccccagcaacagctggcccagccccacagagcccagcagcaagacaggcaaccccaggcacctgcacatcctgattggcacctctgtggtgatcatcctcttcatcctgctcttcttcctgctgcaccgctggtgcagcaacaagaagaatgctgctgtgatggaccaggagagcgctggcaacagaacagccaacagcgaggacagtgatgagcaggacccccaggaggtgacctacacccagctgaaccactgtgtgttcacccagaggaagatcacccggcccagccagaggcccaagaccccacccacagacatcatcgtgtacacagagctgcccaatgctgagagccgcagcaaggtggtgtcctgcccctag

SEQ ID NO: 156944 - DNA, 1026 bp, Artificial Sequence
  Description of Artificial Sequence: Synthetic coding sequence
atgagcctgatggtggtgtccatggtgtgtgtgggcttcttcctgctgcagggcgcctggccccatgagggcgtgcacaggaagcccagcctgctggcccaccctggccccctggtgaagtctgaggagaccgtcatcctgcagtgctggagcgatgtgcgcttccagcacttcctgctgcaccgggagggcaagttcaaggacaccctgcacctgattggagagcaccatgatggagtgtccaaggccaacttcagcatcggccccatgatgcaggacctggccggcacctaccgctgctacggctctgtgacccacagcccctaccagctgagcgcccccagcgaccccctggacatcgtcatcaccggcctgtatgagaagcccagcctgagcgcccagcccggccccaccgtgctggccggggagagcgtgaccctgagctgcagcagccgcagcagctatgacatgtaccacctgagccgggagggggaggcccatgaaagacgcttctctgctggccccaaggtgaatggcaccttccaggccgacttccccctgggccctgccacccacggcggcacctaccgctgcttcggcagcttccgggacagcccctatgagtggagcaacagcagtgaccccctgctggtgtctgtgactggaaaccccagcaacagctggcccagccccacagagcccagcagcgagaccggcaaccccaggcacctgcacgtgctgattggcacctctgtggtgatcatcctcttcatcctgctgctcttcttcctgctgcaccgctggtgctgcaacaagaagaatgctgtggtgatggaccaggagcctgctggcaacagaacagtgaacagagaagattctgatgagcaggacccccaggaggtgacctacgcccagctgaaccactgtgtgttcacccagaggaagatcacccggcccagccagaggcccaagaccccacccacagacatcatcgtgtacacagagctgcccaatgctgagccctag

SEQ ID NO: 156945 - DNA, 1047 bp, Artificial Sequence
  Description of Artificial Sequence: Synthetic coding sequence
atgagcctgatggtggtgtccatggtgtgtgtgggcttcttcctgctgcagggcgcctggccccatgagggcgtgcacaggaagcccagcctgctggcccaccctggccccctggtgaagtctgaggagaccgtcatcctgcagtgctggagcgatgtgcgcttccagcacttcctgctgcaccgggagggcaagttcaaggacaccctgcacctgattggagagcaccatgatggagtgtccaaggccaacttcagcatcggccccatgatgcaggacctggccggcacctaccgctgctacggctctgtgacccacagcccctaccagctgagcgcccccagcgaccccctggacatcgtcatcaccggcctgtatgagaagcccagcctgagcgcccagcccggccccaccgtgctggccggggagagcgtgaccctgagctgcagcagccgcagcagctatgacatgtaccacctgagccgggagggggaggcccatgaaagacgcttctctgctggccccaaggtgaatggcaccttccaggccgacttccccctgggccctgccacccacggcggcacctaccgctgcttcggcagcttccgggacagcccctatgagtggagcaacagcagtgaccccctgctggtgtctgtgactggaaaccccagcaacagctggcccagccccacagagcccagcagcaagacaggcaaccccaggcacctgcacatcctgattggcacctctgtggtgatcatcctcttcatcctgctcttcttcctgctgcaccgctggtgcagcaacaagaagaatgctgctgtgatggaccaggagagcgctggcaacagaacagccaacagcgaggacagtgatgagcaggacccccaggaggtgacctacacccagctgaaccactgtgtgttcacccagaggaagatcacccggcccagccagaggcccaagaccccacccacagacatcatcgtgtacacagagctgcccaatgctgagagccgcagcaaggtggtgtcctgcccctag

SEQ ID NO: 156946 - DNA, 1029 bp, Artificial Sequence
  Description of Artificial Sequence: Synthetic coding sequence
atgtccatgagccccaccgtcatcatcctggcctgcctgggcttcttcctggaccagagcgtgtgggcccacgtgggcggccaggacaagcccttctgcagcgcctggcccagcgctgtggtgccccagggcggccacgtgaccctgcgctgccactaccgccggggcttcaacatcttcaccctgtacaagaaggatggagtgcctgtgcctgagctgtacaaccgcatcttctggaacagcttcctgatcagccctgtgaccccagcccacgccggcacctaccgctgccggggcttccacccccacagccccacagagtggagcgcccccagcaaccccctggtgatcatggtgacaggcctgtatgagaagcccagcctgacagcccggcccggccccaccgtgcgggccggggagaatgtgaccctgagctgcagcagccagagcagctttgacatctaccacctgagccgggagggggaggcccacgagctgcggctgcctgctgtgcccagcatcaatggcaccttccaggccgacttccccctgggccctgccacccatggagagacctaccgctgcttcggcagcttccacggcagcccctatgagtggagcgaccccagcgaccccctgcctgtgtctgtgacaggcaaccccagcagctcctggcccagccccacagagcccagcttcaagacagatgctgctgtgatgaaccaggagcctgctggccacaggacagtgaacagagaagattctgatgagcaggacccccaggaggtgacctacgcccagctggaccactgcatcttcacccagaggaagatcaccggccccagccagaggagcaagaggcccagcacagacacctctgtgtgcatcgagctgcccaatgctgagccccgggccctgagccctgcccacgagcaccacagccaggccctgatgggcagcagccgggagaccacagccctgagccagacccagctggccagcagcaatgtgcctgctgctggcatctag

SEQ ID NO: 156947 - DNA, 978 bp, Artificial Sequence
  Description of Artificial Sequence: Synthetic coding sequence
atgtccatgagccccaccgtcatcatcctggcctgcctgggcttcttcctggaccagagcgtgtgggcccacgtgggcggccaggacaagcccttctgcagcgcctggcccagcgctgtggtgccccagggcggccacgtgaccctgcgctgccactaccgccggggcttcaacatcttcaccctgtacaagaaggatggagtgcctgtgcctgagctgtacaaccgcatcttctggaacagcttcctgatcagccctgtgaccccagcccacgccggcacctaccgctgccggggcttccacccccacagccccacagagtggagcgcccccagcaaccccctggtgatcatggtgacaggcctgtatgagaagcccagcctgacagcccggcccggccccaccgtgcgggccggggagaatgtgaccctgagctgcagcagccagagcagctttgacatctaccacctgagccgggagggggaggcccacgagctgcggctgcctgctgtgcccagcatcaatggcaccttccaggccgacttccccctgggccctgccacccatggagagacctaccgctgcttcggcagcttccacggcagcccctatgagtggagcgaccccagcgaccccctgcctgtgtctgtgacagatgctgctgtgatgaaccaggagcccgccggccacaggacagtgaaccgggaggacagtgatgagcaggacccccaggaggtgacctacgcccagctggaccactgcatcttcacccagaggaagatcaccggccccagccagaggagcaagaggcccagcacagacacctctgtgtgcatcgagctgcccaatgctgagccccgggccctgagccctgcccacgagcaccacagccaggccctgatgggcagcagccgggagaccacagccctgagccagacccagctggccagcagcaatgtgcctgctgctggcatctag

SEQ ID NO: 156948 - DNA, 1194 bp, Artificial Sequence
  Description of Artificial Sequence: Synthetic coding sequence
atgagcctgatggtggtgtccatggcctgtgtgggcttcttcctggaccagagcgtgtgggcccacgtgggcggccaggacaagcccttctgcagcgcctggcccagcgctgtggtgccccagggcggccacgtgaccctgcgctgccactaccgccggggcttcaacatcttcaccctgtacaagaaggatggagtgcctgtgcctgagctgtacaaccgcatcttctggaacagcttcctgatcagccctgtgaccccagcccacgccggcacctaccgctgccggggcttccacccccacagccccacagagtggagcgcccccagcaaccccctggtgatcatggtgacaggcctgtatgagaagcccagcctgacagcccggcccggccccaccgtgcgggccggggagaatgtgaccctgagctgcagcagccagagcagctttgacatctaccacctgagccgggagggggaggcccacgagctgcggctgcctgctgtgcccagcatcaatggcaccttccaggccgacttccccctgggccctgccacccatggagagacctaccgctgcttcggcagcttccacggcagcccctatgagtggagcgaccccagcgaccccctgcctgtgtctgtgacaggcaaccccagcagctcctggcccagccccacagagcccagcttcaagacaggaattgcccggcacctgcatgctgtgatccgctacagcgtggccatcatcctcttcaccatcctgcccttcttcctgctgcaccgctggtgcagcaagaagaaggtgtccctgaccaagcagaggccagaaaattctggcccctgtgccgaggccggctgggagcacgcagatgctgctgtgatgaaccaggagcccgccggccacaggacagtgaaccgggaggacagtgatgagcaggacccccaggaggtgacctacgcccagctggaccactgcatcttcacccagaggaagatcaccggccccagccagaggagcaagaggcccagcacagacacctctgtgtgcatcgagctgcccaatgctgagccccgggccctgagccctgcccacgagcaccacagccaggccctgatgggcagcagccgggagaccacagccctgagccagacccagctggccagcagcaatgtgcctgctgctggcatctag

SEQ ID NO: 156949 - DNA, 693 bp, Artificial Sequence
  Description of Artificial Sequence: Synthetic coding sequence
atgtccatgagccccaccgtcatcatcctggcctgcctgggcttcttcctggaccagagcgtgtgggcccacgtgggcctgtatgagaagcccagcctgacagcccggcccggccccaccgtgcgggctggagaaaatgtgaccctgagctgcagcagccagagcagctttgacatctaccacctgagccgggagggggaggcccacgagctgcggctgcctgctgtgcccagcatcaatggcaccttccaggccgacttccccctgggccctgccacccacggggagacctaccgctgcttcggcagcttccacggcagcccctatgagtggagcgaccccagcgaccccctgcctgtgtctgtgacagatgctgctgtgatgaaccaggagcctgctggccacaggacagtgaacagagaagattctgatgagcaggacccccaggaggtgacctacgcccagctggaccactgcatcttcacccagaggaagatcaccggccccagccagaggagcaagaggcccagcacagacacctctgtgtgcatcgagctgcccaatgctgagccccgggccctgagccctgcccacgagcaccacagccaggccctgatgggcagcagccgggagaccacagccctgagccagacccagctggccagcagcaatgtgcctgctgctggcatctag

SEQ ID NO: 156950 - DNA, 762 bp, Artificial Sequence
  Description of Artificial Sequence: Synthetic coding sequence
atgagctgcaccatcgagaaggccctggctgatgccaaggccctggtggagcggctgcgggaccatgatgatgctgctgagagcctcatcgagcagaccacagccctgaacaagagggtggaggccatgaagcagtaccaggaggagatccaggagctgaatgaggtggcccggcaccggcccaggagcaccctggtgatgggcatccagcaggagaaccggcagatccgggagctgcagcaggagaacaaggagctgcggaccagcctggaggagcaccagagcgccctggagctgatcatgagcaagtaccgggagcagatgttccggctgctgatggccagcaagaaggatgaccccggcatcatcatgaagctgaaggagcagcacagcaagattgacatggtgcacaggaacaagtctgagggcttcttcctggatgccagccgccacatcctggaggccccccagcacggcctggagcggcggcacctggaggccaaccagaatgagctgcaggcccacgtggaccagatcacagagatggctgctgtgatgaggaaggccatcgagattgatgagcagcagggctgcaaggagcaggagcgcatcttccagctggagcaggagaacaagggcctgcgggagatcctgcagatcacccgggagagcttcctgaacctgaggaaggatgatgccagcgagagcaccagcctgagcgccctggtgaccaacagcgacctgagcctgaggaagagctag

SEQ ID NO: 156951 - DNA, 648 bp, Artificial Sequence
  Description of Artificial Sequence: Synthetic coding sequence
atggacaaccagggcgtcatctacagcgacctgaacctgccccccaaccccaagaggcagcagaggaagcccaagggcaacaagaacagcatcctggccacagagcaggagatcacctatgcagagctgaacctgcagaaggccagccaggacttccagggcaatgacaagacctaccactgcaaggacctgcccagcgcccctgagaagctgattgtgggcatcctgggcatcatctgcctgatcctgatggcctctgtggtgaccatcgtggtgatccccagccgccactgcggccactgcccagaggagtggatcacctacagcaacagctgctactacatcggcaaggagaggaggacctgggaggagagcctgctggcctgcaccagcaagaacagcagcctgctgagcattgacaatgaggaggagatgaagttcctgagcatcatcagccccagctcctggattggagtcttcaggaacagcagccaccacccctgggtgaccatgaatggcctggccttcaagcatgagatcaaggacagcgacaatgctgagctgaactgtgctgtgctgcaggtgaaccggctgaagagcgcccagtgtggcagcagcatcatctaccactgcaagcacaagctgtag

SEQ ID NO: 156952 - DNA, 702 bp, Artificial Sequence
  Description of Artificial Sequence: Synthetic coding sequence
atggacaaccagggcgtcatctacagcgacctgaacctgccccccaaccccaagaggcagcagaggaagcccaagggcaacaagaacagcatcctggccacagagcaggagatcacctatgcagagctgaacctgcagaaggccagccaggacttccagggcaatgacaagacctaccactgcaaggacctgcccagcgcccctgagaagctgattgtgggcatcctgggcatcatctgcctgatcctgatggcctctgtggtgaccatcgtggtgatccccagcaccctcatccagaggcacaacaacagcagcctgaacaccaggacccagaaggcccggcactgcggccactgcccagaggagtggatcacctacagcaacagctgctactacatcggcaaggagaggaggacctgggaggagagcctgctggcctgcaccagcaagaacagcagcctgctgagcattgacaatgaggaggagatgaagttcctgagcatcatcagccccagctcctggattggagtcttcaggaacagcagccaccacccctgggtgaccatgaatggcctggccttcaagcatgagatcaaggacagcgacaatgctgagctgaactgtgctgtgctgcaggtgaaccggctgaagagcgcccagtgtggcagcagcatcatctaccactgcaagcacaagctgtag

SEQ ID NO: 156953 - DNA, 648 bp, Artificial Sequence; identical to SEQ ID NO: 156951
  Description of Artificial Sequence: Synthetic coding sequence

SEQ ID NO: 156954 - DNA, 702 bp, Artificial Sequence; identical to SEQ ID NO: 156952
  Description of Artificial Sequence: Synthetic coding sequence

SEQ ID NO: 156955 - DNA, 696 bp, Artificial Sequence
  Description of Artificial Sequence: Synthetic coding sequence
atgaacaagcagaggggcaccttcagcgaggtgtccctggcccaggaccccaagaggcagcagaggaagcccaagggcaacaagagcagcatcagcggcacagagcaggagatcttccaggtggagctgaacctgcagaaccccagcctgaaccaccagggcatcgacaagatctatgactgccagggcctgctgcccccacctgagaagctgacagctgaggtgctgggcatcatctgcatcgtgctgatggccaccgtgctgaagaccatcgtgctgatccccttcctggagcagaacaacagcagccccaacaccaggacccagaagaccaggcactgcggccactgcccagaggagtggatcacctacagcaacagctgctactacatcggcaaggagaggaggacctgggaggagagcctgctggcctgcaccagcaagaacagcagcctgctgagcattgacaatgaggaggagatgaagttcctggccagcatcctgcccagctcctggattggagtcttcaggaacagcagccaccacccctgggtgaccatcaatggcctggccttcaagcacaagatcaaggacagcgacaatgctgagctgaactgtgctgtgctgcaggtgaaccggctgaagagcgcccagtgtggcagctccatgatctaccactgcaagcacaagctgtag

SEQ ID NO: 156956 - DNA, 696 bp, Artificial Sequence
  Description of Artificial Sequence: Synthetic coding sequence
atgaacaagcagaggggcaccttcagcgaggtgtccctggcccaggaccccaagaggcagcagaggaagcccaagggcaacaagagcagcatcagcggcacagagcaggagatcttccaggtggagctgaacctgcagaaccccagcctgaaccaccagggcatcgacaagatctatgactgccagggcctgctgcccccacctgagaagctgacagctgaggtgctgggcatcatctgcatcgtgctgatggccaccgtgctgaagaccatcgtgctgatccccttcctggagcagaacaacttcagccccaacaccaggacccagaaggcccggcactgcggccactgcccagaggagtggatcacctacagcaacagctgctactacatcggcaaggagaggaggacctgggaggagagcctgctggcctgcaccagcaagaacagcagcctgctgagcattgacaatgaggaggagatgaagttcctggccagcatcctgcccagctcctggattggagtcttcaggaacagcagccaccacccctgggtgaccatcaatggcctggccttcaagcacaagatcaaggacagcgacaatgctgagctgaactgtgctgtgctgcaggtgaaccggctgaagagcgcccagtgtggcagctccatgatctaccactgcaagcacaagctgtag

SEQ ID NO: 156957 - DNA, 375 bp, Artificial Sequence
  Description of Artificial Sequence: Synthetic coding sequence
atgatccccaccaggcactgcggccactgcccagaggagtggatcacctacagcaacagctgctactacatcggcaaggagaggaggacctgggaggagagcctgctggcctgcaccagcaagaacagcagcctgctgagcattgacaatgaggaggagatgaagttcctggccagcatcctgcccagctcctggattggagtcttcaggaacagcagccaccacccctgggtgaccatcaatggcctggccttcaagcacaagatcaaggacagcgacaatgctgagctgaactgtgctgtgctgcaggtgaaccggctgaagagcgcccagtgtggcagctccatgatctaccactgcaagcacaagctgtag

SEQ ID NO: 156958 - DNA, 774 bp, Artificial Sequence
  Description of Artificial Sequence: Synthetic coding sequence
atgagcaagcagaggggcaccttcagcgaggtgtccctggcccaggaccccaagtggcagcagaggaagcccaagggcaacaagagcagcatcagcggcacagagcaggagatcttccaggtggagctgaacctgcagaatgccagcctgaaccaccagggcatcgacaagatctatgactgccagggcctgctgcccccacctgagaagctgacagctgaggtgctgggcatcatctgcatcgtgctgatggccaccgtgctgaagaccatcgtgctgatccccttcctggagcagaacaacagcagccccaatgcccggacccagaaggcccggcactgcggccactgcccagaggagtggatcacctacagcaacagctgctactacatcggcaaggagaggaggacctgggaggagagcctgcaggcctgtgccagcaagaacagcagcagcctgctgtgcatcgacaatgaggaggagatgaagttcctggccagcatcctgcccagctcctggattggagtcttcaggaacagcagccaccacccctgggtgaccatcaatggcctggccttcaagcatgagatcaaggacagcgaccatgctgagaggaactgtgccatgctgcacgtgcggggcctcatcagtgaccagtgtggcagcagccgcatcatcgtgtccatctccttccgcatcaaggccctggagctggccgtgcaccagatcaagttctacatctgcagcaacagaaatgacatcatgattgcctag

SEQ ID NO: 156959 - DNA, 723 bp, Artificial Sequence
  Description of Artificial Sequence: Synthetic coding sequence
atgagcaagcagaggggcaccttcagcgaggtgtccctggcccaggaccccaagtggcagcagaggaagcccaagggcaacaagagcagcatcagcggcacagagcaggagatcttccaggtggagctgaacctgcagaatgccagcctgaaccaccagggcatcgacaagatctatgactgccagggcctgctgcccccacctgagaagctgacagctgaggtgctgggcatcatctgcatcgtgctgatggccaccgtgctgaagaccatcgtgctgatccccttcctggagcagaacaacagcagccccaacaccaggacccagaagaccaggcactgcggccactgcccagaggagtggatcacctacagcaacagctgctactacatcggcaaggagaggaggacctgggaggagagcctgcaggcctgtgccagcaagaacagcagcagcctgctgtgcatcgacaatgaggaggagatgaagttcctggccagcatcctgcccagctcctggattggagtcttcaggaacagcagccaccacccctgggtgaccatcaatggcctggccttcaagcatgagatcaaggacagcgaccatgctgagaggaactgtgccatgctgcacgtgcggggcctcatcagtgaccagtgtggcagcagccgcatcatcagaagaggcttcatcatgctgacccggctggtgctgaacagctag

SEQ ID NO: 156960 - DNA, 723 bp, Artificial Sequence
  Description of Artificial Sequence: Synthetic coding sequence
atgagcaagcagaggggcaccttcagcgaggtgtccctggcccaggaccccaagtggcagcagaggaagcccaagggcaacaagagcagcatcagcggcacagagcaggagatcttccaggtggagctgaacctgcagaatgccagcctgaaccaccagggcatcgacaagatctatgactgccagggcctgctgcccccacctgagaagctgacagctgaggtgctgggcatcatctgcatcgtgctgatggccaccgtgctgaagaccatcgtgctgatccccttcctggagcagaacaacagcagccccaatgcccggacccagaaggcccggcactgcggccactgcccagaggagtggatcacctacagcaacagctgctactacatcggcaaggagaggaggacctgggaggagagcctgcaggcctgtgccagcaagaacagcagcagcctgctgtgcatcgacaatgaggaggagatgaagttcctggccagcatcctgcccagctcctggattggagtcttcaggaacagcagccaccacccctgggtgaccatcaatggcctggccttcaagcatgagatcaaggacagcgaccatgctgagaggaactgtgccatgctgcacgtgcggggcctcatcagtgaccagtgtggcagcagccgcatcatcagaagaggcttcatcatgctgacccggctggtgctgaacagctag

SEQ ID NO: 156961 - DNA, 477 bp, Artificial Sequence
  Description of Artificial Sequence: Synthetic coding sequence
atgaacaagcagaggggcacctacagcgaggtgtccctggcccaggaccccaagaggcagcagaggaagctgaagggcaacaagatcagcatcagcggcaccaagcaggagatcttccaggtggagctgaacctgcagaatgccagcagtgaccaccagggcaatgacaagacctaccactgcaagggcctgctgcccccacctgagaagctgacagctgaggtgctgggcatcatctgcatcgtgctgatggccaccgtgctgaagaccatcgtgctgatcccctgcattggagtgctggagcagaacaacttcagcctgaacagaaggatgcagaaggcccggcactgcggccactgcccagaggagtggatcacctacagcaacagctgctactacatcggcaaggagaggaggacctgggaggagcgggtgtgctggcctgtgctgcggaggaccctcatctgcttcctgtag

SEQ ID NO: 156962 - DNA, 540 bp, Artificial Sequence
  Description of Artificial Sequence: Synthetic coding sequence
atggctgtgttcaagaccaccctgtggaggctcatcagcggcaccctgggcatcatctgcctgagcctgatgagcaccctgggcatcctgctgaagaacagcttcaccaagctgagcattgagcccgccttcaccccaggccccaacatcgagctgcagaaggacagcgactgctgcagctgccaggagaagtgggtgggctaccgctgcaactgctacttcatcagcagcgagcagaagacctggaatgaaagccgccacctgtgtgccagccagaagagcagcctgctgcagctgcagaacacagatgagctggacttcatgagcagcagccagcagttctactggattggcctgagctacagcgaggagcacacagcctggctgtgggagaatggcagcgccctgagccagtacctgttccccagctttgagaccttcaacaccaagaactgcatcgcctacaaccccaatggaaatgccctggatgagagctgtgaggacaagaaccgctacatctgcaagcagcagctgatctag

SEQ ID NO: 156963 - DNA, 447 bp, Artificial Sequence
  Description of Artificial Sequence: Synthetic coding sequence
atggccgccttcaccaagctgagcattgaaccagccttcaccccaggccccaacatcgagctgcagaaggacagcgactgctgcagctgccaggagaagtgggtgggctaccgctgcaactgctacttcatcagcagcgagcagaagacctggaatgaaagccgccacctgtgtgccagccagaagagcagcctgctgcagctgcagaacacagatgagctggacttcatgagcagcagccagcagttctactggattggcctgagctacagcgaggagcacacagcctggctgtgggagaatggaagtgccctgagccagtacctgttccccagctttgagaccttcaacaccaagaactgcatcgcctacaaccccaatggaaatgccctggatgagagctgtgaggacaagaaccgctacatctgcaagcagcagctgatctag

SEQ ID NO: 156964 - DNA, 540 bp, Artificial Sequence; identical to SEQ ID NO: 156962
  Description of Artificial Sequence: Synthetic coding sequence

SEQ ID NO: 156965 - DNA, 543 bp, Artificial Sequence
  Description of Artificial Sequence: Synthetic coding sequence
atggctgtgttcaagaccaccctgtggaggctcatcagcggcaccctgggcatcatctgcctgagcctgatgagcaccctgggcatcctgctgaagaacagcttcaccaagctgagcattgagcccgccttcaccccaggccccaacatcgagctgcagaaggacagcgactgctgcagctgccaggagaagtgggtgggctaccgctgcaactgctacttcatcagcagcgagcagaagacctggaatgaaagccgccacctgtgtgccagccagaagagcagcctgctgcagctgcagaacacagatgagctgcaggacttcatgagcagcagccagcagttctactggattggcctgagctacagcgaggagcacacagcctggctgtgggagaatggaagtgccctgagccagtacctgttccccagctttgagaccttcaacaccaagaactgcatcgcctacaaccccaatggaaatgccctggatgagagctgtgaggacaagaaccgctacatctgcaagcagcagctgatctag

SEQ ID NO: 156966 - DNA, 156 bp, Artificial Sequence
  Description of Artificial Sequence: Synthetic coding sequence
tctgccctgagccagtacctgttccccagctttgagaccttcaacaccaagaactgcatcgcctacaaccccaatggaaatgccctggatgagagctgtgaggacaagaaccgctacatctacaaggtgctgctgtgctgccccggctggagctag

SEQ ID NO: 156967 - DNA, 420 bp, Artificial Sequence
  Description of Artificial Sequence: Synthetic coding sequence
atggccgccttcaccaagctgagcattgaaccagccttcaccccaggccccaacatcgagctgcagaaggacagcgactgctgcagctgccaggagaagtgggtgggctaccgctgcaactgctacttcatcagcagcgagcagaagacctggaatgaaagccgccacctgtgtgccagccagaagagcagcctgctgcagctgcagaacacagatgagctggacttcatgagcagcagccagcagttctactggattggcctgagctacagcgaggagcacacagcctggctgtgggagaatggaagtgccctgagccagtacctgttccccagctttgagaccttcaacaccaagaactgcatcgcctacaaccccaatggaaatgccctggatgagagctgtgaggacaagaactag

SEQ ID NO: 156968 - DNA, 699 bp, Artificial Sequence
  Description of Artificial Sequence: Synthetic coding sequence
atgcaggatgaggagcgctacatgaccctgaatgtgcagagcaagaagaggagcagcgcccagaccagccagctgaccttcaaggactacagcgtgaccctgcactggtacaagatcctgctgggcatcagcggcaccgtgaatggcatcctgaccctgaccctcatcagcctcatcctgctggtgtcccagggcgtgctgctgaagtgccagaagggcagctgcagcaatgccacccagtatgaggacaccggggacctgaaggtgaacaacggcaccaggaggaacatcagcaacaaggacctgtgtgccagccgctctgctgaccagacagtgctgtgccagagcgagtggctgaagtaccagggcaagtgctgctactggttcagcaatgagatgaagtcctggagcgacagctatgtgtactgcctggagaggaagagccacctgctgatcatccatgaccagctggagatggccttcatccagaagaacctgcggcagctgaactacgtgtggattggcctgaacttcaccagcctgaagatgacctggacctgggtggatggcagccccatcgacagcaagatcttcttcatcaagggccctgccaaggagaacagctgtgccgccatcaaggagagcaagatcttcagcgagacctgcagcagcgtcttcaagtggatctgccagtactag

SEQ ID NO: 156969 - DNA, 549 bp, Artificial Sequence
  Description of Artificial Sequence: Synthetic coding sequence
atgcaggatgaggagcgctacatgaccctgaatgtgcagagcaagaagaggagcagcgcccagaccagccagctgaccttcaaggactacagcgtgaccctgcactggtacaagatcctgctgggcatcagcggcaccgtgaatggcatcctgaccctgaccctcatcagcctcatcctgctggtgctgtgccagagcgagtggctgaagtaccagggcaagtgctgctactggttcagcaatgagatgaagtcctggagcgacagctatgtgtactgcctggagaggaagagccacctgctgatcatccatgaccagctggagatggccttcatccagaagaacctgcggcagctgaactacgtgtggattggcctgaacttcaccagcctgaagatgacctggacctgggtggatggcagccccatcgacagcaagatcttcttcatcaagggccctgccaaggagaacagctgtgccgccatcaaggagagcaagatcttcagcgagacctgcagcagcgtcttcaagtggatctgccagtactag

SEQ ID NO: 156970 - DNA, 195 bp, Artificial Sequence
  Description of Artificial Sequence: Synthetic coding sequence
atgcaggatgaggagcgctacatgaccctgaatgtgcagagcaagaagaggagcagcgcccagaccagccagctgaccttcaaggactacagcgtgaccctgcactggtacaagatcctgctgggcatcagcggcaccgtgaatggcatcctgaccctgaccctcatcagcctcatcctgctggacagcagctag

SEQ ID NO: 156971 - DNA, 588 bp, Artificial Sequence
  Description of Artificial Sequence: Synthetic coding sequence
atgacagacagcgtcatctacagcatgctggagctgcccacagccacccaggcccagaatgactatggcccccagcagaagagcagcagcagccggcccagctgcagctgcctggtggccatcgccctgggcctgctgacagctgtgctgctgtctgtgctgctgtaccagtggatcctgtgccagggcagcaactacagcacctgtgccagctgccccagctgcccagaccgctggatgaagtatggcaaccactgctactacttctctgtggaggagaaggactggaacagcagcctggagttctgcctggcccgggacagccacctgctggtgatcacagacaaccaggagatgagcctgctgcaggtgttcctgtctgaggccttctgctggattggcctgaggaacaacagcggctggcgctgggaggatggcagccccctgaacttcagccgcatcagcagcaacagctttgtgcagacctgtggggccatcaacaagaatggcctgcaggccagcagctgtgaggtgcccctgcactgggtgtgcaagaagtgcccctttgctgaccaggccctcttctag

SEQ ID NO: 156972 - DNA, 570 bp, Artificial Sequence
  Description of Artificial Sequence: Synthetic coding sequence
atgacagacagcgtcatctacagcatgctggagctgcccacagccacccaggcccagaatgactatggcccccagcagaagagcagcagcagccggcccagctgcagctgcctggtggccatcgccctgggcctgctgacagctgtgctgctgtctgtgctgctgtaccagtggatcctgtgccagggcagcaactacagcacctgtgccagctgccccagctgcccagaccgctggatgaagtatggcaaccactgctactacttctctgtggaggagaaggactggaacagcagcctggagttctgcctggcccgggacagccacctgctggtgatcacagacaaccaggagatgagcctgctgcaggtgttcctgtctgaggccttctgctggattggcctgaggaacaacagcggctggcgctgggaggatggcagccccctgaacttcagccgcatcagcagcaacagctttgtgcagacctgtggggccatcaacaagaatggcctgcaggccagcagctgtgaggtgcccctgcactgggtgtgcaagaaggtgcggctgtag

SEQ ID NO: 156973 - DNA, 651 bp, Artificial Sequence
  Description of Artificial Sequence: Synthetic coding sequence
atgggctggatccggggcagaagaagccgccacagctgggagatgtctgagttccacaactacaacctggacctgaagaagagtgacttcagcacccgctggcagaagcagcgctgccctgtggtgaagagcaaatgtcgggagaatgccagccccttcttcttctgctgcttcatcgctgtggccatgggcatccgcttcatcatcatggtgaccatctggagcgctgtgttcctgaacagcctcttcaaccaggaggtgcagatccccctgacagagagctactgcggcccctgccccaagaactggatctgctacaagaacaactgctaccagttctttgatgagagcaagaactggtatgagagccaggccagctgcatgagccagaatgccagcctgctgaaggtgtacagcaaagaagaccaggacctgctgaagctggtgaagagctaccactggatgggcctggtgcacatccccaccaacggctcctggcagtgggaggatggcagcatcctgagccccaacctgctgaccatcatcgagatgcagaagggggactgtgccctgtatgccagcagcttcaagggctacatcgagaactgcagcacccccaacacctacatctgcatgcagaggacagtgtag

SEQ ID NO: 156974 - DNA, 243 bp, Artificial Sequence
  Description of Artificial Sequence: Synthetic coding sequence
atgggctggatccggggcagaagaagccgccacagctgggagatgtctgagttccacaactacaacctggacctgaagaagagtgacttcagcacccgctggcagaagcagcgctgccctgtggtgaagagcaaatgtcgggagaatgccagccccttcttcttctgctgcttcatcgctgtggccatgggcatccgcttcatcatcatggtgaccatctggagcgctgtgttcctgaactag

SEQ ID NO: 156975 - DNA, 651 bp, Artificial Sequence; identical to SEQ ID NO: 156973
  Description of Artificial Sequence: Synthetic coding sequence

SEQ ID NO: 156976 - DNA, 537 bp, Artificial Sequence
  Description of Artificial Sequence: Synthetic coding sequence
atggaccggcccggccctggcagcgcccggcccggccgcacagtgcacgtgtggggctacagagtggagtggaaggtgagaaatggaaggaagctgcagcccagcgagtgggccggccgcggggacctgggcggcttcaagaggcgctggaaggacacccgggccaccgtgggcaccaccttcagaagaagaagccgggtgtccctggtgggggagctgagcaagttccccctgcccagcgacagcagcggcggcaagagcagcagcagctttgcccggggggccctggcctggtgccggcagaggaaccccaaccccagctgtgccgctgctgagactggagcccggaccagcctgcccaaggagcgctgccggggctggaggctgggcaactggctgcacaagcacccccaccccaacacctgcccccggctgcctgcctgctggctgccccccatcctgacagagcggggggagcgggtgcccaagctggtgcccctgctggcctgctaccccaagagcaagcccaaggactag

SEQ ID NO: 156977 - DNA, 1902 bp, Artificial Sequence
  Description of Artificial Sequence: Synthetic coding sequence
atgctgaggatgagggtgcctgccctgctggtgctgctcttctgcttccggggccgggccggccccagcccccacttcctgcagcagcctgaggacctggtggtgctgctgggggaggaggcccggctgccctgtgccctgggcgcctactggggcctggtgcagtggaccaagagcggcctggccctgggcggccagagggacctgcccggctggagccgctactggatctctggaaatgctgccaacggccagcacgacctgcacatccggcctgtggagctggaggatgaggccagctatgagtgccaggccacccaggccggcctgcggagcaggcctgcccagctgcacgtgctggtgcccccagaggccccccaggtgctgggcggccccagcgtgtccctggtggccggcgtgcctgccaacctgacctgccgcagcagaggagatgcccggcccaccccagagctgctgtggttcagagatggagtgctgctggatggagccaccttccaccagaccctgctgaaggagggcaccccaggctctgtggagagcaccctgaccctgacccccttcagccatgatgatggagccacctttgtgtgccgggcccggagccaggccctgcccaccggccgggacacagccatcaccctgagcctgcagtacccacctgaggtgaccctgagcgccagcccccacacagtgcaggagggggagaaggtgatcttcctgtgccaggccacagcccagccccctgtgacaggctaccgctgggccaagggcggcagccctgtgctgggcgcccggggcccccggctggaggtggtggctgatgccagcttcctgacagagcctgtgtcctgtgaggtgtccaatgctgtgggcagcgccaacagaagcacagccctggatgtgctgtttggccccatcctgcaggccaagccagagcctgtgtctgtggatgtgggagaagatgccagcttcagctgtgcctggaggggcaaccccctgccccgggtgacctggaccaggagaggaggagcccaggtgctgggcagcggggccaccctgcggctgcccagcgtgggcccagaagatgctggggactatgtgtgcagagctgaggccggcctgagcggcctgcggggcggcgctgctgaggcccggctgactgtgaatgcccctcctgtggtgacagccctgcacagcgccccagccttcctgcggggccctgcccggctgcagtgcctggtgtttgccagccctgccccagatgctgtggtgtggagctgggatgagggcttcctggaggccggcagccagggccgcttcctggtggagaccttccctgcccctgagagcagaggaggcctgggccctggcctcatctctgtgctgcacatcagcggcacccaggagagtgacttcagccgctccttcaactgcagcgccaggaaccggctgggggagggcggggcccaggccagcctgggccggcgggacctgctgcccaccgtgagaattgtggccggcgtggccgccgccaccaccaccctgctgatggtgatcactggagtggccctgtgctgctggaggcacagcaaggccagcgccagcttcagcgagcagaagaacctgatgagaattcctggcagcagtgatggcagcagcagccggggccctgaggaggaggagaccggcagcagagaagatcggggccccatcgtgcacacagaccacagcgacctggtgctggaggagaagggcaccctggagaccaaggaccccaccaacggctactacaaggtgcggggcgtgtccccaccagccagcccagacagccgggtgaccagcttccagtggaagagccctggcatcagcaacctgccctag

SEQ ID NO: 156978 - DNA, 660 bp, Artificial Sequence
  Description of Artificial Sequence: Synthetic coding sequence
atgctgaggatgagggtgcctgccctgctggtgctgctcttctgcttccggggccgggccggccccagcccccacttcctgcagcagcctgaggacctggtggtgctgctgggggagggcggggcccaggccagcctgggccggcgggccagcgccagcttcagcgagcagaagaacctgatgagaattcctggcagcagtgatggcagcagcagccggggccctgaggaggaggagaccggcagccgggaggaccggggccccatcgtgcacacagaccacagcgacctggtgctggaggagaagggcaccctggagaccaaggaccccaccaacggctactacaaggtgcggggcgtgtctgtgtccctgagcctgggggaggcccctgggggcggcctcttcctgcccccacccagccccctgggccccccaggcacccccaccttctatgacttcaacccccacctgggcatggtgcccccctgccgcctgtaccgggcccgggccggctacctgaccaccccccacccccgggccttcaccagctacatcaagcccaccagctttggccccccagacctggcccctggcaccccacccttcccctatgctgccttccccacccccagccacccccggctgcagacccacgtgtag

SEQ ID NO: 156979 - DNA, 2067 bp, Artificial Sequence
  Description of Artificial Sequence: Synthetic coding sequence
atgctgaggatgagggtgcctgccctgctggtgctgctcttctgcttccggggccgggccggccccagcccccacttcctgcagcagcctgaggacctggtggtgctgctgggggaggaggcccggctgccctgtgccctgggcgcctactggggcctggtgcagtggaccaagagcggcctggccctgggcggccagagggacctgcccggctggagccgctactggatctctggaaatgctgccaacggccagcacgacctgcacatccggcctgtggagctggaggatgaggccagctatgagtgccaggccacccaggccggcctgcggagcaggcctgcccagctgcacgtgctggtgcccccagaggccccccaggtgctgggcggccccagcgtgtccctggtggccggcgtgcctgccaacctgacctgccgcagcagaggagatgcccggcccaccccagagctgctgtggttcagagatggagtgctgctggatggagccaccttccaccagaccctgctgaaggagggcaccccaggctctgtggagagcaccctgaccctgcccaccggccgggacacagccatcaccctgagcctgcagtacccacctgaggtgaccctgagcgccagcccccacacagtgcaggagggggagaaggtgatcttcctgtgccaggccacagcccagccccctgtgacaggctaccgctgggccaagggcggcagccctgtgctgggcgcccggggcccccggctggaggtggtggctgatgccagcttcctgacagagcctgtgtcctgtgaggtgtccaatgctgtgggcagcgccaacagaagcacagccctggatgtgctgtttggccccatcctgcaggccaagccagagcctgtgtctgtggatgtgggagaagatgccagcttcagctgtgcctggaggggcaaccccctgccccgggtgacctggaccaggagaggaggagcccaggtgctgggcagcggggccaccctgcggctgcccagcgtgggcccagaagatgctggggactatgtgtgcagagctgaggccggcctgagcggcctgcggggcggcgctgctgaggcccggctgactgtgaatgcccctcctgtggtgacagccctgcacagcgccccagccttcctgcggggccctgcccggctgcagtgcctggtgtttgccagccctgccccagatgctgtggtgtggagctgggatgagggcttcctggaggccggcagccagggccgcttcctggtggagaccttccctgcccctgagagcagaggaggcctgggccctggcctcatctctgtgctgcacatcagcggcacccaggagagtgacttcagccgctccttcaactgcagcgccaggaaccggctgggggagggcggggcccaggccagcctgggccggcgggacctgctgcccaccgtgagaattgtggccggcgtggccgccgccaccaccaccctgctgatggtgatcactggagtggccctgtgctgctggaggcacagcaaggccagcgccagcttcagcgagcagaagaacctgatgagaattcctggcagcagtgatggcagcagcagccggggccctgaggaggaggagaccggcagcagagaagatcggggccccatcgtgcacacagaccacagcgacctggtgctggaggagaagggcaccctggagaccaaggaccccaccaacggctactacaaggtgcggggcgtgtctgtgtccctgagcctgggggaggcccctgggggcggcctcttcctgcccccacccagccccctgggccccccaggcacccccaccttctatgacttcaacccccacctgggcatggtgcccccctgccgcctgtaccgggcccgggccggctacctgaccaccccccacccccgggccttcaccagctacatcaagcccaccagctttggacctccagacctggcccctggcaccccacccttcccctatgctgccttccccacccccagccacccccggctgcagacccacgtgtag

SEQ ID NO: 156980 - DNA, 1752 bp, Artificial Sequence
  Description of Artificial Sequence: Synthetic coding sequence
atgctgaggatgagggtgcctgccctgctggtgctgctcttctgcttccggggccgggccggctggagccgctactggatctctggaaatgctgccaacggccagcacgacctgcacatccggcctgtggagctggaggatgaggccagctatgagtgccaggccacccaggccggcctgcggagcaggcctgcccagctgcacgtgctggtgcccccagaggccccccaggtgctgggcggccccagcgtgtccctggtggccggcgtgcctgccaacctgacctgccgcagcagaggagatgcccggcccaccccagagctgctgtggttcagagatggagtgctgctggatggagccaccttccaccagaccctgctgaaggagggcaccccaggctctgtggagagcaccctgaccctgacccccttcagccatgatgatggagccacctttgtgtgccgggcccggagccaggccctgcccaccggccgggacacagccatcaccctgagcctgcagtacccacctgaggtgaccctgagcgccagcccccacacagtgcaggagggggagaaggtgatcttcctgtgccaggccacagcccagccccctgtgacaggctaccgctgggccaagggcggcagccctgtgctgggcgcccggggcccccggctggaggtggtggctgatgccagcttcctgacagagcctgtgtcctgtgaggtgtccaatgctgtgggcagcgccaacagaagcacagccctggatgtgctgtttggccccatcctgcaggccaagccagagcctgtgtctgtggatgtgggagaagatgccagcttcagctgtgcctggaggggcaaccccctgccccgggtgacctggaccaggagaggaggagcccaggtgctgggcagcggggccaccctgcggctgcccagcgtgggcccagaagatgctggggactatgtgtgcagagctgaggccggcctgagcggcctgcggggcggcgctgctgaggcccggctgactgtgaatgcccctcctgtggtgacagccctgcacagcgccccagccttcctgcggggccctgcccggctgcagtgcctggtgtttgccagccctgccccagatgctgtggtgtggagctgggatgagggcttcctggaggccggcagccagggccgcttcctggtggagaccttccctgcccctgagagcagaggaggcctgggccctggcctcatctctgtgctgcacatcagcggcacccaggagagtgacttcagccgctccttcaactgcagcgccaggaaccggctgggggagggcggggcccaggccagcctgggccggcgggacctgctgcccaccgtgagaattgtggccggcgtggccgccgccaccaccaccctgctgatggtgatcactggagtggccctgtgctgctggaggcacagcaaggccagcgccagcttcagcgagcagaagaacctgatgagaattcctggcagcagtgatggcagcagcagccggggccctgaggaggaggagaccggcagcagagaagatcggggccccatcgtgcacacagaccacagcgacctggtgctggaggagaagggcaccctggagaccaaggaccccaccaacggctactacaaggtgcggggcgtgtccccaccagccagcccagacagccgggtgaccagcttccagtggaagagccctggcatcagcaacctgccctag

SEQ ID NO: 156981 - DNA, 2127 bp, Artificial Sequence
  Description of Artificial Sequence: Synthetic coding sequence
atgctgaggatgagggtgcctgccctgctggtgctgctcttctgcttccggggccgggccggccccagcccccacttcctgcagcagcctgaggacctggtggtgctgctgggggaggaggcccggctgccctgtgccctgggcgcctactggggcctggtgcagtggaccaagagcggcctggccctgggcggccagagggacctgcccggctggagccgctactggatctctggaaatgctgccaacggccagcacgacctgcacatccggcctgtggagctggaggatgaggccagctatgagtgccaggccacccaggccggcctgcggagcaggcctgcccagctgcacgtgctggtgcccccagaggccccccaggtgctgggcggccccagcgtgtccctggtggccggcgtgcctgccaacctgacctgccgcagcagaggagatgcccggcccaccccagagctgctgtggttcagagatggagtgctgctggatggagccaccttccaccagaccctgctgaaggagggcaccccaggctctgtggagagcaccctgaccctgacccccttcagccatgatgatggagccacctttgtgtgccgggcccggagccaggccctgcccaccggccgggacacagccatcaccctgagcctgcagtacccacctgaggtgaccctgagcgccagcccccacacagtgcaggagggggagaaggtgatcttcctgtgccaggccacagcccagccccctgtgacaggctaccgctgggccaagggcggcagccctgtgctgggcgcccggggcccccggctggaggtggtggctgatgccagcttcctgacagagcctgtgtcctgtgaggtgtccaatgctgtgggcagcgccaacagaagcacagccctggatgtgctgtttggccccatcctgcaggccaagccagagcctgtgtctgtggatgtgggagaagatgccagcttcagctgtgcctggaggggcaaccccctgccccgggtgacctggaccaggagaggaggagcccaggtgctgggcagcggggccaccctgcggctgcccagcgtgggcccagaagatgctggggactatgtgtgcagagctgaggccggcctgagcggcctgcggggcggcgctgctgaggcccggctgactgtgaatgcccctcctgtggtgacagccctgcacagcgccccagccttcctgcggggccctgcccggctgcagtgcctggtgtttgccagccctgccccagatgctgtggtgtggagctgggatgagggcttcctggaggccggcagccagggccgcttcctggtggagaccttccctgcccctgagagcagaggaggcctgggccctggcctcatctctgtgctgcacatcagcggcacccaggagagtgacttcagccgctccttcaactgcagcgccaggaaccggctgggggagggcggggcccaggccagcctgggccggcgggacctgctgcccaccgtgagaattgtggccggcgtggccgccgccaccaccaccctgctgatggtgatcactggagtggccctgtgctgctggaggcacagcaaggccagcgccagcttcagcgagcagaagaacctgatgagaattcctggcagcagtgatggcagcagcagccggggccctgaggaggaggagaccggcagcagagaagatcggggccccatcgtgcacacagaccacagcgacctggtgctggaggagaagggcaccctggagaccaaggaccccaccaacggctactacaaggtgcggggcgtgtctgtgtccctgagcctgggggaggcccctgggggcggcctcttcctgcccccacccagccccctgggccccccaggcacccccaccttctatgacttcaacccccacctgggcatggtgcccccctgccgcctgtaccgggcccgggccggctacctgaccaccccccacccccgggccttcaccagctacatcaagcccaccagctttggacctccagacctggcccctggcaccccacccttcccctatgctgccttccccacccccagccacccccggctgcagacccacgtgtag

SEQ ID NO: 156982 - DNA, 738 bp, Artificial Sequence
  Description of Artificial Sequence: Synthetic coding sequence
atggccgtcatcattggagtggccgtgggcgccggcgtggccttcctggtgctgatggccaccatcgtggccttctgctgtgcccggagccagaggaacctgaagggcgtggtgtctgccaagaatgacatccgggtggagatcgtgcacaaggagcccgccagcggccgggagggggaggagcacagcaccatcaagcagctgatgatggacagaggagagttccagcaggacagcgtgctgaagcagctggaggtgctgaaggaggaggagaaggagttccagaacctgaaggaccccaccaacggctactacagcgtgaacaccttcaaggagcaccacagcacccccaccatcagcctgagcagctgccagcctgacctgcggcctgctgggaagcagagggtgcccaccggcatgtccttcaccaacatctacagcaccctgagcggccagggccgcctgtatgactatggccagagatttgtgctgggcatgggcagcagcagcattgagctgtgtgagcgggagttccagaggggcagcctgagtgacagcagcagcttcctggacacccagtgtgacagctctgtgagcagcagcggcaagcaggacggctacgtgcagtttgacaaggccagcaaggccagcgccagcagcagccaccacagccagagcagcagccagaacagcgaccccagccggcccctgcagaggaggatgcagacccacgtgtag

SEQ ID NO: 156983 - DNA, 2337 bp, Artificial Sequence
  Description of Artificial Sequence: Synthetic coding sequence
atgaagcccttccagctggacctgctgtttgtgtgcttcttcctgttcagccaggagctgggcctgcagaagaggggctgctgcctggtgctgggctacatggccaaggacaagttccggaggatgaatgaaggccaggtgtacagcttcagccagcagccccaggaccaggtggtggtgtctggccagcctgtgaccctgctgtgtgccatcccagaatatgatggctttgtgctgtggatcaaggatggcctggccctgggcgtgggccgggacctgagcagctacccccagtacctggtggtgggcaaccacctgtctggagagcaccacctgaagatcctgcgggcagagctgcaggatgatgctgtgtatgagtgccaggccatccaggccgccatccgcagcaggcctgcccggctgactgtgctggtgcccccagatgaccccgtcatcctgggcggccctgtgatcagcctgcgggccggggaccccctgaacctgacctgccacgccgacaatgccaagccagctgccagcatcatctggctgaggaagggggaggtgatcaatggagccacctacagcaagaccctgctgagagatggcaagcgggagagcatcgtgtccaccctcttcatcagccctggagatgtggagaatggccagagcatcgtgtgccgggccaccaacaaggccatccctgggggcaaggagacctctgtgaccatcgacatccagcacccccccctggtgaacctgtctgtggagccccagcctgtgctggaggacaacgtggtgaccttccactgcagcgccaaggccaacccagctgtgacccagtaccgctgggccaagaggggccagatcatcaaggaggccagcggggaggtgtaccgcaccaccgtggactacacctacttcagcgagcctgtgtcctgtgaggtgaccaatgccctgggcagcaccaacctgagcaggacagtggatgtgtacttcggccccaggatgaccacagagccccagagcctgctggtggacctgggcagtgatgccatcttcagctgtgcctggacaggcaaccccagcctgaccatcgtgtggatgaagaggggcagcggcgtggtgctgagcaatgagaagaccctgaccctgaagtctgtgcggcaggaggatgctgggaagtatgtgtgcagagctgtggtgccccgggtgggcgctggggagcgggaggtgaccctgactgtgaatggaccacccatcatcagcagcacccagacccagcacgccctgcacggggagaagggccagatcaagtgcttcatccgcagcaccccacctccagacagaattgcctggagctggaaggaaaatgtgctggagagcggcaccagcggccgctacacagtggagaccatcagcacagaggagggcgtcatcagcaccctgaccatcagcaacatcgtgcgggctgacttccagaccatctacaactgcacagcctggaacagctttggaagtgacacagagatcatccggctgaaggagcagggcagcgagatgaagtctggagctggcctggaggccgagagcgtgcccatggctgtgatcatcggcgtggccgtgggcgctggggtggccttcctggtgctgatggccaccatcgtggccttctgctgtgcccggagccagaggaacctgaagggcgtggtgtctgccaagaatgacatccgggtggagatcgtgcacaaggagcccgccagcggccgggagggggaggagcacagcaccatcaagcagctgatgatggacagaggagagttccagcaggacagcgtgctgaagcagctggaggtgctgaaggaggaggagaaggagttccagaacctgaaggaccccaccaacggctactacagcgtgaacaccttcaaggagcaccacagcacccccaccatcagcctgagcagctgccagcctgacctgcggcctgctgggaagcagagggtgcccaccggcatgtccttcaccaacatctacagcaccctgagcggccagggccgcctgtatgactatggccagagatttgtgctgggcatgggcagcagcagcattgagctgtgtgagcgggagttccagaggggcagcctgagtgacagcagcagcttcctggacacccagtgtgacagctctgtgagcagcagcggcaagcaggacggctacgtgcagtttgacaaggccagcaaggccagcgccagcagcagccaccacagccagagcagcagccagaacagcgaccccagccggcccctgcagaggaggatgcagacccacgtgtag

SEQ ID NO: 156984 - DNA, 1803 bp, Artificial Sequence
  Description of Artificial Sequence: Synthetic coding sequence
atgaagcccttccagctggacctgctgtttgtgtgcttcttcctgttcagccaggagctgggcctgcagaagaggggctgctgcctggtgctgggctacatggccaaggacaagttccggaggatgaatgaaggccaggtgtacagcttcagccagcagccccaggaccaggtggtggtgtctggccagcctgtgaccctgctgtgtgccatcccagaatatgatggctttgtgctgtggatcaaggatggcctggccctgggcgtgggccgggacctgagcagctacccccagtacctggtggtgggcaaccacctgtctggagagcaccacctgaagatcctgcgggcagagctgcaggatgatgctgtgtatgagtgccaggccatccaggccgccatccgcagcaggcctgcccggctgactgtgctggtgcccccagatgaccccgtcatcctgggcggccctgtgatcagcctgcgggccggggaccccctgaacctgacctgccacgccgacaatgccaagccagctgccagcatcatctggctgaggaagggggaggtgatcaatggagccacctacagcaagaccctgctgagagatggcaagcgggagagcatcgtgtccaccctcttcatcagccctggagatgtggagaatggccagagcatcgtgtgccgggccaccaacaaggccatccctgggggcaaggagacctctgtgaccatcgacatccagcacccccccctggtgaacctgtctgtggagccccagcctgtgctggaggacaacgtggtgaccttccactgcagcgccaaggccaacccagctgtgacccagtaccgctgggccaagaggggccagatcatcaaggaggccagcggggaggtgtaccgcaccaccgtggactacacctacttcagcgagcctgtgtcctgtgaggtgaccaatgccctgggcagcaccaacctgagcaggacagtggatgtgtacttcggccccaggatgaccacagagccccagagcctgctggtggacctgggcagtgatgccatcttcagctgtgcctggacaggcaaccccagcctgaccatcgtgtggatgaagaggggcagcggcgtggtgctgagcaatgagaagaccctgaccctgaagtctgtgcggcaggaggatgctgggaagtatgtgtgcagagctgtggtgccccgggtgggcgctggggagcgggaggtgaccctgactgtgaatggaccacccatcatcagcagcacccagacccagcacgccctgcacggggagaagggccagatcaagtgcttcatccgcagcaccccacctccagacagaattgcctggagctggaaggaaaatgtgctggagagcggcaccagcggccgctacacagtggagaccatcagcacagaggagggcgtcatcagcaccctgaccatcagcaacatcgtgcgggctgacttccagaccatctacaactgcacagcctggaacagctttggaagtgacacagagatcatccggctgaaggagcagggcagcgagatgaagtctggagctggcctggaggccgagagcgtgcccatggctgtgatcatcggcgtggccgtgggcgctggggtggccttcctggtgctgatggccaccatcgtggccttctgctgtgcccggagccagaggagcactggaggccgcagcggcatcagcggccggggcacagagaagaaggcccggctgcggctgccccggcgggccagcaagcaggagtgcaatgagcagggcagctag

SEQ ID NO: 156985 - DNA, 2301 bp, Artificial Sequence
  Description of Artificial Sequence: Synthetic coding sequence
atgaagcccttccagctggacctgctgtttgtgtgcttcttcctgttcagccaggagctgggcctgcagaagaggggctgctgcctggtgctgggctacatggccaaggacaagttccggaggatgaatgaaggccaggtgtacagcttcagccagcagccccaggaccaggtggtggtgtctggccagcctgtgaccctgctgtgtgccatcccagaatatgatggctttgtgctgtggatcaaggatggcctggccctgggcgtgggccgggacctgagcagctacccccagtacctggtggtgggcaaccacctgtctggagagcaccacctgaagatcctgcgggcagagctgcaggatgatgctgtgtatgagtgccaggccatccaggccgccatccgcagcaggcctgcccggctgactgtgctggtgcccccagatgaccccgtcatcctgggcggccctgtgatcagcctgcgggccggggaccccctgaacctgacctgccacgccgacaatgccaagccagctgccagcatcatctggctgaggaagggggaggtgatcaatggagccacctacagcaagaccctgctgagagatggcaagcgggagagcatcgtgtccaccctcttcatcagccctggagatgtggagaatggccagagcatcgtgtgccgggccaccaacaaggccatccctgggggcaaggagacctctgtgaccatcgacatccagcacccccccctggtgaacctgtctgtggagccccagcctgtgctggaggacaacgtggtgaccttccactgcagcgccaaggccaacccagctgtgacccagtaccgctgggccaagaggggccagatcatcaaggaggccagcggggaggtgtaccgcaccaccgtggactacacctacttcagcgagcctgtgtcctgtgaggtgaccaatgccctgggcagcaccaacctgagcaggacagtggatgtgtacttcggccccaggatgaccacagagccccagagcctgctggtggacctgggcagtgatgccatcttcagctgtgcctggacaggcaaccccagcctgaccatcgtgtggatgaagaggggcagcggcgtggtgctgagcaatgagaagaccctgaccctgaagtctgtgcggcaggaggatgctgggaagtatgtgtgcagagctgtggtgccccgggtgggcgctggggagcgggaggtgaccctgactgtgaatggaccacccatcatcagcagcacccagacccagcacgccctgcacggggagaagggccagatcaagtgcttcatccgcagcaccccacctccagacagaattgcctggagctggaaggaaaatgtgctggagagcggcaccagcggccgctacacagtggagaccatcagcacagaggagggcgtcatcagcaccctgaccatcagcaacatcgtgcgggctgacttccagaccatctacaactgcacagcctggaacagctttggaagtgacacagagatcatccggctgaaggagcaggagagcgtgcccatggctgtgatcatcggcgtggccgtgggcgctggggtggccttcctggtgctgatggccaccatcgtggccttctgctgtgcccggagccagaggaacctgaagggcgtggtgtctgccaagaatgacatccgggtggagatcgtgcacaaggagcccgccagcggccgggagggggaggagcacagcaccatcaagcagctgatgatggacagaggagagttccagcaggacagcgtgctgaagcagctggaggtgctgaaggaggaggagaaggagttccagaacctgaaggaccccaccaacggctactacagcgtgaacaccttcaaggagcaccacagcacccccaccatcagcctgagcagctgccagcctgacctgcggcctgctgggaagcagagggtgcccaccggcatgtccttcaccaacatctacagcaccctgagcggccagggccgcctgtatgactatggccagagatttgtgctgggcatgggcagcagcagcattgagctgtgtgagcgggagttccagaggggcagcctgagtgacagcagcagcttcctggacacccagtgtgacagctctgtgagcagcagcggcaagcaggacggctacgtgcagtttgacaaggccagcaaggccagcgccagcagcagccaccacagccagagcagcagccagaacagcgaccccagccggcccctgcagaggaggatgcagacccacgtgtag

SEQ ID NO: 156986 - DNA, 1182 bp, Artificial Sequence
  Description of Artificial Sequence: Synthetic coding sequence
atgggcaagagtgacttcctgacccccaaggccatcgccaaccgcatcaagagcaagggcctgcagaagctgcgctggtactgccagatgtgccagaagcagtgcagagatgaaaatggcttcaagtgccactgcatgtctgagagccaccagaggcagctgctgctggccagcgagaacccccagcagttcatggactacttcagcgaggagttcagaaatgacttcctggagctgctgcggcggcgcttcggcaccaagagggtgcacaacaacatcgtgtacaatgagtacatcagccaccgggagcacatccacatgaatgccacccagtgggagaccctgacagacttcaccaagtggctgggccgggagggcctgtgcaaggtggatgagacccccaagggctggtacatccagtacatcgaccgggaccctgagaccatccggcggcagctggagctggagaagaagaagaagcaggacctggatgatgaggagaagacagccaagttcatcgaggagcaggtgcggcggggcctggagggcaaggagcaggaggtgcccaccttcacagagctgagcagagaaaatgatgaggagaaggtgaccttcaacctgagcaaaggagcctgcagcagcagcggggccaccagcagcaagagcagcaccctgggccccagcgccctgaagaccatcggcagcagcgcctctgtgaagaggaaggagagcagccagagcagcacccagagcaaggagaagaagaagaagaagagcgccctggatgagatcatggagattgaggaggagaagaagaggacagccaggacagactactggctgcagcctgagatcatcgtgaagatcatcaccaagaagctgggggagaagtaccacaagaagaaggccatcgtgaaggaggtgattgacaagtacacagctgtggtgaagatgattgattctggggacaagctgaagctggaccagacccacctggagaccgtcatcccagcccctgggaagaggatcctggtgctgaatggaggctacagaggaaatgaaggcaccctggagagcatcaatgagaagaccttcagcgccaccatcgtgattgaaacaggccccctgaagggcagaagagtggagggcatccagtatgaggacatcagcaagctggcctag

SEQ ID NO: 156987 - DNA, 1125 bp, Artificial Sequence
  Description of Artificial Sequence: Synthetic coding sequence
atgggcaagagtgacttcctgacccccaaggccatcgccaaccgcatcaagagcaagggcctgcagaagctgcgctggtactgccagatgtgccagaagcagtgcagagatgaaaatggcttcaagtgccactgcatgtctgagagccaccagaggcagctgctgctggccagcgagaacccccagcagttcatggactacttcagcgaggagttcagaaatgacttcctggagctgctgcggcggcgcttcggcaccaagagggtgcacaacaacatcgtgtacaatgagtacatcagccaccgggagcacatccacatgaatgccacccagtgggagaccctgacagacttcaccaagtggctgggccgggagggcctgtgcaaggtggatgagacccccaagggctggtacatccagtacatcgaccgggaccctgagaccatccggcggcagctggagctggagaagaagaagaagcaggacctggatgatgaggagaagacagccaagttcatcgaggagcaggtgcggcggggcctggagggcaaggagcaggaggtgcccaccttcacagagctgagcagagaaaatgatgaggagaaggtgaccttcaacctgagcaaaggagcctgcagcagcagcggggccaccagcagcaagagcagcaccctgggccccagcgccctgaagaccatcggcagcagcgcctctgtgaagaggaaggagagcagccagagcagcacccagagcaaggagaagaagaagaagaagagcgccctggatgagatcatggagattgaggaggagaagaagaggacagccaggacagactactggctgcagcctgagatcatcgtgaagatcatcaccaagaagctgggggagaagtaccacaagaagaaggccatcgtgaaggaggtgattgacaagtacacagctgtggtgaagatgattgattctggggacaagctgaagctggaccagacccacctggagaccgtcatcccagcccctgggaagaggatcctggtgctgaatggaggctacagaggaaatgaaggcaccctggagagcatcaatgagaagaccttcagcgccaccatcgtgattgaaacagtgtag

SEQ ID NO: 156988 - DNA, 867 bp, Artificial Sequence
  Description of Artificial Sequence: Synthetic coding sequence
atgaatgccacccagtgggagaccctgacagacttcaccaagtggctgggccgggagggcctgtgcaaggtggatgagacccccaagggctggtacatccagtacatcgaccgggaccctgagaccatccggcggcagctggagctggagaagaagaagaagcaggacctggatgatgaggagaagacagccaagttcatcgaggagcaggtgcggcggggcctggagggcaaggagcaggaggtgcccaccttcacagagctgagcagagaaaatgatgaggagaaggtgaccttcaacctgagcaaaggagcctgcagcagcagcggggccaccagcagcaagagcagcaccctgggccccagcgccctgaagaccatcggcagcagcgcctctgtgaagaggaaggagagcagccagagcagcacccagagcaaggagaagaagaagaagaagagcgccctggatgagatcatggagattgaggaggagaagaagaggacagccaggacagactactggctgcagcctgagatcatcgtgaagatcatcaccaagaagctgggggagaagtaccacaagaagaaggccatcgtgaaggaggtgattgacaagtacacagctgtggtgaagatgattgattctggggacaagctgaagctggaccagacccacctggagaccgtcatcccagcccctgggaagaggatcctggtgctgaatggaggctacagaggaaatgaaggcaccctggagagcatcaatgagaagaccttcagcgccaccatcgtgattgaaacagtgtccctcttcacccagaggcagaagttccagaatgccctgaagatgtgccacagcttcttctag

SEQ ID NO: 156989 - DNA, 2361 bp, Artificial Sequence
  Description of Artificial Sequence: Synthetic coding sequence
atgaatgaggccaaggtgaaggagaccctgcggcgctgtggggccagcggagatgaatgtggccgcctgcagtatgccctgacctgcctgaggaaggtgacaggcctgggcggggagcacaaggaggacagctcctggagcagcctggatgcccggcgggagagcggcagcggccccagcacagacaccctgtctgctgccagcctgccctggcccccaggcagcagccagctgggccgggccggcaacagcgcccagggccccaggagcatctctgtgtctgccctgcctgccagtgacagccccacccccagcttcagcgagggcctgagtgacacctgcatccccctgcacgccagcggccgcctgaccccccgggccctgcacagcttcatcaccccacccaccaccccccagctgcggcggcacaccaagctgaagccacccaggaccccacctccacccagcaggaaggtgttccagctgctgcccagcttccccaccctgaccaggagcaagagccatgagagccagctgggcaacagaattgatgatgtgtcctccatgagatttgacctgagccacggcagcccccagatggtgcggcgggacatcggcctgtctgtgacccaccgcttcagcaccaagtcctggctgagccaggtgtgccacgtgtgccagaagtccatgatcttcggcgtgaagtgcaagcactgccgcctgaagtgccacaacaagtgcaccaaggaggccccagcctgccgcatctccttcctgcccctgacccggctgcggaggacagaatctgtgcccagcgacatcaacaaccctgtggacagagctgctgagccccacttcggcaccctgcccaaggccctgaccaagaaggagcaccccccagccatgaaccacctggacagcagcagcaaccccagcagcaccaccagcagcacccccagcagccctgcccccttccccaccagcagcaaccccagcagcgccaccaccccacccaaccccagccctggccagagggacagccgcttcaacttccctgctgcctacttcatccaccaccggcagcagttcatcttccctgtgcccagcgctggccactgctggaagtgcctgctgattgctgagagcctgaaggaaaatgccttcaacatcagcgcctttgcccacgccgcccccctgcctgaggccgcagatggcacccggctggatgaccagcccaaggcagatgtgctggaggcccacgaggccgaggccgaggagcctgaggccggcaagtctgaggctgaagatgatgaagatgaggtggatgacctgcccagcagccggcggccctggaggggccccatcagcaggaaggccagccagacctctgtgtacctgcaggagtgggacatcccctttgagcaggtggagctgggggagcccatcggccagggccgctggggccgggtgcaccggggccgctggcacggggaggtggccatccggctgctggagatggatggccacaaccaggaccacctgaagctgttcaagaaggaggtgatgaactaccggcagaccaggcatgaaaatgtggtgctcttcatgggcgcctgcatgaaccccccccacctggccatcatcaccagcttctgcaagggccgcaccctgcacagctttgtgcgggaccccaagaccagcctggacatcaacaagacccggcagatcgcccaggagatcatcaagggcatgggctacctgcacgccaagggcatcgtgcacaaggacctgaagagcaagaatgtgttctatgacaacgggaaggtggtgatcacagactttggcctgtttggcatcagcggcgtggtgcgggagggcagaagagagaaccagctgaagctgagccatgactggctgtgctacctggcccctgagatcgtgcgggagatgacccctgggaaggatgaggaccagctgcccttcagcaaggctgctgatgtgtatgccttcggcaccgtgtggtatgagctgcaggcccgggactggcccctgaagaaccaggccgctgaggccagcatctggcagatcggcagcggggagggcatgaagagggtgctgacctctgtgtccctgggcaaggaggtgtctgagatcctgagcgcctgctgggcctttgacctgcaggagcggcccagcttcagcctgctgatggacatgctggagaagctgcccaagctgaacagaaggctgagccaccctggccacttctggaagtctgctgacatcaacagcagcaaggtggtgcccaggtttgagcgcttcggcctgggcgtgctggagagcagcaaccccaagatgtag

SEQ ID NO: 156990 - DNA, 2772 bp, Artificial Sequence
  Description of Artificial Sequence: Synthetic coding sequence
atggaccgggccgccctgcgggctgctgccatgggagagaagaaggagggcggcggcggcggagatgctgctgctgctgagggcggggccggggctgctgccagccgggccctgcagcagtgtggccagctgcagaagctgattgacatcagcatcggcagcctgcggggcctgcggaccaagtgtgctgtgtccaatgacctgacccagcaggagatccgcaccctggaggccaagctggtgcgctacatctgcaagcagaggcagtgcaagctgtctgtggcccctggagagaggaccccagagctgaacagctacccccgcttcagtgactggctgtacaccttcaacgtgcggcctgaggtggtgcaggagatcccccgggacctgaccctggatgccctgctggagatgaatgaggccaaggtgaaggagaccctgcggcgctgtggggccagcggagatgaatgtggccgcctgcagtatgccctgacctgcctgaggaaggtgacaggcctgggcggggagcacaaggaggacagctcctggagcagcctggatgcccggcgggagagcggcagcggccccagcacagacaccctgtctgctgccagcctgccctggcccccaggcagcagccagctgggccgggccggcaacagcgcccagggccccaggagcatctctgtgtctgccctgcctgccagtgacagccccacccccagcttcagcgagggcctgagtgacacctgcatccccctgcacgccagcggccgcctgaccccccgggccctgcacagcttcatcaccccacccaccaccccccagctgcggcggcacaccaagctgaagccacccaggaccccacctccacccagcaggaaggtgttccagctgctgcccagcttccccaccctgaccaggagcaagagccatgagagccagctgggcaacagaattgatgatgtgtcctccatgagatttgacctgagccacggcagcccccagatggtgagaagagacatcggcctgtctgtgacccaccgcttcagcaccaagtcctggctgagccaggtgtgccacgtgtgccagaagtccatgatctttggagtgaagtgcaagcactgccgcctgaagtgccacaacaagtgcaccaaggaggccccagcctgccgcatctccttcctgcccctgacccggctgcggaggacagagagcgtgcccagcgacatcaacaaccctgtggacagagctgctgagccccacttcggcaccctgcccaaggccctgaccaagaaggagcaccccccagccatgaaccacctggacagcagcagcaaccccagcagcaccaccagcagcacccccagcagccctgcccccttccccaccagcagcaaccccagcagcgccaccaccccacccaaccccagccctggccagagggacagccgcttcaacttccctgctgcctacttcatccaccaccggcagcagttcatcttccctgtgcccagcgctggccactgctggaagtgcctgctgattgctgagagcctgaaggaaaatgccttcaacatcagcgcctttgcccatgctgcccccctgcctgaggccgcagatggcacccggctggatgaccagcccaaggcagatgtgctggaggcccatgaagctgaggccgaggagcctgaggccggcaagtctgaggccgaggatgatgaagatgaggtggatgacctgcccagcagcagaagaccctggaggggccccatcagcaggaaggccagccagacctctgtgtacctgcaggagtgggacatcccctttgagcaggtggagctgggggagcccatcggccagggccgctggggccgggtgcaccggggccgctggcatggagaggtggccatccggctgctggagatggatggccacaaccaggaccacctgaagctgttcaagaaggaggtgatgaactaccggcagaccaggcatgaaaatgtggtgctcttcatgggcgcctgcatgaaccccccccacctggccatcatcaccagcttctgcaagggccgcaccctgcacagctttgtgcgggaccccaagaccagcctggacatcaacaagacccggcagatcgcccaggagatcatcaagggcatgggctacctgcacgccaagggcatcgtgcacaaggacctgaagagcaagaatgtgttctatgacaatggcaaggtggtgatcacagactttggcctgtttggcatctctggagtggtgcgggagggccggcgggagaaccagctgaagctgagccatgactggctgtgctacctggcccctgagatcgtgcgggagatgaccccaggcaaggatgaggaccagctgcccttcagcaaggccgcagatgtgtatgcctttggaacagtgtggtatgagctgcaggcccgggactggcccctgaagaaccaggccgctgaggccagcatctggcagatcggcagcggggagggcatgaagagggtgctgacctctgtgtccctgggcaaggaggtgtctgagatcctgagcgcctgctgggcctttgacctgcaggagcggcccagcttcagcctgctgatggacatgctggagaagctgcccaagctgaacagaaggctgagccaccctggccacttctggaagtctgctgacatcaacagcagcaaggtggtgcccaggtttgaaagatttggcctgggcgtgctggagagcagcaaccccaagatgtag

SEQ ID NO: 156991 - DNA, 2289 bp, Artificial Sequence
  Description of Artificial Sequence: Synthetic coding sequence
atgaatgaggccaaggtgaaggagaccctgcggcgctgtggggccagcggagatgaatgtggccgcctgcagtatgccctgacctgcctgaggaaggtgacaggcctgggcggggagcacaaggaggacagctcctggagcagcctggatgcccggcgggagagcggcagcggccccagcacagacaccctgtctgctgccagcctgccctggcccccaggcagcagccagctgggccgggccggcaacagcgcccagggccccaggagcatctctgtgtctgccctgcctgccagtgacagccccacccccagcttcagcgagggcctgagtgacacctgcatccccctgcacgccagcggccgcctgaccccccgggccctgcacagcttcatcaccccacccaccaccccccagctgcggcggcacaccaagctgaagccacccaggaccccacctccacccagcaggaaggtgttccagctgctgcccagcttccccaccctgaccaggagcaagagccatgagagccagctgggcaacagaattgatgatgtgtcctccatgagatttgacctgagccacggcagcccccagatggtgcggcgggacatcggcctgtctgtgacccaccgcttcagcaccaagtcctggctgagccaggtgtgccacgtgtgccagaagtccatgatcttcggcgtgaagtgcaagcactgccgcctgaagtgccacaacaagtgcaccaaggaggccccagcctgccgcatctccttcctgcccctgacccggctgcggaggacagaatctgtgcccagcgacatcaacaaccctgtggacagagctgctgagccccacttcggcaccctgcccaaggccctgaccaagaaggagcaccccccagccatgaaccacctggacagcagcagcaaccccagcagcaccaccagcagcacccccagcagccctgcccccttccccaccagcagcaaccccagcagcgccaccaccccacccaaccccagccctggccagagggacagccgcttcaacttccctgctgcctacttcatccaccaccggcagcagttcatcttccctgtgcccagcgctggccactgctggaagtgcctgctgattgctgagagcctgaaggaaaatgccttcaacatcagcgcctttgcccacgccgcccccctgcctgaggccgcagatggcacccggctggatgaccagcccaaggcagatgtgctggaggcccacgaggccgaggccgaggagcctgaggccggcaagtctgaggctgaagatgatgaagatgaggtggatgacctgcccagcagccggcggccctggaggggccccatcagcaggaaggccagccagacctctgtgtacctgcaggagtgggacatcccctttgagcaggtggagctgggggagcccatcggccagggccgctggggccgggtgcaccggggccgctggcacggggaggtggccatccggctgctggagatggatggccacaaccaggaccacctgaagctgttcaagaaggaggtgatgaactaccggcagaccaggcatgaaaatgtggtgctcttcatgggcgcctgcatgaaccccccccacctggccatcatcaccagcttctgcaagggccgcaccctgcacagctttgtgcgggaccccaagaccagcctggacatcaacaagacccggcagatcgcccaggagatcatcaagggcatgggctacctgcacgccaagggcatcgtgcacaaggacctgaagagcaagaatgtgttctatgacaacgggaaggtggtgatcacagactttggcctgtttggcatcagcggcgtggtgcgggagggcagaagagagaaccagctgaagctgagccatgactggctgtgctacctggcccctgagatcgtgcgggagatgacccctgggaaggatgaggaccagctgcccttcagcaaggctgctgatgtgtatgccttcggcaccgtgtggtatgagctgcaggcccgggactggcccctgaagaaccaggccgctgaggccagcatctggcagatcggcagcggggagggcatgaagagggtgctgacctctgtgtccctgggcaaggaggtgtctgagatcctgagcgcctgctgggcctttgacctgcaggagcggcccagcttcagcctgctgatggacatgctggagaagctgcccaagctgaacagaaggctgagccaccctggccacttctggaagtctgctgagctgtag

SEQ ID NO: 156992 - DNA, 375 bp, Artificial Sequence
  Description of Artificial Sequence: Synthetic coding sequence
atgcaggccgacctggagatcccccgggacctgaccctggatgccctgctggagatgaatgaggccaaggtgaaggagaccctgcggcgctgtggggccagcggagatgaatgtggccgcctgcagtatgccctgacctgcctgaggaaggtgacaggcctgggcacctggggcctgccccccagccccctgcccggcctggtgcccctgggcctgtggcccagcctgtggtgggtgatggagcggggcaagaggggccctggcttcctgggccagcccgggaaggcccgggtgggctgcagccagcccccagagaagctgagccagggcccccagggcagcggctcctggtgggtgtggccaggccgcatctag

SEQ ID NO: 156993 - DNA, 1842 bp, Artificial Sequence
  Description of Artificial Sequence: Synthetic coding sequence
tgacattccttcatcaccccacccaccaccccccagctgcggcggcacaccaagctgaagccacccaggaccccacctccacccagcaggaaggtgttccagctgctgcccagcttccccaccctgaccaggagcaagagccatgagagccagctgggcaacagaattgatgatgtgtcctccatgagatttgacctgagccacggcagcccccagatggtgagaagagacatcggcctgtctgtgacccaccgcttcagcaccaagtcctggctgagccaggtgtgccacgtgtgccagaagtccatgatctttggagtgaagtgcaagcactgccgcctgaagtgccacaacaagtgcaccaaggaggccccagcctgccgcatctccttcctgcccctgacccggctgcggaggacagagagcgtgcccagcgacatcaacaaccctgtggacagagctgctgagccccacttcggcaccctgcccaaggccctgaccaagaaggagcaccccccagccatgaaccacctggacagcagcagcaaccccagcagcaccaccagcagcacccccagcagccctgcccccttccccaccagcagcaaccccagcagcgccaccaccccacccaaccccagccctggccagagggacagccgcttcaacttccctgctgcctacttcatccaccaccggcagcagttcatcttcccagacatcagcgcctttgcccatgctgcccccctgcctgaggccgcagatggcacccggctggatgaccagcccaaggcagatgtgctggaggcccatgaagctgaggccgaggagcctgaggccggcaagtctgaggccgaggatgatgaagatgaggtggatgacctgcccagcagcagaagaccctggaggggccccatcagcaggaaggccagccagacctctgtgtacctgcaggagtgggacatcccctttgagcaggtggagctgggggagcccatcggccagggccgctggggccgggtgcaccggggccgctggcatggagaggtggccatccggctgctggagatggatggccacaaccaggaccacctgaagctgttcaagaaggaggtgatgaactaccggcagaccaggcatgaaaatgtggtgctcttcatgggcgcctgcatgaaccccccccacctggccatcatcaccagcttctgcaagggccgcaccctgcacagctttgtgcgggaccccaagaccagcctggacatcaacaagacccggcagatcgcccaggagatcatcaagggcatgggctacctgcacgccaagggcatcgtgcacaaggacctgaagagcaagaatgtgttctatgacaatggcaaggtggtgatcacagactttggcctgtttggcatctctggagtggtgcgggagggccggcgggagaaccagctgaagctgagccatgactggctgtgctacctggcccctgagatcgtgcgggagatgaccccaggcaaggatgaggaccagctgcccttcagcaaggccgcagatgtgtatgcctttggaacagtgtggtatgagctgcaggcccgggactggcccctgaagaaccaggccgctgaggccagcatctggcagatcggcagcggggagggcatgaagagggtgctgacctctgtgtccctgggcaaggaggtgtctgagatcctgagcgcctgctgggcctttgacctgcaggagcggcccagcttcagcctgctgatggacatgctggagaagctgcccaagctgaacagaaggctgagccaccctggccacttctggaagtctgctgagctgtag

SEQ ID NO: 156994 - DNA, 2634 bp, Artificial Sequence
  Description of Artificial Sequence: Synthetic coding sequence
atggaccgggccgccctgcgggctgctgccatgggagagaagaaggagggcggcggcggcggagatgctgctgctgctgagggcggggccggggctgctgccagccgggccctgcagcagtgtggccagctgcagaagctgattgacatcagcatcggcagcctgcggggcctgcggaccaagtgtgctgtgtccaatgacctgacccagcaggagatccgcaccctggaggccaagctggtgcgctacatctgcaagcagaggcagtgcaagctgtctgtggcccctggagagaggaccccagagctgaacagctacccccgcttcagtgactggctgtacaccttcaacgtgcggcctgaggtggtgcaggagatcccccgggacctgaccctggatgccctgctggagatgaatgaggccaaggtgaaggagaccctgcggcgctgtggggccagcggagatgaatgtggccgcctgcagtatgccctgacctgcctgaggaaggtgacaggcctgggcggggagcacaaggaggacagctcctggagcagcctggatgcccggcgggagagcggcagcggccccagcacagacaccctgtctgctgccagcctgccctggcccccaggcagcagccagctgggccgggccggcaacagcgcccagggccccaggagcatctctgtgtctgccctgcctgccagtgacagccccacccccagcttcagcgagggcctgagtgacacctgcatccccctgcacgccagcggccgcctgaccccccgggccctgcacagcttcatcaccccacccaccaccccccagctgcggcggcacaccaagctgaagccacccaggaccccacctccacccagcaggaaggtgttccagctgctgcccagcttccccaccctgaccaggagcaagagccatgagagccagctgggcaacagaattgatgatgtgtcctccatgagatttgacctgagccacggcagcccccagatggtgagaagagacatcggcctgtctgtgacccaccgcttcagcaccaagtcctggctgagccaggtgtgccacgtgtgccagaagtccatgatctttggagtgaagtgcaagcactgccgcctgaagtgccacaacaagtgcaccaaggaggccccagcctgccgcatctccttcctgcccctgacccggctgcggaggacagagagcgtgcccagcgacatcaacaaccctgtggacagagctgctgagccccacttcggcaccctgcccaaggccctgaccaagaaggagcaccccccagccatgaaccacctggacagcagcagcaaccccagcagcaccaccagcagcacccccagcagccctgcccccttccccaccagcagcaaccccagcagcgccaccaccccacccaaccccagccctggccagagggacagccgcttcaacttccctgctgcctacttcatccaccaccggcagcagttcatcttcccagacatcagcgcctttgcccatgctgcccccctgcctgaggccgcagatggcacccggctggatgaccagcccaaggcagatgtgctggaggcccatgaagctgaggccgaggagcctgaggccggcaagtctgaggccgaggatgatgaagatgaggtggatgacctgcccagcagcagaagaccctggaggggccccatcagcaggaaggccagccagacctctgtgtacctgcaggagtgggacatcccctttgagcaggtggagctgggggagcccatcggccagggccgctggggccgggtgcaccggggccgctggcatggagaggtggccatccggctgctggagatggatggccacaaccaggaccacctgaagctgttcaagaaggaggtgatgaactaccggcagaccaggcatgaaaatgtggtgctcttcatgggcgcctgcatgaaccccccccacctggccatcatcaccagcttctgcaagggccgcaccctgcacagctttgtgcgggaccccaagaccagcctggacatcaacaagacccggcagatcgcccaggagatcatcaagggcatgggctacctgcacgccaagggcatcgtgcacaaggacctgaagagcaagaatgtgttctatgacaatggcaaggtggtgatcacagactttggcctgtttggcatctctggagtggtgcgggagggccggcgggagaaccagctgaagctgagccatgactggctgtgctacctggcccctgagatcgtgcgggagatgaccccaggcaaggatgaggaccagctgcccttcagcaaggccgcagatgtgtatgcctttggaacagtgtggtatgagctgcaggcccgggactggcccctgaagaaccaggccgctgaggccagcatctggcagatcggcagcggggagggcatgaagagggtgctgacctctgtgtccctgggcaaggaggtgtctgagatcctgagcgcctgctgggcctttgacctgcaggagcggcccagcttcagcctgctgatggacatgctggagaagctgcccaagctgaacagaaggctgagccaccctggccacttctggaagtctgctgagctgtag

SEQ ID NO: 156995 - DNA, 1311 bp, Artificial Sequence
  Description of Artificial Sequence: Synthetic coding sequence
atgtacaacaagaaggccaagatggagcccaatgccagcgagagcgccatcccagcccggcggcagaggcagccccgggccaagaagaagagcaagcccctgaacctgaagatccacagctctgtgggcagctgtgagaacatccccagccagcagaggagccccctgctgtctgagaggagcctgcggagcttctttgtgggccacgcccccttcctgcccagcaccccacctgtgcacacagaggccaacttcagcgccaacaccctgtctgtgccccgctggagcccccagatcccccggcgggacctgggcaacagcatcaagcaccgcttcagcaccaagtactggatgagccagacctgcaccgtgtgtgggaagggcatgctgtttggcctgaagtgcaagaactgcaagctgaagtgccacaacaagtgcaccaaggaggccccaccctgccacctgctgatcatccacagaggagaccctgcccggctggtgaggacagaatctgtgccctgtgacatcaacaaccccctgaggaagcccccacgctacagcgacctgcacatcagccagaccctgcccaagaccaacaagatcaacaaggaccacatccctgtgccctaccagcctgacagcagcagcaaccccagcagcaccaccagcagcacccccagcagccctgccccacccctgccccccagcgccaccccacccagccccctgcaccccagcccccagtgcacccggcagcagaagaacttcaacctgcctgccagccactactacaagtacaagcagcagttcatcttcccagatgtggtgcctgtgcctgagacccccacccgggccccccaggtgatcctgcaccctgtgaccagcaaccccatcctggagggcaaccccctgctgcagatcgaggtggagcccaccagtgaaaatgaggaggtgcatgatgaggccgaggagagtgaagatgactttgaggagatgaacctgagcctgctgagcgcccgctccttccccaggaaggccagccagaccagcatcttcctgcaggagtgggacatcccctttgagcagctggagattggagagctgattggcaagggccgcttcggccaggtgtaccacggccgctggcatggagaggtggccatccggctgattgatattgagcgggacaatgaagaccagctgaaggccttcaagcgggaggtgatggcctaccggcagaccaggcatgaaaatgtggtgctcttcatgggcgcctgcatgagccccccccacctggccatcatcacctag

SEQ ID NO: 156996 - DNA, 2853 bp, Artificial Sequence
  Description of Artificial Sequence: Synthetic coding sequence
atggatgaggagaacatgaccaagtctgaggagcagcagcccctgagcctgcagaaggccctgcagcagtgtgagctggtgcagaacatgattgacctgagcatcagcaacctggagggcctgcggaccaagtgtgccaccagcaatgacctgacccagaaggagatccgcaccctggagagcaagctggtgaagtacttcagccggcagctgagctgcaagaagaaggtggccctgcaggagagaaatgctgagctggatggcttcccccagctgcggcactggttccgcatcgtggatgtgaggaaggaggtgctggaggagatcagccctggccagctgagcctggaggacctgctggagatgacagatgagcaggtgtgtgagaccgtggagaagtacggggccaaccgggaggagtgtgcccggctgaatgccagcctgagctgcctgagaaatgtgcacatgtctgggggcaacctgagcaagcaggactggaccatccagtggcccaccacagaaacaggcaaggagaacaaccctgtgtgccccccagagcccaccccctggatccgcacccacctgagccagagcccccgggtgcccagcaaatgtgtgcagcactactgccacaccagccccacccctggggcccctgtgtacacccacgtggaccggctgactgtggatgcctacccaggcctgtgccccccaccacccctggagagcggccacaggagcctgccccccagcccccggcagagacatgctgtgaggaccccacccaggacccccaacatcgtgaccaccgtgaccccacctggcaccccacccatgaggaagaagaacaagctgaagcccccaggcaccccaccacccagcagcaggaagctgatccacctgatccctggcttcaccgccctgcacaggagcaagagccatgagttccagctgggccaccgggtggatgaggcccacacccccaaggccaagaagaagagcaagcccctgaacctgaagatccacagctctgtgggcagctgtgagaacatccccagccagcagaggagccccctgctgtctgagaggagcctgcgctccttctttgtgggccacgcccccttcctgcccagcaccccacctgtgcacacagaggccaacttcagcgccaacaccctgtctgtgccccgctggagcccccagatcccccggcgggacctgggcaacagcatcaagcaccgcttcagcaccaagtactggatgagccagacctgcaccgtgtgtgggaagggcatgctgtttggcctgaagtgcaagaactgcaagctgaagtgccacaacaagtgcaccaaggaggccccaccctgccacctgctgatcatccacagaggagaccctgcccggctggtgaggacagagagcgtgccctgtgacatcaacaaccccctgaggaagccaccccgctacagcgacctgcacatcagccagaccctgcccaagaccaacaagatcaacaaggaccacatccctgtgccctaccagcctgacagcagcagcaaccccagcagcaccaccagcagcacccccagcagccctgccccacccctgcccccatctgccaccccacccagccccctgcaccccagcccccagtgcacccggcagcagaagaacttcaacctgcctgccagccactactacaagtacaagcagcagttcatcttcccagatgtggtgcctgtgcctgagacccccacccgggccccccaggtgatcctgcaccctgtgaccagcaaccccatcctggagggcaaccccctgctgcagatcgaggtggagcccaccagtgaaaatgaggaggtgcatgatgaagctgaggagagtgaagatgactttgaggagatgaacctgagcctgctgagcgcccggagcttccccaggaaggccagccagaccagcatcttcctgcaggagtgggacatcccctttgagcagctggagatcggggagctgattggcaagggccgcttcggccaggtgtaccacggccgctggcacggggaggtggccatccggctgattgacatcgagcgggacaatgaagaccagctgaaggccttcaagcgggaggtgatggcctaccggcagaccaggcatgaaaatgtggtgctcttcatgggcgcctgcatgagccccccccacctggccatcatcaccagcctgtgcaagggccgcaccctgtacagcgtggtgagagatgccaagatcgtgctggatgtgaacaagacccggcagatcgcccaggagatcgtgaagggcatgggctacctgcacgccaagggcatcctgcacaaggacctgaagagcaagaatgtgttctatgacaacgggaaggtggtgatcacagactttggcctcttcagcatcagcggcgtgctgcaggccggcagaagagaggacaagctgcgcatccagaatggctggctgtgccacctggcccctgagatcatccggcagctgagcccagacacagaggaggacaagctgcccttcagcaagcacagtgatgtgtttgccctgggcaccatctggtatgagctgcacgcccgggagtggcccttcaagacccagcctgctgaggccatcatctggcagatgggcaccggcatgaagcccaacctgagccagatcggcatgggcaaggagatcagtgacatcctgctcttctgctgggcctttgagcaggaggagcggcccaccttcaccaagctgatggacatgctggagaagctgcccaagaggaacagaaggctgagccaccctggccacttctggaagtctgctgagctgtag

SEQ ID NO: 156997 - DNA, 2766 bp, Artificial Sequence
  Description of Artificial Sequence: Synthetic coding sequence
atgattgacctgagcatcagcaacctggagggcctgcggaccaagtgtgccaccagcaatgacctgacccagaaggagatccgcaccctggagagcaagctggtgaagtacttcagccggcagctgagctgcaagaagaaggtggccctgcaggagagaaatgctgagctggatggcttcccccagctgcggcactggttcagaattgtggatgtgaggaaggaggtgctggaggagatcagccctggccagctgagcctggaggacctgctggagatgacagatgagcaggtgtgtgaaacagtggagaagtatggagccaaccgggaggagtgtgcccggctgaatgccagcctgagctgcctgagaaatgtgcacatgtctgggggcaacctgagcaagcaggactggaccatccagtggcccaccacagagaccgggaaggagaacaaccctgtgtgccccccagagcccaccccctggatccgcacccacctgagccagagcccccgggtgcccagcaaatgtgtgcagcactactgccacaccagccccacccctggggcccctgtgtacacccacgtggaccggctgactgtggatgcctacccaggcctgtgccccccaccacccctggagagcggccacaggagcctgccccccagcccccggcagagacatgctgtgaggaccccacccaggacccccaacatcgtgaccaccgtgaccccacctggcaccccacccatgaggaagaagaacaagctgaagcccccaggcaccccaccacccagcagcaggaagctgatccacctgatccctggcttcaccgccctgcacaggagcaagagccatgagttccagctgggccaccgggtggatgaggcccacacccccaaggccaagaagaagagcaagcccctgaacctgaagatccacagctctgtgggcagctgtgagaacatccccagccagcagaggagccccctgctgtctgagaggagcctgcggagcttctttgtgggccacgcccccttcctgcccagcaccccacctgtgcacacagaggccaacttcagcgccaacaccctgtctgtgccccgctggagcccccagatcccccggcgggacctgggcaacagcatcaagcaccgcttcagcaccaagtactggatgagccagacctgcaccgtgtgtgggaagggcatgctgtttggcctgaagtgcaagaactgcaagctgaagtgccacaacaagtgcaccaaggaggccccaccctgccacctgctgatcatccacagaggagaccctgcccggctggtgaggacagaatctgtgccctgtgacatcaacaaccccctgaggaagcccccacgctacagcgacctgcacatcagccagaccctgcccaagaccaacaagatcaacaaggaccacatccctgtgccctaccagcctgacagcagcagcaaccccagcagcaccaccagcagcacccccagcagccctgccccacccctgccccccagcgccaccccacccagccccctgcaccccagcccccagtgcacccggcagcagaagaacttcaacctgcctgccagccactactacaagtacaagcagcagttcatcttcccagatgtggtgcctgtgcctgagacccccacccgggccccccaggtgatcctgcaccctgtgaccagcaaccccatcctggagggcaaccccctgctgcagatcgaggtggagcccaccagtgaaaatgaggaggtgcatgatgaggccgaggagagtgaagatgactttgaggagatgaacctgagcctgctgagcgcccgctccttccccaggaaggccagccagaccagcatcttcctgcaggagtgggacatcccctttgagcagctggagattggagagctgattggcaagggccgcttcggccaggtgtaccacggccgctggcatggagaggtggccatccggctgattgatattgagcgggacaatgaagaccagctgaaggccttcaagcgggaggtgatggcctaccggcagaccaggcatgaaaatgtggtgctcttcatgggcgcctgcatgagccccccccacctggccatcatcaccagcctgtgcaagggccgcaccctgtacagcgtggtgagagatgccaagatcgtgctggatgtgaacaagacccggcagatcgcccaggagatcgtgaagggcatgggctacctgcacgccaagggcatcctgcacaaggacctgaagagcaagaatgtgttctatgacaatggcaaggtggtgatcacagactttggcctcttcagcatctctggagtgctgcaggccggccggcgggaggacaagctgcgcatccagaatggctggctgtgccacctggcccctgagatcatccggcagctgagcccagacacagaggaggacaagctgcccttcagcaagcacagtgatgtgtttgccctgggcaccatctggtatgagctgcacgcccgggagtggcccttcaagacccagcctgctgaggccatcatctggcagatgggcaccggcatgaagcccaacctgagccagatcggcatgggcaaggagatcagtgacatcctgctcttctgctgggcctttgagcaggaggagcggcccaccttcaccaagctgatggacatgctggagaagctgcccaagaggaacagaaggctgagccaccctggccacttctggaagtctgctgagctgtag

SEQ ID NO: 156998 - DNA, 1245 bp, Artificial Sequence
  Description of Artificial Sequence: Synthetic coding sequence
cgggccaagaagaagagcaagcccctgaacctgaagatccacagctctgtgggcagctgtgagaacatccccagccagcagaggagccccctgctgtctgagaggagcctgcgctccttctttgtgggccacgcccccttcctgcccagcaccccacctgtgcacacagaggccaacttcagcgccaacaccctgtctgtgccccgctggagcccccagatcccccggcgggacctgggcaacagcatcaagcaccgcttcagcaccaagtactggatgagccagacctgcaccgtgtgtgggaagggcatgctgtttggcctgaagtgcaagaactgcaagctgaagtgccacaacaagtgcaccaaggaggccccaccctgccacctgctgatcatccacagaggagaccctgcccggctggtgaggacagagagcgtgccctgtgacatcaacaaccccctgaggaagccaccccgctacagcgacctgcacatcagccagaccctgcccaagaccaacaagatcaacaaggaccacatccctgtgccctaccagcctgacagcagcagcaaccccagcagcaccaccagcagcacccccagcagccctgccccacccctgcccccatctgccaccccacccagccccctgcaccccagcccccagtgcacccggcagcagaagaacttcaacctgcctgccagccactactacaagtacaagcagcagttcatcttcccagatgtggtgcctgtgcctgagacccccacccgggccccccaggtgatcctgcaccctgtgaccagcaaccccatcctggagggcaaccccctgctgcagatcgaggtggagcccaccagtgaaaatgaggaggtgcatgatgaagctgaggagagtgaagatgactttgaggagatgaacctgagcctgctgagcgcccggagcttccccaggaaggccagccagaccagcatcttcctgcaggagtgggacatcccctttgagcagctggagatcggggagctgattggcaagggccgcttcggccaggtgtaccacggccgctggcacggggaggtggccatccggctgattgacatcgagcgggacaatgaagaccagctgaaggccttcaagcgggaggtgatggcctaccggcagaccaggcatgaaaatgtggtgctcttcatgggcgcctgcatgagccccccccacctggccatcatcaccaggcctgtgtag

SEQ ID NO: 156999 - DNA, 3921 bp, Artificial Sequence
  Description of Artificial Sequence: Synthetic coding sequence
atggagttctatgagagcgcctacttcatcgtgctgatccccagcatcgtcatcaccgtcatcttcctgttcttctggctgttcatgaaggagaccctgtatgatgaggtgctggccaagcagaagcgggagcagaagctgatccccaccaagacagacaagaagaaggccgagaagaagaagaacaagaagaaggagatccagaatggaaacctgcatgaaagtgacagcgagagcgtgccccgggacttcaagctgagtgatgccctggccgtggaggatgaccaggtggcccctgtgcccctgaatgtggtggagaccagcagctctgtgcgggagaggaagaagaaggagaagaagcagaagcctgtgctggaggagcaggtgatcaaggagagtgatgccagcaagatccctgggaagaaggtggagcctgtgcctgtgaccaagcagcccaccccacccagcgaggccgccgccagcaagaagaagccaggccagaagaagagcaagaatggaagtgatgaccaggacaagaaggtggagaccctgatggtgcccagcaagaggcaggaggccctgcccctgcaccaggagaccaagcaggagagcggcagcggcaagaagaaggccagcagcaagaagcagaagacagaaaatgtgtttgtggatgagcccctcatccacgccaccacctacatccccctgatggacaatgctgacagcagccctgtggtggacaagcgggaggtgattgacctgctgaagccagaccaggtggagggcatccagaagagcggcaccaagaagctgaagacagaaacagacaaggaaaatgctgaggtgaagttcaaggacttcctgctgagcctgaagaccatgatgttttctgaagatgaggccctgtgtgtggtggacctgctgaaggagaagagcggggtcatccaggatgccctgaagaagagcagcaagggggagctgaccaccctcatccaccagctgcaggagaaggacaagctgctggccgctgtgaaggaggatgctgctgccaccaaggaccgctgcaagcagctgacccaggagatgatgacagagaaggagaggagcaatgtggtgatcaccaggatgaaggaccgcatcggcaccctggagaaggagcacaacgtgttccagaacaagatccacgtgtcctaccaggagacccagcagatgcagatgaagttccagcaggtgcgggagcagatggaggccgagatcgcccacctgaagcaggagaatggcatcctgagagatgctgtgagcaacaccaccaaccagctggagagcaagcagagcgctgagctgaacaagctgcggcaggactatgcccggctggtgaatgagctgacagagaagacaggcaagctgcagcaggaggaggtgcagaagaagaatgctgagcaggccgccacccagctgaaggtgcagctgcaggaggccgagcggcgctgggaggaggtgcagagctacatcaggaagaggacagctgagcatgaagctgcccagcaggacctgcagagcaagtttgtggccaaggaaaatgaggtgcagagcctgcacagcaagctgacagacaccctggtgtccaagcagcagctggagcagaggctgatgcagctgatggagagcgagcagaagagggtgaacaaggaggagagcctgcagatgcaggtgcaggacatcctggagcagaatgaggccctgaaggcccagatccagcagttccacagccagattgctgcccagaccagcgcctctgtgctggccgaggagctgcacaaggtgattgctgagaaggacaagcagatcaagcagacagaggacagcctggccagcgagcgggaccggctgaccagcaaggaggaggagctgaaggacatccagaacatgaacttcctgctgaaggccgaggtgcagaagctgcaggccctggccaatgagcaggccgccgccgcccacgagctggagaagatgcagcagagcgtgtatgtgaaggatgacaagatccggctgctggaggagcagctgcagcacgagatcagcaacaagatggaggagttcaagatcctgaatgaccagaacaaggccctgaagtctgaggtgcagaagctgcagaccctggtgtctgagcagcccaacaaggatgtggtggagcagatggagaagtgcatccaggagaaggatgagaagctgaagacagtggaggagctgctggagaccggcctcatccaggtggccaccaaggaggaggagctgaatgccatcagaacagagaacagcagcctgaccaaggaggtgcaggacctgaaggccaagcagaatgaccaggtgtcctttgccagcctggtggaggagctgaagaaggtgatccacgagaaggatggcaagatcaagtctgtggaggagctgctggaggccgagctgctgaaggtggccaacaaggagaagacagtgcagctgagcatcaccagcaaggtgcaggagctgcagaacctgctgaagggcaaggaggagcagatgaacaccatgaaggctgtgctggaggagaaggagaaggacctggccaacacaggcaagtggctgcaggacctgcaggaggagaatgaaagcctgaaggcccacgtgcaggaggtggcccagcacaacctgaaggaggccagcagcgccagccagtttgaggagctggagatcgtgctgaaggagaaggaaaatgagctgaagaggctggaggccatgctgaaggagcgggagagtgacctgagcagcaagacccagctgctgcaggatgtgcaggatgagaacaagctgttcaagagccagatcgagcagctgaagcagcagaactaccagcaggccagcagcttcccccctcatgaggagctgctgaaggtgatcagcgagcgggagaaggagatcagcggcctgtggaatgagctggacagcctgaaggatgctgtggagcaccagaggaagaagaacaatgacctgcgggagaagaactgggaggccatggaggccctggccagcacagagaagatgctgcaggacaaggtgaacaagaccagcaaggagcggcagcagcaggtggaggccgtggagctggaggccaaggaggtgctgaagaagctgttccccaaggtgtctgtgcccagcaacctgtcctatggagagtggctgcacggctttgagaagaaggccaaggagtgcatggccggcaccagcggcagcgaggaggtgaaggtgctggagcacaagctgaaggaggctgatgagatgcacaccctgctgcagctggagtgtgagaagtacaagtctgtgctggccgagacagagggcatcctgcagaagctgcagaggtctgtggagcaggaggagaacaagtggaaggtgaaggtggatgagagccacaagaccatcaagcagatgcagagcagcttcaccagcagcgagcaggagctggagcggctgcggtctgagaacaaggacatcgagaacctgcggcgggagcgggagcacctggagatggagctggagaaggccgagatggagaggagcacctacgtgacagaggtgcgggagctgaaggcccagctgaatgagaccctgaccaagctgaggacagagcagaatgaaaggcagaaggtggccggggacctgcacaaggcccagcagagcctggagctgatccagagcaagatcgtgaaggccgccggggacaccaccgtgattgaaaattctgatgtgtccccagagacagagagcagcgagaaggagaccatgtctgtgtccctgaaccagacagtgacccagctgcagcagctgctgcaggccgtgaaccagcagctgaccaaggagaaggagcactaccaggtgctggagtag

SEQ ID NO: 157000 - DNA, 4074 bp, Artificial Sequence
  Description of Artificial Sequence: Synthetic coding sequence
atggagttctatgagagcgcctacttcatcgtgctgatccccagcatcgtcatcaccgtcatcttcctgttcttctggctgttcatgaaggagaccctgtatgatgaggtgctggccaagcagaagcgggagcagaagctgatccccaccaagacagacaagaagaaggccgagaagaagaagaacaagaagaaggagatccagaatggaaacctgcatgaaagtgacagcgagagcgtgccccgggacttcaagctgagtgatgccctggccgtggaggatgaccaggtggcccctgtgcccctgaatgtggtggagaccagcagctctgtgcgggagaggaagaagaaggagaagaagcagaagcctgtgctggaggagcaggtgatcaaggagagtgatgccagcaagatccctgggaagaaggtggagcctgtgcctgtgaccaagcagcccaccccacccagcgaggccgccgccagcaagaagaagccaggccagaagaagagcaagaatggaagtgatgaccaggacaagaaggtggagaccctgatggtgcccagcaagaggcaggaggccctgcccctgcaccaggagaccaagcaggagagcggcagcggcaagaagaaggccagcagcaagaagcagaagacagaaaatgtgtttgtggatgagcccctcatccacgccaccacctacatccccctgatggacaatgctgacagcagccctgtggtggacaagcgggaggtgattgacctgctgaagccagaccaggtggagggcatccagaagagcggcaccaagaagctgaagacagaaacagacaaggaaaatgctgaggtgaagttcaaggacttcctgctgagcctgaagaccatgatgttttctgaagatgaggccctgtgtgtggtggacctgctgaaggagaagagcggggtcatccaggatgccctgaagaagagcagcaagggggagctgaccaccctcatccaccagctgcaggagaaggacaagctgctggccgctgtgaaggaggatgctgctgccaccaaggaccgctgcaagcagctgacccaggagatgatgacagagaaggagaggagcaatgtggtgatcaccaggatgaaggaccgcatcggcaccctggagaaggagcacaacgtgttccagaacaagatccacgtgtcctaccaggagacccagcagatgcagatgaagttccagcaggtgcgggagcagatggaggccgagatcgcccacctgaagcaggagaatggcatcctgagagatgctgtgagcaacaccaccaaccagctggagagcaagcagagcgctgagctgaacaagctgcggcaggactatgcccggctggtgaatgagctgacagagaagacaggcaagctgcagcaggaggaggtgcagaagaagaatgctgagcaggccgccacccagctgaaggtgcagctgcaggaggccgagcggcgctgggaggaggtgcagagctacatcaggaagaggacagctgagcatgaagctgcccagcaggacctgcagagcaagtttgtggccaaggaaaatgaggtgcagagcctgcacagcaagctgacagacaccctggtgtccaagcagcagctggagcagaggctgatgcagctgatggagagcgagcagaagagggtgaacaaggaggagagcctgcagatgcaggtgcaggacatcctggagcagaatgaggccctgaaggcccagatccagcagttccacagccagattgctgcccagaccagcgcctctgtgctggccgaggagctgcacaaggtgattgctgagaaggacaagcagatcaagcagacagaggacagcctggccagcgagcgggaccggctgaccagcaaggaggaggagctgaaggacatccagaacatgaacttcctgctgaaggccgaggtgcagaagctgcaggccctggccaatgagcaggccgccgccgcccacgagctggagaagatgcagcagagcgtgtatgtgaaggatgacaagatccggctgctggaggagcagctgcagcacgagatcagcaacaagatggaggagttcaagatcctgaatgaccagaacaaggccctgaagtctgaggtgcagaagctgcagaccctggtgtctgagcagcccaacaaggatgtggtggagcagatggagaagtgcatccaggagaaggatgagaagctgaagacagtggaggagctgctggagaccggcctcatccaggtggccaccaaggaggaggagctgaatgccatcagaacagagaacagcagcctgaccaaggaggtgcaggacctgaaggccaagcagaatgaccaggtgtcctttgccagcctggtggaggagctgaagaaggtgatccacgagaaggatggcaagatcaagtctgtggaggagctgctggaggccgagctgctgaaggtggccaacaaggagaagacagtgcaggacctgaagcaggagatcaaggccctgaaggaggagattggaaatgtgcagctggagaaggcccagcagctgagcatcaccagcaaggtgcaggagctgcagaacctgctgaagggcaaggaggagcagatgaacaccatgaaggctgtgctggaggagaaggagaaggacctggccaacacaggcaagtggctgcaggacctgcaggaggagaatgaaagcctgaaggcccacgtgcaggaggtggcccagcacaacctgaaggaggccagcagcgccagccagtttgaggagctggagatcgtgctgaaggagaaggaaaatgagctgaagaggctggaggccatgctgaaggagcgggagagtgacctgagcagcaagacccagctgctgcaggatgtgcaggatgagaacaagctgttcaagagccagatcgagcagctgaagcagcagaactaccagcaggccagcagcttcccccctcatgaggagctgctgaaggtgatcagcgagcgggagaaggagatcagcggcctgtggaatgagctggacagcctgaaggatgctgtggagcaccagaggaagaagaacaatgacctgcgggagaagaactgggaggccatggaggccctggccagcacagagaagatgctgcaggacaaggtgaacaagaccagcaaggagcggcagcagcaggtggaggccgtggagctggaggccaaggaggtgctgaagaagctgttccccaaggtgtctgtgcccagcaacctgtcctatggagagtggctgcacggctttgagaagaaggccaaggagtgcatggccggcaccagcggcagcgaggaggtgaaggtgctggagcacaagctgaaggaggctgatgagatgcacaccctgctgcagctggagtgtgagaagtacaagtctgtgctggccgagacagagggcatcctgcagaagctgcagaggtctgtggagcaggaggagaacaagtggaaggtgaaggtggatgagagccacaagaccatcaagcagatgcagagcagcttcaccagcagcgagcaggagctggagcggctgcggtctgagaacaaggacatcgagaacctgcggcgggagcgggagcacctggagatggagctggagaaggccgagatggagaggagcacctacgtgacagaggtgcgggagctgaaggacctgctgacagagctgcagaagaagctggatgacagctacagcgaggccgtgcggcagaatgaggagctgaacctgctgaaggcccagctgaatgagaccctgaccaagctgaggacagagcagaatgaaaggcagaaggtggccggggacctgcacaaggcccagcagagcctggagctgatccagagcaagatcgtgaaggctgctggggacaccaccgtgattgagaacagtgatgtgtccccagagacagagagcagcgagaaggagaccatgtctgtgtccctgaaccagacagtgacccagctgcagcagctgctgcaggccgtgaaccagcagctgaccaaggagaaggagcactaccaggtgctggagtag

SEQ ID NO: 157001 - DNA, 3921 bp, Artificial Sequence; identical to SEQ ID NO: 156999
  Description of Artificial Sequence: Synthetic coding sequence

SEQ ID NO: 157002 - DNA, 4074 bp, Artificial Sequence; identical to SEQ ID NO: 157000
  Description of Artificial Sequence: Synthetic coding sequence

SEQ ID NO: 157003 - DNA, 3921 bp, Artificial Sequence; identical to SEQ ID NO: 156999
  Description of Artificial Sequence: Synthetic coding sequence

SEQ ID NO: 157004 - DNA, 4074 bp, Artificial Sequence; identical to SEQ ID NO: 157000
  Description of Artificial Sequence: Synthetic coding sequence

SEQ ID NO: 157005 - DNA, 3903 bp, Artificial Sequence
  Description of Artificial Sequence: Synthetic coding sequence
atggagttctatgagagcgcctacttcatcgtgctgatccccagcatcgtcatcaccgtcatcttcctgttcttctggctgttcatgaaggagaccctgtatgatgaggtgctggccaagcagaagcgggagcagaagctgatccccaccaagacagacaagaagaaggccgagaagaagaagaacaagaagaaggagatccagaatggaaacctgcatgaaagtgacagcgagagcgtgccccgggacttcaagctgagtgatgccctggccgtggaggatgaccaggtggcccctgtgcccctgaatgtggtggagaccagcagctctgtgcgggagaggaagaagaaggagaagaagcagaagcctgtgctggaggagcaggtgatcaaggagagtgatgccagcaagatccctgggaagaaggtggagcctgtgcctgtgaccaagcagcccaccccacccagcgaggccgccgccagcaagaagaagccaggccagaagaagagcaagaatggaagtgatgaccaggacaagaaggtggagaccctgatggtgcccagcaagaggcaggaggccctgcccctgcaccaggagaccaagcaggagagcggcagcggcaagaagaaggccagcagcaagaagcagaagacagaaaatgtgtttgtggatgagcccctcatccacgccaccacctacatccccctgatggacaatgctgacagcagccctgtggtggacaagcgggaggtgattgacctgctgaagccagaccaggtggagggcatccagaagagcggcaccaagaagctgaagacagaaacagacaaggaaaatgctgaggtgaagttcaaggacttcctgctgagcctgaagaccatgatgttttctgaagatgaggccctgtgtgtggtggacctgctgaaggagaagagcggggtcatccaggatgccctgaagaagagcagcaagggggagctgaccaccctcatccaccagctgcaggagaaggacaagctgctggccgctgtgaaggaggatgctgctgccaccaaggaccgctgcaagcagctgacccaggagatgatgacagagaaggagaggagcaatgtggtgatcaccaggatgaaggaccgcatcggcaccctggagaaggagcacaacgtgttccagaacaagatccacgtgtcctaccaggagacccagcagatgcagatgaagttccagcaggtgcgggagcagatggaggccgagatcgcccacctgaagcaggagaatggcatcctgagagatgctgtgagcaacaccaccaaccagctggagagcaagcagagcgctgagctgaacaagctgcggcaggactatgcccggctggtgaatgagctgacagagaagacaggcaagctgcagcaggaggaggtgcagaagaagaatgctgagcaggccgccacccagctgaaggtgcagctgcaggaggccgagcggcgctgggaggaggtgcagagctacatcaggaagaggacagctgagcatgaagctgcccagcaggacctgcagagcaagtttgtggccaaggaaaatgaggtgcagagcctgcacagcaagctgacagacaccctggtgtccaagcagcagctggagcagaggctgatgcagctgatggagagcgagcagaagagggtgaacaaggaggagagcctgcagatgcaggtgcaggacatcctggagcagaatgaggccctgaaggcccagatccagcagttccacagccagattgctgcccagaccagcgcctctgtgctggccgaggagctgcacaaggtgattgctgagaaggacaagcagatcaagcagacagaggacagcctggccagcgagcgggaccggctgaccagcaaggaggaggagctgaaggacatccagaacatgaacttcctgctgaaggccgaggtgcagaagctgcaggccctggccaatgagcaggccgccgccgcccacgagctggagaagatgcagcagagcgtgtatgtgaaggatgacaagatccggctgctggaggagcagctgcagcacgagatcagcaacaagatggaggagttcaagatcctgaatgaccagaacaaggccctgaagtctgaggtgcagaagctgcagaccctggtgtctgagcagcccaacaaggatgtggtggagcagatggagaagtgcatccaggagaaggatgagaagctgaagacagtggaggagctgctggagaccggcctcatccaggtggccaccaaggaggaggagctgaatgccatcagaacagagaacagcagcctgaccaaggaggtgcaggacctgaaggccaagcagaatgaccaggtgtcctttgccagcctggtggaggagctgaagaaggtgatccacgagaaggatggcaagatcaagtctgtggaggagctgctggaggccgagctgctgaaggtggccaacaaggagaagacagtgcaggacctgaagcaggagatcaaggccctgaaggaggagattggaaatgtgcagctggagaaggcccagcagctgagcatcaccagcaaggtgcaggagctgcagaacctgctgaagggcaaggaggagcagatgaacaccatgaaggctgtgctggaggagaaggagaaggacctggccaacacaggcaagtggctgcaggacctgcaggaggagaatgaaagcctgaaggcccacgtgcaggaggtggcccagcacaacctgaaggaggccagcagcgccagccagtttgaggagctggagatcgtgctgaaggagaaggaaaatgagctgaagaggctggaggccatgctgaaggagcgggagagtgacctgagcagcaagacccagctgctgcaggatgtgcaggatgagaacaagctgttcaagagccagatcgagcagctgaagcagcagaactaccagcaggccagcagcttcccccctcatgaggagctgctgaaggtgatcagcgagcgggagaaggagatcagcggcctgtggaatgagctggacagcctgaaggatgctgtggagcaccagaggaagaagaacaatgaaaggcagcagcaggtggaggccgtggagctggaggccaaggaggtgctgaagaagctgttccccaaggtgtctgtgcccagcaacctgtcctatggagagtggctgcacggctttgagaagaaggccaaggagtgcatggccggcaccagcggcagcgaggaggtgaaggtgctggagcacaagctgaaggaggctgatgagatgcacaccctgctgcagctggagtgtgagaagtacaagtctgtgctggccgagacagagggcatcctgcagaagctgcagaggtctgtggagcaggaggagaacaagtggaaggtgaaggtggatgagagccacaagaccatcaagcagatgcagagcagcttcaccagcagcgagcaggagctggagcggctgcggtctgagaacaaggacatcgagaacctgcggcgggagcgggagcacctggagatggagctggagaaggccgagatggagaggagcacctacgtgacagaggtgcgggagctgaaggcccagctgaatgagaccctgaccaagctgaggacagagcagaatgaaaggcagaaggtggccggggacctgcacaaggcccagcagagcctggagctgatccagagcaagatcgtgaaggccgccggggacaccaccgtgattgaaaattctgatgtgtccccagagacagagagcagcgagaaggagaccatgtctgtgtccctgaaccagacagtgacccagctgcagcagctgctgcaggccgtgaaccagcagctgaccaaggagaaggagcactaccaggtgctggagtag

SEQ ID NO: 157006 - DNA, 4074 bp, Artificial Sequence; identical to SEQ ID NO: 157000
  Description of Artificial Sequence: Synthetic coding sequence

SEQ ID NO: 157007 - DNA, 228 bp, Artificial Sequence
  Description of Artificial Sequence: Synthetic coding sequence
atggagttctatgagagcgcctacttcatcgtgctgatccccagcatcgtcatcaccgtcatcttcctgttcttctggctgttcatgaaggagaccctgtatgatgaggtgctggccaagcagaagcgggagcagaagctgatccccaccaagacagacaagaagaaggccgagaagaagaagaacaagaagaaggagatccagaatggaaacctgcacgagagctag

SEQ ID NO: 157008 - DNA, 183 bp, Artificial Sequence
  Description of Artificial Sequence: Synthetic coding sequence
atggagttctatgagagcgcctacttcatcgtgctgatccccagcatcgtcatcaccgtcatcttcctgttcttctggctgttcatgaaggagaccctgtatgatgaggtgctggccaagcagaagcgggagcagaagctgatccccaccaagacagacaagaagaaggccgagaagaagtag

SEQ ID NO: 157009 - DNA, 3171 bp, Artificial Sequence
  Description of Artificial Sequence: Synthetic coding sequence
atggccagccagcccaacagcagcgccaagaagaaggaggagaagggcaagaacatccaggtggtggtgcgctgccggcccttcaacctggccgagaggaaggccagcgcccacagcatcgtggagtgtgaccctgtgaggaaggaggtgtctgtgaggactggaggcctggccgacaagagcagcaggaagacctacacctttgacatggtgtttggagccagcaccaagcagattgatgtgtacagatctgtggtgtgccccatcctggatgaagtcatcatgggctacaactgcaccatctttgcctacggccagacaggaacaggcaagaccttcaccatggagggggagaggagccccaatgaggagtacacctgggaggaggaccccctggccggcatcatccccaggaccctgcaccagatctttgagaagctgacagacaatggaacagagttctctgtgaaggtgtccctgctggagatctacaatgaggagctgtttgacctgctgaaccccagcagtgatgtgtctgagcggctgcagatgtttgatgaccccaggaacaagaggggcgtcatcatcaagggcctggaggagatcaccgtgcacaacaaggatgaggtgtaccagatcctggagaagggggccgccaagaggaccacagctgccaccctgatgaatgcctacagcagccgcagccacagcgtcttctctgtgaccatccacatgaaggagaccaccattgatggagaggagctggtgaagattggcaagctgaacctggtggacctggccggcagcgagaacatcggccgctctggagctgtggacaagagggcccgggaggccggcaacatcaaccagagcctgctgaccctgggccgggtcatcacagccctggtggagaggaccccccacgtgccctaccgggagagcaagctgacccgcatcctgcaggacagcctgggcggccgcaccaggaccagcatcatcgccaccatcagccctgccagcctgaacctggaggagaccctgagcaccctggagtatgcccaccgggccaagaacatcctgaacaagccagaggtgaaccagaagctgaccaagaaggccctgatcaaggagtacacagaggagattgaaaggctgaagagggacctggccgccgcccgggagaagaatggagtgtacatcagcgaggagaacttccgggtgatgtctgggaagctgactgtgcaggaggagcagatcgtggagctgattgagaagatcggggctgtggaggaggagctgaacagagtgacagagctgttcatggacaacaagaatgagctggaccagtgcaagagtgacctgcagaacaagacccaggagctggagaccacccagaagcacctgcaggagaccaagctgcagctggtgaaggaggagtacatcaccagcgccctggagagcacagaggagaagctgcatgatgctgccagcaagctgctgaacacagtggaggagaccaccaaggatgtgtctggcctgcacagcaagctggacaggaagaaggctgtggaccagcacaatgctgaggcccaggacatctttgggaagaacctgaacagcctcttcaacaacatggaggagctgatcaaggatggcagcagcaagcagaaggccatgctggaggtgcacaagaccctgtttggaaacctgctgagcagctctgtgtctgccctggacaccatcaccaccgtggccctgggcagcctgaccagcatcccagaaaatgtgtccacccacgtgtcccagatcttcaacatgatcctgaaggagcagagcctggccgctgagagcaagacagtgctgcaggagctgatcaacgtgctgaagacagacctgctgagcagcctggagatgatcctgagccccaccgtggtgtccatcctgaagatcaacagccagctgaagcacatcttcaagaccagcctgactgtggccgacaagattgaggaccagaagaaggagctggatggcttcctgagcatcctgtgcaacaacctgcacgagctgcaggagaacaccatctgcagcctggtggagagccagaagcagtgtggcaacctgacagaggacctgaagaccatcaagcagacccacagccaggagctgtgcaagctgatgaacctgtggacagagcgcttctgtgccctggaggagaagtgtgagaacatccagaagcccctgagctctgtgcaggagaacatccagcagaagagcaaggacatcgtgaacaagatgaccttccacagccagaagttctgtgccgacagtgatggcttcagccaggagctgaggaacttcaaccaggagggcaccaagctggtggaggagagcgtgaagcacagcgacaagctgaatggaaacctggagaagatcagccaggagacagagcagagatgtgagagcctgaacaccaggacagtgtacttcagcgagcagtgggtgagcagcctgaatgaaagagagcaggagctgcacaacctgctggaggtggtgtcccagtgctgtgaggccagcagcagtgacatcacagagaagagtgatggcaggaaggccgcccacgagaagcagcacaacatcttcctggaccagatgaccattgatgaggacaagctgattgcccagaacctggagctgaatgagaccatcaagattggcctgaccaagctgaactgcttcctggagcaggacctgaagctggacatccccaccggcaccaccccccagaggaagagctacctgtaccccagcaccctggtgaggacagagccccgggagcacctgctggaccagctgaagaggaagcagcctgagctgctgatgatgctgaactgcagcgagaacaacaaggaggagaccatcccagatgtggatgtggaggaggccgtgctgggccagtacacagaggagcccctgagccaggagcccagcgtggatgctggggtggactgcagcagcatcggcggcgtgcccttcttccagcacaagaagagccacggcaaggacaaggaaaatagaggcatcaacaccctggagaggagcaaggtggaggagaccacagagcacctggtgaccaagagccggctgcccctgcgggcccagatcaacctgtag

SEQ ID NO: 157010 - DNA, 5418 bp, Artificial Sequence
  Description of Artificial Sequence: Synthetic coding sequence
atgtctgacaccaaggtgaaggtggccgtgcgggtgcggcccatgaacagaagagagctggagctgaacaccaagtgtgtggtggagatggagggcaaccagacagtgctgcaccccccacccagcaacaccaagcagggcgagaggaagccacccaaggtgtttgcctttgactactgcttctggagcatggatgagagcaacaccaccaagtatgccggccaggaggtggtgttcaagtgcctgggggagggcatcctggagaaggccttccagggctacaatgcctgcatctttgcctacggccagacaggcagcggcaagagcttctccatgatgggccacgccgagcagctgggcctcatcccccggctgtgctgtgccctcttcaagaggatcagcctggagcagaatgaaagccagaccttcaaggtggaggtgtcctacatggagatctacaatgagaaggtgcgggacctgctggaccccaagggcagccggcagagcctgaaggtgcgggagcacaaggtgctgggcccctacgtggatggcctgagccagctggccgtgaccagctttgaggacatcgagagcctgatgtctgagggcaacaagagcaggacagtggccgccaccaacatgaatgaggagagcagccgcagccatgctgtgttcaacatcatcatcacccagaccctgtatgacctgcagagcggcaacagcggggagaaggtgtccaaggtgtccctggtggacctggccggcagcgagcgggtgtccaagacaggagctgctggggagcggctgaaggagggcagcaacatcaacaagagcctgaccaccctgggcctggtgatcagcagcctggccgaccaggccgccggcaagggcaagagcaagtttgtgccctacagagattctgtgctgacctggctgctgaaggacaacctgggcggcaacagccagacctccatgattgccaccatcagccctgctgctgacaactatgaggagaccctgagcaccctgcgctatgctgaccgggccaagagaattgtgaaccacgctgtggtgaatgaagaccccaatgccaaggtgatccgggagctgcgggaggaggtggagaagctgcgggagcagctgagccaggccgaggccatgaaggcccctgagctgaaggagaagctggaggagagcgagaagctgatcaaggagctgactgtgacctgggaggagaagctgaggaagacagaggagatcgcccaggagcggcagaggcagctggagagcatgggcatcagcctggagatgagcggcatcaaggtgggagatgacaagtgctacctggtgaacctgaatgctgaccctgccctgaatgagctgctggtgtactacctgaaggaccacaccagggtgggcgctgacaccagccaggacatccagctgtttggaattggcatccagccccagcactgtgaaattgacatcgccagtgatggagatgtgaccctgacccccaaggaaaatgcccggagctgtgtgaatggcaccctggtgtgcagcaccacccagctgtggcatggagaccgcatcctgtggggcaacaaccacttcttccgcatcaacctgcccaagaggaagaggcgggactggctgaaggactttgagaaggagactggacctcctgagcatgacctggatgctgccagcgaggccagcagcgagccagactacaactatgaatttgcccagatggaggtgatcatgaagaccctgaacagcaatgaccctgtgcagaatgtggtgcaggtgctggagaagcagtacctggaggagaagaggtctgccctggaggagcagaggctgatgtatgaaagagagctggagcagctgcggcagcagctgagcccagaccggcagccccagagcagcggccctgaccggctggcctacagcagccagacagcccagcagaaggtgacccagtgggccgaggagagagatgagctgttccggcagagcctggccaagctgcgggagcagctggtgaaggccaacaccctggtgcgggaggccaacttcctggccgaggagatgagcaagctgacagactaccaggtgaccctgcagatcccagctgccaacctgagcgccaacaggaagagaggagccatcgtgtctgagcccgccatccaggtgcggaggaagggcaagagcacccaggtgtggaccatcgagaagctggagaacaagctgattgacatgagggacctgtaccaggagtggaaggagaaggtgcctgaggccaagaggctgtatggcaagagaggagaccccttctatgaggcccaggagaaccacaacctgattggagtggccaacgtgttcctggagtgcctcttctgtgatgtgaagctgcagtatgctgtgcccatcatcagccagcagggcgaggtggccggccgcctgcacgtggaggtgatgagggtgactggagctgtgcctgagcgggtggtggaggatgacagcagcgagaacagcagcgagagcggcagcctggaggtggtggacagcagtggagagatcatccaccgggtgaagaagctgacctgccgggtgaagatcaaggaggccaccggcctgcccctgaacctgagcaactttgtgttctgccagtacaccttctgggaccagtgtgagagcacagtggccgcccctgtggtggaccctgaggtgcccagcccccagagcaaggatgcccagtacacagtgaccttcagccactgcaaggactatgtggtgaatgtgacagaggagttcctggagttcatcagtgatggagccctggccatcgaggtgtggggccaccgctgtgctggaaatggcagcagcatctgggaggtggacagcctgcacgccaagaccaggaccctgcatgaccgctggaatgaggtgaccaggagaattgagatgtggatcagcatcctggagctgaatgagctgggggagtatgctgctgtggagctgcaccaggccaaggatgtgaacacaggaggcatcttccagctgcggcagggccacagcagaagagtgcaggtgacagtgaagcctgtgcagcacagcggcaccctgcccctgatggtggaggccatcctgtctgtgtccatcggctgtgtgacagcccggagcaccaagctgcagaggggcctggacagctaccagagagatgatgaagatggagatgacatggacagctaccaggaggaggacctgaactgtgtgcgggagcgctggagcgatgccctgatcaagagaagagagtacctggatgagcagatcaagaaggtgagcaacaagacagagaagacagaagatgatgtggagcgggaggcccagctggtggagcagtgggtgggcctgacagaggagagaaatgctgtgctggtgcctgcccctggcagcggcatccctggggccccagctgactggatccccccacctggcatggagacccacatccctgtgctcttcctggacctgaatgctgatgacctgagcgccaatgagcagctggtgggcccccacgccagcggcgtgaacagcatcctgcccaaggagcacggcagccagttcttctacctgcccatcatcaagcacagtgatgatgaggtgtctgccacagcctcctgggacagctctgtgcatgattctgtgcacctgaacagagtgaccccccagaatgaaagaatctacctgattgtgaagaccaccgtgcagctgagccaccctgctgccatggagctggtgctgaggaagagaattgctgccaacatctacaacaagcagagcttcacccagagcctgaagaggcgcatcagcctgaagaacatcttctacagctgtggggtgacctatgaaattgtgagcaacatccccaaggccacagaggagattgaagatcgggagaccctggccctgctggccgcccggagtgaaaatgaaggcaccagtgatggagagacctacatcgagaagtacacccggggcgtgctgcaggtggagaacatcctgagcctggagcggctgcggcaggccgtgacagtgaaggaggccctgagcaccaaggcccggcacatccgccgcagcctgagcaccccaaatgtgcacaacgtgagcagcagcaggccagacctgagcggctttgatgaagatgacaagggctggccagagaaccagctggacatgtctgactacagcagcagctaccaggatgtggcctgctacggcaccctgccccgggacagccccaggaggaacaaggagggctgcaccagcgagacccctcatgccctgactgtgagccccttcaaggccttcagcccccagccccccaagttcttcaagcccctgatgcctgtgaaggaggagcacaagaagagaattgccctggaggcccggcccctgctgagccaggagagcatgcccccaccccaggcccacaaccctggctgcatcgtgcccagcggcagcaatggcagctccatgcctgtggagcacaacagcaagcgggagaagaagattgattctgaggaggaggagaatgagctggaggccatcaacaggaagctgatcagcagccagccctacgtgcctgtggagtttgctgacttctctgtgtacaatgccagcctggagaaccgggagtggttcagcagcaaggtggacctgagcaacagccgggtgctggagaaggaggtgagccgcagccccaccaccagcagcatcaccagcggctacttcagccacagcgccagcaatgccaccctgagtgacatggtggtgcccagcagtgacagcagtgaccagctggccatccagaccaaggatgctgacagcacagagcacagcacccccagcctggtgcatgacttccggcccagcagcaacaaggagctgacagaggtggagaagggcctggtgaaggacaagatcatcgtggtgcccctgaaggaaaattctgccctggccaagggcagccccagcagccagagcatccctgagaagaacagcaagagcctgtgcaggacaggcagctgcagcgagctggatgcctgccccagcaagatcagccagcctgcccggggcttctgcccccgggaggtgacagtggagcacaccaccaacatcctggaggaccacagcttcacagagttcatgggcgtgtctgagggcaaggactttgatggcctgacagacagcagcgctggggagctgagcagcagaagaagcctgcccaacaagacaggaggcaagacagtgtctgatggcctgcaccaccccagccagctgcacagcaagctggagaatgaccaggtgatcatccctgaggccgccttctgggtgctgtgctgccagtag

SEQ ID NO: 157011 - DNA, 5250 bp, Artificial Sequence
  Description of Artificial Sequence: Synthetic coding sequence
atgtctgacaccaaggtgaaggtggccgtgcgggtgcggcccatgaacagaagagagctggagctgaacaccaagtgtgtggtggagatggagggcaaccagacagtgctgcaccccccacccagcaacaccaagcagggcgagaggaagccacccaaggtgtttgcctttgactactgcttctggagcatggatgagagcaacaccaccaagtatgccggccaggaggtggtgttcaagtgcctgggggagggcatcctggagaaggccttccagggctacaatgcctgcatctttgcctacggccagacaggcagcggcaagagcttctccatgatgggccacgccgagcagctgggcctcatcccccggctgtgctgtgccctcttcaagaggatcagcctggagcagaatgaaagccagaccttcaaggtggaggtgtcctacatggagatctacaatgagaaggtgcgggacctgctggaccccaagggcagccggcagagcctgaaggtgcgggagcacaaggtgctgggcccctacgtggatggcctgagccagctggccgtgaccagctttgaggacatcgagagcctgatgtctgagggcaacaagagcaggacagtggccgccaccaacatgaatgaggagagcagccgcagccatgctgtgttcaacatcatcatcacccagaccctgtatgacctgcagagcggcaacagcggggagaaggtgtccaaggtgtccctggtggacctggccggcagcgagcgggtgtccaagacaggagctgctggggagcggctgaaggagggcagcaacatcaacaagagcctgaccaccctgggcctggtgatcagcagcctggccgaccaggccgccggcaagggcaagagcaagtttgtgccctacagagattctgtgctgacctggctgctgaaggacaacctgggcggcaacagccagacctccatgattgccaccatcagccctgctgctgacaactatgaggagaccctgagcaccctgcgctatgctgaccgggccaagagaattgtgaaccacgctgtggtgaatgaagaccccaatgccaaggtgatccgggagctgcgggaggaggtggagaagctgcgggagcagctgagccaggccgaggccatgaaggcccctgagctgaaggagaagctggaggagagcgagaagctgatcaaggagctgactgtgacctgggaggagaagctgaggaagacagaggagatcgcccaggagcggcagaggcagctggagagcatgggcatcagcctggagatgagcggcatcaaggtgggagatgacaagtgctacctggtgaacctgaatgctgaccctgccctgaatgagctgctggtgtactacctgaaggaccacaccagggtgggcgctgacaccagccaggacatccagctgtttggaattggcatccagccccagcactgtgaaattgacatcgccagtgatggagatgtgaccctgacccccaaggaaaatgcccggagctgtgtgaatggcaccctggtgtgcagcaccacccagctgtggcatggagaccgcatcctgtggggcaacaaccacttcttccgcatcaacctgcccaagaggaagaggcgggactggctgaaggactttgagaaggagactggacctcctgagcatgacctggatgctgccagcgaggccagcagcgagccagactacaactatgaatttgcccagatggaggtgatcatgaagaccctgaacagcaatgaccctgtgcagaatgtggtgcaggtgctggagaagcagtacctggaggagaagaggtctgccctggaggagcagaggctgatgtatgaaagagagctggagcagctgcggcagcagctgagcccagaccggcagccccagagcagcggccctgaccggctggcctacagcagccagacagcccagcagaaggtgacccagtgggccgaggagagagatgagctgttccggcagagcctggccaagctgcgggagcagctggtgaaggccaacaccctggtgcgggaggccaacttcctggccgaggagatgagcaagctgacagactaccaggtgaccctgcagatcccagctgccaacctgagcgccaacaggaagagaggagccatcgtgtctgagcccgccatccaggtgcggaggaagggcaagagcacccaggtgtggaccatcgagaagctggagaacaagctgattgacatgagggacctgtaccaggagtggaaggagaaggtgcctgaggccaagaggctgtatggcaagagaggagaccccttctatgaggcccaggagaaccacaacctgattggagtggccaacgtgttcctggagtgcctcttctgtgatgtgaagctgcagtatgctgtgcccatcatcagccagcagggcgaggtggccggccgcctgcacgtggaggtgatgagggtgactggagctgtgcctgagcgggtggtggaggatgacagcagcgagaacagcagcgagagcggcagcctggaggtggtggacagcagtggagagatcatccaccgggtgaagaagctgacctgccgggtgaagatcaaggaggccaccggcctgcccctgaacctgagcaactttgtgttctgccagtacaccttctgggaccagtgtgagagcacagtggccgcccctgtggtggaccctgaggtgcccagcccccagagcaaggatgcccagtacacagtgaccttcagccactgcaaggactatgtggtgaatgtgacagaggagttcctggagttcatcagtgatggagccctggccatcgaggtgtggggccaccgctgtgctggaaatggcagcagcatctgggaggtggacagcctgcacgccaagaccaggaccctgcatgaccgctggaatgaggtgaccaggagaattgagatgtggatcagcatcctggagctgaatgagctgggggagtatgctgctgtggagctgcaccaggccaaggatgtgaacacaggaggcatcttccagctgcggcagggccacagcagaagagtgcaggtgacagtgaagcctgtgcagcacagcggcaccctgcccctgatggtggaggccatcctgtctgtgtccatcggctgtgtgacagcccggagcaccaagctgcagaggggcctggacagctaccaggaggaggacctgaactgtgtgcgggagcgctggagcgatgccctgatcaagaggcgggagtacctggatgagcagatcaagaaggtgagcaacaagacagagaagacagaagatgatgtggagcgggaggcccagctggtggagcagtgggtgggcctgacagaggagagaaatgctgtgctggtgcctgcccctggcagcggcatccctggggccccagctgactggatccccccacctggcatggagacccacatccctgtgctcttcctggacctgaatgctgatgacctgagcgccaatgagcagctggtgggcccccacgccagcggcgtgaacagcatcctgcccaaggagcacggcagccagttcttctacctgcccatcatcaagcacagtgatgatgaggtgtctgccacagcctcctgggacagctctgtgcatgacagcgtgcacctgaacagagtgaccccccagaatgaaagaatctacctgattgtgaagaccaccgtgcagctgagccaccctgctgccatggagctggtgctgaggaagagaattgctgccaacatctacaacaagcagagcttcacccagagcctgaagaggcgcatcagcctgaagaacatcttctacagctgtggggtgacctatgagatcgtgagcaacatccccaaggccacagaggagattgaggaccgggagaccctggccctgctggccgcccggagtgaaaatgaaggcaccagtgatggagagacctacatcgagaagtacacccggggcgtgctgcaggtggagaacatcctgagcctggagcggctgcggcaggccgtgacagtgaaggaggccctgagcaccaaggcccggcacatcagaagaagcctgagcacccccaacgtgcacaacgtgagcagcagcaggccagacctgagcggctttgatgaagatgacaagggctggccagagaaccagctggacatgtctgactacagcagcagctaccaggatgtggcctgctacggcaccctgccccgggacagccccaggaggaacaaggagggctgcaccagcgagaccccccacgccctgactgtgagccccttcaaggccttcagcccccagccccccaagttcttcaagcccctgatgcctgtgaaggaggagcacaagaagagaattgccctggaggcccggcccctgctgagccaggaggacagcgaggaggaggagaatgagctggaggccatcaacaggaagctgatcagcagccagccctacgtgcctgtggagtttgctgacttctctgtgtacaatgccagcctggagaaccgggagtggttcagcagcaaggtggacctgagcaacagccgggtgctggagaaggaggtgagccgcagccccaccaccagcagcatcaccagcggctacttcagccacagcgccagcaatgccaccctgagtgacatggtggtgcccagcagtgacagcagtgaccagctggccatccagaccaaggatgctgacagcacagagcacagcacccccagcctggtgcatgacttccggcccagcagcaacaaggagctgacagaggtggagaagggcctggtgaaggacaagatcatcgtggtgcccctgaaggaaaattctgccctggccaagggcagccccagcagccagagcatccctgagaagaacagcaagagcctgtgcaggacaggcagctgcagcgagctggatgcctgccccagcaagatcagccagcctgcccggggcttctgcccccgggaggtgacagtggagcacaccaccaacatcctggaggaccacagcttcacagagttcatgggcgtgtctgagggcaaggactttgatggcctgacagacagcagcgctggggagctgagcagcagaagaagcctgcccaacaagacaggaggcaagacagtgtctgatggcctgcaccaccccagccagctgcacagcaagctggagaatgaccagggcggcaccaccagcaggtag

SEQ ID NO: 157012 - DNA, 5313 bp, Artificial Sequence
  Description of Artificial Sequence: Synthetic coding sequence
atgtctgacaccaaggtgaaggtggccgtgcgggtgcggcccatgaacagaagagagctggagctgaacaccaagtgtgtggtggagatggagggcaaccagacagtgctgcaccccccacccagcaacaccaagcagggcgagcggcggcccagccaggtgtttgcctttgactactgcttctggagcatggatgagagcaacaccaccaagtatgccggccaggaggtggtgttcaagtgcctgggggagggcatcctggagaaggccttccagggctacaatgcctgcatctttgcctacggccagacaggcagcggcaagagcttctccatgatgggccacgccgagcagctgggcctcatcccccggctgtgctgtgccctcttcaagaggatcagcctggagcagaatgaaagccagaccttcaaggtggaggtgtcctacatggagatctacaatgagaaggtgcgggacctgctggaccccaagggcagccggcagagcctgaaggtgcgggagcacaaggtgctgggcccctacgtggatggcctgagccagctggccgtgaccagctttgaggacatcgagagcctgatgtctgagggcaacaagagcaggacagtggccgccaccaacatgaatgaggagagcagccgcagccatgctgtgttcaacatcatcatcacccagaccctgtatgacctgcagagcggcaacagcggggagaaggtgtccaaggtgtccctggtggacctggccggcagcgagcgggtgtccaagacaggagctgctggggagcggctgaaggagggcagcaacatcaacaagagcctgaccaccctgggcctggtgatcagcagcctggccgaccaggccgccggcaagggcaagagcaagtttgtgccctacagagattctgtgctgacctggctgctgaaggacaacctgggcggcaacagccagacctccatgattgccaccatcagccctgctgctgacaactatgaggagaccctgagcaccctgcgctatgctgaccgggccaagagaattgtgaaccacgctgtggtgaatgaagaccccaatgccaaggtgatccgggagctgcgggaggaggtggagaagctgcgggagcagctgagccaggccgaggccatgaaggcccctgagctgaaggagaagctggaggagagcgagaagctgatcaaggagctgactgtgacctgggaggagaagctgaggaagacagaggagatcgcccaggagcggcagaggcagctggagagcatgggcatcagcctggagatgagcggcatcaaggtgggagatgacaagtgctacctggtgaacctgaatgctgaccctgccctgaatgagctgctggtgtactacctgaaggaccacaccagggtgggcgctgacaccagccaggacatccagctgtttggaattggcatccagccccagcactgtgaaattgacatcgccagtgatggagatgtgaccctgacccccaaggaaaatgcccggagctgtgtgaatggcaccctggtgtgcagcaccacccagctgtggcatggagaccgcatcctgtggggcaacaaccacttcttccgcatcaacctgcccaagaggaagaggcgggactggctgaaggactttgagaaggagactggacctcctgagcatgacctggatgctgccagcgaggccagcagcgagccagactacaactatgaatttgcccagatggaggtgatcatgaagaccctgaacagcaatgaccctgtgcagaatgtggtgcaggtgctggagaagcagtacctggaggagaagaggtctgccctggaggagcagaggctgatgtatgaaagagagctggagcagctgcggcagcagctgagcccagaccggcagccccagagcagcggccctgaccggctggcctacagcagccagacagcccagcagaaggtgacccagtgggccgaggagagagatgagctgttccggcagagcctggccaagctgcgggagcagctggtgaaggccaacaccctggtgcgggaggccaacttcctggccgaggagatgagcaagctgacagactaccaggtgaccctgcagatcccagctgccaacctgagcgccaacaggaagagaggagccatcgtgtctgagcccgccatccaggtgcggaggaagggcaagagcacccaggtgtggaccatcgagaagctggagaacaagctgattgacatgagggacctgtaccaggagtggaaggagaaggtgcctgaggccaagaggctgtatggcaagagaggagaccccttctatgaggcccaggagaaccacaacctgattggagtggccaacgtgttcctggagtgcctcttctgtgatgtgaagctgcagtatgctgtgcccatcatcagccagcagggcgaggtggccggccgcctgcacgtggaggtgatgagggtgactggagctgtgcctgagcgggtggtggaggatgacagcagcgagaacagcagcgagagcggcagcctggaggtggtggacagcagtggagagatcatccaccgggtgaagaagctgacctgccgggtgaagatcaaggaggccaccggcctgcccctgaacctgagcaactttgtgttctgccagtacaccttctgggaccagtgtgagagcacagtggccgcccctgtggtggaccctgaggtgcccagcccccagagcaaggatgcccagtacacagtgaccttcagccactgcaaggactatgtggtgaatgtgacagaggagttcctggagttcatcagtgatggagccctggccatcgaggtgtggggccaccgctgtgctggaaatggcagcagcatctgggaggtggacagcctgcacgccaagaccaggaccctgcatgaccgctggaatgaggtgaccaggagaattgagatgtggatcagcatcctggagctgaatgagctgggggagtatgctgctgtggagctgcaccaggccaaggatgtgaacacaggaggcatcttccagctgcggcagggccacagcagaagagtgcaggtgacagtgaagcctgtgcagcacagcggcaccctgcccctgatggtggaggccatcctgtctgtgtccatcggctgtgtgacagcccggagcaccaagctgcagaggggcctggacagctaccagagagatgatgaagatggagatgacatggacagctaccaggaggaggacctgaactgtgtgcgggagcgctggagcgatgccctgatcaagagaagagagtacctggatgagcagatcaagaaggtgagcaacaagacagagaagacagaagatgatgtggagcgggaggcccagctggtggagcagtgggtgggcctgacagaggagagaaatgctgtgctggtgcctgcccctggcagcggcatccctggggccccagctgactggatccccccacctggcatggagacccacatccctgtgctcttcctggacctgaatgctgatgacctgagcgccaatgagcagctggtgggcccccacgccagcggcgtgaacagcatcctgcccaaggagcacggcagccagttcttctacctgcccatcatcaagcacagtgatgatgaggtgtctgccacagcctcctgggacagctctgtgcatgattctgtgcacctgaacagagtgaccccccagaatgaaagaatctacctgattgtgaagaccaccgtgcagctgagccaccctgctgccatggagctggtgctgaggaagagaattgctgccaacatctacaacaagcagagcttcacccagagcctgaagaggcgcatcagcctgaagaacatcttctacagctgtggggtgacctatgaaattgtgagcaacatccccaaggccacagaggagattgaagatcgggagaccctggccctgctggccgcccggagtgaaaatgaaggcaccagtgatggagagacctacatcgagaagtacacccggggcgtgctgcaggtggagaacatcctgagcctggagcggctgcggcaggccgtgacagtgaaggaggccctgagcaccaaggcccggcacatccgccgcagcctgagcaccccaaatgtgcacaacgtgagcagcagcaggccagacctgagcggctttgatgaagatgacaagggctggccagagaaccagctggacatgtctgactacagcagcagctaccaggatgtggcctgctacggcaccctgccccgggacagccccaggaggaacaaggagggctgcaccagcgagacccctcatgccctgactgtgagccccttcaaggccttcagcccccagccccccaagttcttcaagcccctgatgcctgtgaaggaggagcacaagaagagaattgccctggaggcccggcccctgctgagccaggaggacagcgaggaggaggagaatgagctggaggccatcaacaggaagctgatcagcagccagccctacgtgcctgtggagtttgctgacttctctgtgtacaatgccagcctggagaaccgggagtggttcagcagcaaggtggacctgagcaacagccgggtgctggagaaggaggtgagccgcagccccaccaccagcagcatcaccagcggctacttcagccacagcgccagcaatgccaccctgagtgacatggtggtgcccagcagtgacagcagtgaccagctggccatccagaccaaggatgctgacagcacagagcacagcacccccagcctggtgcatgacttccggcccagcagcaacaaggagctgacagaggtggagaagggcctggtgaaggacaagatcatcgtggtgcccctgaaggagaacagcgccctggccaagggcagccccagcagccagagcatccctgagaagaacagcaagagcctgtgcaggacaggcagctgcagcgagctggatgcctgccccagcaagatcagccagcctgcccggggcttctgcccccgggaggtgacagtggagcacaccaccaacatcctggaggaccacagcttcacagagttcatgggcgtgtctgagggcaaggactttgatggcctgacagacagcagcgctggggagctgagcagccgccgcagcctgcccaacaagacaggaggcaagacagtgtctgatggcctgcaccaccccagccagctgcacagcaagctggagaatgaccaggtgatcatccctgaggccgccttctgggtgctgtgctgccagtag

SEQ ID NO: 157013 - DNA, 5313 bp, Artificial Sequence
  Description of Artificial Sequence: Synthetic coding sequence
atgtctgacaccaaggtgaaggtggccgtgcgggtgcggcccatgaacagaagagagctggagctgaacaccaagtgtgtggtggagatggagggcaaccagacagtgctgcaccccccacccagcaacaccaagcagggcgagaggaagccacccaaggtgtttgcctttgactactgcttctggagcatggatgagagcaacaccaccaagtatgccggccaggaggtggtgttcaagtgcctgggggagggcatcctggagaaggccttccagggctacaatgcctgcatctttgcctacggccagacaggcagcggcaagagcttctccatgatgggccacgccgagcagctgggcctcatcccccggctgtgctgtgccctcttcaagaggatcagcctggagcagaatgaaagccagaccttcaaggtggaggtgtcctacatggagatctacaatgagaaggtgcgggacctgctggaccccaagggcagccggcagagcctgaaggtgcgggagcacaaggtgctgggcccctacgtggatggcctgagccagctggccgtgaccagctttgaggacatcgagagcctgatgtctgagggcaacaagagcaggacagtggccgccaccaacatgaatgaggagagcagccgcagccatgctgtgttcaacatcatcatcacccagaccctgtatgacctgcagagcggcaacagcggggagaaggtgtccaaggtgtccctggtggacctggccggcagcgagcgggtgtccaagacaggagctgctggggagcggctgaaggagggcagcaacatcaacaagagcctgaccaccctgggcctggtgatcagcagcctggccgaccaggccgccggcaagggcaagagcaagtttgtgccctacagagattctgtgctgacctggctgctgaaggacaacctgggcggcaacagccagacctccatgattgccaccatcagccctgctgctgacaactatgaggagaccctgagcaccctgcgctatgctgaccgggccaagagaattgtgaaccacgctgtggtgaatgaagaccccaatgccaaggtgatccgggagctgcgggaggaggtggagaagctgcgggagcagctgagccaggccgaggccatgaaggcccctgagctgaaggagaagctggaggagagcgagaagctgatcaaggagctgactgtgacctgggaggagaagctgaggaagacagaggagatcgcccaggagcggcagaggcagctggagagcatgggcatcagcctggagatgagcggcatcaaggtgggagatgacaagtgctacctggtgaacctgaatgctgaccctgccctgaatgagctgctggtgtactacctgaaggaccacaccagggtgggcgctgacaccagccaggacatccagctgtttggaattggcatccagccccagcactgtgaaattgacatcgccagtgatggagatgtgaccctgacccccaaggaaaatgcccggagctgtgtgaatggcaccctggtgtgcagcaccacccagctgtggcatggagaccgcatcctgtggggcaacaaccacttcttccgcatcaacctgcccaagaggaagaggcgggactggctgaaggactttgagaaggagactggacctcctgagcatgacctggatgctgccagcgaggccagcagcgagccagactacaactatgaatttgcccagatggaggtgatcatgaagaccctgaacagcaatgaccctgtgcagaatgtggtgcaggtgctggagaagcagtacctggaggagaagaggtctgccctggaggagcagaggctgatgtatgaaagagagctggagcagctgcggcagcagctgagcccagaccggcagccccagagcagcggccctgaccggctggcctacagcagccagacagcccagcagaaggtgacccagtgggccgaggagagagatgagctgttccggcagagcctggccaagctgcgggagcagctggtgaaggccaacaccctggtgcgggaggccaacttcctggccgaggagatgagcaagctgacagactaccaggtgaccctgcagatcccagctgccaacctgagcgccaacaggaagagaggagccatcgtgtctgagcccgccatccaggtgcggaggaagggcaagagcacccaggtgtggaccatcgagaagctggagaacaagctgattgacatgagggacctgtaccaggagtggaaggagaaggtgcctgaggccaagaggctgtatggcaagagaggagaccccttctatgaggcccaggagaaccacaacctgattggagtggccaacgtgttcctggagtgcctcttctgtgatgtgaagctgcagtatgctgtgcccatcatcagccagcagggcgaggtggccggccgcctgcacgtggaggtgatgagggtgactggagctgtgcctgagcgggtggtggaggatgacagcagcgagaacagcagcgagagcggcagcctggaggtggtggacagcagtggagagatcatccaccgggtgaagaagctgacctgccgggtgaagatcaaggaggccaccggcctgcccctgaacctgagcaactttgtgttctgccagtacaccttctgggaccagtgtgagagcacagtggccgcccctgtggtggaccctgaggtgcccagcccccagagcaaggatgcccagtacacagtgaccttcagccactgcaaggactatgtggtgaatgtgacagaggagttcctggagttcatcagtgatggagccctggccatcgaggtgtggggccaccgctgtgctggaaatggcagcagcatctgggaggtggacagcctgcacgccaagaccaggaccctgcatgaccgctggaatgaggtgaccaggagaattgagatgtggatcagcatcctggagctgaatgagctgggggagtatgctgctgtggagctgcaccaggccaaggatgtgaacacaggaggcatcttccagctgcggcagggccacagcagaagagtgcaggtgacagtgaagcctgtgcagcacagcggcaccctgcccctgatggtggaggccatcctgtctgtgtccatcggctgtgtgacagcccggagcaccaagctgcagaggggcctggacagctaccagagagatgatgaagatggagatgacatggacagctaccaggaggaggacctgaactgtgtgcgggagcgctggagcgatgccctgatcaagagaagagagtacctggatgagcagatcaagaaggtgagcaacaagacagagaagacagaagatgatgtggagcgggaggcccagctggtggagcagtgggtgggcctgacagaggagagaaatgctgtgctggtgcctgcccctggcagcggcatccctggggccccagctgactggatccccccacctggcatggagacccacatccctgtgctcttcctggacctgaatgctgatgacctgagcgccaatgagcagctggtgggcccccacgccagcggcgtgaacagcatcctgcccaaggagcacggcagccagttcttctacctgcccatcatcaagcacagtgatgatgaggtgtctgccacagcctcctgggacagctctgtgcatgattctgtgcacctgaacagagtgaccccccagaatgaaagaatctacctgattgtgaagaccaccgtgcagctgagccaccctgctgccatggagctggtgctgaggaagagaattgctgccaacatctacaacaagcagagcttcacccagagcctgaagaggcgcatcagcctgaagaacatcttctacagctgtggggtgacctatgaaattgtgagcaacatccccaaggccacagaggagattgaagatcgggagaccctggccctgctggccgcccggagtgaaaatgaaggcaccagtgatggagagacctacatcgagaagtacacccggggcgtgctgcaggtggagaacatcctgagcctggagcggctgcggcaggccgtgacagtgaaggaggccctgagcaccaaggcccggcacatccgccgcagcctgagcaccccaaatgtgcacaacgtgagcagcagcaggccagacctgagcggctttgatgaagatgacaagggctggccagagaaccagctggacatgtctgactacagcagcagctaccaggatgtggcctgctacggcaccctgccccgggacagccccaggaggaacaaggagggctgcaccagcgagacccctcatgccctgactgtgagccccttcaaggccttcagcccccagccccccaagttcttcaagcccctgatgcctgtgaaggaggagcacaagaagagaattgccctggaggcccggcccctgctgagccaggaggacagcgaggaggaggagaatgagctggaggccatcaacaggaagctgatcagcagccagccctacgtgcctgtggagtttgctgacttctctgtgtacaatgccagcctggagaaccgggagtggttcagcagcaaggtggacctgagcaacagccgggtgctggagaaggaggtgagccgcagccccaccaccagcagcatcaccagcggctacttcagccacagcgccagcaatgccaccctgagtgacatggtggtgcccagcagtgacagcagtgaccagctggccatccagaccaaggatgctgacagcacagagcacagcacccccagcctggtgcatgacttccggcccagcagcaacaaggagctgacagaggtggagaagggcctggtgaaggacaagatcatcgtggtgcccctgaaggagaacagcgccctggccaagggcagccccagcagccagagcatccctgagaagaacagcaagagcctgtgcaggacaggcagctgcagcgagctggatgcctgccccagcaagatcagccagcctgcccggggcttctgcccccgggaggtgacagtggagcacaccaccaacatcctggaggaccacagcttcacagagttcatgggcgtgtctgagggcaaggactttgatggcctgacagacagcagcgctggggagctgagcagccgccgcagcctgcccaacaagacaggaggcaagacagtgtctgatggcctgcaccaccccagccagctgcacagcaagctggagaatgaccaggtgatcatccctgaggccgccttctgggtgctgtgctgccagtag

SEQ ID NO: 157014 - DNA, 5274 bp, Artificial Sequence
  Description of Artificial Sequence: Synthetic coding sequence
atgtctgacaccaaggtgaaggtggccgtgcgggtgcggcccatgaacagaagagagctggagctgaacaccaagtgtgtggtggagatggagggcaaccagacagtgctgcaccccccacccagcaacaccaagcagggcgagaggaagccacccaaggtgtttgcctttgactactgcttctggagcatggatgagagcaacaccaccaagtatgccggccaggaggtggtgttcaagtgcctgggggagggcatcctggagaaggccttccagggctacaatgcctgcatctttgcctacggccagacaggcagcggcaagagcttctccatgatgggccacgccgagcagctgggcctcatcccccggctgtgctgtgccctcttcaagaggatcagcctggagcagaatgaaagccagaccttcaaggtggaggtgtcctacatggagatctacaatgagaaggtgcgggacctgctggaccccaagggcagccggcagagcctgaaggtgcgggagcacaaggtgctgggcccctacgtggatggcctgagccagctggccgtgaccagctttgaggacatcgagagcctgatgtctgagggcaacaagagcaggacagtggccgccaccaacatgaatgaggagagcagccgcagccatgctgtgttcaacatcatcatcacccagaccctgtatgacctgcagagcggcaacagcggggagaaggtgtccaaggtgtccctggtggacctggccggcagcgagcgggtgtccaagacaggagctgctggggagcggctgaaggagggcagcaacatcaacaagagcctgaccaccctgggcctggtgatcagcagcctggccgaccaggccgccggcaagggcaagagcaagtttgtgccctacagagattctgtgctgacctggctgctgaaggacaacctgggcggcaacagccagacctccatgattgccaccatcagccctgctgctgacaactatgaggagaccctgagcaccctgcgctatgctgaccgggccaagagaattgtgaaccacgctgtggtgaatgaagaccccaatgccaaggtgatccgggagctgcgggaggaggtggagaagctgcgggagcagctgagccaggccgaggccatgaaggcccctgagctgaaggagaagctggaggagagcgagaagctgatcaaggagctgactgtgacctgggaggagaagctgaggaagacagaggagatcgcccaggagcggcagaggcagctggagagcatgggcatcagcctggagatgagcggcatcaaggtgggagatgacaagtgctacctggtgaacctgaatgctgaccctgccctgaatgagctgctggtgtactacctgaaggaccacaccagggtgggcgctgacaccagccaggacatccagctgtttggaattggcatccagccccagcactgtgaaattgacatcgccagtgatggagatgtgaccctgacccccaaggaaaatgcccggagctgtgtgaatggcaccctggtgtgcagcaccacccagctgtggcatggagaccgcatcctgtggggcaacaaccacttcttccgcatcaacctgcccaagaggaagaggcgggactggctgaaggactttgagaaggagactggacctcctgagcatgacctggatgctgccagcgaggccagcagcgagccagactacaactatgaatttgcccagatggaggtgatcatgaagaccctgaacagcaatgaccctgtgcagaatgtggtgcaggtgctggagaagcagtacctggaggagaagaggtctgccctggaggagcagaggctgatgtatgaaagagagctggagcagctgcggcagcagctgagcccagaccggcagccccagagcagcggccctgaccggctggcctacagcagccagacagcccagcagaaggtgacccagtgggccgaggagagagatgagctgttccggcagagcctggccaagctgcgggagcagctggtgaaggccaacaccctggtgcgggaggccaacttcctggccgaggagatgagcaagctgacagactaccaggtgaccctgcagatcccagctgccaacctgagcgccaacaggaagagaggagccatcgtgtctgagcccgccatccaggtgcggaggaagggcaagagcacccaggtgtggaccatcgagaagctggagaacaagctgattgacatgagggacctgtaccaggagtggaaggagaaggtgcctgaggccaagaggctgtatggcaagagaggagaccccttctatgaggcccaggagaaccacaacctgattggagtggccaacgtgttcctggagtgcctcttctgtgatgtgaagctgcagtatgctgtgcccatcatcagccagcagggcgaggtggccggccgcctgcacgtggaggtgatgagggtgactggagctgtgcctgagcgggtggtggaggatgacagcagcgagaacagcagcgagagcggcagcctggaggtggtggacagcagtggagagatcatccaccgggtgaagaagctgacctgccgggtgaagatcaaggaggccaccggcctgcccctgaacctgagcaactttgtgttctgccagtacaccttctgggaccagtgtgagagcacagtggccgcccctgtggtggaccctgaggtgcccagcccccagagcaaggatgcccagtacacagtgaccttcagccactgcaaggactatgtggtgaatgtgacagaggagttcctggagttcatcagtgatggagccctggccatcgaggtgtggggccaccgctgtgctggaaatggcagcagcatctgggaggtggacagcctgcacgccaagaccaggaccctgcatgaccgctggaatgaggtgaccaggagaattgagatgtggatcagcatcctggagctgaatgagctgggggagtatgctgctgtggagctgcaccaggccaaggatgtgaacacaggaggcatcttccagctgcggcagggccacagcagaagagtgcaggtgacagtgaagcctgtgcagcacagcggcaccctgcccctgatggtggaggccatcctgtctgtgtccatcggctgtgtgacagcccggagcaccaagctgcagaggggcctggacagctaccaggaggaggacctgaactgtgtgcgggagcgctggagcgatgccctgatcaagaggcgggagtacctggatgagcagatcaagaaggtgagcaacaagacagagaagacagaagatgatgtggagcgggaggcccagctggtggagcagtgggtgggcctgacagaggagagaaatgctgtgctggtgcctgcccctggcagcggcatccctggggccccagctgactggatccccccacctggcatggagacccacatccctgtgctcttcctggacctgaatgctgatgacctgagcgccaatgagcagctggtgggcccccacgccagcggcgtgaacagcatcctgcccaaggagcacggcagccagttcttctacctgcccatcatcaagcacagtgatgatgaggtgtctgccacagcctcctgggacagctctgtgcatgacagcgtgcacctgaacagagtgaccccccagaatgaaagaatctacctgattgtgaagaccaccgtgcagctgagccaccctgctgccatggagctggtgctgaggaagagaattgctgccaacatctacaacaagcagagcttcacccagagcctgaagaggcgcatcagcctgaagaacatcttctacagctgtggggtgacctatgagatcgtgagcaacatccccaaggccacagaggagattgaggaccgggagaccctggccctgctggccgcccggagtgaaaatgaaggcaccagtgatggagagacctacatcgagaagtacacccggggcgtgctgcaggtggagaacatcctgagcctggagcggctgcggcaggccgtgacagtgaaggaggccctgagcaccaaggcccggcacatcagaagaagcctgagcacccccaacgtgcacaacgtgagcagcagcaggccagacctgagcggctttgatgaagatgacaagggctggccagagaaccagctggacatgtctgactacagcagcagctaccaggatgtggcctgctacggcaccctgccccgggacagccccaggaggaacaaggagggctgcaccagcgagaccccccacgccctgactgtgagccccttcaaggccttcagcccccagccccccaagttcttcaagcccctgatgcctgtgaaggaggagcacaagaagagaattgccctggaggcccggcccctgctgagccaggaggacagcgaggaggaggagaatgagctggaggccatcaacaggaagctgatcagcagccagccctacgtgcctgtggagtttgctgacttctctgtgtacaatgccagcctggagaaccgggagtggttcagcagcaaggtggacctgagcaacagccgggtgctggagaaggaggtgagccgcagccccaccaccagcagcatcaccagcggctacttcagccacagcgccagcaatgccaccctgagtgacatggtggtgcccagcagtgacagcagtgaccagctggccatccagaccaaggatgctgacagcacagagcacagcacccccagcctggtgcatgacttccggcccagcagcaacaaggagctgacagaggtggagaagggcctggtgaaggacaagatcatcgtggtgcccctgaaggaaaattctgccctggccaagggcagccccagcagccagagcatccctgagaagaacagcaagagcctgtgcaggacaggcagctgcagcgagctggatgcctgccccagcaagatcagccagcctgcccggggcttctgcccccgggaggtgacagtggagcacaccaccaacatcctggaggaccacagcttcacagagttcatgggcgtgtctgagggcaaggactttgatggcctgacagacagcagcgctggggagctgagcagcagaagaagcctgcccaacaagacaggaggcaagacagtgtctgatggcctgcaccaccccagccagctgcacagcaagctggagaatgaccaggtgatcatccctgaggccgccttctgggtgctgtgctgccagtag

SEQ ID NO: 157015 - DNA, 213 bp, Artificial Sequence
  Description of Artificial Sequence: Synthetic coding sequence
atgtctgacaccaaggtgaaggtggccgtgcgggtgcggcccatgaacagaagagagctggagctgaacaccaagtgtgtggtggagatggagggcaaccagacagtgctgcaccccccacccagcaacaccaagcagggcgagcggctggtgacagtggcccacatcagcaacagcagcaccctgggcggccagggcaagaggatcacctag

SEQ ID NO: 157016 - DNA, 1038 bp, Artificial Sequence
  Description of Artificial Sequence: Synthetic coding sequence
atgcccaagctgctgaagagcctcttccctgtgagagatgagaagaggggcaagaggcccagccccctggcccaccaggcccagcctgagatgggcccagatgtgctggtgcagaccatgggcgccccagccctgaagatctgtgacaagccagccaaggtgcccagccccccacctgtgattgctgtgacagctgtgaccccagcccctgaggcccaggacggcccccccagccccctgtctgaggccagcagcggctacttcagccacagcgtgtccacagccaccctgagtgatgccctgggccctggcctggatgctgctgcccctcctggctccatgcccacagcccctgaggccgagcctgaggcccccatcagccaccccccaccacccacagctgtgcctgctgaggagcccccaggcccccagcagctggtgtccccaggccgggagaggccagacctggaggccccagcccctggcagccccttccgggtgcggcgggtgcgggccagcgagctgcgctccttcagcaggatgctggccggggaccccggctgcagccctggagctgagggcaatgccccagcccctggagctgggggccaggccctggccagtgacagcgaggaggctgatgaggtgcctgagtggctgcgggagggggagtttgtgacagtgggcgcccacaagacaggagtggtgcgctacgtgggccctgctgacttccaggagggcacctgggtgggcgtggagctggacctgcccagcggcaagaatgatggcagcattggaggcaagcagtacttccgctgcaaccctggctacggcctgctggtgcggcccagccgggtgagaagagccaccggccctgtgagaagaagaagcacaggcctgcggctgggcgcccctgaggcccggcgcagcgccaccctgagcggcagcgccaccaacctggccagcctgacagctgccctggccaaggctgacaggagccacaagaaccctgagaacaggaagtcctgggccagctag

SEQ ID NO: 157017 - DNA, 5481 bp, Artificial Sequence
  Description of Artificial Sequence: Synthetic coding sequence
atgggagacagcaaggtgaaggtggccgtgcgcatccggcccatgaacagaagagaaacagacctgcacaccaagtgtgtggtggatgtggatgccaacaaggtgatcctgaaccctgtgaacaccaacctgagcaaaggagatgcccggggccagcccaaggtgtttgcctatgaccactgcttctggagcatggatgagagcgtgaaggagaagtatgccggccaggacatcgtgttcaagtgcctgggggagaacatcctgcagaatgcctttgatggctacaatgcctgcatctttgcctacggccagacaggcagcggcaagagctacaccatgatgggcacagctgaccagcccggcctcatcccccggctgtgcagcggcctgtttgagaggacccagaaggaggagaatgaggagcagagcttcaaggtggaggtgtcctacatggagatctacaatgagaaggtgcgggacctgctggaccccaagggcagccggcagaccctgaaggtgcgggagcacagcgtgctgggcccctacgtggatggcctgagcaagctggccgtgaccagctacaaggacatcgagagcctgatgtctgagggcaacaagagcaggacagtggccgccaccaacatgaatgaggagagcagccgcagccatgctgtgttcaagatcaccctgacccacaccctgtatgatgtgaagagcggcaccagcggggagaaggtgggcaagctgagcctggtggacctggccggcagcgagcgggccaccaagacaggagctgctggggaccggctgaaggagggcagcaacatcaacaagagcctgaccaccctgggcctggtgatcagcgccctggccgaccagagcgctgggaagaacaagaacaagtttgtgccctacagagacagcgtgctgacctggctgctgaaggacagcctgggcggcaacagcaagacagccatggtggccaccgtgtccccagctgctgacaactatgatgagaccctgagcaccctgcgctatgctgaccgggccaagcacatcgtgaaccacgctgtggtgaatgaagaccccaatgcccgcatcatccgggacctgcgggaggaggtggagaagctgcgggagcagctgaccaaggccgaggccatgaagagccctgagctgaaggaccggctggaggagagcgagaagctgatccaggagatgacagtgacctgggaggagaagctgaggaagacagaggagatcgcccaggagcggcagaagcagctggagagcctgggcatcagcctgcagagcagcggcatcaaggtgggagatgacaagtgcttcctggtgaacctgaatgctgaccctgccctgaatgagctgctggtgtactacctgaaggagcacaccctgattggcagcgccaacagccaggacatccagctgtgtggcatgggcatcctgcctgagcactgcatcatcgacatcaccagcgagggccaggtgatgctgaccccccagaagaacaccaggacctttgtgaatggcagctctgtgagcagccccatccagctgcaccacggggaccgcatcctgtggggcaacaaccacttcttccggctgaacctgcccaagaagaagaagaaggccgagcgggaggatgaggaccaggaccccagcatgaagaatgaaaacagcagcgagcagctggatgtggatggagacagcagcagcgaggtgtcctctgaggtgaacttcaactatgaatatgcccagatggaggtgaccatgaaggccctgggcagcaatgaccccatgcagagcatcctgaacagcctggagcagcagcacgaggaggagaagaggtctgccctggagcggcagaggctgatgtatgaacatgagctggagcagctgcggcggcggctgagccctgagaagcagaactgccgctccatggaccgcttctccttccacagccccagcgcccagcagaggctgcggcagtgggccgaggagcgggaggccaccctgaacaacagcctgatgaggctgcgggagcagatcgtgaaggccaacctgctggtgcgggaggccaactacatcgccgaggagctggacaagaggacagagtacaaggtgaccctgcagatcccagccagcagcctggatgccaacaggaagaggggcagcctgctgtctgagcccgccatccaggtgcggaggaagggcaagggcaagcagatctggagcctggagaagctggacaaccggctgctggacatgagggacctgtaccaggagtggaaggaatgtgaggaggacaaccctgtgatccgcagctacttcaagagagctgaccccttctatgatgagcaggagaaccacagcctcatcggcgtggccaacgtgttcctggagagcctcttctatgatgtgaagctgcagtatgctgtgcccatcatcaaccagaagggggaggtggccggccgcctgcacgtggaggtgatgaggctgtctggagatgtgggggagagaattgctggaggagatgaggtggccgaggtgtcctttgagaaggagacccaggagaacaagctggtgtgcatggtgaagatcctgcaggccaccggcctgccccagcacctgagccactttgtgttctgcaagtacagcttctgggaccagcaggagcccgtcatcgtggcccctgaggtggacaccagcagcagctctgtgtccaaggagccccactgcatggtggtgtttgaccactgcaatgagttctctgtgaacatcacagaggacttcatcgagcacctgtctgagggcgccctggccatcgaggtgtatggccacaagatcaatgaccccaggaagaacccagccctgtgggacctgggcatcatccaggccaagaccaggagcctgcgggaccgctggagcgaggtgaccaggaagctggagttctgggtgcagatcctggagcagaatgaaaatggagagtactgccctgtggaggtgatcagcgccaaggatgtgcccactggaggcatcttccagctgcggcagggccagagcagaagagtgcaggtggaggtgaagtctgtgcaggagagcggcaccctgcccctgatggaggagtgcatcctgtctgtgggcatcggctgtgtgaaggtgcggcccctgcgggcccccaggacccatgagaccttccacgaggaggaggaggacatggacagctaccaggaccgggacctggagcggctgcggaggaagtggctgaatgccctgaccaagaggcaggagtacctggaccagcagctgcagaagctggtgtccaagagggacaagacagaagatgatgctgaccgggaggcccagctgctggagatgaggctgaccctgacagaggagagaaatgctgtgatggtgcccagcgctggcagcggcatccctggggccccagctgagtggacccctgtgcccggcatggagacccacatccctgtgatcttcctggacctgaatgctgatgacttcagcagccaggacaacctggatgatcctgaggccggcggctgggatgccaccctgactggagaggaggaggaggagttctttgagctgcagatcgtgaagcagcatgatggagaggtgaaggccgaggcctcctgggacagcgctgtgcacggctgcccccagctgagccggggcacccctgtggatgagcggctcttcctgattgtgcgggtgacagtgcagctgagccaccctgctgacatgcagctggtgctgaggaagaggatctgtgtgaatgtgcacggccggcagggctttgcccagagcctgctgaagaagatgagccacaggagcagcatccctggctgcggcgtgacctttgagatcgtgagcaacatcccagaagatgcccagggcgtggaggagcgggaggccctggccaggatggccgccaacgtggagaacccagccagcgctgacagcgaggcctacatcgagaagtacctgcggtctgtgctggccgtggagaacctgctgaccctggaccggctgcggcaggaggtggccgtgaaggagcagctgaccgggaagggcaagctgagcagaagaagcatcagcagccccaacgtgaaccggctgagcggcagccggcaggacctgatccccagctacagcctgggcagcaacaagggccgctgggagagccagcaggatgtgtcccagaccaccgtgtcccggggcatcgccccagccccagccctgtctgtgagcccccagaacaaccacagcccagaccccggcctgagcaacctggccgccagctacctgaaccctgtgaagagctttgtgccccagatgcccaagctgctgaagagcctcttccctgtgagagatgagaagaggggcaagaggcccagccccctggcccaccagcctgtgccccgcatcatggtgcagagcgccagcccagacatccgggtgaccaggatggaggaggcccagcctgagatgggcccagatgtgctggtgcagaccatgggcgccccagccctgaagatctgtgacaagccagccaaggtgcccagccccccacctgtgattgctgtgacagctgtgaccccagcccctgaggcccaggacggcccccccagccccctgtctgaggccagcagcggctacttcagccacagcgtgtccacagccaccctgagtgatgccctgggccctggcctggatgctgctgcccctcctggctccatgcccacagcccctgaggccgagcctgaggcccccatcagccaccccccaccacccacagctgtgcctgctgaggagcccccaggcccccagcagctggtgtccccaggccgggagaggccagacctggaggccccagcccctggcagccccttccgggtgagaagagtgcgggccagcgagctgcggagcttcagcaggatgctggccggggaccccggctgcagccctggagctgagggcaatgccccagcccctggggccggcggccaggccctggccagtgacagcgaggaggctgatgaggtgcctgagtggctgcgggagggggagtttgtgacagtgggcgcccacaagacaggagtggtgcgctacgtgggccctgctgacttccaggagggcacctgggtgggcgtggagctggacctgcccagcggcaagaatgatggcagcatcggcggcaagcagtacttccgctgcaaccctggctacggcctgctggtgcggcccagccgggtgcggcgggccactggacctgtgagaagaagaagcacaggcctgcggctgggcgcccctgaggccaggagaagtgccaccctgagcggcagcgccaccaacctggccagcctgacagctgccctggccaaggctgacaggagccacaagaacccagaaaataggaagtcctgggccagctag

SEQ ID NO: 157018 - DNA, 4947 bp, Artificial Sequence
  Description of Artificial Sequence: Synthetic coding sequence
atgagcctgcacagcacccacaacagaaacaacagcggggacatcctggacatccccagcagccagaacagcagcagcctgaatgccctgacccacagcagccggctgaagctgcacctgaagagtgacatgtctgaatgtgaaaatgatgaccccctgctgcggtctgctgggaaggtgcgggacatcaacagaacctacgtgatcagcgccagcaggaagacagctgacatgcccctgacccccaaccctgtgggccgcctggccctgcagaggaggaccaccaggaacaaggagagcagcctgctggtgtctgagctggaggacaccacagagaagacagctgagacccggctgaccctgcagaggcgggccaagacagattctgctgagaagtggaagacagctgagattgacagcgtgaagatgaccctgaatgtgggcggggagacagagaacaacggggtgtccaaggagagcaggaccaacgtgcgcatcgtgaacaatgccaagaacagctttgtggccagctctgtgcccctggatgaggacccccaggtgattgagatgatggctgacaagaagtacaaggagaccttcagcgcccccagccgggccaatgaaaatgtggccctgaagtacagcagcaacagaccacccatcgccagcctgagccagacagaggtggtgcgcagcggccacctgaccaccaagcccacccagagcaagctggacatcaaggtgctgggcactggaaacctgtaccacaggagcatcggcaaggagatcgccaagaccagcaacaagtttggcagcctggagaagaggacccccaccaagtgcaccacagagcacaagctgaccaccaagtgcagcctgccccagctgaagagccctgcccccagcatcctgaagaacaggatgagcaacctgcaggtgaagcagaggcccaagagcagcttcctggccaacaagcaggagaggtctgctgagaacaccatcctgcctgaggaggagaccgtggtgcagaacaccagcgctgggaaggaccccctgaaggtggagaacagccaggtgacagtggccgtgcgggtgcggcccttcaccaagcgggagaagattgagaaggccagccaggtggtgttcatgtctgggaaggagatcaccgtggagcacccagacaccaagcaggtgtacaacttcatctatgatgtgtccttctggagctttgatgagtgccacccccactacgccagccagaccaccgtgtatgagaagctggccgcccccctgctggagcgggcctttgagggcttcaacacctgcctgtttgcctacggccagacaggcagcggcaagagctacaccatgatgggcttcagcgaggagcccggcatcatcccccgcttctgtgaggacctcttcagccaggtggccaggaagcagacccaggaggtgtcctaccacatcgagatgtccttctttgaggtgtacaatgagaagatccatgacctgctggtgtgcaaggatgaaaatggccagaggaagcagcccctgcgggtgcgggagcaccctgtgtatggcccctacgtggaggccctgtccatgaacatcgtgtcctcctatgctgacatccagagctggctggagctgggcaacaagcagagggccacagctgccaccggcatgaatgacaagagcagccgcagccacagcgtcttcaccctggtgatgacccagaccaagacagaatttgtggagggggaggagcatgaccaccgcatcaccagccgcatcaacctgattgacctggccggcagcgagcgctgcagcacagcccacaccaacggggaccggctgaaggagggcgtgtccatcaacaagagcctgctgaccctgggcaaggtgatcagcgccctgtctgagcaggccaaccagaggagcgtcttcatcccctaccgggagagcgtgctgacctggctgctgaaggagagcctgggcggcaacagcaagacagccatgattgccaccatcagccctgctgccagcaacatcgaggagaccctgagcaccctgcgctatgccaaccaggcccggctgattgtgaacatcgccaaggtgaatgaagacatgaatgccaagctgatccgggagctgaaggccgagatcgccaagctgaaggccgcccagaggaacagcaggaacatcgaccctgagcgctaccgcctgtgccggcaggagatcaccagcctgaggatgaagctgcaccagcaggagcgggacatggccgagatgcagagggtgtggaaggagaagtttgagcaggccgagaagaggaagctgcaggagaccaaggagctgcagaaggccggcatcatgttccagatggacaaccacctgcccaacctggtgaacctgaatgaagacccccagctgtctgagatgctgctgtacatgatcaaggagggcaccaccaccgtgggcaagtacaagcccaacagcagccatgacatccagctgtctggagtgctgattgctgatgaccactgcaccatcaagaactttggaggcaccgtgtccatcatccctgtgggggaggccaagacctacgtgaatggcaagcacatcctggagatcaccgtgctgcggcacggggacagagtcatcctgggcggggaccactacttccgcttcaaccaccctgtggaggtgcagaagggcaagaggccttctggccgggacacccccatcagcgagggccccaaggactttgaatttgccaagaatgagctgctgatggcccagaggagccagctggaggccgagatcaaggaggcccagctgaaggccaaggaggagatgatgcagggcatccagatcgccaaggagatggcccagcaggagctgagcagccagaaggccgcctatgagagcaagatcaaggccctggaggccgagctgcgggaggagagccagaggaagaagatgcaggagatcaacaaccagaaggccaaccacaagattgaggagctggagaaggccaagcagcacctggagcaggagatctacgtgaacaagaagaggctggagatggagaccctggccaccaagcaggccctggaggaccacagcatcagacatgcccgcatcctggaggccctggagacagagaagcagaagatcgccaaggaggtgcagatcctgcagcagaacagaaacaacagagacaagaccttcaccgtgcagaccacctggagctccatgaagctgtccatgatgatccaggaggccaatgccatcagcagcaagctgaagacctactacgtgtttggaagacatgacatcagtgacaagagcagcagtgacaccagcatccgggtgaggaacctgaagctgggcatcagcaccttctggagcctggagaagtttgagagcaagctggccgccatgaaggagctgtatgagagcaatggcagcaacagaggagaagatgccttctgtgaccctgaagatgagtgggagccagacatcacagatgcccctgtgagcagcctgagcagaagaagaagccgcagcctgatgaagaacagacgcatcagcggctgcctgcatgacatccaggtgcaccccatcaagaacctgcacagcagccacagcagcggcctgatggacaagagcagcaccatctacagcaacagcgctgagagcttcctgcccggcatctgcaaggagctgattggcagcagcctggacttcttcggccagagctatgatgaggagaggaccatcgctgacagcctcatcaacagcttcctgaagatctacaacggcctgtttgccatcagcaaggcccacgaggagcaggatgaggagagccaggacaacctcttcagcagtgaccgggccatccagagcctgaccatccagacagcctgtgcctttgagcagctggtggtgctgatgaagcactggctgagtgacctgctgccctgcaccaacatcgcccggctggaggatgagctgcggcaggaggtgaagaagctgggcggctacctgcagctgttcctgcagggctgctgcctggacatcagctccatgatcaaggaggcccagaagaatgccatccagatcgtgcagcaggccgtgaagtatgtgggccagctggccgtgctgaagggcagcaagctgcacttcctggagaatggaaacaacaaggccgcctctgtgcaggaggagttcatggatgctgtgtgtgatggagtgggcctgggcatgaagatcctgctggacagcggcctggagaaggccaaggagctgcagcacgagctgttccggcagtgcaccaagaatgaggtgaccaaggagatgaagaccaatgccatgggcctcatccgcagcctggagaacatctttgctgagagcaagatcaagagcttccggcggcaggtgcaggaggagaactttgagtaccaggacttcaagaggatggtgaacagagcccctgagttcctgaagctgaagcactgcctggagaaggccatcgagatcatcatcagcgccctgaagggctgccacagcgacatcaacctgctgcagacctgtgtggagagcatccggaacctggccagtgacttctacagcgacttctctgtgcccagcacctctgtgggcagctatgagagccgggtgacccacatcgtgcaccaggagctggagagcctggccaagagcctgctcttctgctttgagagcgaggagagcccagacctgctgaagccctgggagacctacaaccagaacaccaaggaggagcaccagcagagcaagagcagcggcattgatggcagcaagaacaagggcgtgcccaagagggtgtatgagctgcacggcagcagccctgctgtgtccagtgaagaatgtacccccagccgcatccagtgggtgtag

SEQ ID NO: 157019 - DNA, 5073 bp, Artificial Sequence
  Description of Artificial Sequence: Synthetic coding sequence
atggccggggcctctgtgaaggtggccgtgcgggtgcggcccttcaacagccgggagatgagccgggacagcaagtgcatcatccagatgagcggcagcaccaccaccatcgtgaaccccaagcagcccaaggagacccccaagagcttctcctttgactacagctactggagccacaccagccctgaggacatcaactatgccagccagaagcaggtgtacagagacattggagaggagatgctgcagcacgcctttgagggctacaacgtgtgcatctttgcctacggccagacaggagctgggaagagctacaccatgatgggcaagcaggagaaggaccagcagggcatcatcccccagctgtgtgaggacctcttcagccgcatcaatgacaccaccaatgacaacatgagctacagcgtggaggtgtcctacatggagatctactgtgagcgggtgcgggacctgctgaaccccaagaacaagggcaacctgcgggtgcgggagcaccccctgctgggcccctacgtggaggacctgagcaagctggccgtgaccagctacaatgacatccaggacctgatggacagcggcaacaaggccaggacagtggccgccaccaacatgaatgagaccagcagccgcagccatgctgtgttcaacatcatcttcacccagaagagacatgatgctgagaccaacatcaccacagagaaggtgtccaagatcagcctggtggacctggccggcagcgagagagctgacagcactggagccaagggcacccggctgaaggagggcgccaacatcaacaagagcctgaccaccctgggcaaggtgatcagcgccctggccgagatggacagcggccccaacaagaacaagaagaagaagaagacagacttcatcccctacagagattctgtgctgacctggctgctgcgggagaacctgggcggcaacagcaggacagccatggtggccgccctgagccctgctgacatcaactatgatgagaccctgagcaccctgcgctatgctgaccgggccaagcagatccgctgcaatgctgtgatcaatgaagaccccaacaacaagctgatccgggagctgaaggatgaggtgacccggctgcgggacctgctgtatgcccagggcctgggggacatcacagacatgaccaatgccctggtgggcatgagccccagcagcagcctgagcgccctgagcagccgggccgcctctgtgagcagcctgcacgagcgcatcctgtttgcccctggcagcgaggaggccatcgagcggctgaaggagacagagaagatcatcgccgagctgaatgagacctgggaggagaagctgcggaggacagaggccatccgcatggagcgggaggccctgctggccgagatgggcgtggccatgagagaagatggcggcaccctgggcgtcttcagccccaagaagaccccccacctggtgaacctgaatgaagaccccctgatgtctgaatgtctgctgtactacatcaaggatggcatcaccagggtgggcagagaagatggagagcggcggcaggacatcgtgctgagcggccacttcatcaaggaggagcactgtgtgttcagaagtgacagcagaggaggcagcgaggccgtggtgaccctggagccctgtgagggcgctgacacctacgtgaatggcaagaaggtgacagagcccagcatcctgcggagcggcaaccgcatcatcatgggcaagagccacgtgttccgcttcaaccaccctgagcaggcccggcaggagcgggagaggaccccctgtgccgagaccccagctgagcctgtggactgggcctttgcccagcgggagctgctggagaagcagggcatcgacatgaagcaggagatggagcagaggctgcaggagctggaggaccagtaccgccgggagcgggaggaggccacctacctgctggagcagcagaggctggactatgagagcaagctggaggccctgcagaagcagatggacagccgctactacccagaggtgaatgaggaggaggaggagccagaagatgaggtgcagtggacagaaagagaatgtgagctggccctgtgggccttcaggaagtggaagtggtaccagttcaccagcctgcgggacctgctgtggggcaatgccatcttcctgaaggaggccaatgccatctctgtggagctgaagaagaaggtgcagttccagtttgtgctgctgacagacaccctgtacagccccctgcccccagacctgctgcccccagaggccgccaaggaccgggagacccggcccttccccaggaccatcgtggccgtggaggtgcaggaccagaagaatggagccacccactactggaccctggagaagctgcggcagaggctggacctgatgagggagatgtatgacagagctgctgaggtgcccagctctgtgattgaggactgtgacaacgtggtgactggaggagaccccttctatgaccgcttcccctggttccggctggtgggccgggcctttgtgtacctgagcaacctgctgtaccctgtgcccctggtgcaccgggtggccatcgtgtctgagaagggggaggtgaagggcttcctgcgggtggccgtgcaggccatctctgcagatgaggaggccccagactatggcagcggcgtgcggcagagcggcacagccaagatcagctttgatgaccagcactttgagaagttccagagcgagagctgccctgtggtgggcatgagccgcagcggcaccagccaggaggagctgagaattgtggagggccagggccagggcgcagatgtgggccccagcgcagatgaggtgaacaacaacacctgcagcgctgtgcccccagagggcctgctgctggacagcagcgagaaggccgccctggatggccccctggatgctgccctggaccacctgcggctgggcaacaccttcaccttccgggtgacagtgctgcaggccagcagcatctctgcagaatatgctgacatcttctgccagttcaacttcatccacagacatgatgaggccttcagcacagagcccctgaagaacacaggccggggcccccccctgggcttctaccacgtgcagaacattgctgtggaggtgaccaagagcttcatcgagtacatcaagagccagcccatcgtgtttgaggtgtttggccactaccagcagcaccccttcccccccctgtgcaaggatgtgctgagccccctgcggcccagccgccgccacttcccccgggtgatgcccctgagcaagcctgtgcctgccaccaagctgagcaccctgacccggccctgccccggcccctgccactgcaagtatgacctgctggtgtactttgagatctgtgagctggaggccaatggagactacatcccagctgtggtggaccacagaggaggcatgccctgcatgggcaccttcctgctgcaccagggcatccagaggcgcatcaccgtgaccctgctgcatgaaacaggcagccacatccgctggaaggaggtgcgggagctggtggtgggccgcatccggaacaccccagagacagatgagagcctgattgaccccaacatcctgagcctgaacatcctgagcagcggctacatccacccagcccaggatgacaggaccttctaccagtttgaggccgcctgggacagctccatgcacaacagcctgctgctgaacagagtgaccccctaccgggagaagatctacatgaccctgagcgcctacatcgagatggagaactgcacccagcctgctgtggtgaccaaggacttctgcatggtgttctacagcagagatgccaagctgcctgccagccgcagcatccggaacctgtttggcagcggcagcctgcgggccagcgagagcaacagagtgactggagtgtatgagctgagcctgtgccacgtggctgatgctggcagccctggcatgcagaggagaagaagaagagtgctggacacctctgtggcctacgtgcggggggaggagaacctggccggctggaggcccaggagtgacagcctcatcctggaccaccagtgggagctggagaagctgagcctgctgcaggaggtggagaagaccaggcactacctgctgctgcgggagaagctggagacagcccagaggcctgtgcctgaggccctgagccctgccttcagcgaggacagcgagagccacggcagcagcagcgccagcagccccctgtctgctgagggccggcccagccccctggaggccccaaatgaaaggcagcgggagctggccgtgaagtgcctgcggctgctgacccacaccttcaaccgggagtacacccacagccacgtgtgtgtgtctgccagcgagagcaagctgtctgagatgtctgtgaccctgctgcgggaccccagcatgagccccctgggcgtggccaccctgacccccagcagcacctgccccagcctggtggagggccgctacggggccacagacctgcggaccccccagccctgcagcaggcctgccagccctgagcctgagctgctgcctgaggccgacagcaagaagctgcccagccctgcccgggccacagaaacagacaaggagccccagaggctgctggtgcctgacatccaggagatccgggtgagccccatcgtgtccaagaagggctacctgcacttcctggagccccacaccagcggctgggccaggagatttgtggtggtgcggcggccctatgcctacatgtacaacagcgacaaggacacagtggagagatttgtgctgaacctggccacagcccaggtggagtacagcgaggaccagcaggccatgctgaagacccccaacacctttgctgtgtgcacagagcaccggggcatcctgctgcaggccgccagtgacaaggacatgcatgactggctgtatgccttcaaccccctgctggccggcaccatccgcagcaagctgagcagaagaagaagtgcccagatgagggtgtag

SEQ ID NO: 157020 - DNA, 5400 bp, Artificial Sequence
  Description of Artificial Sequence: Synthetic coding sequence
atggccggggcctctgtgaaggtggccgtgcgggtgcggcccttcaacagccgggagatgagccgggacagcaagtgcatcatccagatgagcggcagcaccaccaccatcgtgaaccccaagcagcccaaggagacccccaagagcttctcctttgactacagctactggagccacaccagccctgaggacatcaactatgccagccagaagcaggtgtacagagacattggagaggagatgctgcagcacgcctttgagggctacaacgtgtgcatctttgcctacggccagacaggagctgggaagagctacaccatgatgggcaagcaggagaaggaccagcagggcatcatcccccagctgtgtgaggacctcttcagccgcatcaatgacaccaccaatgacaacatgagctacagcgtggaggtgtcctacatggagatctactgtgagcgggtgcgggacctgctgaaccccaagaacaagggcaacctgcgggtgcgggagcaccccctgctgggcccctacgtggaggacctgagcaagctggccgtgaccagctacaatgacatccaggacctgatggacagcggcaacaaggccaggacagtggccgccaccaacatgaatgagaccagcagccgcagccatgctgtgttcaacatcatcttcacccagaagagacatgatgctgagaccaacatcaccacagagaaggtgtccaagatcagcctggtggacctggccggcagcgagagagctgacagcactggagccaagggcacccggctgaaggagggcgccaacatcaacaagagcctgaccaccctgggcaaggtgatcagcgccctggccgagatggtgtctggccctgccaggaacaagaagaagaagaagacagacttcatcccctacagagattctgtgctgacctggctgctgcgggagaacctgggcggcaacagcaggacagccatggtggccgccctgagccctgctgacatcaactatgatgagaccctgagcaccctgcgctatgctgaccgggccaagcagatccgctgcaatgctgtgatcaatgaagaccccaacaacaagctgatccgggagctgaaggatgaggtgacccggctgcgggacctgctgtatgcccagggcctgggggacatcacagacaccaacacagtgcctgggggccccaagctgaccaatgccctggtgggcatgagccccagcagcagcctgagcgccctgagcagcagagctgcctctgtgagcagcctgcacgagcgcatcctgtttgcccctggcagcgaggaggccatcgagcggctgaaggagacagagaagatcatcgccgagctgaatgagacctgggaggagaagctgcggaggacagaggccatccgcatggagcgggaggccctgctggccgagatgggcgtggccatgagagaagatggcggcaccctgggcgtcttcagccccaagaagaccccccacctggtgaacctgaatgaagaccccctgatgtctgagtgcctgctgtactacatcaaggatggcatcaccagggtgggccgggaggatggagagcggcggcaggacatcgtgctgagcggccacttcatcaaggaggagcactgtgtgttcagaagtgacagccggggcggcagcgaggccgtggtgaccctggagccctgtgagggcgctgacacctacgtgaatggcaagaaggtgacagagcccagcatcctgcggagcggcaaccgcatcatcatgggcaagagccacgtgttccgcttcaaccaccctgagcaggcccggcaggagcgggagaggaccccctgtgccgagaccccagctgagcctgtggactgggcctttgcccagcgggagctgctggagaagcagggcatcgacatgaagcaggagatggagcagaggctgcaggagctggaggaccagtacagaagagagcgggaggaggccacctacctgctggagcagcagaggctggactatgagagcaagctggaggccctgcagaagcagatggacagccgctactacccagaggtgaatgaggaggaggaggagccagaagatgaggtgcagtggacagagcgggagtgtgagctggccctgtgggccttcaggaagtggaagtggtaccagttcaccagcctgcgggacctgctgtggggcaatgccatcttcctgaaggaggccaatgccatctctgtggagctgaagaagaaggtgcagttccagtttgtgctgctgacagacaccctgtacagccccctgcccccagacctgctgcccccagaggccgccaaggaccgggagacccggcccttccccaggaccatcgtggccgtggaggtgcaggaccagaagaatggagccacccactactggaccctggagaagctgcggcagaggctggacctgatgagggagatgtatgacagagctgctgaggtgcccagctctgtgattgaggactgtgacaacgtggtgactggaggagaccccttctatgaccgcttcccctggttccggctggtgggcagcagcgccatcagcggctgcaacagctaccccctgctgaacacctgcatgtctgagaggatggccgccctgacccccagccccaccttcagcagcccagacagtgatgccacagagcctgctgaggagcagagcgtgggggaggaggaggaggaggaggaggaggaggaggatgaggaggaggaggacctggaggatgatgtgtttcctgagcacgccctgtgtgatggccgggaccccttctatgacaggcctcctctcttcagcctggtgggccgggcctttgtgtacctgagcaacctgctgtaccctgtgcccctggtgcaccgggtggccatcgtgtctgagaagggggaggtgaagggcttcctgcgggtggccgtgcaggccatctctgcagatgaggaggccccagactatggcagcggcgtgcggcagagcggcacagccaagatcagctttgatgaccagcactttgagaagttccagagcgagagctgccctgtggtgggcatgagccgcagcggcaccagccaggaggagctgcgcatcgtggagggccagggccagggcgcagatgtgggccccagcgcagatgaggtgaacaacaacacctgcagcgctgtgcccccagagggcctgctgctggacagcagcgagaaggccgccctggatggccccctggatgctgccctggaccacctgcggctgggcaacaccttcaccttccgggtgacagtgctgcaggccagcagcatctctgcagaatatgctgacatcttctgccagttcaacttcatccacagacatgatgaggccttcagcacagagcccctgaagaacacaggccggggcccccccctgggcttctaccacgtgcagaacattgctgtggaggtgaccaagagcttcatcgagtacatcaagagccagcccatcgtgtttgaggtgtttggccactaccagcagcaccccttcccccccctgtgcaaggatgtgctgagccccctgcggcccagcagaagacacttcccccgggtgatgcccctgagcaagcctgtgcctgccaccaagctgagcaccctgacccggccctgccccggcccctgccactgcaagtatgacctgctggtgtactttgagatctgtgagctggaggccaacggggactacatcccagctgtggtggaccaccggggcggcatgccctgcatgggcaccttcctgctgcaccagggcatccagaggcgcatcaccgtgaccctgctgcacgagaccggcagccacatccgctggaaggaggtgcgggagctggtggtgggccgcatccggaacaccccagagacagatgagagcctgattgaccccaacatcctgagcctgaacatcctgagcagcggctacatccacccagcccaggatgacagagtgtccctgggcaatgacaccaggaccttctaccagtttgaagctgcctgggacagctccatgcacaacagcctgctgctgaacagagtgaccccctaccgggagaagatctacatgaccctgagcgcctacatcgagatggagaactgcacccagcctgctgtggtgaccaaggacttctgcatggtgttctacagcagagatgccaagctgcctgccagccgcagcatccggaacctgtttggaagtggcagcctgcgggccagcgagagcaacagagtgactggagtgtatgagctgagcctgtgccacgtggctgatgctggcagccctggcatgcagaggagaagaagaagagtgctggacacctctgtggcctacgtgcggggggaggagaacctggccggctggaggcccaggagtgacagcctcatcctggaccaccagtgggagctggagaagctgagcctgctgcaggaggtggagaagaccaggcactacctgctgctgcgggagaagctggagacagcccagaggcctgtgcctgaggccctgagccctgccttctctgaagattctgagagccacggcagcagcagcgccagcagccccctgtctgctgagggccggcccagccccctggaggccccaaatgaaaggcagcgggagctggccgtgaagtgcctgcggctgctgacccacaccttcaaccgggagtacacccacagccacgtgtgtgtgtctgccagcgagagcaagctgtctgagatgtctgtgaccctgctgcgggaccccagcatgagccccctgggcgtggccaccctgacccccagcagcacctgccccagcctggtggagggccgctatggagccacagacctgcggaccccccagccctgcagcaggcctgccagccctgagcctgagctgctgcctgaggccgacagcaagaagctgcccagccctgcccgggccacagaaacagacaaggagccccagaggctgctggtgcctgacatccaggagatccgggtgagccccatcgtgtccaagaagggctacctgcacttcctggagccccacaccagcggctgggccaggagatttgtggtggtgagaagaccctatgcctacatgtacaacagcgacaaggacacagtggagagatttgtgctgaacctggccacagcccaggtggagtacagcgaggaccagcaggccatgctgaagacccccaacacctttgctgtgtgcacagagcaccggggcatcctgctgcaggccgccagtgacaaggacatgcatgactggctgtatgccttcaaccccctgctggccggcaccatccgcagcaagctgagcagaagaagaagtgcccagatgagggtgtag

SEQ ID NO: 157021 - DNA, 117 bp, Artificial Sequence
  Description of Artificial Sequence: Synthetic coding sequence
atggccggggcctctgtgaaggtggccgtgcgggtgcggcccttcaacagccgggagatgagccgggacagcaagtgcatcatccagatgagcggcagcaccaccaccatcgtgtag

SEQ ID NO: 157022 - DNA, 5376 bp, Artificial Sequence
  Description of Artificial Sequence: Synthetic coding sequence
atggccggggcctctgtgaaggtggccgtgcgggtgcggcccttcaacagccgggagatgagccgggacagcaagtgcatcatccagatgagcggcagcaccaccaccatcgtgaaccccaagcagcccaaggagacccccaagagcttctcctttgactacagctactggagccacaccagccctgaggacatcaactatgccagccagaagcaggtgtacagagacattggagaggagatgctgcagcacgcctttgagggctacaacgtgtgcatctttgcctacggccagacaggagctgggaagagctacaccatgatgggcaagcaggagaaggaccagcagggcatcatcccccagctgtgtgaggacctcttcagccgcatcaatgacaccaccaatgacaacatgagctacagcgtggaggtgtcctacatggagatctactgtgagcgggtgcgggacctgctgaaccccaagaacaagggcaacctgcgggtgcgggagcaccccctgctgggcccctacgtggaggacctgagcaagctggccgtgaccagctacaatgacatccaggacctgatggacagcggcaacaaggccaggacagtggccgccaccaacatgaatgagaccagcagccgcagccatgctgtgttcaacatcatcttcacccagaagagacatgatgctgagaccaacatcaccacagagaaggtgtccaagatcagcctggtggacctggccggcagcgagagagctgacagcactggagccaagggcacccggctgaaggagggcgccaacatcaacaagagcctgaccaccctgggcaaggtgatcagcgccctggccgagatggacagcggccccaacaagaacaagaagaagaagaagacagacttcatcccctacagagattctgtgctgacctggctgctgcgggagaacctgggcggcaacagcaggacagccatggtggccgccctgagccctgctgacatcaactatgatgagaccctgagcaccctgcgctatgctgaccgggccaagcagatccgctgcaatgctgtgatcaatgaagaccccaacaacaagctgatccgggagctgaaggatgaggtgacccggctgcgggacctgctgtatgcccagggcctgggggacatcacagacaccaacacagtgcctgggggccccaagctgaccaatgccctggtgggcatgagccccagcagcagcctgagcgccctgagcagcagagctgcctctgtgagcagcctgcacgagcgcatcctgtttgcccctggcagcgaggaggccatcgagcggctgaaggagacagagaagatcatcgccgagctgaatgagacctgggaggagaagctgcggaggacagaggccatccgcatggagcgggaggccctgctggccgagatgggcgtggccatgagagaagatggcggcaccctgggcgtcttcagccccaagaagaccccccacctggtgaacctgaatgaagaccccctgatgtctgagtgcctgctgtactacatcaaggatggcatcaccagggtgggccgggaggatggagagcggcggcaggacatcgtgctgagcggccacttcatcaaggaggagcactgtgtgttcagaagtgacagccggggcggcagcgaggccgtggtgaccctggagccctgtgagggcgctgacacctacgtgaatggcaagaaggtgacagagcccagcatcctgcggagcggcaaccgcatcatcatgggcaagagccacgtgttccgcttcaaccaccctgagcaggcccggcaggagcgggagaggaccccctgtgccgagaccccagctgagcctgtggactgggcctttgcccagcgggagctgctggagaagcagggcatcgacatgaagcaggagatggagcagaggctgcaggagctggaggaccagtacagaagagagcgggaggaggccacctacctgctggagcagcagaggctggactatgagagcaagctggaggccctgcagaagcagatggacagccgctactacccagaggtgaatgaggaggaggaggagccagaagatgaggtgcagtggacagagcgggagtgtgagctggccctgtgggccttcaggaagtggaagtggtaccagttcaccagcctgcgggacctgctgtggggcaatgccatcttcctgaaggaggccaatgccatctctgtggagctgaagaagaaggtgcagttccagtttgtgctgctgacagacaccctgtacagccccctgcccccagacctgctgcccccagaggccgccaaggaccgggagacccggcccttccccaggaccatcgtggccgtggaggtgcaggaccagaagaatggagccacccactactggaccctggagaagctgcggcagaggctggacctgatgagggagatgtatgacagagctgctgaggtgcccagctctgtgattgaggactgtgacaacgtggtgactggaggagaccccttctatgaccgcttcccctggttccggctggtgggcagcagcgccatcagcggctgcaacagctaccccctgctgaacacctgcatgtctgagaggatggccgccctgacccccagccccaccttcagcagcccagacagtgatgccacagagcctgctgaggagcagagcgtgggggaggaggaggaggaggaggaggaggaggaggatgaggaggaggaggacctggaggatgatgtgtttcctgagcacgccctgtgtgatggccgggaccccttctatgacaggcctcctctcttcagcctggtgggccgggcctttgtgtacctgagcaacctgctgtaccctgtgcccctggtgcaccgggtggccatcgtgtctgagaagggggaggtgaagggcttcctgcgggtggccgtgcaggccatctctgcagatgaggaggccccagactatggcagcggcgtgcggcagagcggcacagccaagatcagctttgatgaccagcactttgagaagttccagagcgagagctgccctgtggtgggcatgagccgcagcggcaccagccaggaggagctgcgcatcgtggagggccagggccagggcgcagatgtgggccccagcgcagatgaggtgaacaacaacacctgcagcgctgtgcccccagagggcctgctgctggacagcagcgagaaggccgccctggatggccccctggatgctgccctggaccacctgcggctgggcaacaccttcaccttccgggtgacagtgctgcaggccagcagcatctctgcagaatatgctgacatcttctgccagttcaacttcatccacagacatgatgaggccttcagcacagagcccctgaagaacacaggccggggcccccccctgggcttctaccacgtgcagaacattgctgtggaggtgaccaagagcttcatcgagtacatcaagagccagcccatcgtgtttgaggtgtttggccactaccagcagcaccccttcccccccctgtgcaaggatgtgctgagccccctgcggcccagcagaagacacttcccccgggtgatgcccctgagcaagcctgtgcctgccaccaagctgagcaccctgacccggccctgccccggcccctgccactgcaagtatgacctgctggtgtactttgagatctgtgagctggaggccaacggggactacatcccagctgtggtggaccaccggggcggcatgccctgcatgggcaccttcctgctgcaccagggcatccagaggcgcatcaccgtgaccctgctgcacgagaccggcagccacatccgctggaaggaggtgcgggagctggtggtgggccgcatccggaacaccccagagacagatgagagcctgattgaccccaacatcctgagcctgaacatcctgagcagcggctacatccacccagcccaggatgacaggaccttctaccagtttgaagctgcctgggacagctccatgcacaacagcctgctgctgaacagagtgaccccctaccgggagaagatctacatgaccctgagcgcctacatcgagatggagaactgcacccagcctgctgtggtgaccaaggacttctgcatggtgttctacagcagagatgccaagctgcctgccagccgcagcatccggaacctgtttggaagtggcagcctgcgggccagcgagagcaacagagtgactggagtgtatgagctgagcctgtgccacgtggctgatgctggcagccctggcatgcagaggagaagaagaagagtgctggacacctctgtggcctacgtgcggggggaggagaacctggccggctggaggcccaggagtgacagcctcatcctggaccaccagtgggagctggagaagctgagcctgctgcaggaggtggagaagaccaggcactacctgctgctgcgggagaagctggagacagcccagaggcctgtgcctgaggccctgagccctgccttctctgaagattctgagagccacggcagcagcagcgccagcagccccctgtctgctgagggccggcccagccccctggaggccccaaatgaaaggcagcgggagctggccgtgaagtgcctgcggctgctgacccacaccttcaaccgggagtacacccacagccacgtgtgtgtgtctgccagcgagagcaagctgtctgagatgtctgtgaccctgctgcgggaccccagcatgagccccctgggcgtggccaccctgacccccagcagcacctgccccagcctggtggagggccgctatggagccacagacctgcggaccccccagccctgcagcaggcctgccagccctgagcctgagctgctgcctgaggccgacagcaagaagctgcccagccctgcccgggccacagaaacagacaaggagccccagaggctgctggtgcctgacatccaggagatccgggtgagccccatcgtgtccaagaagggctacctgcacttcctggagccccacaccagcggctgggccaggagatttgtggtggtgagaagaccctatgcctacatgtacaacagcgacaaggacacagtggagagatttgtgctgaacctggccacagcccaggtggagtacagcgaggaccagcaggccatgctgaagacccccaacacctttgctgtgtgcacagagcaccggggcatcctgctgcaggccgccagtgacaaggacatgcatgactggctgtatgccttcaaccccctgctggccggcaccatccgcagcaagctgagcagaagaagaagtgcccagatgagggtgtag

SEQ ID NO: 157023 - DNA, 5313 bp, Artificial Sequence
  Description of Artificial Sequence: Synthetic coding sequence
atgtctggggcctctgtgaaggtggccgtgcgggtgcggcccttcaacagccgggagaccagcaaggagagcaagtgcatcatccagatgcagggcaacagcaccagcatcatcaaccccaagaaccccaaggaggcccccaagagcttctcctttgactacagctactggagccacaccagccctgaggacccctgctttgccagccagaacagagtgtacaatgacatcggcaaggagatgctgctgcacgcctttgagggctacaacgtgtgcatctttgcctacggccagacaggagctgggaagagctacaccatgatgggcaagcaggaggagagccaggccggcatcatcccccagctgtgtgaggagctgtttgagaagatcaatgacaactgcaatgaggagatgagctacagcgtggaggtgtcctacatggagatctactgtgagcgggtgcgggacctgctgaaccccaagaacaagggcaacctgcgggtgcgggagcaccccctgctgggcccctacgtggaggacctgagcaagctggccgtgaccagctacacagacattgctgacctgatggatgctggcaacaaggccaggacagtggccgccaccaacatgaatgagaccagcagccgcagccatgctgtgttcaccatcgtgttcacccagaagaagcatgacaatgagaccaacctgagcacagagaaggtgtccaagatcagcctggtggacctggccggcagcgagagagctgacagcactggagccaagggcacccggctgaaggagggcgccaacatcaacaagagcctgaccaccctgggcaaggtgatcagcgccctggccgaggtgtccaagaagaagaagaagacagacttcatcccctacagagattctgtgctgacctggctgctgcgggagaacctgggcggcaacagcaggacagccatggtggccgccctgagccctgctgacatcaactatgatgagaccctgagcaccctgcgctatgctgaccgggccaagcagatcaagtgcaatgctgtgatcaatgaagaccccaatgccaagctggtgcgggagctgaaggaggaggtgacccggctgaaggacctgctgcgggcccagggcctgggggacatcatcgacacctccatgggcagcctgaccagcagccccagcagctgcagcctgagcagccaggtgggcctgacctctgtgaccagcatccaggagcgcatcatgagcaccccaggaggagaggaggccatcgagcggctgaaggagagcgagaagatcatcgccgagctgaatgagacctgggaggagaagctgaggaagacagaggccatccgcatggagcgggaggccctgctggccgagatgggcgtggccatccgggaggatggcggcaccctgggcgtcttcagccccaagaagaccccccacctggtgaacctgaatgaagaccccctgatgtctgaatgtctgctgtactacatcaaggatggcatcaccagggtgggccaggctgatgctgagcggcggcaggacatcgtgctgagcggggcccacatcaaggaggagcactgcatcttccgctctgagaggagcaacagcggggaggtgattgtgaccctggagccctgtgagaggtctgagacctacgtgaatggcaagagggtgtcccagcctgtgcagctgcggagcggcaaccgcatcatcatgggcaagaaccacgtgttccgcttcaaccaccctgagcaggcccgggcagagcgggagaagaccccatctgctgagacccccagcgagcctgtggactggacctttgcccagcgggagctgctggagaagcagggcatcgacatgaagcaggagatggagaagaggctgcaggagatggagatcctgtacaagaaggagaaggaggaggccgacctgctgctggagcagcagaggctggactatgagagcaagctgcaggccctgcagaagcaggtggagaccaggagcctggccgctgagaccacagaggaggaggaggaggaggaggaggtgccctggacccagcacgagtttgagctggcccagtgggccttcaggaagtggaagagccaccagttcaccagcctgcgggacctgctgtggggcaatgctgtgtacctgaaggaggccaatgccatctctgtggagctgaagaagaaggtgcagttccagtttgtgctgctgacagacaccctgtacagccccctgcccccagagctgctgcccacagagatggagaagacccatgaggaccggcccttccccaggacagtggtggccgtggaggtgcaggacctgaagaatggagccacccactactggagcctggagaagctgaagcagaggctggacctgatgagggagatgtatgacagagctggggagatggccagcagcgcccaggatgagagcgagaccaccgtgactggaagtgaccccttctatgaccgcttccactggttcaagctggtgggcagcagccccatcttccacggctgtgtgaatgaaaggctggccgacaggacccccagccccaccttcagcacagctgacagcgacatcacagagctggctgatgagcagcaggatgagatggaggactttgatgatgaggcctttgtggatgatgctggcagtgatgctggaacagaggagggcagtgacctcttcagtgatggccatgaccccttctatgacaggagcccctggttcatcctggtgggccgggcctttgtgtacctgagcaacctgctgtaccctgtgcccctcatccaccgggtggccatcgtgtctgagaagggggaggtgcggggcttcctgcgggtggccgtgcaggccatcgctgctgatgaggaggccccagactatggcagcggcatccggcagagcggcacagccaagatcagctttgacaatgagtacttcaaccagagcgacttcagctctgtggccatgaccaggagcggcctgagcctggaggagctgagaattgtggagggccagggccagagcagcgaggtgatcaccccacctgaggagatcagccgcatcaatgacctggacctgaagagcagcaccctgctggatggcaagatggtgatggagggcttcagcgaggagatcggcaaccacctgaagctgggcagcgccttcaccttccgggtgacagtgctgcaggccagcggcatcctgcctgaatatgctgacatcttctgccagttcaacttcctgcacagacatgatgaggccttcagcacagagcccctgaagaacaacggccggggcagccccctggccttctaccacgtgcagaacattgctgtggagatcacagagagctttgtggactacatcaagaccaagcccatcgtgtttgaggtgtttggccactaccagcagcaccccctgcacctgcagggccaggagctgaacagccccccccagccctgccgccgcttcttccccccacccatgcccctgagcaagcctgtgcctgccaccaagctgaacaccatgagcaagaccagcctgggccagagcatgagcaaatatgacctgctggtgtggtttgagatcagcgagctggagcccaccggggagtacatcccagctgtggtggaccacacagctggcctgccctgccagggcaccttcctgctgcaccagggcatccagaggcgcatcaccgtgaccatcatccacgagaagggcagcgagctgcactggaaggatgtgcgggagctggtggtgggccgcatccggaacaagccagaggtggatgaggccgctgtggatgccatcctgagcctgaacatcatcagcgccaagtacctgaagagcagccacaacagcagcaggaccttctacagatttgaagctgtgtgggacagcagcctgcacaacagcctgctgctgaacagagtgaccccctatggagagaagatctacatgaccctgagcgcctacctggagctggaccactgcatccagcctgctgtgatcaccaaggatgtgtgcatggtgttctacagcagagatgccaagatcagccccccaagaagcctgcggagcctgtttggaagtggctacagcaagagcccagacagcaacagagtgacaggcatctatgagctgagcctgtgcaagatgtctgacaccggcagccctggcatgcagaggagaagaaggaagatcctggacacctctgtggcctacgtgcggggggaggagaacctggccggctggaggcccaggggggacagcctcatcctggagcaccagtgggagctggagaagctggagctgctgcacgaggtggagaagaccaggcacttcctgctgctgcgggagcggctgggggacagcatccccaagagcctgagtgacagcctgagccccagcctgagcagcggcaccctgagcaccagcaccagcatcagcagccagatcagcaccaccacctttgagagcgccatcaccccatctgagagcagcggctatgacagcggggacatcgagagcctggtggaccgggagaaggagctggccaccaagtgcctgcagctgctgacccacaccttcaaccgggagttcagccaggtgcacggctctgtgtctgactgcaagctgagtgacatcagccccatcggccgggaccccagcgagagcagcttcagcagcgccaccctgacccccagcagcacctgccccagcctggtggacagccgcagcaacagcctggaccagaagaccccagaggccaacagccgggccagcagcccctgcccagagtttgagcagttccagatcgtgcctgctgtggagaccccctacctggcccgggccggcaagaatgagttcctgaacctggtgcctgacatcgaggagatccggcccagctctgtggtgtccaagaagggctacctgcacttcaaggagcccctgtacagcaactgggccaagcactttgtggtggtgcggcggccctacgtgttcatctacaacagcgacaaggaccctgtggagcggggcatcatcaacctgagcacagcccaggtggagtacagcgaggaccagcaggccatggtgaagacccccaacacctttgctgtgtgcaccaagcaccggggcgtgctgctgcaggccctgaatgacaaggacatgaatgactggctgtatgccttcaaccccctgctggccggcaccatccgcagcaagctgagccgccgctgccccagccagagcaagtactag

SEQ ID NO: 157024 - DNA, 5472 bp, Artificial Sequence
  Description of Artificial Sequence: Synthetic coding sequence
atgtctggggcctctgtgaaggtggccgtgcgggtgcggcccttcaacagccgggagaccagcaaggagagcaagtgcatcatccagatgcagggcaacagcaccagcatcatcaaccccaagaaccccaaggaggcccccaagagcttctcctttgactacagctactggagccacaccagccctgaggacccctgctttgccagccagaacagagtgtacaatgacatcggcaaggagatgctgctgcacgcctttgagggctacaacgtgtgcatctttgcctacggccagacaggagctgggaagagctacaccatgatgggcaagcaggaggagagccaggccggcatcatcccccagctgtgtgaggagctgtttgagaagatcaatgacaactgcaatgaggagatgagctacagcgtggaggtgtcctacatggagatctactgtgagcgggtgcgggacctgctgaaccccaagaacaagggcaacctgcgggtgcgggagcaccccctgctgggcccctacgtggaggacctgagcaagctggccgtgaccagctacacagacattgctgacctgatggatgctggcaacaaggccaggacagtggccgccaccaacatgaatgagaccagcagccgcagccatgctgtgttcaccatcgtgttcacccagaagaagcatgacaatgagaccaacctgagcacagagaaggtgtccaagatcagcctggtggacctggccggcagcgagagagctgacagcactggagccaagggcacccggctgaaggagggcgccaacatcaacaagagcctgaccaccctgggcaaggtgatcagcgccctggccgaggtggacaccagcaagaagaagagcaagaagaagaagaagacagacttcatcccctacagagattctgtgctgacctggctgctgcgggagaacctgggcggcaacagcaggacagccatggtggccgccctgagccctgctgacatcaactatgatgagaccctgagcaccctgcgctatgctgaccgggccaagcagatcaagtgcaatgctgtgatcaatgaagaccccaatgccaagctggtgcgggagctgaaggaggaggtgacccggctgaaggacctgctgcgggcccagggcctgggggacatcatcgacatcgaccccctgattgatgactacagcggcagcggcagcaagtacctgaaggacttccagaacaacaagcaccgctacctgctggccagcgagaaccagaggcctggccacttcagcacagcctccatgggcagcctgaccagcagccccagcagctgcagcctgagcagccaggtgggcctgacctctgtgaccagcatccaggagcgcatcatgagcaccccaggaggagaggaggccatcgagcggctgaaggagagcgagaagatcatcgccgagctgaatgagacctgggaggagaagctgaggaagacagaggccatccgcatggagcgggaggccctgctggccgagatgggcgtggccatccgggaggatggcggcaccctgggcgtcttcagccccaagaagaccccccacctggtgaacctgaatgaagaccccctgatgtctgaatgtctgctgtactacatcaaggatggcatcaccagggtgggccaggctgatgctgagcggcggcaggacatcgtgctgagcggggcccacatcaaggaggagcactgcatcttccgctctgagaggagcaacagcggggaggtgattgtgaccctggagccctgtgagaggtctgagacctacgtgaatggcaagagggtgtcccagcctgtgcagctgcggagcggcaaccgcatcatcatgggcaagaaccacgtgttccgcttcaaccaccctgagcaggcccgggcagagcgggagaagaccccatctgctgagacccccagcgagcctgtggactggacctttgcccagcgggagctgctggagaagcagggcatcgacatgaagcaggagatggagaagaggctgcaggagatggagatcctgtacaagaaggagaaggaggaggccgacctgctgctggagcagcagaggctggactatgagagcaagctgcaggccctgcagaagcaggtggagaccaggagcctggccgctgagaccacagaggaggaggaggaggaggaggaggtgccctggacccagcacgagtttgagctggcccagtgggccttcaggaagtggaagagccaccagttcaccagcctgcgggacctgctgtggggcaatgctgtgtacctgaaggaggccaatgccatctctgtggagctgaagaagaaggtgcagttccagtttgtgctgctgacagacaccctgtacagccccctgcccccagagctgctgcccacagagatggagaagacccatgaggaccggcccttccccaggacagtggtggccgtggaggtgcaggacctgaagaatggagccacccactactggagcctggagaagctgaagcagaggctggacctgatgagggagatgtatgacagagctggggagatggccagcagcgcccaggatgagagcgagaccaccgtgactggaagtgaccccttctatgaccgcttccactggttcaagctggtgggcagcagccccatcttccacggctgtgtgaatgaaaggctggccgacaggacccccagccccaccttcagcacagctgacagcgacatcacagagctggctgatgagcagcaggatgagatggaggactttgatgatgaggcctttgtggatgatgctggcagtgatgctggaacagaggagggcagtgacctcttcagtgatggccatgaccccttctatgacaggagcccctggttcatcctggtgggccgggcctttgtgtacctgagcaacctgctgtaccctgtgcccctcatccaccgggtggccatcgtgtctgagaagggggaggtgcggggcttcctgcgggtggccgtgcaggccatcgctgctgatgaggaggccccagactatggcagcggcatccggcagagcggcacagccaagatcagctttgacaatgagtacttcaaccagagcgacttcagctctgtggccatgaccaggagcggcctgagcctggaggagctgagaattgtggagggccagggccagagcagcgaggtgatcaccccacctgaggagatcagccgcatcaatgacctggacctgaagagcagcaccctgctggatggcaagatggtgatggagggcttcagcgaggagatcggcaaccacctgaagctgggcagcgccttcaccttccgggtgacagtgctgcaggccagcggcatcctgcctgaatatgctgacatcttctgccagttcaacttcctgcacagacatgatgaggccttcagcacagagcccctgaagaacaacggccggggcagccccctggccttctaccacgtgcagaacattgctgtggagatcacagagagctttgtggactacatcaagaccaagcccatcgtgtttgaggtgtttggccactaccagcagcaccccctgcacctgcagggccaggagctgaacagccccccccagccctgccgccgcttcttccccccacccatgcccctgagcaagcctgtgcctgccaccaagctgaacaccatgagcaagaccagcctgggccagagcatgagcaaatatgacctgctggtgtggtttgagatcagcgagctggagcccaccggggagtacatcccagctgtggtggaccacacagctggcctgccctgccagggcaccttcctgctgcaccagggcatccagaggcgcatcaccgtgaccatcatccacgagaagggcagcgagctgcactggaaggatgtgcgggagctggtggtgggccgcatccggaacaagccagaggtggatgaggccgctgtggatgccatcctgagcctgaacatcatcagcgccaagtacctgaagagcagccacaacagcagcaggaccttctacagatttgaagctgtgtgggacagcagcctgcacaacagcctgctgctgaacagagtgaccccctatggagagaagatctacatgaccctgagcgcctacctggagctggaccactgcatccagcctgctgtgatcaccaaggatgtgtgcatggtgttctacagcagagatgccaagatcagccccccaagaagcctgcggagcctgtttggaagtggctacagcaagagcccagacagcaacagagtgacaggcatctatgagctgagcctgtgcaagatgtctgacaccggcagccctggcatgcagaggagaagaaggaagatcctggacacctctgtggcctacgtgcggggggaggagaacctggccggctggaggcccaggggggacagcctcatcctggagcaccagtgggagctggagaagctggagctgctgcacgaggtggagaagaccaggcacttcctgctgctgcgggagcggctgggggacagcatccccaagagcctgagtgacagcctgagccccagcctgagcagcggcaccctgagcaccagcaccagcatcagcagccagatcagcaccaccacctttgagagcgccatcaccccatctgagagcagcggctatgacagcggggacatcgagagcctggtggaccgggagaaggagctggccaccaagtgcctgcagctgctgacccacaccttcaaccgggagttcagccaggtgcacggctctgtgtctgactgcaagctgagtgacatcagccccatcggccgggaccccagcgagagcagcttcagcagcgccaccctgacccccagcagcacctgccccagcctggtggacagccgcagcaacagcctggaccagaagaccccagaggccaacagccgggccagcagcccctgcccagagtttgagcagttccagatcgtgcctgctgtggagaccccctacctggcccgggccggcaagaatgagttcctgaacctggtgcctgacatcgaggagatccggcccagctctgtggtgtccaagaagggctacctgcacttcaaggagcccctgtacagcaactgggccaagcactttgtggtggtgcggcggccctacgtgttcatctacaacagcgacaaggaccctgtggagcggggcatcatcaacctgagcacagcccaggtggagtacagcgaggaccagcaggccatggtgaagacccccaacacctttgctgtgtgcaccaagcaccggggcgtgctgctgcaggccctgaatgacaaggacatgaatgactggctgtatgccttcaaccccctgctggccggcaccatccggcccggccacctggccagcgagatcatccgggaggacaagtctgtgtccttcagctgccagtag

SEQ ID NO: 157025 - DNA, 5472 bp, Artificial Sequence
  Description of Artificial Sequence: Synthetic coding sequence
atgtctggggcctctgtgaaggtggccgtgcgggtgcggcccttcaacagccgggagaccagcaaggagagcaagtgcatcatccagatgcagggcaacagcaccagcatcatcaaccccaagaaccccaaggaggcccccaagagcttctcctttgactacagctactggagccacaccagccctgaggacccctgctttgccagccagaacagagtgtacaatgacatcggcaaggagatgctgctgcacgcctttgagggctacaacgtgtgcatctttgcctacggccagacaggagctgggaagagctacaccatgatgggcaagcaggaggagagccaggccggcatcatcccccagctgtgtgaggagctgtttgagaagatcaatgacaactgcaatgaggagatgagctacagcgtggaggtgtcctacatggagatctactgtgagcgggtgcgggacctgctgaaccccaagaacaagggcaacctgcgggtgcgggagcaccccctgctgggcccctacgtggaggacctgagcaagctggccgtgaccagctacacagacattgctgacctgatggatgctggcaacaaggccaggacagtggccgccaccaacatgaatgagaccagcagccgcagccatgctgtgttcaccatcgtgttcacccagaagaagcatgacaatgagaccaacctgagcacagagaaggtgtccaagatcagcctggtggacctggccggcagcgagagagctgacagcactggagccaagggcacccggctgaaggagggcgccaacatcaacaagagcctgaccaccctgggcaaggtgatcagcgccctggccgaggtggacaactgcaccagcaagagcaagaagaagaagaagacagacttcatcccctacagagattctgtgctgacctggctgctgcgggagaacctgggcggcaacagcaggacagccatggtggccgccctgagccctgctgacatcaactatgatgagaccctgagcaccctgcgctatgctgaccgggccaagcagatcaagtgcaatgctgtgatcaatgaagaccccaatgccaagctggtgcgggagctgaaggaggaggtgacccggctgaaggacctgctgcgggcccagggcctgggggacatcatcgacatcgaccccctgattgatgactacagcggcagcggcagcaagtacctgaaggacttccagaacaacaagcaccgctacctgctggccagcgagaaccagaggcctggccacttcagcacagcctccatgggcagcctgaccagcagccccagcagctgcagcctgagcagccaggtgggcctgacctctgtgaccagcatccaggagcgcatcatgagcaccccaggaggagaggaggccatcgagcggctgaaggagagcgagaagatcatcgccgagctgaatgagacctgggaggagaagctgaggaagacagaggccatccgcatggagcgggaggccctgctggccgagatgggcgtggccatccgggaggatggcggcaccctgggcgtcttcagccccaagaagaccccccacctggtgaacctgaatgaagaccccctgatgtctgaatgtctgctgtactacatcaaggatggcatcaccagggtgggccaggctgatgctgagcggcggcaggacatcgtgctgagcggggcccacatcaaggaggagcactgcatcttccgctctgagaggagcaacagcggggaggtgattgtgaccctggagccctgtgagaggtctgagacctacgtgaatggcaagagggtgtcccagcctgtgcagctgcggagcggcaaccgcatcatcatgggcaagaaccacgtgttccgcttcaaccaccctgagcaggcccgggcagagcgggagaagaccccatctgctgagacccccagcgagcctgtggactggacctttgcccagcgggagctgctggagaagcagggcatcgacatgaagcaggagatggagaagaggctgcaggagatggagatcctgtacaagaaggagaaggaggaggccgacctgctgctggagcagcagaggctggactatgagagcaagctgcaggccctgcagaagcaggtggagaccaggagcctggccgctgagaccacagaggaggaggaggaggaggaggaggtgccctggacccagcacgagtttgagctggcccagtgggccttcaggaagtggaagagccaccagttcaccagcctgcgggacctgctgtggggcaatgctgtgtacctgaaggaggccaatgccatctctgtggagctgaagaagaaggtgcagttccagtttgtgctgctgacagacaccctgtacagccccctgcccccagagctgctgcccacagagatggagaagacccatgaggaccggcccttccccaggacagtggtggccgtggaggtgcaggacctgaagaatggagccacccactactggagcctggagaagctgaagcagaggctggacctgatgagggagatgtatgacagagctggggagatggccagcagcgcccaggatgagagcgagaccaccgtgactggaagtgaccccttctatgaccgcttccactggttcaagctggtgggcagcagccccatcttccacggctgtgtgaatgaaaggctggccgacaggacccccagccccaccttcagcacagctgacagcgacatcacagagctggctgatgagcagcaggatgagatggaggactttgatgatgaggcctttgtggatgatgctggcagtgatgctggaacagaggagggcagtgacctcttcagtgatggccatgaccccttctatgacaggagcccctggttcatcctggtgggccgggcctttgtgtacctgagcaacctgctgtaccctgtgcccctcatccaccgggtggccatcgtgtctgagaagggggaggtgcggggcttcctgcgggtggccgtgcaggccatcgctgctgatgaggaggccccagactatggcagcggcatccggcagagcggcacagccaagatcagctttgacaatgagtacttcaaccagagcgacttcagctctgtggccatgaccaggagcggcctgagcctggaggagctgagaattgtggagggccagggccagagcagcgaggtgatcaccccacctgaggagatcagccgcatcaatgacctggacctgaagagcagcaccctgctggatggcaagatggtgatggagggcttcagcgaggagatcggcaaccacctgaagctgggcagcgccttcaccttccgggtgacagtgctgcaggccagcggcatcctgcctgaatatgctgacatcttctgccagttcaacttcctgcacagacatgatgaggccttcagcacagagcccctgaagaacaacggccggggcagccccctggccttctaccacgtgcagaacattgctgtggagatcacagagagctttgtggactacatcaagaccaagcccatcgtgtttgaggtgtttggccactaccagcagcaccccctgcacctgcagggccaggagctgaacagccccccccagccctgccgccgcttcttccccccacccatgcccctgagcaagcctgtgcctgccaccaagctgaacaccatgagcaagaccagcctgggccagagcatgagcaaatatgacctgctggtgtggtttgagatcagcgagctggagcccaccggggagtacatcccagctgtggtggaccacacagctggcctgccctgccagggcaccttcctgctgcaccagggcatccagaggcgcatcaccgtgaccatcatccacgagaagggcagcgagctgcactggaaggatgtgcgggagctggtggtgggccgcatccggaacaagccagaggtggatgaggccgctgtggatgccatcctgagcctgaacatcatcagcgccaagtacctgaagagcagccacaacagcagcaggaccttctacagatttgaagctgtgtgggacagcagcctgcacaacagcctgctgctgaacagagtgaccccctatggagagaagatctacatgaccctgagcgcctacctggagctggaccactgcatccagcctgctgtgatcaccaaggatgtgtgcatggtgttctacagcagagatgccaagatcagccccccaagaagcctgcggagcctgtttggaagtggctacagcaagagcccagacagcaacagagtgacaggcatctatgagctgagcctgtgcaagatgtctgacaccggcagccctggcatgcagaggagaagaaggaagatcctggacacctctgtggcctacgtgcggggggaggagaacctggccggctggaggcccaggggggacagcctcatcctggagcaccagtgggagctggagaagctggagctgctgcacgaggtggagaagaccaggcacttcctgctgctgcgggagcggctgggggacagcatccccaagagcctgagtgacagcctgagccccagcctgagcagcggcaccctgagcaccagcaccagcatcagcagccagatcagcaccaccacctttgagagcgccatcaccccatctgagagcagcggctatgacagcggggacatcgagagcctggtggaccgggagaaggagctggccaccaagtgcctgcagctgctgacccacaccttcaaccgggagttcagccaggtgcacggctctgtgtctgactgcaagctgagtgacatcagccccatcggccgggaccccagcgagagcagcttcagcagcgccaccctgacccccagcagcacctgccccagcctggtggacagccgcagcaacagcctggaccagaagaccccagaggccaacagccgggccagcagcccctgcccagagtttgagcagttccagatcgtgcctgctgtggagaccccctacctggcccgggccggcaagaatgagttcctgaacctggtgcctgacatcgaggagatccggcccagctctgtggtgtccaagaagggctacctgcacttcaaggagcccctgtacagcaactgggccaagcactttgtggtggtgcggcggccctacgtgttcatctacaacagcgacaaggaccctgtggagcggggcatcatcaacctgagcacagcccaggtggagtacagcgaggaccagcaggccatggtgaagacccccaacacctttgctgtgtgcaccaagcaccggggcgtgctgctgcaggccctgaatgacaaggacatgaatgactggctgtatgccttcaaccccctgctggccggcaccatccggcccggccacctggccagcgagatcatccgggaggacaagtctgtgtccttcagctgccagtag

SEQ ID NO: 157026 - DNA, 3462 bp, Artificial Sequence
  Description of Artificial Sequence: Synthetic coding sequence
atgtctggggcctctgtgaaggtggccgtgcgggtgcggcccttcaacagccgggagaccagcaaggagagcaagtgcatcatccagatgcagggcaacagcaccagcatcatcaaccccaagaaccccaaggaggcccccaagagcttctcctttgactacagctactggagccacaccagccctgaggacccctgctttgccagccagaacagagtgtacaatgacatcggcaaggagatgctgctgcacgcctttgagggctacaacgtgtgcatctttgcctacggccagacaggagctgggaagagctacaccatgatgggcaagcaggaggagagccaggccggcatcatcccccagctgtgtgaggagctgtttgagaagatcaatgacaactgcaatgaggagatgagctacagcgtggaggtgtcctacatggagatctactgtgagcgggtgcgggacctgctgaaccccaagaacaagggcaacctgcgggtgcgggagcaccccctgctgggcccctacgtggaggacctgagcaagctggccgtgaccagctacacagacattgctgacctgatggatgctggcaacaaggccaggacagtggccgccaccaacatgaatgagaccagcagccgcagccatgctgtgttcaccatcgtgttcacccagaagaagcatgacaatgagaccaacctgagcacagagaaggtgtccaagatcagcctggtggacctggccggcagcgagagagctgacagcactggagccaagggcacccggctgaaggagggcgccaacatcaacaagagcctgaccaccctgggcaaggtgatcagcgccctggccgaggtgtccaagaagaagaagaagacagacttcatcccctacagagattctgtgctgacctggctgctgcgggagaacctgggcggcaacagcaggacagccatggtggccgccctgagccctgctgacatcaactatgatgagaccctgagcaccctgcgctatgctgaccgggccaagcagatcaagtgcaatgctgtgatcaatgaagaccccaatgccaagctggtgcgggagctgaaggaggaggtgacccggctgaaggacctgctgcgggcccagggcctgggggacatcatcgacacctccatgggcagcctgaccagcagccccagcagctgcagcctgagcagccaggtgggcctgacctctgtgaccagcatccaggagcgcatcatgagcaccccaggaggagaggaggccatcgagcggctgaaggagagcgagaagatcatcgccgagctgaatgagacctgggaggagaagctgaggaagacagaggccatccgcatggagcgggaggccctgctggccgagatgggcgtggccatccgggaggatggcggcaccctgggcgtcttcagccccaagaagaccccccacctggtgaacctgaatgaagaccccctgatgtctgaatgtctgctgtactacatcaaggatggcatcaccagggtgggccaggctgatgctgagcggcggcaggacatcgtgctgagcggggcccacatcaaggaggagcactgcatcttccgctctgagaggagcaacagcggggaggtgattgtgaccctggagccctgtgagaggtctgagacctacgtgaatggcaagagggtgtcccagcctgtgcagctgcggagcggcaaccgcatcatcatgggcaagaaccacgtgttccgcttcaaccaccctgagcaggcccgggcagagcgggagaagaccccatctgctgagacccccagcgagcctgtggactggacctttgcccagcgggagctgctggagaagcagggcatcgacatgaagcaggagatggagaagaggctgcaggagatggagatcctgtacaagaaggagaaggaggaggccgacctgctgctggagcagcagaggctggatgctgacagcgacagcggagatgacagcgacaagaggagctgtgaggagagctggaagctgatcaccagcctgcgggagaagctgccccccagcaagctgcagaccatcgtgaagaagtgtggcctgcccagcagcggcaagaagcgggagcccatcaagatgtaccagatcccccagaggcggcggctgagcaaggacagcaagtgggtgaccatcagtgacctgaagatccaggccgtgaaggagatctgctatgaggtggccctgaatgacttccgccacagccggcaggagattgaggccctggccatcgtgaagatgaaggagctgtgtgccatgtatggcaagaaggaccccaatgaaagagacagctggagggctgtggccagagatgtgtgggacacagtgggcgtgggagatgagaagattgaagatgtgatggccaccgggaagggcagcacagatgtggatgacctgaaggtgcacatcgacaagctggaggacatcctgcaggaggtgaagaagcagaacaacatgaaggatgaggagatcaaggtgctgaggaacaagatgctgaagatggagaaggtgctgcccctgattggcagccaggagcagaagagccctggcagccacaaggccaaggagcctgtgggcgctggggtgagcagcaccagtgaaaataatgtgtccaagggggacaatggagagctggccaaggaggagcgggtgtcccagctgatgaatggagaccctgccttcagaagaggccgcctgcgctggatgaggcaggagcagatccgcttcaagaacctgcagcagcaggagatcaccaagcagctgcggcggcagaatgtgccccaccgcttcatccccccagagaacaggaagccccgcttccccttcaagagcaaccccaagcacagaaattcctggagccctggcacccacatcatcatcacagaagatgaagtcatcgagctgcgcatccccaaggatgatgaggccaggaagggcaacaaggaggagagccaggagaagggcggcaagggggccttcaaggacccccagttcccctggggcagccagggcatgaggagccaggaccacatccaggtgtccaagcagcacatcaacaaccagcagcagcccccccagctgcgctggaggagcaacagcctgaacaacggccagcccaagagcacccgctgccaggccagcgccagcgctgagagcctgaacagccacagcggccaccccacagcagatgtgcagaccttccaggccaagaggcacatccaccagcaccggcagagctactgcaactacaacacaggaggccagctggagggcaatgctgccaccagctaccagaagcagacagacaagcccagccactgcagccagtttgtgaccccacccaggatgaggcggcagttcagcgcccccaacctgaaggccggccgggagaccaccgtgtag

SEQ ID NO: 157027 - DNA, 5451 bp, Artificial Sequence
  Description of Artificial Sequence: Synthetic coding sequence
atgtctggggcctctgtgaaggtggccgtgcgggtgcggcccttcaacagccgggagaccagcaaggagagcaagtgcatcatccagatgcagggcaacagcaccagcatcatcaaccccaagaaccccaaggaggcccccaagagcttctcctttgactacagctactggagccacaccagccctgaggacccctgctttgccagccagaacagagtgtacaatgacatcggcaaggagatgctgctgcacgcctttgagggctacaacgtgtgcatctttgcctacggccagacaggagctgggaagagctacaccatgatgggcaagcaggaggagagccaggccggcatcatcccccagctgtgtgaggagctgtttgagaagatcaatgacaactgcaatgaggagatgagctacagcgtggaggtgtcctacatggagatctactgtgagcgggtgcgggacctgctgaaccccaagaacaagggcaacctgcgggtgcgggagcaccccctgctgggcccctacgtggaggacctgagcaagctggccgtgaccagctacacagacattgctgacctgatggatgctggcaacaaggccaggacagtggccgccaccaacatgaatgagaccagcagccgcagccatgctgtgttcaccatcgtgttcacccagaagaagcatgacaatgagaccaacctgagcacagagaaggtgtccaagatcagcctggtggacctggccggcagcgagagagctgacagcactggagccaagggcacccggctgaaggagggcgccaacatcaacaagagcctgaccaccctgggcaaggtgatcagcgccctggccgaggtggacaactgcaccagcaagagcaagaagaagaagaagacagacttcatcccctacagagattctgtgctgacctggctgctgcgggagaacctgggcggcaacagcaggacagccatggtggccgccctgagccctgctgacatcaactatgatgagaccctgagcaccctgcgctatgctgaccgggccaagcagatcaagtgcaatgctgtgatcaatgaagaccccaatgccaagctggtgcgggagctgaaggaggaggtgacccggctgaaggacctgctgcgggcccagggcctgggggacatcatcgacatcgaccccctgattgatgactacagcggcagcggcagcaagtacctgaaggacttccagaacaacaagcaccgctacctgctggccagcgagaaccagaggcctggccacttcagcacagcctccatgggcagcctgaccagcagccccagcagctgcagcctgagcagccaggtgggcctgacctctgtgaccagcatccaggagcgcatcatgagcaccccaggaggagaggaggccatcgagcggctgaaggagagcgagaagatcatcgccgagctgaatgagacctgggaggagaagctgaggaagacagaggccatccgcatggagcgggaggccctgctggccgagatgggcgtggccatccgggaggatggcggcaccctgggcgtcttcagccccaagaagaccccccacctggtgaacctgaatgaagaccccctgatgtctgaatgtctgctgtactacatcaaggatggcatcaccagggtgggccaggctgatgctgagcggcggcaggacatcgtgctgagcggggcccacatcaaggaggagcactgcatcttccgctctgagaggagcaacagcggggaggtgattgtgaccctggagccctgtgagaggtctgagacctacgtgaatggcaagagggtgtcccagcctgtgcagctgcggagcggcaaccgcatcatcatgggcaagaaccacgtgttccgcttcaaccaccctgagcaggcccgggcagagcgggagaagaccccatctgctgagacccccagcgagcctgtggactggacctttgcccagcgggagctgctggagaagcagggcatcgacatgaagcaggagatggagaagaggctgcaggagatggagatcctgtacaagaaggagaaggaggaggccgacctgctgctggagcagcagaggctggactatgagagcaagctgcaggccctgcagaagcaggtggagaccaggagcctggccgctgagaccacagaggaggaggaggaggaggaggaggtgccctggacccagcacgagtttgagctggcccagtgggccttcaggaagtggaagagccaccagttcaccagcctgcgggacctgctgtggggcaatgctgtgtacctgaaggaggccaatgccatctctgtggagctgaagaagaaggtgcagttccagtttgtgctgctgacagacaccctgtacagccccctgcccccagagctgctgcccacagagatggagaagacccatgaggaccggcccttccccaggacagtggtggccgtggaggtgcaggacctgaagaatggagccacccactactggagcctggagaagctgaagcagaggctggacctgatgagggagatgtatgacagagctggggagatggccagcagcgcccaggatgagagcgagaccaccgtgactggaagtgaccccttctatgaccgcttccactggttcaagctggtgggcagcagccccatcttccacggctgtgtgaatgaaaggctggccgacaggacccccagccccaccttcagcacagctgacagcgacatcacagagctggctgatgagcagcaggatgagatggaggactttgatgatgaggcctttgtggatgatgctggcagtgatgctggaacagaggagggcagtgacctcttcagtgatggccatgaccccttctatgacaggagcccctggttcatcctggtgggccgggcctttgtgtacctgagcaacctgctgtaccctgtgcccctcatccaccgggtggccatcgtgtctgagaagggggaggtgcggggcttcctgcgggtggccgtgcaggccatcgctgctgatgaggaggccccagactatggcagcggcatccggcagagcggcacagccaagatcagctttgacaatgagtacttcaaccagagcgacttcagctctgtggccatgaccaggagcggcctgagcctggaggagctgagaattgtggagggccagggccagagcagcgaggtgatcaccccacctgaggagatcagccgcatcaatgacctggacctgaagagcagcaccctgctggatggcaagatggtgatggagggcttcagcgaggagatcggcaaccacctgaagctgggcagcgccttcaccttccgggtgacagtgctgcaggccagcggcatcctgcctgaatatgctgacatcttctgccagttcaacttcctgcacagacatgatgaggccttcagcacagagcccctgaagaacaacggccggggcagccccctggccttctaccacgtgcagaacattgctgtggagatcacagagagctttgtggactacatcaagaccaagcccatcgtgtttgaggtgtttggccactaccagcagcaccccctgcacctgcagggccaggagctgaacagccccccccagccctgccgccgcttcttccccccacccatgcccctgagcaagcctgtgcctgccaccaagctgaacaccatgagcaagaccagcctgggccagagcatgagcaaatatgacctgctggtgtggtttgagatcagcgagctggagcccaccggggagtacatcccagctgtggtggaccacacagctggcctgccctgccagggcaccttcctgctgcaccagggcatccagaggcgcatcaccgtgaccatcatccacgagaagggcagcgagctgcactggaaggatgtgcgggagctggtggtgggccgcatccggaacaagccagaggtggatgaggccgctgtggatgccatcctgagcctgaacatcatcagcgccaagtacctgaagagcagccacaacagcagcaggaccttctacagatttgaagctgtgtgggacagcagcctgcacaacagcctgctgctgaacagagtgaccccctatggagagaagatctacatgaccctgagcgcctacctggagctggaccactgcatccagcctgctgtgatcaccaaggatgtgtgcatggtgttctacagcagagatgccaagatcagccccccaagaagcctgcggagcctgtttggaagtggctacagcaagagcccagacagcaacagagtgacaggcatctatgagctgagcctgtgcaagatgtctgacaccggcagccctggcatgcagaggagaagaaggaagatcctggacacctctgtggcctacgtgcggggggaggagaacctggccggctggaggcccaggggggacagcctcatcctggagcaccagtgggagctggagaagctggagctgctgcacgaggtggagaagaccaggcacttcctgctgctgcgggagcggctgggggacagcatccccaagagcctgagtgacagcctgagccccagcctgagcagcggcaccctgagcaccagcaccagcatcagcagccagatcagcaccaccacctttgagagcgccatcaccccatctgagagcagcggctatgacagcggggacatcgagagcctggtggaccgggagaaggagctggccaccaagtgcctgcagctgctgacccacaccttcaaccgggagttcagccaggtgcacggctctgtgtctgactgcaagctgagtgacatcagccccatcggccgggaccccagcgagagcagcttcagcagcgccaccctgacccccagcagcacctgccccagcctggtggacagccgcagcaacagcctggaccagaagaccccagaggccaacagccgggccagcagcccctgcccagagtttgagcagttccagatcgtgcctgctgtggagaccccctacctggcccgggccggcaagaatgagttcctgaacctggtgcctgacatcgaggagatccggcccagctctgtggtgtccaagaagggctacctgcacttcaaggagcccctgtacagcaactgggccaagcactttgtggtggtgcggcggccctacgtgttcatctacaacagcgacaaggaccctgtggagcggggcatcatcaacctgagcacagcccaggtggagtacagcgaggaccagcaggccatggtgaagacccccaacacctttgctgtgtgcaccaagcaccggggcgtgctgctgcaggccctgaatgacaaggacatgaatgactggctgtatgccttcaaccccctgctggccggcaccatccgcagcaagctgagccgccgctgccccagccagagcaagtactag

SEQ ID NO: 157028 - DNA, 3462 bp, Artificial Sequence; identical to SEQ ID NO: 157026
  Description of Artificial Sequence: Synthetic coding sequence

SEQ ID NO: 157029 - DNA, 2673 bp, Artificial Sequence
  Description of Artificial Sequence: Synthetic coding sequence
atgagccagggcatcctgagccccccagctggcctgctgagtgatgatgatgtggtggtgagccccatgtttgagagcacagctgctgacctgggctctgtggtgaggaagaacctgctgagtgactgcagcgtggtgtccaccagcctggaggacaagcagcaggtgcccagtgaagattccatggagaaggtgaaggtgtacctgcgggtgcggcccctgctgcccagcgagctggagcggcaggaggaccagggctgtgtgagaattgaaaatgtggagaccctggtgctgcaggcccccaaggacagctttgccctgaagagcaatgaaagaggcatcggccaggccacccaccgcttcaccttcagccagatctttggacctgaggtgggccaggccagcttcttcaacctgactgtgaaggagatggtgaaggatgtgctgaagggccagaactggctgatctacacctatggagtgaccaacagcggcaagacccacaccatccagggcaccatcaaggatggcggcatcctgcccaggagcctggccctgatcttcaacagcctgcagggccagctgcaccccaccccagacctgaagcccctgctgagcaatgaagtcatctggctggacagcaagcagatccggcaggaggagatgaagaagctgagcctgctgaatggaggcctgcaggaggaggagctgagcaccagcctgaagaggtctgtgtacatcgagagcagaattggcaccagcaccagctttgattctggaattgctggcctgagcagcatcagccagtgcaccagcagcagccagctggatgagaccagccaccgctgggcccagcctgacacagcccccctgcctgtgcctgccaacatccgcttcagcatctggatctccttctttgagatctacaatgagctgctgtatgacctgctggagccccccagccagcagaggaagaggcagaccctgcggctgtgtgaggaccagaatggaaacccctacgtgaaggacctgaactggatccacgtgcaggatgctgaggaggcctggaagctgctgaaggtgggcaggaagaaccagagctttgccagcacccacctgaaccagaacagcagccgcagccacagcatcttcagcatccgcatcctgcacctgcagggcgagggggacatcgtgcccaagatcagcgagctgagcctgtgtgacctggccggcagcgagcgctgcaaggaccagaagagcggggagcggctgaaggaggccggcaacatcaacaccagcctgcacaccctgggccgctgcatcgccgccctgcggcagaaccagcagaacagaagcaagcagaacctggtgcccttccgggacagcaagctgaccagggtcttccagggcttcttcaccggccggggccgcagctgcatgattgtgaatgtgaacccctgtgccagcacctatgatgagaccctgcacgtggccaagttcagcgccatcgccagccagctggtgcacgccccacccatgcagctgggcttccccagcctgcacagcttcatcaaggagcacagcctgcaggtgagccccagcctggagaagggggccaaggctgacaccggcctggatgatgacattgaaaatgaagctgacatctccatgtatggcaaggaggagctgctgcaggtggtggaggccatgaagaccctgctgctgaaggagcggcaggagaagctgcagctggagatgcacctgagagatgagatctgcaatgagatggtggagcagatgcagcagcgggagcagtggtgcagcgagcacctggacacccagaaggagctgctggaggagatgtatgaggagaagctgaacatcctgaaggagagcctgaccagcttctaccaggaggagatccaggagagagatgagaagattgaggagctggaggccctgctgcaggaggcccggcagcagagcgtggcccaccagcagagcggcagcgagctggccctgcggcgcagccagaggctggccgccagcgccagcacccagcagctgcaggaggtgaaggccaagctgcagcagtgcaaggccgagctgaacagcaccacagaggagctgcacaagtaccagaagatgctggagcccccacccagcgccaagcccttcaccattgatgtggacaagaagctggaggagggccagaagaacatccggctgctgaggacagagctgcagaagctgggggagagcctgcagagcgctgagcgggcctgctgccacagcactggagctgggaagctgcggcaggccctgaccacctgtgatgacatcctgatcaagcaggaccagaccctggccgagctgcagaacaacatggtgctggtgaagctggacctgaggaagaaggccgcctgcatcgccgagcagtaccacacagtgctgaagctgcagggccaggtgtctgccaagaagaggctgggcaccaaccaggagaaccagcagcccaaccagcagcccccaggcaagaagcccttcctgaggaacctgctgcccaggacccccacctgccagagcagcacagactgcagcccctatgcccgcatcctgcggagccgccgcagccccctgctgaagagcggcccctttgggaagaagtactag

SEQ ID NO: 157030 - DNA, 678 bp, Artificial Sequence
  Description of Artificial Sequence: Synthetic coding sequence
atgagccagggcatcctgagccccccagctggcctgctgagtgatgatgatgtggtggtgagccccatgtttgagagcacagctgctgacctgggctctgtggtgaggaagaacctgctgagtgactgcagcgtggtgtccaccagcctggaggacaagcagcaggtgcccagtgaagattccatggagaaggtgaaggtgtacctgcgggtgcggcccctgctgcccagcgagctggagcggcaggaggaccagggctgtgtgagaattgaaaatgtggagaccctggtgctgcaggcccccaaggacagctttgccctgaagagcaatgaaagaggcatcggccaggccacccaccgcttcaccttcagccagatctttggacctgaggtgggccaggccagcttcttcaacctgactgtgaaggagatggtgaaggatgtgctgaagggccagaactggctgatctacacctatggagtgaccaacagcggcaagacccacaccatccagggcaccatcaaggatggcggcatcctgcccaggagcctggccctgatcttcaacagcctgcagggccagctgcaccccaccccagacctgaagcccctgctgagcaatgaagtcatctggctggacagcaagcagatccggcaggaggagatgaagaagctgtag

SEQ ID NO: 157031 - DNA, 2619 bp, Artificial Sequence
  Description of Artificial Sequence: Synthetic coding sequence
atgagccagggcatcctgagccccccagctggcctgctgagtgatgatgatgtggtggtgagccccatgtttgagagcacagctgctgacctgggctctgtggtgaggaagaacctgctgagtgactgcagcgtggtgtccaccagcctggaggacaagcagcaggtgcccagtgaagattccatggagaaggaggaccagggctgtgtgagaattgaaaatgtggagaccctggtgctgcaggcccccaaggacagctttgccctgaagagcaatgaaagaggcatcggccaggccacccaccgcttcaccttcagccagatctttggacctgaggtgggccaggccagcttcttcaacctgactgtgaaggagatggtgaaggatgtgctgaagggccagaactggctgatctacacctatggagtgaccaacagcggcaagacccacaccatccagggcaccatcaaggatggcggcatcctgcccaggagcctggccctgatcttcaacagcctgcagggccagctgcaccccaccccagacctgaagcccctgctgagcaatgaagtcatctggctggacagcaagcagatccggcaggaggagatgaagaagctgagcctgctgaatggaggcctgcaggaggaggagctgagcaccagcctgaagaggtctgtgtacatcgagagcagaattggcaccagcaccagctttgattctggaattgctggcctgagcagcatcagccagtgcaccagcagcagccagctggatgagaccagccaccgctgggcccagcctgacacagcccccctgcctgtgcctgccaacatccgcttcagcatctggatctccttctttgagatctacaatgagctgctgtatgacctgctggagccccccagccagcagaggaagaggcagaccctgcggctgtgtgaggaccagaatggaaacccctacgtgaaggacctgaactggatccacgtgcaggatgctgaggaggcctggaagctgctgaaggtgggcaggaagaaccagagctttgccagcacccacctgaaccagaacagcagccgcagccacagcatcttcagcatccgcatcctgcacctgcagggcgagggggacatcgtgcccaagatcagcgagctgagcctgtgtgacctggccggcagcgagcgctgcaaggaccagaagagcggggagcggctgaaggaggccggcaacatcaacaccagcctgcacaccctgggccgctgcatcgccgccctgcggcagaaccagcagaacagaagcaagcagaacctggtgcccttccgggacagcaagctgaccagggtcttccagggcttcttcaccggccggggccgcagctgcatgattgtgaatgtgaacccctgtgccagcacctatgatgagaccctgcacgtggccaagttcagcgccatcgccagccagctggtgcacgccccacccatgcagctgggcttccccagcctgcacagcttcatcaaggagcacagcctgcaggtgagccccagcctggagaagggggccaaggctgacaccggcctggatgatgacattgaaaatgaagctgacatctccatgtatggcaaggaggagctgctgcaggtggtggaggccatgaagaccctgctgctgaaggagcggcaggagaagctgcagctggagatgcacctgagagatgagatctgcaatgagatggtggagcagatgcagcagcgggagcagtggtgcagcgagcacctggacacccagaaggagctgctggaggagatgtatgaggagaagctgaacatcctgaaggagagcctgaccagcttctaccaggaggagatccaggagagagatgagaagattgaggagctggaggccctgctgcaggaggcccggcagcagagcgtggcccaccagcagagcggcagcgagctggccctgcggcgcagccagaggctggccgccagcgccagcacccagcagctgcaggaggtgaaggccaagctgcagcagtgcaaggccgagctgaacagcaccacagaggagctgcacaagtaccagaagatgctggagcccccacccagcgccaagcccttcaccattgatgtggacaagaagctggaggagggccagaagaacatccggctgctgaggacagagctgcagaagctgggggagagcctgcagagcgctgagcgggcctgctgccacagcactggagctgggaagctgcggcaggccctgaccacctgtgatgacatcctgatcaagcaggaccagaccctggccgagctgcagaacaacatggtgctggtgaagctggacctgaggaagaaggccgcctgcatcgccgagcagtaccacacagtgctgaagctgcagggccaggtgtctgccaagaagaggctgggcaccaaccaggagaaccagcagcccaaccagcagcccccaggcaagaagcccttcctgaggaacctgctgcccaggacccccacctgccagagcagcacagactgcagcccctatgcccgcatcctgcggagccgccgcagccccctgctgaagagcggcccctttgggaagaagtactag

SEQ ID NO: 157032 - DNA, 480 bp, Artificial Sequence
  Description of Artificial Sequence: Synthetic coding sequence
atgagccagggcatcctgagccccccagctggcctgctgagtgatgatgatgtggtggtgagccccatgtttgagagcacagctgctgacctgggctctgtggtgaggaagaacctgctgagtgactgcagcgtggtgtccaccagcctggaggacaagcagcaggtgcccagtgaagattccatggagaaggtgaaggtgtacctgcgggtgcggcccctgctgcccagcgagctggagcggcaggaggaccagggctgtgtgagaattgaaaatgtggagaccctggtgctgcaggcccccaaggacagctttgccctgaagagcaatgaaagaggcatcggccaggccacccaccgcttcaccttcagccagatctttggacctgaggtgggccaggccagcttcttcaacctgactgtgaaggagatggtgaaggatgtgctgaagggccagaactggctgatctacacctactag

SEQ ID NO: 157033 - DNA, 4884 bp, Artificial Sequence
  Description of Artificial Sequence: Synthetic coding sequence
atgctgggcgccccagatgagagctctgtgcgggtggccgtgcgcatccggccccagctggccaaggagaagattgagggctgccacatctgcacctctgtgaccccaggagagccccaggtgttcctgggcaaggacaaggccttcacctttgattatgtgtttgatattgacagccagcaggagcagatctacatccagtgcatcgagaagctgattgagggctgctttgagggctacaatgccaccgtgtttgcctacggccagacaggagctgggaagacctacaccatgggcaccggctttgatgtgaacatcgtggaggaggagctgggcatcatcagcagagctgtgaagcacctgttcaagagcattgaggagaagaagcacatcgccatcaagaatggcctgcctgccccagacttcaaggtgaatgcccagttcctggagctgtacaatgaggaggtgctggacctgtttgacaccacccgggacattgatgccaagagcaagaagagcaacatccgcatccacgaggacagcactggaggcatctacacagtgggcgtgaccaccaggacagtgaacacagaaagtgagatgatgcagtgcctgaagctgggcgccctgagcaggaccacagccagcacccagatgaatgtgcagagcagccgcagccacgccatcttcaccatccacgtgtgccagaccagggtgtgcccccagattgatgctgacaatgccacagacaacaagatcatcagcgagagcgcccagatgaatgaatttgagaccctgacagccaagttccactttgtggacctggccggcagcgagcggctgaagaggactggagccactggagagcgggccaaggagggcatcagcatcaactgtggcctgctggccctgggcaatgtcatcagcgccctgggggacaagagcaagagggccacccacgtgccctacagagacagcaagctgacccggctgctgcaggacagcctgggcggcaacagccagaccatcatgattgcctgtgtgagccccagcgaccgggacttcatggagaccctgaacaccctgaagtatgccaacagagccaggaacatcaagaacaaggtgatggtgaaccaggaccgggccagccagcagatcaatgccctgcggtctgagatcacccggctgcagatggagctgatggagtacaagacaggcaagaggatcattgatgaggagggcgtggagagcatcaatgacatgtttcatgaaaatgccatgctgcagacagagaacaacaacctgcgggtgcgcatcaaggccatgcaggagaccgtggatgccctgcggagccgcatcacccagctggtgtctgaccaggccaaccacgtgctggcccgggccggggagggcaatgaggagatcagcaacatgatccacagctacatcaaggagattgaggacctgcgggccaagctgctggagagcgaggccgtgaatgaaaacctgaggaagaacctgacccgggccacagcccgggccccctacttcagcggcagcagcaccttcagccccaccatcctgagcagtgacaaggagaccatcgagatcatcgacctggccaagaaggacctggagaagctgaagaggaaggagaagaggaagaagaagaggctgcagaagctggaggagagcaaccgggaggagaggtctgtggccggcaaggaggacaacacagacacagaccaggagaagaaggaggagaagggcgtgtctgaaagagaaaataatgagctggaggtggaggagagccaggaggtgtctgaccatgaagatgaggaggaggaggaggaggaggaggaggatgacattgatggaggagagagcagtgatgaaagtgacagcgagagtgatgagaaggccaactaccaggccgacctggccaacatcacctgtgagatcgccatcaagcagaagctgattgatgagctggagaacagccagaagaggctgcagaccctgaagaagcagtatgaggagaagctgatgatgctgcagcacaagatccgggacacccagctggagcgggaccaggtgctgcagaacctgggctctgtggagagctacagcgaggagaaggccaagaaggtgcgctcagaatatgagaagaagctgcaggccatgaacaaggagctgcagaggctgcaggccgcccagaaggagcacgcccggctgctgaagaaccagagccagtatgagaagcagctgaagaagctgcagcaggatgtgatggagatgaagaagaccaaggtgcggctgatgaagcagatgaaggaggagcaggagaaggcccggctgacagagagcagaagaaaccgggagatcgcccagctgaagaaggaccagaggaagagggaccaccagctgcggctgctggaggcccagaagaggaaccaggaggtggtgctgcggaggaagacagaggaggtgacagccctgcggcggcaggtgcggcccatgtctgacaaggtggccggcaaggtgaccaggaagctgagcagcagtgatgccccagcccaggacaccggcagcagcgctgctgctgtggagacagatgccagcaggactggagcccagcagaagatgagaattcctgtggcccgggtgcaggccctgcccaccccagccaccaacggcaacaggaagaagtaccagaggaagggcctgaccggccgggtcttcatcagcaagacagccaggatgaagtggcagctgctggagcggcgggtgacagacatcatcatgcagaagatgaccatcagcaacatggaggccgacatgaaccggctgctgaagcagcgggaggagctgaccaagaggcgggagaagctgagcaagagaagagagaagatcgtgaaggaaaatggagagggggacaagaatgtggccaacatcaatgaggagatggagagcctgacagccaacatcgactacatcaatgacagcatcagtgactgccaggccaacatcatgcagatggaggaggccaaggaggagggggagaccctggatgtgacagctgtgatcaatgcctgcaccctgacagaggcccgctacctgctggaccacttcctgtccatgggcatcaacaagggcctgcaggccgcccagaaggaggcccagatcaaggtgctggagggccgcctgaagcagacagagatcaccagcgccacccagaaccagctgctcttccacatgctgaaggagaaggccgagctgaaccctgagctggatgccctgctgggccacgccctgcaggacttcaagcacttctttgtggagaatgtggaggacagcacagatgaagatgcccccctgaacagccctggcagcgagggcagcaccctgagcagtgacctgatgaagctgtgtggggaggtgaagcccaagaacaaggcccggcggaggaccaccacccagatggagctgctgtatgctgacagcagcgagctggccagtgacaccagcactggagatgccagcctgcccggccccctgacccctgtggccgagggccaggagatcggcatgaacacagagaccagcggcaccagcgcccgggagaaggagctgagccccccacctggcctgcccagcaagattggcagcatcagccggcagagcagcctgtctgagaagaagatccctgagcccagccctgtgaccaggaggaaggcctatgagaaggccgagaagagcaaggccaaggagcagaagcagagtgatgaaagtgacagcagcctgtctgaggtgcaccggggcatcatcaaccccttccctgccagcaagggcatccgggccttccccctgcagtgcatccacatcgccgagggccacaccaaggctgtgctgtgtgtggacagcacagatgacctgctcttcaccggcagcaaggacaggacctgcaaggtgtggaacctggtgacaggccaggagatcatgagcctgggcggccaccccaacaacgtggtgtctgtgaagtactgcaactacaccagcctggtgttcaccgtgtccaccagctacatcaaggtgtgggacatccgggacagcgccaagtgcatccgcaccctgaccagcagcggccaggtgaccctgggagatgcctgcagcgccagcaccagcaggacagtggccatccccagcggggagaaccagatcaaccagatcgccctgaaccccaccggcaccttcctgtatgctgccagcggaaatgctgtgaggatgtgggacctgaagcgcttccagagcacaggcaagctgaccggccacctgggccctgtgatgtgcctgactgtggaccagatcagcagcggccaggacctgatcatcaccggcagcaaggaccactacatcaagatgtttgatgtgacagagggcgccctgggcaccgtgagccccacccacaactttgagcccccccactatgatggcatcgaggccctgaccatccagggcgacaacctcttcagcggcagccgggacaatggcatcaagaagtgggacctgacccagaaggacctgctgcagcaggtgcccaatgcccacaaggactgggtgtgtgccctgggcgtggtgcctgaccaccctgtgctgctgagcggctgccggggcggcatcctgaaggtgtggaacatggacaccttcatgcctgtgggggagatgaagggccatgacagccccatcaatgccatctgtgtgaacagcacccacatcttcaccgctgctgatgacagaacagtgcgcatctggaaggccaggaacctgcaggacggccagatcagtgacacaggagacctgggggaggacatcgccagcaactag

SEQ ID NO: 157034 - DNA, 5025 bp, Artificial Sequence
  Description of Artificial Sequence: Synthetic coding sequence
atgctgggcgccccagatgagagctctgtgcgggtggccgtgcgcatccggccccagctggccaaggagaagattgagggctgccacatctgcacctctgtgaccccaggagagccccaggtgttcctgggcaaggacaaggccttcacctttgattatgtgtttgatattgacagccagcaggagcagatctacatccagtgcatcgagaagctgattgagggctgctttgagggctacaatgccaccgtgtttgcctacggccagacaggagctgggaagacctacaccatgggcaccggctttgatgtgaacatcgtggaggaggagctgggcatcatcagcagagctgtgaagcacctgttcaagagcattgaggagaagaagcacatcgccatcaagaatggcctgcctgccccagacttcaaggtgaatgcccagttcctggagctgtacaatgaggaggtgctggacctgtttgacaccacccgggacattgatgccaagagcaagaagagcaacatccgcatccacgaggacagcactggaggcatctacacagtgggcgtgaccaccaggacagtgaacacagaaagtgagatgatgcagtgcctgaagctgggcgccctgagcaggaccacagccagcacccagatgaatgtgcagagcagccgcagccacgccatcttcaccatccacgtgtgccagaccagggtgtgcccccagattgatgctgacaatgccacagacaacaagatcatcagcgagagcgcccagatgaatgaatttgagaccctgacagccaagttccactttgtggacctggccggcagcgagcggctgaagaggactggagccactggagagcgggccaaggagggcatcagcatcaactgtggcctgctggccctgggcaatgtcatcagcgccctgggggacaagagcaagagggccacccacgtgccctacagagacagcaagctgacccggctgctgcaggacagcctgggcggcaacagccagaccatcatgattgcctgtgtgagccccagcgaccgggacttcatggagaccctgaacaccctgaagtatgccaacagagccaggaacatcaagaacaaggtgatggtgaaccaggaccgggccagccagcagatcaatgccctgcggtctgagatcacccggctgcagatggagctgatggagtacaagacaggcaagaggatcattgatgaggagggcgtggagagcatcaatgacatgtttcatgaaaatgccatgctgcagacagagaacaacaacctgcgggtgcgcatcaaggccatgcaggagaccgtggatgccctgcggagccgcatcacccagctggtgtctgaccaggccaaccacgtgctggcccgggccggggagggcaatgaggagatcagcaacatgatccacagctacatcaaggagattgaggacctgcgggccaagctgctggagagcgaggccgtgaatgaaaacctgaggaagaacctgacccgggccacagcccgggccccctacttcagcggcagcagcaccttcagccccaccatcctgagcagtgacaaggagaccatcgagatcatcgacctggccaagaaggacctggagaagctgaagaggaaggagaagaggaagaagaagaggctgcagaagctggaggagagcaaccgggaggagaggtctgtggccggcaaggaggacaacacagacacagaccaggagaagaaggaggagaagggcgtgtctgaaagagaaaataatgagctggaggtggaggagagccaggaggtgtctgaccatgaagatgaggaggaggaggaggaggaggaggaggatgacattgatggaggagagagcagtgatgaaagtgacagcgagagtgatgagaaggccaactaccaggccgacctggccaacatcacctgtgagatcgccatcaagcagaagctgattgatgagctggagaacagccagaagaggctgcagaccctgaagaagcagtatgaggagaagctgatgatgctgcagcacaagatccgggacacccagctggagcgggaccaggtgctgcagaacctgggctctgtggagagctacagcgaggagaaggccaagaaggtgcgctcagaatatgagaagaagctgcaggccatgaacaaggagctgcagaggctgcaggccgcccagaaggagcacgcccggctgctgaagaaccagagccagtatgagaagcagctgaagaagctgcagcaggatgtgatggagatgaagaagaccaaggtgcggctgatgaagcagatgaaggaggagcaggagaaggcccggctgacagagagcagaagaaaccgggagatcgcccagctgaagaaggaccagaggaagagggaccaccagctgcggctgctggaggcccagaagaggaaccaggaggtggtgctgcggaggaagacagaggaggtgacagccctgcggcggcaggtgcggcccatgtctgacaaggtggccggcaaggtgaccaggaagctgagcagcagtgatgccccagcccaggacaccggcagcagcgctgctgctgtggagacagatgccagcaggactggagcccagcagaagatgagaattcctgtggcccgggtgcaggccctgcccaccccagccaccaacggcaacaggaagaagtaccagaggaagggcctgaccggccgggtcttcatcagcaagacagccaggatgaagtggcagctgctggagcggcgggtgacagacatcatcatgcagaagatgaccatcagcaacatggaggccgacatgaaccggctgctgaagcagcgggaggagctgaccaagaggcgggagaagctgagcaagagaagagagaagatcgtgaaggaaaatggagagggggacaagaatgtggccaacatcaatgaggagatggagagcctgacagccaacatcgactacatcaatgacagcatcagtgactgccaggccaacatcatgcagatggaggaggccaaggaggagggggagaccctggatgtgacagctgtgatcaatgcctgcaccctgacagaggcccgctacctgctggaccacttcctgtccatgggcatcaacaagggcctgcaggccgcccagaaggaggcccagatcaaggtgctggagggccgcctgaagcagacagagatcaccagcgccacccagaaccagctgctcttccacatgctgaaggagaaggccgagctgaaccctgagctggatgccctgctgggccacgccctgcaggacctggacagcgtgcccctggagaatgtggaggacagcacagatgaagatgcccccctgaacagccctggcagcgagggcagcaccctgagcagtgacctgatgaagctgtgtggggaggtgaagcccaagaacaaggcccggcggaggaccaccacccagatggagctgctgtatgctgacagcagcgagctggccagtgacaccagcactggagatgccagcctgcccggccccctgacccctgtggccgagggccaggagatcggcatgaacacagagaccagcggcaccagcgcccgggagaaggagctgagccccccacctggcctgcccagcaagattggcagcatcagccggcagagcagcctgtctgagaagaagatccctgagcccagccctgtgaccaggaggaaggcctatgagaaggccgagaagagcaaggccaaggagcagaagcacagcgacagcggcaccagcgaggccagcctgagcccccccagcagcccccccagccggcccagaaatgagctgaatgtgttcaaccggctgactgtgtcccagggcaacacctctgtgcagcaggacaagagtgatgaaagtgacagcagcctgtctgaggtgcacaggagcagcagaagaggcatcatcaaccccttccctgccagcaagggcatccgggccttccccctgcagtgcatccacatcgccgagggccacaccaaggctgtgctgtgtgtggacagcacagatgacctgctcttcaccggcagcaaggacaggacctgcaaggtgtggaacctggtgacaggccaggagatcatgagcctgggcggccaccccaacaacgtggtgtctgtgaagtactgcaactacaccagcctggtgttcaccgtgtccaccagctacatcaaggtgtgggacatccgggacagcgccaagtgcatccgcaccctgaccagcagcggccaggtgaccctgggagatgcctgcagcgccagcaccagcaggacagtggccatccccagcggggagaaccagatcaaccagatcgccctgaaccccaccggcaccttcctgtatgctgccagcggaaatgctgtgaggatgtgggacctgaagcgcttccagagcacaggcaagctgaccggccacctgggccctgtgatgtgcctgactgtggaccagatcagcagcggccaggacctgatcatcaccggcagcaaggaccactacatcaagatgtttgatgtgacagaaggagccctgggcaccgtgagccccacccacaactttgagcccccccactatgatggcatcgaggccctgaccatccagggcgacaacctcttcagcggcagccgggacaatggcatcaagaagtgggacctgacccagaaggacctgctgcagcaggtgcccaatgcccacaaggactgggtgtgtgccctgggcgtggtgcctgaccaccctgtgctgctgagcggctgccggggcggcatcctgaaggtgtggaacatggacaccttcatgcctgtgggggagatgaagggccatgacagccccatcaatgccatctgtgtgaacagcacccacatcttcaccgctgctgatgacagaacagtgcgcatctggaaggccaggaacctgcaggacggccagatcagtgacaccggggacctgggagaagatattgccagcaactag

SEQ ID NO: 157035 - DNA, 4986 bp, Artificial Sequence
  Description of Artificial Sequence: Synthetic coding sequence
atgctgggcgccccagatgagagctctgtgcgggtggccgtgcgcatccggccccagctggccaaggagaagattgagggctgccacatctgcacctctgtgaccccaggagagccccaggtgttcctgggcaaggacaaggccttcacctttgattatgtgtttgatattgacagccagcaggagcagatctacatccagtgcatcgagaagctgattgagggctgctttgagggctacaatgccaccgtgtttgcctacggccagacaggagctgggaagacctacaccatgggcaccggctttgatgtgaacatcgtggaggaggagctgggcatcatcagcagagctgtgaagcacctgttcaagagcattgaggagaagaagcacatcgccatcaagaatggcctgcctgccccagacttcaaggtgaatgcccagttcctggagctgtacaatgaggaggtgctggacctgtttgacaccacccgggacattgatgccaagagcaagaagagcaacatccgcatccacgaggacagcactggaggcatctacacagtgggcgtgaccaccaggacagtgaacacagaaagtgagatgatgcagtgcctgaagctgggcgccctgagcaggaccacagccagcacccagatgaatgtgcagagcagccgcagccacgccatcttcaccatccacgtgtgccagaccagggtgtgcccccagattgatgctgacaatgccacagacaacaagatcatcagcgagagcgcccagatgaatgaatttgagaccctgacagccaagttccactttgtggacctggccggcagcgagcggctgaagaggactggagccactggagagcgggccaaggagggcatcagcatcaactgtggcctgctggccctgggcaatgtcatcagcgccctgggggacaagagcaagagggccacccacgtgccctacagagacagcaagctgacccggctgctgcaggacagcctgggcggcaacagccagaccatcatgattgcctgtgtgagccccagcgaccgggacttcatggagaccctgaacaccctgaagtatgccaacagagccaggaacatcaagaacaaggtgatggtgaaccaggaccgggccagccagcagatcaatgccctgcggtctgagatcacccggctgcagatggagctgatggagtacaagacaggcaagaggatcattgatgaggagggcgtggagagcatcaatgacatgtttcatgaaaatgccatgctgcagacagagaacaacaacctgcgggtgcgcatcaaggccatgcaggagaccgtggatgccctgcggagccgcatcacccagctggtgtctgaccaggccaaccacgtgctggcccgggccggggagggcaatgaggagatcagcaacatgatccacagctacatcaaggagattgaggacctgcgggccaagctgctggagagcgaggccgtgaatgaaaacctgaggaagaacctgacccgggccacagcccgggccccctacttcagcggcagcagcaccttcagccccaccatcctgagcagtgacaaggagaccatcgagatcatcgacctggccaagaaggacctggagaagctgaagaggaaggagaagaggaagaagaagtctgtggccggcaaggaggacaacacagacacagaccaggagaagaaggaggagaagggcgtgtctgagcgggagaacaatgagctggaggtggaggagagccaggaggtgtctgaccatgaagatgaggaggaggaggaggaggaggaggaggatgacattgatggaggagagagcagtgatgaaagtgacagcgagagtgatgagaaggccaactaccaggccgacctggccaacatcacctgtgaaattgccatcaagcagaagctgattgatgagctggagaacagccagaagaggctgcagaccctgaagaagcagtatgaggagaagctgatgatgctgcagcacaagatccgggacacccagctggagcgggaccaggtgctgcagaacctgggctctgtggagagctacagcgaggagaaggccaagaaggtgcgctcagaatatgagaagaagctgcaggccatgaacaaggagctgcagaggctgcaggccgcccagaaggagcacgcccggctgctgaagaaccagagccagtatgagaagcagctgaagaagctgcagcaggatgtgatggagatgaagaagaccaaggtgcggctgatgaagcagatgaaggaggagcaggagaaggcccggctgacagagagcagaagaaaccgggagatcgcccagctgaagaaggaccagaggaagagggaccaccagctgcggctgctggaggcccagaagaggaaccaggaggtggtgctgcggaggaagacagaggaggtgacagccctgcggcggcaggtgcggcccatgtctgacaaggtggccggcaaggtgaccaggaagctgagcagcagtgatgccccagcccaggacaccggcagcagcgctgctgctgtggagacagatgccagcaggactggagcccagcagaagatgagaattcctgtggcccgggtgcaggccctgcccaccccagccaccaatggaaacaggaagaagtaccagaggaagggcctgaccggccgggtcttcatcagcaagacagccaggatgaagtggcagctgctggagaggagagtgacagacatcatcatgcagaagatgaccatcagcaacatggaggccgacatgaaccggctgctgaagcagcgggaggagctgaccaagagaagagagaagctgagcaagaggcgggagaagatcgtgaaggaaaatggagagggggacaagaatgtggccaacatcaatgaggagatggagagcctgacagccaacatcgactacatcaatgacagcatcagtgactgccaggccaacatcatgcagatggaggaggccaaggaggagggggagaccctggatgtgacagctgtgatcaatgcctgcaccctgacagaggcccgctacctgctggaccacttcctgtccatgggcatcaacaagggcctgcaggccgcccagaaggaggcccagatcaaggtgctggagggccgcctgaagcagacagagatcaccagcgccacccagaaccagctgctcttccacatgctgaaggagaaggccgagctgaaccctgagctggatgccctgctgggccacgccctgcaggacctggacagcgtgcccctggagaatgtggaggacagcacagatgaagatgcccccctgaacagccctggcagcgagggcagcaccctgagcagtgacctgatgaagctgtgtggggaggtgaagcccaagaacaaggcccggcggaggaccaccacccagatggagctgctgtatgctgacagcagcgagctggccagtgacaccagcactggagatgccagcctgcccggccccctgacccctgtggccgagggccaggagatcggcatgaacacagagaccagcggcaccagcgcccgggagaaggagctgagccccccacctggcctgcccagcaagattggcagcatcagccggcagagcagcctgtctgagaagaagatccctgagcccagccctgtgaccaggaggaaggcctatgagaaggccgagaagagcaaggccaaggagcagaagcacagcgacagcggcaccagcgaggccagcctgagcccccccagcagcccccccagccggcccagaaatgagctgaatgtgttcaaccggctgactgtgtcccagggcaacacctctgtgcagcaggacaagagtgatgaaagtgacagcagcctgtctgaggtgcacaggagcagccggcggggcatcatcaaccccttccctgccagcaagggcatccgggccttccccctgcagtgcatccacatcgccgagggccacaccaaggctgtgctgtgtgtggacagcacagatgacctgctcttcaccggcagcaaggacaggacctgcaaggtgtggaacctggtgacaggccaggagatcatgagcctgggcggccaccccaacaacgtggtgtctgtgaagtactgcaactacaccagcctggtgttcaccgtgtccaccagctacatcaaggtgtgggacatccgggacagcgccaagtgcatccgcaccctgaccagcagcggccaggtgaccctgggagatgcctgcagcgccagcaccagcaggacagtggccatccccagcggggagaaccagatcaaccagatcgccctgaaccccaccggcaccttcctgtatgctgccagcggaaatgctgtgaggatgtgggacctgaagcgcttccagagcacaggcaagctgaccggccacctgggccctgtgatgtgcctgactgtggaccagatcagcagcggccaggacctgatcatcaccggcagcaaggaccactacatcaagatgtttgatgtgacagagggcgccctgggcaccgtgagccccacccacaactttgagcccccccactatgatggcatcgaggccctgaccatccagggcgacaacctcttcagcggcagccgggacaatggcatcaagaagtgggacctgacccagaaggacctgctgcagcaggtgcccaatgcccacaaggactgggtgtgtgccctgggcgtggtgcctgaccaccctgtgctgctgagcggctgccggggcggcatcctgaaggtgtggaacatggacaccttcatgcctgtgggggagatgaagggccatgacagccccatcaatgccatctgtgtgaacagcacccacatcttcaccgctgctgatgacagaacagtgcgcatctggaaggccaggaacctgcaggacggccagatcagtgacacaggagacctgggggaggacatcgccagcaactag

SEQ ID NO: 157036 - DNA, 5028 bp, Artificial Sequence
  Description of Artificial Sequence: Synthetic coding sequence
atgctgggcgccccagatgagagctctgtgcgggtggccgtgcgcatccggccccagctggccaaggagaagattgagggctgccacatctgcacctctgtgaccccaggagagccccaggtgttcctgggcaaggacaaggccttcacctttgattatgtgtttgatattgacagccagcaggagcagatctacatccagtgcatcgagaagctgattgagggctgctttgagggctacaatgccaccgtgtttgcctacggccagacaggagctgggaagacctacaccatgggcaccggctttgatgtgaacatcgtggaggaggagctgggcatcatcagcagagctgtgaagcacctgttcaagagcattgaggagaagaagcacatcgccatcaagaatggcctgcctgccccagacttcaaggtgaatgcccagttcctggagctgtacaatgaggaggtgctggacctgtttgacaccacccgggacattgatgccaagagcaagaagagcaacatccgcatccacgaggacagcactggaggcatctacacagtgggcgtgaccaccaggacagtgaacacagaaagtgagatgatgcagtgcctgaagctgggcgccctgagcaggaccacagccagcacccagatgaatgtgcagagcagccgcagccacgccatcttcaccatccacgtgtgccagaccagggtgtgcccccagattgatgctgacaatgccacagacaacaagatcatcagcgagagcgcccagatgaatgaatttgagaccctgacagccaagttccactttgtggacctggccggcagcgagcggctgaagaggactggagccactggagagcgggccaaggagggcatcagcatcaactgtggcctgctggccctgggcaatgtcatcagcgccctgggggacaagagcaagagggccacccacgtgccctacagagacagcaagctgacccggctgctgcaggacagcctgggcggcaacagccagaccatcatgattgcctgtgtgagccccagcgaccgggacttcatggagaccctgaacaccctgaagtatgccaacagagccaggaacatcaagaacaaggtgatggtgaaccaggaccgggccagccagcagatcaatgccctgcggtctgagatcacccggctgcagatggagctgatggagtacaagacaggcaagaggatcattgatgaggagggcgtggagagcatcaatgacatgtttcatgaaaatgccatgctgcagacagagaacaacaacctgcgggtgcgcatcaaggccatgcaggagaccgtggatgccctgcggagccgcatcacccagctggtgtctgaccaggccaaccacgtgctggcccgggccggggagggcaatgaggagatcagcaacatgatccacagctacatcaaggagattgaggacctgcgggccaagctgctggagagcgaggccgtgaatgaaaacctgaggaagaacctgacccgggccacagcccgggccccctacttcagcggcagcagcaccttcagccccaccatcctgagcagtgacaaggagaccatcgagatcatcgacctggccaagaaggacctggagaagctgaagaggaaggagaagaggaagaagaagaggctgcagaagctggaggagagcaaccgggaggagaggtctgtggccggcaaggaggacaacacagacacagaccaggagaagaaggaggagaagggcgtgtctgaaagagaaaataatgagctggaggtggaggagagccaggaggtgtctgaccatgaagatgaggaggaggaggaggaggaggaggaggatgacattgatggaggagagagcagtgatgaaagtgacagcgagagtgatgagaaggccaactaccaggccgacctggccaacatcacctgtgagatcgccatcaagcagaagctgattgatgagctggagaacagccagaagaggctgcagaccctgaagaagcagtatgaggagaagctgatgatgctgcagcacaagatccgggacacccagctggagcgggaccaggtgctgcagaacctgggctctgtggagagctacagcgaggagaaggccaagaaggtgcgctcagaatatgagaagaagctgcaggccatgaacaaggagctgcagaggctgcaggccgcccagaaggagcacgcccggctgctgaagaaccagagccagtatgagaagcagctgaagaagctgcagcaggatgtgatggagatgaagaagaccaaggtgcggctgatgaagcagatgaaggaggagcaggagaaggcccggctgacagagagcagaagaaaccgggagatcgcccagctgaagaaggaccagaggaagagggaccaccagctgcggctgctggaggcccagaagaggaaccaggaggtggtgctgcggaggaagacagaggaggtgacagccctgcggcggcaggtgcggcccatgtctgacaaggtggccggcaaggtgaccaggaagctgagcagcagtgatgccccagcccaggacaccggcagcagcgctgctgctgtggagacagatgccagcaggactggagcccagcagaagatgagaattcctgtggcccgggtgcaggccctgcccaccccagccaccaacggcaacaggaagaagtaccagaggaagggcctgaccggccgggtcttcatcagcaagacagccaggatgaagtggcagctgctggagcggcgggtgacagacatcatcatgcagaagatgaccatcagcaacatggaggccgacatgaaccggctgctgaagcagcgggaggagctgaccaagaggcgggagaagctgagcaagagaagagagaagatcgtgaaggaaaatggagagggggacaagaatgtggccaacatcaatgaggagatggagagcctgacagccaacatcgactacatcaatgacagcatcagtgactgccaggccaacatcatgcagatggaggaggccaaggaggagggggagaccctggatgtgacagctgtgatcaatgcctgcaccctgacagaggcccgctacctgctggaccacttcctgtccatgggcatcaacaagggcctgcaggccgcccagaaggaggcccagatcaaggtgctggagggccgcctgaagcagacagagatcaccagcgccacccagaaccagctgctcttccacatgctgaaggagaaggccgagctgaaccctgagctggatgccctgctgggccacgccctgcaggacttcaagcacttctttgtggagaatgtggaggacagcacagatgaagatgcccccctgaacagccctggcagcgagggcagcaccctgagcagtgacctgatgaagctgtgtggggaggtgaagcccaagaacaaggcccggcggaggaccaccacccagatggagctgctgtatgctgacagcagcgagctggccagtgacaccagcactggagatgccagcctgcccggccccctgacccctgtggccgagggccaggagatcggcatgaacacagagaccagcggcaccagcgcccgggagaaggagctgagccccccacctggcctgcccagcaagattggcagcatcagccggcagagcagcctgtctgagaagaagatccctgagcccagccctgtgaccaggaggaaggcctatgagaaggccgagaagagcaaggccaaggagcagaagcacagcgacagcggcaccagcgaggccagcctgagcccccccagcagcccccccagccggcccagaaatgagctgaatgtgttcaaccggctgactgtgtcccagggcaacacctctgtgcagcaggacaagagtgatgaaagtgacagcagcctgtctgaggtgcacaggaacagcaacctgcggggcatcatcaaccccttccctgccagcaagggcatccgggccttccccctgcagtgcatccacatcgccgagggccacaccaaggctgtgctgtgtgtggacagcacagatgacctgctcttcaccggcagcaaggacaggacctgcaaggtgtggaacctggtgacaggccaggagatcatgagcctgggcggccaccccaacaacgtggtgtctgtgaagtactgcaactacaccagcctggtgttcaccgtgtccaccagctacatcaaggtgtgggacatccgggacagcgccaagtgcatccgcaccctgaccagcagcggccaggtgaccctgggagatgcctgcagcgccagcaccagcaggacagtggccatccccagcggggagaaccagatcaaccagatcgccctgaaccccaccggcaccttcctgtatgctgccagcggaaatgctgtgaggatgtgggacctgaagcgcttccagagcacaggcaagctgaccggccacctgggccctgtgatgtgcctgactgtggaccagatcagcagcggccaggacctgatcatcaccggcagcaaggaccactacatcaagatgtttgatgtgacagagggcgccctgggcaccgtgagccccacccacaactttgagcccccccactatgatggcatcgaggccctgaccatccagggcgacaacctcttcagcggcagccgggacaatggcatcaagaagtgggacctgacccagaaggacctgctgcagcaggtgcccaatgcccacaaggactgggtgtgtgccctgggcgtggtgcctgaccaccctgtgctgctgagcggctgccggggcggcatcctgaaggtgtggaacatggacaccttcatgcctgtgggggagatgaagggccatgacagccccatcaatgccatctgtgtgaacagcacccacatcttcaccgctgctgatgacagaacagtgcgcatctggaaggccaggaacctgcaggacggccagatcagtgacacaggagacctgggggaggacatcgccagcaactag

SEQ ID NO: 157037 - DNA, 4866 bp, Artificial Sequence
  Description of Artificial Sequence: Synthetic coding sequence
atgctgggcgccccagatgagagctctgtgcgggtggccgtgcgcatccggccccagctggccaaggagaagattgagggctgccacatctgcacctctgtgaccccaggagagccccaggtgttcctgggcaaggacaaggccttcacctttgattatgtgtttgatattgacagccagcaggagcagatctacatccagtgcatcgagaagctgattgagggctgctttgagggctacaatgccaccgtgtttgcctacggccagacaggagctgggaagacctacaccatgggcaccggctttgatgtgaacatcgtggaggaggagctgggcatcatcagcagagctgtgaagcacctgttcaagagcattgaggagaagaagcacatcgccatcaagaatggcctgcctgccccagacttcaaggtgaatgcccagttcctggagctgtacaatgaggaggtgctggacctgtttgacaccacccgggacattgatgccaagagcaagaagagcaacatccgcatccacgaggacagcactggaggcatctacacagtgggcgtgaccaccaggacagtgaacacagaaagtgagatgatgcagtgcctgaagctgggcgccctgagcaggaccacagccagcacccagatgaatgtgcagagcagccgcagccacgccatcttcaccatccacgtgtgccagaccagggtgtgcccccagattgatgctgacaatgccacagacaacaagatcatcagcgagagcgcccagatgaatgaatttgagaccctgacagccaagttccactttgtggacctggccggcagcgagcggctgaagaggactggagccactggagagcgggccaaggagggcatcagcatcaactgtggcctgctggccctgggcaatgtcatcagcgccctgggggacaagagcaagagggccacccacgtgccctacagagacagcaagctgacccggctgctgcaggacagcctgggcggcaacagccagaccatcatgattgcctgtgtgagccccagcgaccgggacttcatggagaccctgaacaccctgaagtatgccaacagagccaggaacatcaagaacaaggtgatggtgaaccaggaccgggccagccagcagatcaatgccctgcggtctgagatcacccggctgcagatggagctgatggagtacaagacaggcaagaggatcattgatgaggagggcgtggagagcatcaatgacatgtttcatgaaaatgccatgctgcagacagagaacaacaacctgcgggtgcgcatcaaggccatgcaggagaccgtggatgccctgcggagccgcatcacccagctggtgtctgaccaggccaaccacgtgctggcccgggccggggagggcaatgaggagatcagcaacatgatccacagctacatcaaggagattgaggacctgcgggccaagctgctggagagcgaggccgtgaatgaaaacctgaggaagaacctgacccgggccacagcccgggccccctacttcagcggcagcagcaccttcagccccaccatcctgagcagtgacaaggagaccatcgagatcatcgacctggccaagaaggacctggagaagctgaagaggaaggagaagaggaagaagaagtctgtggccggcaaggaggacaacacagacacagaccaggagaagaaggaggagaagggcgtgtctgagcgggagaacaatgagctggaggtggaggagagccaggaggtgtctgaccatgaagatgaggaggaggaggaggaggaggaggaggatgacattgatggaggagagagcagtgatgaaagtgacagcgagagtgatgagaaggccaactaccaggccgacctggccaacatcacctgtgaaattgccatcaagcagaagctgattgatgagctggagaacagccagaagaggctgcagaccctgaagaagcagtatgaggagaagctgatgatgctgcagcacaagatccgggacacccagctggagcgggaccaggtgctgcagaacctgggctctgtggagagctacagcgaggagaaggccaagaaggtgcgctcagaatatgagaagaagctgcaggccatgaacaaggagctgcagaggctgcaggccgcccagaaggagcacgcccggctgctgaagaaccagagccagtatgagaagcagctgaagaagctgcagcaggatgtgatggagatgaagaagaccaaggtgcggctgatgaagcagatgaaggaggagcaggagaaggcccggctgacagagagcagaagaaaccgggagatcgcccagctgaagaaggaccagaggaagagagatgtgacagccctgcggcggcaggtgcggcccatgtctgacaaggtggccggcaaggtgaccaggaagctgagcagcagtgatgccccagcccaggacaccggcagcagcgctgctgctgtggagacagatgccagcaggactggagcccagcagaagatgagaattcctgtggcccgggtgcaggccctgcccaccccagccaccaacggcaacaggaagaagtaccagaggaagggcctgaccggccgggtcttcatcagcaagacagccaggatgaagtggcagctgctggagcggcgggtgacagacatcatcatgcagaagatgaccatcagcaacatggaggccgacatgaaccggctgctgaagcagcgggaggagctgaccaagaggcgggagaagctgagcaagagaagagagaagatcgtgaaggaaaatggagagggggacaagaatgtggccaacatcaatgaggagatggagagcctgacagccaacatcgactacatcaatgacagcatcagtgactgccaggccaacatcatgcagatggaggaggccaaggaggagggggagaccctggatgtgacagctgtgatcaatgcctgcaccctgacagaggcccgctacctgctggaccacttcctgtccatgggcatcaacaagggcctgcaggccgcccagaaggaggcccagatcaaggtgctggagggccgcctgaagcagacagagatcaccagcgccacccagaaccagctgctcttccacatgctgaaggagaaggccgagctgaaccctgagctggatgccctgctgggccacgccctgcaggacctggacagcgtgcccctggagaatgtggaggacagcacagatgaagatgcccccctgaacagccctggcagcgagggcagcaccctgagcagtgacctgatgaagctgtgtggggaggtgaagcccaagaacaaggcccggcggaggaccaccacccagatggagctgctgtatgctgacagcagcgagctggccagtgacaccagcactggagatgccagcctgcccggccccctgacccctgtggccgagggccaggagatcggcatgaacacagagaccagcggcaccagcgcccgggagaaggagctgagccccccacctggcctgcccagcaagattggcagcatcagccggcagagcagcctgtctgagaagaagatccctgagcccagccctgtgaccaggaggaaggcctatgagaaggccgagaagagcaaggccaaggagcagaagcacagcgacagcggcaccagcgaggccagcctgagcccccccagcagcccccccagccggcccagaaatgagctgaatgtgttcaaccggctgactgtgtcccagggcaacacctctgtgcagcaggacaagggcatcatcaaccccttccctgccagcaagggcatccgggccttccccctgcagtgcatccacatcgccgagggccacaccaaggctgtgctgtgtgtggacagcacagatgacctgctcttcaccggcagcaaggacaggacctgcaaggtgtggaacctggtgacaggccaggagatcatgagcctgggcggccaccccaacaacgtggtgtctgtgaagtactgcaactacaccagcctggtgttcaccgtgtccaccagctacatcaaggtgtgggacatccgggacagcgccaagtgcatccgcaccctgaccagcagcggccaggtgaccctgggagatgcctgcagcgccagcaccagcaggacagtggccatccccagcggggagaaccagatcaaccagatcgccctgaaccccaccggcaccttcctgtatgctgccagcggaaatgctgtgaggatgtgggacctgaagcgcttccagagcacaggcaagctgaccggccacctgggccctgtgatgtgcctgactgtggaccagatcagcagcggccaggacctgatcatcaccggcagcaaggaccactacatcaagatgtttgatgtgacagagggcgccctgggcaccgtgagccccacccacaactttgagcccccccactatgatggcatcgaggccctgaccatccagggcgacaacctcttcagcggcagccgggacaatggcatcaagaagtgggacctgacccagaaggacctgctgcagcaggtgcccaatgcccacaaggactgggtgtgtgccctgggcgtggtgcctgaccaccctgtgctgctgagcggctgccggggcggcatcctgaaggtgtggaacatggacaccttcatgcctgtgggggagatgaagggccatgacagccccatcaatgccatctgtgtgaacagcacccacatcttcaccgctgctgatgacagaacagtgcgcatctggaaggccaggaacctgcaggacggccagatcagtgacacaggagacctgggggaggacatcgccagcaactag

SEQ ID NO: 157038 - DNA, 4914 bp, Artificial Sequence
  Description of Artificial Sequence: Synthetic coding sequence
atgctgggcgccccagatgagagctctgtgcgggtggccgtgcgcatccggccccagctggccaaggagaagattgagggctgccacatctgcacctctgtgaccccaggagagccccaggtgttcctgggcaaggacaaggccttcacctttgattatgtgtttgatattgacagccagcaggagcagatctacatccagtgcatcgagaagctgattgagggctgctttgagggctacaatgccaccgtgtttgcctacggccagacaggagctgggaagacctacaccatgggcaccggctttgatgtgaacatcgtggaggaggagctgggcatcatcagcagagctgtgaagcacctgttcaagagcattgaggagaagaagcacatcgccatcaagaatggcctgcctgccccagacttcaaggtgaatgcccagttcctggagctgtacaatgaggaggtgctggacctgtttgacaccacccgggacattgatgccaagagcaagaagagcaacatccgcatccacgaggacagcactggaggcatctacacagtgggcgtgaccaccaggacagtgaacacagaaagtgagatgatgcagtgcctgaagctgggcgccctgagcaggaccacagccagcacccagatgaatgtgcagagcagccgcagccacgccatcttcaccatccacgtgtgccagaccagggtgtgcccccagattgatgctgacaatgccacagacaacaagatcatcagcgagagcgcccagatgaatgaatttgagaccctgacagccaagttccactttgtggacctggccggcagcgagcggctgaagaggactggagccactggagagcgggccaaggagggcatcagcatcaactgtggcctgctggccctgggcaatgtcatcagcgccctgggggacaagagcaagagggccacccacgtgccctacagagacagcaagctgacccggctgctgcaggacagcctgggcggcaacagccagaccatcatgattgcctgtgtgagccccagcgaccgggacttcatggagaccctgaacaccctgaagtatgccaacagagccaggaacatcaagaacaaggtgatggtgaaccaggaccgggccagccagcagatcaatgccctgcggtctgagatcacccggctgcagatggagctgatggagtacaagacaggcaagaggatcattgatgaggagggcgtggagagcatcaatgacatgtttcatgaaaatgccatgctgcagacagagaacaacaacctgcgggtgcgcatcaaggccatgcaggagaccgtggatgccctgcggagccgcatcacccagctggtgtctgaccaggccaaccacgtgctggcccgggccggggagggcaatgaggagatcagcaacatgatccacagctacatcaaggagattgaggacctgcgggccaagctgctggagagcgaggccgtgaatgaaaacctgaggaagaacctgacccgggccacagcccgggccccctacttcagcggcagcagcaccttcagccccaccatcctgagcagtgacaaggagaccatcgagatcatcgacctggccaagaaggacctggagaagctgaagaggaaggagaagaggaagaagaagtctgtggccggcaaggaggacaacacagacacagaccaggagaagaaggaggagaagggcgtgtctgagcgggagaacaatgagctggaggtggaggagagccaggaggtgtctgaccatgaagatgaggaggaggaggaggaggaggaggaggatgacattgatggaggagagagcagtgatgaaagtgacagcgagagtgatgagaaggccaactaccaggccgacctggccaacatcacctgtgaaattgccatcaagcagaagctgattgatgagctggagaacagccagaagaggctgcagaccctgaagaagcagtatgaggagaagctgatgatgctgcagcacaagatccgggacacccagctggagcgggaccaggtgctgcagaacctgggctctgtggagagctacagcgaggagaaggccaagaaggtgcgctcagaatatgagaagaagctgcaggccatgaacaaggagctgcagaggctgcaggccgcccagaaggagcacgcccggctgctgaagaaccagagccagtatgagaagcagctgaagaagctgcagcaggatgtgatggagatgaagaagaccaaggtgcggctgatgaagcagatgaaggaggagcaggagaaggcccggctgacagagagcagaagaaaccgggagatcgcccagctgaagaaggaccagaggaagagggaccaccagctgcggctgctggaggcccagaagaggaaccaggaggtggtgctgcggaggaagacagaggaggtgacagccctgcggcggcaggtgcggcccatgtctgacaaggtggccggcaaggtgaccaggaagctgagcagcagtgatgccccagcccaggacaccggcagcagcgctgctgctgtggagacagatgccagcaggactggagcccagcagaagatgagaattcctgtggcccgggtgcaggccctgcccaccccagccaccaatggaaacaggaagaagtaccagaggaagggcctgaccggccgggtcttcatcagcaagacagccaggatgaagtggcagctgctggagaggagagtgacagacatcatcatgcagaagatgaccatcagcaacatggaggccgacatgaaccggctgctgaagcagcgggaggagctgaccaagagaagagagaagctgagcaagaggcgggagaagatcgtgaaggaaaatggagagggggacaagaatgtggccaacatcaatgaggagatggagagcctgacagccaacatcgactacatcaatgacagcatcagtgactgccaggccaacatcatgcagatggaggaggccaaggaggagggggagaccctggatgtgacagctgtgatcaatgcctgcaccctgacagaggcccgctacctgctggaccacttcctgtccatgggcatcaacaagggcctgcaggccgcccagaaggaggcccagatcaaggtgctggagggccgcctgaagcagacagagatcaccagcgccacccagaaccagctgctcttccacatgctgaaggagaaggccgagctgaaccctgagctggatgccctgctgggccacgccctgcaggagaatgtggaggacagcacagatgaagatgcccccctgaacagccctggcagcgagggcagcaccctgagcagtgacctgatgaagctgtgtggggaggtgaagcccaagaacaaggcccggcggaggaccaccacccagatggagctgctgtatgctgacagcagcgagctggccagtgacaccagcactggagatgccagcctgcccggccccctgacccctgtggccgagggccaggagatcggcatgaacacagagaccagcggcaccagcgcccgggagaaggagctgagccccccacctggcctgcccagcaagattggcagcatcagccggcagagcagcctgtctgagaagaagatccctgagcccagccctgtgaccaggaggaaggcctatgagaaggccgagaagagcaaggccaaggagcagaagcacagcgacagcggcaccagcgaggccagcctgagcccccccagcagcccccccagccggcccagaaatgagctgaatgtgttcaaccggctgactgtgtcccagggcaacacctctgtgcagcaggacaagggcatcatcaaccccttccctgccagcaagggcatccgggccttccccctgcagtgcatccacatcgccgagggccacaccaaggctgtgctgtgtgtggacagcacagatgacctgctcttcaccggcagcaaggacaggacctgcaaggtgtggaacctggtgacaggccaggagatcatgagcctgggcggccaccccaacaacgtggtgtctgtgaagtactgcaactacaccagcctggtgttcaccgtgtccaccagctacatcaaggtgtgggacatccgggacagcgccaagtgcatccgcaccctgaccagcagcggccaggtgaccctgggagatgcctgcagcgccagcaccagcaggacagtggccatccccagcggggagaaccagatcaaccagatcgccctgaaccccaccggcaccttcctgtatgctgccagcggaaatgctgtgaggatgtgggacctgaagcgcttccagagcacaggcaagctgaccggccacctgggccctgtgatgtgcctgactgtggaccagatcagcagcggccaggacctgatcatcaccggcagcaaggaccactacatcaagatgtttgatgtgacagagggcgccctgggcaccgtgagccccacccacaactttgagcccccccactatgatggcatcgaggccctgaccatccagggcgacaacctcttcagcggcagccgggacaatggcatcaagaagtgggacctgacccagaaggacctgctgcagcaggtgcccaatgcccacaaggactgggtgtgtgccctgggcgtggtgcctgaccaccctgtgctgctgagcggctgccggggcggcatcctgaaggtgtggaacatggacaccttcatgcctgtgggggagatgaagggccatgacagccccatcaatgccatctgtgtgaacagcacccacatcttcaccgctgctgatgacagaacagtgcgcatctggaaggccaggaacctgcaggacggccagatcagtgacacaggagacctgggggaggacatcgccagcaactag

SEQ ID NO: 157039 - DNA, 1986 bp, Artificial Sequence
  Description of Artificial Sequence: Synthetic coding sequence
atgaaccggctgctgaagcagcgggaggagctgaccaagaggcgggagaagctgagcaagagaagagagaagatcgtgaaggaaaatggagagggggacaagaatgtggccaacatcaatgaggagatggagagcctgacagccaacatcgactacatcaatgacagcatcagtgactgccaggccaacatcatgcagatggaggaggccaaggaggagggggagaccctggatgtgacagctgtgatcaatgcctgcaccctgacagaggcccgctacctgctggaccacttcctgtccatgggcatcaacaagggcctgcaggccgcccagaaggaggcccagatcaaggtgctggagggccgcctgaagcagacagagatcaccagcgccacccagaaccagctgctcttccacatgctgaaggagaaggccgagctgaaccctgagctggatgccctgctgggccacgccctgcaggagaatgtggaggacagcacagatgaagatgcccccctgaacagccctggcagcgagggcagcaccctgagcagtgacctgatgaagctgtgtggggaggtgaagcccaagaacaaggcccggcggaggaccaccacccagatggagctgctgtatgctgacagcagcgagctggccagtgacaccagcactggagatgccagcctgcccggccccctgacccctgtggccgagggccaggagatcggcatgaacacagagaccagcggcaccagcgcccgggagaaggagctgagccccccacctggcctgcccagcaagattggcagcatcagccggcagagcagcctgtctgagaagaagatccctgagcccagccctgtgaccaggaggaaggcctatgagaaggccgagaagagcaaggccaaggagcagaagcagggcatcatcaaccccttccctgccagcaagggcatccgggccttccccctgcagtgcatccacatcgccgagggccacaccaaggctgtgctgtgtgtggacagcacagatgacctgctcttcaccggcagcaaggacaggacctgcaaggtgtggaacctggtgacaggccaggagatcatgagcctgggcggccaccccaacaacgtggtgtctgtgaagtactgcaactacaccagcctggtgttcaccgtgtccaccagctacatcaaggtgtgggacatccgggacagcgccaagtgcatccgcaccctgaccagcagcggccaggtgaccctgggagatgcctgcagcgccagcaccagcaggacagtggccatccccagcggggagaaccagatcaaccagatcgccctgaaccccaccggcaccttcctgtatgctgccagcggaaatgctgtgaggatgtgggacctgaagcgcttccagagcacaggcaagctgaccggccacctgggccctgtgatgtgcctgactgtggaccagatcagcagcggccaggacctgatcatcaccggcagcaaggaccactacatcaagatgtttgatgtgacagagggcgccctgggcaccgtgagccccacccacaactttgagcccccccactatgatggcatcgaggccctgaccatccagggcgacaacctcttcagcggcagccgggacaatggcatcaagaagtgggacctgacccagaaggacctgctgcagcaggtgcccaatgcccacaaggactgggtgtgtgccctgggcgtggtgcctgaccaccctgtgctgctgagcggctgccggggcggcatcctgaaggtgtggaacatggacaccttcatgcctgtgggggagatgaagggccatgacagccccatcaatgccatctgtgtgaacagcacccacatcttcaccgctgctgatgacagaacagtgcgcatctggaaggccaggaacctgcaggacggccagatcagtgacacaggagacctgggggaggacatcgccagcaactag

SEQ ID NO: 157040 - DNA, 4875 bp, Artificial Sequence
  Description of Artificial Sequence: Synthetic coding sequence
atggccggccagggcgactgctgcgtgaaggtggccgtgcgcatccggccccagctgagcaaggagaagattgagggctgccacatctgcacctctgtgaccccaggagagccccaggtgctgctgggcaaggacaaggccttcacctatgactttgtgtttgacctggacacctggcaggagcagatctacagcacctgtgtgtccaagctgattgagggctgctttgagggctacaatgccaccgtgctggcctacggccagacaggagctgggaagacctacaccatgggcactggatttgacatggccaccagcgaggaggagcagggcatcatcccccgggccatcgcccacctgtttggaggcattgctgagaggaagagaagagcccaggagcagggcgtggccggccctgagttcaaggtgtctgcccagttcctggagctgtacaatgaggagatcctggacctgtttgacagcacccgggaccctgacaccaggcaccggcgcagcaacatcaagatccatgaagatgccaatggaggcatctacaccactggagtgaccagccgcctcatccacagccaggaggagctgatccagtgcctgaagcagggcgccctgagcaggaccacagccagcacccagatgaatgtgcagagcagccgcagccacgccatcttcaccatccacctgtgccagatgaggatgtgcacccagcctgacctggtgaatgaggccgtgacaggcctgcctgatggcaccccacccagcagtgaatatgagaccctgacagccaagttccactttgtggacctggccggcagcgagcggctgaagaggactggagccaccggggagcgggccaaggagggcatcagcatcaactgtggcctgctggccctgggcaatgtcatcagcgccctgggggaccagagcaagaaggtggtgcacgtgccctacagagacagcaagctgacccggctgctgcaggacagcctgggcggcaacagccagaccatcatgattgcctgtgtgagccccagcgaccgggacttcatggagaccctgaacaccctgaagtatgccaacagagccaggaacatcaagaacaaggtggtggtgaaccaggacaagaccagccagcagatcagcgccctgcgggcagagatcgcccggctgcagatggagctgatggagtacaaggccggcaagagggtgattggagaagatggagctgagggctacagcgacctcttcagagaaaatgccatgctgcagaaggaaaatggagccctgcggctgcgggtgaaggccatgcaggaggccattgatgccatcaacaacagagtgacccagctgatgagccaggaggccaacctgctgctggccaaggctggagatggaaatgaggccatcggggccctgatccagaactacatccgggagattgaggagctgcggaccaagctgctggagagcgaggccatgaatgaaagcctgcggcgcagcctgagccgggccagcgcccggagcccctacagcctgggcgccagccctgctgccccagccttcggcggcagccctgccagctccatggaggatgccagcgaggtgatccggcgggccaagcaggacctggagcggctgaagaagaaggaggtgcggcagaggaggaagagccctgagaaggaggccttcaagaagagggccaagctgcagcaggagaacagcgaggagacagatgaaaatgaagctgaggaggaggaggaggagagagatgaaagtggctgtgaggaggaggagggccgggaggatgaagatgaggacagcggcagcgaggagagcctggtggacagcgacagcgaccctgaggagaaggaggtgaacttccaggccgacctggccgacctgacctgtgaaattgagatcaagcagaagctgattgatgagctggagaacagccagaggcggctgcagaccctgaagcaccagtatgaggagaagctgatcctgctgcagaacaagatccgggacacccagctggagcgggacagagtgctgcagaacctgagcaccatggagtgctacacagaggagaaggccaacaagatcaaggctgactatgagaagaggctgcgggagatgaacagagacctgcagaagctgcaggccgcccagaaggagcacgcccggctgctgaagaaccagagccgctatgagcgggagctgaagaagctgcaggccgaggtggccgagatgaagaaggccaaggtggccctgatgaagcagatgagggaggagcagcagaggcggcggctggtggagaccaagaggaaccgggagatcgcccagctgaagaaggagcagaggcggcaggagttccagatccgggccctggagagccagaagaggcagcaggagatggtgctgcggaggaagacccaggaggtgtctgccctgcggcggctggccaagcccatgtctgagcgggtggccggccgggccggcctgaagccacccatgctggacagcggggctgaggtgtctgccagcaccaccagcagcgaggccgagagcggggcccggtctgtgagcagcatcgtgcggcagtggaacaggaagatcaaccacttcctgggggaccacccagcccccaccgtgaatggcaccaggcctgccaggaagaagttccagaagaagggggccagccagagcttcagcaaggccgcccggctgaagtggcagagcctggagcggcgcatcatcgacatcgtgatgcagaggatgaccatcgtgaacctggaggccgacatggagcggctcatcaagaagcgggaggagctgttcctgctgcaggaggccctgcggaggaagcgggagcggctgcaggccgagagccctgaggaggagaagggcctgcaggagctggccgaggagattgaggtgctggccgccaacatcgactacatcaatgatggcatcacagactgccaggccaccatcgtgcagctggaggagaccaaggaggagctggacagcacagacacctctgtggtgatcagcagctgcagcctggccgaggcccggctgctgctggacaacttcctgaaggccagcattgacaagggcctgcaggtggcccagaaggaggcccagatccggctgctggagggccgcctgcggcagacagacatggccggcagcagccagaaccacctgctgctggatgccctgcgggagaaggccgaggcccaccctgagctgcaggccctgatctacaacgtgcagcaggagaatggctacgccagcacagatgaggagatcagcgagttcagcgagggcagcttcagccagagcttcaccatgaagggcagcaccagccatgatgacttcaagttcaagtctgagcccaagctgagcgcccagatgaaggctgtgtctgcagaatgtctgggcccccccctggacatcagcaccaagaacatcaccaagagcctggccagcctggtggagatcaaggaggatggagtgggcttctctgtgcgggacccctactacagagacagagtgtccaggacagtgtccctgcccacccggggcagcaccttcccccggcagagccgggccacagagaccagccccctgaccaggaggaagagctatgaccggggccagcccatccgcagcacagatgtgggcttcaccccacccagcagcccccccacccggcccagaaatgacagaaatgtgttcagccggctgaccagcaaccagagccagggcagcgccctggacaagggcatcatcagccctgtgggcggggccaagggggccaggacagcccccctgcagtgtgtgtccatggccgagggccacaccaagcccatcctgtgcctggatgccacagatgagctgctcttcaccggcagcaaggacaggagctgcaagatgtggaacctggtgacaggccaggagattgctgccctgaagggccaccccaacaacgtggtgtccatcaagtactgcagccacagcggcctggtgttttctgtgtccaccagctacatcaaggtgtgggacatccgggacagcgccaagtgcatccgcaccctgaccagcagcggccaggtgatctctggagatgcctgtgccgccaccagcacccgggccatcaccagcgcccagggcgagcaccagatcaaccagatcgccctgagccccagcggcaccatgctgtatgctgccagcggaaatgctgtgcgcatctgggagctgagccgcttccagcctgtgggcaagctgaccggccacatcggccctgtgatgtgcctgactgtgacccagacagccagccagcacgacctggtggtgacaggcagcaaggaccactacgtgaagatgtttgagctgggggagtgtgtgacaggcaccatcggccccacccacaactttgagcccccccactatgatggcattgaatgtctggccatccagggcgacatcctcttcagcggcagccgggacaatggcatcaagaagtgggacctggaccagcaggagctgatccagcagatccccaatgcccacaaggactgggtgtgtgccctggccttcatccctggccggcccatgctgctgagcgcctgcagagctggggtcatcaaggtgtggaatgtggacaacttcacccccatcggggagatcaagggccatgacagccccatcaatgccatctgcaccaatgccaagcacatcttcaccgccagcagtgactgccgggtgaagctgtggaactacgtgcccggcctgaccccctgcctgcccaggagagtgctggccatcaagggccgggccaccaccctgccctag

SEQ ID NO: 157041 - DNA, 4833 bp, Artificial Sequence
  Description of Artificial Sequence: Synthetic coding sequence
atggccggccagggcgactgctgcgtgaaggtggccgtgcgcatccggccccagctgagcaaggagaagattgagggctgccacatctgcacctctgtgaccccaggagagccccaggtgctgctgggcaaggacaaggccttcacctatgactttgtgtttgacctggacacctggcaggagcagatctacagcacctgtgtgtccaagctgattgagggctgctttgagggctacaatgccaccgtgctggcctacggccagacaggagctgggaagacctacaccatgggcactggatttgacatggccaccagcgaggaggagcagggcatcatcccccgggccatcgcccacctgtttggaggcattgctgagaggaagagaagagcccaggagcagggcgtggccggccctgagttcaaggtgtctgcccagttcctggagctgtacaatgaggagatcctggacctgtttgacagcacccgggaccctgacaccaggcaccggcgcagcaacatcaagatccatgaagatgccaatggaggcatctacaccactggagtgaccagccgcctcatccacagccaggaggagctgatccagtgcctgaagcagggcgccctgagcaggaccacagccagcacccagatgaatgtgcagagcagccgcagccacgccatcttcaccatccacctgtgccagatgaggatgtgcacccagcctgacctggtgaatgaggccgtgacaggcctgcctgatggcaccccacccagcagtgaatatgagaccctgacagccaagttccactttgtggacctggccggcagcgagcggctgaagaggactggagccaccggggagcgggccaaggagggcatcagcatcaactgtggcctgctggccctgggcaatgtcatcagcgccctgggggaccagagcaagaaggtggtgcacgtgccctacagagacagcaagctgacccggctgctgcaggacagcctgggcggcaacagccagaccatcatgattgcctgtgtgagccccagcgaccgggacttcatggagaccctgaacaccctgaagtatgccaacagagccaggaacatcaagaacaaggtggtggtgaaccaggacaagaccagccagcagatcagcgccctgcgggcagagatcgcccggctgcagatggagctgatggagtacaaggccggcaagagggtgattggagaagatggagctgagggctacagcgacctcttcagagaaaatgccatgctgcagaaggaaaatggagccctgcggctgcgggtgaaggccatgcaggaggccattgatgccatcaacaacagagtgacccagctgatgagccaggaggccaacctgctgctggccaaggctggagatggaaatgaggccatcggggccctgatccagaactacatccgggagattgaggagctgcggaccaagctgctggagagcgaggccatgaatgaaagcctgcggcgcagcctgagccgggccagcgcccggagcccctacagcctgggcgccagccctgctgccccagccttcggcggcagccctgccagctccatggaggatgccagcgaggtgatccggcgggccaagcaggacctggagcggctgaagaagaaggaggtgcggcagaggaggaagagccctgagaaggaggccttcaagaagagggccaagctgcagcaggagaacagcgaggagacagatgaaaatgaagctgaggaggaggaggaggagagagatgaaagtggctgtgaggaggaggagggccgggaggatgaagatgaggacagcggcagcgaggagagcctggtggacagcgacagcgaccctgaggagaaggaggtgaacttccaggccgacctggccgacctgacctgtgaaattgagatcaagcagaagctgattgatgagctggagaacagccagaggcggctgcagaccctgaagcaccagtatgaggagaagctgatcctgctgcagaacaagatccgggacacccagctggagcgggacagagtgctgcagaacctgagcaccatggagtgctacacagaggagaaggccaacaagatcaaggctgactatgagaagaggctgcgggagatgaacagagacctgcagaagctgcaggccgcccagaaggagcacgcccggctgctgaagaaccagagccgctatgagcgggagctgaagaagctgcaggccgaggtggccgagatgaagaaggccaaggtggccctgatgaagcagatgagggaggagcagcagaggcggcggctggtggagaccaagaggaaccgggagatcgcccagctgaagaaggagcagaggcggcaggagttccagatccgggccctggagagccagaagaggcagcaggagatggtgctgcggaggaagacccaggaggtgtctgccctgcggcggctggccaagcccatgtctgagcgggtggccggccgggccggcctgaagccacccatgctggacagcggggctgaggtgtctgccagcaccaccagcagcgaggccgagagcggggcccggtctgtgagcagcatcgtgcggcagtggaacaggaagatcaaccacttcctgggggaccacccagcccccaccgtgaatggcaccaggcctgccaggaagaagttccagaagaagggggccagccagagcttcagcaaggccgcccggctgaagtggcagagcctggagcggcgcatcatcgacatcgtgatgcagaggatgaccatcgtgaacctggaggccgacatggagcggctcatcaagaagcgggaggagctgttcctgctgcaggaggccctgcggaggaagcgggagcggctgcaggccgagagccctgaggaggagaagggcctgcaggagctggccgaggagattgaggtgctggccgccaacatcgactacatcaatgatggcatcacagactgccaggccaccatcgtgcagctggaggagaccaaggaggagctggacagcacagacacctctgtggtgatcagcagctgcagcctggccgaggcccggctgctgctggacaacttcctgaaggccagcattgacaagggcctgcaggtggcccagaaggaggcccagatccggctgctggagggccgcctgcggcagacagacatggccggcagcagccagaaccacctgctgctggatgccctgcgggagaaggccgaggcccaccctgagctgcaggccctgatctacaacgtgcagcaggagaatggctacgccagcacagatgaggagatcagcgagttcagcgagggcagcttcagccagagcttcaccatgaagggcagcaccagccatgatgacttcaagttcaagtctgagcccaagctgagcgcccagatgaaggctgtgtctgcagaatgtctgggcccccccctggacatcagcaccaagaacatcaccaagagcctggccagcctggtggagatcaaggaggatggagtgggcttctctgtgcgggacccctactacagagacagagtgtccaggacagtgtccctgcccacccggggcagcaccttcccccggcagagccgggccacagagaccagccccctgaccaggaggaagagctatgaccggggccagcccatccgcagcacagatgtgggcttcaccccacccagcagcccccccacccggcccagaaatgacagaaatgtgttcagccggctgaccagcaaccagagccagggcagcgccctggacaagggcatcatcagccctgtgggcggggccaagggggccaggacagcccccctgcagtgtgtgtccatggccgagggccacaccaagcccatcctgtgcctggatgccacagatgagctgctcttcaccggcagcaaggacaggagctgcaagatgtggaacctggtgacaggccaggagattgctgccctgaagggccaccccaacaacgtggtgtccatcaagtactgcagccacagcggcctggtgttttctgtgtccaccagctacatcaaggtgtgggacatccgggacagcgccaagtgcatccgcaccctgaccagcagcggccaggtgatctctggagatgcctgtgccgccaccagcacccgggccatcaccagcgcccagggcgagcaccagatcaaccagatcgccctgagccccagcggcaccatgctgtatgctgccagcggaaatgctgtgcgcatctgggagctgagccgcttccagcctgtgggcaagctgaccggccacatcggccctgtgatgtgcctgactgtgacccagacagccagccagcacgacctggtggtgacaggcagcaaggaccactacgtgaagatgtttgagctgggggagtgtgtgacaggcaccatcggccccacccacaactttgagcccccccactatgatggcattgaatgtctggccatccagggcgacatcctcttcagcggcagccgggacaatggcatcaagaagtgggacctggaccagcaggagctgatccagcagatccccaatgcccacaaggactgggtgtgtgccctggccttcatccctggccggcccatgctgctgagcgcctgcagagctggggtcatcaaggtgtggaatgtggacaacttcacccccatcggggagatcaagggccatgacagccccatcaatgccatctgcaccaatgccaagcacatcttcaccgccagcagtgacctgactgtgaagttctggagcgtgcggcggctgccccacagcggccccccatag

SEQ ID NO: 157042 - DNA, 4914 bp, Artificial Sequence
  Description of Artificial Sequence: Synthetic coding sequence
atggccggccagggcgactgctgcgtgaaggtggccgtgcgcatccggccccagctgagcaaggagaagattgagggctgccacatctgcacctctgtgaccccaggagagccccaggtgctgctgggcaaggacaaggccttcacctatgactttgtgtttgacctggacacctggcaggagcagatctacagcacctgtgtgtccaagctgattgagggctgctttgagggctacaatgccaccgtgctggcctacggccagacaggagctgggaagacctacaccatgggcactggatttgacatggccaccagcgaggaggagcagggcatcatcccccgggccatcgcccacctgtttggaggcattgctgagaggaagagaagagcccaggagcagggcgtggccggccctgagttcaaggtgtctgcccagttcctggagctgtacaatgaggagatcctggacctgtttgacagcacccgggaccctgacaccaggcaccggcgcagcaacatcaagatccatgaagatgccaatggaggcatctacaccactggagtgaccagccgcctcatccacagccaggaggagctgatccagtgcctgaagcagggcgccctgagcaggaccacagccagcacccagatgaatgtgcagagcagccgcagccacgccatcttcaccatccacctgtgccagatgaggatgtgcacccagcctgacctggtgaatgaggccgtgacaggcctgcctgatggcaccccacccagcagtgaatatgagaccctgacagccaagttccactttgtggacctggccggcagcgagcggctgaagaggactggagccaccggggagcgggccaaggagggcatcagcatcaactgtggcctgctggccctgggcaatgtcatcagcgccctgggggaccagagcaagaaggtggtgcacgtgccctacagagacagcaagctgacccggctgctgcaggacagcctgggcggcaacagccagaccatcatgattgcctgtgtgagccccagcgaccgggacttcatggagaccctgaacaccctgaagtatgccaacagagccaggaacatcaagaacaaggtggtggtgaaccaggacaagaccagccagcagatcagcgccctgcgggcagagatcgcccggctgcagatggagctgatggagtacaaggccggcaagagggtgattggagaagatggagctgagggctacagcgacctcttcagagaaaatgccatgctgcagaaggaaaatggagccctgcggctgcgggtgaaggccatgcaggaggccattgatgccatcaacaacagagtgacccagctgatgagccaggaggccaacctgctgctggccaaggctggagatggaaatgaggccatcggggccctgatccagaactacatccgggagattgaggagctgcggaccaagctgctggagagcgaggccatgaatgaaagcctgcggcgcagcctgagccgggccagcgcccggagcccctacagcctgggcgccagccctgctgccccagccttcggcggcagccctgccagctccatggaggatgccagcgaggtgatccggcgggccaagcaggacctggagcggctgaagaagaaggaggtgcggcagaggaggaagagccctgagaaggaggccttcaagaagagggccaagctgcagcaggagaacagcgaggagacagatgaaaatgaagctgaggaggaggaggaggagagagatgaaagtggctgtgaggaggaggagggccgggaggatgaagatgaggacagcggcagcgaggagagcctggtggacagcgacagcgaccctgaggagaaggaggtgaacttccaggccgacctggccgacctgacctgtgaaattgagatcaagcagaagctgattgatgagctggagaacagccagaggcggctgcagaccctgaagcaccagtatgaggagaagctgatcctgctgcagaacaagatccgggacacccagctggagcgggacagagtgctgcagaacctgagcaccatggagtgctacacagaggagaaggccaacaagatcaaggctgactatgagaagaggctgcgggagatgaacagagacctgcagaagctgcaggccgcccagaaggagcacgcccggctgctgaagaaccagagccgctatgagcgggagctgaagaagctgcaggccgaggtggccgagatgaagaaggccaaggtggccctgatgaagcagatgagggaggagcagcagaggcggcggctggtggagaccaagaggaaccgggagatcgcccagctgaagaaggagcagaggcggcaggagttccagatccgggccctggagagccagaagaggcagcaggagatggtgctgcggaggaagacccaggaggtgtctgccctgcggcggctggccaagcccatgtctgagcgggtggccggccgggccggcctgaagccacccatgctggacagcggggctgaggtgtctgccagcaccaccagcagcgaggccgagagcggggcccggtctgtgagcagcatcgtgcggcagtggaacaggaagatcaaccacttcctgggggaccacccagcccccaccgtgaatggcaccaggcctgccaggaagaagttccagaagaagggggccagccagagcttcagcaaggccgcccggctgaagtggcagagcctggagcggcgcatcatcgacatcgtgatgcagaggatgaccatcgtgaacctggaggccgacatggagcggctcatcaagaagcgggaggagctgttcctgctgcaggaggccctgcggaggaagcgggagcggctgcaggccgagagccctgaggaggagaagggcctgcaggagctggccgaggagattgaggtgctggccgccaacatcgactacatcaatgatggcatcacagactgccaggccaccatcgtgcagctggaggagaccaaggaggagctggacagcacagacacctctgtggtgatcagcagctgcagcctggccgaggcccggctgctgctggacaacttcctgaaggccagcattgacaagggcctgcaggtggcccagaaggaggcccagatccggctgctggagggccgcctgcggcagacagacatggccggcagcagccagaaccacctgctgctggatgccctgcgggagaaggccgaggcccaccctgagctgcaggccctgatctacaacgtgcagcaggagaatggctacgccagcacagatgaggagatcagcgagttcagcgagggcagcttcagccagagcttcaccatgaagggcagcaccagccatgatgacttcaagttcaagtctgagcccaagctgagcgcccagatgaaggctgtgtctgcagaatgtctgggcccccccctggacatcagcaccaagaacatcaccaagagcctggccagcctggtggagatcaaggaggatggagtgggcttctctgtgcgggacccctactacagagacagagtgtccaggacagtgtccctgcccacccggggcagcaccttcccccggcagagccgggccacagagaccagccccctgaccaggaggaagagctatgaccggggccagcccatccgcagcacagatgtgggcttcaccccacccagcagcccccccacccggcccagaaatgacagaaatgtgttcagccggctgaccagcaaccagagccagggcagcgccctggacaagagtgatgacagcgacagcagcctgtctgaggtgctgcggggcatcatcagccctgtgggcggggccaagggggccaggacagcccccctgcagtgtgtgtccatggccgagggccacaccaagcccatcctgtgcctggatgccacagatgagctgctcttcaccggcagcaaggacaggagctgcaagatgtggaacctggtgacaggccaggagattgctgccctgaagggccaccccaacaacgtggtgtccatcaagtactgcagccacagcggcctggtgttttctgtgtccaccagctacatcaaggtgtgggacatccgggacagcgccaagtgcatccgcaccctgaccagcagcggccaggtgatctctggagatgcctgtgccgccaccagcacccgggccatcaccagcgcccagggcgagcaccagatcaaccagatcgccctgagccccagcggcaccatgctgtatgctgccagcggaaatgctgtgcgcatctgggagctgagccgcttccagcctgtgggcaagctgaccggccacatcggccctgtgatgtgcctgactgtgacccagacagccagccagcacgacctggtggtgacaggcagcaaggaccactacgtgaagatgtttgagctgggagaatgtgtgacaggcaccatcggccccacccacaactttgagcccccccactatgatggcatcgagtgcctggccatccagggcgacatcctcttcagcggcagccgggacaatggcatcaagaagtgggacctggaccagcaggagctgatccagcagatccccaatgcccacaaggactgggtgtgtgccctggccttcatccctggccggcccatgctgctgagcgcctgccgggccggggtcatcaaggtgtggaatgtggacaacttcacccccatcggggagatcaagggccatgacagccccatcaatgccatctgcaccaatgccaagcacatcttcaccgccagcagtgactgccgggtgaagctgtggaactacgtgcccggcctgaccccctgcctgccccggcgggtgctggccatcaagggccgggccaccaccctgccctag

SEQ ID NO: 157043 - DNA, 4872 bp, Artificial Sequence
  Description of Artificial Sequence: Synthetic coding sequence
atggccggccagggcgactgctgcgtgaaggtggccgtgcgcatccggccccagctgagcaaggagaagattgagggctgccacatctgcacctctgtgaccccaggagagccccaggtgctgctgggcaaggacaaggccttcacctatgactttgtgtttgacctggacacctggcaggagcagatctacagcacctgtgtgtccaagctgattgagggctgctttgagggctacaatgccaccgtgctggcctacggccagacaggagctgggaagacctacaccatgggcactggatttgacatggccaccagcgaggaggagcagggcatcatcccccgggccatcgcccacctgtttggaggcattgctgagaggaagagaagagcccaggagcagggcgtggccggccctgagttcaaggtgtctgcccagttcctggagctgtacaatgaggagatcctggacctgtttgacagcacccgggaccctgacaccaggcaccggcgcagcaacatcaagatccatgaagatgccaatggaggcatctacaccactggagtgaccagccgcctcatccacagccaggaggagctgatccagtgcctgaagcagggcgccctgagcaggaccacagccagcacccagatgaatgtgcagagcagccgcagccacgccatcttcaccatccacctgtgccagatgaggatgtgcacccagcctgacctggtgaatgaggccgtgacaggcctgcctgatggcaccccacccagcagtgaatatgagaccctgacagccaagttccactttgtggacctggccggcagcgagcggctgaagaggactggagccaccggggagcgggccaaggagggcatcagcatcaactgtggcctgctggccctgggcaatgtcatcagcgccctgggggaccagagcaagaaggtggtgcacgtgccctacagagacagcaagctgacccggctgctgcaggacagcctgggcggcaacagccagaccatcatgattgcctgtgtgagccccagcgaccgggacttcatggagaccctgaacaccctgaagtatgccaacagagccaggaacatcaagaacaaggtggtggtgaaccaggacaagaccagccagcagatcagcgccctgcgggcagagatcgcccggctgcagatggagctgatggagtacaaggccggcaagagggtgattggagaagatggagctgagggctacagcgacctcttcagagaaaatgccatgctgcagaaggaaaatggagccctgcggctgcgggtgaaggccatgcaggaggccattgatgccatcaacaacagagtgacccagctgatgagccaggaggccaacctgctgctggccaaggctggagatggaaatgaggccatcggggccctgatccagaactacatccgggagattgaggagctgcggaccaagctgctggagagcgaggccatgaatgaaagcctgcggcgcagcctgagccgggccagcgcccggagcccctacagcctgggcgccagccctgctgccccagccttcggcggcagccctgccagctccatggaggatgccagcgaggtgatccggcgggccaagcaggacctggagcggctgaagaagaaggaggtgcggcagaggaggaagagccctgagaaggaggccttcaagaagagggccaagctgcagcaggagaacagcgaggagacagatgaaaatgaagctgaggaggaggaggaggagagagatgaaagtggctgtgaggaggaggagggccgggaggatgaagatgaggacagcggcagcgaggagagcctggtggacagcgacagcgaccctgaggagaaggaggtgaacttccaggccgacctggccgacctgacctgtgaaattgagatcaagcagaagctgattgatgagctggagaacagccagaggcggctgcagaccctgaagcaccagtatgaggagaagctgatcctgctgcagaacaagatccgggacacccagctggagcgggacagagtgctgcagaacctgagcaccatggagtgctacacagaggagaaggccaacaagatcaaggctgactatgagaagaggctgcgggagatgaacagagacctgcagaagctgcaggccgcccagaaggagcacgcccggctgctgaagaaccagagccgctatgagcgggagctgaagaagctgcaggccgaggtggccgagatgaagaaggccaaggtggccctgatgaagcagatgagggaggagcagcagaggcggcggctggtggagaccaagaggaaccgggagatcgcccagctgaagaaggagcagaggcggcaggagttccagatccgggccctggagagccagaagaggcagcaggagatggtgctgcggaggaagacccaggaggtgtctgccctgcggcggctggccaagcccatgtctgagcgggtggccggccgggccggcctgaagccacccatgctggacagcggggctgaggtgtctgccagcaccaccagcagcgaggccgagagcggggcccggtctgtgagcagcatcgtgcggcagtggaacaggaagatcaaccacttcctgggggaccacccagcccccaccgtgaatggcaccaggcctgccaggaagaagttccagaagaagggggccagccagagcttcagcaaggccgcccggctgaagtggcagagcctggagcggcgcatcatcgacatcgtgatgcagaggatgaccatcgtgaacctggaggccgacatggagcggctcatcaagaagcgggaggagctgttcctgctgcaggaggccctgcggaggaagcgggagcggctgcaggccgagagccctgaggaggagaagggcctgcaggagctggccgaggagattgaggtgctggccgccaacatcgactacatcaatgatggcatcacagactgccaggccaccatcgtgcagctggaggagaccaaggaggagctggacagcacagacacctctgtggtgatcagcagctgcagcctggccgaggcccggctgctgctggacaacttcctgaaggccagcattgacaagggcctgcaggtggcccagaaggaggcccagatccggctgctggagggccgcctgcggcagacagacatggccggcagcagccagaaccacctgctgctggatgccctgcgggagaaggccgaggcccaccctgagctgcaggccctgatctacaacgtgcagcaggagaatggctacgccagcacagatgaggagatcagcgagttcagcgagggcagcttcagccagagcttcaccatgaagggcagcaccagccatgatgacttcaagttcaagtctgagcccaagctgagcgcccagatgaaggctgtgtctgcagaatgtctgggcccccccctggacatcagcaccaagaacatcaccaagagcctggccagcctggtggagatcaaggaggatggagtgggcttctctgtgcgggacccctactacagagacagagtgtccaggacagtgtccctgcccacccggggcagcaccttcccccggcagagccgggccacagagaccagccccctgaccaggaggaagagctatgaccggggccagcccatccgcagcacagatgtgggcttcaccccacccagcagcccccccacccggcccagaaatgacagaaatgtgttcagccggctgaccagcaaccagagccagggcagcgccctggacaagagtgatgacagcgacagcagcctgtctgaggtgctgcggggcatcatcagccctgtgggcggggccaagggggccaggacagcccccctgcagtgtgtgtccatggccgagggccacaccaagcccatcctgtgcctggatgccacagatgagctgctcttcaccggcagcaaggacaggagctgcaagatgtggaacctggtgacaggccaggagattgctgccctgaagggccaccccaacaacgtggtgtccatcaagtactgcagccacagcggcctggtgttttctgtgtccaccagctacatcaaggtgtgggacatccgggacagcgccaagtgcatccgcaccctgaccagcagcggccaggtgatctctggagatgcctgtgccgccaccagcacccgggccatcaccagcgcccagggcgagcaccagatcaaccagatcgccctgagccccagcggcaccatgctgtatgctgccagcggaaatgctgtgcgcatctgggagctgagccgcttccagcctgtgggcaagctgaccggccacatcggccctgtgatgtgcctgactgtgacccagacagccagccagcacgacctggtggtgacaggcagcaaggaccactacgtgaagatgtttgagctgggagaatgtgtgacaggcaccatcggccccacccacaactttgagcccccccactatgatggcatcgagtgcctggccatccagggcgacatcctcttcagcggcagccgggacaatggcatcaagaagtgggacctggaccagcaggagctgatccagcagatccccaatgcccacaaggactgggtgtgtgccctggccttcatccctggccggcccatgctgctgagcgcctgccgggccggggtcatcaaggtgtggaatgtggacaacttcacccccatcggggagatcaagggccatgacagccccatcaatgccatctgcaccaatgccaagcacatcttcaccgccagcagtgacctgactgtgaagttctggagcgtgcggcggctgccccacagcggccccccatag

SEQ ID NO: 157044 - DNA, 5007 bp, Artificial Sequence
  Description of Artificial Sequence: Synthetic coding sequence
atggccggccagggcgactgctgcgtgaaggtggccgtgcgcatccggccccagctgagcaaggagaagattgagggctgccacatctgcacctctgtgaccccaggagagccccaggtgctgctgggcaaggacaaggccttcacctatgactttgtgtttgacctggacacctggcaggagcagatctacagcacctgtgtgtccaagctgattgagggctgctttgagggctacaatgccaccgtgctggcctacggccagacaggagctgggaagacctacaccatgggcactggatttgacatggccaccagcgaggaggagcagggcatcatcccccgggccatcgcccacctgtttggaggcattgctgagaggaagagaagagcccaggagcagggcgtggccggccctgagttcaaggtgtctgcccagttcctggagctgtacaatgaggagatcctggacctgtttgacagcacccgggaccctgacaccaggcaccggcgcagcaacatcaagatccatgaagatgccaatggaggcatctacaccactggagtgaccagccgcctcatccacagccaggaggagctgatccagtgcctgaagcagggcgccctgagcaggaccacagccagcacccagatgaatgtgcagagcagccgcagccacgccatcttcaccatccacctgtgccagatgaggatgtgcacccagcctgacctggtgaatgaggccgtgacaggcctgcctgatggcaccccacccagcagtgaatatgagaccctgacagccaagttccactttgtggacctggccggcagcgagcggctgaagaggactggagccaccggggagcgggccaaggagggcatcagcatcaactgtggcctgctggccctgggcaatgtcatcagcgccctgggggaccagagcaagaaggtggtgcacgtgccctacagagacagcaagctgacccggctgctgcaggacagcctgggcggcaacagccagaccatcatgattgcctgtgtgagccccagcgaccgggacttcatggagaccctgaacaccctgaagtatgccaacagagccaggaacatcaagaacaaggtggtggtgaaccaggacaagaccagccagcagatcagcgccctgcgggcagagatcgcccggctgcagatggagctgatggagtacaaggccggcaagagggtgattggagaagatggagctgagggctacagcgacctcttcagagaaaatgccatgctgcagaaggaaaatggagccctgcggctgcgggtgaaggccatgcaggaggccattgatgccatcaacaacagagtgacccagctgatgagccaggaggccaacctgctgctggccaaggctggagatggaaatgaggccatcggggccctgatccagaactacatccgggagattgaggagctgcggaccaagctgctggagagcgaggccatgaatgaaagcctgcggcgcagcctgagccgggccagcgcccggagcccctacagcctgggcgccagccctgctgccccagccttcggcggcagccctgccagctccatggaggatgccagcgaggtgatccggcgggccaagcaggacctggagcggctgaagaagaaggaggtgcggcagaggaggaagagccctgagaaggaggccttcaagaagagggccaagctgcagcaggagaacagcgaggagacagatgaaaatgaagctgaggaggaggaggaggagagagatgaaagtggctgtgaggaggaggagggccgggaggatgaagatgaggacagcggcagcgaggagagcctggtggacagcgacagcgaccctgaggagaaggaggtgaacttccaggccgacctggccgacctgacctgtgaaattgagatcaagcagaagctgattgatgagctggagaacagccagaggcggctgcagaccctgaagcaccagtatgaggagaagctgatcctgctgcagaacaagatccgggacacccagctggagcgggacagagtgctgcagaacctgagcaccatggagtgctacacagaggagaaggccaacaagatcaaggctgactatgagaagaggctgcgggagatgaacagagacctgcagaagctgcaggccgcccagaaggagcacgcccggctgctgaagaaccagagccgctatgagcgggagctgaagaagctgcaggccgaggtggccgagatgaagaaggccaaggtggccctgatgaagcagatgagggaggagcagcagaggcggcggctggtggagaccaagaggaaccgggagatcgcccagctgaagaaggagcagaggcggcaggagttccagatccgggccctggagagccagaagaggcagcaggagatggtgctgcggaggaagacccaggaggtgtctgccctgcggcggctggccaagcccatgtctgagcgggtggccggccgggccggcctgaagccacccatgctggacagcggggctgaggtgtctgccagcaccaccagcagcgaggccgagagcggggcccggtctgtgagcagcatcgtgcggcagtggaacaggaagatcaaccacttcctgggggaccacccagcccccaccgtgaatggcaccaggcctgccaggaagaagttccagaagaagggggccagccagagcttcagcaaggccgcccggctgaagtggcagagcctggagcggcgcatcatcgacatcgtgatgcagaggatgaccatcgtgaacctggaggccgacatggagcggctcatcaagaagcgggaggagctgttcctgctgcaggaggccctgcggaggaagcgggagcggctgcaggccgagagccctgaggaggagaagggcctgcaggagctggccgaggagattgaggtgctggccgccaacatcgactacatcaatgatggcatcacagactgccaggccaccatcgtgcagctggaggagaccaaggaggagctggacagcacagacacctctgtggtgatcagcagctgcagcctggccgaggcccggctgctgctggacaacttcctgaaggccagcattgacaagggcctgcaggtggcccagaaggaggcccagatccggctgctggagggccgcctgcggcagacagacatggccggcagcagccagaaccacctgctgctggatgccctgcgggagaaggccgaggcccaccctgagctgcaggccctgatctacaacgtgcagcaggagaatggctacgccagcacagatgaggagatcagcgagttcagcgagggcagcttcagccagagcttcaccatgaagggcagcaccagccatgatgacttcaagttcaagtctgagcccaagctgagcgcccagatgaaggctgtgtctgcagaatgtctgggcccccccctggacatcagcaccaagaacatcaccaagagcctggccagcctggtggagatcaaggaggatggagtgggcttctctgtgcgggacccctactacagagacagagtgtccaggacagtgtccctgcccacccggggcagcaccttcccccggcagagccgggccacagagaccagccccctgaccaggaggaagagctatgaccggggccagcccatccgcagcacagatgtgggcttcaccccacccagcagcccccccacccggcccagaaatgacagaaatgtgttcagccggctgaccagcaaccagagccagggcagcgccctggacaagagtgatgacagcgacagcagcctgtctgaggtgctgcggggcatcatcagccctgtgggcggggccaagggggccaggacagcccccctgcagtgtgtgtccatggccgagggccacaccaagcccatcctgtgcctggatgccacagatgagctgctcttcaccggcagcaaggacaggagctgcaagatgtggaacctggtgacaggccaggagattgctgccctgaagggccaccccaacaacgtggtgtccatcaagtactgcagccacagcggcctggtgttttctgtgtccaccagctacatcaaggtgtgggacatccgggacagcgccaagtgcatccgcaccctgaccagcagcggccaggtgatctctggagatgcctgtgccgccaccagcacccgggccatcaccagcgcccagggcgagcaccagatcaaccagatcgccctgagccccagcggcaccatgctgtatgctgccagcggaaatgctgtgcgcatctgggagctgagccgcttccagcctgtgggcaagctgaccggccacatcggccctgtgatgtgcctgactgtgacccagacagccagccagcacgacctggtggtgacaggcagcaaggaccactacgtgaagatgtttgagctgggagaatgtgtgacaggcaccatcggccccacccacaactttgagcccccccactatgatggcatcgagtgcctggccatccagggcgacatcctcttcagcggcagccgggacaatggcatcaagaagtgggacctggaccagcaggagctgatccagcagatccccaatgcccacaaggactgggtgtgtgccctggccttcatccctggccggcccatgctgctgagcgcctgccgggccggggtcatcaaggtgtggaatgtggacaacttcacccccatcggggagatcaagggccatgacagccccatcaatgccatctgcaccaatgccaagcacatcttcaccgccagcagtgactgccgggtgaagctgtggaactacgtgcccggcctgaccccctgcctgccccggcgggtgctggccatcaagggccgggccaccacctgcccagaccccccccagctgagcctgagccccctgtccttcttccccagcttcctgttccccctcttcccccactttgacctgagctgcttcctgacctag

SEQ ID NO: 157045 - DNA, 1998 bp, Artificial Sequence
  Description of Artificial Sequence: Synthetic coding sequence
atggctgctgggggcagcacccagcagaggagaagagagatggccgccgccagcgctgctgccatctctggagctggccgctgccgcctgagcaagattggagccaccaggaggcctcctccagcccgggtgcgggtggccgtgcggctgcggccctttgtggatggaacagctggggccagtgaccccccctgtgtgcggggcatggacagctgcagcctggagatcgccaactggaggaaccaccaggagaccctgaagtaccagtttgatgccttctacggggagaggagcacccagcaggacatctatgccggctctgtgcagcccatcctgcggcacctgctggagggccagaatgcctctgtgctggcctacggccccactggagctgggaagacccacaccatgctgggcagccctgagcagcccggggtcatcccccgggccctgatggacctgctgcagctgacccgggaggagggcgctgagggccggccctgggccctgtctgtgaccatgagctacctggagatctaccaggagaaggtgctggacctgctggaccctgccagcggggacctggtgatccgggaggactgccggggcaacatcctgatccctggcctgagccagaagcccatcagcagctttgctgactttgagcggcacttcctgcctgccagcaggaacagaacagtgggcgccacccggctgaaccagaggagcagccgcagccatgctgtgctgctggtgaaggtggaccagcgggagcggctggcccccttccggcagcgggagggcaagctgtacctgattgacctggccggcagcgaggacaacagaagaacaggcaacaagggcctgcggctgaaggagagcggggccatcaacaccagcctgtttgtgctgggcaaggtggtggatgccctgaaccagggcctgccccgggtgccctacagagacagcaagctgacccggctgctgcaggacagcctgggcggcagcgcccacagcatcctgattgccaacatcgcccctgagcggcgcttctacctggacacagtgtctgccctgaactttgctgcccggagcaaggaggtgatcaaccggcccttcaccaatgaaagcctgcagccccacgccctgggccctgtgaagctgagccagaaggagctgctgggccccccagaggccaagagggcccggggccctgaggaggaggagatcggcagccctgagcccatggccgccccagccagcgccagccagaagctgagccccctgcagaagctgagctccatggaccctgccatgctggagcggctgctgagcctggaccggctgctggccagccagggcagccagggcgcccccctgctgagcacccccaagcgggagaggatggtgctgatgaagacagtggaggagaaggacctggagattgaaaggctgaagaccaagcagaaggagctggaggccaagatgctggcccagaaggccgaggagaaggagaaccactgccccaccatgctgcggcccctgagccacaggacagtgactggagccaagcccctgaagaaggctgtggtgatgcccctgcagctgatccaggagcaggccgccagccccaatgctgagatccacatcctgaagaacaagggcaggaagaggaagctggagagcctggatgccctggagcctgaggagaaggccgaggactgctgggagctgcagatcagccctgagctgctggcccacggccggcagaagatcctggacctgctgaatgaaggcagcgcccgggacctgcggagcctgcagagaattggccccaagaaggcccagctgattgtgggctggagggagctgcacggccccttcagccaggtggaggacctggagcgggtggagggcatcaccgggaagcagatggagagcttcctgaaggccaacatcctgggcctggccgccggccagagatgtggggccagctag

SEQ ID NO: 157046 - DNA, 219 bp, Artificial Sequence
  Description of Artificial Sequence: Synthetic coding sequence
atgctggcccagaaggccgaggagaaggagaaccactgccccaccatgctgcggcccctgagccacaggacagtgactggagccaagcccctgaagaaggctgtggtgatgcccctgcagctgatccaggagcaggccgccagccccaatgctgagatccacatcctgaagaacaagggcaggaagaggaagggggccaacatcaccaccggctactag

SEQ ID NO: 157047 - DNA, 1794 bp, Artificial Sequence
  Description of Artificial Sequence: Synthetic coding sequence
atggacagctgcagcctggagatcgccaactggaggaaccaccaggagaccctgaagtaccagtttgatgccttctacggggagaggagcacccagcaggacatctatgccggctctgtgcagcccatcctgcggcacctgctggagggccagaatgcctctgtgctggcctacggccccactggagctgggaagacccacaccatgctgggcagccctgagcagcccggggtcatcccccgggccctgatggacctgctgcagctgacccgggaggagggcgctgagggccggccctgggccctgtctgtgaccatgagctacctggagatctaccaggagaaggtgctggacctgctggaccctgccagcggggacctggtgatccgggaggactgccggggcaacatcctgatccctggcctgagccagaagcccatcagcagctttgctgactttgagcggcacttcctgcctgccagcaggaacagaacagtgggcgccacccggctgaaccagaggagcagccgcagccatgctgtgctgctggtgaaggtggaccagcgggagcggctggcccccttccggcagcgggagggcaagctgtacctgattgacctggccggcagcgaggacaacagaagaacaggcaacaagggcctgcggctgaaggagagcggggccatcaacaccagcctgtttgtgctgggcaaggtggtggatgccctgaaccagggcctgccccgggtgccctacagagacagcaagctgacccggctgctgcaggacagcctgggcggcagcgcccacagcatcctgattgccaacatcgcccctgagcggcgcttctacctggacacagtgtctgccctgaactttgctgcccggagcaaggaggtgatcaaccggcccttcaccaatgaaagcctgcagccccacgccctgggccctgtgaagctgagccagaaggagctgctgggccccccagaggccaagagggcccggggccctgaggaggaggagatcggcagccctgagcccatggccgccccagccagcgccagccagaagctgagccccctgcagaagctgagctccatggaccctgccatgctggagcggctgctgagcctggaccggctgctggccagccagggcagccagggcgcccccctgctgagcacccccaagcgggagaggatggtgctgatgaagacagtggaggagaaggacctggagattgaaaggctgaagaccaagcagaaggagctggaggccaagatgctggcccagaaggccgaggagaaggagaaccactgccccaccatgctgcggcccctgagccacaggacagtgactggagccaagcccctgaagaaggctgtggtgatgcccctgcagctgatccaggagcaggccgccagccccaatgctgagatccacatcctgaagaacaagggcaggaagaggaagctggagagcctggatgccctggagcctgaggagaaggccgaggactgctgggagctgcagatcagccctgagctgctggcccacggccggcagaagatcctggacctgctgaatgaaggcagcgcccgggacctgcggagcctgcagagaattggccccaagaaggcccagctgattgtgggctggagggagctgcacggccccttcagccaggtggaggacctggagcgggtggagggcatcaccgggaagcagatggagagcttcctgaaggccaacatcctgggcctggccgccggccagagatgtggggccagctag

SEQ ID NO: 157048 - DNA, 1794 bp, Artificial Sequence; identical to SEQ ID NO: 157047
  Description of Artificial Sequence: Synthetic coding sequence

SEQ ID NO: 157049 - DNA, 2883 bp, Artificial Sequence
  Description of Artificial Sequence: Synthetic coding sequence
atgaagagcgcccgggccaagacccccaggaagcccaccgtgaagaagggcagccagaccaacctgaaggaccctgtgggcgtgtactgccgggtgcggcccctgggcttcccagaccaggagtgctgcatcgaggtgatcaacaacaccaccgtgcagctgcacaccccagagggctaccgcctgaacagaaatggagactacaaggagacccagtacagcttcaagcaggtgtttggcacccacaccacccagaaggagctgtttgatgtggtggccaaccccctggtgaatgacctgatccacggcaagaatggcctgctcttcacctatggagtgacaggcagcggcaagacccacaccatgacaggcagccctggagagggcggcctgctgccccgctgcctggacatgatcttcaacagcatcggcagcttccaggccaagagatatgtgttcaagagcaatgacaggaacagcatggacatccagtgtgaggtggatgccctgctggagcggcagaagcgggaggccatgcccaaccccaagaccagcagcagcaagaggcaggtggaccctgagtttgctgacatgatcaccgtgcaggagttctgcaaggccgaggaggtggatgaggacagcgtgtatggagtgtttgtgtcctacatcgagatctacaacaactacatctatgacctgctggaggaggtgccctttgaccccatcaagcccaagccaccccagagcaagctgctgcgggaggacaagaaccacaacatgtatgtggccggctgcacagaggtggaggtgaagagcacagaggaggcctttgaggtgttctggaggggccagaagaagagaagaattgccaacacccacctgaaccgggagagcagccgcagccacagcgtcttcaacatcaagctggtgcaggcccccctggatgctgatggagacaacgtgctgcaggagaaggagcagatcaccatcagccagctgagcctggtggacctggccggcagcgagaggaccaacagaaccagggctgagggcaaccggctgcgggaggccggcaacatcaaccagagcctgatgaccctgcggacctgcatggatgtgctgcgggagaaccagatgtatggcaccaacaagatggtgccctacagagacagcaagctgacccacctgttcaagaactactttgatggagagggcaaggtgaggatgattgtgtgtgtgaaccccaaggccgaggactatgaggagaacctgcaggtgatgagatttgctgaggtgacccaggaggtggaggtggcccggcctgtggacaaggccatctgtggcctgaccccaggaagacgctacagaaaccagccccggggccctgtgggcaatgagcccctggtgacagatgtggtgctgcagagcttcccccccctgcccagctgtgagatcctggacatcaatgatgagcagaccctgcccaggctcatcgaggccctggagaagaggcacaacctgcggcagatgatgattgatgagttcaacaagcagagcaatgccttcaaggccctgctgcaggagtttgacaatgctgtgctgagcaaagaaaaccacatgcagggcaagctgaatgagaaggagaagatgatcagcggccagaagctggagattgaaaggctggagaagaagaacaagaccctggagtacaagattgagatcctggagaagaccaccaccatctatgaggaggacaagaggaacctgcagcaggagctggagacccagaaccagaagctgcagaggcagttcagtgacaagaggcggctggaggcccggctgcagggcatggtgacagagaccaccatgaagtgggagaaggaatgtgaaagaagagtggccgccaagcagctggagatgcagaacaagctgtgggtgaaggatgagaagctgaagcagctgaaggccatcgtgacagagcccaagacagagaagccagagcggcccagccgggagcgggaccgggagaaggtgacccagaggtctgtgagccccagccctgtgcccctgagcagcaactacatcgcccagatcagcaatggccagcagctgatgagccagccccagctgcaccggcgcagcaacagctgcagcagcatctctgtggccagctgcatcagcgagtgggagcagaagatccccacctacaacacccccctgaaggtgaccagcatcgcccggcggcggcagcaggagcccggccagagcaagacctgcatcgtgtctgacagaagaagaggcatgtactggacagagggccgggaggtggtgcccaccttcagaaatgaaattgaaattgaggaggaccactgcggccgcctgctcttccagcctgaccagaatgccccacccatccggctgcggcaccggcgcagccgctctgctggggaccgctgggtggaccacaagccagccagcaacatgcagacagagaccgtgatgcagccccacgtgccccacgccatcaccgtgtctgtggccaatgagaaggccctggccaagtgtgagaagtacatgctgacccaccaggagctggccagtgatggagaaattgagaccaagctgatcaagggggacatctacaagacccggggcggcggccagagcgtgcagttcacagacatcgagaccctgaagcaggagagccccaacggcagcaggaagagaagaagcagcacagtggccccagcccagccagatggagctgagagcgagtggacagatgtggagacccgctgcagcgtggccgtggagatgagagctggcagccagctgggccctggctaccagcaccacgcccagcccaagaggaagaagccctag

SEQ ID NO: 157050 - DNA, 2022 bp, Artificial Sequence
  Description of Artificial Sequence: Synthetic coding sequence
atgatcaccgtgcaggagttctgcaaggccgaggaggtggatgaagattctgtgtatggagtgtttgtgtcctacatcgagatctacaacaactacatctatgacctgctggaggaggtgccctttgaccccatcaagcccaagtggaacagctgcagcacccccatgaggaacacagactttgtgcccccccagagcaagctgctgcgggaggacaagaaccacaacatgtatgtggccggctgcacagaggtggaggtgaagagcacagaggaggcctttgaggtgttctggaggggccagaagaagaggcgcatcgccaacacccacctgaaccgggagagcagccgcagccacagcgtcttcaacatcaagctggtgcaggcccccctggatgctgatggagacaacgtgctgcaggagaaggagcagatcaccatcagccagctgagcctggtggacctggccggcagcgagaggaccaacagaaccagggctgagggcaaccggctgcgggaggccggcaacatcaaccagagcctgatgaccctgcggacctgcatggatgtgctgcgggagaaccagatgtatggcaccaacaagatggtgccctacagagacagcaagctgacccacctgttcaagaactactttgatggagagggcaaggtgaggatgattgtgtgtgtgaaccccaaggcagaagattatgaggagaacctgcaggtgatgagatttgctgaggtgacccaggaggtggaggtggcccggcctgtggacaaggccatctgtggcctgaccccaggccgccgctacagaaaccagccccggggccctgtgggcaatgagcccctggtgacagatgtggtgctgcagagcttcccccccctgcccagctgtgagatcctggacatcaatgatgagcagaccctgccccggctgattgaggccctggagaagaggcacaacctgcggcagatgatgattgatgagttcaacaagcagagcaatgccttcaaggccctgctgcaggagtttgacaatgctgtgctgagcaaggagaaccacatgcagggcaagctgaatgagaaggagaagatgatcagcggccagaagctggagattgagcggctggagaagaagaacaagaccctggagtacaagattgagatcctggagaagaccaccaccatctatgaggaggacaagaggaacctgcagcaggagctggagacccagaaccagaagctgcagaggcagttcagtgacaagaggcggctggaggcccggctgcagggcatggtgacagagaccaccatgaagtgggagaaggaatgtgagcggcgggtggccgccaagcagctggagatgcagaacaagctgtgggtgaaggatgagaagctgaagcagctgaaggccatcgtgacagagcccaagacagagaagccagagcggcccagccgggagcgggaccgggagaaggtgacccagaggtctgtgagccccagccctgtgcccctgctcttccagcctgaccagaatgccccacccatccggctgcggcacagaagaagccgctctgctggggaccgctgggtggaccacaagccagccagcaacatgcagacagaaacagtgatgcagccccacgtgccccacgccatcaccgtgtctgtggccaatgagaaggccctggccaagtgtgagaagtacatgctgacccaccaggagctggccagtgatggagaaattgagaccaagctgatcaagggggacatctacaagacccggggcggcggccagagcgtgcagttcacagacatcgagaccctgaagcaggagagccccaacggcagcaggaagaggaggagcagcacagtggccccagcccagccagatggagctgagagcgagtggacagatgtggagacccgctgcagcgtggccgtggagatgagagctggcagccagctgggccctggctaccagcaccacgcccagcccaagaggaagaagccctag

SEQ ID NO: 157051 - DNA, 2022 bp, Artificial Sequence; identical to SEQ ID NO: 157050
  Description of Artificial Sequence: Synthetic coding sequence

SEQ ID NO: 157052 - DNA, 2571 bp, Artificial Sequence
  Description of Artificial Sequence: Synthetic coding sequence
atgaagagcgcccgggccaagacccccaggaagcccaccgtgaagaagggcagccagaccaacctgaaggaccctgtgggcgtgtactgccgggtgcggcccctgggcttcccagaccaggagtgctgcatcgaggtgatcaacaacaccaccgtgcagctgcacaccccagagggctaccgcctgaacagaaatggagactacaaggagacccagtacagcttcaagcaggtgtttggcacccacaccacccagaaggagctgtttgatgtggtggccaaccccctggtgaatgacctgatccacggcaagaatggcctgctcttcacctatggagtgacaggcagcggcaagacccacaccatgacaggcagccctggagagggcggcctgctgccccgctgcctggacatgatcttcaacagcatcggcagcttccaggccaagagatatgtgttcaagagcaatgacaggaacagcatggacatccagtgtgaggtggatgccctgctggagcggcagaagcgggaggccatgcccaaccccaagaccagcagcagcaagaggcaggtggaccctgagtttgctgacatgatcaccgtgcaggagttctgcaaggccgaggaggtggatgaggacagcgtgtatggagtgtttgtgtcctacatcgagatctacaacaactacatctatgacctgctggaggaggtgccctttgaccccatcaagcccaagccaccccagagcaagctgctgcgggaggacaagaaccacaacatgtatgtggccggctgcacagaggtggaggtgaagagcacagaggaggcctttgaggtgttctggaggggccagaagaagagaagaattgccaacacccacctgaaccgggagagcagccgcagccacagcgtcttcaacatcaagctggtgcaggcccccctggatgctgatggagacaacgtgctgcaggagaaggagcagatcaccatcagccagctgagcctggtggacctggccggcagcgagaggaccaacagaaccagggctgagggcaaccggctgcgggaggccggcaacatcaaccagagcctgatgaccctgcggacctgcatggatgtgctgcgggagaaccagatgtatggcaccaacaagatggtgccctacagagacagcaagctgacccacctgttcaagaactactttgatggagagggcaaggtgaggatgattgtgtgtgtgaaccccaaggccgaggactatgaggagaacctgcaggtgatgagatttgctgaggtgacccaggaggtggaggtggcccggcctgtggacaaggccatctgtggcctgaccccaggaagacgctacagaaaccagccccggggccctgtgggcaatgagcccctggtgacagatgtggtgctgcagagcttcccccccctgcccagctgtgagatcctggacatcaatgatgagcagaccctgcccaggctcatcgaggccctggagaagaggcacaacctgcggcagatgatgattgatgagttcaacaagcagagcaatgccttcaaggccctgctgcaggagtttgacaatgctgtgctgagcaaagaaaaccacatgcagggcaagctgaatgagaaggagaagatgatcagcggccagaagctggagattgaaaggctggagaagaagaacaagaccctggagtacaagattgagatcctggagaagaccaccaccatctatgaggaggacaagaggaacctgcagcaggagctggagacccagaaccagaagctgcagaggcagttcagtgacaagaggcggctggaggcccggctgcagggcatggtgacagagaccaccatgaagtgggagaaggaatgtgaaagaagagtggccgccaagcagctggagatgcagaacaagctgtgggtgaaggatgagaagctgaagcagctgaaggccatcgtgacagagcccaagacagagaagccagagcggcccagccgggagcgggaccgggagaaggtgacccagaggtctgtgagccccagccctgtgcccctgctcttccagcctgaccagaatgccccacccatccggctgcggcaccggcgcagccgctctgctggggaccgctgggtggaccacaagccagccagcaacatgcagacagagaccgtgatgcagccccacgtgccccacgccatcaccgtgtctgtggccaatgagaaggccctggccaagtgtgagaagtacatgctgacccaccaggagctggccagtgatggagaaattgagaccaagctgatcaagggggacatctacaagacccggggcggcggccagagcgtgcagttcacagacatcgagaccctgaagcaggagagccccaacggcagcaggaagagaagaagcagcacagtggccccagcccagccagatggagctgagagcgagtggacagatgtggagacccgctgcagcgtggccgtggagatgagagctggcagccagctgggccctggctaccagcaccacgcccagcccaagaggaagaagccctag

SEQ ID NO: 157053 - DNA, 2520 bp, Artificial Sequence
  Description of Artificial Sequence: Synthetic coding sequence
atgacaggcagccctggagagggcggcctgctgccccgctgcctggacatgatcttcaacagcatcggcagcttccaggccaagcgctacgtgttcaagagcaatgacagaaattccatggacatccagtgtgaggtggatgccctgctggagcggcagaagcgggaggccatgcccaaccccaagaccagcagcagcaagaggcaggtggaccctgagtttgctgacatgatcaccgtgcaggagttctgcaaggccgaggaggtggatgaagattctgtgtatggagtgtttgtgtcctacatcgagatctacaacaactacatctatgacctgctggaggaggtgccctttgaccccatcaagcccaagccaccccagagcaagctgctgcgggaggacaagaaccacaacatgtatgtggccggctgcacagaggtggaggtgaagagcacagaggaggcctttgaggtgttctggaggggccagaagaagaggcgcatcgccaacacccacctgaaccgggagagcagccgcagccacagcgtcttcaacatcaagctggtgcaggcccccctggatgctgatggagacaacgtgctgcaggagaaggagcagatcaccatcagccagctgagcctggtggacctggccggcagcgagaggaccaacagaaccagggctgagggcaaccggctgcgggaggccggcaacatcaaccagagcctgatgaccctgcggacctgcatggatgtgctgcgggagaaccagatgtatggcaccaacaagatggtgccctacagagacagcaagctgacccacctgttcaagaactactttgatggagagggcaaggtgaggatgattgtgtgtgtgaaccccaaggcagaagattatgaggagaacctgcaggtgatgagatttgctgaggtgacccaggaggtggaggtggcccggcctgtggacaaggccatctgtggcctgaccccaggccgccgctacagaaaccagccccggggccctgtgggcaatgagcccctggtgacagatgtggtgctgcagagcttcccccccctgcccagctgtgagatcctggacatcaatgatgagcagaccctgccccggctgattgaggccctggagaagaggcacaacctgcggcagatgatgattgatgagttcaacaagcagagcaatgccttcaaggccctgctgcaggagtttgacaatgctgtgctgagcaaggagaaccacatgcagggcaagctgaatgagaaggagaagatgatcagcggccagaagctggagattgagcggctggagaagaagaacaagaccctggagtacaagattgagatcctggagaagaccaccaccatctatgaggaggacaagaggaacctgcagcaggagctggagacccagaaccagaagctgcagaggcagttcagtgacaagaggcggctggaggcccggctgcagggcatggtgacagagaccaccatgaagtgggagaaggaatgtgagcggcgggtggccgccaagcagctggagatgcagaacaagctgtgggtgaaggatgagaagctgaagcagctgaaggccatcgtgacagagcccaagacagagaagccagagcggcccagccgggagcgggaccgggagaaggtgacccagaggtctgtgagccccagccctgtgcccctgagcagcaactacatcgcccagatcagcaatggccagcagctgatgagccagccccagctgcacagaagaagcaacagctgcagcagcatctctgtggccagctgcatcagcgagtgggagcagaagatccccacctacaacacccccctgaaggtgaccagcatcgcccggcggcggcagcaggagcccggccagagcaagacctgcatcgtgtctgacagaagaagaggcatgtactggacagagggccgggaggtggtgcccaccttcagaaatgaaattgaaattgaggaggaccactgcggccgcctgctcttccagcctgaccagaatgccccacccatccggctgcggcacagaagaagccgctctgctggggaccgctgggtggaccacaagccagccagcaacatgcagacagaaacagtgatgcagccccacgtgccccacgccatcaccgtgtctgtggccaatgagaaggccctggccaagtgtgagaagtacatgctgacccaccaggagctggccagtgatggagaaattgagaccaagctgatcaagggggacatctacaagacccggggcggcggccagagcgtgcagttcacagacatcgagaccctgaagcaggagagccccaacggcagcaggaagaggaggagcagcacagtggccccagcccagccagatggagctgagagcgagtggacagatgtggagacccgctgcagcgtggccgtggagatgagagctggcagccagctgggccctggctaccagcaccacgcccagcccaagaggaagaagccctag

SEQ ID NO: 157054 - DNA, 3705 bp, Artificial Sequence
  Description of Artificial Sequence: Synthetic coding sequence
atggcctcctggctgtatgaatgtctgtgtgaggccgagctggcccagtactacagccacttcaccgccctgggcctgcagaagattgatgagctggccaagatcaccatgaaggactacagcaagctgggcgtgcatgacatgaatgacaggaagaggctcttccagctgatcaagatcatcaagatcatgcaggaggaggacaaggctgtgtccatccctgagcggcacctgcagaccagcagcctgcgcatcaagagccaggagctgcggagcggcccccggcggcagctgaactttgacagccctgctgacaacaaggacagaaatgccagcaatgatggctttgagatgtgcagcctgagtgacttcagcgccaatgagcagaagagcacctacctgaaggtgctggagcacatgctgcctgatgacagccagtaccacaccaagacaggcatcctgaatgccacagctggggacagctatgtgcagacagagatcagcaccagcctcttcagccccaactacctgagcgccatcctgggggactgtgacatccccatcatccagaggatcagccacgtgtctggctacaactacggcatcccccacagctgcatccggcagaacaccagcgagaagcagaacccctggacagagatggagaagatccgggtgtgtgtgaggaagaggcccctgggcatgagggaggtgagaagaggagagatcaacatcatcaccgtggaggacaaggagaccctgctggtgcatgagaagaaggaggccgtggacctgacccagtacatcctgcaggtgatcctgaagggcagcaaggagaggagcactggagccactggagtgaatgctgacagcagccgcagccacgccgtcatccagatccagatcaaggacagcgccaagaggaccttcggccgcatctccttcatcgacctggccggcagcgagagagctgctgatgcccgggacagcgaccggcagaccaagatggagggcgctgagatcaaccagagcctgctggccctgaaggagtgcatccgggccctggaccaggagcacacccacacccccttccggcagagcaagctgacccaggtgctgaaggacagcttcatcggaaatgccaagacctgcatgattgccaacatcagccccagccacgtggccacagagcacaccctgaacaccctgcgctatgctgacagagtgaaggagctgaagaagggcatcaagtgctgcacctctgtgaccagcaggaacagaacatctggcaacagcagccccaagaggatccagagcagccctggggccctgtctgaggacaagtgcagccccaagaaggtgaagctgggcttccagcagagcctgactgtggccgcccctggcagcacccggggcaaggtgcaccccctgaccagccacccccccaacatccccttcaccagcgcccccaaggtgtctgggaagagaggaggcagccggggcagccccagccaggagtgggtgatccacgccagccctgtgaagggcaccgtgcgcagcggccacgtggccaagaagaagccagaggagagcgcccccctgtgcagcgagaagaacaggatgggcaacaagacagtgctgggctgggagagccgggccagcggccctggagagggcctggtgcggggcaagctgagcaccaagtgcaagaaggtgcagacagtgcagcctgtgcagaagcagctggtgtcccgggtggagctgagctttggaaatgcccaccacagagctgagtacagccaggacagccagaggggcaccccagcccggcctgccagcgaggcctggaccaacatccccccccaccagaaggagcgggaggagcacctgcgcttctaccaccagcagttccagcagccccccctgctgcagcagaagctgaagtaccagcccctgaagaggagcctgcggcagtacagacctcctgagggccagctgaccaatgagaccccacccctcttccacagctacagtgaaaatcatgatggagcccaggtggaggagctggatgacagcgacttcagcgaggacagcttcagccacatcagcagccagagggccaccaagcagaggaacaccctggagaacagcgaggacagcttcttcctgcaccagacctggggccagggccctgagaagcaggtggccgagcggcagcagagcctcttcagcagccccaggactggagacaagaaggacctgaccaagtcctgggtggacagccgggaccccatcaaccaccggcgggccgccctggaccacagctgcagccccagcaagggccctgtggactggagccgggagaacagcaccagcagcggccccagcccccgggacagcctggccgagaagccctactgcagccaggtggacttcatctaccggcaggagcggggcggcggcagcagctttgacctgaggaaggatgccagccagagcgaggtgtctggagaaaatgaaggcaacctgcccagccctgaggaggatggcttcaccatcagcctgagccacgtggccgtgcccggcagcccagaccagagggacacagtgaccacccccctgcgggaggtgtctgcagatggccccatccaggtgaccagcacagtgaagaatggacatgctgtgcctggagaggacccccggggccagctgggcacccacgccgagtatgccagcggcctgatgagccccctgaccatgagcctgctggagaacccagacaatgaaggcagcccccccagcgagcagctggtgcaggatggagccacccacagcctggtggccgagagcactggaggccctgtggtgagccacacagtgcccagcggggaccaggaggccgccctgcctgtgtcctctgccaccaggcacctgtggctgagcagcagccccccagacaacaagccaggaggagacctgcctgccctgagccccagccccatccggcagcaccctgctgacaagctgcccagccgggaggccgacctgggggaggcctgccagagccgggagaccgtgctcttcagccatgagcacatgggcagcgagcagtatgatgctgatgctgaggagaccggcctggatggctcctggggcttccctgggaagcccttcaccaccatccacatgggcgtgccccacagcggccccaccctgacccccaggacaggcagcagtgatgtggccgaccagctgtgggcccaggagaggaagcaccccacccggctgggctggcaggagtttggcctgagcacagaccccatcaagctgccctgcaacagtgaaaatgtgacctggctgaagccccggcccatcagccgctgcctggcccggcccagcagccccctggtgcccagctgcagccccaagacagctggcaccctgcggcagcccaccctggagcaggcccagcaggtggtgatccgggcccaccaggagcagctggatgagatggccgagctgggcttcaaggaggagaccctgatgagccagctggccagcaatgactttgaagattttgtgacccagctggatgagatcatggtgctgaagagcaagtgcatccagagcctgcggagccagctgcagctgtacctgacctgccacggccccacagctgcccctgagggcaccgtgcccagctag

SEQ ID NO: 157055 - DNA, 4107 bp, Artificial Sequence
  Description of Artificial Sequence: Synthetic coding sequence
atggcctcctggctgtatgaatgtctgtgtgaggccgagctggcccagtactacagccacttcaccgccctgggcctgcagaagattgatgagctggccaagatcaccatgaaggactacagcaagctgggcgtgcatgacatgaatgacaggaagaggctcttccagctgatcaagatcatcaagatcatgcaggaggaggacaaggctgtgtccatccctgagcggcacctgcagaccagcagcctgcgcatcaagagccaggagctgcggagcggcccccggcggcagctgaactttgacagccctgctgacaacaaggacagaaatgccagcaatgatggctttgagatgtgcagcctgagtgacttcagcgccaatgagcagaagagcacctacctgaaggtgctggagcacatgctgcctgatgacagccagtaccacaccaagacaggcatcctgaatgccacagctggggacagctatgtgcagacagagatcagcaccagcctcttcagccccaactacctgagcgccatcctgggggactgtgacatccccatcatccagaggatcagccacgtgtctggctacaactacggcatcccccacagctgcatccggcagaacaccagcgagaagcagaacccctggacagagatggagaagatccgggtgtgtgtgaggaagaggcccctgggcatgagggaggtgagaagaggagagatcaacatcatcaccgtggaggacaaggagaccctgctggtgcatgagaagaaggaggccgtggacctgacccagtacatcctgcagcacgtgttctactttgatgaggtgtttggagaggcctgcaccaaccaggatgtgtacatgaagaccacccaccccctcatccagcacatcttcaatggaggaaatgccacctgctttgcctacggccagacaggagctgggaagacctacaccatgattggcacccatgagaaccctggcctgtatgccctggccgccaaggacatcttccggcagctggaggtgtcccagcccaggaagcacctgtttgtgtggatctccttctatgagatctactgcggccagctgtatgacctgctgaacagaaggaagaggctgtttgcccgggaggacagcaagcacatggtgcagatcgtgggcctgcaggagctgcaggtggacagcgtggagctgctgctggaggtgatcctgaagggcagcaaggagaggagcactggagccactggagtgaatgctgacagcagccgcagccacgccgtcatccagatccagatcaaggacagcgccaagaggaccttcggccgcatctccttcatcgacctggccggcagcgagagagctgctgatgcccgggacagcgaccggcagaccaagatggagggcgctgagatcaaccagagcctgctggccctgaaggagtgcatccgggccctggaccaggagcacacccacacccccttccggcagagcaagctgacccaggtgctgaaggacagcttcatcggaaatgccaagacctgcatgattgccaacatcagccccagccacgtggccacagagcacaccctgaacaccctgcgctatgctgacagagtgaaggagctgaagaagggcatcaagtgctgcacctctgtgaccagcaggaacagaacatctggcaacagcagccccaagaggatccagagcagccctggggccctgtctgaggacaagtgcagccccaagaaggtgaagctgggcttccagcagagcctgactgtggccgcccctggcagcacccggggcaaggtgcaccccctgaccagccacccccccaacatccccttcaccagcgcccccaaggtgtctgggaagagaggaggcagccggggcagccccagccaggagtgggtgatccacgccagccctgtgaagggcaccgtgcgcagcggccacgtggccaagaagaagccagaggagagcgcccccctgtgcagcgagaagaacaggatgggcaacaagacagtgctgggctgggagagccgggccagcggccctggagagggcctggtgcggggcaagctgagcaccaagtgcaagaaggtgcagacagtgcagcctgtgcagaagcagctggtgtcccgggtggagctgagctttggaaatgcccaccacagagctgagtacagccaggacagccagaggggcaccccagcccggcctgccagcgaggcctggaccaacatccccccccaccagaaggagcgggaggagcacctgcgcttctaccaccagcagttccagcagccccccctgctgcagcagaagctgaagtaccagcccctgaagaggagcctgcggcagtacagacctcctgagggccagctgaccaatgagaccccacccctcttccacagctacagtgaaaatcatgatggagcccaggtggaggagctggatgacagcgacttcagcgaggacagcttcagccacatcagcagccagagggccaccaagcagaggaacaccctggagaacagcgaggacagcttcttcctgcaccagacctggggccagggccctgagaagcaggtggccgagcggcagcagagcctcttcagcagccccaggactggagacaagaaggacctgaccaagtcctgggtggacagccgggaccccatcaaccaccggcgggccgccctggaccacagctgcagccccagcaagggccctgtggactggagccgggagaacagcaccagcagcggccccagcccccgggacagcctggccgagaagccctactgcagccaggtggacttcatctaccggcaggagcggggcggcggcagcagctttgacctgaggaaggatgccagccagagcgaggtgtctggagaaaatgaaggcaacctgcccagccctgaggaggatggcttcaccatcagcctgagccacgtggccgtgcccggcagcccagaccagagggacacagtgaccacccccctgcgggaggtgtctgcagatggccccatccaggtgaccagcacagtgaagaatggacatgctgtgcctggagaggacccccggggccagctgggcacccacgccgagtatgccagcggcctgatgagccccctgaccatgagcctgctggagaacccagacaatgaaggcagcccccccagcgagcagctggtgcaggatggagccacccacagcctggtggccgagagcactggaggccctgtggtgagccacacagtgcccagcggggaccaggaggccgccctgcctgtgtcctctgccaccaggcacctgtggctgagcagcagccccccagacaacaagccaggaggagacctgcctgccctgagccccagccccatccggcagcaccctgctgacaagctgcccagccgggaggccgacctgggggaggcctgccagagccgggagaccgtgctcttcagccatgagcacatgggcagcgagcagtatgatgctgatgctgaggagaccggcctggatggctcctggggcttccctgggaagcccttcaccaccatccacatgggcgtgccccacagcggccccaccctgacccccaggacaggcagcagtgatgtggccgaccagctgtgggcccaggagaggaagcaccccacccggctgggctggcaggagtttggcctgagcacagaccccatcaagctgccctgcaacagtgaaaatgtgacctggctgaagccccggcccatcagccgctgcctggcccggcccagcagccccctggtgcccagctgcagccccaagacagctggcaccctgcggcagcccaccctggagcaggcccagcaggtggtgatccgggcccaccaggagcagctggatgagatggccgagctgggcttcaaggaggagaccctgatgagccagctggccagcaatgactttgaagattttgtgacccagctggatgagatcatggtgctgaagagcaagtgcatccagagcctgcggagccagctgcagctgtacctgacctgccacggccccacagctgcccctgagggcaccgtgcccagctag

SEQ ID NO: 157056 - DNA, 4107 bp, Artificial Sequence; identical to SEQ ID NO: 157055
  Description of Artificial Sequence: Synthetic coding sequence

SEQ ID NO: 157057 - DNA, 3477 bp, Artificial Sequence
  Description of Artificial Sequence: Synthetic coding sequence
atggcctcctggctgtatgaatgtctgtgtgaggccgagctggcccagtactacagccacttcaccgccctgggcctgcagaagattgatgagctggccaagatcaccatgaaggactacagcaagctgggcgtgcatgacatgaatgacaggaagaggctcttccagctgatcaagatcatcaagatcatgcaggaggaggacaaggctgtgtccatccctgagcggcacctgcagaccagcagcctgcgcatcaagagccaggagctgcggagcggcccccggcggcagctgaactttgacagccctgctgacaacaaggacagaaatgccagcaatgatggctttgagatgtgcagcctgagtgacttcagcgccaatgagcagaagagcacctacctgaaggtgctggagcacatgctgcctgatgacagccagtaccacaccaagacaggcatcctgaatgccacagctggggacagctatgtgcagacagagatcagcaccagcctcttcagccccaactacctgagcgccatcctgggggactgtgacatccccatcatccagaggatcagccacgtgtctggctacaactacggcatcccccacagctgcatccggcagaacaccagcgagaagcagaacccctggacagagatggagaagatccgggtgtgtgtgaggaagaggcccctgggcatgagggaggtgagaagaggagagatcaacatcatcaccgtggaggacaaggagaccctgctggtgcatgagaagaaggaggccgtggacctgacccagtacatcctgcagcacgtgttctactttgatgaggtgtttggagaggcctgcaccaaccaggatgtgtacatgaagaccacccaccccctcatccagcacatcttcaatggaggaaatgccacctgctttgcctacggccagacaggagctgggaagacctacaccatgattggcacccatgagaaccctggcctgtatgccctggccgccaaggacatcttccggcagctggaggtgtcccagcccaggaagcacctgtttgtgtggatctccttctatgagatctactgcggccagctgtatgacctgctgaacagaaggaagaggctgtttgcccgggaggacagcaagcacatggtgcagatcgtgggcctgcaggagctgcaggtggacagcgtggagctgctgctggaggtgatcctgaagggcagcaaggagaggagcactggagccactggagtgaatgctgacagcagccgcagccacgccgtcatccagatccagatcaaggacagcgccaagaggaccttcggccgcatctccttcatcgacctggccggcagcgagagagctgctgatgcccgggacagcgaccggcagaccaagatggagggcgctgagatcaaccagagcctgctggccctgaaggagtgcatccgggccctggaccaggagcacacccacacccccttccggcagagcaagctgacccaggtgctgaaggacagcttcatcggaaatgccaagacctgcatgattgccaacatcagccccagccacgtggccacagagcacaccctgaacaccctgcgctatgctgacagagtgaaggagctgaagaagggcatcaagtgctgcacctctgtgaccagcaggaacagaacatctggcaacagcagccccaagaggatccagagcagccctggggccctgtctgaggacaagtgcagccccaagaaggtgaagctgggcttccagcagagcctgactgtggccgcccctggcagcacccggggcaaggtgcaccccctgaccagccacccccccaacatccccttcaccagcgcccccaaggtgtctgggaagagaggaggcagccggggcagccccagccaggagtgggtgatccacgccagccctgtgaagggcaccgtgcgcagcggccacgtggccaagaagaagccagaggagagcgcccccctgtgcagcgagaagaacaggatgggcaacaagacagtgctgggctgggagagccgggccagcggccctggagagggcctggtgcggggcaagctgagcaccaagtgcaagaaggtgcagacagtgcagcctgtgcagaagcagctggtgtcccgggtggagctgagctttggaaatgcccaccacagagctgagtacagccaggacagccagaggggcaccccagcccggcctgccagcgaggcctggaccaacatccccccccaccagaaggagcgggaggagcacctgcgcttctaccaccagcagttccagcagccccccctgctgcagcagaagctgaagtaccagcccctgaagaggagcctgcggcagtacagacctcctgagggccagctgaccaatgagaccccacccctcttccacagctacagtgaaaatcatgatggagcccaggtggaggagctggatgacagcgacttcagcgaggacagcttcagccacatcagcagccagagggccaccaagcagaggaacaccctggagaacagcgaggacagcttcttcctgcaccagacctggggccagggccctgagaagcaggtggccgagcggcagcagagcctcttcagcagccccaggactggagacaagaaggacctgaccaagtcctgggtggacagccgggaccccatcaaccaccggcgggccgccctggaccacagctgcagccccagcaagggccctgtggactggagccgggagaacagcaccagcagcggccccagcccccgggacagcctggccgagaagccctactgcagccaggtggacttcatctaccggcaggagcggggcggcggcagcagctttgacctgaggaaggatgccagccagagcgaggtgtctggagaaaatgaaggcaacctgcccagccctgaggaggatggcttcaccatcagcctgagccacgtggccgtgcccggcagcccagaccagagggacacagtgaccacccccctgcgggaggtgtctgcagatggccccatccaggtgaccagcacagtgaagaatggacatgctgtgcctggagaggacccccggggccagctgggcacccacgccgagtatgccagcggcctgatgagccccctgaccatgagcctgctggagaacccagacaatgaaggcagcccccccagcgagcagctggtgcaggatggagccacccacagcctggtggccgagagcactggaggccctgtggtgagccacacagtgcccagcggggaccaggaggccgccctgcctgtgtcctctgccaccaggcacctgtggctgagcagcagccccccagacaacaagccaggaggagacctgcctgccctgggccctggagagaagaccagctacaaggcctggctggccggcgtgtggtttgtgcaccggccccaccaggtggccctgcagcagtag

SEQ ID NO: 157058 - DNA, 999 bp, Artificial Sequence
  Description of Artificial Sequence: Synthetic coding sequence
atgacctggaccagcggccagctgcagcgggagaagcaggcccggcccggcagcggggctgtgctggccttcccagatgacaaggacctgcgggtgtatggccctgctgagagccagagcgctgtgtttggagatgtgtgccccctgctgaccagcctgctggatggctacaacgtgtgtgtgatggcctacggccagacaggcagcggcaagagctacaccatgctgggccgccacagtgatgatggccctgtgctgcccctggacccccagagcgacctgggcatcatcccccgggtggccgaggagctgttccgcctcatcctggagaacaccagccgcagccccaaggtggaggtgtccatcgtggaggtgtacaacaatgacatctttgacctgctggccaaggacagcattgctgctgtgtctggagtgaagcgggaggtggtgacagccaaggatggccgcacagaggtggccctgctggccagcgaggccgtgggcagcgccagcaagctgatggagctggtgcacggcggcctgcagctgcgggccaagcaccccaccctggtgcatgctgacagcagccgcagccacctgatcatcaccgtgaccctgaccacagccagctgcagcgacagcacagctgaccaggcctgcagcgccaccctgccccgggagcagacagaagctggccgggccggccgcagccggcgggccagccagggcgccctggccccccagctggtgcccggcaacccagctggccacgccgagcaggtgcaggcccggctgcagctggtggacagcgctggctctgaatgtgtgggcggagatgccaagctgctggtgatcctgtgcatcagccccagccagaggcacctggcccagaccctgcagggcctgggcttcggcatccgggcccggcaggtgcagaggggccctgccaggaagaagccacccagcagccagacagagggcaagagaagaccagactag

SEQ ID NO: 157059 - DNA, 1155 bp, Artificial Sequence
  Description of Artificial Sequence: Synthetic coding sequence
atgacctggaccagcggccagctgcagcgggagaagcaggcccggcccggcagcggggctgtgctggccttcccagatgacaaggacctgcgggtgtatggccctgctgagagccagagcgctgtgtttggagatgtgtgccccctgctgaccagcctgctggatggctacaacgtgtgtgtgatggcctacggccagacaggcagcggcaagagctacaccatgctgggccgccacagtgatgatggccctgtgctgcccctggacccccagagcgacctgggcatcatcccccgggtggccgaggagctgttccgcctcatcctggagaacaccagccgcagccccaaggtggaggtgtccatcgtggaggtgtacaacaatgacatctttgacctgctggccaaggacagcattgctgctgtgtctggagtgaagcgggaggtggtgacagccaaggatggccgcacagaggtggccctgctggccagcgaggccgtgggcagcgccagcaagctgatggagctggtgcacggcggcctgcagctgcgggccaagcaccccaccctggtgcatgctgacagcagccgcagccacctgatcatcaccgtgaccctgaccacagccagctgcagcgacagcacagctgaccaggcctgcagcgccaccctgccccgggagcagacagaagctggccgggccggccgcagccggcgggccagccagggcgccctggccccccagctggtgcccggcaacccagctggccacgccgagcaggtgcaggcccggctgcagctggtggacagcgctggctctgaatgtgtgggcgtgtctggagtgacaggcctggccctgcgggagatggcctgcatcagccgcagcctggccgccctggccggcgtgctgggcgccctgctggagcaccggggccacgccccctacagaaacagccggctgacccacctgctgcaggactgcctgggcggagatgccaagctgctggtgatcctgtgcatcagccccagccagaggcacctggcccagaccctgcagggcctgggcttcggcatccgggcccggcaggtgcagaggggccctgccaggaagaagccacccagcagccagacagagggcaagagaagaccagactag

SEQ ID NO: 157060 - DNA, 1155 bp, Artificial Sequence; identical to SEQ ID NO: 157059
  Description of Artificial Sequence: Synthetic coding sequence

SEQ ID NO: 157061 - DNA, 5649 bp, Artificial Sequence
  Description of Artificial Sequence: Synthetic coding sequence
atggtgggccggggcgtgcccctgtgtgccgcccagcctgctgtggccgagggcggccctgcccgggagcccccacccctgctggaggtgagccccaggaagaggctgcctgctggccctgaccaggacccctgtggcagcaggcctgcccctgagggcgctggggccggccctgagcagggccacagcgctgggggcggcggctggtgccgccactgccacaccaagctggtggagctgaagaggcaggcctggaagctggtgtctggccctggcaccaccctgcgggacccctgcctgagcgccctgctgctggacaagctgcctgcccctggggccctgcctgcctgcaggcctgaggccgagcggcgctgtgatgtgtgtgccacccacctgcagcagctgacccgggaggccatgcacctgctgcaggccccagccagccatgaggacctggatgccccccacggcggccccagcctggccccacccagcaccaccaccagcagccgggacaccccaggccctgctggccctgctggccggcagcccggccgggccggccctgacaggaccaagggcctggcctggagccctggccccagcgtgcaggtgtctgtggccccagctggcctgggcggggccctgagcacagtgaccatccaggcccagcagtgcctggagggcatgtggagcgtgtcccgggtgaacagcttcctgcccccagcctgcctggccgaggccgctgtggccgctgtggccgtggccgacacagtgagagaatgtcctcctgtggccggcccagatggcctgagcaaggcctggggccggggcggcgtgtgcaccagcgccctggtgacccccaccccaggctctgtgggcggcagcacaggccccagcgctgctgccagcttcttcatccgggccatgcagaagctgagcctggccagcaagaggaagaagccccaccccccacctcctccagccacccggggcaccagcacctaccccacagacttctctggagtgctgcagctgtggcccccaccagccccaccctgcctgctgcgggccgccagcaagaccaaggacaaccctggcagcatcggcaaggtgaaggtgatgctgcgcatctggccagcccagggcgcccagaggtctgctgaggccatgtccttcctgaaggtggaccccaggaagaagcaggtgatcctgtatgaccctgctgctggccccccaggcagcgctggccccaggagagctgccacagctgctgtgcccaagatgtttgcctttgatgctgtgttcccccaggacagcgagcaggccgaggtgtgcagcggcaccgtggctgatgtgctgcagagcgtggtgtctggagcagatggctgcatcttctcctttggccacatgagcctgggcaagagctacaccatgattggcaaggacagcagcccccagagcctgggcatcgtgccctgtgccatctcctggctgttccggctgattgaggagcggcgggagaggacaggcacccgcttctctgtgcgggtgtctgctgtggaggtgtgtggccgggaccagagcctgcgggacctgctggccgaggtggcccctggcagcctgcaggacacccagagccctggggtgtacctgcgggaggaccctgtgtgtggggcccagctgcagaaccagagcgagctgcgggcccccacagctgagaaggccgccttctacctggatgctgccctggccgcccggagcaccagccgggccggctgtggggaggatgcccggcgcagcagccacatgctgttcaccctgcacgtgtaccagtacaggatggagaagtgtggccggggcggcatgtctgggggccgcagccggctgcacctgattgacctgggcagctgtgaggccgccgccggccgggccggggaggccgccggcggccccctgtgcctgagcctgagcgccctgggcagcgtcatcctggccctggtgaatggagccaagcacgtgccctacagagaccaccggctgaccatgctgctgcgggagagcctggccacagctggctgcaggaccaccatgattgcccacgtgtctgatgccccagcccagcacgccgagaccctgagcacagtgcagctggccgcccgcatccaccggctgcggaggaagaaggccaagtatgccagcagcagcagtggaggagagagcagctgtgaggagggccgggcccggcggcccccccacctgcggcccttccaccccaggacagtggccctggaccctgacaggaccccaccctgcctgcccggggaccctgactacagcagcagcagcgagcagagctgtgacaccgtcatctacgtgggccctggaggagctgccctgagtgaccgggagctgacagacaatgaaggacctccagactttgtgcccatcatcccagccctgagccgccaccggcccagcaagggccccagagatgctgaccacttccgctgcagcacctttgctgagctgcaggagcggctggagtgcatggatggaaatgaaggccccagcggcggccctgggggcacagatggagcccaggccagccctgcccggggcggcaggaagcccagccccccagaggccgccagccccaggaaggctgtgggcacccccatggccgccagcaccccccggggcagcagcggccctgacacccaccagggcaccccagagccctgcaaggccatcgtgtggggagaccagcgggaggacagcagcgcctggccagagctgctggtgcctgagaaggctgctgtgtctgggggcagaagacccctgcccagccctgcccctcctccaccccagctgctggaggcctgccgggcccctgaggagcccggcggcggcggcacagatggagtggcccggaccccacctgtgggcatgagcggccaggtggccggcagccccatgctgcccggggccacctgcccccggctggccgccggcagccgctgcccagagcggggcctgctgaccaccaccgtgaccctgcagaggcctgtggagctgaatggagaagatgagctggtgttcaccgtggtggaggagctgagcctgggcgccctggccggggccggccggcccaccagcctggccagctttgacagcgactgcagcctgcgggccctggccagcggcagcaggcctgtgtccatcatcagcagcatcaatgatgaatttgatgcctacaccagccaggcccctgagggcggccccctggagggcgccgcctgggccggcagcagccacggcagcagcatcagctcctggctgtctgaggtgtctgtgtgcacagctgacagccgggaccccaccccccagccccgcttctccccagacagcctggccggcctggaccccggcggccccccagccctggatggcagcctgggagatggcagcagcggcttcctgggccctgacagaccagacagccctggccccacctggggcccctgccctggagaggtggccgctgtggcccccagccggcccggccgggagccccaggccggccccagccgctgggccagcgctgcccagaccatccacagcagcctgcccaggaagcccaggacagccagcgccaccaccagggtgggctgtgcccggctgggccagagccccccaggccggggcggcctgtttgaggacccctggctgctgcgggtgggagaatgtgacacccaggccgccagcgctggccgggcccccagccccaccctgggcagcccccggctgcctgaggcccaggtgatgctggcctgtgcccagagggtggtggatggctgtgaggtggccgcccgggccgcccggcggcctgaggccgtggcccgcatcccccccctgcggcggggggccaccaccctgggcgtgaccaccccagctgtgtcctggggagatgcccccacagaggtggtggcctgcagcggcagcctgaaggccagccccaccagcaagaagggcctggcccccaaggccggcttcctgccccggcccagcggggccgcccccccagccccacccaccaggaagagcagcctggagcagaggagcagccctgccagcgcccctcctcatgctgtgaacccagcccgggtgggcgctgctgctgtgctgcggggggaggaggagccccggcccagcagcagagctgaccacagcgtgccccgggccaccagcagcctgaaggcccgggccagcaaggtggaggccgcccaccggctggccggccacgccagcctggagagatatgagggcctggcccacagcagcagcaagggccgggaggcccctggccggccccccagggctgtgcccaagctgggcgtgccccccagcagccccacccacggccctgccccagcctgccgcagcggggccgccaaggctgtgggcgcccccaagccccctgtgggcggcggcaagggccggggcctggtggccggcggcagccgggccctgggccccagcgtgaagctgagcacagcctctgtgacaggccgcagccctgggggccctgtggccggcccccgggccgccccccgggccggccccagcgtgggcgccaaggccggccggggcaccgtgatgggcaccaagcaggccctgcgggccgcccacagccgggtgcatgagctgagcgccagcggggcccctggccggggcggcagctcctggggcagcgctgacagcgacagcggccatgacagcggcgtgaatgtgggggaggagcggcccccaactggacctgccctgcccagcccctacagcaaggtgacagccccccggcggccccagcgctacagcagcggccacggcagtgacaacagctctgtgctgagcggggagctgcccccagccatgggccgcacagccctcttccaccacagcggcggcagcagcggctatgagagcctgcggcgggacagcgaggccaccggcagcgccagcagcgccccagacagcatgtctgagagcggggccgccagccctggggcccggaccaggagcctgaagagccccaagaagagggccaccggcctgcagaggcggcggctcatcccagcccccctgcctgacaccacagccctgggcaggaagcccagcctgcccggccagtgggtggacctgcccccacccctggccggcagcctgaaggagccctttgagatcaaggtgtatgaaattgatgatgtggagcggctgcagaggccccggcccaccccccgggaggcccccacccagggcctggcctgtgtgtccacccggctgcggctggccgagcggcggcagcagaggctgcgggaggtgcaggccaagcacaagcacctgtgtgaggagctggccgagacccagggccgcctgatgctggagcccggccgctggctggagcagtttgaggtggaccctgagctggagcctgagagcgctgagtacctggccgccctggagcgggccacagctgccctggagcagtgtgtgaacctgtgcaaggcccacgtgatgatggtgacctgctttgacatctctgtggccgccagcgctgccatccctggcccccaggaggtggatgtgtag

SEQ ID NO: 157062 - DNA, 5184 bp, Artificial Sequence
  Description of Artificial Sequence: Synthetic coding sequence
atgatgatggactggaaggctgtggccgcccagaagctgaacctgagcagcaagaagaagaagcaccggcccagcaccagcagcgctgctgagccccccctgtttgccaccagcttcagcggcatcctgcagaccagccccccaccagccccaccctgcctgctgcgggctgtgaacaaggtgaaggacaccccaggcctgggcaaggtgaaggtgatgctgcgcatctgcagcaccctggcccgggacaccagcgagagcagcagcttcctgaaggtggaccccaggaagaagcagatcaccctgtatgaccccctgacctgtggcggccagaatgccttccagaagaggggcaaccaggtgccccccaagatgtttgcctttgatgctgtgttcccccaggatgccagccaggccgaggtgtgtgccggcaccgtggccgaggtgatccagagcgtggtgaatggagcagatggctgtgtgttctgcttcggccacgccaagctgggcaagagctacaccatgattggcaaggatgacagcatgcagaacctgggcatcatcccctgtgccatctcctggctgttcaagctgatcaatgaaaggaaggagaagacaggagcccgcttctctgtgcgggtgtctgctgtggaggtgtggggcaaggaggagaacctgcgggacctgctgtctgaggtggccaccggcagcctgcaggacggccagagccctggggtgtacctgtgtgaggaccccatctgtggcacccagctgcagaaccagagcgagctgcgggcccccacagctgagaaggccgccttcttcctggatgctgccatcgccagcagaagaagccaccagcaggactgtgatgaagatgaccacaggaacagccacgtgttcttcaccctgcacatctaccagtacaggatggagaagagcggcaagggcggcatgtctgggggccgcagccggctgcacctgattgacctgggcagctgtgtgaaggccctgagcaagaaccgggagggcggcagcggcctgtgcctgagcctgagcgccctgggcaatgtcatcctggccctggtgaatggcagcaagcacatcccctacaaggagagcaagctggccatgctgctgcgggagagcctgggcaacatgaactgcaggaccaccatgattgcccacatctctgctgctgtgggcagctatgcagagaccctgagcaccatccagatcgccagccgggtgctgaggatgaagaagaagaagaccaagtacaccagcagcagcagcggcggggagagcagctgtgaggagggccgcatgaggcggcccacccagctgcggcccttccacacccgggccaccgtggaccctgacttccccatcgcccacctgagcagtgaccctgactacagcagcagcagcgagcagagctgtgacaccgtcatctacatcggccccaacggcacagccctgagtgacaaggagctgacagacaatgaaggacctccagactttgtgcccatcgtgcctgccctgcagaagaccaggggggacagcaggcctgctgaggccggggaggccgccgccggcaagtctgagcgggactgcctgaagtgcaacacctttgctgagctgcaggagcggctggactgcattgatggcagcgaggagcccagcagcttcccctttgaggagctgcctgcccagtttggacctgagcaggccagccggggcccccggctgagccaggccgccggggccagccccctgtctgagagtgacaaggaggacaatggaagtgagggccagctgaccaaccgggagggccctgagctgcctgccagcaagatgcagaggagccacagccctgtgcctgctgctgccccagcccacagccccagccctgccagccccaggtctgtgcccggcagcagcagccagcacagcgccagccccctggtgcagagccccagcctgcagagcagccgggagagcctgaacagctgtggctttgtggagggcaagccccggcccatgggcagcccccggctgggcatcgccagcctgagcaagaccagcgagtacaagccacccagcagccccagccagcgctgcaaggtgtacacccagaagggcgtgctgcccagccctgcccccctgccccccagcagcaaggacagcggcgtggccagccgggagagcctgctgcagcctgaggtgaggaccccacctgtgggcatgagcccccaggtgctgaagaagtccatgtctgctggcagcgagggcttccctgagacccctgtggatgatgagcagcaggccgccaccccatctgagagcaagaaggagatcctgagcaccaccatggtgacagtgcagcagcccctggagctgaatggagaagatgagctggtgttcaccctggtggaggagctgaccatcagcggcgtgctggacagcggccggcccaccagcatcatctccttcaacagcgactgcagcgcccgggccctggccagcggcagcaggcctgtgtccatcatcagcagcatcagcgaggacctggagtgctacagcagcacagcccctgtgtctgaggtgtccatcacccagttcctgcccctgcccaagatgagcctggatgagaaggcccaggatgctggcagcagaagaagcagcatcagctcctggctgtctgagatgtctgctggcagcgagggggagcagagctgccacagcttcatcgcccagacctgctttggacatggagaggccatggccgagcctgtggccagcgagtttgtgagcagcctgcagaacacagctgtggtgtgccgggagaagcccaaggccagcccagacaacctgctgatcctgtctgagatgggagatgacagcttcaacaaggccgcccccatcaagggctgcaagatcagcacagtgtccaaggccatggtgaccatcagcaacacagccaacctgagcagctgtgagggctacatccccatgaagaccaacatcaccgtgtacccctgcatcgccatgagccccaggaacatccaggagcctgaggcccccacagccacccccaaggccggccccaccctggcccagagccgggagagcaaagaaaattctgccaagaaggagatgaagtttgaggacccctggctgaagcgggaggaggaggtgaagaaggagacagcccaccccaatgaggagggcatgatgagatgtgaaacagccaccggccccagcaatgctgagaccagggctgagcaggagcaggacggcaagcccagccctggggaccggctgagcagcagcagtggagaggtgtctgccagccctgtgacagacaacttccggcgggtggtggatggctgtgagatggccctgcccggcctggccacccagagccctgtgcaccccaacaagtctgtgaagagcagcagcctgccccgggccttccagaaggccagccggcaggaggagccagacagcctgagctactactgtgccgctgagaccaatggagtgggcgccgccagcggcaccccacccagcaaggccaccctggagggcaaggtggccagccccaagcactgtgtgctggcccggcccaagggcaccccacccctgccccctgtgaggaagagcagcctggaccagaagaacagagccagcccccagcacagcgccagcggcagcggcaccagcagccccctgaaccagcctgctgccttccctgctggcctgcctgatgagcccagcggcaagaccaaggatgccagcagcagcagcaagctgttcagcgccaagctggagcagctggccagccgcagcaacagcctgggccgggccaccgtgagccactatgaatgtctgagcctggagcgggcagagagcctgagctctgtgagcagccggctgcacgccggcaaggatggcaccatgcccagggctggccgcagcctgggccgctctgctggcaccagcccccccagcagcggggccagccccaaggccggccagagcaagatctctgctgtgtcccggctgctgctggccagcccccgggcccggggccccagcgccagcaccaccaagaccctgtccttcagcaccaagagcctgccccaggccgtgggccagggcagcagcagccccccaggcggcaagcacaccccctggagcacccagagcctgagcaggaacagaagcagcggcctggccagcaagctgcccctgcgggctgtgtctggccgcatcagcgagctgctgcagggcggggccggggcccggggcctgcagctgcgggccggccctgaggccgaggcccggggcggggccctggctgaagatgagcctgctgctgcccacctgctgcccagcccctacagcaagatcaccccaccaagaagaccccaccgctgcagcagcggccacggcagtgacaacagctctgtgctgtctggagagctgcccccagccatgggcaagacagccctcttctaccacagcggcggcagcagcggctatgaatctgtgatgagggacagcgaggccactggaagtgccagcagcgcccaggacagcaccagcgagaacagcagctctgtgggcggccgctgccgcagcctgaagacccccaagaagaggagcaaccctggcagccagaggagaagactcatcccagccctgagcctggacaccagcagccctgtgaggaagccacccaacagcactggagtgcgctgggtggatggccccctgcggagcagcccccggggcctgggggagccctttgagatcaaggtgtatgaaattgatgatgtggagcggctgcagaggcggcggggcggggccagcaaggaggccatgtgcttcaatgccaagctgaagatcctggagcaccggcagcagagaattgctgaggtgcgggccaagtatgagtggctgatgaaggagctggaggccaccaagcagtacctgatgctggaccccaacaagtggctgtctgaatttgacctggagcaggtgtgggagctggacagcctggagtacctggaggccctggagtgtgtgacagagcggctggagagccgggtgaacttctgcaaggcccacctgatgatgatcacctgctttgacatcaccagcagaagaagatag

SEQ ID NO: 157063 - DNA, 6327 bp, Artificial Sequence
  Description of Artificial Sequence: Synthetic coding sequence
atgaacagcgtggccggcaacaaggagcggctggccgtgtccacccggggcaagaagtatggagtgaatgaggtgtgcagccccaccaagccagctgcccccttcagccctgagagctggtacaggaaggcctatgaggagagccgggccggcagccggcccaccccagagggcgccggcagcgccctgggcagcagcggcacccccagccctggcagcggcaccagcagccccagcagcttcaccggcagccctggccctgccagccctggcatcggcaccagcagccctggcagcctgggcggcagccctggcttcggcaccggcagccctggcagcggcagcggcggcggcagcagccctggcagtgaccggggcgtgtggtgtgagaactgcaatgcccggctggtggagctgaagaggcaggccctgcggctgctgctgcccggccccttccctgggaaggaccctgccttctctgctgtgattcatgacaagctgcaggtgcccaacaccatcaggaaggcctggaatgaccgggacaacagatgtgacatctgtgccacccacctgaaccagctgaagcaggaggccatccagatggtgctgaccctggagcaggccgccggcagcgagcactatgatgccagcccctgcagccccccacccctgagcaacatccccaccctggtgggcagcagacatgtgggcggcctgcagcagccccgggactgggcctttgtgcctgccccctgtgccaccagcaactacacaggctttgccaacaagcacggcagcaagcccagcagcctgggcgtgtccaatggagctgagaagaagagcggcagccccacccaccaggccaaggtgtccctgcagatggccaccagccccagcaatggaaacatcctgaacagcgtggccatccaggcccaccagtacctggatggcacctggagcctgagcaggaccaatggagtgaccctgtacccctaccagatcagccagctgatgacagagagcagccgggagggcctgacagaagctgtgctgaaccgctacaatgctgacaagcccagcgcctgcagcgtgcctgccagccagggcagctgtgtggccagcgagaccagcacaggcacctctgtggccgccagcttctttgcccgggccgcccagaagctgaacctgagcagcaagaagaagaagcaccggcccagcaccagcagcgctgctgagccccccctgtttgccaccagcttcagcggcatcctgcagaccagccccccaccagccccaccctgcctgctgcgggctgtgaacaaggtgaaggacaccccaggcctgggcaaggtgaaggtgatgctgcgcatctgcagcaccctggcccgggacaccagcgagagcagcagcttcctgaaggtggaccccaggaagaagcagatcaccctgtatgaccccctgacctgtggcggccagaatgccttccagaagaggggcaaccaggtgccccccaagatgtttgcctttgatgctgtgttcccccaggatgccagccaggccgaggtgtgtgccggcaccgtggccgaggtgatccagagcgtggtgaatggagcagatggctgtgtgttctgctttggacatgccaagctgggcaagagctacaccatgattggcaaggatgacagcatgcagaacctgggcatcatcccctgtgccatctcctggctgttcaagctgatcaatgaaaggaaggagaagacaggagcccgcttctctgtgcgggtgtctgctgtggaggtgtggggcaaggaggagaacctgcgggacctgctgtctgaggtggccaccggcagcctgcaggacggccagagccctggggtgtacctgtgtgaggaccccatctgtggcacccagctgcagaaccagagcgagctgcgggcccccacagctgagaaggccgccttcttcctggatgctgccatcgccagccgccgcagccaccagcaggactgtgatgaagatgaccacaggaacagccacgtgttcttcaccctgcacatctaccagtacaggatggagaagtctggaaaaggaggcatgtctgggggccgcagccggctgcacctgattgacctgggcagctgtgtgaaggccctgagcaagaaccgggagggcggcagcggcctgtgcctgagcctgagcgccctgggcaatgtcatcctggccctggtgaatggcagcaagcacatcccctacaaggagagcaagctggccatgctgctgcgggagagcctgggcaacatgaactgcaggaccaccatgattgcccacatctctgctgctgtgggcagctatgcagagaccctgagcaccatccagatcgccagccgggtgctgaggatgaagaagaagaagaccaagtacaccagcagcagcagtggaggagagagcagctgtgaggagggccgcatgagaagacccacccagctgcggcccttccacacccgggccaccgtggaccctgacttccccatcgcccacctgagcagtgaccctgactacagcagcagcagcgagcagagctgtgacaccgtcatctacatcggccccaatggaacagccctgagtgacaaggagctgacagacaatgaaggccccccagactttgtgcccatcgtgcctgccctgcagaagaccaggggggacagcaggcctgctgaggccggggaggccgctgctgggaagtctgagcgggactgcctgaagtgcaacacctttgctgagctgcaggagcggctggactgcattgatggcagcgaggagcccagcagcttcccctttgaggagctgcctgcccagtttggacctgagcaggccagccggggcccccggctgagccaggccgccggggccagccccctgtctgagagtgacaaggaggacaatggcagcgagggccagctgaccaaccgggagggccctgagctgcctgccagcaagatgcagaggagccacagccctgtgcctgctgctgccccagcccacagccccagccctgccagccccaggtctgtgcccggcagcagcagccagcacagcgccagccccctggtgcagagccccagcctgcagagcagccgggagagcctgaacagctgtggctttgtggagggcaagccccggcccatgggcagcccccggctgggcatcgccagcctgagcaagaccagcgagtacaagccacccagcagccccagccagcgctgcaaggtgtacacccagaagggcgtgctgcccagccctgcccccctgccccccagcagcaaggacagcggcgtggccagccgggagagcctgctgcagcctgaggtgaggaccccacctgtgggcatgagcccccaggtgctgaagaagtccatgtctgctggcagcgagggcttccctgagacccctgtggatgatgagcagcaggccgccacccccagcgagagcaagaaggagatcctgagcaccaccatggtgacagtgcagcagcccctggagctgaatggagaagatgagctggtgttcaccctggtggaggagctgaccatctctggagtgctggacagcggccggcccaccagcatcatctccttcaacagcgactgcagcgcccgggccctggccagcggcagcaggcctgtgtccatcatcagcagcatcagcgaggacctggagtgctacagcagcacagcccctgtgtctgaggtgtccatcacccagttcctgcccctgcccaagatgagcctggatgagaaggcccaggatgctggcagccgccgcagcagcatcagctcctggctgtctgagatgtctgctggcagcgagggggagcagagctgccacagcttcatcgcccagacctgcttcggccacggggaggccatggccgagcctgtggccagcgagtttgtgagcagcctgcagaacacagctgtggtgtgccgggagaagcccaaggccagcccagacaacctgctgatcctgtctgagatgggagatgacagcttcaacaaggccgcccccatcaagggctgcaagatcagcacagtgtccaaggccatggtgaccatcagcaacacagccaacctgagcagctgtgagggctacatccccatgaagaccaacatcaccgtgtacccctgcatcgccatgagccccaggaacatccaggagcctgaggcccccacagccacccccaaggccggccccaccctggcccagagccgggagagcaaggagaacagcgccaagaaggagatgaagtttgaggacccctggctgaagcgggaggaggaggtgaagaaggagacagcccaccccaatgaggagggcatgatgagatgtgaaacagccaccggccccagcaatgctgagaccagggctgagcaggagcaggacggcaagcccagccctggggaccggctgagcagcagcagcggggaggtgtctgccagccctgtgacagacaacttcagaagagtggtggatggctgtgagatggccctgcccggcctggccacccagagccctgtgcaccccaacaagtctgtgaagagcagcagcctgccccgggccttccagaaggccagccggcaggaggagccagacagcctgagctactactgtgccgctgagaccaacggggtgggcgccgccagcggcaccccacccagcaaggccaccctggagggcaaggtggccagccccaagcactgtgtgctggcccggcccaagggcaccccacccctgccccctgtgaggaagagcagcctggaccagaagaacagagccagcccccagcacagcgccagcggcagcggcaccagcagccccctgaaccagcctgctgccttccctgctggcctgcctgatgagcccagcggcaagaccaaggatgccagcagcagcagcaagctgttcagcgccaagctggagcagctggccagccgcagcaacagcctgggccgggccaccgtgagccactatgagtgcctgagcctggagagagctgagagcctgagctctgtgagcagccggctgcatgctgggaaggatggcaccatgccccgggccggccgcagcctgggccgctctgctggcaccagcccccccagcagcggggccagccccaaggccggccagagcaagatctctgctgtgtcccggctgctgctggccagcccccgggcccggggccccagcgccagcaccaccaagaccctgtccttcagcaccaagagcctgccccaggccgtgggccagggcagcagcagccccccaggcggcaagcacaccccctggagcacccagagcctgagcaggaacagaagcagcggcctggccagcaagctgcccctgcgggctgtgtctggccgcatcagcgagctgctgcagggcggggccggggcccggggcctgcagctgcgggccggccctgaggccgaggcccggggcggggccctggccgaggatgagcctgctgctgcccacctgctgcccagcccctacagcaagatcaccccaccccggcggccccaccgctgcagcagcggccacggcagtgacaacagctctgtgctgagcggggagctgcccccagccatgggcaagacagccctcttctaccacagcggcggcagcagcggctatgagagcgtgatgagggacagcgaggccaccggcagcgccagcagcgcccaggacagcaccagcgagaacagcagctctgtgggcggccgctgccgcagcctgaagacccccaagaagaggagcaaccctggcagccagaggcggcggctcatcccagccctgagcctggacaccagcagccctgtgaggaagccacccaacagcactggagtgcgctgggtggatggccccctgcggagcagcccccggggcctgggggagccctttgagatcaaggtgtatgaaattgatgatgtggagcggctgcagaggagaagaggaggagccagcaaggaggccatgtgcttcaatgccaagctgaagatcctggagcaccggcagcagagaattgctgaggtgcgggccaagtatgagtggctgatgaaggagctggaggccaccaagcagtacctgatgctggaccccaacaagtggctgtctgaatttgacctggagcaggtgtgggagctggacagcctggagtacctggaggccctggagtgtgtgacagagcggctggagagccgggtgaacttctgcaaggcccacctgatgatgatcacctgctttgacatcaccagcagaagaagatag

SEQ ID NO: 157064 - DNA, 5175 bp, Artificial Sequence
  Description of Artificial Sequence: Synthetic coding sequence
gactggaagaccaaggccgcccagaagctgaacctgagcagcaagaagaagaagcaccggcccagcaccagcagcgctgctgagccccccctgtttgccaccagcttcagcggcatcctgcagaccagccccccaccagccccaccctgcctgctgcgggctgtgaacaaggtgaaggacaccccaggcctgggcaaggtgaaggtgatgctgcgcatctgcagcaccctggcccgggacaccagcgagagcagcagcttcctgaaggtggaccccaggaagaagcagatcaccctgtatgaccccctgacctgtggcggccagaatgccttccagaagaggggcaaccaggtgccccccaagatgtttgcctttgatgctgtgttcccccaggatgccagccaggccgaggtgtgtgccggcaccgtggccgaggtgatccagagcgtggtgaatggagcagatggctgtgtgttctgctttggacatgccaagctgggcaagagctacaccatgattggcaaggatgacagcatgcagaacctgggcatcatcccctgtgccatctcctggctgttcaagctgatcaatgaaaggaaggagaagacaggagcccgcttctctgtgcgggtgtctgctgtggaggtgtggggcaaggaggagaacctgcgggacctgctgtctgaggtggccaccggcagcctgcaggacggccagagccctggggtgtacctgtgtgaggaccccatctgtggcacccagctgcagaaccagagcgagctgcgggcccccacagctgagaaggccgccttcttcctggatgctgccatcgccagccgccgcagccaccagcaggactgtgatgaagatgaccacaggaacagccacgtgttcttcaccctgcacatctaccagtacaggatggagaagtctggaaaaggaggcatgtctgggggccgcagccggctgcacctgattgacctgggcagctgtgtgaaggccctgagcaagaaccgggagggcggcagcggcctgtgcctgagcctgagcgccctgggcaatgtcatcctggccctggtgaatggcagcaagcacatcccctacaaggagagcaagctggccatgctgctgcgggagagcctgggcaacatgaactgcaggaccaccatgattgcccacatctctgctgctgtgggcagctatgcagagaccctgagcaccatccagatcgccagccgggtgctgaggatgaagaagaagaagaccaagtacaccagcagcagcagtggaggagagagcagctgtgaggagggccgcatgagaagacccacccagctgcggcccttccacacccgggccaccgtggaccctgacttccccatcgcccacctgagcagtgaccctgactacagcagcagcagcgagcagagctgtgacaccgtcatctacatcggccccaatggaacagccctgagtgacaaggagctgacagacaatgaaggccccccagactttgtgcccatcgtgcctgccctgcagaagaccaggggggacagcaggcctgctgaggccggggaggccgctgctgggaagtctgagcgggactgcctgaagtgcaacacctttgctgagctgcaggagcggctggactgcattgatggcagcgaggagcccagcagcttcccctttgaggagctgcctgcccagtttggacctgagcaggccagccggggcccccggctgagccaggccgccggggccagccccctgtctgagagtgacaaggaggacaatggcagcgagggccagctgaccaaccgggagggccctgagctgcctgccagcaagatgcagaggagccacagccctgtgcctgctgctgccccagcccacagccccagccctgccagccccaggtctgtgcccggcagcagcagccagcacagcgccagccccctggtgcagagccccagcctgcagagcagccgggagagcctgaacagctgtggctttgtggagggcaagccccggcccatgggcagcccccggctgggcatcgccagcctgagcaagaccagcgagtacaagccacccagcagccccagccagcgctgcaaggtgtacacccagaagggcgtgctgcccagccctgcccccctgccccccagcagcaaggacagcggcgtggccagccgggagagcctgctgcagcctgaggtgaggaccccacctgtgggcatgagcccccaggtgctgaagaagtccatgtctgctggcagcgagggcttccctgagacccctgtggatgatgagcagcaggccgccacccccagcgagagcaagaaggagatcctgagcaccaccatggtgacagtgcagcagcccctggagctgaatggagaagatgagctggtgttcaccctggtggaggagctgaccatctctggagtgctggacagcggccggcccaccagcatcatctccttcaacagcgactgcagcgcccgggccctggccagcggcagcaggcctgtgtccatcatcagcagcatcagcgaggacctggagtgctacagcagcacagcccctgtgtctgaggtgtccatcacccagttcctgcccctgcccaagatgagcctggatgagaaggcccaggatgctggcagccgccgcagcagcatcagctcctggctgtctgagatgtctgctggcagcgagggggagcagagctgccacagcttcatcgcccagacctgcttcggccacggggaggccatggccgagcctgtggccagcgagtttgtgagcagcctgcagaacacagctgtggtgtgccgggagaagcccaaggccagcccagacaacctgctgatcctgtctgagatgggagatgacagcttcaacaaggccgcccccatcaagggctgcaagatcagcacagtgtccaaggccatggtgaccatcagcaacacagccaacctgagcagctgtgagggctacatccccatgaagaccaacatcaccgtgtacccctgcatcgccatgagccccaggaacatccaggagcctgaggcccccacagccacccccaaggccggccccaccctggcccagagccgggagagcaaggagaacagcgccaagaaggagatgaagtttgaggacccctggctgaagcgggaggaggaggtgaagaaggagacagcccaccccaatgaggagggcatgatgagatgtgaaacagccaccggccccagcaatgctgagaccagggctgagcaggagcaggacggcaagcccagccctggggaccggctgagcagcagcagcggggaggtgtctgccagccctgtgacagacaacttcagaagagtggtggatggctgtgagatggccctgcccggcctggccacccagagccctgtgcaccccaacaagtctgtgaagagcagcagcctgccccgggccttccagaaggccagccggcaggaggagccagacagcctgagctactactgtgccgctgagaccaacggggtgggcgccgccagcggcaccccacccagcaaggccaccctggagggcaaggtggccagccccaagcactgtgtgctggcccggcccaagggcaccccacccctgccccctgtgaggaagagcagcctggaccagaagaacagagccagcccccagcacagcgccagcggcagcggcaccagcagccccctgaaccagcctgctgccttccctgctggcctgcctgatgagcccagcggcaagaccaaggatgccagcagcagcagcaagctgttcagcgccaagctggagcagctggccagccgcagcaacagcctgggccgggccaccgtgagccactatgagtgcctgagcctggagagagctgagagcctgagctctgtgagcagccggctgcatgctgggaaggatggcaccatgccccgggccggccgcagcctgggccgctctgctggcaccagcccccccagcagcggggccagccccaaggccggccagagcaagatctctgctgtgtcccggctgctgctggccagcccccgggcccggggccccagcgccagcaccaccaagaccctgtccttcagcaccaagagcctgccccaggccgtgggccagggcagcagcagccccccaggcggcaagcacaccccctggagcacccagagcctgagcaggaacagaagcagcggcctggccagcaagctgcccctgcgggctgtgtctggccgcatcagcgagctgctgcagggcggggccggggcccggggcctgcagctgcgggccggccctgaggccgaggcccggggcggggccctggccgaggatgagcctgctgctgcccacctgctgcccagcccctacagcaagatcaccccaccccggcggccccaccgctgcagcagcggccacggcagtgacaacagctctgtgctgagcggggagctgcccccagccatgggcaagacagccctcttctaccacagcggcggcagcagcggctatgagagcgtgatgagggacagcgaggccaccggcagcgccagcagcgcccaggacagcaccagcgagaacagcagctctgtgggcggccgctgccgcagcctgaagacccccaagaagaggagcaaccctggcagccagaggcggcggctcatcccagccctgagcctggacaccagcagccctgtgaggaagccacccaacagcactggagtgcgctgggtggatggccccctgcggagcagcccccggggcctgggggagccctttgagatcaaggtgtatgaaattgatgatgtggagcggctgcagaggagaagaggaggagccagcaaggaggccatgtgcttcaatgccaagctgaagatcctggagcaccggcagcagagaattgctgaggtgcgggccaagtatgagtggctgatgaaggagctggaggccaccaagcagtacctgatgctggaccccaacaagtggctgtctgaatttgacctggagcaggtgtgggagctggacagcctggagtacctggaggccctggagtgtgtgacagagcggctggagagccgggtgaacttctgcaaggcccacctgatgatgatcacctgctttgacatcaccagcagaagaagatag

SEQ ID NO: 157065 - DNA, 2016 bp, Artificial Sequence
  Description of Artificial Sequence: Synthetic coding sequence
atgattgactttgatgatgtggccgccatcaaccctgagctgctgcagctgctgcccctgcaccccaaggacaacctgcccctgcaggagaatgtgaccatccagaagcagaagagaagatctgtgaacagcaagatcccagcccccaaggagagcctgcggagccgcagcaccaggatgagcacagtgtctgagctgcgcatcacagcccaggagaatgacatggaggtggagctgcctgctgctgccaacagcaggaagcagttctctgtgcccccagcccccacccggcccagctgcccagctgtggccgagatccccctgaggatggtgtctgaggagatggaggagcaggtgcacagcatccggggcagcagcagcgccaaccctgtgaacagcgtgcggaggaagagctgcctggtgaaggaggtggagaagatgaagaacaagcgggaggagaagaaggcccagaacagcgagatgaggatgaagagggcccaggagtatgacagcagcttccccaactgggagtttgccaggatgatcaaggagttccgggccaccctggagtgccaccccctgaccatgacagaccccatcgaggagcaccgcatctgtgtgtgtgtgaggaagaggcccctgaacaagcaggagctggccaagaaggagattgatgtgatcagcatccccagcaagtgcctgctgctggtgcatgagcccaagctgaaggtggacctgaccaagtacctggagaaccaggccttctgctttgattttgcctttgatgaaacagccagcaatgaggtggtgtaccgcttcaccgcccggcccctggtgcagaccatctttgaaggaggcaaggccacctgctttgcctacggccagacaggcagcggcaagacccacaccatgggcggggacctgagcggcaaggcccagaatgccagcaagggcatctatgccatggccagcagagatgtgttcctgctgaagaaccagccctgctacaggaagctgggcctggaggtgtatgtgaccttctttgagatctacaacgggaagctgtttgacctgctgaacaagaaggccaagctgcgggtgctggaggatggcaagcagcaggtgcaggtggtgggcctgcaggagcacctggtgaacagcgcagatgatgtgatcaagatgattgacatgggcagcgcctgcaggaccagcggccagacctttgccaacagcaacagcagccgcagccacgcctgcttccagatcatcctgcgggccaagggccgcatgcacggcaagttcagcctggtggacctggccggaaatgaaagaggagctgacaccagcagcgctgaccggcagaccaggatggagggcgctgagatcaacaagagcctgctggccctgaaggagtgcatccgggccctgggccagaacaaggcccacacccccttccgggagagcaagctgacccaggtgctgcgggacagcttcatcggggagaacagcaggacctgcatgattgccaccatcagccctggcatcagcagctgtgagtacaccctgaacaccctgcgctatgctgacagagtgaaggagctgagcccccacagcggccccagcggggagcagctgatccagatggagacagaggagatggaggcctgcagcaatggagccctgatccctggcaacctgagcaaggaggaggaggagctgagcagccagatgagcagcttcaatgaggccatgacccagatccgggagctggaggagaaggccatggaggagctgaaggagatcatccagcagggccctgactggctggagctgtctgagatgacagagcagcctgactatgacctggagacctttgtgaacaaggccgagagcgccctggcccagcaggccaagcacttcagcgccctgagagatgtgatcaaggccctgcggctggccatgcagctggaggagcaggccagccggcagatcagcagcaagaagaggccccagtag

SEQ ID NO: 157066 - DNA, 2055 bp, Artificial Sequence
  Description of Artificial Sequence: Synthetic coding sequence
atggccatggacagcagcctgcaggcccggctcttccctggcctggccatcaagatccagaggagcaatggcctcatccacagcgccaacgtgaggacagtgaacctggagaagagctgtgtgtctgtggagtgggccgagggcggggccaccaagggcaaggagattgactttgatgatgtggccgccatcaaccctgagctgctgcagctgctgcccctgcaccccaaggacaacctgcccctgcaggagaatgtgaccatccagaagcagaagagaagatctgtgaacagcaagatcccagcccccaaggagagcctgcggagccgcagcaccaggatgagcacagtgtctgagctgcgcatcacagcccaggagaatgacatggaggtggagctgcctgctgctgccaacagcaggaagcagttctctgtgcccctgcggaggaagagctgcctggtgaaggaggtggagaagatgaagaacaagcgggaggagaagaaggcccagaacagcgagatgaggatgaagagggcccaggagtatgacagcagcttccccaactgggagtttgccaggatgatcaaggagttccgggccaccctggagtgccaccccctgaccatgacagaccccatcgaggagcaccgcatctgtgtgtgtgtgaggaagaggcccctgaacaagcaggagctggccaagaaggagattgatgtgatcagcatccccagcaagtgcctgctgctggtgcatgagcccaagctgaaggtggacctgaccaagtacctggagaaccaggccttctgctttgattttgcctttgatgaaacagccagcaatgaggtggtgtaccgcttcaccgcccggcccctggtgcagaccatctttgagggcggcaaggccacctgctttgcctacggccagacaggcagcggcaagacccacaccatgggcggggacctgagcggcaaggcccagaatgccagcaagggcatctatgccatggccagcagagatgtgttcctgctgaagaaccagccctgctacaggaagctgggcctggaggtgtatgtgaccttctttgagatctacaacgggaagctgtttgacctgctgaacaagaaggccaagctgcgggtgctggaggatggcaagcagcaggtgcaggtggtgggcctgcaggagcacctggtgaacagcgcagatgatgtgatcaagatgattgacatgggcagcgcctgcaggaccagcggccagacctttgccaacagcaacagcagccgcagccacgcctgcttccagatcatcctgcgggccaagggccgcatgcacggcaagttcagcctggtggacctggccggaaatgaaagaggagctgacaccagcagcgctgaccggcagaccaggatggagggcgctgagatcaacaagagcctgctggccctgaaggagtgcatccgggccctgggccagaacaaggcccacacccccttccgggagagcaagctgacccaggtgctgcgggacagcttcatcggggagaacagcaggacctgcatgattgccaccatcagccctggcatcagcagctgtgagtacaccctgaacaccctgcgctatgctgacagagtgaaggagctgagcccccacagcggccccagcggggagcagctgatccagatggagacagaggagatggaggcctgcagcaatggagccctgatccctggcaacctgagcaaggaggaggaggagctgagcagccagatgagcagcttcaatgaggccatgacccagatccgggagctggaggagaaggccatggaggagctgaaggagatcatccagcagggccctgactggctggagctgtctgagatgacagagcagcctgactatgacctggagacctttgtgaacaaggccgagagcgccctggcccagcaggccaagcacttcagcgccctgagagatgtgatcaaggccctgcggctggccatgcagctggaggagcaggccagccggcagatcagcagcaagaagaggccccagtag

SEQ ID NO: 157067 - DNA, 1839 bp, Artificial Sequence
  Description of Artificial Sequence: Synthetic coding sequence
atgagcacagtgtctgagctgcgcatcacagcccaggagaatgacatggaggtggagctgcctgctgctgccaacagcaggaagcagttctctgtgcccccagcccccacccggcccagctgcccagctgtggccgagatccccctgaggatggtgtctgaggagatggaggagcaggtgcacagcatccggggcagcagcagcgccaaccctgtgaacagcgtgcggaggaagagctgcctggtgaaggaggtggagaagatgaagaacaagcgggaggagaagaaggcccagaacagcgagatgaggatgaagagggcccaggagtatgacagcagcttccccaactgggagtttgccaggatgatcaaggagttccgggccaccctggagtgccaccccctgaccatgacagaccccatcgaggagcaccgcatctgtgtgtgtgtgaggaagaggcccctgaacaagcaggagctggccaagaaggagattgatgtgatcagcatccccagcaagtgcctgctgctggtgcatgagcccaagctgaaggtggacctgaccaagtacctggagaaccaggccttctgctttgattttgcctttgatgaaacagccagcaatgaggtggtgtaccgcttcaccgcccggcccctggtgcagaccatctttgagggcggcaaggccacctgctttgcctacggccagacaggcagcggcaagacccacaccatgggcggggacctgagcggcaaggcccagaatgccagcaagggcatctatgccatggccagcagagatgtgttcctgctgaagaaccagccctgctacaggaagctgggcctggaggtgtatgtgaccttctttgagatctacaacgggaagctgtttgacctgctgaacaagaaggccaagctgcgggtgctggaggatggcaagcagcaggtgcaggtggtgggcctgcaggagcacctggtgaacagcgcagatgatgtgatcaagatgattgacatgggcagcgcctgcaggaccagcggccagacctttgccaacagcaacagcagccgcagccacgcctgcttccagatcatcctgcgggccaagggccgcatgcacggcaagttcagcctggtggacctggccggaaatgaaagaggagctgacaccagcagcgctgaccggcagaccaggatggagggcgctgagatcaacaagagcctgctggccctgaaggagtgcatccgggccctgggccagaacaaggcccacacccccttccgggagagcaagctgacccaggtgctgcgggacagcttcatcggggagaacagcaggacctgcatgattgccaccatcagccctggcatcagcagctgtgagtacaccctgaacaccctgcgctatgctgacagagtgaaggagctgagcccccacagcggccccagcggggagcagctgatccagatggagacagaggagatggaggcctgcagcaatggagccctgatccctggcaacctgagcaaggaggaggaggagctgagcagccagatgagcagcttcaatgaggccatgacccagatccgggagctggaggagaaggccatggaggagctgaaggagatcatccagcagggccctgactggctggagctgtctgagatgacagagcagcctgactatgacctggagacctttgtgaacaaggccgagagcgccctggcccagcaggccaagcacttcagcgccctgagagatgtgatcaaggccctgcggctggccatgcagctggaggagcaggccagccggcagatcagcagcaagaagaggccccagtag

SEQ ID NO: 157068 - DNA, 2178 bp, Artificial Sequence
  Description of Artificial Sequence: Synthetic coding sequence
atggccatggacagcagcctgcaggcccggctcttccctggcctggccatcaagatccagaggagcaatggcctcatccacagcgccaacgtgaggacagtgaacctggagaagagctgtgtgtctgtggagtgggccgagggcggggccaccaagggcaaggagattgactttgatgatgtggccgccatcaaccctgagctgctgcagctgctgcccctgcaccccaaggacaacctgcccctgcaggagaatgtgaccatccagaagcagaagagaagatctgtgaacagcaagatcccagcccccaaggagagcctgcggagccgcagcaccaggatgagcacagtgtctgagctgcgcatcacagcccaggagaatgacatggaggtggagctgcctgctgctgccaacagcaggaagcagttctctgtgcccccagcccccacccggcccagctgcccagctgtggccgagatccccctgaggatggtgtctgaggagatggaggagcaggtgcacagcatccggggcagcagcagcgccaaccctgtgaacagcgtgcggaggaagagctgcctggtgaaggaggtggagaagatgaagaacaagcgggaggagaagaaggcccagaacagcgagatgaggatgaagagggcccaggagtatgacagcagcttccccaactgggagtttgccaggatgatcaaggagttccgggccaccctggagtgccaccccctgaccatgacagaccccatcgaggagcaccgcatctgtgtgtgtgtgaggaagaggcccctgaacaagcaggagctggccaagaaggagattgatgtgatcagcatccccagcaagtgcctgctgctggtgcatgagcccaagctgaaggtggacctgaccaagtacctggagaaccaggccttctgctttgattttgcctttgatgaaacagccagcaatgaggtggtgtaccgcttcaccgcccggcccctggtgcagaccatctttgaaggaggcaaggccacctgctttgcctacggccagacaggcagcggcaagacccacaccatgggcggggacctgagcggcaaggcccagaatgccagcaagggcatctatgccatggccagcagagatgtgttcctgctgaagaaccagccctgctacaggaagctgggcctggaggtgtatgtgaccttctttgagatctacaacgggaagctgtttgacctgctgaacaagaaggccaagctgcgggtgctggaggatggcaagcagcaggtgcaggtggtgggcctgcaggagcacctggtgaacagcgcagatgatgtgatcaagatgattgacatgggcagcgcctgcaggaccagcggccagacctttgccaacagcaacagcagccgcagccacgcctgcttccagatcatcctgcgggccaagggccgcatgcacggcaagttcagcctggtggacctggccggaaatgaaagaggagctgacaccagcagcgctgaccggcagaccaggatggagggcgctgagatcaacaagagcctgctggccctgaaggagtgcatccgggccctgggccagaacaaggcccacacccccttccgggagagcaagctgacccaggtgctgcgggacagcttcatcggggagaacagcaggacctgcatgattgccaccatcagccctggcatcagcagctgtgagtacaccctgaacaccctgcgctatgctgacagagtgaaggagctgagcccccacagcggccccagcggggagcagctgatccagatggagacagaggagatggaggcctgcagcaatggagccctgatccctggcaacctgagcaaggaggaggaggagctgagcagccagatgagcagcttcaatgaggccatgacccagatccgggagctggaggagaaggccatggaggagctgaaggagatcatccagcagggccctgactggctggagctgtctgagatgacagagcagcctgactatgacctggagacctttgtgaacaaggccgagagcgccctggcccagcaggccaagcacttcagcgccctgagagatgtgatcaaggccctgcggctggccatgcagctggaggagcaggccagccggcagatcagcagcaagaagaggccccagtag

SEQ ID NO: 157069 - DNA, 324 bp, Artificial Sequence
  Description of Artificial Sequence: Synthetic coding sequence
tgaaaagaatgcatccgggccctgggccagaacaaggcccacacccccttccgggagagcaagctgacccaggtgctgcgggacagcttcatcggggagaacagcaggacctgcatgattgccaccatcagccctggcatcagcagctgtgagtacaccctgaacaccctgcgctatgctgaccggcagggctgccacagcatccccctggagccccaggccagcaagccaggccgctgccacatccccctgctgagcaaggaggaggaggagctgagcagccagatgagcagcttcaatgaggccatgacccagatcagatag

SEQ ID NO: 157070 - DNA, 1011 bp, Artificial Sequence
  Description of Artificial Sequence: Synthetic coding sequence
atggccatggacagcagcctgcaggcccggctcttccctggcctggccatcaagatccagaggagcaatggcctcatccacagcgccaacgtgaggacagtgaacctggagaagagctgtgtgtctgtggagtgggccgagggcggggccaccaagggcaaggagattgactttgatgatgtggccgccatcaaccctgagctgctgcagctgctgcccctgcaccccaaggacaacctgcccctgcaggagaatgtgaccatccagaagcagaagagaagatctgtgaacagcaagatcccagcccccaaggagagcctgcggagccgcagcaccaggatgagcacagtgtctgagctgcgcatcacagcccaggagaatgacatggaggtggagctgcctgctgctgccaacagcaggaagcagttctctgtgcccctgcggaggaagagctgcctggtgaaggaggtggagaagatgaagaacaagcgggaggagaagaaggcccagaacagcgagatgaggatgaagagggcccaggagtatgacagcagcttccccaactgggagtttgccaggatgatcaaggagttccgggccaccctggagtgccaccccctgaccatgacagaccccatcgaggagcaccgcatctgtgtgtgtgtgaggaagaggcccctgaacaagcaggagctggccaagaaggagattgatgtgatcagcatccccagcaagtgcctgctgctggtgcatgagcccaagctgaaggtggacctgaccaagtacctggagaaccaggccttctgctttgattttgcctttgatgaaacagccagcaatgaggtggtgtaccgcttcaccgcccggcccctggtgcagaccatctttgagggcggcaaggccacctgctttgcctacggccagacaggcagcggcaagacccacaccatgggcggggacctgagcggcaaggcccagaatgccagcaagggcatctatgccatggcctag

SEQ ID NO: 157071 - DNA, 864 bp, Artificial Sequence
  Description of Artificial Sequence: Synthetic coding sequence
atggtgcgcagcggcgtgcccaggagccggggcctggtgtctggcctcatccacagcgccaacgtgaggacagtgaacctggagaagagctgtgtgtctgtggagtgggccgagggcggggccaccaagggcaaggagattgactttgatgatgtggccgccatcaaccctgagctgctgcagctgctgcccctgcaccccaaggacaacctgcccctgcaggagaatgtgaccatccagaagcagaagagaagatctgtgaacagcaagatcccagcccccaaggagagcctgcggagccgcagcaccaggatgagcacagtgtctgagctgcgcatcacagcccaggagaatgacatggaggtggagctgcctgctgctgccaacagcaggaagcagttctctgtgcccccagcccccacccggcccagctgcccagctgtggccgagatccccctgaggatggtgtctgaggagatggaggagcaggtgcacagcatccggggcagcagcagcgccaaccctgtgaacagcgtgcggaggaagagctgcctggtgaaggaggtggagaagatgaagaacaagcgggaggagaagaaggcccagaacagcgagatgaggatgaagagggcccaggagtatgacagcagcttccccaactgggagtttgccaggatgatcaaggagttccgggccaccctggagtgccaccccctgaccatgacagaccccatcgaggagcaccgcatctgtgtgtgtgtgaggaagaggcccctgaacaagcaggagctggccaagaaggagattgatgtgatcagcatccccagcaagtgcctgctgctggtgcatgagcccaagctgtag

SEQ ID NO: 157072 - DNA, 2244 bp, Artificial Sequence
  Description of Artificial Sequence: Synthetic coding sequence
atgagcaagctgaagagcagcgagagcgtgcgggtggtggtgcgctgccggcccatgaatggcaaggagaaggccgccagctatgacaaggtggtggatgtggatgtgaagctgggccaggtgtctgtgaagaaccccaagggcacagcccacgagatgcccaagaccttcacctttgatgctgtgtatgactggaatgccaagcagtttgagctgtatgatgagaccttccggcccctggtggacagcgtgctgcagggcttcaacggcaccatctttgcctacggccagacaggcaccgggaagacctacaccatggagggcatccggggggaccctgagaagaggggcgtcatccccaacagctttgaccacatcttcacccacatcagccgcagccagaaccagcagtacctggtgcgggccagctacctggagatctaccaggaggagatccgggacctgctgagcaaggaccagaccaagaggctggagctgaaggagaggccagacaccggggtgtatgtgaaggacctgagcagctttgtgaccaagtctgtgaaggagattgagcacgtgatgaatgtgggcaaccagaacagatctgtgggcgccaccaacatgaatgagcacagcagccgcagccacgccatctttgtgatcaccatcgagtgcagcgaggtgggcctggatggagagaaccacatccgggtgggcaagctgaacctggtggacctggccggcagcgagcggcaggccaagacaggagcccagggcgagcggctgaaggaggccaccaagatcaacctgagcctgagcgccctgggcaatgtcatcagcgccctggtggatggcaagagcacccacatcccctacagagacagcaagctgacccggctgctgcaggacagcctgggcggcaatgccaagacagtgatggtggccaacgtgggccctgccagctacaacgtggaggagaccctgaccaccctgcgctatgccaacagagccaagaacatcaagaacaagccccgggtgaatgaagaccccaaggatgccctgctgcgggagttccaggaggagatcgcccggctgaaggcccagctggagaagaggagcatcggccgcaggaagagaagagagaagagaagagagggcggcggcagcggcggcggcggggaggaggaggaggaggagggggaggagggggaggaggagggagatgacaaggatgactactggagggagcagcaggagaagctggagattgagaagagggccatcgtggaggaccacagcctggtggccgaggagaagatgaggctgctgaaggagaaggagaagaagatggaggacctgcggcgggagaaggatgctgctgagatgctgggcgccaagatcaaggccatggagagcaagctgctggtgggcggcaagaacatcgtggaccacaccaatgagcagcagaagatcctggagcagaagaggcaggagattgctgagcagaagaggcgggagcgggagatccagcagcagatggagagcagagatgaggagaccctggagctgaaggagacctacagcagcctgcagcaggaggtggacatcaagaccaagaagctgaagaagctgttcagcaagctgcaggccgtgaaggccgagatccatgacctgcaggaggagcacatcaaggagcggcaggagctggagcagacccagaatgagctgacccgggagctgaagctgaagcacctgatcatcgagaacttcatccccctggaggagaagagcaagatcatgaacagagccttctttgatgaggaggaggaccactggaagctgcaccccatcacccggctggagaaccagcagatgatgaagaggcctgtgtctgctgtgggctacaagaggcccctgagccagcacgccaggatgtccatgatgatccggcctgaggcccgctacagagctgagaacatcgtgctgctggagctggacatgcccagcaggaccacccgggactatgagggccctgccatcgcccccaaggtgcaggccgccctggatgctgccctgcaggatgaagatgagatccaggtggatgccagcagctttgagagcacagccaacaagaagagcaaggcccggcccaagagcggcaggaagagcggcagcagcagcagcagcagcggcaccccagccagccagctgtacccccagagccggggcctggtgcccaagtag

SEQ ID NO: 157073 - DNA, 1122 bp, Artificial Sequence
  Description of Artificial Sequence: Synthetic coding sequence
atggtggccaacgtgggccctgccagctacaacgtggaggagaccctgaccaccctgcgctatgccaacagagccaagaacatcaagaacaagccccgggtgaatgaagaccccaaggatgccctgctgcgggagttccaggaggagatcgcccggctgaaggcccagctggagaagaggagcattgaggagaagatgaggctgctgaaggagaaggagaagaagatggaggacctgcggcgggagaaggatgctgctgagatgctgggcgccaagatcaaggccatggagagcaagctgctggtgggcggcaagaacatcgtggaccacaccaatgagcagcagaagatcctggagcagaagaggcaggagattgctgagcagaagaggcgggagcgggagatccagcagcagatggagagcagagatgaggagaccctggagctgaaggagacctacagcagcctgcagcaggaggtggacatcaagaccaagaagctgaagaagctgttcagcaagctgcaggccgtgaaggccgagatccatgacctgcaggaggagcacatcaaggagcggcaggagctggagcagacccagaatgagctgacccgggagctgaagctgaagcacctgatcatcgagaacttcatccccctggaggagaagagcaagatcatgaacagagccttctttgatgaggaggaggaccactggaagctgcaccccatcacccggctggagaaccagcagatgatgaagaggcctgtgtctgctgtgggctacaagaggcccctgagccagcacgccaggatgtccatgatgatccggcctgaggcccgctacagagctgagaacatcgtgctgctggagctggacatgcccagcaggaccacccgggactatgagggccctgccatcgcccccaaggtgcaggccgccctggatgctgccctgcaggatgaagatgagatccaggtggatgccagcagctttgagagcacagccaacaagaagagcaaggcccggcccaagagcggcaggaagagcggcagcagcagcagcagcagcggcaccccagccagccagctgtacccccagagccggggcctggtgcccaagtag

SEQ ID NO: 157074 - DNA, 2382 bp, Artificial Sequence
  Description of Artificial Sequence: Synthetic coding sequence
atggccagcaagaccaaggccagcgaggccctgaaggtggtggcccgctgccggcccctgagcaggaaggaggaggccgccggccacgagcagatcctgaccatggatgtgaagctgggccaggtgaccctgaggaaccccagggctgcccctggagagctgcccaagaccttcacctttgatgctgtgtatgatgccagcagcaagcaggccgacctgtatgatgaaacagtgcggcccctgattgacagcgtgctgcagggcttcaacggcaccgtgtttgcctacggccagacaggaacaggcaagacctacaccatgcagggcacctgggtggagcctgagctgcggggcgtcatccccaatgcctttgagcacatcttcacccacatcagccgcagccagaaccagcagtacctggtgcgggccagctacctggagatctaccaggaggagatccgggacctgctgagcaaggagcccgggaagaggctggagctgaaggaaaatcctgagactggagtgtacatcaaggacctgagcagctttgtgaccaagaatgtgaaggagattgaacatgtgatgaacctgggcaaccagaccagggctgtgggcagcacccacatgaatgaggtgagcagccgcagccacgccatcttcatcatcaccgtggagtgcagcgagcggggcagtgatggccaggaccacatccgggtgggcaagctgaacctggtggacctggccggcagcgagcggcagaacaaggccggccccaacacagctggaggagctgccacccccagcagcggcggcggcggcggcggcggcggcagcggcggcggggccggcggggagcggcccaaggaggccagcaagatcaacctgagcctgagcgccctgggcaatgtgattgctgccctggccggcaacagaagcacccacatcccctacagagacagcaagctgacccggctgctgcaggacagcctgggcggcaatgccaagaccatcatggtggccaccctgggccctgccagccacagctatgatgagagcctgagcaccctgcgctttgccaacagagccaagaacatcaagaacaagccccaggtgaatgaagaccccaaggacaccctgctgcgggagttccaggaggagatcgcccggctgaaggcccagctggagaagaggggcatgctgggcaagaggcccaggaggaagagcagcaggaggaagaaggctgtgtctgcccctcctggctacccagagggccctgtgattgaggcctgggtggccgaggaggaggatgacaacaacaacaaccaccggcccccccagcccatcctggagagcgccctggagaagaacatggagaactacctgcaggagcagaaggagcggctggaggaggagaaggccgccatccaggatgacaggagcctggtgtctgaggagaagcagaagctgctggaggagaaggagaagatgctggaggacctgcggcgggagcagcaggccacagagctgctggccgccaagtacaaggccatggagagcaagctgctgattggaggcaggaacatcatggaccacaccaatgagcagcagaagatgctggagctgaagaggcaggagattgctgagcagaagagaagagagcgggagatgcagcaggagatgatgctgagagatgaggagaccatggagctgcggggcacctacaccagcctgcagcaggaggtggaggtgaagaccaagaagctgaagaagctgtatgccaagctgcaggccgtgaaggccgagatccaggaccagcatgatgagtacatccgggtgcggcaggacctggaggaggcccagaatgagcagacccgggagctgaagctgaagtacctgatcatcgagaacttcatccccccagaggagaagaacaagatcatgaacagactcttcctggactgtgaggaggagcagtggaagttccagcccctggtgcctgctggggtgagcagcagccagatgaagaagaggcccaccagcgctgtgggctacaagaggcccatcagccagtatgcccgggtggccatggccatgggcagccacccccgctacagagctgagaacatcatgttcctggagctggatgtgagccccccagctgtgtttgagatggagttcagccatgaccaggagcaggacccccgggccctgcacatggagcggctgatgaggctggacagcttcctggagcggcccagcaccagcaaggtgaggaagagccgctcctggtgccagagcccccagaggcccccacccagcaccacccacgccagcctggccagcgccagcctgcggcctgccaccgtggccgaccacgagtag

SEQ ID NO: 157075 - DNA, 2382 bp, Artificial Sequence; identical to SEQ ID NO: 157074
  Description of Artificial Sequence: Synthetic coding sequence

SEQ ID NO: 157076 - DNA, 1800 bp, Artificial Sequence
  Description of Artificial Sequence: Synthetic coding sequence
atgaacctgggcaaccagaccagggctgtgggcagcacccacatgaatgaggtgagcagccgcagccacgccatcttcatcatcaccgtggagtgcagcgagcggggcagtgatggccaggaccacatccgggtgggcaagctgaacctggtggacctggccggcagcgagcggcagaacaaggccggccccaacacagctggaggagctgccacccccagcagcggcggcggcggcggcggcggcggcagcggcggcggggccggcggggagcggcccaaggaggccagcaagatcaacctgagcctgagcgccctgggcaatgtgattgctgccctggccggcaacagaagcacccacatcccctacagagacagcaagctgacccggctgctgcaggacagcctgggcggcaatgccaagaccatcatggtggccaccctgggccctgccagccacagctatgatgagagcctgagcaccctgcgctttgccaacagagccaagaacatcaagaacaagccccaggtgaatgaagaccccaaggacaccctgctgcgggagttccaggaggagatcgcccggctgaaggcccagctggagaagaggggcatgctgggcaagaggcccaggaggaagagcagcaggaggaagaaggctgtgtctgcccctcctggctacccagagggccctgtgattgaggcctgggtggccgaggaggaggatgacaacaacaacaaccaccggcccccccagcccatcctggagagcgccctggagaagaacatggagaactacctgcaggagcagaaggagcggctggaggaggagaaggccgccatccaggatgacaggagcctggtgtctgaggagaagcagaagctgctggaggagaaggagaagatgctggaggacctgcggcgggagcagcaggccacagagctgctggccgccaagtacaaggccatggagagcaagctgctgattggaggcaggaacatcatggaccacaccaatgagcagcagaagatgctggagctgaagaggcaggagattgctgagcagaagagaagagagcgggagatgcagcaggagatgatgctgagagatgaggagaccatggagctgcggggcacctacaccagcctgcagcaggaggtggaggtgaagaccaagaagctgaagaagctgtatgccaagctgcaggccgtgaaggccgagatccaggaccagcatgatgagtacatccgggtgcggcaggacctggaggaggcccagaatgagcagacccgggagctgaagctgaagtacctgatcatcgagaacttcatccccccagaggagaagaacaagatcatgaacagactcttcctggactgtgaggaggagcagtggaagttccagcccctggtgcctgctggggtgagcagcagccagatgaagaagaggcccaccagcgctgtgggctacaagaggcccatcagccagtatgcccgggtggccatggccatgggcagccacccccgctacagagctgagaacatcatgttcctggagctggatgtgagccccccagctgtgtttgagatggagttcagccatgaccaggagcaggacccccgggccctgcacatggagcggctgatgaggctggacagcttcctggagcggcccagcaccagcaaggtgaggaagagccgctcctggtgccagagcccccagaggcccccacccagcaccacccacgccagcctggccagcgccagcctgcggcctgccaccgtggccgaccacgagtag

SEQ ID NO: 157077 - DNA, 3384 bp, Artificial Sequence
  Description of Artificial Sequence: Synthetic coding sequence
atgaaggaggaggtgaagggcatccctgtgcgggtggccctgcgctgccggcccctggtgcccaaggagatcagcgagggctgccagatgtgcctgagctttgtgcctggagagccccaggtggtggtgggcacagacaagagcttcacctatgactttgtgtttgaccccagcacagagcaggaggaggtgttcaacacagctgtggcccccctcatcaagggcgtcttcaagggctacaatgccaccgtgctggcctacggccagacaggcagcggcaagacctacagcatgggcggggcctacacagctgagcaggagaatgagcccaccgtgggcgtcatccccagggtcatccagctgctcttcaaggagattgacaagaagagtgactttgagttcaccctgaaggtgtcctacctggagatctacaatgaggagatcctggacctgctgtgccccagccgggagaaggcccagatcaacatccgggaggaccccaaggagggcatcaagatcgtgggcctgacagagaagacagtgctggtggccctggacacagtgtcctgcctggagcagggcaacaacagcaggacagtggccagcacagccatgaacagccagagcagccgcagccacgccatcttcaccatcagcctggagcagaggaagaagagtgacaagaacagcagcttccgcagcaagctgcacctggtggacctggccggcagcgagcggcagaagaagaccaaggccgagggggaccggctgaaggagggcatcaacatcaacagaggcctgctgtgcctgggcaatgtcatcagcgccctgggagatgacaagaagggcggctttgtgccctacagagacagcaagctgacccggctgctgcaggacagcctgggcggcaacagccacaccctgatgattgcctgtgtgtccccagctgacagcaacctggaggagaccctgaacaccctgcgctatgctgaccgggccaggaagatcaagaacaagcccatcgtgaacatcgacccccagacagctgagctgaaccacctgaagcagcaggtgcagcagctgcaggtgctgctgctgcaggcccatggaggcaccctgcccggcagcatcaccgtggagcccagcgagaacctgcagagcctgatggagaagaaccagagcctggtggaggagaatgagaagctgagccggggcctgtctgaggccgccggccagacagcccagatgctggagcgcatcatcctgacagagcaggccaatgagaagatgaatgccaagctggaggagctgcggcagcacgccgcctgcaagctggacctgcagaagctggtggagaccctggaggaccaggagctgaaggaaaatgtggagatcatctgcaacctgcagcagctgatcacccagctgagtgatgagaccgtggcctgcatggccgccgccatcgacacagctgtggagcaggaggcccaggtggagaccagccctgagaccagccgcagcagtgatgccttcaccacccagcacgccctgcggcaggcccagatgagcaaggagctggtggagctgaacaaggccctggccctgaaggaggccctggccaggaagatgacccagaatgacagccagctgcagcccatccagtaccagtaccaggacaacatcaaggagctggagctggaggtgatcaacctgcagaaggagaaggaggagctggtgctggagctgcagacagccaagaaggatgccaaccaggccaagctgtctgaaagaagaaggaagaggctgcaggagctggagggccagattgctgacctgaagaagaagctgaatgagcagagcaagctgctgaagctgaaggagagcacagagaggacagtgtccaagctgaaccaggagatccgcatgatgaagaaccagagggtgcagctgatgaggcagatgaaggaggatgctgagaagttccggcagtggaagcagaagaaggacaaggaggtgatccagctgaaggagcgggacaggaagaggcagtatgagctgctgaagctggagaggaacttccagaagcagagcaatgtgctgcggaggaagacagaggaggccgctgctgccaacaagaggctgaaggatgccctgcagaagcagcgggaggtggccgacaagaggaaggagacccagagccggggcatggagggcacagctgcccgggtgaagaactggctgggcaatgaaattgaggtgatggtgtccacagaggaggccaagaggcacctgaatgacctgctggaggacaggaagatcctggcccaggatgtggcccagctgaaggagaagaaggagagcggagaaaatcctccacccaagctgcggcggaggaccttcagcctgacagaggtgcggggccaggtgtctgagagtgaagattccatcaccaagcagatcgagagcctggagacagagatggagttccgcagcgcccagattgctgacctgcagcagaagctgctggatgctgagagtgaagatcggcccaagcagcgctgggagaacatcgccaccatcctggaggccaagtgtgccctgaagtacctgattggagagctggtgagcagcaagatccaggtgtccaagctggagagcagcctgaagcagagcaagaccagctgtgccgacatgcagaagatgctgtttgaggagaggaaccactttgctgagattgaaacagagctgcaggccgagctggtgaggatggagcagcagcaccaggagaaggtgctgtacctgctgagccagctgcagcagagccagatggccgagaagcagctggaggagagcgtgtctgagaaggagcagcagctgctgagcaccctgaagtgccaggatgaggagctggagaagatgagggaggtgtgtgagcagaaccagcagctgctgcgggagaatgagatcatcaagcagaagctgaccctgctgcaggtggccagccggcagaagcacctgcccaaggacaccctgctgagcccagacagcagctttgaatatgtgccccccaagcccaagcccagccgggtgaaggagaagttcctggagcagagcatggacatcgaggacctgaagtactgcagcgagcacagcgtgaatgaacatgaagatggagatggagatgatgatgaaggagatgatgaggagtggaagcccaccaagctggtgaaggtgtccaggaagaacatccagggcgtgctgctgctgacccctgtgatcagcgccctgtgggaggccgaggcccggggcctgctggaggcccggagcagcaggcctgcctgggccacctggagggaccctgtgtccaccaagcccaagaactag

SEQ ID NO: 157078 - DNA, 3699 bp, Artificial Sequence
  Description of Artificial Sequence: Synthetic coding sequence
atgaaggaggaggtgaagggcatccctgtgcgggtggccctgcgctgccggcccctggtgcccaaggagatcagcgagggctgccagatgtgcctgagctttgtgcctggagagccccaggtggtggtgggcacagacaagagcttcacctatgactttgtgtttgaccccagcacagagcaggaggaggtgttcaacacagctgtggcccccctcatcaagggcgtcttcaagggctacaatgccaccgtgctggcctacggccagacaggcagcggcaagacctacagcatgggcggggcctacacagctgagcaggagaatgagcccaccgtgggcgtcatccccagggtcatccagctgctcttcaaggagattgacaagaagagtgactttgagttcaccctgaaggtgtcctacctggagatctacaatgaggagatcctggacctgctgtgccccagccgggagaaggcccagatcaacatccgggaggaccccaaggagggcatcaagatcgtgggcctgacagagaagacagtgctggtggccctggacacagtgtcctgcctggagcagggcaacaacagcaggacagtggccagcacagccatgaacagccagagcagccgcagccacgccatcttcaccatcagcctggagcagaggaagaagagtgacaagaacagcagcttccgcagcaagctgcacctggtggacctggccggcagcgagcggcagaagaagaccaaggccgagggggaccggctgaaggagggcatcaacatcaacagaggcctgctgtgcctgggcaatgtcatcagcgccctgggagatgacaagaagggcggctttgtgccctacagagacagcaagctgacccggctgctgcaggacagcctgggcggcaacagccacaccctgatgattgcctgtgtgtccccagctgacagcaacctggaggagaccctgaacaccctgcgctatgctgaccgggccaggaagatcaagaacaagcccatcgtgaacatcgacccccagacagctgagctgaaccacctgaagcagcaggtgcagcagctgcaggtgctgctgctgcaggcccatggaggcaccctgcccggcagcatcaccgtggagcccagcgagaacctgcagagcctgatggagaagaaccagagcctggtggaggagaatgagaagctgagccggggcctgtctgaggccgccggccagacagcccagatgctggagcgcatcatcctgacagagcaggccaatgagaagatgaatgccaagctggaggagctgcggcagcacgccgcctgcaagctggacctgcagaagctggtggagaccctggaggaccaggagctgaaggaaaatgtggagatcatctgcaacctgcagcagctgatcacccagctgagtgatgagaccgtggcctgcatggccgccgccatcgacacagctgtggagcaggaggcccaggtggagaccagccctgagaccagccgcagcagtgatgccttcaccacccagcacgccctgcggcaggcccagatgagcaaggagctggtggagctgaacaaggccctggccctgaaggaggccctggccaggaagatgacccagaatgacagccagctgcagcccatccagtaccagtaccaggacaacatcaaggagctggagctggaggtgatcaacctgcagaaggagaaggaggagctggtgctggagctgcagacagccaagaaggatgccaaccaggccaagctgtctgaaagaagaaggaagaggctgcaggagctggagggccagattgctgacctgaagaagaagctgaatgagcagagcaagctgctgaagctgaaggagagcacagagaggacagtgtccaagctgaaccaggagatccgcatgatgaagaaccagagggtgcagctgatgaggcagatgaaggaggatgctgagaagttccggcagtggaagcagaagaaggacaaggaggtgatccagctgaaggagcgggacaggaagaggcagtatgagctgctgaagctggagaggaacttccagaagcagagcaatgtgctgcggaggaagacagaggaggccgctgctgccaacaagaggctgaaggatgccctgcagaagcagcgggaggtggccgacaagaggaaggagacccagagccggggcatggagggcacagctgcccgggtgaagaactggctgggcaatgaaattgaggtgatggtgtccacagaggaggccaagaggcacctgaatgacctgctggaggacaggaagatcctggcccaggatgtggcccagctgaaggagaagaaggagagcggagaaaatcctccacccaagctgcggcggaggaccttcagcctgacagaggtgcggggccaggtgtctgagagtgaagattccatcaccaagcagatcgagagcctggagacagagatggagttccgcagcgcccagattgctgacctgcagcagaagctgctggatgctgagagtgaagatcggcccaagcagcgctgggagaacatcgccaccatcctggaggccaagtgtgccctgaagtacctgattggagagctggtgagcagcaagatccaggtgtccaagctggagagcagcctgaagcagagcaagaccagctgtgccgacatgcagaagatgctgtttgaggagaggaaccactttgctgagattgaaacagagctgcaggccgagctggtgaggatggagcagcagcaccaggagaaggtgctgtacctgctgagccagctgcagcagagccagatggccgagaagcagctggaggagagcgtgtctgagaaggagcagcagctgctgagcaccctgaagtgccaggatgaggagctggagaagatgagggaggtgtgtgagcagaaccagcagctgctgcgggagaatgagatcatcaagcagaagctgaccctgctgcaggtggccagccggcagaagcacctgcccaaggacaccctgctgagcccagacagcagctttgaatatgtgccccccaagcccaagcccagccgggtgaaggagaagttcctggagcagagcatggacatcgaggacctgaagtactgcagcgagcacagcgtgaatgaacatgaagatggagatggagatgatgatgaaggagatgatgaggagtggaagcccaccaagctggtgaaggtgtccaggaagaacatccagggctgcagctgcaagggctggtgtggcaacaagcagtgtggctgcaggaagcagaagagtgactgtggggtggactgctgctgtgaccccaccaagtgcaggaaccggcagcagggcaaggacagcctgggcaccgtggagaggacccaggacagcgagggcagcttcaagctggaggaccccacagaggtgaccccaggcctgtccttcttcaaccctgtgtgtgccacccccaacagcaagatcctgaaggagatgtgtgatgtggagcaggtgctgagcaagaagaccccaccagcccccagcccctttgacctgcctgagctgaagcacgtggccacagagtaccaggagaacaaggcccctgggaagaagaagaagagggccctggccagcaacaccagcttcttcagcggctgcagccccatcgaggaggaggcccactag

SEQ ID NO: 157079 - DNA, 1605 bp, Artificial Sequence
  Description of Artificial Sequence: Synthetic coding sequence
atgtgcagtgatgtgaagcgggaggccgctgctgccaacaagaggctgaaggatgccctgcagaagcagcgggaggtggccgacaagaggaaggagacccagagccggggcatggagggcacagctgcccgggtgaagaactggctgggcaatgaaattgaggtgatggtgtccacagaggaggccaagaggcacctgaatgacctgctggaggacaggaagatcctggcccaggatgtggcccagctgaaggagaagaaggagagcggagaaaatcctccacccaagctgcggcggaggaccttcagcctgacagaggtgcggggccaggtgtctgagagtgaagattccatcaccaagcagatcgagagcctggagacagagatggagttccgcagcgcccagattgctgacctgcagcagaagctgctggatgctgagagtgaagatcggcccaagcagcgctgggagaacatcgccaccatcctggaggccaagtgtgccctgaagtacctgattggagagctggtgagcagcaagatccaggtgtccaagctggagagcagcctgaagcagagcaagaccagctgtgccgacatgcagaagatgctgtttgaggagaggaaccactttgctgagattgaaacagagctgcaggccgagctggtgaggatggagcagcagcaccaggagaaggtgctgtacctgctgagccagctgcagcagagccagatggccgagaagcagctggaggagagcgtgtctgagaaggagcagcagctgctgagcaccctgaagtgccaggatgaggagctggagaagatgagggaggtgtgtgagcagaaccagcagctgctgcgggagaatgagatcatcaagcagaagctgaccctgctgcaggtggccagccggcagaagcacctgcccaaggacaccctgctgagcccagacagcagctttgaatatgtgccccccaagcccaagcccagccgggtgaaggagaagttcctggagcagagcatggacatcgaggacctgaagtactgcagcgagcacagcgtgaatgaacatgaagatggagatggagatgatgatgaaggagatgatgaggagtggaagcccaccaagctggtgaaggtgtccaggaagaacatccagggctgcagctgcaagggctggtgtggcaacaagcagtgtggctgcaggaagcagaagagtgactgtggggtggactgctgctgtgaccccaccaagtgcaggaaccggcagcagggcaaggacagcctgggcaccgtggagaggacccaggacagcgagggcagcttcaagctggaggaccccacagaggtgaccccaggcctgtccttcttcaaccctgtgtgtgccacccccaacagcaagatcctgaaggagatgtgtgatgtggagcaggtgctgagcaagaagaccccaccagcccccagcccctttgacctgcctgagctgaagcacgtggccacagagtaccaggagaacaaggcccctgggaagaagaagaagagggccctggccagcaacaccagcttcttcagcggctgcagccccatcgaggaggaggcccactag

SEQ ID NO: 157080 - DNA, 3705 bp, Artificial Sequence
  Description of Artificial Sequence: Synthetic coding sequence
atgaaggaggaggtgaagggcatccctgtgcgggtggccctgcgctgccggcccctggtgcccaaggagatcagcgagggctgccagatgtgcctgagctttgtgcctggagagacccaggtggtggtgggcacagacaagagcttcacctatgactttgtgtttgacccctgcacagagcaggaggaggtgttcaacaaggctgtggcccccctcatcaagggcatcttcaagggctacaatgccaccgtgctggcctacggccagacaggcagcggcaagacctacagcatgggcggggcctacacagctgagcaggagaatgagcccaccgtgggcatcatccccagggtcatccagctgctcttcaaggagattgacaagaagagtgactttgagttcaccctgaaggtgtcctacctggagatctacaatgaggagatcctggacctgctgtgccccagccgggagaaggcccagatcaacatccgggaggaccccaaggagggcatcaagatcgtgggcctgacagagaagacagtgctggtggccctggacacagtgtcctgcctggagcagggcaacaacagcaggacagtggccagcacagccatgaacagccagagcagccgcagccacgccatcttcaccatcagcattgagcagaggaagaagagtgacaagaactgcagcttccgcagcaagctgcacctggtggacctggccggcagcgagcggcagaagaagaccaaggccgagggggaccggctgaaggagggcatcaacatcaacagaggcctgctgtgcctgggcaatgtcatcagcgccctgggagatgacaagaagggcagctttgtgccctacagagacagcaagctgacccggctgctgcaggacagcctgggcggcaacagccacaccctgatgattgcctgtgtgtccccagctgacagcaacctggaggagaccctgagcaccctgcgctatgctgaccgggccaggaagatcaagaacaagcccatcgtgaacatcgacccccacacagctgagctgaaccacctgaagcagcaggtgcagcagctgcaggtgctgctgctgcaggcccatggaggcaccctgcccggcagcatcaatgctgagcccagcgagaacctgcagagcctgatggagaagaaccagagcctggtggaggagaatgagaagctgagccgctgcctgagcaaggccgccggccagacagcccagatgctggagcgcatcatcctgacagagcaggtgaatgagaagctgaatgccaagctggaggagctgcggcagcacgtggcctgcaagctggacctgcagaagctggtggagaccctggaggaccaggagctgaaggaaaatgtggagatcatctgcaacctgcagcagctgatcacccagctgagtgatgagaccgtggcctgcacagctgctgccatcgacacagctgtggaggaggaggcccaggtggagaccagccctgagaccagccgcagcagtgatgccttcaccacccagcacgccctgcaccaggcccagatgagcaaggaggtggtggagctgaacaatgccctggccctgaaggaggccctggtgaggaagatgacccagaatgacaaccagctgcagcccatccagttccagtaccaggacaacatcaagaacctggagctggaggtgatcaacctgcagaaggagaaggaggagctggtgcgggagctgcagacagccaagaagaatgtgaaccaggccaagctgtctgagcaccgccacaagctgctgcaggagctggagggccagattgctgacctgaagaagaagctgaatgagcagagcaagctgctgaagctgaaggagagcacagagaggacagtgtccaagctgaaccaggagatctggatgatgaagaaccagagggtgcagctgatgaggcagatgaaggaggatgctgagaagttccggcagtggaagcagaagaaggacaaggaggtgatccagctgaaggagcgggacaggaagaggcagtatgagctgctgaagctggagaggaacttccagaagcagagctctgtgctgcggaggaagacagaggaggccgctgctgccaacaagaggctgaaggatgccctgcagaagcagcgggaggtgacagacaagaggaaggagacccagagccacggcaaggagggcattgctgcccgggtgaggaactggctgggcaatgaaattgaggtgatggtgtccacagaggaggccaagaggcacctgaatgacctgctggaggacaggaagatcctggcccaggatgtggtgcagctgaaggagaagaaggagagcagagaaaatcctccacccaagctgaggaagtgcaccttcagcctgtctgaggtgcacggccaggtgctggagagcgaggactgcatcaccaagcagatcgagagcctggagacagagatggagctgcggagcgcccagattgctgacctgcagcagaagctgctggatgctgagagtgaagatcggcccaagcagtgctgggagaacatcgccaccatcctggaggccaagtgtgccctgaagtacctgattggagagctggtgagcagcaagatccacgtgaccaagctggagaacagcctgcggcagagcaaggccagctgtgccgacatgcagaagatgctgtttgaggagcagaaccacttcagcgagattgaaacagagctgcaggccgagctggtgaggatggagcagcagcaccaggagaaggtgctgtacctggtgtcccagctgcaggagagccagatggccgagaagcagctggagaagagcgccagcgagaaggagcagcagctggtgtccaccctgcagtgccaggatgaggagctggagaagatgagggaggtgtgtgagcagaaccagcagctgctgcaggagaatgagatcatcaagcagaagctgatcctgctgcaggtggccagccggcagaagcacctgcccaatgacaccctgctgagcccagacagcagctttgagtacatcccccccaagcccaagcccagccgggtgaaggagaagttcctggagcagagcatggacatcgaggacctgaagtactgcagcgagcacagcgtgaatgaacatgaagatggagatggagatggagacagtgatgaaggagatgatgaggagtggaagcccaccaagctggtgaaggtgtccaggaagaacatccagggctgcagctgcaagggctggtgtggcaacaagcagtgtggctgcaggaagcagaagagtgactgtggggtggactgcagctgtgaccccaccaagtgcaggaaccggcagcagggcaaggacagcctgggcaccgtggagcagacccaggacagcgagggcagcttcaagctggaggaccccacagaggtgaccccaggcctgtccttcttcaaccctgtgtgtgccacccccaacagcaagatcctgaaggagatgtgtgacatggagcaggtgctgagcaagaagacagccccagcccccagcccctttgacctgcctgagagcaagcatggagccacagagtaccagcagaacaagcccccaggcaagaagaagaagagggccctggccagcaacaccagcttcttcagcggctgcagccccatcgaggaggaggcccactag

SEQ ID NO: 157081 - DNA, 3099 bp, Artificial Sequence
  Description of Artificial Sequence: Synthetic coding sequence
atggccgagaccaacaatgaatgttccatcaaggtgctgtgccgcttccggcccctgaaccaggccgagatcctgcggggggacaagttcatccccatcttccagggagatgattctgtggtgattggaggcaagccctacgtgtttgacagagtcttcccccccaacaccacccaggagcaggtgtaccacgcctgtgccatgcagatcgtgaaggatgtgctggccggctacaacggcaccatctttgcctacggccagaccagcagcggcaagacccacaccatggagggcaagctgcatgacccccagctgatgggcatcatcccccgcatcgcccgggacatcttcaaccacatctacagcatggatgagaacctggagttccacatcaaggtgtcctactttgagatctacctggacaagatccgggacctgctggatgtgaccaagaccaacctgtctgtgcatgaggacaagaacagagtgccctttgtgaagggctgcacagaaagatttgtgagcagccctgaggagatcctggatgtgattgatgagggcaagagcaacagacatgtggccgtgaccaacatgaatgagcacagcagccgcagccacagcatcttcctgatcaacatcaagcaggagaacatggagacagagcagaagctgagcggcaagctgtacctggtggacctggccggcagcgagaaggtgtccaagacaggagctgagggcgctgtgctggatgaggccaagaacatcaacaagagcctgagcgccctgggcaatgtcatcagcgccctggccgagggcaccaagagctatgtgccctacagagacagcaagatgacccgcatcctgcaggacagcctgggcggcaactgcaggaccaccatgttcatctgctgcagccccagcagctacaatgatgctgagaccaagagcaccctgatgtttggccagagggccaagaccatcaagaacacagcctctgtgaacctggagctgacagctgagcagtggaagaagaagtatgagaaggagaaggagaagaccaaggcccagaaggagaccatcgccaagctggaggccgagctgagccgctggagaaatggagaaaatgtgcctgagacagagcggctggccggggaggaggccgccctgggcgctgagctgtgtgaggagacccctgtgaatgacaacagcagcatcgtggtgagaattgcccctgaggagcggcagaagtatgaggaggagatccggcggctgtacaagcagctggatgacaaggatgatgagatcaaccagcagagccagctgattgagaagctgaagcagcagatgctggaccaggaggagctgctggtgtccaccaggggggacaatgagaaggtgcagcgggagctgagccacctgcagagtgaaaatgatgctgccaaggatgaggtgaaggaggtgctgcaggccctggaggagctggccgtgaactatgaccagaagagccaggaggtggaggagaagagccagcagaaccagctgctggtggatgagctgagccagaaggtggccaccatgctgagcctggagagcgagctgcagaggctgcaggaggtgtctggccaccagaggaagagaattgctgaggtgctgaatggcctgatgaaggacctgtctgagttcagcgtcatcgtgggcaatggagagatcaagctgcctgtggagatcagcggggccatcgaggaggagttcaccgtggcccggctgtacatcagcaagatcaagtctgaggtgaagtctgtggtgaagcgctgccggcagctggagaacctgcaggtggagtgccacaggaagatggaggtgacaggccgggagctgagcagctgccagctgctgatcagccagcacgaggccaagatccgcagcctgacagagtacatgcagagcgtggagctgaagaagaggcacctggaggagagctatgacagcctgagtgatgagctggccaagctgcaggcccaggagaccgtgcatgaggtggccctgaaggacaaggagccagacacccaggatgctgatgaggtgaagaaggccctggagctgcagatggagagccaccgggaggcccaccaccggcagctggcccggctgagagatgagatcaatgagaagcagaagaccattgatgagctgaaggacctgaaccagaagctgcagctggagctggagaagctgcaggccgactatgagaagctgaagtctgaggagcacgagaagagcaccaagctgcaggagctgaccttcctgtatgaaagacatgagcagagcaagcaggacctgaagggcctggaggagaccgtggcccgggagctgcagaccctgcacaacctgaggaagctgtttgtgcaggatgtgaccaccagggtgaagaagtctgctgagatggagcctgaggacagcggcggcatccacagccagaagcagaagatctccttcctggagaacaacctggagcagctgaccaaggtgcacaagcagctggtgcgggacaatgctgacctgcgctgtgagctgcccaagctggagaagaggctgcgggccacagctgagcgggtgaaggccctggagggcgccctgaaggaggccaaggagggcgccatgaaggacaagaggcgctaccagcaggaggtggaccgcatcaaggaggccgtgcgctacaagagcagcggcaagaggggccacagcgcccagatcgccaagcctgtgcggcccggccactacccagccagcagccccaccaacccctacggcaccaggagccctgagtgcatctcctacaccaacagcctcttccagaactaccagaacctgtacctgcaggccacccccagcagcaccagtgacatgtactttgccaacagctgcaccagcagcggggccaccagcagcggcggccccctggccagctaccagaaggccaacatggacaatggaaatgccacagacatcaatgacaacagaagtgacctgccctgtggctatgaagctgaggaccaggccaagctgttccccctgcaccaggagacagctgccagctag

SEQ ID NO: 157082 - DNA, 381 bp, Artificial Sequence
  Description of Artificial Sequence: Synthetic coding sequence
aagagcagcggcaagaggggccacagcgcccagatcgccaagcctgtgcggcccggccactacccagccagcagccccaccaacccctacggcaccaggagccctgagtgcatctcctacaccaacagcctcttccagaactaccagaacctgtacctgcaggccacccccagcagcaccagtgacatgtactttgccaacagctgcaccagcagcggggccaccagcagcggcggccccctggccagctaccagaaggccaacatggacaatggaaatgccacagacatcaatgacaacagaagtgacctgccctgtggctatgaagctgaggaccaggccaagctgttccccctgcaccaggagacagctgccagctag

SEQ ID NO: 157083 - DNA, 2892 bp, Artificial Sequence
  Description of Artificial Sequence: Synthetic coding sequence
atggctgacctggccgagtgcaacatcaaggtgatgtgccgcttccggcccctgaatgaaagtgaggtgaacagaggagacaagtacatcgccaagttccagggcgaggacacagtggtgattgccagcaagccctatgcctttgacagagtcttccagagcagcaccagccaggagcaggtgtacaatgactgtgccaagaagatcgtgaaggatgtgctggagggctacaacggcaccatctttgcctacggccagaccagcagcggcaagacccacaccatggagggcaagctgcatgaccctgagggcatgggcatcatccccagaattgtgcaggacatcttcaactacatctacagcatggatgagaacctggagttccacatcaaggtgtcctactttgagatctacctggacaagatccgggacctgctggatgtgtccaagaccaacctgtctgtgcatgaggacaagaacagagtgccctacgtgaagggctgcacagaaagatttgtgtgcagcccagatgaggtgatggacaccattgatgagggcaagagcaacagacatgtggccgtgaccaacatgaatgagcacagcagccgcagccacagcatcttcctgatcaacgtgaagcaggagaacacccagacagagcagaagctgagcggcaagctgtacctggtggacctggccggcagcgagaaggtgtccaagacaggagctgagggcgctgtgctggatgaggccaagaacatcaacaagagcctgagcgccctgggcaatgtcatcagcgccctggccgagggcagcacctacgtgccctacagagacagcaagatgacccgcatcctgcaggacagcctgggcggcaactgcaggaccaccatcgtcatctgctgcagccccagcagctacaatgaaagtgagaccaagagcaccctgctgtttggccagagggccaagaccatcaagaacacagtgtgtgtgaatgtggagctgacagctgagcagtggaagaagaagtatgagaaggagaaggagaagaacaagatcctgaggaacaccatccagtggctggagaatgagctgaaccgctggagaaatggagaaacagtgcccattgatgagcagtttgacaaggagaaggccaacctggaggccttcaccgtggacaaggacatcaccctgaccaatgacaagccagccacagccatcggggtcatcggcaacttcacagatgctgagaggaggaaatgtgaggaggagatcgccaagctgtacaagcagctggatgacaaggatgaggagatcaaccagcagagccagctggtggagaagctgaagacccagatgctggaccaggaggagctgctggccagcacccggcgggaccaggacaacatgcaggccgagctgaaccggctgcaggccgagaatgatgccagcaaggaggaggtgaaggaggtgctgcaggccctggaggagctggccgtgaactatgaccagaagagccaggaggtggaggacaagaccaaggagtatgagctgctgagtgatgagctgaaccagaagagcgccaccctggccagcattgatgctgagctgcagaagctgaaggagatgaccaaccaccagaagaagagagctgctgagatgatggccagcctgctgaaggacctggccgagattggaattgctgtgggcaacaatgatgtgaagcagcctgagggcaccggcatgattgatgaggagttcaccgtggcccggctgtacatcagcaagatgaagtctgaggtgaagaccatggtgaagcgctgcaagcagctggagagcacccagacagagagcaacaagaagatggaggagaatgagaaggagctggccgcctgccagctgcgcatcagccagcacgaggccaagatcaagagcctgacagagtacctgcagaatgtggagcagaagaagaggcagctggaggagagcgtggatgccctgtctgaggagctggtgcagctgcgggcccaggagaaggtgcatgagatggagaaggagcacctgaacaaggtgcagacagccaatgaggtgaagcaggccgtggagcagcagatccagagccaccgggagacccaccagaagcagatcagcagcctgagagatgaggtggaggccaaggccaagctgatcacagacctgcaggaccagaaccagaagatgatgctggagcaggagcggctgcgggtggagcacgagaagctgaaggccacagaccaggagaagagcaggaagctgcacgagctgactgtgatgcaggaccggcgggagcaggcccggcaggacctgaagggcctggaggagaccgtggccaaggagctgcagaccctgcacaacctgaggaagctgtttgtgcaggacctggccaccagggtgaagaagtctgctgagattgacagtgatgacaccggcggcagcgctgcccagaagcagaagatctccttcctggagaacaacctggagcagctgaccaaggtgcacaagcagctggtgcgggacaatgctgacctgcgctgtgagctgcccaagctggagaagaggctgcgggccacagctgagcgggtgaaggccctggagagcgccctgaaggaggccaaggaaaatgccagccgggacaggaagcgctaccagcaggaggtggaccgcatcaaggaggccgtgcgcagcaagaacatggcccggcggggccacagcgcccagatcgccaagcccatccggcccggccagcaccctgctgccagccccacccaccccagcgccatccggggcggcggggcctttgtgcagaacagccagcctgtggccgtgcggggcggcggcggcaagcaggtgtag

SEQ ID NO: 157084 - DNA, 2583 bp, Artificial Sequence
  Description of Artificial Sequence: Synthetic coding sequence
gggaagctgcatgacccccagctgatgggcatcatccccagaattgcccatgacatctttgaccacatctacagcatggatgagaacctggagttccacatcaaggtgtcctactttgagatctacctggacaagatccgggacctgctggatgtgtccaagaccaacctggccgtgcatgaggacaagaacagagtgccctacgtgaagggctgcacagaaagatttgtgagcagccctgaggaggtgatggatgtgattgatgagggcaaggccaacagacatgtggccgtgaccaacatgaatgagcacagcagccgcagccacagcatcttcctgatcaacatcaagcaggagaatgtggagacagagaagaagctgagcggcaagctgtacctggtggacctggccggcagcgagaaggtgtccaagacaggagctgagggcgctgtgctggatgaggccaagaacatcaacaagagcctgagcgccctgggcaatgtcatcagcgccctggccgagggcaccaagacccacgtgccctacagagacagcaagatgacccgcatcctgcaggacagcctgggcggcaactgcaggaccaccatcgtcatctgctgcagccccagcgtcttcaatgaagctgagaccaagagcaccctgatgtttggccagagggccaagaccatcaagaacacagtgtctgtgaacctggagctgacagctgaggagtggaagaagaagtatgagaaggagaaggagaagaacaagaccctgaagaatgtcatccagcacctggagatggagctgaaccgctggagaaatggagaggccgtgcctgaagatgagcagatcagcgccaaggaccagaagaacctggagccctgtgacaacacccccatcatcgacaacatcgcccctgtggtggccggcatcagcacagaggagaaggagaagtatgatgaggagatcagcagcctgtaccggcagctggatgacaaggatgatgagatcaaccagcagagccagctggccgagaagctgaagcagcagatgctggaccaggatgagctgctggccagcacccggcgggactatgagaagatccaggaggagctgacccggctgcagattgaaaatgaggccgccaaggatgaggtgaaggaggtgctgcaggccctggaggagctggccgtgaactatgaccagaagagccaggaggtggaggacaagacccgggccaatgagcagctgacagatgagctggcccagaagaccaccaccctgaccaccacccagcgggagctgagccagctgcaggagctgagcaaccaccagaagaagagggccacagagatcctgaacctgctgctgaaggacctgggggagatcggcggcatcatcggcaccaatgatgtgaagaccctggctgatgtgaatggagtgattgaggaggagttcaccatggcccggctgtacatcagcaagatgaagtctgaggtgaagagcctggtgaacagaagcaagcagctggagagcgcccagatggacagcaacaggaagatgaatgccagcgagcgggagctggccgcctgccagctgctgatcagccagcacgaggccaagatcaagagcctgacagactacatgcagaacatggagcagaagaggcggcagctggaggagagccaggacagcctgtctgaggagctggccaagctgcgggcccaggagaagatgcatgaggtgtccttccaggacaaggagaaggagcacctgacccggctgcaggatgctgaggagatgaagaaggccctggagcagcagatggagagccaccgggaggcccaccagaagcagctgagccggctgagagatgaaattgaggagaagcagaagatcattgatgagatccgggacctgaaccagaagctgcagctggagcaggagaagctgagcagtgactacaacaagctgaagattgaggaccaggagcgggagatgaagctggagaagctgctgctgctgaatgacaagcgggagcaggcccgggaggacctgaagggcctggaggagaccgtgtcccgggagctgcagaccctgcacaacctgaggaagctgtttgtgcaggacctgaccaccagggtgaagaagtctgtggagctggacaatgatgatggcggcggcagcgctgcccagaagcagaagatctccttcctggagaacaacctggagcagctgaccaaggtgcacaagcagctggtgcgggacaatgctgacctgcgctgtgagctgcccaagctggagaagaggctgcgggccacagctgagcgggtgaaggccctggagagcgccctgaaggaggccaaggaaaatgccatgagggacaggaagcgctaccagcaggaggtggaccgcatcaaggaggccgtgcgggccaagaacatggcccggcgggcccacagcgcccagatcgccaagcccatccggcccggccactacccagccagcagccccacagctgtgcacgccatccggggcggcggcggcagcagcagcaacagcacccactaccagaagtag

SEQ ID NO: 157085 - DNA, 2178 bp, Artificial Sequence
  Description of Artificial Sequence: Synthetic coding sequence
atggccacctacatccacgtgtccaagacaggagctgagggcgctgtgctggatgaggccaagaacatcaacaagagcctgagcgccctgggcaatgtcatcagcgccctggccgagggcaccaagacccacgtgccctacagagacagcaagatgacccgcatcctgcaggacagcctgggcggcaactgcaggaccaccatcgtcatctgctgcagccccagcgtcttcaatgaggccgagaccaagagcaccctgatgtttggccagagggccaagaccatcaagaacacagtgtctgtgaacctggagctgacagctgaggagtggaagaagaagtatgagaaggagaaggagaagaacaagaccctgaagaatgtcatccagcacctggagatggagctgaaccgctggagaaatggagaggccgtgcctgaagatgagcagatcagcgccaaggaccagaagaacctggagccctgtgacaacacccccatcatcgacaacatcgcccctgtggtggccggcatcagcacagaggagaaggagaagtatgatgaggagatcagcagcctgtaccggcagctggatgacaaggatgatgagatcaaccagcagagccagctggccgagaagctgaagcagcagatgctggaccaggatgagctgctggccagcacccggcgggactatgagaagatccaggaggagctgacccggctgcagattgaaaatgaagctgccaaggatgaggtgaaggaggtgctgcaggccctggaggagctggccgtgaactatgaccagaagagccaggaggtggaggacaagacccgggccaatgagcagctgacagatgagctggcccagaagaccaccaccctgaccaccacccagcgggagctgagccagctgcaggagctgagcaaccaccagaagaagagggccacagagatcctgaacctgctgctgaaggacctgggggagattggaggcatcatcggcaccaatgatgtgaagaccctggctgatgtgaatggagtcatcgaggaggagttcaccatggcccggctgtacatcagcaagatgaagtctgaggtgaagagcctggtgaacagaagcaagcagctggagagcgcccagatggacagcaacaggaagatgaatgccagcgagcgggagctggccgcctgccagctgctgatcagccagcacgaggccaagatcaagagcctgacagactacatgcagaacatggagcagaagaggcggcagctggaggagagccaggacagcctgtctgaggagctggccaagctgcgggcccaggagaagatgcatgaggtgtccttccaggacaaggagaaggagcacctgacccggctgcaggatgctgaggagatgaagaaggccctggagcagcagatggagagccaccgggaggcccaccagaagcagctgagccggctgagagatgaaattgaggagaagcagaagatcattgatgagatccgggacctgaaccagaagctgcagctggagcaggagaagctgagcagtgactacaacaagctgaagattgaggaccaggagcgggagatgaagctggagaagctgctgctgctgaatgacaagcgggagcaggcccgggaggacctgaagggcctggaggagaccgtgtcccgggagctgcagaccctgcacaacctgaggaagctgtttgtgcaggacctgaccaccagggtgaagaagtctgtggagctggacaatgatgatggcggcggcagcgctgcccagaagcagaagatctccttcctggagaacaacctggagcagctgaccaaggtgcacaagcagctggtgcgggacaatgctgacctgcgctgtgagctgcccaagctggagaagaggctgcgggccacagctgagcgggtgaaggccctggagagcgccctgaaggaggccaaggaaaatgccatgagggacaggaagcgctaccagcaggaggtggaccgcatcaaggaggccgtgcgggccaagaacatggcccggcgggcccacagcgcccagatcgccaagcccatccggcccggccactacccagccagcagccccacagctgtgcacgccatccggggcggcggcggcagcagcagcaacagcacccactaccagaagtag

SEQ ID NO: 157086 - DNA, 2589 bp, Artificial Sequence
  Description of Artificial Sequence: Synthetic coding sequence
atgtggggcaagctgcatgacccccagctgatgggcatcatccccagaattgcccatgacatctttgaccacatctacagcatggatgagaacctggagttccacatcaaggtgtcctactttgagatctacctggacaagatccgggacctgctggatgtgtccaagaccaacctggccgtgcatgaggacaagaacagagtgccctacgtgaagggctgcacagaaagatttgtgagcagccctgaggaggtgatggatgtgattgatgagggcaaggccaacagacatgtggccgtgaccaacatgaatgagcacagcagccgcagccacagcatcttcctgatcaacatcaagcaggagaatgtggagacagagaagaagctgagcggcaagctgtacctggtggacctggccggcagcgagaaggtgtccaagacaggagctgagggcgctgtgctggatgaggccaagaacatcaacaagagcctgagcgccctgggcaatgtcatcagcgccctggccgagggcaccaagacccacgtgccctacagagacagcaagatgacccgcatcctgcaggacagcctgggcggcaactgcaggaccaccatcgtcatctgctgcagccccagcgtcttcaatgaagctgagaccaagagcaccctgatgtttggccagagggccaagaccatcaagaacacagtgtctgtgaacctggagctgacagctgaggagtggaagaagaagtatgagaaggagaaggagaagaacaagaccctgaagaatgtcatccagcacctggagatggagctgaaccgctggagaaatggagaggccgtgcctgaagatgagcagatcagcgccaaggaccagaagaacctggagccctgtgacaacacccccatcatcgacaacatcgcccctgtggtggccggcatcagcacagaggagaaggagaagtatgatgaggagatcagcagcctgtaccggcagctggatgacaaggatgatgagatcaaccagcagagccagctggccgagaagctgaagcagcagatgctggaccaggatgagctgctggccagcacccggcgggactatgagaagatccaggaggagctgacccggctgcagattgaaaatgaggccgccaaggatgaggtgaaggaggtgctgcaggccctggaggagctggccgtgaactatgaccagaagagccaggaggtggaggacaagacccgggccaatgagcagctgacagatgagctggcccagaagaccaccaccctgaccaccacccagcgggagctgagccagctgcaggagctgagcaaccaccagaagaagagggccacagagatcctgaacctgctgctgaaggacctgggggagatcggcggcatcatcggcaccaatgatgtgaagaccctggctgatgtgaatggagtgattgaggaggagttcaccatggcccggctgtacatcagcaagatgaagtctgaggtgaagagcctggtgaacagaagcaagcagctggagagcgcccagatggacagcaacaggaagatgaatgccagcgagcgggagctggccgcctgccagctgctgatcagccagcacgaggccaagatcaagagcctgacagactacatgcagaacatggagcagaagaggcggcagctggaggagagccaggacagcctgtctgaggagctggccaagctgcgggcccaggagaagatgcatgaggtgtccttccaggacaaggagaaggagcacctgacccggctgcaggatgctgaggagatgaagaaggccctggagcagcagatggagagccaccgggaggcccaccagaagcagctgagccggctgagagatgaaattgaggagaagcagaagatcattgatgagatccgggacctgaaccagaagctgcagctggagcaggagaagctgagcagtgactacaacaagctgaagattgaggaccaggagcgggagatgaagctggagaagctgctgctgctgaatgacaagcgggagcaggcccgggaggacctgaagggcctggaggagaccgtgtcccgggagctgcagaccctgcacaacctgaggaagctgtttgtgcaggacctgaccaccagggtgaagaagtctgtggagctggacaatgatgatggcggcggcagcgctgcccagaagcagaagatctccttcctggagaacaacctggagcagctgaccaaggtgcacaagcagctggtgcgggacaatgctgacctgcgctgtgagctgcccaagctggagaagaggctgcgggccacagctgagcgggtgaaggccctggagagcgccctgaaggaggccaaggaaaatgccatgagggacaggaagcgctaccagcaggaggtggaccgcatcaaggaggccgtgcgggccaagaacatggcccggcgggcccacagcgcccagatcgccaagcccatccggcccggccactacccagccagcagccccacagctgtgcacgccatccggggcggcggcggcagcagcagcaacagcacccactaccagaagtag

SEQ ID NO: 157087 - DNA, 2874 bp, Artificial Sequence
  Description of Artificial Sequence: Synthetic coding sequence
atggctgaccctgctgagtgcagcatcaaggtgatgtgccgcttccggcccctgaatgaagctgagatcctgcggggggacaagttcatccccaagttcaagggagatgagaccgtggtgattggccagggcaagccctacgtgtttgacagagtgctgccccccaacaccacccaggagcaggtgtacaatgcctgtgccaagcagatcgtgaaggatgtgctggagggctacaacggcaccatctttgcctacggccagaccagcagcggcaagacccacaccatggagggcaagctgcatgacccccagctgatgggcatcatcccccgcatcgcccatgacatctttgaccacatctacagcatggatgagaacctggagttccacatcaaggtgtcctactttgagatctacctggacaagatccgggacctgctggatgtgtccaagaccaacctggccgtgcatgaggacaagaacagagtgccctacgtgaagggctgcacagaaagatttgtgagcagccctgaggaggtgatggatgtgattgatgagggcaaggccaacagacatgtggccgtgaccaacatgaatgagcacagcagccgcagccacagcatcttcctgatcaacatcaagcaggagaatgtggagacagagaagaagctgagcggcaagctgtacctggtggacctggccggcagcgagaaggtgtccaagacaggagctgagggcgctgtgctggatgaggccaagaacatcaacaagagcctgagcgccctgggcaatgtcatcagcgccctggccgagggcaccaagacccacgtgccctacagagacagcaagatgacccgcatcctgcaggacagcctgggcggcaactgcaggaccaccatcgtcatctgctgcagccccagcgtcttcaatgaggccgagaccaagagcaccctgatgtttggccagagggccaagaccatcaagaacacagtgtctgtgaacctggagctgacagctgaggagtggaagaagaagtatgagaaggagaaggagaagaacaagaccctgaagaatgtcatccagcacctggagatggagctgaaccgctggagaaatggagaggccgtgcctgaagatgagcagatcagcgccaaggaccagaagaacctggagccctgtgacaacacccccatcatcgacaacatcgcccctgtggtggccggcatcagcacagaggagaaggagaagtatgatgaggagatcagcagcctgtaccggcagctggatgacaaggatgatgagatcaaccagcagagccagctggccgagaagctgaagcagcagatgctggaccaggatgagctgctggccagcacccggcgggactatgagaagatccaggaggagctgacccggctgcagattgaaaatgaagctgccaaggatgaggtgaaggaggtgctgcaggccctggaggagctggccgtgaactatgaccagaagagccaggaggtggaggacaagacccgggccaatgagcagctgacagatgagctggcccagaagaccaccaccctgaccaccacccagcgggagctgagccagctgcaggagctgagcaaccaccagaagaagagggccacagagatcctgaacctgctgctgaaggacctgggggagattggaggcatcatcggcaccaatgatgtgaagaccctggctgatgtgaatggagtcatcgaggaggagttcaccatggcccggctgtacatcagcaagatgaagtctgaggtgaagagcctggtgaacagaagcaagcagctggagagcgcccagatggacagcaacaggaagatgaatgccagcgagcgggagctggccgcctgccagctgctgatcagccagcacgaggccaagatcaagagcctgacagactacatgcagaacatggagcagaagaggcggcagctggaggagagccaggacagcctgtctgaggagctggccaagctgcgggcccaggagaagatgcatgaggtgtccttccaggacaaggagaaggagcacctgacccggctgcaggatgctgaggagatgaagaaggccctggagcagcagatggagagccaccgggaggcccaccagaagcagctgagccggctgagagatgaaattgaggagaagcagaagatcattgatgagatccgggacctgaaccagaagctgcagctggagcaggagaagctgagcagtgactacaacaagctgaagattgaggaccaggagcgggagatgaagctggagaagctgctgctgctgaatgacaagcgggagcaggcccgggaggacctgaagggcctggaggagaccgtgtcccgggagctgcagaccctgcacaacctgaggaagctgtttgtgcaggacctgaccaccagggtgaagaagtctgtggagctggacaatgatgatggcggcggcagcgctgcccagaagcagaagatctccttcctggagaacaacctggagcagctgaccaaggtgcacaagcagctggtgcgggacaatgctgacctgcgctgtgagctgcccaagctggagaagaggctgcgggccacagctgagcgggtgaaggccctggagagcgccctgaaggaggccaaggaaaatgccatgagggacaggaagcgctaccagcaggaggtggaccgcatcaaggaggccgtgcgggccaagaacatggcccggcgggcccacagcgcccagatcgccaagcccatccggcccggccactacccagccagcagccccacagctgtgcacgccatccggggcggcggcggcagcagcagcaacagcacccactaccagaagtag

SEQ ID NO: 157088 - DNA, 219 bp, Artificial Sequence
  Description of Artificial Sequence: Synthetic coding sequence
atggctgaccctgctgagtgcagcatcaaggtgatgtgccgcttccggcccctgaatgaagctgagatcctgcggggggacaagttcatccccaagttcaagggagatgagaccgtggtgattggccagggcaagccctacgtgtttgacagagtgctgccccccaacaccacccaggagcaggtgtacaatgcctgtgccaagcagatcgtgaagtag

SEQ ID NO: 157089 - DNA, 552 bp, Artificial Sequence
  Description of Artificial Sequence: Synthetic coding sequence
atggagcagaggctggccgagttccgggccgccaggaagagagctggcctggccgcccagcccccagctgccagccagggcgcccagaccccaggagagaaggccgaggccgccgccaccctgaaggccgcccctggctggctgaagcgcttcctggtgtggaagcccaggcctgccagcgcccgggcccagcccggcctggtgcaggaggccgcccagccccagggcagcaccagcgagaccccctggaacacagccatccccctgcccagctgctgggaccagagcttcctgaccaacatcaccttcctgaaggtgctgctgtggctggtgctgctgggcctgtttgtggagctggagtttggcctggcctactttgtgctgagcctcttctactggatgtatgtgggcacccggggccctgaggagaagaaggagggggagaagagcgcctacagcgtcttcaaccctggctgtgaggccatccagggcaccctgacagctgagcagctggagcgggagctgcagctgcggcccctggccggccgctag

SEQ ID NO: 157090 - DNA, 2445 bp, Artificial Sequence
  Description of Artificial Sequence: Synthetic coding sequence
atggtgaagcagaccatccagatctttgcccgggtgaagccccctgtgaggaagcaccagcagggcatctacagcattgatgaagatgagaagctgatccccagcctggagatcatcctgccccgggacctggctgatggctttgtgaacaacaagcgggagagctacaagttcaagttccagaggatctttgaccaggatgccaaccaggagaccgtgtttgaaaatattgccaagcctgtggccggctctgtgctggccggctacaacggcaccatctttgcctacggccagacaggcagcggcaagaccttcaccatcaccggcggcgctgagcgctacagcgaccggggcatcatccccaggaccctgagctacatctttgagcagctgcagaaggacagcagcaagatctacaccacccacatctcctacctggagatctacaatgaatgtggctatgacctgctggaccccaggcatgaggccagcagcctggaggacctgcccaaggtgaccatcctggaggaccctgaccagaacatccacctgaagaacctgaccctgcaccaggccaccacagaggaggaggccctgaacctgctcttcctgggggacaccaacaggatgattgctgagacccccatgaaccaggccagcaccaggagccactgcatcttcaccatccacctgagcagcaaggagcccggcagcgccaccgtgagacatgccaagctgcacctggtggacctggccggcagcgagcgggtggccaagacaggagtgggcggccacctgctgacagaggccaagtacatcaacctgagcctgcactacctggagcaggtgatcatcgccctgtctgagaagcacaggagccacatcccctacagaaacagcatgatgacctctgtgctgcgggacagcctgggcggcaactgcatgaccaccatgattgccaccctgagcctggagaagaggaacctggatgagagcatcagcacctgccgctttgcccagagggtggccctgatcaagaatgaagctgtgctgaatgaggagatcaacccccggctggtgatcaagaggctgcagaaggagatccaggagctgaaggatgagctggccatggtgactggagagcagaggacagaggccctgacagaggccgagctgctgcagctggagaagctgatcaccagcttcctggaggaccaggacagcgacagccggctggaggtgggcgctgacatgaggaaggtgcaccactgcttccaccacctgaagaagctgctgaatgacaagaagatcctggagaacaacacagtgtcctctgagagcaaggaccaggactgccaggagcccctgaaggaggaggagtacaggaagctgcgggacatcctgaagcagagggacaatgagatcaacatcctggtgaacatgctgaagaaggagaagaagaaggcccaggaggccctgcacctggccggcatggaccggcgggagttccggcagagccagagcccccccttccggctgggcaaccctgaggagggccagaggatgaggctgagcagcgcccccagccaggcccaggacttcagcatcctgggcaagaggagcagcctgctgcacaagaagattggcatgagggaggagatgagcctgggctgccaggaggcctttgagatcttcaagagggaccacgccgacagcgtgaccattgatgacaacaagcagatcctgaagcagcgcttcagcgaggccaaggccctgggggagagcatcaatgaggcccggagcaagattggccacctgaaggaggagatcacccagaggcacatccagcaggtggccctgggcatcagcgagaacatggctgtgcccctgatgccagaccagcaggaggagaagctgcggagccagctggaggaggagaagaggcgctacaagaccatgttcacccggctgaaggccctgaaggtggagattgagcacctgcagctgctgatggacaaggccaaggtgaagctgcagaaggagtttgaggtgtggtgggccgaggaggccaccaacctgcaggtgaacagccctgctgtgaacagcctggaccacaccaagcccttcctgcagaccagtgacagccagcacgagtggagccagctgctgagcaacaagagcagcggcggctgggaggtgcaggaccagggcaccggccgctttgatgtgtgtgatgtgaatgccaggaagatcctgcccagcccctgccccagcccccacagccagaagcagagcagcaccagcacccccctggaggacagcatccccaagaggcctgtgagcagcatccccctgaccggggacagccagacagacagcgacatcatcgccttcatcaaggcccggcagagcatcctgcagaagcagtgcctgggcagcaactag

SEQ ID NO: 157091 - DNA, 498 bp, Artificial Sequence
  Description of Artificial Sequence: Synthetic coding sequence
atgattgctgagacccccatgaaccaggccagcaccaggagccactgcatcttcaccatccacctgagcagcaaggagcccggcagcgccaccgtgagacatgccaagctgcacctggtggacctggccggcagcgagcgggtggccaagacaggagtgggcggccacctgctgacagaggccaagtacatcaacctgagcctgcactacctggagcaggtgatcatcgccctgtctgagaagcacaggagccacatcccctacagaaattccatgatgacctctgtgctgcgggacagcctgggcggcaactgcatgaccaccatgattgccaccctgagcctggagaagaggaacctggatgagagcatcagcacctgccgctttgcccagagggtggccctgatcaagaatgaggccgtgctgaatgaggagatcaacccccggctgaaggcccccagcagcagtgatggagtgctcttctgcaggaaccagtag

SEQ ID NO: 157092 - DNA, 1962 bp, Artificial Sequence
  Description of Artificial Sequence: Synthetic coding sequence
atggccagcagcctgtatgacctgaagaaggtgaccatcctggaggaccctgaccagaacatccacctgaagaacctgaccctgcaccaggccaccacagaggaggaggccctgaacctgctcttcctgggggacaccaacaggatgattgctgagacccccatgaaccaggccagcaccaggagccactgcatcttcaccatccacctgagcagcaaggagcccggcagcgccaccgtgagacatgccaagctgcacctggtggacctggccggcagcgagcgggtggccaagacaggagtgggcggccacctgctgacagaggccaagtacatcaacctgagcctgcactacctggagcaggtgatcatcgccctgtctgagaagcacaggagccacatcccctacagaaattccatgatgacctctgtgctgcgggacagcctgggcggcaactgcatgaccaccatgattgccaccctgagcctggagaagaggaacctggatgagagcatcagcacctgccgctttgcccagagggtggccctgatcaagaatgaggccgtgctgaatgaggagatcaacccccggctggtgatcaagaggctgcagaaggagatccaggagctgaaggatgagctggccatggtgactggagagcagaggacagaggccctgacagaagctgagctgctgcagctggagaagctgatcaccagcttcctggaggaccaggacagcgacagccggctggaggtgggcgctgacatgaggaaggtgcaccactgcttccaccacctgaagaagctgctgaatgacaagaagatcctggagaacaacacagtgagcagcgagagcaaggaccaggactgccaggagcccctgaaggaggaggagtacaggaagctgcgggacatcctgaagcagagggacaatgagatcaacatcctggtgaacatgctgaagaaggagaagaagaaggcccaggaggccctgcacctggccggcatggacagaagagagttccggcagagccagagcccccccttccggctgggcaaccctgaggagggccagaggatgaggctgagcagcgcccccagccaggcccaggacttcagcatcctgggcaagaggagcagcctgctgcacaagaagattggcatgagggaggagatgagcctgggctgccaggaggcctttgagatcttcaagagggaccatgctgacagcgtgaccattgatgacaacaagcagatcctgaagcagcgcttcagcgaggccaaggccctgggggagagcatcaatgaggcccggagcaagattggccacctgaaggaggagatcacccagaggcacatccagcaggtggccctgggcatcagcgagaacatggctgtgcccctgatgccagaccagcaggaggagaagctgcggagccagctggaggaggagaagaggcgctacaagaccatgttcacccggctgaaggccctgaaggtggagattgagcacctgcagctgctgatggacaaggccaaggtgaagctgcagaaggagtttgaggtgtggtgggccgaggaggccaccaacctgcaggtgaacagccctgctgtgaacagcctggaccacaccaagcccttcctgcagaccagtgacagccagcacgagtggagccagctgctgagcaacaagagcagcggcggctgggaggtgcaggaccagggcaccggccgctttgatgtgtgtgatgtgaatgccaggaagatcctgcccagcccctgccccagcccccacagccagaagcagagcagcaccagcacccccctggaggacagcatccccaagaggcctgtgagcagcatccccctgactggagacagccagacagacagcgacatcatcgccttcatcaaggcccggcagagcatcctgcagaagcagtgcctgggcagcaactag

SEQ ID NO: 157093 - DNA, 2394 bp, Artificial Sequence
  Description of Artificial Sequence: Synthetic coding sequence
atggtgaagcagaccatccagatctttgcccgggtgaagccccctgtgaggaagcaccagcagggcatctacagcattgatgaagatgagaagctgatccccagcctggagatcatcctgccccgggacctggctgatggctttgtgaacaacaagcgggagagctacaagttcaagttccagaggatctttgaccaggatgccaaccaggagaccgtgtttgaaaatattgccaagcctgtggccggctctgtgctggccggctacaacggcaccatctttgcctacggccagacaggcagcggcaagaccttcaccatcaccggcggcgctgagcgctacagcgaccggggcatcatccccaggaccctgagctacatctttgagcagctgcagaaggacagcagcaagatctacaccacccacatctcctacctggagatctacaatgaatgtggctatgacctgctggaccccaggcatgaggccagcagcctggaggacctgcccaaggtgaccatcctggaggaccctgaccagaacatccacctgaagaacctgaccctgcaccaggccaccacagaggaggaggccctgaacctgctcttcctgggggacaccaacaggatgattgctgagacccccatgaaccaggccagcaccaggagccactgcatcttcaccatccacctgagcagcaaggagcccggcagcgccaccgtgagacatgccaagctgcacctggtggacctggccggcagcgagcgggtggccaagacaggagtgggcggccacctgctgacagaggccaagtacatcaacctgagcctgcactacctggagcaggtgatcatcgccctgtctgagaagcacaggagccacatcccctacagaaacagcatgatgacctctgtgctgcgggacagcctgggcggcaactgcatgaccaccatgattgccaccctgagcctggagaagaggaacctggatgagagcatcagcacctgccgctttgcccagagggtggccctgatcaagaatgaagctgtgctgaatgaggagatcaacccccggctggtgatcaagaggctgcagaaggagatccaggagctgaaggatgagctggccatggtgactggagagcagaggacagaggccctgacagaggccgagctgctgcagctggagaagctgatcaccagcttcctggaggaccaggacagcgacagccggctggaggtgggcgctgacatgaggaaggtgcaccactgcttccaccacctgaagaagctgctgaatgacaagaagatcctggagaacaacacagtgtcctctgagagcaaggaccaggactgccaggagcccctgaaggaggaggagtacaggaagctgcgggacatcctgaagcagagggacaatgagatcaacatcctggtgaacatgctgaagaaggagaagaagaaggcccaggaggccctgcacctggccggcatggaccggcgggagttccggcagagccagagcccccccttccggctgggcaaccctgaggagggccagaggatgaggctgagcagcgcccccagccaggcccaggacttcagcatcctgggcaagaggagcagcctgctgcacaagaagattggcatgagggaggagatgagcctgggctgccaggaggcctttgagatcttcaagagggaccacgccgacagcgtgaccattgatgacaacaagcagatcctgaagcagcgcttcagcgaggccaaggccctgggggagagcatcaatgaggcccggagcaagattggcatcagcgagaacatggctgtgcccctgatgccagaccagcaggaggagaagctgcggagccagctggaggaggagaagaggcgctacaagaccatgttcacccggctgaaggccctgaaggtggagattgagcacctgcagctgctgatggacaaggccaaggtgaagctgcagaaggagtttgaggtgtggtgggccgaggaggccaccaacctgcaggtgaacagccctgctgtgaacagcctggaccacaccaagcccttcctgcagaccagtgacagccagcacgagtggagccagctgctgagcaacaagagcagcggcggctgggaggtgcaggaccagggcaccggccgctttgatgtgtgtgatgtgaatgccaggaagatcctgcccagcccctgccccagcccccacagccagaagcagagcagcaccagcacccccctggaggacagcatccccaagaggcctgtgagcagcatccccctgactggagacagccagacagacagcgacatcatcgccttcatcaaggcccggcagagcatcctgcagaagcagtgcctgggcagcaactag

SEQ ID NO: 157094 - DNA, 2394 bp, Artificial Sequence
  Description of Artificial Sequence: Synthetic coding sequence
atggtgaagcagaccatccagatctttgcccgggtgaagccccctgtgaggaagcaccagcagggcatctacagcattgatgaagatgagaagctgatccccagcctggagatcatcctgccccgggacctggctgatggctttgtgaacaacaagcgggagagctacaagttcaagttccagaggatctttgaccaggatgccaaccaggagaccgtgtttgaaaatattgccaagcctgtggccggctctgtgctggccggctacaacggcaccatctttgcctacggccagacaggcagcggcaagaccttcaccatcaccggcggcgctgagcgctacagcgaccggggcatcatccccaggaccctgagctacatctttgagcagctgcagaaggacagcagcaagatctacaccacccacatctcctacctggagatctacaatgaatgtggctatgacctgctggaccccaggcatgaggccagcagcctggaggacctgcccaaggtgaccatcctggaggaccctgaccagaacatccacctgaagaacctgaccctgcaccaggccaccacagaggaggaggccctgaacctgctcttcctgggggacaccaacaggatgattgctgagacccccatgaaccaggccagcaccaggagccactgcatcttcaccatccacctgagcagcaaggagcccggcagcgccaccgtgagacatgccaagctgcacctggtggacctggccggcagcgagcgggtggccaagacaggagtgggcggccacctgctgacagaggccaagtacatcaacctgagcctgcactacctggagcaggtgatcatcgccctgtctgagaagcacaggagccacatcccctacagaaacagcatgatgacctctgtgctgcgggacagcctgggcggcaactgcatgaccaccatgattgccaccctgagcctggagaagaggaacctggatgagagcatcagcacctgccgctttgcccagagggtggccctgatcaagaatgaagctgtgctgaatgaggagatcaacccccggctggtgatcaagaggctgcagaaggagatccaggagctgaaggatgagctggccatggtgactggagagcagaggacagaggccctgacagaggccgagctgctgcagctggagaagctgatcaccagcttcctggaggaccaggacagcgacagccggctggaggtgggcgctgacatgaggaaggtgcaccactgcttccaccacctgaagaagctgctgaatgacaagaagatcctggagaacaacacagtgtcctctgagagcaaggaccaggactgccaggagcccctgaaggaggaggagtacaggaagctgcgggacatcctgaagcagagggacaatgagatcaacatcctggtgaacatgctgaagaaggagaagaagaaggcccaggaggccctgcacctggccggcatggaccggcgggagttccggcagagccagagcccccccttccggctgggcaaccctgaggagggccagaggatgaggctgagcagcgcccccagccaggcccaggacttcagcatcctgggcaagaggagcagcctgctgcacaagaagattggcatgagggaggagatgagcctgggctgccaggaggcctttgagatcttcaagagggaccacgccgacagcgtgaccattgatgacaacaagcagatcctgaagcagcgcttcagcgaggccaaggccctgggggagagcatcaatgaggcccggagcaagattggccacctgaaggaggagatcacccagaggcacatccagcaggtggccctgggcatcagcgagaacatggctgtgcccctgatgccagaccagcaggaggagaagctgcggagccagctggaggaggagaagaggcgctacaagaccatgttcacccggctgaaggccctgaaggtggagattgagcacctgcagctgctgatggacaaggccaaggtgaagctgcagaaggagtttgaggtgtggtgggccgaggaggccaccaacctgcaggtgaacagccctgctgtgaacagcctggaccacaccaagcccttcctgcagaccagtgacagccagcacgagtggagccagctgctgagcaacaagagtgatgtgaatgccaggaagatcctgcccagcccctgccccagcccccacagccagaagcagagcagcaccagcacccccctggaggacagcatccccaagaggcctgtgagcagcatccccctgactggagacagccagacagacagcgacatcatcgccttcatcaaggcccggcagagcatcctgcagaagcagtgcctgggcagcaactag

SEQ ID NO: 157095 - DNA, 747 bp, Artificial Sequence
  Description of Artificial Sequence: Synthetic coding sequence
atgagggaggagatgagcctgggctgccaggaggcctttgagatcttcaagagggaccatgctgacagcgtgaccattgatgacaacaagcagatcctgaagcagcgcttcagcgaggccaaggccctgggggagagcatcaatgaggcccggagcaagattggccacctgaaggaggagatcacccagaggcacatccagcaggtggccctgggcatcagcgagaacatggctgtgcccctgatgccagaccagcaggaggagaagctgcggagccagctggaggaggagaagaggcgctacaagaccatgttcacccggctgaaggccctgaaggtggagattgagcacctgcagctgctgatggacaaggccaaggtgaagctgcagaaggagtttgaggtgtggtgggccgaggaggccaccaacctgcaggtgaacagccctgctgtgaacagcctggaccacaccaagcccttcctgcagaccagtgacagccagcacgagtggagccagctgctgagcaacaagagtgatgtgaatgccaggaagatcctgcccagcccctgccccagcccccacagccagaagcagagcagcaccagcacccccctggaggacagcatccccaagaggcctgtgagcagcatccccctgaccggggacagccagacagacagcgacatcatcgccttcatcaaggcccggcagagcatcctgcagaagcagtgcctgggcagcaactag

SEQ ID NO: 157096 - DNA, 486 bp, Artificial Sequence
  Description of Artificial Sequence: Synthetic coding sequence
acccccatgaaccaggccagcaccaggagccactgcatcttcaccatccacctgagcagcaaggagcccggcagcgccaccgtgagacatgccaagctgcacctggtggacctggccggcagcgagcgggtggccaagacaggagtgggcggccacctgctgacagaggccaagtacatcaacctgagcctgcactacctggagcaggtgatcatcgccctgtctgagaagcacaggagccacatcccctacagaaattccatgatgacctctgtgctgcgggacagcctgggcggcaactgcatgaccaccatgattgccaccctgagcctggagaagaggaacctggatgagagcatcagcacctgccgctttgcccagagggtggccctgatcaagaatgaggccgtgctgaatgaggagatcaacccccggctgaaggcccccagcagcagtgatggagtgctcttctgcaggaaccagtag

SEQ ID NO: 157097 - DNA, 2070 bp, Artificial Sequence
  Description of Artificial Sequence: Synthetic coding sequence
tgaggagctgagcgctacagcgaccggggcatcatccccaggaccctgagctacatctttgagcagctgcagaaggacagcagcaagatctacaccacccacatctcctacctggagatctacaatgaatgtggctatgacctgctggaccccaggcatgaggccagcagcctggaggacctgcccaaggtgaccatcctggaggaccctgaccagaacatccacctgaagaacctgaccctgcaccaggccaccacagaggaggaggccctgaacctgctcttcctgggggacaccaacaggatgattgctgagacccccatgaaccaggccagcaccaggagccactgcatcttcaccatccacctgagcagcaaggagcccggcagcgccaccgtgagacatgccaagctgcacctggtggacctggccggcagcgagcgggtggccaagacaggagtgggcggccacctgctgacagaggccaagtacatcaacctgagcctgcactacctggagcaggtgatcatcgccctgtctgagaagcacaggagccacatcccctacagaaacagcatgatgacctctgtgctgcgggacagcctgggcggcaactgcatgaccaccatgattgccaccctgagcctggagaagaggaacctggatgagagcatcagcacctgccgctttgcccagagggtggccctgatcaagaatgaagctgtgctgaatgaggagatcaacccccggctggtgatcaagaggctgcagaaggagatccaggagctgaaggatgagctggccatggtgactggagagcagaggacagaggccctgacagaggccgagctgctgcagctggagaagctgatcaccagcttcctggaggaccaggacagcgacagccggctggaggtgggcgctgacatgaggaaggtgcaccactgcttccaccacctgaagaagctgctgaatgacaagaagatcctggagaacaacacagtgtcctctgagagcaaggaccaggactgccaggagcccctgaaggaggaggagtacaggaagctgcgggacatcctgaagcagagggacaatgagatcaacatcctggtgaacatgctgaagaaggagaagaagaaggcccaggaggccctgcacctggccggcatggaccggcgggagttccggcagagccagagcccccccttccggctgggcaaccctgaggagggccagaggatgaggctgagcagcgcccccagccaggcccaggacttcagcatcctgggcaagaggagcagcctgctgcacaagaagattggcatgagggaggagatgagcctgggctgccaggaggcctttgagatcttcaagagggaccacgccgacagcgtgaccattgatgacaacaagcagatcctgaagcagcgcttcagcgaggccaaggccctgggggagagcatcaatgaggcccggagcaagattggccacctgaaggaggagatcacccagaggcacatccagcaggtggccctgggcatcagcgagaacatggctgtgcccctgatgccagaccagcaggaggagaagctgcggagccagctggaggaggagaagaggcgctacaagaccatgttcacccggctgaaggccctgaaggtggagattgagcacctgcagctgctgatggacaaggccaaggtgaagctgcagaaggagtttgaggtgtggtgggccgaggaggccaccaacctgcaggtgaacagccctgctgtgaacagcctggaccacaccaagcccttcctgcagaccagtgacagccagcacgagtggagccagctgctgagcaacaagagtgatgtgaatgccaggaagatcctgcccagcccctgccccagcccccacagccagaagcagagcagcaccagcacccccctggaggacagcatccccaagaggcctgtgagcagcatccccctgactggagacagccagacagacagcgacatcatcgccttcatcaaggcccggcagagcatcctgcagaagcagtgcctgggcagcaactag

SEQ ID NO: 157098 - DNA, 2277 bp, Artificial Sequence
  Description of Artificial Sequence: Synthetic coding sequence
atggtgaagcagaccatccagatctttgcccgggtgaagccccctgtgaggaagcaccagcagggcatctacagcattgatgaagatgagaagctgatccccagcctggagatcatcctgccccgggacctggctgatggctttgtgaacaacaagcgggagagctacaagttcaagttccagaggatctttgaccaggatgccaaccaggagaccgtgtttgaaaatattgccaagcctgtggccggctctgtgctggccggctacaacggcaccatctttgcctacggccagacaggcagcggcaagaccttcaccatcaccggcggcgctgagcgctacagcgaccggggcatcatccccaggaccctgagctacatctttgagcagctgcagaaggacagcagcaagatctacaccacccacatctcctacctggagatctacaatgaatgtggctatgacctgctggaccccaggcatgaggccagcagcctggaggacctgcccaaggtgaccatcctggaggaccctgaccagaacatccacctgaagaacctgaccctgcaccaggccaccacagaggaggaggccctgaacctgctcttcctgggggacaccaacaggatgattgctgagacccccatgaaccaggccagcaccaggagccactgcatcttcaccatccacctgagcagcaaggagcccggcagcgccaccgtgagacatgccaagctgcacctggtggacctggccggcagcgagcgggtggccaagacaggagtgggcggccacctgctgacagaggccaagtacatcaacctgagcctgcactacctggagcaggtgatcatcgccctgtctgagaagcacaggagccacatcccctacagaaacagcatgatgacctctgtgctgcgggacagcctgggcggcaactgcatgaccaccatgattgccaccctgagcctggagaagaggaacctggatgagagcatcagcacctgccgctttgcccagagggtggccctgatcaagaatgaagctgtgctgaatgaggagatcaacccccggctggtgatcaagaggctgcagaaggagatccaggagctgaaggatgagctggccatggtgactggagagcagaggacagaggccctgacagaggccgagctgctgcagctggagaagctgatcaccagcttcctggaggaccaggacagcgacagccggctggaggtgggcgctgacatgaggaaggtgcaccactgcttccaccacctgaagaagctgctgaatgacaagaagatcctggagaacaacacagtgtcctctgagagcaaggaccaggactgccaggagcccctgaaggaggaggagtacaggaagctgcgggacatcctgaagcagagggacaatgagatcagcatcctgtctgaggtgatgaagaagctgcccctgtcctggtttgagcggggcatgagggaggagatgagcctgggctgccaggaggcctttgagatcttcaagagggaccacgccgacagcgtgaccattgatgacaacaagcagatcctgaagcagcgcttcagcgaggccaaggccctgggggagagcatcaatgaggcccggagcaagattggccacctgaaggaggagatcacccagaggcacatccagcaggtggccctgggcatcagcgagaacatggctgtgcccctgatgccagaccagcaggaggagaagctgcggagccagctggaggaggagaagaggcgctacaagaccatgttcacccggctgaaggccctgaaggtggagattgagcacctgcagctgctgatggacaaggccaaggtgaagctgcagaaggagtttgaggtgtggtgggccgaggaggccaccaacctgcaggtgaacagccctgctgtgaacagcctggaccacaccaagcccttcctgcagaccagtgacagccagcacgagtggagccagctgctgagcaacaagagcagcggcggctgggaggtgcaggaccagggcaccggccgctttgatgtgtgtgatgtgaatgccaggaagatcctgcccagcccctgccccagcccccacagccagaagcagagcagcaccagcacccccctggaggacagcatccccaagaggcctgtgagcagcatccccctgaccggggacagccagacagacagcgacatcatcgccttcatcaaggcccggcagagcatcctgcagaagcagtgcctgggcagcaactag

SEQ ID NO: 157099 - DNA, 516 bp, Artificial Sequence
  Description of Artificial Sequence: Synthetic coding sequence
atgagggaggagatgagcctgggctgccaggaggcctttgagatcttcaagagggaccatgctgacagcgtgaccattgatgacaacaagcagatcctgaagcagcgcttcagcgaggccaaggccctgggggagagcatcaatgaggcccggagcaagattggccacctgaaggaggagatcacccagaggcacatccagcaggtggccctgggcatcagcgagaacatggctgtgcccctgatgccagaccagcaggaggagaagctgcggagccagctggaggaggagaagaggcgctacaagaccatgttcacccggctgaaggccctgaaggtggagattgagcacctgcagctgctgatggacaaggccaaggtgaagctgcagaaggagtttgaggtgtggtgggccgaggaggccaccaacctgcaggtgaacagccctgctgtgaacagcctggaccacaccaagagcaagatcaaggccctggccgacagcatgagcggcctgtag

SEQ ID NO: 157100 - DNA, 882 bp, Artificial Sequence
  Description of Artificial Sequence: Synthetic coding sequence
atgagggaggagatgagcctgggctgccaggaggcctttgagatcttcaagagggaccatgctgacagcgtgaccattgatgacaacaagcagatcctgaagcagcgcttcagcgaggccaaggccctgggggagagcatcaatgaggcccggagcaagattggccacctgaaggaggagatcacccagaggcacatccagcaggtggccctgggcatcagcgagaacatggctgtgcccctgatgccagaccagcaggaggagaagctgcggagccagctggaggaggagaagaggcgctacaagaccatgttcacccggctgaaggccctgaaggtggagattgagcacctgcagctgctgatggacaaggccaaggtgaagctgcagaaggagtttgaggtgtggtgggccgaggaggccaccaacctgcaggtgaacagccctgctgtgaacagcctggaccacaccaagcccttcctgcagaccagtgacagccagcacgagtggagccagctgctgagcaacaagagcagcggcggctgggaggtgcaggaccagggcaccggccgctttgatgtgtgtgatgtgaatgccaggaagatcctgcccagcccctgccccagcccccacagccagaagcagagcagcaccagcacccccctggaggacagcatccccaagaggcctgtgagcagcatccccctgactggagacagccagacagacagcgacatcatcgccttcatcaaggcccggcagagcatcctgcagaagcagtacctgcagctgctgtgcagcctcttccccaagtctgctgtgagcagcgcccaggccagcaccaacaggaagggcctgagtgatgtgctggtgaccaggtag

SEQ ID NO: 157101 - DNA, 4032 bp, Artificial Sequence
  Description of Artificial Sequence: Synthetic coding sequence
atgggcctggaggcccagaggctgcctggagctgaggaggcccctgtgcgggtggccctgcgggtgcggcccctgctgcccaaggagctgctgcacggccaccagagctgcctgcaggtggagcccggcctgggccgggtgaccctgggccgggacagacacttcggcttccacgtggtgctggctgaagatgctggccaggaggccgtgtaccaggcctgtgtgcagcccctgctggaggccttctttgagggcttcaatgccaccgtgtttgcctacggccagacaggcagcggcaagacctacaccatgggagaggcctctgtggccagcctgctggaggatgagcagggcatcgtgccccgggccatggccgaggccttcaagctgattgatgaaaatgacctgctggactgcctggtgcacgtgtcctacctggaggtgtacaaggaggagttccgggacctgctggaggtgggcacagccagccgggacatccagctgcgggaggatgaaagaggaaatgtggtgctgtgtggggtgaaggaggtggatgtggagggcctggatgaggtgctgagcctgctggagatgggaaatgctgcccggcacactggagccacccacctgaaccacctgagcagccgcagccacacagtgttcaccgtgaccctggagcagaggggccgggcccccagccggctgcccaggcctgcccctggccagctgctggtgtccaagttccactttgtggacctggccggcagcgagcgggtgctgaagacaggcagcactggagagcggctgaaggagagcatccagatcaacagcagcctgctggccctgggcaatgtcatcagcgccctgggggacccccagaggcggggcagccacatcccctacagagacagcaagatcacccgcatcctgaaggacagcctgggcggcaatgccaagacagtgatgattgcctgtgtgagccccagcagcagtgactttgatgagaccctgaacaccctgaactatgccagccgggcccagaacatccggaacagagccaccgtgaactggaggcctgaggccgagcggcccccagaggagacagccagcggggcccggggccccccaagacacaggtctgagacccgcatcatccaccggggcagaagagcccctggccctgccacagccagcgctgctgctgccatgaggctgggcgcagaatgtgcccgctaccgggcctgcacagatgctgcctacagcctgctgcgggagctgcaggccgagcccggcctgcctggagctgctgccaggaaggtgcgggactggctgtgtgctgtggagggggagaggtctgccctgagcagcgccagcggccctgacagcggcatcgagagcgcctctgtggaggaccaggccgcccagggcgccggcggcaggaaggaggatgaaggagcccagcagctgctgaccctgcagaaccaggtggcccggctggaggaggagaacagagacttcctggccgccctggaggatgccatggagcagtacaagctgcagagcgaccggctgcgggagcagcaggaggagatggtggagctgcggctgcggctggagctggtgcggcccggctggggcggcccccggctgctgaatggcctgcccccaggcagctttgtgccccggccccacacagcccccctgggcggggcccacgcccacgtgctgggcatggtgcccccagcctgcctgcctggagatgaggtgggcagcgagcagagaggagagcaggtgaccaacggccgggaggccggggctgagctgctgacagaggtgaaccggctgggcagcggcagcagcgctgccagcgaggaggaggaggaggaggaggagccccccaggaggaccctgcacctgcggaggaaccgcatcagcaactgcagccagagagctggggcccggcccggcagcctgcctgagaggaagggccctgagctgtgcctggaggagctggatgctgccatccctggcagcagagctgtgggcggcagcaaggcccgggtgcaggcccggcaggtgcccccagccacagccagcgagtggaggctggcccaggcccagcagaagatccgggagctggccatcaacatccgcatgaaggaggagctgattggagagctggtgaggacaggcaaggccgcccaggccctgaaccggcagcacagccagaggatccgggagctggagcaggaggccgagcaggtgcgggcagagctgtctgagggccagaggcagctgcgggagctggagggcaaggagctgcaggatgctggggagaggagccggctgcaggagttcagaagaagagtggccgccgcccagagccaggtgcaggtgctgaaggagaagaagcaggccacagagcggctggtgtccctgagcgcccagagcgagaagaggctgcaggagctggagagaaatgtgcagctgatgaggcagcagcagggccagctgcagaggcggctgcgggaggagacagagcagaagaggcggctggaggccgagatgagcaagaggcagcaccgggtgaaggagctggagctgaagcatgagcagcagcagaagatcctgaagatcaagacagaggagattgctgccttccagaggaagagaagaagtggcagcaatggatctgtggtgtccctggagcagcagcagaagattgaggagcagaagaagtggctggaccaggagatggagaaggtgctgcagcagaggcgggccctggaggagctgggggaggagctgcacaagcgggaggccatcctggccaagaaggaggccctgatgcaggagaagacaggcctggagagcaagaggctgcggagcagccaggccctgaatgaagatattgtgcgggtgagcagccggctggagcacctggagaaggagctgtctgagaagagcggccagctgcggcagggcagcgcccagagccagcagcagatccggggggagattgacagcctgcggcaggagaaggacagcctgctgaagcagaggctggagattgatggcaagctgcggcagggcagcctgctgagccctgaggaggagaggaccctcttccagctggatgaggccatcgaggccctggatgctgccatcgagtacaagaatgaggccatcacctgccggcagagggtgctgcgggccagcgccagcctgctgagccagtgtgagatgaacctgatggccaagctgagctacctgagcagcagcgagacccgggccctgctgtgcaagtactttgacaaggtggtgaccctgcgggaggagcagcaccagcagcagatcgccttcagcgagctggagatgcagctggaggagcagcagaggctggtgtactggctggaggtggccctggagcggcagaggctggagatggaccggcagctgaccctgcagcagaaggagcacgagcagaacatgcagctgctgctgcagcagagccgggaccacctgggggagggcctggccgacagccggcggcagtatgaggcccgcatccaggccctggagaaggagctgggccgctacatgtggatcaaccaggagctgaagcagaagctgggcggcgtgaatgctgtgggccacagccggggcggggagaagaggagcctgtgcagcgagggccggcaggcccctggaaatgaagatgagctgcacctggcccctgagctgctgtggctgagccccctgacagaaggagcccccaggacccgggaggagacccgggacctggtgcacgcccccctgcccctgacctggaagaggagcagcctgtgtggggaggagcagggcagccctgaggagctgcggcagcgggaggccgctgagcccctggtgggccgggtgctgcctgtgggggaggccggcctgccctggaactttggccccctgagcaagccccggcgggagctgcggcgggccagccctggcatgattgatgtgaggaagaaccccctgtag

SEQ ID NO: 157102 - DNA, 2022 bp, Artificial Sequence
  Description of Artificial Sequence: Synthetic coding sequence
atggacccccagaggagccccctgctggaggtgaagggcaacatcgagctgaagaggcccctcatcaaggcccccagccagctgcccctgagcggcagccggctgaagagaagaccagaccagatggaggatggcctggagcctgagaagaagaggacccggggcctgggcgccaccaccaagatcaccaccagccacccccgggtgcccagcctgaccaccgtgccccagacccagggccagaccacagcccagaaggtgtccaagaagacaggcccccgctgcagcacagccatcgccaccggcctgaagaaccagaagcctgtgcctgctgtgcctgtgcagaagagcggcaccagcggcgtgccccccatggccggcggcaagaagcccagcaagaggcctgcctgggacctgaagggccagctgtgtgacctgaatgctgagctgaagcgctgccgggagaggacccagaccctggaccaggagaaccagcagctgcaggaccagctgagagatgcccagcagcaggtgaaggccctgggcacagagaggaccaccctggagggccacctggccaaggtgcaggcccaggccgagcagggccagcaggagctgaagaacctgcgggcctgtgtgctggagctggaggagcggctgagcacccaggagggcctggtgcaggagctgcagaagaagcaggtggagctgcaggaggagcggcggggcctgatgagccagctggaggagaaggagcggcggctgcagaccagcgaggccgccctgagcagcagccaggccgaggtggccagcctgcggcaggagaccgtggcccaggccgccctgctgacagagcgggaggagcggctgcacggcctggagatggagcggcggcggctgcacaaccagctgcaggagctgaagggcaacatccgggtcttctgccgggtgcggcctgtgctgcccggggagcccaccccacctcctggcctgctgctcttccccagcggccctgggggccccagcgacccccccacccggctgagcctgagcagaagtgatgagcggcggggcaccctgagcggggccccagccccacccaccaggcatgacttctcctttgacagagtcttccccccaggcagcggccaggatgaggtgtttgaggagatcgccatgctggtgcagagcgccctggatggctaccctgtgtgcatctttgcctacggccagacaggcagcggcaagaccttcaccatggagggcggccctggaggagacccccagctggagggcctcatcccccgggccctgcggcacctgttctctgtggcccaggagctgagcggccagggctggacctacagctttgtggccagctatgtggagatctacaatgagaccgtgcgggacctgctggccaccggcaccaggaagggccagggcggggagtgtgagatccggcgggccggccctggcagcgaggagctgactgtgaccaatgcccgctacgtgcctgtgtcctgtgagaaggaggtggatgccctgctgcacctggcccggcagaacagagctgtggccaggacagcccagaatgaaagaagcagccgcagccacagcgtcttccagctgcagatctctggagagcacagcagccggggcctgcagtgtggggcccccctgagcctggtggacctggccggcagcgagcggctggaccccggcctggccctgggccctggagagcgggagcggctgcgggagacccaggccatcaacagcagcctgagcaccctgggcctggtgatcatggccctgagcaacaaggagagccacgtgccctacagaaacagcaagctgacctacctgctgcagaacagcctgggcggcagcgccaagatgctgatgtttgtgaacatcagccccctggaggagaatgtgtctgagagcctgaacagcctgcgctttgccagcaaggtgaaccagtgtgtgattggaacagcccaggccaacaggaagtag

SEQ ID NO: 157103 - DNA, 612 bp, Artificial Sequence
  Description of Artificial Sequence: Synthetic coding sequence
atggacccccagaggagccccctgctggaggtgaagggcaacatcgagctgaagaggcccctcatcaaggcccccagccagctgcccctgagcggcagccggctgaagagaagaccagaccagatggaggatggcctggagcctgagaagaagaggacccggggcctgggcgccaccaccaagatcaccaccagccacccccgggtgcccagcctgaccaccgtgccccagacccagggccagaccaccggccccagcagccaccccctgccctggcagtgccaccaccagcccttcctggtgacagaccccggcggccgctcctggggccctggccagaagtggcaccggctgcacctgtggtgcaccagcgcccagaaggtgtccaagaagacaggcccccgctgcagcacagccatcgccaccggcctgaagaaccagaagcctgtgcctgctgtgcctgtgcagaagagcggcaccagcggcgtgccccccatggccggcggcaagaagcccagcaagaggcctgcctgggacctgaagggccagctgtgtgacctgaatgctgagctgaagcgctgccgggagaggacccagaccctggaccagtag

SEQ ID NO: 157104 - DNA, 612 bp, Artificial Sequence
  Description of Artificial Sequence: Synthetic coding sequence
atggacccccagaggagccccctgctggaggtgaagggcaacatcgagctgaagaggcccctcatcaaggcccccagccagctgcccctgagcggcagccggctgaagagaagaccagaccagatggaggatggcctggagcctgagaagaagaggacccggggcctgggcgccaccaccaagatcaccaccagccacccccgggtgcccagcctgaccaccgtgccccagacccagggccagaccaccggccccagcagccaccccctgccctggcagtgccaccaccagcccttcctggagacagaccccggcggccgctcctggggccctggccagaagtggcaccggctgcacctgtggtgcaccagcgcccagaaggtgtccaagaagacaggcccccgctgcagcacagccatcgccaccggcctgaagaaccagaagcctgtgcctgctgtgcctgtgcagaagagcggcaccagcggcgtgccccccatggccggcggcaagaagcccagcaagaggcctgcctgggacctgaagggccagctgtgtgacctgaatgctgagctgaagcgctgccgggagaggacccagaccctggaccagtag

SEQ ID NO: 157105 - DNA, 2022 bp, Artificial Sequence; identical to SEQ ID NO: 157102
  Description of Artificial Sequence: Synthetic coding sequence

SEQ ID NO: 157106 - DNA, 2022 bp, Artificial Sequence; identical to SEQ ID NO: 157102
  Description of Artificial Sequence: Synthetic coding sequence

SEQ ID NO: 157107 - DNA, 612 bp, Artificial Sequence; identical to SEQ ID NO: 157104
  Description of Artificial Sequence: Synthetic coding sequence

SEQ ID NO: 157108 - DNA, 2502 bp, Artificial Sequence
  Description of Artificial Sequence: Synthetic coding sequence
atggtgcccagcaggaggacctggaacctgggcgccacccccagcctgcggggcctgtggagggtgggccgggcccctgagcctgagcccggcatggcccggcctgccccagccccagccagccctgctgcccggcccttcccccacacaggccctggccgcctgaggacaggccggggcaaggacacccctgtgtgtggagatgaggacagcagcgcccggtctgctgcccggcctgccctggcccagtgccgggccctgtctgtggactgggccggccctggcagcccccacggcctgtacctgaccctgcaggtggagcacctgaaggagaagctgatcagccaggcccaggaggtgtcccggctgcggtctgagctgggcggcacagacctggagaagcaccgggacctgctgatggtggagaatgaaaggctgcggcaggagatgagaagatgtgaggccgagctgcaggagctgcggaccaagccagctggcccctgccccggctgtgagcacagccaggagagcgcccagctgcgggacaagctgagccagctgcagctggagatggccgagagcaagggcatgctgtctgagctgaacctggaggtgcagcagaagacagaccggctggccgaggtggagctgcggctgaaggactgcctggccgagaaggcccaggaggaggagcggctgagccggcggctgcgggacagccatgagaccatcgccagcctgcgggcccagagcccccctgtgaagtatgtgatcaagacagtggaggtggagagcagcaagaccaagcaggccctgtctgagagccaggccaggaaccagcacctgcaggagcaggtggccatgcagaggcaggtgctgaaggagatggagcagcagctgcagagcagccaccagctgacagcccggctgcgggcccagatcgccatgtatgaaagtgagctggagcgggcccacggccagatgctggaggagatgcagagcctggaggaggacaagaacagagccatcgaggaggcctttgcccgggcccaggtggagatgaaggctgtgcatgagaacctggccggcgtgaggaccaacctgctgaccctgcagcctgccctgcggaccctgaccaatgactacaacggcctgaagaggcaggtgcggggcttccccctgctgctgcaggaggccctgcggtctgtgaaggccgagatcggccaggccatcgaggaggtgaacagcaacaaccaggagctgctgaggaagtaccgccgggagctgcagctgaggaagaagtgccacaatgagctggtgcggctgaagggcaacatccgggtgattgcccgggtgcggcctgtgaccaaggaggatggagagggccctgaggccaccaatgctgtgacctttgatgctgatgatgacagcatcatccacctgctgcacaagggcaagcctgtgtcctttgagctggacaaggtgttcagcccccaggccagccagcaggatgtgttccaggaggtgcaggccctggtgaccagctgcattgatggcttcaacgtgtgcatctttgcctacggccagacaggagctgggaagacctacaccatggagggcacagcagaaaatcctggcatcaaccagagggccctgcagctgctcttcagcgaggtgcaggagaaggccagtgactgggagtacaccatcaccgtgtctgctgctgagatctacaatgaggtgctgcgggacctgctgggcaaggagccccaggagaagctggagatccggctgtgcccagatggcagcggccagctgtatgtgcccggcctgacagagttccaggtgcagagcgtggatgacatcaacaaggtgtttgaatttggccacaccaacagaaccacagagttcaccaacctgaatgagcacagcagccgcagccacgccctgctgattgtgacagtgcggggcgtggactgcagcacaggcctgcggaccaccgggaagctgaacctggtggacctggccggcagcgagcgggtgggcaagagcggggctgagggcagccggctgcgggaggcccagcacatcaacaagagcctgagcgccctgggagatgtgattgctgccctgcggagccggcagggccacgtgcccttcaggaacagcaagctgacctacctgctgcaggacagcctgagcggggacagcaagaccctgatggtggtgcaggtgtcccctgtggagaagaacaccagcgagaccctgtacagcctgaagtttgctgagcgggtgcgctctgtggagctgggccctggcctgcggcgggcagagctgggctcctggagcagccaggagcacctggagtgggagcccgcctgccagaccccccagcccagcgcccgggcccacagcgcccccagcagcggcaccagcagcaggcctggcagcatccggaggaagctgcagcccagcggcaagagccggcccctgcctgtgtag

SEQ ID NO: 157109 - DNA, 2064 bp, Artificial Sequence
  Description of Artificial Sequence: Synthetic coding sequence
atggtggagaatgaaaggctgcggcaggagatgaggcgctgtgaggccgagctgcaggagctgcggaccaagccagctggcccctgccccggctgtgagcacagccaggagagcgcccagctgcgggacaagctgagccagctgcagctggagatggccgagagcaagggcatgctgtctgagctgaacctggaggtgcagcagaagacagaccggctggccgaggtggagctgcggctgaaggactgcctggccgagaaggcccaggaggaggagcggctgagccggcggctgcgggacagccatgagaccatcgccagcctgcgggcccagagcccccctgtgaagtatgtgatcaagacagtggaggtggagagcagcaagaccaagcaggccctgtctgagagccaggccaggaaccagcacctgcaggagcaggtggccatgcagaggcaggtgctgaaggagatggagcagcagctgcagagcagccaccagctgacagcccggctgcgggcccagatcgccatgtatgagagcgagctggagcgggcccacggccagatgctggaggagatgcagagcctggaggaggacaagaacagagccatcgaggaggcctttgcccgggcccaggtggagatgaaggctgtgcatgagaacctggccggcgtgaggaccaacctgctgaccctgcagcctgccctgcggaccctgaccaatgactacaacggcctgaagaggcaggtgcggggcttccccctgctgctgcaggaggccctgcggtctgtgaaggccgagatcggccaggccatcgaggaggtgaacagcaacaaccaggagctgctgaggaagtacagaagagagctgcagctgaggaagaagtgccacaatgagctggtgcggctgaagggcaacatccgggtcatcgcccgggtgcggcctgtgaccaaggaggatggagagggccctgaggccaccaatgctgtgacctttgatgctgatgatgacagcatcatccacctgctgcacaagggcaagcctgtgtcctttgagctggacaaggtgttcagcccccaggccagccagcaggatgtgttccaggaggtgcaggccctggtgaccagctgcattgatggcttcaacgtgtgcatctttgcctacggccagacaggagctgggaagacctacaccatggagggcacagctgagaaccctggcatcaaccagagggccctgcagctgctcttcagcgaggtgcaggagaaggccagtgactgggagtacaccatcaccgtgtctgctgctgagatctacaatgaggtgctgcgggacctgctgggcaaggagccccaggagaagctggagatccggctgtgcccagatggcagcggccagctgtatgtgcccggcctgacagagttccaggtgcagagcgtggatgacatcaacaaggtgtttgaatttggccacaccaacagaaccacagagttcaccaacctgaatgagcacagcagccgcagccacgccctgctgattgtgacagtgcggggcgtggactgcagcacaggcctgcggaccaccgggaagctgaacctggtggacctggccggcagcgagcgggtgggcaagtctggagctgagggcagccggctgcgggaggcccagcacatcaacaagagcctgagcgccctgggagatgtgattgctgccctgcggagccggcagggccacgtgcccttcaggaacagcaagctgacctacctgctgcaggacagcctgagcggggacagcaagaccctgatggtggtgcaggtgtcccctgtggagaagaacaccagcgagaccctgtacagcctgaagtttgctgagcgggtgcgctctgtggagctgggccctggcctgcggcgggcagagctgggctcctggagcagccaggagcacctggagtgggagcccgcctgccagaccccccagcccagcgcccgggcccacagcgcccccagcagcggcaccagcagccggcccggcagcatccggaggaagctgcagcccagcgcctag

SEQ ID NO: 157110 - DNA, 2481 bp, Artificial Sequence
  Description of Artificial Sequence: Synthetic coding sequence
atggtgcccagcaggaggacctggaacctgggcgccacccccagcctgcggggcctgtggagggtgggccgggcccctgagcctgagcccggcatggcccggcctgccccagccccagccagccctgctgcccggcccttcccccacacaggccctggccgcctgaggacaggccggggcaaggacacccctgtgtgtggagatgaggacagcagcgcccggtctgctgcccggcctgccctggcccagtgccgggccctgtctgtggactgggccggccctggcagcccccacggcctgtacctgaccctgcaggtggagcacctgaaggagaagctgatcagccaggcccaggaggtgtcccggctgcggtctgagctgggcggcacagacctggagaagcaccgggacctgctgatggtggagaatgaaaggctgcggcaggagatgagaagatgtgaggccgagctgcaggagctgcggaccaagccagctggcccctgccccggctgtgagcacagccaggagagcgcccagctgcgggacaagctgagccagctgcagctggagatggccgagagcaagggcatgctgtctgagctgaacctggaggtgcagcagaagacagaccggctggccgaggtggagctgcggctgaaggactgcctggccgagaaggcccaggaggaggagcggctgagccggcggctgcgggacagccatgagaccatcgccagcctgcgggcccagagcccccctgtgaagtatgtgatcaagacagtggaggtggagagcagcaagaccaagcaggccctgtctgagagccaggccaggaaccagcacctgcaggagcaggtggccatgcagaggcaggtgctgaaggagatggagcagcagctgcagagcagccaccagctgacagcccggctgcgggcccagatcgccatgtatgaaagtgagctggagcgggcccacggccagatgctggaggagatgcagagcctggaggaggacaagaacagagccatcgaggaggcctttgcccgggcccaggtggagatgaaggctgtgcatgagaacctggccggcgtgaggaccaacctgctgaccctgcagcctgccctgcggaccctgaccaatgactacaacggcctgaagaggcaggtgcggggcttccccctgctgctgcaggaggccctgcggtctgtgaaggccgagatcggccaggccatcgaggaggtgaacagcaacaaccaggagctgctgaggaagtaccgccgggagctgcagctgaggaagaagtgccacaatgagctggtgcggctgaagggcaacatccgggtgattgcccgggtgcggcctgtgaccaaggaggatggagagggccctgaggccaccaatgctgtgacctttgatgctgatgatgacagcatcatccacctgctgcacaagggcaagcctgtgtcctttgagctggacaaggtgttcagcccccaggccagccagcaggatgtgttccaggaggtgcaggccctggtgaccagctgcattgatggcttcaacgtgtgcatctttgcctacggccagacaggagctgggaagacctacaccatggagggcacagcagaaaatcctggcatcaaccagagggccctgcagctgctcttcagcgaggtgcaggagaaggccagtgactgggagtacaccatcaccgtgtctgctgctgagatctacaatgaggtgctgcgggacctgctgggcaaggagccccaggagaagctggagatccggctgtgcccagatggcagcggccagctgtatgtgcccggcctgacagagttccaggtgcagagcgtggatgacatcaacaaggtgtttgaatttggccacaccaacagaaccacagagttcaccaacctgaatgagcacagcagccgcagccacgccctgctgattgtgacagtgcggggcgtggactgcagcacaggcctgcggaccaccgggaagctgaacctggtggacctggccggcagcgagcgggtgggcaagagcggggctgagggcagccggctgcgggaggcccagcacatcaacaagagcctgagcgccctgggagatgtgattgctgccctgcggagccggcagggccacgtgcccttcaggaacagcaagctgacctacctgctgcaggacagcctgagcggggacagcaagaccctgatggtggtgcaggtgtcccctgtggagaagaacaccagcgagaccctgtacagcctgaagtttgctgagcgggtgcgctctgtggagctgggccctggcctgcggcgggcagagctgggctcctggagcagccaggagcacctggagtgggagcccgcctgccagaccccccagcccagcgcccgggcccacagcgcccccagcagcggcaccagcagcaggcctggcagcatccggaggaagctgcagcccagcgcctag

SEQ ID NO: 157111 - DNA, 2307 bp, Artificial Sequence
  Description of Artificial Sequence: Synthetic coding sequence
atggtgctgaggatggtggaggccatgagccagctgcaggatgagaagacccagctgcaggaggagctggtggtgctgcaggagcggctggccctgcgggacagcgaccagcaggccaccagcacccagctgcagaaccaggtggagcacctgaaggagaagctgatcagccaggcccaggaggtgtcccggctgcggtctgagctgggcggcacagacctggagaagcaccgggacctgctgatggtggagaatgaaaggctgcggcaggagatgagaagatgtgaggccgagctgcaggagctgcggaccaagccagctggcccctgccccggctgtgagcacagccaggagagcgcccagctgcgggacaagctgagccagctgcagctggagatggccgagagcaagggcatgctgtctgagctgaacctggaggtgcagcagaagacagaccggctggccgaggtggagctgcggctgaaggactgcctggccgagaaggcccaggaggaggagcggctgagccggcggctgcgggacagccatgagaccatcgccagcctgcgggcccagagcccccctgtgaagtatgtgatcaagacagtggaggtggagagcagcaagaccaagcaggccctgtctgagagccaggccaggaaccagcacctgcaggagcaggtggccatgcagaggcaggtgctgaaggagatggagcagcagctgcagagcagccaccagctgacagcccggctgcgggcccagatcgccatgtatgaaagtgagctggagcgggcccacggccagatgctggaggagatgcagagcctggaggaggacaagaacagagccatcgaggaggcctttgcccgggcccaggtggagatgaaggctgtgcatgagaacctggccggcgtgaggaccaacctgctgaccctgcagcctgccctgcggaccctgaccaatgactacaacggcctgaagaggcaggtgcggggcttccccctgctgctgcaggaggccctgcggtctgtgaaggccgagatcggccaggccatcgaggaggtgaacagcaacaaccaggagctgctgaggaagtaccgccgggagctgcagctgaggaagaagtgccacaatgagctggtgcggctgaagggcaacatccgggtgattgcccgggtgcggcctgtgaccaaggaggatggagagggccctgaggccaccaatgctgtgacctttgatgctgatgatgacagcatcatccacctgctgcacaagggcaagcctgtgtcctttgagctggacaaggtgttcagcccccaggccagccagcaggatgtgttccaggaggtgcaggccctggtgaccagctgcattgatggcttcaacgtgtgcatctttgcctacggccagacaggagctgggaagacctacaccatggagggcacagcagaaaatcctggcatcaaccagagggccctgcagctgctcttcagcgaggtgcaggagaaggccagtgactgggagtacaccatcaccgtgtctgctgctgagatctacaatgaggtgctgcgggacctgctgggcaaggagccccaggagaagctggagatccggctgtgcccagatggcagcggccagctgtatgtgcccggcctgacagagttccaggtgcagagcgtggatgacatcaacaaggtgtttgaatttggccacaccaacagaaccacagagttcaccaacctgaatgagcacagcagccgcagccacgccctgctgattgtgacagtgcggggcgtggactgcagcacaggcctgcggaccaccgggaagctgaacctggtggacctggccggcagcgagcgggtgggcaagagcggggctgagggcagccggctgcgggaggcccagcacatcaacaagagcctgagcgccctgggagatgtgattgctgccctgcggagccggcagggccacgtgcccttcaggaacagcaagctgacctacctgctgcaggacagcctgagcggggacagcaagaccctgatggtggtgcaggtgtcccctgtggagaagaacaccagcgagaccctgtacagcctgaagtttgctgagcgggtgcgctctgtggagctgggccctggcctgcggcgggcagagctgggctcctggagcagccaggagcacctggagtgggagcccgcctgccagaccccccagcccagcgcccgggcccacagcgcccccagcagcggcaccagcagcaggcctggcagcatccggaggaagctgcagcccagcgcctag

SEQ ID NO: 157112 - DNA, 2175 bp, Artificial Sequence
  Description of Artificial Sequence: Synthetic coding sequence
atgatcaaggtggagcacctgaaggagaagctgatcagccaggcccaggaggtgtcccggctgcggtctgagctgggcggcacagacctggagaagcaccgggacctgctgatggtggagaatgaaaggctgcggcaggagatgagaagatgtgaggccgagctgcaggagctgcggaccaagccagctggcccctgccccggctgtgagcacagccaggagagcgcccagctgcgggacaagctgagccagctgcagctggagatggccgagagcaagggcatgctgtctgagctgaacctggaggtgcagcagaagacagaccggctggccgaggtggagctgcggctgaaggactgcctggccgagaaggcccaggaggaggagcggctgagccggcggctgcgggacagccatgagaccatcgccagcctgcgggcccagagcccccctgtgaagtatgtgatcaagacagtggaggtggagagcagcaagaccaagcaggccctgtctgagagccaggccaggaaccagcacctgcaggagcaggtggccatgcagaggcaggtgctgaaggagatggagcagcagctgcagagcagccaccagctgacagcccggctgcgggcccagatcgccatgtatgaaagtgagctggagcgggcccacggccagatgctggaggagatgcagagcctggaggaggacaagaacagagccatcgaggaggcctttgcccgggcccaggtggagatgaaggctgtgcatgagaacctggccggcgtgaggaccaacctgctgaccctgcagcctgccctgcggaccctgaccaatgactacaacggcctgaagaggcaggtgcggggcttccccctgctgctgcaggaggccctgcggtctgtgaaggccgagatcggccaggccatcgaggaggtgaacagcaacaaccaggagctgctgaggaagtaccgccgggagctgcagctgaggaagaagtgccacaatgagctggtgcggctgaagggcaacatccgggtgattgcccgggtgcggcctgtgaccaaggaggatggagagggccctgaggccaccaatgctgtgacctttgatgctgatgatgacagcatcatccacctgctgcacaagggcaagcctgtgtcctttgagctggacaaggtgttcagcccccaggccagccagcaggatgtgttccaggaggtgcaggccctggtgaccagctgcattgatggcttcaacgtgtgcatctttgcctacggccagacaggagctgggaagacctacaccatggagggcacagcagaaaatcctggcatcaaccagagggccctgcagctgctcttcagcgaggtgcaggagaaggccagtgactgggagtacaccatcaccgtgtctgctgctgagatctacaatgaggtgctgcgggacctgctgggcaaggagccccaggagaagctggagatccggctgtgcccagatggcagcggccagctgtatgtgcccggcctgacagagttccaggtgcagagcgtggatgacatcaacaaggtgtttgaatttggccacaccaacagaaccacagagttcaccaacctgaatgagcacagcagccgcagccacgccctgctgattgtgacagtgcggggcgtggactgcagcacaggcctgcggaccaccgggaagctgaacctggtggacctggccggcagcgagcgggtgggcaagagcggggctgagggcagccggctgcgggaggcccagcacatcaacaagagcctgagcgccctgggagatgtgattgctgccctgcggagccggcagggccacgtgcccttcaggaacagcaagctgacctacctgctgcaggacagcctgagcggggacagcaagaccctgatggtggtgcaggtgtcccctgtggagaagaacaccagcgagaccctgtacagcctgaagtttgctgagcgggtgcgctctgtggagctgggccctggcctgcggcgggcagagctgggctcctggagcagccaggagcacctggagtgggagcccgcctgccagaccccccagcccagcgcccgggcccacagcgcccccagcagcggcaccagcagcaggcctggcagcatccggaggaagctgcagcccagcgcctag

SEQ ID NO: 157113 - DNA, 2547 bp, Artificial Sequence
  Description of Artificial Sequence: Synthetic coding sequence
atgtgtgccagcgcctgcaaggacacagctgcctggtgcccagaggaggccgctgagccccaggccatggtgcccagcaggaggacctggaacctgggcgccacccccagcctgcggggcctgtggagggtgggccgggcccctgagcctgagcccggcatggcccggcctgccccagccccagccagccctgctgcccggcccttcccccacacaggccctggccgcctgaggacaggccggggcaaggacacccctgtgtgtggagatgaggacagcagcgcccggtctgctgcccggcctgccctggcccagtgccgggccctgtctgtggactgggccggccctggcagcccccacggcctgtacctgaccctgcaggtggagcacctgaaggagaagctgatcagccaggcccaggaggtgtcccggctgcggtctgagctgggcggcacagacctggagaagcaccgggacctgctgatggtggagaatgaaaggctgcggcaggagatgagaagatgtgaggccgagctgcaggagctgcggaccaagccagctggcccctgccccggctgtgagcacagccaggagagcgcccagctgcgggacaagctgagccagctgcagctggagatggccgagagcaagggcatgctgtctgagctgaacctggaggtgcagcagaagacagaccggctggccgaggtggagctgcggctgaaggactgcctggccgagaaggcccaggaggaggagcggctgagccggcggctgcgggacagccatgagaccatcgccagcctgcgggcccagagcccccctgtgaagtatgtgatcaagacagtggaggtggagagcagcaagaccaagcaggccctgtctgagagccaggccaggaaccagcacctgcaggagcaggtggccatgcagaggcaggtgctgaaggagatggagcagcagctgcagagcagccaccagctgacagcccggctgcgggcccagatcgccatgtatgaaagtgagctggagcgggcccacggccagatgctggaggagatgcagagcctggaggaggacaagaacagagccatcgaggaggcctttgcccgggcccaggtggagatgaaggctgtgcatgagaacctggccggcgtgaggaccaacctgctgaccctgcagcctgccctgcggaccctgaccaatgactacaacggcctgaagaggcaggtgcggggcttccccctgctgctgcaggaggccctgcggtctgtgaaggccgagatcggccaggccatcgaggaggtgaacagcaacaaccaggagctgctgaggaagtaccgccgggagctgcagctgaggaagaagtgccacaatgagctggtgcggctgaagggcaacatccgggtgattgcccgggtgcggcctgtgaccaaggaggatggagagggccctgaggccaccaatgctgtgacctttgatgctgatgatgacagcatcatccacctgctgcacaagggcaagcctgtgtcctttgagctggacaaggtgttcagcccccaggccagccagcaggatgtgttccaggaggtgcaggccctggtgaccagctgcattgatggcttcaacgtgtgcatctttgcctacggccagacaggagctgggaagacctacaccatggagggcacagcagaaaatcctggcatcaaccagagggccctgcagctgctcttcagcgaggtgcaggagaaggccagtgactgggagtacaccatcaccgtgtctgctgctgagatctacaatgaggtgctgcgggacctgctgggcaaggagccccaggagaagctggagatccggctgtgcccagatggcagcggccagctgtatgtgcccggcctgacagagttccaggtgcagagcgtggatgacatcaacaaggtgtttgaatttggccacaccaacagaaccacagagttcaccaacctgaatgagcacagcagccgcagccacgccctgctgattgtgacagtgcggggcgtggactgcagcacaggcctgcggaccaccgggaagctgaacctggtggacctggccggcagcgagcgggtgggcaagagcggggctgagggcagccggctgcgggaggcccagcacatcaacaagagcctgagcgccctgggagatgtgattgctgccctgcggagccggcagggccacgtgcccttcaggaacagcaagctgacctacctgctgcaggacagcctgagcggggacagcaagaccctgatggtggtgcaggtgtcccctgtggagaagaacaccagcgagaccctgtacagcctgaagtttgctgagcgggtgcgctctgtggagctgggccctggcctgcggcgggcagagctgggctcctggagcagccaggagcacctggagtgggagcccgcctgccagaccccccagcccagcgcccgggcccacagcgcccccagcagcggcaccagcagcaggcctggcagcatccggaggaagctgcagcccagcgcctag

SEQ ID NO: 157114 - DNA, 2055 bp, Artificial Sequence
  Description of Artificial Sequence: Synthetic coding sequence
atggtggagaatgaaaggctgcggcaggagatgaggcgctgtgaggccgagctgcaggagctgcggaccaagccagctggcccctgccccggctgtgagcacagccaggagagcgcccagctgcgggacaagctgagccagctgcagctggagatggccgagagcaagggcatgctgtctgagctgaacctggaggtgcagcagaagacagaccggctggccgaggtggagctgcggctgaaggactgcctggccgagaaggcccaggaggaggagcggctgagccggcggctgcgggacagccatgagaccatcgccagcctgcgggcccagagcccccctgtgaagtatgtgatcaagacagtggaggtggagagcagcaagaccaagcaggccctgtctgagagccaggccaggaaccagcacctgcaggagcaggtggccatgcagaggcaggtgctgaaggagatggagcagcagctgcagagcagccaccagctgacagcccggctgcgggcccagatcgccatgtatgagagcgagctggagcgggcccacggccagatgctggaggagatgcagagcctggaggaggacaagaacagagccatcgaggaggcctttgcccgggcccaggtggagatgaaggctgtgcatgagaacctggccggcgtgaggaccaacctgctgaccctgcagcctgccctgcggaccctgaccaatgactacaacggcctgaagaggcaggtgcggggcttccccctgctgctgcaggaggccctgcggtctgtgaaggccgagatcggccaggccatcgaggaggtgaacagcaacaaccaggagctgctgaggaagtacagaagagagctgcagctgaggaagaagtgccacaatgagctggtgcggctgaagggcaacatccgggtcatcgcccgggtgcggcctgtgaccaaggaggatggagagggccctgaggccaccaatgctgtgacctttgatgctgatgatgacagcatcatccacctgctgcacaagggcaagcctgtgtcctttgagctggacaaggtgttcagcccccaggccagccagcaggatgaggtgcaggccctggtgaccagctgcattgatggcttcaacgtgtgcatctttgcctacggccagacaggagctgggaagacctacaccatggagggcacagcagaaaatcctggcatcaaccagagggccctgcagctgctcttcagcgaggtgcaggagaaggccagtgactgggagtacaccatcaccgtgtctgctgctgagatctacaatgaggtgctgcgggacctgctgggcaaggagccccaggagaagctggagatccggctgtgcccagatggcagcggccagctgtatgtgcccggcctgacagagttccaggtgcagagcgtggatgacatcaacaaggtgtttgaatttggccacaccaacagaaccacagagttcaccaacctgaatgagcacagcagccgcagccacgccctgctgattgtgacagtgcggggcgtggactgcagcacaggcctgcggaccaccgggaagctgaacctggtggacctggccggcagcgagcgggtgggcaagagcggggctgagggcagccggctgcgggaggcccagcacatcaacaagagcctgagcgccctgggagatgtgattgctgccctgcggagccggcagggccacgtgcccttcaggaacagcaagctgacctacctgctgcaggacagcctgagcggggacagcaagaccctgatggtggtgcaggtgtcccctgtggagaagaacaccagcgagaccctgtacagcctgaagtttgctgagcgggtgcgctctgtggagctgggccctggcctgcggcgggcagagctgggctcctggagcagccaggagcacctggagtgggagcccgcctgccagaccccccagcccagcgcccgggcccacagcgcccccagcagcggcaccagcagcaggcctggcagcatccggaggaagctgcagcccagcgcctag

SEQ ID NO: 157115 - DNA, 1914 bp, Artificial Sequence
  Description of Artificial Sequence: Synthetic coding sequence
atgtatgacaacatgagcaccatggtgtacatcaaggaggacaagctggagaagctgacccaggatgagatcatcagcaagaccaagcaggtgatccagggcctggaggccctgaagaatgagcacaacagcatcctgcagagcctgctggagaccctgaagtgcctgaagaaggatgatgagagcaacctggtggaggagaagagcaacatgatcaggaagagcctggagatgctggagctgggcctgtctgaggcccaggtgatgatggccctgagcaaccacctgaatgctgtggagagcgagaagcagaagctgcgggcccaggtgcggcggctgtgccaggagaaccagtggctgagagatgagctggccaacacccagcagaagctgcagaagtctgagcagagcgtggcccagctggaggaggagaagaagcacctggagttcatgaaccagctgaagaagtatgatgatgacatcagccccagcgaggacaaggacacagacagcaccaaggagcccctggatgacctcttccccaatgatgaagatgatcctggccagggcatccagcagcagcacagcagcgctgctgctgctgcccagcagggcggctatgagatcccagcccggctgcggaccctgcacaacctggtgatccagtatgccagccagggccgctatgaggtggccgtgcccctgtgcaagcaggccctggaggacctggagaagaccagcggccatgaccacccagatgtggccaccatgctgaacatcctggccctggtgtacagagaccagaacaagtacaaggatgctgccaacctgctgaatgatgccctggccatccgggagaagaccctgggcaaggaccaccctgctgtggccgccaccctgaacaacctggccgtgctgtatggcaagaggggcaagtacaaggaggccgagcccctgtgcaagagggccctggagatccgggagaaggtgctgggcaaggaccacccagatgtggccaagcagctgaacaacctggccctgctgtgccagaaccagggcaagtatgaggaggtggagtactactaccagagggccctggagatctaccagaccaagctgggcccagatgaccccaacgtggccaagaccaagaacaacctggccagctgctacctgaagcagggcaagttcaagcaggccgagaccctgtacaaggagatcctgacccgggcccacgagcgggagtttggatctgtggatgatgagaacaagcccatctggatgcacgccgaggagcgggaggagtgcaagggcaagcagaaggatggcaccagctttggagaatatggaggctggtacaaggcctgcaaggtggacagccccaccgtgaccaccaccctgaagaacctgggcgccctgtaccgccggcagggcaagtttgaggccgctgagaccctggaggaggccgccatgaggagcaggaagcagggcctggacaacgtgcacaagcagagggtggccgaggtgctgaatgaccctgagaacatggagaagagaagaagccgggagagcctgaatgtggatgtggtgaagtatgagagcggcccagatggaggagaggaggtgtccatgtctgtggagtggaatggagatggcaccggcagcctgaagaggagcggcagcttcagcaagctgcgggccagcatccgccgcagcagcgagaagctggtgaggaagctgaagggcggcagcagccgggagagcgagcccaagaaccctggcatgaagagggccagcagcctgaatgtgctgaatgtgggcggcaaggctgctgaggaccgcttccaggagaggaacaactgcctggccgacagccgggccctgagcgccagccacacagacctggcccactag

SEQ ID NO: 157116 - DNA, 1920 bp, Artificial Sequence
  Description of Artificial Sequence: Synthetic coding sequence
atgtatgacaacatgagcaccatggtgtacatcaaggaggacaagctggagaagctgacccaggatgagatcatcagcaagaccaagcaggtgatccagggcctggaggccctgaagaatgagcacaacagcatcctgcagagcctgctggagaccctgaagtgcctgaagaaggatgatgagagcaacctggtggaggagaagagcaacatgatcaggaagagcctggagatgctggagctgggcctgtctgaggcccaggtgatgatggccctgagcaaccacctgaatgctgtggagagcgagaagcagaagctgcgggcccaggtgcggcggctgtgccaggagaaccagtggctgagagatgagctggccaacacccagcagaagctgcagaagtctgagcagagcgtggcccagctggaggaggagaagaagcacctggagttcatgaaccagctgaagaagtatgatgatgacatcagccccagcgaggacaaggacacagacagcaccaaggagcccctggatgacctcttccccaatgatgaagatgatcctggccagggcatccagcagcagcacagcagcgctgctgctgctgcccagcagggcggctatgagatcccagcccggctgcggaccctgcacaacctggtgatccagtatgccagccagggccgctatgaggtggccgtgcccctgtgcaagcaggccctggaggacctggagaagaccagcggccatgaccacccagatgtggccaccatgctgaacatcctggccctggtgtacagagaccagaacaagtacaaggatgctgccaacctgctgaatgatgccctggccatccgggagaagaccctgggcaaggaccaccctgctgtggccgccaccctgaacaacctggccgtgctgtatggcaagaggggcaagtacaaggaggccgagcccctgtgcaagagggccctggagatccgggagaaggtgctgggcaaggaccacccagatgtggccaagcagctgaacaacctggccctgctgtgccagaaccagggcaagtatgaggaggtggagtactactaccagagggccctggagatctaccagaccaagctgggcccagatgaccccaacgtggccaagaccaagaacaacctggccagctgctacctgaagcagggcaagttcaagcaggccgagaccctgtacaaggagatcctgacccgggcccacgagcgggagtttggatctgtggatgatgagaacaagcccatctggatgcacgccgaggagcgggaggagtgcaagggcaagcagaaggatggcaccagctttggagaatatggaggctggtacaaggcctgcaaggtggacagccccaccgtgaccaccaccctgaagaacctgggcgccctgtaccgccggcagggcaagtttgaggccgctgagaccctggaggaggccgccatgaggagcaggaagcagggcctggacaacgtgcacaagcagagggtggccgaggtgctgaatgaccctgagaacatggagaagagaagaagccgggagagcctgaatgtggatgtggtgaagtatgagagcggcccagatggaggagaggaggtgtccatgtctgtggagtggaatggagatggcaccggcagcctgaagaggagcggcagcttcagcaagctgcgggccagcatccgccgcagcagcgagaagctggtgaggaagctgaagggcggcagcagccgggagagcgagcccaagaaccctggcatgaagagggccagcagcctgaatgtgctgaatgtgggcggcaaggctgctgaggaccgcttccagggcgtgtctggccgggccagcttctgtgggaagaggcagcagcagcagtggccaggccgccgccacaggtag

SEQ ID NO: 157117 - DNA, 1887 bp, Artificial Sequence
  Description of Artificial Sequence: Synthetic coding sequence
atgtatgacaacatgagcaccatggtgtacatcaaggaggacaagctggagaagctgacccaggatgagatcatcagcaagaccaagcaggtgatccagggcctggaggccctgaagaatgagcacaacagcatcctgcagagcctgctggagaccctgaagtgcctgaagaaggatgatgagagcaacctggtggaggagaagagcaacatgatcaggaagagcctggagatgctggagctgggcctgtctgaggcccaggtgatgatggccctgagcaaccacctgaatgctgtggagagcgagaagcagaagctgcgggcccaggtgcggcggctgtgccaggagaaccagtggctgagagatgagctggccaacacccagcagaagctgcagaagtctgagcagagcgtggcccagctggaggaggagaagaagcacctggagttcatgaaccagctgaagaagtatgatgatgacatcagccccagcgaggacaaggacacagacagcaccaaggagcccctggatgacctcttccccaatgatgaagatgatcctggccagggcatccagcagcagcacagcagcgctgctgctgctgcccagcagggcggctatgagatcccagcccggctgcggaccctgcacaacctggtgatccagtatgccagccagggccgctatgaggtggccgtgcccctgtgcaagcaggccctggaggacctggagaagaccagcggccatgaccacccagatgtggccaccatgctgaacatcctggccctggtgtacagagaccagaacaagtacaaggatgctgccaacctgctgaatgatgccctggccatccgggagaagaccctgggcaaggaccaccctgctgtggccgccaccctgaacaacctggccgtgctgtatggcaagaggggcaagtacaaggaggccgagcccctgtgcaagagggccctggagatccgggagaaggtgctgggcaaggaccacccagatgtggccaagcagctgaacaacctggccctgctgtgccagaaccagggcaagtatgaggaggtggagtactactaccagagggccctggagatctaccagaccaagctgggcccagatgaccccaacgtggccaagaccaagaacaacctggccagctgctacctgaagcagggcaagttcaagcaggccgagaccctgtacaaggagatcctgacccgggcccacgagcgggagtttggatctgtggatgatgagaacaagcccatctggatgcacgccgaggagcgggaggagtgcaagggcaagcagaaggatggcaccagctttggagaatatggaggctggtacaaggcctgcaaggtggacagccccaccgtgaccaccaccctgaagaacctgggcgccctgtaccgccggcagggcaagtttgaggccgctgagaccctggaggaggccgccatgaggagcaggaagcagggcctggacaacgtgcacaagcagagggtggccgaggtgctgaatgaccctgagaacatggagaagagaagaagccgggagagcctgaatgtggatgtggtgaagtatgagagcggcccagatggaggagaagaagatggcaccggcagcctgaagaggagcggcagcttcagcaagctgcgggccagcatcagaagaagcagcgagaagctggtgaggaagctgaagggcggcagcagccgggagagcgagcccaagaaccctggcatgaagagggccagcagcctgaatgtgctgaatgtgggcggcaaggccgcagaagatcgcttccaggagaggaacaactgcctggccgacagccgggccctgagcgccagccacacagacctggcccactag

SEQ ID NO: 157118 - DNA, 1722 bp, Artificial Sequence
  Description of Artificial Sequence: Synthetic coding sequence
atgtatgacaacatgagcaccatggtgtacatcaaggaggacaagctggagaagctgacccaggatgagatcatcagcaagaccaagcaggtgatccagggcctggaggccctgaagaatgagcacaacagcatcctgcagagcctgctggagaccctgaagtgcctgaagaaggatgatgagagcaacctggtggaggagaagagcaacatgatcaggaagagcctggagatgctggagctgggcctgtctgaggcccaggtgatgatggccctgagcaaccacctgaatgctgtggagagcgagaagcagaagctgcgggcccaggtgcggcggctgtgccaggagaaccagtggctgagagatgagctggccaacacccagcagaagctgcagaagtctgagcagagcgtggcccagctggaggaggagaagaagcacctggagttcatgaaccagctgaagaagtatgatgatgacatcagccccagcgaggacaaggacacagacagcaccaaggagcccctggatgacctcttccccaatgatgaagatgatcctggccagggcatccagcagcagcacagcagcgctgctgctgctgcccagcagggcggctatgagatcccagcccggctgcggaccctgcacaacctggtgatccagtatgccagccagggccgctatgaggtggccgtgcccctgtgcaagcaggccctggaggacctggagaagaccagcggccatgaccacccagatgtggccaccatgctgaacatcctggccctggtgtacagagaccagaacaagtacaaggatgctgccaacctgctgaatgatgccctggccatccgggagaagaccctgggcaaggaccaccctgctgtggccgccaccctgaacaacctggccgtgctgtatggcaagaggggcaagtacaaggaggccgagcccctgtgcaagagggccctggagatccgggagaaggtgctgggcaaggaccacccagatgtggccaagcagctgaacaacctggccctgctgtgccagaaccagggcaagtatgaggaggtggagtactactaccagagggccctggagatctaccagaccaagctgggcccagatgaccccaacgtggccaagaccaagaacaacctggccagctgctacctgaagcagggcaagttcaagcaggccgagaccctgtacaaggagatcctgacccgggcccacgagcgggagtttggatctgtggatgatgagaacaagcccatctggatgcacgccgaggagcgggaggagtgcaagggcaagcagaaggatggcaccagctttggagaatatggaggctggtacaaggcctgcaaggtggacagccccaccgtgaccaccaccctgaagaacctgggcgccctgtaccgccggcagggcaagtttgaggccgctgagaccctggaggaggccgccatgaggagcaggaagcagggcctggacaacgtgcacaagcagagggtggccgaggtgctgaatgaccctgagaacatggagaagagaagaagccgggagagcctgaatgtggatgtggtgaagtatgagagcggcccagatggaggagaggaggtgtccatgtctgtggagtggaatggaggagtgtctggccgggccagcttctgtgggaagaggcagcagcagcagtggccaggccgccgccacaggtag

SEQ ID NO: 157119 - DNA, 1731 bp, Artificial Sequence
  Description of Artificial Sequence: Synthetic coding sequence
atgtatgacaacatgagcaccatggtgtacatcaaggaggacaagctggagaagctgacccaggatgagatcatcagcaagaccaagcaggtgatccagggcctggaggccctgaagaatgagcacaacagcatcctgcagagcctgctggagaccctgaagtgcctgaagaaggatgatgagagcaacctggtggaggagaagagcaacatgatcaggaagagcctggagatgctggagctgggcctgtctgaggcccaggtgatgatggccctgagcaaccacctgaatgctgtggagagcgagaagcagaagctgcgggcccaggtgcggcggctgtgccaggagaaccagtggctgagagatgagctggccaacacccagcagaagctgcagaagtctgagcagagcgtggcccagctggaggaggagaagaagcacctggagttcatgaaccagctgaagaagtatgatgatgacatcagccccagcgaggacaaggacacagacagcaccaaggagcccctggatgacctcttccccaatgatgaagatgatcctggccagggcatccagcagcagcacagcagcgctgctgctgctgcccagcagggcggctatgagatcccagcccggctgcggaccctgcacaacctggtgatccagtatgccagccagggccgctatgaggtggccgtgcccctgtgcaagcaggccctggaggacctggagaagaccagcggccatgaccacccagatgtggccaccatgctgaacatcctggccctggtgtacagagaccagaacaagtacaaggatgctgccaacctgctgaatgatgccctggccatccgggagaagaccctgggcaaggaccaccctgctgtggccgccaccctgaacaacctggccgtgctgtatggcaagaggggcaagtacaaggaggccgagcccctgtgcaagagggccctggagatccgggagaaggtgctgggcaaggaccacccagatgtggccaagcagctgaacaacctggccctgctgtgccagaaccagggcaagtatgaggaggtggagtactactaccagagggccctggagatctaccagaccaagctgggcccagatgaccccaacgtggccaagaccaagaacaacctggccagctgctacctgaagcagggcaagttcaagcaggccgagaccctgtacaaggagatcctgacccgggcccacgagcgggagtttggatctgtggatgatgagaacaagcccatctggatgcacgccgaggagcgggaggagtgcaagggcaagcagaaggatggcaccagctttggagaatatggaggctggtacaaggcctgcaaggtggacagccccaccgtgaccaccaccctgaagaacctgggcgccctgtaccgccggcagggcaagtttgaggccgctgagaccctggaggaggccgccatgaggagcaggaagcagaggagcatcagcgagatccccaagaagatcctgagcgccaacggcagcaaccacttccccctgcccggcagccagggcctggacaacgtgcacaagcagagggtggccgaggtgctgaatgaccctgagaacatggagaagaggaggagccgggagagcctgaatgtggatgtggtgaagtatgaaagtggcccagatggaggagaggagatgaggaagatgaagctgggcctggtgaactag

SEQ ID NO: 157120 - DNA, 1683 bp, Artificial Sequence
  Description of Artificial Sequence: Synthetic coding sequence
atgtatgacaacatgagcaccatggtgtacatcaaggaggacaagctggagaagctgacccaggatgagatcatcagcaagaccaagcaggtgatccagggcctggaggccctgaagaatgagcacaacagcatcctgcagagcctgctggagaccctgaagtgcctgaagaaggatgatgagagcaacctggtggaggagaagagcaacatgatcaggaagagcctggagatgctggagctgggcctgtctgaggcccaggtgatgatggccctgagcaaccacctgaatgctgtggagagcgagaagcagaagctgcgggcccaggtgcggcggctgtgccaggagaaccagtggctgagagatgagctggccaacacccagcagaagctgcagaagtctgagcagagcgtggcccagctggaggaggagaagaagcacctggagttcatgaaccagctgaagaagtatgatgatgacatcagccccagcgaggacaaggacacagacagcaccaaggagcccctggatgacctcttccccaatgatgaagatgatcctggccagggcatccagcagcagcacagcagcgctgctgctgctgcccagcagggcggctatgagatcccagcccggctgcggaccctgcacaacctggtgatccagtatgccagccagggccgctatgaggtggccgtgcccctgtgcaagcaggccctggaggacctggagaagaccagcggccatgaccacccagatgtggccaccatgctgaacatcctggccctggtgtacagagaccagaacaagtacaaggatgctgccaacctgctgaatgatgccctggccatccgggagaagaccctgggcaaggaccaccctgctgtggccgccaccctgaacaacctggccgtgctgtatggcaagaggggcaagtacaaggaggccgagcccctgtgcaagagggccctggagatccgggagaaggtgctgggcaaggaccacccagatgtggccaagcagctgaacaacctggccctgctgtgccagaaccagggcaagtatgaggaggtggagtactactaccagagggccctggagatctaccagaccaagctgggcccagatgaccccaacgtggccaagaccaagaacaacctggccagctgctacctgaagcagggcaagttcaagcaggccgagaccctgtacaaggagatcctgacccgggcccacgagcgggagtttggatctgtggatgatgagaacaagcccatctggatgcacgccgaggagcgggaggagtgcaagggcaagcagaaggatggcaccagctttggagaatatggaggctggtacaaggcctgcaaggtggacagccccaccgtgaccaccaccctgaagaacctgggcgccctgtaccgccggcagggcaagtttgaggccgctgagaccctggaggaggccgccatgaggagcaggaagcagggcctggacaacgtgcacaagcagagggtggccgaggtgctgaatgaccctgagaacatggagaagagaagaagccgggagagcctgaatgtggatgtggtgaagtatgagagcggcccagatggaggagaggaggtgtccatgtctgtggagtggaatggcatgaggaagatgaagctgggcctggtgaactag

SEQ ID NO: 157121 - DNA, 1755 bp, Artificial Sequence
  Description of Artificial Sequence: Synthetic coding sequence
atgtatgacaacatgagcaccatggtgtacatcaaggaggacaagctggagaagctgacccaggatgagatcatcagcaagaccaagcaggtgatccagggcctggaggccctgaagaatgagcacaacagcatcctgcagagcctgctggagaccctgaagtgcctgaagaaggatgatgagagcaacctggtggaggagaagagcaacatgatcaggaagagcctggagatgctggagctgggcctgtctgaggcccaggtgatgatggccctgagcaaccacctgaatgctgtggagagcgagaagcagaagctgcgggcccaggtgcggcggctgtgccaggagaaccagtggctgagagatgagctggccaacacccagcagaagctgcagaagtctgagcagagcgtggcccagctggaggaggagaagaagcacctggagttcatgaaccagctgaagaagtatgatgatgacatcagccccagcgaggacaaggacacagacagcaccaaggagcccctggatgacctcttccccaatgatgaagatgatcctggccagggcatccagcagcagcacagcagcgctgctgctgctgcccagcagggcggctatgagatcccagcccggctgcggaccctgcacaacctggtgatccagtatgccagccagggccgctatgaggtggccgtgcccctgtgcaagcaggccctggaggacctggagaagaccagcggccatgaccacccagatgtggccaccatgctgaacatcctggccctggtgtacagagaccagaacaagtacaaggatgctgccaacctgctgaatgatgccctggccatccgggagaagaccctgggcaaggaccaccctgctgtggccgccaccctgaacaacctggccgtgctgtatggcaagaggggcaagtacaaggaggccgagcccctgtgcaagagggccctggagatccgggagaaggtgctgggcaaggaccacccagatgtggccaagcagctgaacaacctggccctgctgtgccagaaccagggcaagtatgaggaggtggagtactactaccagagggccctggagatctaccagaccaagctgggcccagatgaccccaacgtggccaagaccaagaacaacctggccagctgctacctgaagcagggcaagttcaagcaggccgagaccctgtacaaggagatcctgacccgggcccacgagcgggagtttggatctgtggatgatgagaacaagcccatctggatgcacgccgaggagcgggaggagtgcaagggcaagcagaaggatggcaccagctttggagaatatggaggctggtacaaggcctgcaaggtggacagccccaccgtgaccaccaccctgaagaacctgggcgccctgtaccgccggcagggcaagtttgaggccgctgagaccctggaggaggccgccatgaggagcaggaagcagggcctggacaacgtgcacaagcagagggtggccgaggtgctgaatgaccctgagaacatggagaagagaagaagccgggagagcctgaatgtggatgtggtgaagtatgagagcggcccagatggaggagaggagatgaagagggccagcagcctgaatgtgctgaatgtgggcggcaaggccgcagaagatcgcttccaggagaggaacaactgcctggccgacagccgggccctgagcgccagccacacagacctggcccactag

SEQ ID NO: 157122 - DNA, 1857 bp, Artificial Sequence
  Description of Artificial Sequence: Synthetic coding sequence
atgtatgacaacatgagcaccatggtgtacatcaaggaggacaagctggagaagctgacccaggatgagatcatcagcaagaccaagcaggtgatccagggcctggaggccctgaagaatgagcacaacagcatcctgcagagcctgctggagaccctgaagtgcctgaagaaggatgatgagagcaacctggtggaggagaagagcaacatgatcaggaagagcctggagatgctggagctgggcctgtctgaggcccaggtgatgatggccctgagcaaccacctgaatgctgtggagagcgagaagcagaagctgcgggcccaggtgcggcggctgtgccaggagaaccagtggctgagagatgagctggccaacacccagcagaagctgcagaagtctgagcagagcgtggcccagctggaggaggagaagaagcacctggagttcatgaaccagctgaagaagtatgatgatgacatcagccccagcgaggacaaggacacagacagcaccaaggagcccctggatgacctcttccccaatgatgaagatgatcctggccagggcatccagcagcagcacagcagcgctgctgctgctgcccagcagggcggctatgagatcccagcccggctgcggaccctgcacaacctggtgatccagtatgccagccagggccgctatgaggtggccgtgcccctgtgcaagcaggccctggaggacctggagaagaccagcggccatgaccacccagatgtggccaccatgctgaacatcctggccctggtgtacagagaccagaacaagtacaaggatgctgccaacctgctgaatgatgccctggccatccgggagaagaccctgggcaaggaccaccctgctgtggccgccaccctgaacaacctggccgtgctgtatggcaagaggggcaagtacaaggaggccgagcccctgtgcaagagggccctggagatccgggagaaggtgctgggcaaggaccacccagatgtggccaagcagctgaacaacctggccctgctgtgccagaaccagggcaagtatgaggaggtggagtactactaccagagggccctggagatctaccagaccaagctgggcccagatgaccccaacgtggccaagaccaagaacaacctggccagctgctacctgaagcagggcaagttcaagcaggccgagaccctgtacaaggagatcctgacccgggcccacgagcgggagtttggatctgtggatgatgagaacaagcccatctggatgcacgccgaggagcgggaggagtgcaagggcaagcagaaggatggcaccagctttggagaatatggaggctggtacaaggcctgcaaggtggacagccccaccgtgaccaccaccctgaagaacctgggcgccctgtaccgccggcagggcaagtttgaggccgctgagaccctggaggaggccgccatgaggagcaggaagcagggcctggacaacgtgcacaagcagagggtggccgaggtgctgaatgaccctgagaacatggagaagagaagaagccgggagagcctgaatgtggatgtggtgaagtatgagagcggcccagatggaggagaggaggtgtccatgtctgtggagtggaatggagatggcaccggcagcctgaagaggagcggcagcttcagcaagctgcgggccagcatccgccgcagcagcgagaagctggtgaggaagctgaagggcggcagcagccgggagagcgagcccaagaaccctggggccagcctggccgagcccctgtttgtggagaatgacagcagcagcagcggcctggaggatgccacagccaactag

SEQ ID NO: 157123 - DNA, 1683 bp, Artificial Sequence; identical to SEQ ID NO: 157120
  Description of Artificial Sequence: Synthetic coding sequence

SEQ ID NO: 157124 - DNA, 396 bp, Artificial Sequence
  Description of Artificial Sequence: Synthetic coding sequence
tgagaaaacaagcccatctggatgcacgccgaggagcgggaggagtgcaagggcaagcagaaggatggcaccagctttggagaatatggaggctggtacaaggcctgcaaggtggacagccccaccgtgaccaccaccctgaagaacctgggcgccctgtaccgccggcagggcaagtttgaggccgctgagaccctggaggaggccgccatgaggagcaggaagcagggcctggacaacgtgcacaagcagagggtggccgaggtgctgaatgaccctgagaacatggagaagagaagaagccgggagagcctgaatgtggatgtggtgaagtatgagagcggcccagatggaggagaggagatgaggaagatgaagctgggcctggtgaactag

SEQ ID NO: 157125 - DNA, 1893 bp, Artificial Sequence
  Description of Artificial Sequence: Synthetic coding sequence
atgtatgacaacatgagcaccatggtgtacatcaaggaggacaagctggagaagctgacccaggatgagatcatcagcaagaccaagcaggtgatccagggcctggaggccctgaagaatgagcacaacagcatcctgcagagcctgctggagaccctgaagtgcctgaagaaggatgatgagagcaacctggtggaggagaagagcaacatgatcaggaagagcctggagatgctggagctgggcctgtctgaggcccaggtgatgatggccctgagcaaccacctgaatgctgtggagagcgagaagcagaagctgcgggcccaggtgcggcggctgtgccaggagaaccagtggctgagagatgagctggccaacacccagcagaagctgcagaagtctgagcagagcgtggcccagctggaggaggagaagaagcacctggagttcatgaaccagctgaagaagtatgatgatgacatcagccccagcgaggacaaggacacagacagcaccaaggagcccctggatgacctcttccccaatgatgaagatgatcctggccagggcatccagcagcagcacagcagcgctgctgctgctgcccagcagggcggctatgagatcccagcccggctgcggaccctgcacaacctggtgatccagtatgccagccagggccgctatgaggtggccgtgcccctgtgcaagcaggccctggaggacctggagaagaccagcggccatgaccacccagatgtggccaccatgctgaacatcctggccctggtgtacagagaccagaacaagtacaaggatgctgccaacctgctgaatgatgccctggccatccgggagaagaccctgggcaaggaccaccctgctgtggccgccaccctgaacaacctggccgtgctgtatggcaagaggggcaagtacaaggaggccgagcccctgtgcaagagggccctggagatccgggagaaggtgctgggcaaggaccacccagatgtggccaagcagctgaacaacctggccctgctgtgccagaaccagggcaagtatgaggaggtggagtactactaccagagggccctggagatctaccagaccaagctgggcccagatgaccccaacgtggccaagaccaagaacaacctggccagctgctacctgaagcagggcaagttcaagcaggccgagaccctgtacaaggagatcctgacccgggcccacgagcgggagtttggatctgtggatgatgagaacaagcccatctggatgcacgccgaggagcgggaggagtgcaagggcaagcagaaggatggcaccagctttggagaatatggaggctggtacaaggcctgcaaggtggacagccccaccgtgaccaccaccctgaagaacctgggcgccctgtaccgccggcagggcaagtttgaggccgctgagaccctggaggaggccgccatgaggagcaggaagcagggcctggacaacgtgcacaagcagagggtggccgaggtgctgaatgaccctgagaacatggagaagagaagaagccgggagagcctgaatgtggatgtggtgaagtatgagagcggcccagatggaggagaagaagatggcaccggcagcctgaagaggagcggcagcttcagcaagctgcgggccagcatcagaagaagcagcgagaagctggtgaggaagctgaagggcggcagcagccgggagagcgagcccaagaaccctggcatgaagagggccagcagcctgaatgtgctgaatgtgggcggcaaggccgcagaagatcgcttccagggcgtgtctggccgggccagcttctgtgggaagaggcagcagcagcagtggccaggaagaagacacaggtag

SEQ ID NO: 157126 - DNA, 453 bp, Artificial Sequence
  Description of Artificial Sequence: Synthetic coding sequence
atgtatgacaacatgagcaccatggtgtacatcaaggaggacaagctggagaagctgacccaggatgagatcatcagcaagaccaagcaggtgatccagggcctggaggccctgaagaatgagcacaacagcatcctgcagagcctgctggagaccctgaagtgcctgaagaaggatgatgagagcaacctggtggaggagaagagcaacatgatcaggaagagcctggagatgctggagctgggcctgtctgaggcccaggtgatgatggccctgagcaaccacctgaatgctgtggagagcgagaagcagaagctgcgggcccaggtgcggcggctgtgccaggagaaccagtggctgagagatgagctggccaacacccagcagaagctgcagaagtctgagcagagcgtggcccagctggaggaggagaagaagcacctggagttctag

SEQ ID NO: 157127 - DNA, 1695 bp, Artificial Sequence
  Description of Artificial Sequence: Synthetic coding sequence
atgtatgacaacatgagcaccatggtgtacatcaaggaggacaagctggagaagctgacccaggatgagatcatcagcaagaccaagcaggtgatccagggcctggaggccctgaagaatgagcacaacagcatcctgcagagcctgctggagaccctgaagtgcctgaagaaggatgatgagagcaacctggtggaggagaagagcaacatgatcaggaagagcctggagatgctggagctgggcctgtctgaggcccaggtgatgatggccctgagcaaccacctgaatgctgtggagagcgagaagcagaagctgcgggcccaggtgcggcggctgtgccaggagaaccagtggctgagagatgagctggccaacacccagcagaagctgcagaagtctgagcagagcgtggcccagctggaggaggagaagaagcacctggagttcatgaaccagctgaagaagtatgatgatgacatcagccccagcgaggacaaggacacagacagcaccaaggagcccctggatgacctcttccccaatgatgaagatgatcctggccagggcatccagcagcagcacagcagcgctgctgctgctgcccagcagggcggctatgagatcccagcccggctgcggaccctgcacaacctggtgatccagtatgccagccagggccgctatgaggtggccgtgcccctgtgcaagcaggccctggaggacctggagaagaccagcggccatgaccacccagatgtggccaccatgctgaacatcctggccctggtgtacagagaccagaacaagtacaaggatgctgccaacctgctgaatgatgccctggccatccgggagaagaccctgggcaaggaccaccctgctgtggccgccaccctgaacaacctggccgtgctgtatggcaagaggggcaagtacaaggaggccgagcccctgtgcaagagggccctggagatccgggagaaggtgctgggcaaggaccacccagatgtggccaagcagctgaacaacctggccctgctgtgccagaaccagggcaagtatgaggaggtggagtactactaccagagggccctggagatctaccagaccaagctgggcccagatgaccccaacgtggccaagaccaagaacaacctggccagctgctacctgaagcagggcaagttcaagcaggccgagaccctgtacaaggagatcctgacccgggcccacgagcgggagtttggatctgtggatgatgagaacaagcccatctggatgcacgccgaggagcgggaggagtgcaagggcaagcagaaggatggcaccagctttggagaatatggaggctggtacaaggcctgcaaggtggacagccccaccgtgaccaccaccctgaagaacctgggcgccctgtaccgccggcagggcaagtttgaggccgctgagaccctggaggaggccgccatgaggagcaggaagcagggcctggacaacgtgcacaagcagagggtggccgaggtgctgaatgaccctgagaacatggagaagagaagaagccgggagagcctgaatgtggatgtggtgaagtatgagagcggcccagatggaggagaggagggcgtgtctggccgggccagcttctgtgggaagaggcagcagcagcagtggccaggaagaagacacaggtag

SEQ ID NO: 157128 - DNA, 1869 bp, Artificial Sequence
  Description of Artificial Sequence: Synthetic coding sequence
atggccatgatggtgttcccccgggaggagaagctgagccaggatgaaattgtgctgggcaccaaggctgtgatccagggcctggagaccctgcggggggagcaccgggccctgctggcccccctggtggcccctgaggccggggaggccgagcccggcagccaggagcgctgcatcctgctgcggcgcagcctggaggccatcgagctgggcctgggggaggcccaggtgatcctggccctgagcagccacctgggcgctgtggagagcgagaagcagaagctgcgggcccaggtgcggcggctggtgcaggagaaccagtggctgcgggaggagctggccggcacccagcagaagctgcagaggtctgagcaggccgtggcccagctggaggaggagaagcagcacctgctcttcatgagccagatcaggaagctggatgaagatgccagccccaatgaggagaagggagatgtgcccaaggacaccctggatgacctcttccccaatgaagatgagcagagccctgcccccagccctggaggaggagatgtgtctggccagcacggcggctatgagatcccagcccggctgcggaccctgcacaacctggtgatccagtatgccagccagggccgctatgaggtggccgtgcccctgtgcaagcaggccctggaggacctggagaagaccagcggccatgaccacccagatgtggccaccatgctgaacatcctggccctggtgtacagagaccagaacaagtacaaggaggccgcccacctgctgaatgatgccctggccatccgggagaagaccctgggcaaggaccaccctgctgtggccgccaccctgaacaacctggccgtgctgtatggcaagaggggcaagtacaaggaggccgagcccctgtgcaagagggccctggagatccgggagaaggtgctgggcaagttccacccagatgtggccaagcagctgagcaacctggccctgctgtgccagaaccagggcaaggccgaggaggtggagtactactaccgccgggccctggagatctatgccacccggctgggcccagatgaccccaacgtggccaagaccaagaacaacctggccagctgctacctgaagcagggcaagtaccaggatgctgagaccctgtacaaggagatcctgacccgggcccacgagaaggagtttggatctgtgaatggagacaacaagcccatctggatgcatgctgaggagcgggaggagagcaaggacaagagaagagacagcgccccctatggagaatatggctcctggtacaaggcctgcaaggtggacagccccaccgtgaacaccaccctgcggagcctgggcgccctgtaccgccggcagggcaagctggaggccgcccacaccctggaggactgtgccagcaggaacaggaagcagggcctggaccctgccagccagaccaaggtggtggagctgctgaaggatggcagcggcagaagaggagacagaagaagcagccgggacatggccggcggggccggccccaggtctgagagtgacctggaggatgtgggccccacagctgagtggaatggagatggcagcggcagcctgcggcgcagcggcagctttgggaagctgagagatgccctgcggcgcagcagcgagatgctggtgaagaagctgcagggcggcaccccccaggagccccccaaccccaggatgaagagggccagcagcctgaacttcctgaacaagtctgtggaggagcccacccagcccggcggcaccggcctgagtgacagcaggaccctgagcagcagctccatggacctgagccgccgcagcagcctggtgggctag

SEQ ID NO: 157129 - DNA, 1638 bp, Artificial Sequence
  Description of Artificial Sequence: Synthetic coding sequence
atggccatgatggtgttcccccgggaggagaagctgagccaggatgaaattgtgctgggcaccaaggctgtgatccagggcctggagaccctgcggggggagcaccgggccctgctggcccccctggtggcccctgaggccggggaggccgagcccggcagccaggagcgctgcatcctgctgcggcgcagcctggaggccatcgagctgggcctgggggaggcccaggaggagaagggagatgtgcccaaggacaccctggatgacctcttccccaatgaagatgagcagagccctgcccccagccctggaggaggagatgtgtctggccagcacggcggctatgagatcccagcccggctgcggaccctgcacaacctggtgatccagtatgccagccagggccgctatgaggtggccgtgcccctgtgcaagcaggccctggaggacctggagaagaccagcggccatgaccacccagatgtggccaccatgctgaacatcctggccctggtgtacagagaccagaacaagtacaaggaggccgcccacctgctgaatgatgccctggccatccgggagaagaccctgggcaaggaccaccctgctgtggccgccaccctgaacaacctggccgtgctgtatggcaagaggggcaagtacaaggaggccgagcccctgtgcaagagggccctggagatccgggagaaggtgctgggcaagttccacccagatgtggccaagcagctgagcaacctggccctgctgtgccagaaccagggcaaggccgaggaggtggagtactactacagaagagccctggagatctatgccacccggctgggcccagatgaccccaacgtggccaagaccaagaacaacctggccagctgctacctgaagcagggcaagtaccaggatgctgagaccctgtacaaggagatcctgacccgggcccacgagaaggagtttggatctgtgaatggagacaacaagcccatctggatgcacgccgaggagcgggaggagagcaaggacaagaggcgggacagcgccccctacggggagtatggctcctggtacaaggcctgcaaggtggacagccccaccgtgaacaccaccctgcggagcctgggcgccctgtaccgccggcagggcaagctggaggccgcccacaccctggaggactgtgccagcaggaacaggaagcagggcctggaccctgccagccagaccaaggtggtggagctgctgaaggatggcagcggccggcggggggaccggcgcagcagccgggacatggccggcggggccggccccaggtctgagagtgacctggaggatgtgggccccacagctgagtggaatggagatggcagcggcagcctgcggcgcagcggcagctttgggaagctgagagatgccctgcggcgcagcagcgagatgctggtgaagaagctgcagggcggcaccccccaggagccccccaaccccaggatgaagagggccagcagcctgaacttcctgaacaagtctgtggaggagcccacccagcccggcggcaccggcctgagtgacagcaggaccctgagcagcagctccatggacctgagcagaagaagcagcctggtgggctag

SEQ ID NO: 157130 - DNA, 1869 bp, Artificial Sequence; identical to SEQ ID NO: 157128
  Description of Artificial Sequence: Synthetic coding sequence

SEQ ID NO: 157131 - DNA, 1869 bp, Artificial Sequence; identical to SEQ ID NO: 157128
  Description of Artificial Sequence: Synthetic coding sequence

SEQ ID NO: 157132 - DNA, 1638 bp, Artificial Sequence; identical to SEQ ID NO: 157129
  Description of Artificial Sequence: Synthetic coding sequence

SEQ ID NO: 157133 - DNA, 501 bp, Artificial Sequence
  Description of Artificial Sequence: Synthetic coding sequence
atggccatgatggtgttcccccgggaggagaagctgagccaggatgaaattgtgctgggcaccaaggctgtgatccagggcctggagaccctgcggggggagcaccgggccctgctggcccccctggtggcccctgaggccggggaggccgagcccggcagccaggagcgctgcatcctgctgcggcgcagcctggaggccatcgagctgggcctgggggaggcccaggtgatcctggccctgagcagccacctgggcgctgtggagagcgagaagcagaagctgcgggcccaggtgcggcggctggtgcaggagaaccagtggctgcgggaggagctggccggcacccagcagaagctgcagaggtctgagcaggccgtggcccagctggaggaggagaagcagcacctgctcttcatgagccagatcaggaagctggatgaagatgccagccccaatgaggagaagggagatgtgcccaaggacaccctggatgactag

SEQ ID NO: 157134 - DNA, 570 bp, Artificial Sequence
  Description of Artificial Sequence: Synthetic coding sequence
atggccatgatggtgttcccccgggaggagaagctgagccaggatgaaattgtgctgggcaccaaggctgtgatccagggcctggagaccctgcggggggagcaccgggccctgctggcccccctggtggcccctgaggccggggaggccgagcccggcagccaggagcgctgcatcctgctgcggcgcagcctggaggccatcgagctgggcctgggggaggcccaggaggagaagggagatgtgcccaaggacaccctggatgacctcttccccaatgaagatgagcagagccctgcccccagccctggaggaggagatgtgtctggccagcacggcggctatgagatcccagcccggctgcggaccctgcacaacctggtgatccagtatgccagccagggccgctatgaggtggccgtgcccctgtgcaagcaggccctggaggacctggagaagaccagcggccatgaccacccagatgtggccaccatgctgaacatcctggccctggtgtacagagaccagaacaagtacaaggaggccgcccacctgctgaatgatgcctag

SEQ ID NO: 157135 - DNA, 516 bp, Artificial Sequence
  Description of Artificial Sequence: Synthetic coding sequence
atggccatgatggtgttcccccgggaggagaagctgagccaggatgaaattgtgctgggcaccaaggctgtgatccagggcctggagaccctgcggggggagcaccgggccctgctggcccccctggtggcccctgaggccggggaggccgagcccggcagccaggagcgctgcatcctgctgcggcgcagcctggaggccatcgagctgggcctgggggaggcccaggtgatcctggccctgagcagccacctgggcgctgtggagagcgagaagcagaagctgcgggcccaggtgcggcggctggtgcaggagaaccagtggctgcgggaggagctggccggcacccagcagaagctgcagaggtctgagcaggccgtggcccagctggaggaggagaagcagcacctgctcttcatgagccagatcaggaagctggatgaagatgccagccccaatgaggagaagggagatgtgcccaaggacaccctggatgacctcttccccaatgaatag

SEQ ID NO: 157136 - DNA, 438 bp, Artificial Sequence
  Description of Artificial Sequence: Synthetic coding sequence
atggccatgatggtgttcccccgggaggagaagctgagccaggatgaaattgtgctgggcaccaaggctgtgatccagggcctggagaccctgcggggggagcaccgggccctgctggcccccctggtggcccctgaggccggggaggccgagcccggcagccaggagcgctgcatcctgctgcggcgcagcctggaggccatcgagctgggcctgggggaggcccaggtgatcctggccctgagcagccacctgggcgctgtggagagcgagaagcagaagctgcgggcccaggtgcggcggctggtgcaggagaaccagtggctgcgggaggagctggccggcacccagcagaagctgcagaggtctgagcaggccgtggcccagctggaggaggagaagcagcacctgctcttcatgagccagatcaggaagtag

SEQ ID NO: 157137 - DNA, 318 bp, Artificial Sequence
  Description of Artificial Sequence: Synthetic coding sequence
atggccatgatggtgttcccccgggaggagaagctgagccaggatgaaattgtgctgggcaccaaggctgtgatccagggcctggagaccctgcggggggagcaccgggccctgctggcccccctggtggcccctgaggccggggaggccgagcccggcagccaggagcgctgcatcctgctgcggcgcagcctggaggccatcgagctgggcctgggggaggcccaggtgatcctggccctgagcagccacctgggcgctgtggagagcgagaagcagaagctgcgggcccaggtgcggcggctggtgcaggagtag

SEQ ID NO: 157138 - DNA, 1515 bp, Artificial Sequence
  Description of Artificial Sequence: Synthetic coding sequence
atgtctgtgcaggtggccgcccctggcagcgctggcctgggccctgagcggctgagccctgaggagctggtgcggcagacccggcaggtggtgcagggcctggaggccctgcgggcagagcaccacggcctggccggccacctggccgaggccctggccggccagggccctgctgctggcctggagatgctggaggagaagcagcaggtggtgagccacagcctggaggccatcgagctgggcctgggggaggcccaggtgctgctggccctgagcgcccacgtgggcgccctggaggccgagaagcagaggctgcggagccaggcccggcggctggcccaggagaatgtgtggctgcgggaggagctggaggagacccagaggcggctgcgggccagcgaggagagcgtggcccagctggaggaggagaagaggcacctggagttcctgggccagctgcggcagtatgaccccccagctgagagccagcagagcgagagccccccccggcgggacagcctggccagcctcttccccagcgaggaggaggagaggaagggccctgaggccgccggggctgctgctgcccagcagggcggctatgagatcccagcccggctgcggaccctgcacaacctggtgatccagtatgccggccagggccgctatgaggtggccgtgcccctgtgccggcaggccctggaggacctggagaggagcagcggccactgccacccagatgtggccaccatgctgaacatcctggccctggtgtacagagaccagaacaagtacaaggaggccacagacctgctgcatgatgccctgcagatccgggagcagaccctgggccctgagcaccctgctgtggccgccaccctgaacaacctggccgtgctgtatggcaagaggggccgctaccgggaggccgagcccctgtgccagagggccctggagatccgggagaaggtgctgggcgctgaccacccagatgtggccaagcagctgaacaacctggccctgctgtgccagaaccagggcaagtttgaagatgtggagcggcactacgcccgggccctgagcatctatgaggccctgggcggcccccatgaccccaacgtggccaagaccaagaacaacctggccagcgcctacctgaagcagaacaagtaccagcaggccgaggagctgtacaaggagatcctgcacaaggaggacctgcctgcccccctgggcgcccccaacacaggaacagctggagatgctgagcaggccctgcggcgcagcagcagcctgagcaagatccgggagagcatccggcggggcagcgagaagctggtgtcccggctgcggggggaggccgccgccggggctgctggcatgaagagggccatgagcctgaacaccctgaatgtggatgccccccgggcccctggcacccagttccccagctggcacctggacaaggcccccaggaccctgagcgccagcacccaggacctgagcccccactag

SEQ ID NO: 157139 - DNA, 1557 bp, Artificial Sequence
  Description of Artificial Sequence: Synthetic coding sequence
atgatcccccagaccccccaccactgcagccctggagctgccatgtctgtgcaggtggccgcccctggcagcgctggcctgggccctgagcggctgagccctgaggagctggtgcggcagacccggcaggtggtgcagggcctggaggccctgcgggcagagcaccacggcctggccggccacctggccgaggccctggccggccagggccctgctgctggcctggagatgctggaggagaagcagcaggtggtgagccacagcctggaggccatcgagctgggcctgggggaggcccaggtgctgctggccctgagcgcccacgtgggcgccctggaggccgagaagcagaggctgcggagccaggcccggcggctggcccaggagaatgtgtggctgcgggaggagctggaggagacccagaggcggctgcgggccagcgaggagagcgtggcccagctggaggaggagaagaggcacctggagttcctgggccagctgcggcagtatgaccccccagctgagagccagcagagcgagagccccccccggcgggacagcctggccagcctcttccccagcgaggaggaggagaggaagggccctgaggccgccggggctgctgctgcccagcagggcggctatgagatcccagcccggctgcggaccctgcacaacctggtgatccagtatgccggccagggccgctatgaggtggccgtgcccctgtgccggcaggccctggaggacctggagaggagcagcggccactgccacccagatgtggccaccatgctgaacatcctggccctggtgtacagagaccagaacaagtacaaggaggccacagacctgctgcatgatgccctgcagatccgggagcagaccctgggccctgagcaccctgctgtggccgccaccctgaacaacctggccgtgctgtatggcaagaggggccgctaccgggaggccgagcccctgtgccagagggccctggagatccgggagaaggtgctgggcgctgaccacccagatgtggccaagcagctgaacaacctggccctgctgtgccagaaccagggcaagtttgaagatgtggagcggcactacgcccgggccctgagcatctatgaggccctgggcggcccccatgaccccaacgtggccaagaccaagaacaacctggccagcgcctacctgaagcagaacaagtaccagcaggccgaggagctgtacaaggagatcctgcacaaggaggacctgcctgcccccctgggcgcccccaacacaggaacagctggagatgctgagcaggccctgcggcgcagcagcagcctgagcaagatccgggagagcatccggcggggcagcgagaagctggtgtcccggctgcggggggaggccgccgccggggctgctggcatgaagagggccatgagcctgaacaccctgaatgtggatgccccccgggcccctggcacccagttccccagctggcacctggacaaggcccccaggaccctgagcgccagcacccaggacctgagcccccactag

SEQ ID NO: 157140 - DNA, 2379 bp, Artificial Sequence
  Description of Artificial Sequence: Synthetic coding sequence
atgcagggagaagatgcccgctacctgaagaggaaggtgaagggcggcaacattgatgtgcaccccagcgagaaggccctgattgtgcactatgaggtggaggccaccatcctgggggagatgggagaccccatgctgggggagaggaaagaatgccagaagatcatccggctgaagagcctgaatgccaacacagacatcaccagcctggccaggaaggtggtggaggagtgcaagctgatccaccccagcaagctgaatgaggtggagcagctgctgtactacctgcagaacagaagagacagcctgagcggcaaggagaagaaggagaagagcagcaagcccaaggaccccccaccatttgagggcatggagattgatgaggtggccaacatcaatgacatggatgagtacatcgagctgctgtatgaggacatcccagacaaggtgcggggcagcgccctgatcctgcagctggccagaaatccagacaacctggaggagctgctgctgaatgaaacagccctgggcgccctggcccgggtgctgcgggaggactggaagcagagcgtggagctggccaccaacatcatctacatcttcttctgcttcagcagcttcagccagttccacggcctcatcacccactacaagattggagccctgtgcatgaacatcatcgaccacgagctgaagagacatgagctgtggcaggaggagctgagcaagaagaagaaggctgtggatgaggaccctgagaaccagaccctgaggaaggactatgagaagaccttcaagaagtaccagggcctggtggtgaagcaggagcagctgctgcgggtggccctgtacctgctgctgaacctggccgaggacaccaggacagagctgaagatgaggaacaagaacatcgtgcacatgctggtgaaggccctggaccgggacaactttgagctgctgatcctggtggtgtccttcctgaagaagctgagcatcttcatggagaacaagaatgacatggtggagatggacatcgtggagaagctggtgaagatgatcccctgtgaacatgaggacctgctgaacatcaccctgcggctgctgctgaacctgagctttgacaccggcctgaggaacaagatggtgcaggtgggcctgctgcccaagctgacagccctgctgggcaatgacaactacaagcagatcgccatgtgtgtgctgtaccacatctccatggatgaccgcttcaagtccatgtttgcctacacagactgcatcccccagctgatgaagatgctgtttgaatgttctgatgaaagaattgacctggagctgatctccttctgcatcaacctggccgccaacaagagaaatgtgcagctgatctgtgagggcaatggcctgaagatgctgatgaagagggccctgaagttcaaggaccccctgctgatgaagatgatccggaacatcagccagcatgatggccccaccaagaacctcttcatcgactatgtgggggacctggccgcccagatcagcaatgatgaggaggaggagtttgtgattgaatgtctgggcaccctggccaacctgaccatcccagacctggactgggagctggtgctgaaggagtacaagctggtgccctacctgaaggacaagctgaagccaggagctgctgaagatgacctggtgctggaggtggtgatcatgattggcaccgtgtccatggatgacagctgtgccgccctgctggccaagagcggcatcatcccagccctgattgagctgctgaatgcccagcaggaggatgatgaatttgtgtgccagatcatctacgtgttctaccagatggtgttccaccaggccaccagagatgtgatcatcaaggagacccaggccccagcctacctgattgacctgatgcatgacaagaacaatgagatcaggaaggtgtgtgacaacaccctggacatcatcgccgagtatgatgaggagtgggccaagaagatccagagcgagaagttccgctggcacaacagccagtggctggagatggtggagagccggcagatggatgaaagtgagcagtacctgtatggagatgacagaattgagccctacatccacgagggggacatcctggagaggccagacctcttctacaacagtgatggcctcatcgccagcgagggcgccatcagcccagacttcttcaatgactaccacctgcagaatggagatgtggtgggccagcacagcttccctggcagcctgggcatggatggcttcggccagcctgtgggcatcctgggccggcctgccacagcctacggcttccggccagatgagccctactactacggctacggcagctag

SEQ ID NO: 157141 - DNA, 2259 bp, Artificial Sequence
  Description of Artificial Sequence: Synthetic coding sequence
atgggagaccccatgctgggggagaggaaagaatgccagaagatcatccggctgaagagcctgaatgccaacacagacatcaccagcctggccaggaaggtggtggaggagtgcaagctgatccaccccagcaagctgaatgaggtggagcagctgctgtactacctgcagaacagaagagacagcctgagcggcaaggagaagaaggagaagagcagcaagcccaaggaccccccaccatttgagggcatggagattgatgaggtggccaacatcaatgacatggatgagtacatcgagctgctgtatgaggacatcccagacaaggtgcggggcagcgccctgatcctgcagctggccagaaatccagacaacctggaggagctgctgctgaatgaaacagccctgggcgccctggcccgggtgctgcgggaggactggaagcagagcgtggagctggccaccaacatcatctacatcttcttctgcttcagcagcttcagccagttccacggcctcatcacccactacaagattggagccctgtgcatgaacatcatcgaccacgagctgaagagacatgagctgtggcaggaggagctgagcaagaagaagaaggctgtggatgaggaccctgagaaccagaccctgaggaaggactatgagaagaccttcaagaagtaccagggcctggtggtgaagcaggagcagctgctgcgggtggccctgtacctgctgctgaacctggccgaggacaccaggacagagctgaagatgaggaacaagaacatcgtgcacatgctggtgaaggccctggaccgggacaactttgagctgctgatcctggtggtgtccttcctgaagaagctgagcatcttcatggagaacaagaatgacatggtggagatggacatcgtggagaagctggtgaagatgatcccctgtgaacatgaggacctgctgaacatcaccctgcggctgctgctgaacctgagctttgacaccggcctgaggaacaagatggtgcaggtgggcctgctgcccaagctgacagccctgctgggcaatgacaactacaagcagatcgccatgtgtgtgctgtaccacatctccatggatgaccgcttcaagtccatgtttgcctacacagactgcatcccccagctgatgaagatgctgtttgaatgttctgatgaaagaattgacctggagctgatctccttctgcatcaacctggccgccaacaagagaaatgtgcagctgatctgtgagggcaatggcctgaagatgctgatgaagagggccctgaagttcaaggaccccctgctgatgaagatgatccggaacatcagccagcatgatggccccaccaagaacctcttcatcgactatgtgggggacctggccgcccagatcagcaatgatgaggaggaggagtttgtgattgaatgtctgggcaccctggccaacctgaccatcccagacctggactgggagctggtgctgaaggagtacaagctggtgccctacctgaaggacaagctgaagccaggagctgctgaagatgacctggtgctggaggtggtgatcatgattggcaccgtgtccatggatgacagctgtgccgccctgctggccaagagcggcatcatcccagccctgattgagctgctgaatgcccagcaggaggatgatgaatttgtgtgccagatcatctacgtgttctaccagatggtgttccaccaggccaccagagatgtgatcatcaaggagacccaggccccagcctacctgattgacctgatgcatgacaagaacaatgagatcaggaaggtgtgtgacaacaccctggacatcatcgccgagtatgatgaggagtgggccaagaagatccagagcgagaagttccgctggcacaacagccagtggctggagatggtggagagccggcagatggatgaaagtgagcagtacctgtatggagatgacagaattgagccctacatccacgagggggacatcctggagaggccagacctcttctacaacagtgatggcctcatcgccagcgagggcgccatcagcccagacttcttcaatgactaccacctgcagaatggagatgtggtgggccagcacagcttccctggcagcctgggcatggatggcttcggccagcctgtgggcatcctgggccggcctgccacagcctacggcttccggccagatgagccctactactacggctacggcagctag

SEQ ID NO: 157142 - DNA, 2247 bp, Artificial Sequence
  Description of Artificial Sequence: Synthetic coding sequence
atgcagggagaagatgcccgctacctgaagagcatccggctgaagagcctgaatgccaacacagacatcaccagcctggccaggaaggtggtggaggagtgcaagctgatccaccccagcaagctgaatgaggtggagcagctgctgtactacctgcagaacagaagagacagcctgagcggcaaggagaagaaggagaagagcagcaagcccaaggaccccccaccatttgagggcatggagattgatgaggtggccaacatcaatgacatggatgagtacatcgagctgctgtatgaggacatcccagacaaggtgcggggcagcgccctgatcctgcagctggccagaaatccagacaacctggaggagctgctgctgaatgaaacagccctgggcgccctggcccgggtgctgcgggaggactggaagcagagcgtggagctggccaccaacatcatctacatcttcttctgcttcagcagcttcagccagttccacggcctcatcacccactacaagattggagccctgtgcatgaacatcatcgaccacgagctgaagagacatgagctgtggcaggaggagctgagcaagaagaagaaggctgtggatgaggaccctgagaaccagaccctgaggaaggactatgagaagaccttcaagaagtaccagggcctggtggtgaagcaggagcagctgctgcgggtggccctgtacctgctgctgaacctggccgaggacaccaggacagagctgaagatgaggaacaagaacatcgtgcacatgctggtgaaggccctggaccgggacaactttgagctgctgatcctggtggtgtccttcctgaagaagctgagcatcttcatggagaacaagaatgacatggtggagatggacatcgtggagaagctggtgaagatgatcccctgtgaacatgaggacctgctgaacatcaccctgcggctgctgctgaacctgagctttgacaccggcctgaggaacaagatggtgcaggtgggcctgctgcccaagctgacagccctgctgggcaatgacaactacaagcagatcgccatgtgtgtgctgtaccacatctccatggatgaccgcttcaagtccatgtttgcctacacagactgcatcccccagctgatgaagatgctgtttgaatgttctgatgaaagaattgacctggagctgatctccttctgcatcaacctggccgccaacaagagaaatgtgcagctgatctgtgagggcaatggcctgaagatgctgatgaagagggccctgaagttcaaggaccccctgctgatgaagatgatccggaacatcagccagcatgatggccccaccaagaacctcttcatcgactatgtgggggacctggccgcccagatcagcaatgatgaggaggaggagtttgtgattgaatgtctgggcaccctggccaacctgaccatcccagacctggactgggagctggtgctgaaggagtacaagctggtgccctacctgaaggacaagctgaagccaggagctgctgaagatgacctggtgctggaggtggtgatcatgattggcaccgtgtccatggatgacagctgtgccgccctgctggccaagagcggcatcatcccagccctgattgagctgctgaatgcccagcaggaggatgatgaatttgtgtgccagatcatctacgtgttctaccagatggtgttccaccaggccaccagagatgtgatcatcaaggagacccaggccccagcctacctgattgacctgatgcatgacaagaacaatgagatcaggaaggtgtgtgacaacaccctggacatcatcgccgagtatgatgaggagtgggccaagaagatccagagcgagaagttccgctggcacaacagccagtggctggagatggtggagagccggcagatggatgaaagtgagcagtacctgtatggagatgacagaattgagccctacatccacgagggggacatcctggagaggccagacctcttctacaacagtgatggcctcatcgccagcgagggcgccatcagcccagacttcttcaatgactaccacctgcagaatggagatgtggtgggccagcacagcttccctggcagcctgggcatggatggcttcggccagcctgtgggcatcctgggccggcctgccacagcctacggcttccggccagatgagccctactactacggctacggcagctag

SEQ ID NO: 157143 - DNA, 2145 bp, Artificial Sequence
  Description of Artificial Sequence: Synthetic coding sequence
atgagcatcgccctgggcaacacctaccgccgcagcctgagtgacagcgagaccgtgtctgtgctgcaggccagcctgtgtgaggagaagaaggagaagagcagcaagcccaaggaccccccaccatttgagggcatggagattgatgaggtggccaacatcaatgacatggatgagtacatcgagctgctgtatgaggacatcccagacaaggtgcggggcagcgccctgatcctgcagctggccagaaatccagacaacctggaggagctgctgctgaatgaaacagccctgggcgccctggcccgggtgctgcgggaggactggaagcagagcgtggagctggccaccaacatcatctacatcttcttctgcttcagcagcttcagccagttccacggcctcatcacccactacaagattggagccctgtgcatgaacatcatcgaccacgagctgaagagacatgagctgtggcaggaggagctgagcaagaagaagaaggctgtggatgaggaccctgagaaccagaccctgaggaaggactatgagaagaccttcaagaagtaccagggcctggtggtgaagcaggagcagctgctgcgggtggccctgtacctgctgctgaacctggccgaggacaccaggacagagctgaagatgaggaacaagaacatcgtgcacatgctggtgaaggccctggaccgggacaactttgagctgctgatcctggtggtgtccttcctgaagaagctgagcatcttcatggagaacaagaatgacatggtggagatggacatcgtggagaagctggtgaagatgatcccctgtgaacatgaggacctgctgaacatcaccctgcggctgctgctgaacctgagctttgacaccggcctgaggaacaagatggtgcaggtgggcctgctgcccaagctgacagccctgctgggcaatgacaactacaagcagatcgccatgtgtgtgctgtaccacatctccatggatgaccgcttcaagtccatgtttgcctacacagactgcatcccccagctgatgaagatgctgtttgaatgttctgatgaaagaattgacctggagctgatctccttctgcatcaacctggccgccaacaagagaaatgtgcagctgatctgtgagggcaatggcctgaagatgctgatgaagagggccctgaagttcaaggaccccctgctgatgaagatgatccggaacatcagccagcatgatggccccaccaagaacctcttcatcgactatgtgggggacctggccgcccagatcagcaatgatgaggaggaggagtttgtgattgaatgtctgggcaccctggccaacctgaccatcccagacctggactgggagctggtgctgaaggagtacaagctggtgccctacctgaaggacaagctgaagccaggagctgctgaagatgacctggtgctggaggtggtgatcatgattggcaccgtgtccatggatgacagctgtgccgccctgctggccaagagcggcatcatcccagccctgattgagctgctgaatgcccagcaggaggatgatgaatttgtgtgccagatcatctacgtgttctaccagatggtgttccaccaggccaccagagatgtgatcatcaaggagacccaggccccagcctacctgattgacctgatgcatgacaagaacaatgagatcaggaaggtgtgtgacaacaccctggacatcatcgccgagtatgatgaggagtgggccaagaagatccagagcgagaagttccgctggcacaacagccagtggctggagatggtggagagccggcagatggatgaaagtgagcagtacctgtatggagatgacagaattgagccctacatccacgagggggacatcctggagaggccagacctcttctacaacagtgatggcctcatcgccagcgagggcgccatcagcccagacttcttcaatgactaccacctgcagaatggagatgtggtgggccagcacagcttccctggcagcctgggcatggatggcttcggccagcctgtgggcatcctgggccggcctgccacagcctacggcttccggccagatgagccctactactacggctacggcagctag

SEQ ID NO: 157144 - DNA, 1485 bp, Artificial Sequence
  Description of Artificial Sequence: Synthetic coding sequence
atgaggaacaagaacatcgtgcacatgctggtgaaggccctggaccgggacaactttgagctgctgatcctggtggtgtccttcctgaagaagctgagcatcttcatggagaacaagaatgacatggtggagatggacatcgtggagaagctggtgaagatgatcccctgtgaacatgaggacctgctgaacatcaccctgcggctgctgctgaacctgagctttgacaccggcctgaggaacaagatggtgcaggtgggcctgctgcccaagctgacagccctgctgggcaatgacaactacaagcagatcgccatgtgtgtgctgtaccacatctccatggatgaccgcttcaagtccatgtttgcctacacagactgcatcccccagctgatgaagatgctgtttgaatgttctgatgaaagaattgacctggagctgatctccttctgcatcaacctggccgccaacaagagaaatgtgcagctgatctgtgagggcaatggcctgaagatgctgatgaagagggccctgaagttcaaggaccccctgctgatgaagatgatccggaacatcagccagcatgatggccccaccaagaacctcttcatcgactatgtgggggacctggccgcccagatcagcaatgatgaggaggaggagtttgtgattgaatgtctgggcaccctggccaacctgaccatcccagacctggactgggagctggtgctgaaggagtacaagctggtgccctacctgaaggacaagctgaagccaggagctgctgaagatgacctggtgctggaggtggtgatcatgattggcaccgtgtccatggatgacagctgtgccgccctgctggccaagagcggcatcatcccagccctgattgagctgctgaatgcccagcaggaggatgatgaatttgtgtgccagatcatctacgtgttctaccagatggtgttccaccaggccaccagagatgtgatcatcaaggagacccaggccccagcctacctgattgacctgatgcatgacaagaacaatgagatcaggaaggtgtgtgacaacaccctggacatcatcgccgagtatgatgaggagtgggccaagaagatccagagcgagaagttccgctggcacaacagccagtggctggagatggtggagagccggcagatggatgaaagtgagcagtacctgtatggagatgacagaattgagccctacatccacgagggggacatcctggagaggccagacctcttctacaacagtgatggcctcatcgccagcgagggcgccatcagcccagacttcttcaatgactaccacctgcagaatggagatgtggtgggccagcacagcttccctggcagcctgggcatggatggcttcggccagcctgtgggcatcctgggccggcctgccacagcctacggcttccggccagatgagccctactactacggctacggcagctag

SEQ ID NO: 157145 - DNA, 1935 bp, Artificial Sequence
  Description of Artificial Sequence: Synthetic coding sequence
atgaagctgatcaccatcctcttcctgtgcagccggctgctgctgagcctgacccaggagagccagagcgaggagattgactgcaatgacaaggacctcttcaaggctgtggatgctgccctgaagaagtacaacagccagaaccagagcaacaaccagtttgtgctgtaccgcatcacagaggccaccaagacagtgggcagtgacaccttctacagcttcaagtatgagatcaaggagggggactgccctgtgcagagcggcaagacctggcaggactgtgagtacaaggatgctgccaaggccgccaccggggagtgcacagccaccgtgggcaagaggagcagcaccaagttctctgtggccacccagacctgccagatcaccccagctgagggccctgtggtgacagcccagtatgactgcctgggctgtgtgcaccccatcagcacccagagcccagacctggagcccatcctgcggcacggcatccagtacttcaacaacaacacccagcacagcagcctcttcatgctgaatgaggtgaagagggcccagaggcaggtggtggccggcctgaacttccgcatcacctacagcatcgtgcagaccaactgcagcaaagaaaacttcctgttcctgaccccagactgcaagagcctgtggaatggagacaccggggagtgcacagacaatgcctacatcgacatccagctgagaattgccagcttcagccagaactgtgacatctacccaggcaaggactttgtgcagccccccaccaagatctgtgtgggctgcccccgggacatccccaccaacagccctgagctggaggagaccctgacccacaccatcaccaagctgaatgctgagaacaatgccaccttctacttcaagattgacaacgtgaagaaggcccgggtgcaggtggtggccggcaagaagtacttcatcgactttgtggcccgggagaccacctgcagcaaggagagcaatgaggagctgacagagagctgtgagaccaagaagctgggccagagcctggactgcaatgctgaggtgtatgtggtgccctgggagaagaagatctaccccaccgtgaactgccagcccctgggcatgatcagcctgatgaagaggcctcctggcttcagccccttccgcagcagcagaattggagagatcaaggaggagaccaccgtgagccccccccacacctccatggccccagcccaggatgaggagcgggacagcggcaaggagcagggccacaccaggagacatgactggggccacgagaagcagaggaagcacaacctgggccacggccacaagcatgagcgggaccagggccacggccaccagaggggccacggcctgggccacggccacgagcagcagcacggcctgggccacggccacaagttcaagctggatgatgacctggagcaccagggcggccacgtgctggaccacggccacaagcacaagcacggccacggccacggcaagcacaagaacaagggcaagaagaatggcaagcacaacggctggaagacagagcacctggccagcagcagcgaggacagcaccaccccatctgcccagacccaggagaagacagagggccccacccccatccccagcctggccaagccaggagtgacagtgaccttcagtgacttccaggacagcgacctgattgccaccatgatgccacccatcagccctgcccccatccagagtgatgatgactggatcccagacatccagattgaccccaacggcctgtccttcaaccccatcagtgacttcccagacaccaccagccccaagtgccccggccggccctggaagtctgtgtctgagatcaaccccaccacccagatgaaggagagctactactttgacctgacagatggcctgtcctag

SEQ ID NO: 157146 - DNA, 1284 bp, Artificial Sequence
  Description of Artificial Sequence: Synthetic coding sequence
atgaagctgatcaccatcctcttcctgtgcagccggctgctgctgagcctgacccaggagagccagagcgaggagattgactgcaatgacaaggacctcttcaaggctgtggatgctgccctgaagaagtacaacagccagaaccagagcaacaaccagtttgtgctgtaccgcatcacagaggccaccaagacagtgggcagtgacaccttctacagcttcaagtatgagatcaaggagggggactgccctgtgcagagcggcaagacctggcaggactgtgagtacaaggatgctgccaaggccgccaccggggagtgcacagccaccgtgggcaagaggagcagcaccaagttctctgtggccacccagacctgccagatcaccccagctgagggccctgtggtgacagcccagtatgactgcctgggctgtgtgcaccccatcagcacccagagcccagacctggagcccatcctgcggcacggcatccagtacttcaacaacaacacccagcacagcagcctcttcatgctgaatgaggtgaagagggcccagaggcaggtggtggccggcctgaacttccgcatcacctacagcatcgtgcagaccaactgcagcaaagaaaacttcctgttcctgaccccagactgcaagagcctgtggaatggagacaccggggagtgcacagacaatgcctacatcgacatccagctgagaattgccagcttcagccagaactgtgacatctacccaggcaaggactttgtgcagccccccaccaagatctgtgtgggctgcccccgggacatccccaccaacagccctgagctggaggagaccctgacccacaccatcaccaagctgaatgctgagaacaatgccaccttctacttcaagattgacaacgtgaagaaggcccgggtgcaggtggtggccggcaagaagtacttcatcgactttgtggcccgggagaccacctgcagcaaggagagcaatgaggagctgacagagagctgtgagaccaagaagctgggccagagcctggactgcaatgctgaggtgtatgtggtgccctgggagaagaagatctaccccaccgtgaactgccagcccctgggcatgatcagcctgatgaagaggcctcctggcttcagccccttccgcagcagcagaattggagagatcaaggaggagaccaccagccacctgcggagctgtgagtacaagggccggccccccaaggccggggctgagcccgccagcgagcgggaggtgtcctag

SEQ ID NO: 157147 - DNA, 1248 bp, Artificial Sequence
  Description of Artificial Sequence: Synthetic coding sequence
atgaagctgagcctgacccaggagagccagagcgaggagattgactgcaatgacaaggacctcttcaaggctgtggatgctgccctgaagaagtacaacagccagaaccagagcaacaaccagtttgtgctgtaccgcatcacagaggccaccaagacagtgggcagtgacaccttctacagcttcaagtatgagatcaaggagggggactgccctgtgcagagcggcaagacctggcaggactgtgagtacaaggatgctgccaaggccgccaccggggagtgcacagccaccgtgggcaagaggagcagcaccaagttctctgtggccacccagacctgccagatcaccccagctgagggccctgtggtgacagcccagtatgactgcctgggctgtgtgcaccccatcagcacccagagcccagacctggagcccatcctgcggcacggcatccagtacttcaacaacaacacccagcacagcagcctcttcatgctgaatgaggtgaagagggcccagaggcaggtggtggccggcctgaacttccgcatcacctacagcatcgtgcagaccaactgcagcaaagaaaacttcctgttcctgaccccagactgcaagagcctgtggaatggagacaccggggagtgcacagacaatgcctacatcgacatccagctgagaattgccagcttcagccagaactgtgacatctacccaggcaaggactttgtgcagccccccaccaagatctgtgtgggctgcccccgggacatccccaccaacagccctgagctggaggagaccctgacccacaccatcaccaagctgaatgctgagaacaatgccaccttctacttcaagattgacaacgtgaagaaggcccgggtgcaggtggtggccggcaagaagtacttcatcgactttgtggcccgggagaccacctgcagcaaggagagcaatgaggagctgacagagagctgtgagaccaagaagctgggccagagcctggactgcaatgctgaggtgtatgtggtgccctgggagaagaagatctaccccaccgtgaactgccagcccctgggcatgatcagcctgatgaagaggcctcctggcttcagccccttccgcagcagcagaattggagagatcaaggaggagaccaccagccacctgcggagctgtgagtacaagggccggccccccaaggccggggctgagcccgccagcgagcgggaggtgtcctag

SEQ ID NO: 157148 - DNA, 1176 bp, Artificial Sequence
  Description of Artificial Sequence: Synthetic coding sequence
atgaagctgatcaccatcctcttcctgtgcagccggctgctgctgagcctgacccaggagagccagagcgaggagattgactgcaatgacaaggacctcttcaaggctgtggatgctgccctgaagaagtacaacagccagaaccagagcaacaaccagtttgtgctgtaccgcatcacagaggccaccaagacagtgggcagtgacaccttctacagcttcaagtatgagatcaaggagggggactgccctgtgcagagcggcaagacctggcaggactgtgagtacaaggatgctgccaaggccgccaccggggagtgcacagccaccgtgggcaagaggagcagcaccaagttctctgtggccacccagacctgccagatcaccccagctgagggccctgtggtgacagcccagtatgactgcctgggctgtgtgcaccccatcagcacccagagcccagacctggagcccatcctgcggcacggcatccagtacttcaacaacaacacccagcacagcagcctcttcatgctgaatgaggtgaagagggcccagaggcaggacaccggggagtgcacagacaatgcctacatcgacatccagctgagaattgccagcttcagccagaactgtgacatctacccaggcaaggactttgtgcagccccccaccaagatctgtgtgggctgcccccgggacatccccaccaacagccctgagctggaggagaccctgacccacaccatcaccaagctgaatgctgagaacaatgccaccttctacttcaagattgacaacgtgaagaaggcccgggtgcaggtggtggccggcaagaagtacttcatcgactttgtggcccgggagaccacctgcagcaaggagagcaatgaggagctgacagagagctgtgagaccaagaagctgggccagagcctggactgcaatgctgaggtgtatgtggtgccctgggagaagaagatctaccccaccgtgaactgccagcccctgggcatgatcagcctgatgaagaggcctcctggcttcagccccttccgcagcagcagaattggagagatcaaggaggagaccaccagccacctgcggagctgtgagtacaagggccggccccccaaggccggggctgagcccgccagcgagcgggaggtgtcctag

SEQ ID NO: 157149 - DNA, 306 bp, Artificial Sequence
  Description of Artificial Sequence: Synthetic coding sequence
atggacatccccatcagcagccgggacttccggggcctgcagctggcctgtgtggccctgggcctggtggccggcagcatcatcatcggcatctctgtgtccaaggctgctgctgccatgggcggcgtcttcatcggggctgctgtgctgggcagcctgcgcatccacccccaccctggagctgaccatggagagggccgcagcagcaccaatggaaacaaggagggcgcccggagcagcctgagcacagtgtccaggaccctggagaagctgaagccaggcaccagaggagctgaggagtgctag

SEQ ID NO: 157150 - DNA, 375 bp, Artificial Sequence
  Description of Artificial Sequence: Synthetic coding sequence
atggacatccccatcagcagccgggacttccggggcctgcagctggcctgtgtggccctgggcctggtggccggcagcatcatcatcggcatctctgtgtccaaggctgctgctgccatgggcggcgtcttcatcggggctgctgtgctgggcctgctgatcctggcctaccccttcctgaaggcccgcttcaacctggaccacatcctgcccaccatcggcagcctgcgcatccacccccaccctggagctgaccacggggagggccgcagcagcaccaacggcaacaaggagggcgcccggagcagcctgagcacagtgtccaggaccctggagaagctgaagccaggcaccagaggagcagaagaatgttag

SEQ ID NO: 157151 - DNA, 3135 bp, Artificial Sequence
  Description of Artificial Sequence: Synthetic coding sequence
atgaagccaggctgtgccgccggcagccctggaaatgagtggatcttcttcagcacagatgagatcaccacccgctacagaaacaccatgagcaatggaggcctgcagaggagcgtcatcctgagcgccctgatcctgctgcgggctgtgacaggcttctctggagatggccgggccatctggagcaagaaccccaacttcacccctgtgaatgaaagccagctgttcctgtatgacaccttccccaagaacttcttctggggcattggaactggagccctgcaggtggagggctcctggaagaaggatggcaagggccccagcatctgggaccacttcatccacacccacctgaagaatgtgagcagcaccaacggcagcagtgacagctacatcttcctggagaaggacctgagcgccctggacttcatcggcgtgtccttctaccagttcagcatctcctggcccaggctcttcccagatggcatcgtgacagtggccaatgccaagggcctgcagtactacagcaccctgctggatgccctggtgctgagaaatattgagcccatcgtgaccctgtaccactgggacctgcccctggccctgcaggagaagtatggaggctggaagaatgacaccatcatcgacatcttcaatgactatgccacctactgcttccagatgtttggagacagagtgaagtactggatcaccatccacaacccctacctggtggcctggcacggctacggcaccggcatgcacgcccctggagagaagggcaacctggccgctgtgtacacagtgggccacaacctgatcaaggcccacagcaaggtgtggcacaactacaacacccacttccggccccaccagaagggctggctgagcatcaccctgggcagccactggattgagcccaacagaagtgagaacaccatggacatcttcaagtgccagcagagcatggtgtctgtgctgggctggtttgccaaccccatccatggagatggagactacccagagggcatgaggaagaagctgttctctgtgctgcccatcttcagcgaggccgagaagcatgagatgaggggcacagctgacttctttgccttctcctttggccccaacaacttcaagcccctgaacaccatggccaagatgggccagaatgtgtccctgaacctgcgggaggccctgaactggatcaagctggagtacaacaacccccgcatcctgattgctgaaaatggctggttcacagacagccgggtgaagacagaggacaccacagccatctacatgatgaagaacttcctgagccaggtgctgcaggccatccggctggatgagatccgggtgtttggctacacagcctggagcctgctggatggctttgagtggcaggatgcctacaccatcagaagaggcctcttctacgtggacttcaacagcaagcagaaggagaggaagcccaagagcagcgcccactactacaagcagatcatcagagaaaatggcttcagcctgaaggagagcaccccagatgtgcagggccagttcccctgtgacttctcctggggcgtgacagagagcgtgctgaagccagagagcgtggccagcagcccccagttcagtgacccccacctgtatgtgtggaatgccaccggcaaccggctgctgcaccgggtggagggcgtgcggctgaagaccaggcctgcccagtgcacagactttgtgaacatcaagaagcagctggagatgctggccaggatgaaggtgacccactacagatttgccctggactgggcctctgtgctgcccactggaaacctgtctgctgtgaaccggcaggccctgcgctactaccgctgtgtggtgtctgagggcctgaagctgggcatcagcgccatggtgaccctgtactaccccacccacgcccacctgggcctgcctgagcccctgctgcacgcagatggctggctgaaccccagcacagctgaggccttccaggcctatgccggcctgtgcttccaggagctgggggacctggtgaagctgtggatcaccatcaatgagcccaaccggctgagtgacatctacaacagaagtggaaatgacacctatggagctgcccacaacctgctggtggcccacgccctggcctggaggctgtatgaccggcagttccggcccagccagagaggagctgtgtccctgagcctgcacgccgactgggccgagcccgccaacccctatgctgacagccactggagggctgctgagcgcttcctgcagtttgaaattgcctggtttgctgagcccctcttcaagacaggagactacccagctgccatgagggagtacatcgccagcaagcacagaagaggcctgagcagcagcgccctgccccggctgacagaagctgagcggcggctgctgaagggcaccgtggacttctgtgccctgaaccacttcaccaccaggtttgtgatgcatgagcagctggccggcagccgctatgacagcgaccgggacatccagttcctgcaggacatcacccggctgagcagccccacccggctggccgtcatcccctggggcgtgaggaagctgctgcgctgggtgagaagaaactacggggacatggacatctacatcacagccagcggcattgatgaccaggccctggaggatgaccggctgaggaagtactacctgggcaagtacctgcaggaggtgctgaaggcctacctgattgacaaggtgcgcatcaagggctactatgccttcaagctggccgaggagaagagcaagccccgcttcggcttcttcaccagtgacttcaaggccaagagcagcatccagttctacaacaaggtgatcagcagccggggcttcccctttgagaacagcagcagccgctgcagccagacccaggagaacacagagtgcaccgtgtgcctcttcctggtgcagaagaagcccctcatcttcctgggctgctgcttcttcagcaccctggtgctgctgctgagcatcgccatcttccagaggcagaagaggaggaagttctggaaggccaagaacctgcagcacatccccctgaagaagggcaagagggtggtgtcctag

SEQ ID NO: 157152 - DNA, 1389 bp, Artificial Sequence
  Description of Artificial Sequence: Synthetic coding sequence
atgggcacccaggccctgcagggcttcctgttcctgctcttcctgcccctgctgcagcccaggggggccagcgctggcagcctgcacagccctggcctgtctgagtgcttccaggtgaatggagctgactaccggggccaccagaacagaacaggccccaggggggccggccggccctgcctcttctgggaccagacccagcagcacagctacagcagcgccagtgacccccacggccgctggggcctgggcgcccacaacttctgcaggaacccagatggagatgtgcagccctggtgctacgtggccgagacagaggagggcatctactggagatactgtgacatccccagctgccacatgcctggctacctgggctgctttgtggacagcggggcccccccagccctgagcggccccagcggcaccagcaccaagctgactgtgcaggtgtgcctgcgcttctgcaggatgaagggctaccagctggccggcgtggaggccggctacgcctgcttctgtggcagcgagagtgacctggcccggggccgcctggccccagccacagactgtgaccagatctgcttcggccaccctggccagctgtgtggaggagatggccgcctgggcgtgtatgaggtgtctgtgggcagctgccagggcaactggacagccccccagggcgtcatctacagcccagacttcccagatgaatatggccctgacaggaactgctcctgggccctgggccccccaggggccgccctggagctgaccttccggctgtttgagctggccgacccccgggaccggctggagctgagagatgctgccagcggcagcctgctgcgggcctttgatggagcccggcccccacccagcggccccctgcggctgggcacagctgccctgctgctgaccttcagaagtgatgcccggggccacgcccagggctttgccctgacctaccggggcctgcaggatgctgctgaagatcctgaggcccctgagggcagcgcccagaccccagctgcccccctggatggagccaacgtgtcctgcagccccaggcctggggcccctcctgctgccatcggggcccgggtcttcagcacagtgacagctgtgtctgtgctgctgctgctgctgctgggcctgctgcggcccctgcggcggcgcagctgcctgctggcccctggaaaaggacctccagccctgggcgccagccggggccccaggaggtcctgggccgtgtggtaccagcagccccggggcgtggccctgccctgcagccctggggacccccaggccgagggcagcgctgctggctaccggcccctgagcgccagcagccagagcagcctgcggagcctcatcagcgccctgtag

SEQ ID NO: 157153 - DNA, 1263 bp, Artificial Sequence
  Description of Artificial Sequence: Synthetic coding sequence
atgggcacccaggccctgcagggcttcctgttcctgctcttcctgcccctgctgcagcccaggggggccagcgctggcagcctgcacagccctggcctgtctgagtgcttccaggtgaatggagctgactaccggggccaccagaacagaacaggccccaggggggccggccggccctgcctcttctgggaccagacccagcagcacagctacagcagcgccagtgacccccacggccgctggggcctgggcgcccacaacttctgcaggaacccagatggagatgtgcagccctggtgctacgtggccgagacagaggagggcatctactggagatactgtgacatccccagctgccacatgcctggctacctgggctgctttgtggacagcggggcccccccagccctgagcggccccagcggcaccagcaccaagctgactgtgcaggtgtgcctgcgcttctgcaggatgaagggctaccagctggccggcgtggaggccggctacgcctgcttctgtggcagcgagagtgacctggcccggggccgcctggccccagccacagactgtgaccagatctgcttcggccaccctggccagctgtgtggaggagatggccgcctgggcgtgtatgaggtgtctgtgggcagctgccagggcaactggacagccccccagggcgtcatctacagcccagacttcccagatgaatatggccctgacaggaactgctcctgggccctgggccccccaggggccgccctggagctgaccttccggctgtttgagctggccgacccccgggaccggctggagctgagagatgctgccagcggcagcctgctgcgggcctttgatggagcccggcccccacccagcggccccctgcggctgggcacagctgccctgctgctgaccttcagaagtgatgcccggggccacgcccagggctttgccctgacctaccggggcctgcaggatgctgctgaagatcctgaggcccctgagggcagcgcccagaccccagctgcccccctggatggagccaacgtgtcctgcagccccaggcctggggcccctcctgctgccatcggcggcgctgtgtgctggctgcgggagaagggcccccggcgctggggcctgcccggggcccctggagaggccggcctgtgtggcaccaacagccctgagggctggccctgcccagcccctcctggcaccccccggctgcgggtgctgccccgggccaccggcctgtag

SEQ ID NO: 157154 - DNA, 1272 bp, Artificial Sequence
  Description of Artificial Sequence: Synthetic coding sequence
atgggcacccaggccctgcagggcttcctgttcctgctcttcctgcccctgctgcagcccaggggggccagcgctggcagcctgcacagccctggcctgtctgagtgcttccaggtgaatggagctgactaccggggccaccagaacagaacaggccccaggggggccggccggccctgcctcttctgggaccagacccagcagcacagctacagcagcgccagtgacccccacggccgctggggcctgggcgcccacaacttctgcaggaacccagatggagatgtgcagccctggtgctacgtggccgagacagaggagggcatctactggagatactgtgacatccccagctgccacatgcctggctacctgggctgctttgtggacagcggggcccccccagccctgagcggccccagcggcaccagcaccaagctgactgtgcaggtgtgcctgcgcttctgcaggatgaagggctaccagctgtgtggaggagatggccgcctgggcgtgtatgaggtgtctgtgggcagctgccagggcaactggacagccccccagggcgtcatctacagcccagacttcccagatgaatatggccctgacaggaactgctcctgggccctgggccccccaggagctgccctggagctgaccttccggctgtttgagctggccgacccccgggaccggctggagctgagagatgctgccagcggcagcctgctgcgggcctttgatggagcccggcccccaccttctggccccctgcggctgggcacagctgccctgctgctgaccttcagaagtgatgcccggggccacgcccagggctttgccctgacctaccggggcctgcaggatgctgctgaggaccctgaggcccctgagggcagcgcccagaccccagctgcccccctggatggagccaacgtgtcctgcagccccaggcctggggcccccccagctgccatcggggcccgggtcttcagcacagtgacagctgtgtctgtgctgctgctgctgctgctgggcctgctgcggcccctgcggcggcgcagctgcctgctggcccctgggaagggccccccagccctgggcgccagccggggcccccggcgctcctgggccgtgtggtaccagcagccccggggcgtggccctgccctgcagccctggggacccccaggccgagggcagcgctgctggctaccggcccctgagcgccagcagccagagcagcctgcggagcctcatcagcgccctgtag

SEQ ID NO: 157155 - DNA, 1146 bp, Artificial Sequence
  Description of Artificial Sequence: Synthetic coding sequence
atgggcacccaggccctgcagggcttcctgttcctgctcttcctgcccctgctgcagcccaggggggccagcgctggcagcctgcacagccctggcctgtctgagtgcttccaggtgaatggagctgactaccggggccaccagaacagaacaggccccaggggggccggccggccctgcctcttctgggaccagacccagcagcacagctacagcagcgccagtgacccccacggccgctggggcctgggcgcccacaacttctgcaggaacccagatggagatgtgcagccctggtgctacgtggccgagacagaggagggcatctactggagatactgtgacatccccagctgccacatgcctggctacctgggctgctttgtggacagcggggcccccccagccctgagcggccccagcggcaccagcaccaagctgactgtgcaggtgtgcctgcgcttctgcaggatgaagggctaccagctgtgtggaggagatggccgcctgggcgtgtatgaggtgtctgtgggcagctgccagggcaactggacagccccccagggcgtcatctacagcccagacttcccagatgaatatggccctgacaggaactgctcctgggccctgggccccccaggagctgccctggagctgaccttccggctgtttgagctggccgacccccgggaccggctggagctgagagatgctgccagcggcagcctgctgcgggcctttgatggagcccggcccccaccttctggccccctgcggctgggcacagctgccctgctgctgaccttcagaagtgatgcccggggccacgcccagggctttgccctgacctaccggggcctgcaggatgctgctgaggaccctgaggcccctgagggcagcgcccagaccccagctgcccccctggatggagccaacgtgtcctgcagccccaggcctggggcccccccagctgccatcggcggcgctgtgtgctggctgcgggagaagggcccccggcgctggggcctgcccggggcccctggagaggccggcctgtgtggcaccaacagccctgagggctggccctgcccagcccctcctggcaccccccggctgcgggtgctgccccgggccaccggcctgtag

SEQ ID NO: 157156 - DNA, 2211 bp, Artificial Sequence
  Description of Artificial Sequence: Synthetic coding sequence
atgggcaacccagaaaatattgaagatgcctacgtggccgtcatccggcccaagaacacagccagcctgaacagccgggagtaccgggccaagagctatgagatcctgctgcacgaggtgcccatcgagggccagaagaagaagaggaagaaggtgctgctggagaccaagctgcagggcaacagcgagatcacccagggcatcctggactatgtggtggagaccaccaagcccatcagccctgccaaccagggcatccggggcaagagggtggtgctgatgaagaagttccccctggatggagagaagatgggccgggaggccagcctcttcatcgtgcccagcgtggtgaaggacaacaccaagtacacctacaccccaggctgccccatcttctactgcctgcaggacatcatgagggtgtgcagcgagagcagcacccactttgccaccctgacagccaggatgctgattgccctggacaagtggctggatgaaagacatgcccagagccacttcatcccagccctcttccggcccagccccctggagcgcatcaagaccaacgtcatcaacccagcctatgccacagaaagtggccagacagagaacagcctgcacatgggctacagcgccctggagatcaagagcaagatgctggccctggagaaggctgacacctgcatctacaaccccctgtttggaagtgacctgcagtacaccaacagagtggacaaggtggtgatcaacccctacttcggcctgggcgccccagactacagcaagatccagatccccaagcaggagaagtggcagaggtccatgagctctgtgacagaggacaaggagcggcagtgggtggatgacttccccctgcacaggtctgcctgtgagggggacagcgagctgctgagccggctgctgtctgagcgcttctctgtgaaccagctggacagcgaccactgggcccccatccactacgcctgctggtacggcaaggtggaggccacccgcatcctgctggagaagggcaagtgcaaccccaacctgctgaatggccagctgagcagccccctgcactttgctgctgggggcggccacgccgagatcgtgcagatcctgctgaaccaccctgagacagacagacacatcacagaccagcagggccgcagccccctgaacatctgtgaggagaacaagcagaacaactgggaggaggccgccaagctgctgaaggaggccatcaacaagccctatgagaaggtgcgcatctacaggatggatggcagctacagatctgtggagctgaagcacggcaacaacaccaccgtgcagcagatcatggagggcatgaggctgagccaggagacccagcagtacttcaccatctggatctgcagcgagaacctgagcctgcagctgaagccctaccacaagcccctgcagcacgtgcgggactggccagagatcctggccgagctgaccaacctggacccccagcgggagaccccccagctgttcctgcggagagatgtgcggctgcccctggaggtggagaagcagatcgaggaccccctggccatcctgatcctgtttgatgaggcccgctacaacctgctgaagggcttctacacagccccagatgccaagctgatcaccctggccagcctgctgctgcagatcgtgtatggcaactatgagagcaagaagcacaagcagggcttcctgaatgaggagaacctgaagagcatcgtgcctgtgaccaagctgaagagcaaggccccccactggaccaaccgcatcctgcacgagtacaagaacctgagcaccagcgagggcgtgtccaaggagatgcaccacctgcagaggatgttcctgcagaactgctgggagatccccacctatggagctgccttcttcaccggccagatcttcaccaaggccagccccagcaaccacaaggtgattcctgtgtatgtgggcgtgaacatcaagggcctgcacctgctgaacatggagaccaaggccctgctgatcagcctgaagtatggctgcttcatgtggcagctgggggacacagacacctgcttccagatccacagcatggagaacaagatgtccttcatcgtgcacaccaagcaggccggcctggtggtgaagctgctgatgaagctgaatggccagctgatgcccacagagaggaacagctag

SEQ ID NO: 157157 - DNA, 3624 bp, Artificial Sequence
  Description of Artificial Sequence: Synthetic coding sequence
atggacctgcacatgatgaactgtgagctgctggccacctgcagcgccctgggctacctggagggggacacctaccacaaggagccagactgcctggagagcgtgaaggacctgatccgctacctgcggcatgaagatgagaccagagatgtgcggcagcagctgggcgccgcccagatcctgcagagcgacctgctgcccatcctgacccagcaccaccaggacaagcccctgtttgatgctgtgatccggctgatggtgaacctgacccagcctgccctgctgtgctttggaaacctgcccaaggagcccagcttccgccaccacttcctgcaggtgctgacctacctgcaggcctacaaggaggcctttgccagcgagaaggccttcggcgtgctgtctgagaccctgtatgagctgctgcagctgggctgggaggagcggcaggaggaggacaacctgctgattgaaagaatcctgctgctggtgaggaacatcctgcacgtgcctgctgacctggaccaggagaagattgatgatgatgccagcgcccatgaccagctgctgtgggccatccacctgagcggcctggatgacctgctgctcttcctggccagcagcagcgctgaggagcagtggagcctgcacgtgctggagatcgtgtccctgatgttccgggaccagaaccctgagcagctggccggcgtgggccagggccgcctggcccaggagaggtctgctgactttgctgagctggaggtgctgcggcagcgggagatggccgagaagaagacccgggccctgcagaggggcaacagacacagcagatttggaggcagctacatcgtgcagggcctgaagagcattggagagcgggacctgatcttccacaagggcctgcacaacctgaggaactacagcagtgacctgggcaagcagcccaagaaggtgcccaagaggcggcaggccgcccgggagctgagcatccagaggagaagtgccctgaatgtgcggctcttcctgcgggacttctgcagcgagttcctggagaactgctacaaccggctgatgggctctgtgaaggaccacctgctgcgggagaaggcccagcagcatgatgagacctactacatgtgggccctggccttcttcatggccttcaacagagctgccagcttccggcccggcctggtgtctgagaccctgtctgtgaggaccttccacttcatcgagcagaacctgaccaactactatgagatgatgctgacagacaggaaggaggccgcctcctgggcccggaggatgcacctggccctgaaggcctaccaggagctgctggccaccgtgaatgagatggacatcagcccagatgaagctgtgcgggagagcagccgcatcatcaagaacaacatcttctacgtgatggagtaccgggagctgttcctggccctcttcaggaagtttgatgagcgctgccagcccaggagcttcctgcgggacctggtggagaccacccacctgttcctgaagatgctggagcgcttctgccgcagccggggcaacctggtggtgcagaacaagcagaagaagaggaggaagaagaagaagaaggtgctggaccaggccatcgtgtctggaaatgtgcccagcagccctgaggaggtggaggccgtgtggccagccctggccgagcagctgcagtgctgtgcccagaacagcgagctgtccatggattctgtggtgccctttgatgctgccagcgaggtgcctgtggaggagcagagagctgaggccatggtgcgcatccaggactgcctgctggccggccaggccccccaggccctgaccctgctgcggagcgcccgggaggtgtggccagaaggagatgtgtttggcagccaggacatcagccctgaggaggagatccagctgctgaagcagatcctgagcgcccccctgccccggcagcagggccctgaggagagaggagctgaggaggaggaggaggaggaggaggaggaggaggaggagctgcaggtggtgcaggtgtctgagaaggagttcaacttcctggactacctgaagagatttgcctgcagcacagtggtgcgggcctacgtgctgctgctgcggagctaccagcagaacagcgcccacaccaaccactgcatcgtgaagatgctgcaccggctggcccatgacctgaagatggaggccctgctcttccagctgtctgtgttctgcctcttcaaccggctgctgagtgaccctgctgctggggcctacaaggagctggtgacctttgccaagtacatcctgggcaagttctttgccctggccgctgtgaaccagaaggcctttgtggagctgctcttctggaagaacacagctgtggtgcgggagatgacagagggctacggcagcctggatgacaggagcagcagccggcgggcccccacctggagccctgaggaggaggcccacctgcgggagctgtacctggccaacaaggatgtggagggccaggatgtggtggaggccatcctggcccacctgaacacagtgcccaggaccaggaagcagatcatccaccacctggtgcagatgggcctggccgacagcgtgaaggacttccagaggaagggcacccacatcgtgctgtggacaggagaccaggagctggagctgcagaggctgtttgaggagttccgggacagtgatgatgtgctgggccacatcatgaagaacatcacagccaagaggagccgggcccgcatcgtggacaagctgctggccctgggcctggtggccgagcggcgggagctgtacaagaagaggcagaagaagctggccagcagcatcctgcccaatggagctgagagcctgaaggacttctgccaggaggacctggaggaggaggagaacctgcctgaagaagattctgaggaggaggaggagggcggcagcgaggccgagcaggtgcagggcagcctggtgctgagcaatgaaaacctgggccagagcctgcaccaggagggcttcagcatccccctgctgtggctgcagaactgcctgatccgggctgctgatgaccgggaggaggatggctgcagccaggccgtgcccctggtgcccctgacagaagaaaatgaggaggccatggagaatgagcagttccagcagctgctgaggaagctgggcgtgcggcccccagccagcggccaggagaccttctggaggatcccagccaagctgagccccacccagctgcggcgggccgccgccagcctgagccagcctgaggaggagcagaagctgcagcctgagctgcagcccaaggtgcctggagagcagggcagtgatgaggagcactgcaaggagcaccgggcccaggccctgcgggccctgctgctggcccacaagaagaaggccggcctggccagccctgaggaggaggatgctgtgggcaaggagcccctgaaggccgcccccaagaagaggcagctgctggacagtgatgaggagcaggaggaggatgagggcaggaacagagcccctgagctgggcgcccctggcatccagaagaagaagcgctaccagattgaagatgatgaagatgactag

SEQ ID NO: 157158 - DNA, 1539 bp, Artificial Sequence
  Description of Artificial Sequence: Synthetic coding sequence
atgcacaccccagactttgctggcccagatgatgcccgggctgtggacatcatggacatctgtgagagcatcctggagaggaagagacatgacagcgagaggagcacctgcagcatcctggagcagacagacatggaggccgtggaggccctggtgtgcatgagctcctggggccagaggagccagaagggggacctgctgcgcatccggcccctgacccctgtgtctgacagcggagatgtgaccaccaccgtgcacatggatgctgccaccccagagctgcccaaggacttccacagcctgagcaccctgtgcatcaccccaccccagagcccagacctggtggagcccagcaccaggacccctgtgagcccccaggtgacagacagcaaggcctgcacagccacagatgtgctgcagagcagcgctgtggtggcccgggccctgagcggcggcgctgagcggggcctgctgggcctggagcctgtgcccagcagcccctgccgggccaagggcaccagcgtcatccgccacactggagagagccctgctgcctgcttccccaccatccagaccccagactgccgcctgagtgacagccgggagggggaggagcagctgctgggccactttgagaccctgcaggacacccacctgacagacagcctgctgagcaccaacctggtgtcctgccagccctgcctgcacaagagcggcggcctgctgctgacagacaagggccagcaggccggctggccaggagctgtgcagacctgcagccccaagaactatgaaaatgacctgcccaggaagaccacccccctcatctctgtgtctgtgcctgcccctcctgtgctgtgccagatgatccctgtgacaggccagagctccatgctgcctgccttcctgaagcccccaccccagctgtctgtgggcaccgtgcggcccatcctggcccaggccgccccagccccccagcctgtgtttgtgggccctgctgtgccccagggcgctgtgatgctggtgctgccccagggcgccctgcccccaccagccccctgtgccgccaacgtgatggctgctggcaacaccaagctgctgcccctggccccagcccctgtgttcatcaccagcagccagaactgtgtgccccaggtggacttcagcagaagaagaaactacgtgtgcagcttccctggctgcaggaagacctacttcaagagcagccacctgaaggcccacctgcggacccacactggagagaagcccttcaactgctcctgggatggctgtgacaagaagtttgcccggagtgatgagctgagccgccacaggaggacccacactggagagaagaagtttgtgtgccctgtgtgtgaccggcgcttcatgagaagtgaccacctgaccaagcacgcccggcggcacatgaccaccaagaagatccctggctggcaggccgaggtgggcaagctgaacagaattgccagcgctgagagccctggcagccccctggtgtccatgcctgccagcgcctag

SEQ ID NO: 157159 - DNA, 1488 bp, Artificial Sequence
  Description of Artificial Sequence: Synthetic coding sequence
atggacatctgtgagagcatcctggagaggaagagacatgattctgagaggagcacctgcagcatcctggagcagacagacatggaggccgtggaggccctggtgtgcatgagctcctggggccagaggagccagaagggggacctgctgcgcatccggcccctgacccctgtgtctgattctggagatgtgaccaccaccgtgcacatggatgctgccaccccagagctgcccaaggacttccacagcctgagcaccctgtgcatcaccccaccccagagcccagacctggtggagcccagcaccaggacccctgtgagcccccaggtgacagacagcaaggcctgcacagccacagatgtgctgcagagcagcgctgtggtggcccgggccctgtctggaggagctgagcggggcctgctgggcctggagcctgtgcccagcagcccctgccgggccaagggcaccagcgtcatccgccacactggagagagccctgctgcctgcttccccaccatccagaccccagactgccgcctgagtgacagccgggagggggaggagcagctgctgggccactttgagaccctgcaggacacccacctgacagacagcctgctgagcaccaacctggtgtcctgccagccctgcctgcacaagagcggcggcctgctgctgacagacaagggccagcaggccggctggccaggagctgtgcagacctgcagccccaagaactatgaaaatgacctgcccaggaagaccacccccctcatctctgtgtctgtgcctgcccctcctgtgctgtgccagatgatccctgtgacaggccagagctccatgctgcctgccttcctgaagcccccaccccagctgtctgtgggcaccgtgcggcccatcctggcccaggccgccccagccccccagcctgtgtttgtgggccctgctgtgccccagggcgctgtgatgctggtgctgccccagggcgccctgcccccaccagccccctgtgccgccaacgtgatggccgccggcaacaccaagctgctgcccctggccccagcccctgtgttcatcaccagcagccagaactgtgtgccccaggtggacttcagcagaagaagaaattatgtgtgcagcttccctggctgcaggaagacctacttcaagagcagccacctgaaggcccacctgcggacccacactggagagaagcccttcaactgctcctgggatggctgtgacaagaagtttgcccggagtgatgagctgagccgccacaggaggacccacactggagagaagaagtttgtgtgccctgtgtgtgaccggcgcttcatgagaagtgaccacctgaccaagcacgcccggcggcacatgaccaccaagaagatccctggctggcaggccgaggtgggcaagctgaaccgcatcgccagcgctgagagccctggcagccccctggtgtccatgcctgccagcgcctag

SEQ ID NO: 157160 - DNA, 1488 bp, Artificial Sequence; identical to SEQ ID NO: 157159
  Description of Artificial Sequence: Synthetic coding sequence

SEQ ID NO: 157161 - DNA, 1209 bp, Artificial Sequence
  Description of Artificial Sequence: Synthetic coding sequence
atctctgtgcacctgatgaggaagcacgtgaagaacatcaacacctttgaaaataggatgctgatgctggatggcatgcctgctgtgcgggtgaagacagagctgctggagagcgagcagggcagccccaacgtgcacaactacccagacatggaggccgtgcccctgctgctgaacaacgtgaagggggagcccccagaggacagcctgtctgtggaccacttccagacccagacagagcctgtggacctgagcatcaacaaggcccggaccagccccacagctgtgagcagcagccctgtgtccatgacagccagcgccagcagccccagcagcaccagcaccagcagcagcagcagcagccggctggccagcagccccaccgtcatcacctctgtgtcctctgccagcagcagcagcacagtgctgaccccaggccccctggtggccagcgccagcggcgtgggcggccagcagttcctgcacatcatccaccctgtgccccccagcagccccatgaacctgcagagcaacaagctgagccacgtgcaccgcatccctgtggtggtgcagagcgtgcctgtggtgtacacagctgtgcgcagccctggaaatgtgaacaacaccatcgtggtgcccctgctggaggatggccggggccacggcaaggcccagatggacccccggggcctgagcccccggcagagcaagagtgacagtgatgatgatgacctgcccaacgtgaccctggacagcgtgaatgagaccggcagcacagccctgagcatcgcccgggctgtgcaggaggtgcaccccagccctgtgtcccgggtgcggggcaacaggatgaacaaccagaagttcccctgcagcatcagccccttcagcattgagagcacccggcggcagaggagaagtgagagcccagacagcaggaagaggcgcatccaccgctgtgactttgagggctgcaacaaggtgtacaccaagagcagccacctgaaggcccacaggaggacccacactggagagaagccctacaagtgcacctgggagggctgcacctggaagtttgcccggagtgatgagctgaccaggcactacaggaagcacactggagtgaagcccttcaagtgtgccgactgtgaccgctccttcagcagaagtgaccacctggccctgcacagaagaagacacatgctggtgtag

SEQ ID NO: 157162 - DNA, 1209 bp, Artificial Sequence
  Description of Artificial Sequence: Synthetic coding sequence
atgaacatccacatgaagaggaagaccatcaagaacatcaacacctttgaaaataggatgctgatgctggatggcatgcctgctgtgcgggtgaagacagagctgctggagagcgagcagggcagccccaacgtgcacaactacccagacatggaggccgtgcccctgctgctgaacaacgtgaagggggagcccccagaggacagcctgtctgtggaccacttccagacccagacagagcctgtggacctgagcatcaacaaggcccggaccagccccacagctgtgagcagcagccctgtgtccatgacagccagcgccagcagccccagcagcaccagcaccagcagcagcagcagcagccggctggccagcagccccaccgtcatcacctctgtgtcctctgccagcagcagcagcacagtgctgaccccaggccccctggtggccagcgccagcggcgtgggcggccagcagttcctgcacatcatccaccctgtgccccccagcagccccatgaacctgcagagcaacaagctgagccacgtgcaccgcatccctgtggtggtgcagagcgtgcctgtggtgtacacagctgtgcgcagccctggaaatgtgaacaacaccatcgtggtgcccctgctggaggatggccggggccacggcaaggcccagatggacccccggggcctgagcccccggcagagcaagagtgacagtgatgatgatgacctgcccaacgtgaccctggacagcgtgaatgagaccggcagcacagccctgagcatcgcccgggctgtgcaggaggtgcaccccagccctgtgtcccgggtgcggggcaacaggatgaacaaccagaagttcccctgcagcatcagccccttcagcattgagagcacccggcggcagaggagaagtgagagcccagacagcaggaagaggcgcatccaccgctgtgactttgagggctgcaacaaggtgtacaccaagagcagccacctgaaggcccacaggaggacccacactggagagaagccctacaagtgcacctgggagggctgcacctggaagtttgcccggagtgatgagctgaccaggcactacaggaagcacactggagtgaagcccttcaagtgtgccgactgtgaccgctccttcagcagaagtgaccacctggccctgcacagaagaagacacatgctggtgtag

SEQ ID NO: 157163 - DNA, 1209 bp, Artificial Sequence; identical to SEQ ID NO: 157162
  Description of Artificial Sequence: Synthetic coding sequence

SEQ ID NO: 157164 - DNA, 867 bp, Artificial Sequence
  Description of Artificial Sequence: Synthetic coding sequence
atggctgctgctgcctacgtggaccactttgctgctgaatgtctggtgtccatgagcagcagagctgtggtgcacggcccccgggagggccctgagagcaggcctgagggcgctgctgtggccgccacccccaccctgccccgggtggaggagaggagagatggcaaggacagcgccagcctgtttgtggtggcccgcatcctggccgacctgaaccagcaggccccagccccagccccagctgagcggcgggagggcgccgccgccaggaaggcccggaccccctgccgcctgcccccaccagcccctgagcccaccagccctggagctgagggcgctgctgctgccccacccagccctgcctggagcgagcctgagcctgaggccggcctggagcctgagcgggagcccggccctgctggcagcggggagcccggcctgcggcagagggtgcggcggggccgcagcagagctgacctggagagcccccagaggaagcacaagtgccactacgccggctgtgagaaggtgtatggcaagagcagccacctgaaggcccacctgcggacccacactggagagcggccctttgcctgctcctggcaggactgcaacaagaagtttgcccggagtgatgagctggcccggcactaccgcacccacactggagagaagaagttcagctgccccatctgtgagaagcgcttcatgagaagtgaccacctgaccaagcacgccaggagacatgccaacttccaccctggcatgctgcagaggagaggaggcggcagcaggacaggcagcctgagtgactacagcagaagtgatgccagcagccccaccatcagccctgccagcagcccctag

SEQ ID NO: 157165 - DNA, 1251 bp, Artificial Sequence
  Description of Artificial Sequence: Synthetic coding sequence
atggtggaccacctgctgcctgtggatgagaacttcagcagccccaagtgccctgtgggctacctgggggaccggctggtgggcagaagagcctaccacatgctgcccagccctgtgtctgaagatgacagtgatgccagcagcccctgcagctgcagcagcccagacagccaggccctgtgcagctgctacggcggcggcctgggcacagagagccaggacagcatcctggacttcctgctgagccaggccaccctgggcagcggcggcggcagcggcagcagcatcggggccagcagcggccctgtggcctggggcccctggaggagagctgctgcccctgtgaagggggagcacttctgcctgcctgagttccccctgggggaccctgatgatgtgccccggcccttccagcccaccctggaggagattgaggagttcctggaggagaacatggagcccggggtgaaggaggtgcctgagggcaacagcaaggacctggatgcctgcagccagctgtctgctggcccccacaagagccacctgcaccctggcagcagcggccgggagcgctgcagccccccacctgggggcgccagcgctggaggagcccagggccctgggggcggccccaccccagatggccccatccctgtgctgctgcagatccagcctgtgcctgtgaagcaggagagcggcaccggccctgccagccctggccaggccccagaaaatgtgaaggtggcccagctgctggtgaacatccagggccagacctttgccctggtgccccaggtggtgcccagcagcaacctgaacctgcccagcaagtttgtgagaattgcccctgtgcccatcgccgccaagcctgtgggcagcggccccctgggccctggccctgctggcctgctgatgggccagaagttccccaagaacccagctgctgagctgatcaagatgcacaagtgcaccttccctggctgcagcaagatgtacaccaagagcagccacctgaaggcccacctgcggcggcacactggagagaagccctttgcctgcacctggccaggctgcggctggaggttcagcagaagtgatgagctgagccgccaccggcgcagccacagcggcgtgaagccctaccagtgccctgtgtgtgagaagaagtttgcccggagtgaccacctgagcaagcacatcaaggtgcaccgcttccccaggagcagccgctctgtgcgctctgtgaactag

SEQ ID NO: 157166 - DNA, 1068 bp, Artificial Sequence
  Description of Artificial Sequence: Synthetic coding sequence
atggccctgtctgagcccatcctgcccagcttcagcacctttgccagcccctgccgggagcggggcctgcaggagcgctggcccagggctgagcctgagagcggcggcacagatgatgacctgaacagcgtgctggacttcatcctgtccatgggcctggatggcctgggcgctgaggccgcccctgagcccccacctcctcctcctcctccagccttctactacccagagcccggggcccccccaccctacagcgccccagctgggggcctggtgtctgagctgctgcggcctgagctggatgcccccctgggccctgccctgcacggccgcttcctgctggcccctcctggccgcctggtgaaggccgagcccccagaggctgatggcggcggcggctacggctgtgcccctggcctgacccggggcccccggggcctgaagcgggagggcgcccctggccctgctgccagctgcatgaggggccctgggggccggcccccacctcctccagacaccccacccctgagcccagatggccctgcccggctgcctgcccctggcccccgggccagcttccccccaccatttggaggccctggctttggagcccctggccctggcctgcactacgcccccccagcccccccagccttcggcctgtttgatgatgctgctgctgctgctgctgccctgggcctggcccccccagctgcccggggcctgctgaccccaccagccagccccctggagctgctggaggccaagcccaagagaggaagaagatcctggcccaggaagaggacagccacccacacctgcagctatgccggctgcggcaagacctacaccaagagcagccacctgaaggcccacctgcggacccacactggagagaagccctaccactgcaactgggatggctgcggctggaagtttgcccggagtgatgagctgaccaggcactacaggaagcacacaggccaccggcccttccagtgccacctgtgtgaccgggccttcagcagaagtgaccacctggccctgcacatgaagaggcacatgtag

SEQ ID NO: 157167 - DNA, 234 bp, Artificial Sequence
  Description of Artificial Sequence: Synthetic coding sequence
atggatgtgctgcccatgtgcagcatcttccaggagctgcagatcgtgcatgaaacaggctacttcagcgccctgcccagcctggaggagtactggcagcagacctgcctggagctggagcgctacctgcagagcgagccctgctacgtgtctgccagcgagatcaagtttgacagccaggagagcgtggaccagaaccactggctgggcaggaagagaagaaaccccaactag

SEQ ID NO: 157168 - DNA, 846 bp, Artificial Sequence
  Description of Artificial Sequence: Synthetic coding sequence
atggatgtgctgcccatgtgcagcatcttccaggagctgcagatcgtgcatgaaacaggctacttcagcgccctgcccagcctggaggagtactggcagcagacctgcctggagctggagcgctacctgcagagcgagccctgctacgtgtctgccagcgagatcaagtttgacagccaggaggacctgtggaccaagatcatcctggcccgggagaagaaggaggagagcgagctgaagatcagcagcagccccccagaggacaccctcatcagccccagcttctgctacaacctggagaccaacagcctgaacagtgatgtgagcagcgagagcagtgacagcagcgaggagctgagccccacagccaagttcaccagtgaccccatcggggaggtgctggtgtcctctgggaagctgagcagctctgtgaccagcaccccacccagcagccctgagctgagccgggagcccagccagctgtggggctgtgtgcctggagagctgcccagccctgggaaggtgcgcagcggcaccagcggcaagccaggggacaagggaaatggagatgccagcccagatggaagaagaagagtgcaccgctgccacttcaacggctgcaggaaggtgtacaccaagagcagccacctgaaggcccaccagaggacccacacaggccagtgcccccggggccccaggagagctgctgctgggggccgccactgcatcgccccagccctggagggcgccggccctggctgcaccggctgcggccagggccggcagatcctgaccagcagtgatgtgttccaccagagcatccgctccttctggagcagcgagtag

SEQ ID NO: 157169 - DNA, 852 bp, Artificial Sequence
  Description of Artificial Sequence: Synthetic coding sequence
atggatgtgctgcccatgtgcagcatcttccaggagctgcagatcgtgcatgaaacaggctacttcagcgccctgcccagcctggaggagtactggcagcagacctgcctggagctggagcgctacctgcagagcgagccctgctacgtgtctgccagcgagatcaagtttgacagccaggaggacctgtggaccaagatcatcctggcccgggagaagaaggaggagagcgagctgaagatcagcagcagccccccagaggacaccctcatcagccccagcttctgctacaacctggagaccaacagcctgaacagtgatgtgagcagcgagagcagtgacagcagcgaggagctgagccccacagccaagttcaccagtgaccccatcggggaggtgctggtgtcctctgggaagctgagcagctctgtgaccagcaccccacccagcagccctgagctgagccgggagcccagccagctgtggggctgtgtgcctggagagctgcccagccctgggaaggtgcgcagcggcaccagcggcaagccaggggacaagggaaatggagatgccagcccagatggaagaagaagagtgcaccgctgccacttcaacggctgcaggaaggtgtacaccaagagcagccacctgaaggcccaccagaggacccacactggagagaagccctaccgctgctcctgggagggctgtgagtggaggtttgcccggagtgatgagctgaccaggcacttcaggaagcacactggagccaagcccttcaagtgcagccactgtgaccgctgcttcagcagaagtgaccacctggccctgcacatgaagaggcacctgtag

SEQ ID NO: 157170 - DNA, 714 bp, Artificial Sequence
  Description of Artificial Sequence: Synthetic coding sequence
atggatgtgctgcccatgtgcagcatcttccaggagctgcagatcgtgcatgaaacaggctacttcagcgccctgcccagcctggaggagtactggcagcagacctgcctggagctggagcgctacctgcagagcgagccctgctacgtgtctgccagcgagatcaagtttgacagccaggaggacctgtggaccaagatcatcctggcccgggagaagaaggaggagagcgagctgaagatcagcagcagccccccagaggacaccctcatcagccccagcttctgctacaacctggagaccaacagcctgaacagtgatgtgagcagcgagagcagtgacagcagcgaggagctgagccccacagccaagttcaccagtgaccccatcggggaggtgctggtgtcctctgggaagctgagcagctctgtgaccagcaccccacccagcagccctgagctgagccgggagcccagccagctgtggggctgtgtgcctggagagctgcccagccctgggaaggtgcgcagcggcaccagcggcaagccaggggacaagggaaatggagatgccagcccagatggaagaagaagagtgcaccgctgccacttcaacggctgcaggaaggtgtacaccaagagcagccacctgaaggcccaccagaggacccacactggagtcttccctggcctgaccacctggccctgcacctag

SEQ ID NO: 157171 - DNA, 909 bp, Artificial Sequence
  Description of Artificial Sequence: Synthetic coding sequence
atggatgtgctggccagctacagcatcttccaggagctgcagctggtgcatgacaccggctacttcagcgccctgcccagcctggaggagacctggcagcagacctgcctggagctggagcgctacctgcagacagagccccggcgcatcagcgagaccttcggggaggacctggactgcttcctgcacgccagccccccaccctgcatcgaggagagcttccggcggctggaccccctgctgctgcctgtggaggccgccatctgtgagaagagcagcgctgtggacatcctgctgagccgggacaagctgctgtctgagacctgcctgagcctgcagcctgccagcagcagcctggacagctacacagctgtgaaccaggcccagctgaatgctgtgaccagcctgaccccacccagcagccctgagctgagccgccacctggtgaagaccagccagaccctgtctgctgtggatggcaccgtgaccctgaagctggtggccaagaaggccgccctgagctctgtgaaggtgggcggcgtggccacagctgctgctgctgtgacagctgctggagctgtgaagagcggccagagcgacagcgaccagggcggcctgggcgctgaggcctgcccagagaacaagaagagggtgcaccgctgccagttcaacggctgcaggaaggtgtacaccaagagcagccacctgaaggcccaccagaggacccacactggagagaagccctacaagtgctcctgggagggctgtgagtggaggtttgcccggagtgatgagctgaccaggcactacaggaagcacactggagccaagcccttcaagtgcaaccactgtgaccgctgcttcagcagaagtgaccacctggccctgcacatgaagaggcacatctag

SEQ ID NO: 157172 - DNA, 825 bp, Artificial Sequence
  Description of Artificial Sequence: Synthetic coding sequence
atgttccccagctggcccacctgcctggagctggagcgctacctgcagacagagccccggcgcatcagcgagaccttcggggaggacctggactgcttcctgcacgccagccccccaccctgcatcgaggagagcttccggcggctggaccccctgctgctgcctgtggaggccgccatctgtgagaagagcagcgctgtggacatcctgctgagccgggacaagctgctgtctgagacctgcctgagcctgcagcctgccagcagcagcctggacagctacacagctgtgaaccaggcccagctgaatgctgtgaccagcctgaccccacccagcagccctgagctgagccgccacctggtgaagaccagccagaccctgtctgctgtggatggcaccgtgaccctgaagctggtggccaagaaggccgccctgagctctgtgaaggtgggcggcgtggccacagctgctgctgctgtgacagctgctggagctgtgaagagcggccagagcgacagcgaccagggcggcctgggcgctgaggcctgcccagagaacaagaagagggtgcaccgctgccagttcaacggctgcaggaaggtgtacaccaagagcagccacctgaaggcccaccagaggacccacactggagagaagccctacaagtgctcctgggagggctgtgagtggaggtttgcccggagtgatgagctgaccaggcactacaggaagcacactggagccaagcccttcaagtgcaaccactgtgaccgctgcttcagcagaagtgaccacctggccctgcacatgaagaggcacatctag

SEQ ID NO: 157173 - DNA, 810 bp, Artificial Sequence
  Description of Artificial Sequence: Synthetic coding sequence
atgacctgcctggagctggagcgctacctgcagacagagccccggcgcatcagcgagacctttggagaggacctggactgcttcctgcacgccagccccccaccctgcatcgaggagagcttccggcggctggaccccctgctgctgcctgtggaggccgccatctgtgagaagagcagcgctgtggacatcctgctgagccgggacaagctgctgtctgagacctgcctgagcctgcagcctgccagcagcagcctggacagctacacagctgtgaaccaggcccagctgaatgctgtgaccagcctgaccccacccagcagccctgagctgagccgccacctggtgaagaccagccagaccctgtctgctgtggatggcaccgtgaccctgaagctggtggccaagaaggccgccctgagctctgtgaaggtgggcggcgtggccacagctgctgctgctgtgacagctgctggagctgtgaagagcggccagagcgacagcgaccagggcggcctgggcgctgaggcctgcccagagaacaagaagagggtgcaccgctgccagttcaacggctgcaggaaggtgtacaccaagagcagccacctgaaggcccaccagaggacccacactggagagaagccctacaagtgctcctgggagggctgtgagtggaggtttgcccggagtgatgagctgaccaggcactacaggaagcacactggagccaagcccttcaagtgcaaccactgtgaccgctgcttcagcagaagtgaccacctggccctgcacatgaagaggcacatctag

SEQ ID NO: 157174 - DNA, 339 bp, Artificial Sequence
  Description of Artificial Sequence: Synthetic coding sequence
atggatgtgctggccagctacagcatcttccaggagctgcagctggtgcatgacaccggctacttcagcgccctgcccagcctggaggagacctggcagcagacctgcctggagctggagcgctacctgcagacagagccccggcgcatcagcgagaccttcggggaggacctggactgcttcctgcacgccagccccccaccctgcatcgaggagagcttccggcggctggaccccctgctgctgcctgtggaggccgccatctgtgagaagagcagcgctgtggacatcctgctgagccgggacaagctgctgtctgagacctgcctgagcctgtag

SEQ ID NO: 157175 - DNA, 183 bp, Artificial Sequence
  Description of Artificial Sequence: Synthetic coding sequence
atggatgtgctggccagctacagcatcttccaggagctgcagctggtgcatgacaccggctacttcagcgccctgcccagcctggaggagacctggcagcagacctgcctggagctggagcgctacctgcagacagagccccggcgcatcagcgagaccttcggggaggacctggactgctag

SEQ ID NO: 157176 - DNA, 339 bp, Artificial Sequence
  Description of Artificial Sequence: Synthetic coding sequence
atggatgtgctggccagctacagcatcttccaggagctgcagctggtgcatgacaccggctacttcagcgccctgcccagcctggaggagacctggcagcagacctgcctggagctggagcgctacctgcagacagagccccggcgcatcagcgagaccttcggggagaagccctacaagtgctcctgggagggctgtgagtggaggtttgcccggagtgatgagctgaccaggcactacaggaagcacactggagccaagcccttcaagtgcaaccactgtgaccgctgcttcagcagaagtgaccacctggccctgcacatgaagaggcacatctag

SEQ ID NO: 157177 - DNA, 774 bp, Artificial Sequence
  Description of Artificial Sequence: Synthetic coding sequence
atggtggacatggacaagctgatcaacaacctggaggtgcagctgaacagcgagggcggctccatgcaggtgttcaagcaggtgacagcctctgtgaggaacagagatcctcctgagattgagtaccgcagcaacatgaccagccccaccctgctggatgccaaccccatggagaacccagccctcttcaatgacatcaagattgagcccccagaggagctgctggccagtgacttcagcctgccccaggtggagcctgtggacctgtccttccacaagcccaaggcccccctgcagcctgcctccatgctgcaggcccccatccggccccccaagccccagagcagcccccagaccctggtggtgtccaccagcaccagtgacatgagcaccagcgccaacatccccaccgtgctgaccccaggctctgtgctgaccagcagccagagcacaggcagccagcagatcctgcacgtgatccacaccatccccagcgtgtccctgcccaacaagatgggcggcctgaagaccatccctgtggtggtgcagagcctgcccatggtgtacaccaccctgcctgcagatggcggccctgctgccatcaccgtgcccctgattggaggagatggcaagaatgccggctctgtgaaggtggaccccacctccatgagccccctggagatccccagcgacagcgaggagagcaccattgaaagtggcagcagcgccctgcagagcctgcagggcctgcagcaggagcgggaggccctgtag

SEQ ID NO: 157178 - DNA, 1080 bp, Artificial Sequence
  Description of Artificial Sequence: Synthetic coding sequence
atggtggacatggacaagctgatcaacaacctggaggtgcagctgaacagcgagggcggctccatgcaggtgttcaagcaggtgacagcctctgtgaggaacagagatcctcctgagattgagtaccgcagcaacatgaccagccccaccctgctggatgccaaccccatggagaacccagccctcttcaatgacatcaagattgagcccccagaggagctgctggccagtgacttcagcctgccccaggtggagcctgtggacctgtccttccacaagcccaaggcccccctgcagcctgcctccatgctgcaggcccccatccggccccccaagccccagagcagcccccagaccctggtggtgtccaccagcaccagtgacatgagcaccagcgccaacatccccaccgtgctgaccccaggctctgtgctgaccagcagccagagcacaggcagccagcagatcctgcacgtgatccacaccatccccagcgtgtccctgcccaacaagatgggcggcctgaagaccatccctgtggtggtgcagagcctgcccatggtgtacaccaccctgcctgcagatggcggccctgctgccatcaccgtgcccctgattggaggagatggcaagaatgccggctctgtgaaggtggaccccacctccatgagccccctggagatccccagcgacagcgaggagagcaccattgaaagtggcagcagcgccctgcagagcctgcagggcctgcagcaggagcctgctgccatggcccagatgcagggcgaggagagcctggacctgaagagaagacgcatccaccagtgtgactttgctggctgcagcaaggtgtacaccaagagcagccacctgaaggcccaccggcgcatccacactggagagaagccctacaagtgcacctgggatggctgctcctggaagtttgcccggagtgatgagctgaccaggcacttcaggaagcacacaggcatcaagcccttccgctgcacagactgcaacagaagcttcagcagaagtgaccacctgagcctgcacagaagaagacatgacaccatgtag

SEQ ID NO: 157179 - DNA, 771 bp, Artificial Sequence
  Description of Artificial Sequence: Synthetic coding sequence
atgcagcctgccaaggaggtgaccaaggccagtgatggcagcctgctgggggacctgggccacacccccctgagcaagaaggagggcatcaagtggcagaggccccggctgagccggcaggccctgatgcgctgctgcctggtgaagtggatcctgagcagcacagccccccagggcagtgacagcagtgacagcgagctggagctgagcacagtgcgccaccagcctgagggcctggaccagctgcaggcccagaccaagttcaccaagaaggagctgcagagcctgtaccggggcttcaagaatgaatgtcccaccggcctggtggatgaggacaccttcaagctgatctatgcccagttcttcccccagggagatgccaccacctacgcccacttcctgttcaatgcctttgatgctgatggaaatggagccatccactttgaagattttgtggtgggcctgagcatcctgctgcggggcaccgtgcatgagaagctgaagtgggccttcaacctgtatgacatcaacaaggatggctacatcaccaaggaggagatgctggccatcatgaagagcatctatgacatgatgggccgccacacctaccccatcctgcgggaggatgccccagctgagcacgtggagcgcttctttgagaagatggacaggaaccaggatggagtggtgaccatcgaggagttcctggaggcctgccagaaggatgagaacatcatgagctccatgcagctgtttgaaaatgtcatctag

SEQ ID NO: 157180 - DNA, 705 bp, Artificial Sequence
  Description of Artificial Sequence: Synthetic coding sequence
atgcagcccaggaaggaggtgaccaaggccagtgatggcagcctgctgggggacctgggccacacccccctgagcaagaaggagggcatcaagtggcagaggccccggctgagccggcaggccctgatgcgctgctgcctggtgaagtggatcctgagcagcacagccccccagggcagtgacagcagtgacagcgagctggagctgagcacagtgcgccaccagcctgagggcctggaccagctgcaggcccagaccaagttcaccaagaaggagctgcagagcctgtaccggggcttcaagaatggagatgccaccacctacgcccacttcctgttcaatgcctttgatgctgatggaaatggagccatccactttgaagattttgtggtgggcctgagcatcctgctgcggggcaccgtgcatgagaagctgaagtgggccttcaacctgtatgacatcaacaaggatggctacatcaccaaggaggagatgctggccatcatgaagagcatctatgacatgatgggccgccacacctaccccatcctgcgggaggatgccccagctgagcacgtggagcgcttctttgagaagatggacaggaaccaggatggagtggtgaccatcgaggagttcctggaggcctgccagaaggatgagaacatcatgagctccatgcagctgtttgaaaatgtcatctag

SEQ ID NO: 157181 - DNA, 693 bp, Artificial Sequence
  Description of Artificial Sequence: Synthetic coding sequence
atgggcatccagggcatggagctgtgtgccatggctgtggtggtgctgctcttcatcgctgtgctgaagcagtttggcatcctggagcccatctccatggaggacagcagtgacagcgagctggagctgagcacagtgcgccaccagcctgagggcctggaccagctgcaggcccagaccaagttcaccaagaaggagctgcagagcctgtaccggggcttcaagaatgaatgtcccaccggcctggtggatgaggacaccttcaagctgatctatgcccagttcttcccccagggagatgccaccacctacgcccacttcctgttcaatgcctttgatgctgatggaaatggagccatccactttgaagattttgtggtgggcctgagcatcctgctgcggggcaccgtgcatgagaagctgaagtgggccttcaacctgtatgacatcaacaaggatggctacatcaccaaggaggagatgctggccatcatgaagagcatctatgacatgatgggccgccacacctaccccatcctgcgggaggatgccccagctgagcacgtggagcgcttctttgagaagatggacaggaaccaggatggagtggtgaccatcgaggagttcctggaggcctgccagaaggatgagaacatcatgagctccatgcagctgtttgaaaatgtcatctag

SEQ ID NO: 157182 - DNA, 567 bp, Artificial Sequence
  Description of Artificial Sequence: Synthetic coding sequence
atggccaccgtgcgccacaggcctgaggccctggagctgctggaggcccagagcaagttcaccaagaaggagctgcagatcctgtaccggggcttcaagaatgaatgtcccagcggcgtggtgaatgaggagaccttcaaggagatctacagccagttcttcccccagggcgacagcaccacctacgcccacttcctgttcaatgcctttgacacagaccacaatggagctgtgtcctttgaggacttcatcaagggcctgagcatcctgctgcggggcaccgtgcaggagaagctgaactgggccttcaacctgtatgacatcaacaaggatggctacatcaccaaggaggagatgctggacatcatgaaggccatctatgacatgatgggcaagtgcacctaccctgtgctgaaggaggatgccccccggcagcacgtggagaccttcttccagaagatggacaagaacaaggatggagtggtgaccattgatgagttcatcgagagctgccagaaggatgagaacatcatgaggtccatgcagctgtttgaaaatgtcatctag

SEQ ID NO: 157183 - DNA, 678 bp, Artificial Sequence
  Description of Artificial Sequence: Synthetic coding sequence
atgagcggctgcaggaagcgctgcaagcgggagatcctgaagtttgcccagtacctgctgcggctgctgaccggcagcctgcacacagattctgtggaggatgagctggagatggccaccgtgcgccacaggcctgaggccctggagctgctggaggcccagagcaagttcaccaagaaggagctgcagatcctgtaccggggcttcaagaatgaatgtccttctggagtggtgaatgaggagaccttcaaggagatctacagccagttcttcccccagggcgacagcaccacctacgcccacttcctgttcaatgcctttgacacagaccacaacggggctgtgtcctttgaggacttcatcaagggcctgagcatcctgctgcggggcaccgtgcaggagaagctgaactgggccttcaacctgtatgacatcaacaaggatggctacatcaccaaggaggagatgctggacatcatgaaggccatctatgacatgatgggcaagtgcacctaccctgtgctgaaggaggatgccccccggcagcacgtggagaccttcttccagaagatggacaagaacaaggatggagtggtgaccattgatgagttcatcgagagctgccagaaggatgagaacatcatgaggtccatgcagctgtttgaaaatgtcatctag

SEQ ID NO: 157184 - DNA, 690 bp, Artificial Sequence
  Description of Artificial Sequence: Synthetic coding sequence
atgaacctggagggcctggagatgattgctgtgctgattgtgattgtgctgtttgtgaagctgctggagcagtttggcctcatcgaggccggcctggaggacagcgtggaggatgagctggagatggccaccgtgcgccacaggcctgaggccctggagctgctggaggcccagagcaagttcaccaagaaggagctgcagatcctgtaccggggcttcaagaatgaatgtccttctggagtggtgaatgaggagaccttcaaggagatctacagccagttcttcccccagggcgacagcaccacctacgcccacttcctgttcaatgcctttgacacagaccacaacggggctgtgtcctttgaggacttcatcaagggcctgagcatcctgctgcggggcaccgtgcaggagaagctgaactgggccttcaacctgtatgacatcaacaaggatggctacatcaccaaggaggagatgctggacatcatgaaggccatctatgacatgatgggcaagtgcacctaccctgtgctgaaggaggatgccccccggcagcacgtggagaccttcttccagaagatggacaagaacaaggatggagtggtgaccattgatgagttcatcgagagctgccagaaggatgagaacatcatgaggtccatgcagctgtttgaaaatgtcatctag

SEQ ID NO: 157185 - DNA, 753 bp, Artificial Sequence
  Description of Artificial Sequence: Synthetic coding sequence
atgaatgtgcggcgggtggagagcatcagcgcccagctggaggaggccagcagcactggaggcttcctgtatgcccagaacagcaccaagaggagcatcaaggagcggctgatgaagctgctgccctgcagcgctgccaagaccagcagccctgccatccagaacagcgtggaggatgagctggagatggccaccgtgcgccacaggcctgaggccctggagctgctggaggcccagagcaagttcaccaagaaggagctgcagatcctgtaccggggcttcaagaatgaatgtcccagcggcgtggtgaatgaggagaccttcaaggagatctacagccagttcttcccccagggcgacagcaccacctacgcccacttcctgttcaatgcctttgacacagaccacaatggagctgtgtcctttgaggacttcatcaagggcctgagcatcctgctgcggggcaccgtgcaggagaagctgaactgggccttcaacctgtatgacatcaacaaggatggctacatcaccaaggaggagatgctggacatcatgaaggccatctatgacatgatgggcaagtgcacctaccctgtgctgaaggaggatgccccccggcagcacgtggagaccttcttccagaagatggacaagaacaaggatggagtggtgaccattgatgagttcatcgagagctgccagaaggatgagaacatcatgaggtccatgcagctgtttgaaaatgtcatctag

SEQ ID NO: 157186 - DNA, 567 bp, Artificial Sequence; identical to SEQ ID NO: 157182
  Description of Artificial Sequence: Synthetic coding sequence

SEQ ID NO: 157187 - DNA, 651 bp, Artificial Sequence
  Description of Artificial Sequence: Synthetic coding sequence
atgaatgtgcggcgggtggagagcatcagcgcccagctggaggaggccagcagcactggagacagcgtggaggatgagctggagatggccaccgtgcgccacaggcctgaggccctggagctgctggaggcccagagcaagttcaccaagaaggagctgcagatcctgtaccggggcttcaagaatgaatgtcccagcggcgtggtgaatgaggagaccttcaaggagatctacagccagttcttcccccagggcgacagcaccacctacgcccacttcctgttcaatgcctttgacacagaccacaatggagctgtgtcctttgaggacttcatcaagggcctgagcatcctgctgcggggcaccgtgcaggagaagctgaactgggccttcaacctgtatgacatcaacaaggatggctacatcaccaaggaggagatgctggacatcatgaaggccatctatgacatgatgggcaagtgcacctaccctgtgctgaaggaggatgccccccggcagcacgtggagaccttcttccagaagatggacaagaacaaggatggagtggtgaccattgatgagttcatcgagagctgccagaaggatgagaacatcatgaggtccatgcagctgtttgaaaatgtcatctag

SEQ ID NO: 157188 - DNA, 567 bp, Artificial Sequence; identical to SEQ ID NO: 157182
  Description of Artificial Sequence: Synthetic coding sequence

SEQ ID NO: 157189 - DNA, 549 bp, Artificial Sequence
  Description of Artificial Sequence: Synthetic coding sequence
tgaggcatgaatgccggctttgaggactgcctggtgtttgatgagctgatggacaagttcagcaatgacctgagcctgtgcctgcctgtgttcagccggctgcgcatcccagatgaccacgccatcagtgacctgtccatgtacaactacatcgagatgagggcccacgtgaacagctcctggttcatcttccagaagaacatggagcgcttcctgcacgccatcatgcccagcaccttcatccccctgtacaccatggtgaccttcagccgcatccgctaccatgaagctgtgcagcgctggcactggcagaagaaggtgatcaacaagggcctcttcttcctgggcagcctgattgccatcagcagcacctacctgctgatccactacatgagccccaggagcttcctgcggctgcggcggccctggaactggatcgcccacttcaggaacaccacctgcttccctgccaaggctgtggacagcctggagcagatcagcaacctgatcagccggctgctgagccacagcgagatcctgcagacctag

SEQ ID NO: 157190 - DNA, 1359 bp, Artificial Sequence
  Description of Artificial Sequence: Synthetic coding sequence
atggacagcagcgtcatccagaggaagaaggtggccgtcatcggcggcggcctggtgggcagcctgcaggcctgcttcctggccaagaggaacttccagattgatgtgtatgaggcccgggaggacaccagggtggccaccttcacccggggccgcagcatcaacctggccctgagccaccggggccggcaggccctgaaggctgtgggcctggaggaccagatcgtgtcccagggcatccccatgagggccaggatgatccacagcctgagcggcaagaagagcgccatcccctacggcaccaagagccagtacatcctgtctgtgtcccgggagaacctgaacaaggacctgctgacagctgctgagaagtacccaaatgtgaagatgcacttcaaccaccggctgctgaagtgcaaccctgaggagggcatgatcaccgtgctgggcagtgacaaggtgcccaaggatgtgacctgtgacctgattgtgggctgtgatggagcctacagcacagtgcgcagccacctgatgaagaagcccaggtttgactacagccagcagtacatcccccacggctacatggagctgaccatcccccccaagaatggagactatgccatggagcccaactacctgcacatctggcccaggaacaccttcatgatgattgccctgcccaacatgaacaagagcttcacctgcaccctcttcatgccctttgaggagtttgagaagctgctgaccagcaatgatgtggtggacttcttccagaagtacttcccagatgccatccccctcatcggggagaagctgctggtgcaggacttcttcctgctgcctgcccagcccatgatctctgtgaagtgcagcagcttccacttcaagagccactgtgtgctgctgggagatgctgcccacgccatcgtgcccttcttcggccagggcatgaatgccggctttgaggactgcctggtgtttgatgagctgatggacaagttcagcaatgacctgagcctgtgcctgcctgtgttcagccggctgcgcatcccagatgaccacgccatcagtgacctgtccatgtacaactacatcgaggtgaccttcagccgcatccgctaccatgaagctgtgcagcgctggcactggcagaagaaggtgatcaacaagggcctcttcttcctgggcagcctgattgccatcagcagcacctacctgctgatccactacatgagccccaggagcttcctgcggctgcggcggccctggaactggatcgcccacttcaggaacaccacctgcttccctgccaaggctgtggacagcctggagcagatcagcaacctgatcagcaggtag

SEQ ID NO: 157191 - DNA, 1422 bp, Artificial Sequence
  Description of Artificial Sequence: Synthetic coding sequence
atggacagcagcgtcatccagaggaagaaggtggccgtcatcggcggcggcctggtgggcagcctgcaggcctgcttcctggccaagaggaacttccagattgatgtgtatgaggcccgggaggacaccagggtggccaccttcacccggggccgcagcatcaacctggccctgagccaccggggccggcaggccctgaaggctgtgggcctggaggaccagatcgtgtcccagggcatccccatgagggccaggatgatccacagcctgagcggcaagaagagcgccatcccctacggcaccaagagccagtacatcctgtctgtgtcccgggagaacctgaacaaggacctgctgacagctgctgagaagtacccaaatgtgaagatgcacttcaaccaccggctgctgaagtgcaaccctgaggagggcatgatcaccgtgctgggcagtgacaaggtgcccaaggatgtgacctgtgacctgattgtgggctgtgatggagcctacagcacagtgcgcagccacctgatgaagaagcccaggtttgactacagccagcagtacatcccccacggctacatggagctgaccatcccccccaagaatggagactatgccatggagcccaactacctgcacatctggcccaggaacaccttcatgatgattgccctgcccaacatgaacaagagcttcacctgcaccctcttcatgccctttgaggagtttgagaagctgctgaccagcaatgatgtggtggacttcttccagaagtacttcccagatgccatccccctcatcggggagaagctgctggtgcaggacttcttcctgctgcctgcccagcccatgatctctgtgaagtgcagcagcttccacttcaagagccactgtgtgctgctgggagatgctgcccacgccatcgtgcccttcttcggccagggcatgaatgccggctttgaggactgcctggtgtttgatgagctgatggacaagttcagcaatgacctgagcctgtgcctgcctgtgttcagccggctgcgcatcccagatgaccacgccatcagtgacctgtccatgtacaactacatcgagaagaacatggagcgcttcctgcacgccatcatgcccagcaccttcatccccctgtacaccatggtgaccttcagccgcatccgctaccacgaggccgtgcagcgctggcactggcagaagaaggtgatcaacaagggcctcttcttcctgggcagcctcatcgccatcagcagcacctacctgctgatccactacatgagccccaggagcttcctgcggctgcggcggccctggaactggatcgcccacttcaggaacaccacctgcttccctgccaaggctgtggacagcctggagcagatcagcaacctgatcagcaggtag

SEQ ID NO: 157192 - DNA, 1461 bp, Artificial Sequence
  Description of Artificial Sequence: Synthetic coding sequence
atggacagcagcgtcatccagaggaagaaggtggccgtcatcggcggcggcctggtgggcagcctgcaggcctgcttcctggccaagaggaacttccagattgatgtgtatgaggcccgggaggacaccagggtggccaccttcacccggggccgcagcatcaacctggccctgagccaccggggccggcaggccctgaaggctgtgggcctggaggaccagatcgtgtcccagggcatccccatgagggccaggatgatccacagcctgagcggcaagaagagcgccatcccctacggcaccaagagccagtacatcctgtctgtgtcccgggagaacctgaacaaggacctgctgacagctgctgagaagtacccaaatgtgaagatgcacttcaaccaccggctgctgaagtgcaaccctgaggagggcatgatcaccgtgctgggcagtgacaaggtgcccaaggatgtgacctgtgacctgattgtgggctgtgatggagcctacagcacagtgcgcagccacctgatgaagaagcccaggtttgactacagccagcagtacatcccccacggctacatggagctgaccatcccccccaagaatggagactatgccatggagcccaactacctgcacatctggcccaggaacaccttcatgatgattgccctgcccaacatgaacaagagcttcacctgcaccctcttcatgccctttgaggagtttgagaagctgctgaccagcaatgatgtggtggacttcttccagaagtacttcccagatgccatccccctcatcggggagaagctgctggtgcaggacttcttcctgctgcctgcccagcccatgatctctgtgaagtgcagcagcttccacttcaagagccactgtgtgctgctgggagatgctgcccacgccatcgtgcccttcttcggccagggcatgaatgccggctttgaggactgcctggtgtttgatgagctgatggacaagttcagcaatgacctgagcctgtgcctgcctgtgttcagccggctgcgcatcccagatgaccacgccatcagtgacctgtccatgtacaactacatcgagatgagggcccacgtgaacagctcctggttcatcttccagaagaacatggagcgcttcctgcacgccatcatgcccagcaccttcatccccctgtacaccatggtgaccttcagccgcatccgctaccatgaagctgtgcagcgctggcactggcagaagaaggtgatcaacaagggcctcttcttcctgggcagcctgattgccatcagcagcacctacctgctgatccactacatgagccccaggagcttcctgcggctgcggcggccctggaactggatcgcccacttcaggaacaccacctgcttccctgccaaggctgtggacagcctggagcagatcagcaacctgatcagcaggtag

SEQ ID NO: 157193 - DNA, 1689 bp, Artificial Sequence
  Description of Artificial Sequence: Synthetic coding sequence
atggagctgaagaaggacatcaatgctgtgtccattgacatgctgctgattgtgcacagcgagaagagaagagctgcccagggcaccctgagtgaccagcaggccaaccccagcagcctgctgcagaggggcggcggcttccagggcgtgggcaatggagtgcggcgctggcagaagctggagggcaatgacttccacgagaacctggtggagaagcagcacccccagcagccccaggtgatcaccagctacaacagccagggcacccagctgactgtggaggtgcaccccagagatgccatgccccagctgctgaagaagttcagcctggccaagaggctgcagggcgacaagaatggaaacacccggccccggcagcccggcggcaaggatgcccacgcctacccctgggacaggagcagcctgaagtccatgagcctggacctgcagcagtttgagaagctggacatctatgccagccaggtgacagccaagagcggcctggatgagctggtgtctgacctgctgcaggaggcccacacagacctggagcgggtgcgggccatctggatctggatctgccaccacattgaatatgacattgctgctgcccaggagaaggaccggcaggccttcaagcccacagacatcctgcggacccagaagaccaactgtgatggctacgccggcctgtttgagaggatgtgccgcctggccggcgtgcagtgcatgacagtgcccggctacagcaaaggatttggctaccagacaggccagagcttcagcggggagtttgaccacgcctggaatgctgtgtacctggagggccgctggcacctggtggacagcacctggggcagcggcctggtggacaccatcaccagcaagttcaccttcctgtacaatgagttctacttcctgacccacccagccctcttcatcgaggaccacttcccagacaacaagaactggcagctgctgaagccaccccagagcctgcggcagtttgagaacaacatgtaccacaagtctgagttctacaacaagggcatgctgagcgcccaccctgagacctccatgatcagaacagtgaatggcaaggccaccgtgaccatcgagagctgtgcccccaccctcttcatgttcatgctgaatggcaagcaggagcacggcctgctgagcctgaggaagaatggcatgaagctggaggtgtacccacccaccatgggcacccacaagctgcagatctttgccaagggcaacagcgacatctacagctctgtgctggagtacaccctgaagtgcaactacgtggacatgggcgtgcagctgcctgctgagctgcaccagcctgtgggccccagctggttcagcgagcagatgggcatcatgaagcccagccacccagaccccatcatccacaccagtgatggccgctgcagcatctccttctctgtggaggagggcatcaacgtgctggccagcctgcatggagatgatggccccatcacagaggagacccagaggcgctacatcttccagctgcaccgggagaagcagacagagctgaaggtgcagctgccccacgccggcaagtttgccctgaaggaggtgtatgtgatggtgctggagaatgccaaccacaacttctacagctacatcctgaagtacaaggtgaatgcccagtag

SEQ ID NO: 157194 - DNA, 1986 bp, Artificial Sequence
  Description of Artificial Sequence: Synthetic coding sequence
atggagctgaagaaggacatcaatgctgtgtccattgacatgctgctgattgtgcacagcgagaagagaagagctgcccagggcaccctgagtgaccagcaggccaaccccagcagcctgctgcagaggggcggcggcttccagggcgtgggcaatggagtgcggcgctggcagaagctggagggcaatgacttccacgagaacctggtggagaagcagcacccccagcagccccaggtgatcaccagctacaacagccagggcacccagctgactgtggaggtgcaccccagagatgccatgccccagctgctgaagaagttcagcctggccaagaggctgcagggcgacaagaatggaaacacccggccccggcagcccggcggcaaggatgcccacgcctacccctgggacaggagcagcctgaagtccatgagcctggacctgcagcagtttgagaagctggacatctatgccagccaggtgacagccaagagcggcctggatgagctggtgtctgacctgctgcaggaggcccacacagacctggagcgggtgcgggccatctggatctggatctgccaccacattgaatatgacattgctgctgcccaggagaaggaccggcaggccttcaagcccacagacatcctgcggacccagaagaccaactgtgatggctacgccggcctgtttgagaggatgtgccgcctggccggcgtgcagtgcatgacagtgcccggctacagcaaaggatttggctaccagacaggccagagcttcagcggggagtttgaccacgcctggaatgctgtgtacctggagggccgctggcacctggtggacagcacctggggcagcggcctggtggacaccatcaccagcaagttcaccttcctgtacaatgagttctacttcctgacccacccagccctcttcatcgaggaccacttcccagacaacaagaactggcagctgctgaagccaccccagagcctgcggcagtttgagaacaacatgtaccacaagtctgagttctacaacaagggcatgctgagcgcccaccctgagacctccatgatcagaacagtgaatggcaaggccaccgtgaccatcgagagctgtgcccccaccctcttcatgttcatgctgaatggcaagcaggagcacggcctgctgagcctgaggaagaatggcatgaagctggaggtgtacccacccaccatgggcacccacaagctgcagatctttgccaagggcaacagcgacatctacagctctgtgctggagtacaccctgaagtgcaactacgtggacatgggcgtgcagctgcctgctgagctgcaccagcctgtgggccccagctggttcagcgagcagatgggcatcatgaagcccagccacccagaccccatcatccacaccagtgatggccgctgcagcatctccttctctgtggaggagggcatcaacgtgctggccagcctgcatggagatgatggccccatcacagaggagacccagaggcgctacatcttccagctgcaccgggagaagcagacagagctgaaggtgcagctgccccacgccggcaagtttgccctgaagatctttgtgaagaagaggcaggagcccggcaactacatctttgtgttcaactacctggtgtgctgtgccaacaccaaggtgaactggcccatgtttcctgagagctttggaaactggggccaggacaatgagctgctggagcccctgagcggcgtgctgcctgccaacagaaatgtgcccttcaagctgaagctgcacggcatcgccaaggtgctggtgaagggccaggacacctggcccctgaccctgaaccacgagggctactgggagggcagctgcagcacagctggctgccaggaggtgtatgtgatggtgctggagaatgccaaccacaacttctacagctacatcctgaagtacaaggtgaatgcccagtag

SEQ ID NO: 157195 - DNA, 1173 bp, Artificial Sequence
  Description of Artificial Sequence: Synthetic coding sequence
atgaagctggaggccgtggacaggatgaaccccagcctggtgtgtgtggcctctgtgacagatgtggtggacagccgcttcctggtgcactttgacaactgggatgacacctatgactactggtgtgaccccagcagcccctacatccaccctgtgggctggtgccagaagcagggcaagcccctgaccccaccccaggactacccagaccctgacaacttctgctgggagaagtacctggaggagactggagccagcgctgtgcccacctgggccttcaaggtgcggcccccccacagcttcctggtgaacatgaagctggaggccgtggacagaagaaatcctgccctgatccgggtggcctctgtggaggatgtggaggaccaccgcatcaagatccactttgatggctggagccacggctatgacttctggattgatgctgaccacccagacatccaccctgctggctggtgcagcaagacaggccaccccctgcagccccccctgggcccccgggagcccagcagcgccagccctgggggctgcccccccctgagctaccgcagcctgccccacaccaggaccagcaagtacagcttccaccacaggaaatgtcccaccccaggctgtgatggcagcggccacgtgacaggcaagttcaccgcccaccactgcctgagcggctgccccctggccgagaggaaccagagccggctgaaggccgagctgagtgacagcgaggccagcgccaggaagaagaacctgagcggcttcagccccaggaagaagcccaggcaccacggcagaattggccggccccccaagtacaggaagatcccccaggaggacttccagaccctgaccccagatgtggtgcaccagagcctcttcatgtctgccctgagcgcccacccagacaggagcctgtctgtgtgctgggagcagcactgcaagctgctgcccggggtggccggcatcagcgccagcacagtggccaagtggaccattgatgaggtgtttggatttgtgcagaccctgaccggctgtgaggaccaggcccggctcttcaaggatgaggtgcgctgcaagtgccgggtgggggacagagctggggtgacagtgctgaagacagctggcagccgctgccccccccagaggcacttctgctag

SEQ ID NO: 157196 - DNA, 2232 bp, Artificial Sequence
  Description of Artificial Sequence: Synthetic coding sequence
atgagaagaagagagggccatggaacagattctgagatgggccagggccctgtgcgggagagccagagcagtgaccccccagccctgcagttccgcatcagcgagtacaagcccctgaacatggccggcgtggagcagccccccagccctgagctgcggcaggagggcgtgacagaatatgaagatggaggagccccagctggagatggagaggccggcccccagcaggccgaggaccacccccagaaccccccagaggaccccaaccaggaccccccagaagatgacagcacctgccagtgccaggcctgtggcccccaccaggccgccggccctgacctgggcagcagcaatgatggctgcccccagctgttccaggagaggtctgtgattgtggagaacagcagcggcagcaccagcgccagcgagctgctgaagcccatgaagaagaggaagagaagagagtaccagagccccagcgaggaggagagcgagcctgaggccatggagaagcaggaggagggcaaggaccctgagggccagcccacagccagcaccccagagagcgaggagtggagcagcagccagcctgccactggagagaagaaggagtgctggagctgggagagctacctggaggagcagaaggccatcacagcccctgtgtccctcttccaggacagccaggccgtgacccacaacaagaatggcttcaagctgggcatgaagctggagggcatcgacccccagcaccccagcatgtacttcatcctgactgtggccgaggtgtgtggctaccgcctgcggctgcactttgatggctacagtgaatgtcatgacttctgggtgaatgccaacagcccagacatccaccctgctggctggtttgagaagacaggccacaagctgcagccccccaagggctacaaggaggaggagttctcctggagccagtacctgcggagcacccgggcccaggccgcccccaagcacctgtttgtgtcccagagccacagccccccacccctgggcttccaggtgggcatgaagctggaggccgtggacaggatgaaccccagcctggtgtgtgtggcctctgtgacagatgtggtggacagccgcttcctggtgcactttgacaactgggatgacacctatgactactggtgtgaccccagcagcccctacatccaccctgtgggctggtgccagaagcagggcaagcccctgaccccaccccaggactacccagaccctgacaacttctgctgggagaagtacctggaggagactggagccagcgctgtgcccacctgggccttcaaggtgcggcccccccacagcttcctggtgaacatgaagctggaggccgtggacagaagaaatcctgccctgatccgggtggcctctgtggaggatgtggaggaccaccgcatcaagatccactttgatggctggagccacggctatgacttctggattgatgctgaccacccagacatccaccctgctggctggtgcagcaagacaggccaccccctgcagccccccctgggcccccgggagcccagcagcgccagccctgggggctgcccccccctgagctaccgcagcctgccccacaccaggaccagcaagtacagcttccaccacaggctcttcttccccaggaagtgccccaccccaggctgtgatggcagcggccacgtgacaggcaagttcaccgcccaccactgcctgagcggctgccccctggccgagaggaaccagagccggctgaaggccgagctgagtgacagcgaggccagcgccaggaagaagaacctgagcggcttcagccccaggaagaagcccaggcaccacggccgcatcggccggccccccaagtacaggaagatcccccaggaggacttccagaccctgaccccagatgtggtgcaccagagcctcttcatgtctgccctgagcgcccacccagacaggagcctgtctgtgtgctgggagcagcactgcaagctgctgcccggggtggccggcatcagcgccagcacagtggccaagtggaccattgatgaggtgtttggatttgtgcagaccctgaccggctgtgaggaccaggcccggctcttcaaggatgaggtgcgctgcaagtgccgggtgggggaccgggccggcgtgacagtgctgaagacagctggcagccgctgccccccccagaggcacttctgctag

SEQ ID NO: 157197 - DNA, 2319 bp, Artificial Sequence
  Description of Artificial Sequence: Synthetic coding sequence
atgagaagaagagagggccatggaacagattctgagatgggccagggccctgtgcgggagagccagagcagtgaccccccagccctgcagttccgcatcagcgagtacaagcccctgaacatggccggcgtggagcagccccccagccctgagctgcggcaggagggcgtgacagaatatgaagatggaggagccccagctggagatggagaggccggcccccagcaggccgaggaccacccccagaaccccccagaggaccccaaccaggaccccccagaagatgacagcacctgccagtgccaggcctgtggcccccaccaggccgccggccctgacctgggcagcagcaatgatggctgcccccagctgttccaggagaggtctgtgattgtggagaacagcagcggcagcaccagcgccagcgagctgctgaagcccatgaagaagaggaagagaagagagtaccagagccccagcgaggaggagagcgagcctgaggccatggagaagcaggaggagggcaaggaccctgagggccagcccacagccagcaccccagagagcgaggagtggagcagcagccagcctgccactggagagaagaaggagtgctggagctgggagagctacctggaggagcagaaggccatcacagcccctgtgtccctcttccaggacagccaggccgtgacccacaacaagaatggcttcaagctgggcatgaagctggagggcatcgacccccagcaccccagcatgtacttcatcctgactgtggccgaggtgtgtggctaccgcctgcggctgcactttgatggctacagtgaatgtcatgacttctgggtgaatgccaacagcccagacatccaccctgctggctggtttgagaagacaggccacaagctgcagccccccaagggctacaaggaggaggagttctcctggagccagtacctgcggagcacccgggcccaggccgcccccaagcacctgtttgtgtcccagagccacagccccccacccctgggcttccaggtgggcatgaagctggaggccgtggacaggatgaaccccagcctggtgtgtgtggcctctgtgacagatgtggtggacagccgcttcctggtgcactttgacaactgggatgacacctatgactactggtgtgaccccagcagcccctacatccaccctgtgggctggtgccagaagcagggcaagcccctgaccccaccccaggactacccagaccctgacaacttctgctgggagaagtacctggaggagactggagccagcgctgtgcccacctgggccttcaaggtgcggcccccccacagcttcctggtgaacatgaagctggaggccgtggacagaagaaatcctgccctgatccgggtggcctctgtggaggatgtggaggaccaccgcatcaagatccactttgatggctggagccacggctatgacttctggattgatgctgaccacccagacatccaccctgctggctggtgcagcaagacaggccaccccctgcagccccccctgggcccccgggagcccagcagcgccagccctgggggctgcccccccctgagctaccgcagcctgccccacaccaggaccagcaagtacagcttccaccacaggaaatgtcccaccccaggctgtgatggcagcggccacgtgacaggcaagttcaccgcccaccactgcctgagcggctgccccctggccgagaggaaccagagccggctgaaggccgagctgagtgacagcgaggccagcgccaggaagaagaacctgagcggcttcagccccaggaagaagcccaggcaccacggcagaattggccggccccccaagtacaggaagatcccccaggaggacttccagaccctgaccccagatgtggtgcaccagagcctcttcatgtctgccctgagcgcccacccagacaggagcctgtctgtgtgctgggagcagcactgcaagctgctgcccggggtggccggcatcagcgccagcacagtggccaagtggaccattgatgaggtgtttggatttgtgcagaccctgaccggctgtgaggaccaggcccggctcttcaaggatgaggccagaattgtgcgggtgacccacgtgtctgggaagaccctggtgtggacagtggcccagctgggggacctggtgtgcagcgaccacctgcaggagggcaagggcatcctggagactggagtgcacagcctgctgtgcagcctgcccacccacctgctggccaagctgagctttgccagtgacagccagtactag

SEQ ID NO: 157198 - DNA, 2523 bp, Artificial Sequence
  Description of Artificial Sequence: Synthetic coding sequence
atgcacctggtggccggggacagccctggcagcggcccccacctgcctgccacagccttcatcatcccagccagcagcgccaccctgggcctgcccagcagcgccctggatgtgtcctgcttcccccgggagcccatccacgtgggcgcccctgagcaggtggccggctgtgagcctgtgtctgccaccgtgctgccccagctgtctgctggccctgccagcagcagcaccagcacagtgcggctgctggagtggacagaggccgccgcccctcctcctgggggcggcctgcgcttccgcatcagcgagtacaagcccctgaacatggccggcgtggagcagccccccagccctgagctgcggcaggagggcgtgacagaatatgaagatggaggagccccagctggagatggagaggccggcccccagcaggccgaggaccacccccagaaccccccagaggaccccaaccaggaccccccagaagatgacagcacctgccagtgccaggcctgtggcccccaccaggccgccggccctgacctgggcagcagcaatgatggctgcccccagctgttccaggagaggtctgtgattgtggagaacagcagcggcagcaccagcgccagcgagctgctgaagcccatgaagaagaggaagagaagagagtaccagagccccagcgaggaggagagcgagcctgaggccatggagaagcaggaggagggcaaggaccctgagggccagcccacagccagcaccccagagagcgaggagtggagcagcagccagcctgccactggagagaagaaggagtgctggagctgggagagctacctggaggagcagaaggccatcacagcccctgtgtccctcttccaggacagccaggccgtgacccacaacaagaatggcttcaagctgggcatgaagctggagggcatcgacccccagcaccccagcatgtacttcatcctgactgtggccgaggtgtgtggctaccgcctgcggctgcactttgatggctacagtgaatgtcatgacttctgggtgaatgccaacagcccagacatccaccctgctggctggtttgagaagacaggccacaagctgcagccccccaagggctacaaggaggaggagttctcctggagccagtacctgcggagcacccgggcccaggccgcccccaagcacctgtttgtgtcccagagccacagccccccacccctgggcttccaggtgggcatgaagctggaggccgtggacaggatgaaccccagcctggtgtgtgtggcctctgtgacagatgtggtggacagccgcttcctggtgcactttgacaactgggatgacacctatgactactggtgtgaccccagcagcccctacatccaccctgtgggctggtgccagaagcagggcaagcccctgaccccaccccaggactacccagaccctgacaacttctgctgggagaagtacctggaggagactggagccagcgctgtgcccacctgggccttcaaggtgcggcccccccacagcttcctggtgaacatgaagctggaggccgtggacagaagaaatcctgccctgatccgggtggcctctgtggaggatgtggaggaccaccgcatcaagatccactttgatggctggagccacggctatgacttctggattgatgctgaccacccagacatccaccctgctggctggtgcagcaagacaggccaccccctgcagccccccctgggcccccgggagcccagcagcgccagccctgggggctgcccccccctgagctaccgcagcctgccccacaccaggaccagcaagtacagcttccaccacaggaaatgtcccaccccaggctgtgatggcagcggccacgtgacaggcaagttcaccgcccaccactgcctgagcggctgccccctggccgagaggaaccagagccggctgaaggccgagctgagtgacagcgaggccagcgccaggaagaagaacctgagcggcttcagccccaggaagaagcccaggcaccacggcagaattggccggccccccaagtacaggaagatcccccaggaggacttccagaccctgaccccagatgtggtgcaccagagcctcttcatgtctgccctgagcgcccacccagacaggagcctgtctgtgtgctgggagcagcactgcaagctgctgcccggggtggccggcatcagcgccagcacagtggccaagtggaccattgatgaggtgtttggatttgtgcagaccctgaccggctgtgaggaccaggcccggctcttcaaggatgaggccagaattgtgcgggtgacccacgtgtctgggaagaccctggtgtggacagtggcccagctgggggacctggtgtgcagcgaccacctgcaggagggcaagggcatcctggagactggagtgcacagcctgctgtgcagcctgcccacccacctgctggccaagctgagctttgccagtgacagccagtactag

SEQ ID NO: 157199 - DNA, 1617 bp, Artificial Sequence
  Description of Artificial Sequence: Synthetic coding sequence
cagaaggccatcacagcccctgtgtccctcttccaggacagccaggccgtgacccacaacaagaatggcttcaagctgggcatgaagctggagggcatcgacccccagcaccccagcatgtacttcatcctgactgtggccgaggtgtgtggctaccgcctgcggctgcactttgatggctacagtgaatgtcatgacttctgggtgaatgccaacagcccagacatccaccctgctggctggtttgagaagacaggccacaagctgcagccccccaagggctacaaggaggaggagttctcctggagccagtacctgcggagcacccgggcccaggccgcccccaagcacctgtttgtgtcccagagccacagccccccacccctgggcttccaggtgggcatgaagctggaggccgtggacaggatgaaccccagcctggtgtgtgtggcctctgtgacagatgtggtggacagccgcttcctggtgcactttgacaactgggatgacacctatgactactggtgtgaccccagcagcccctacatccaccctgtgggctggtgccagaagcagggcaagcccctgaccccaccccaggactacccagaccctgacaacttctgctgggagaagtacctggaggagactggagccagcgctgtgcccacctgggccttcaaggtgcggcccccccacagcttcctggtgaacatgaagctggaggccgtggacagaagaaatcctgccctgatccgggtggcctctgtggaggatgtggaggaccaccgcatcaagatccactttgatggctggagccacggctatgacttctggattgatgctgaccacccagacatccaccctgctggctggtgcagcaagacaggccaccccctgcagccccccctgggcccccgggagcccagcagcgccagccctgggggctgcccccccctgagctaccgcagcctgccccacaccaggaccagcaagtacagcttccaccacaggaaatgtcccaccccaggctgtgatggcagcggccacgtgacaggcaagttcaccgcccaccactgcctgagcggctgccccctggccgagaggaaccagagccggctgaaggccgagctgagtgacagcgaggccagcgccaggaagaagaacctgagcggcttcagccccaggaagaagcccaggcaccacggcagaattggccggccccccaagtacaggaagatcccccaggaggacttccagaccctgaccccagatgtggtgcaccagagcctcttcatgtctgccctgagcgcccacccagacaggagcctgtctgtgtgctgggagcagcactgcaagctgctgcccggggtggccggcatcagcgccagcacagtggccaagtggaccattgatgaggtgtttggatttgtgcagaccctgaccggctgtgaggaccaggcccggctcttcaaggatgagatgattgatggagaggccttcctgctgctgacccaggccgacatcgtgaagatcatgtctgtgaagctgggccctgccctgaagatctacaatgccatcctgatgttcaagaatgctgatgacaccctgaagtag

SEQ ID NO: 157200 - DNA, 2523 bp, Artificial Sequence; identical to SEQ ID NO: 157198
  Description of Artificial Sequence: Synthetic coding sequence

SEQ ID NO: 157201 - DNA, 255 bp, Artificial Sequence
  Description of Artificial Sequence: Synthetic coding sequence
atggccggcgtggagcagccccccagccctgagctgcggcaggagggcgtgacagaatatgaagatggaggagccccagctggagatggagaggccggcccccagcaggccgaggaccacccccagaaccccccagaggaccccaaccaggaccccccagaagatgacagcacctgccagtgccaggcctgtggcccccaccaggccgccggccctgacctgggcagcagcaatgatggctgcccccagctgtag

SEQ ID NO: 157202 - DNA, 417 bp, Artificial Sequence
  Description of Artificial Sequence: Synthetic coding sequence
atgcacctggtggccggggacagccctggcagcggcccccacctgcctgccacagccttcatcatcccagccagcagcgccaccctgggcctgcccagcagcgccctggatgtgtcctgcttcccccgggagcccatccacgtgggcgcccctgagcaggtggccggctgtgagcctgtgtctgccaccgtgctgccccagctgtctgctggccctgccagcagcagcaccagcacagtgcggctgctggagtggacagaggccgccgcccctcctcctgggggcggcctgcgcttccgcatcagcgagtacaagcccctgaacatggccggcgtggagcagccccccagccctgagctgcggcaggagggcgtgacagaatatgaagatggaggagccccagctggagatggatag

SEQ ID NO: 157203 - DNA, 2217 bp, Artificial Sequence
  Description of Artificial Sequence: Synthetic coding sequence
atgagaagaagagagggccatggaacagattctgagatgggccagggccctgtgcgggagagccagagcagtgaccccccagccctgcagttccgcatcagcgagtacaagcccctgaacatggccggcgtggagcagccccccagccctgagctgcggcaggagggcgtgacagaatatgaagatggaggagccccagctggagatggagaggccggcccccagcaggccgaggaccacccccagaaccccccagaggaccccaaccaggaccccccagaagatgacagcacctgccagtgccaggcctgtggcccccaccaggccgccggccctgacctgggcagcagcaatgatggctgcccccagctgttccaggagaggtctgtgattgtggagaacagcagcggcagcaccagcgccagcgagctgctgaagcccatgaagaagaggaagagaagagagtaccagagccccagcgaggaggagagcgagcctgaggccatggagaagcaggaggagggcaaggaccctgagggccagcccacagccagcaccccagagagcgaggagtggagcagcagccagcctgccactggagagaagaaggagtgctggagctgggagagctacctggaggagcagaaggccatcacagcccctgtgtccctcttccaggacagccaggccgtgacccacaacaagaatggcttcaagctgggcatgaagctggagggcatcgacccccagcaccccagcatgtacttcatcctgactgtggccgaggtgtgtggctaccgcctgcggctgcactttgatggctacagtgaatgtcatgacttctgggtgaatgccaacagcccagacatccaccctgctggctggtttgagaagacaggccacaagctgcagccccccaagggctacaaggaggaggagttctcctggagccagtacctgcggagcacccgggcccaggccgcccccaagcacctgtttgtgtcccagagccacagccccccacccctgggcttccaggtgggcatgaagctggaggccgtggacaggatgaaccccagcctggtgtgtgtggcctctgtgacagatgtggtggacagccgcttcctggtgcactttgacaactgggatgacacctatgactactggtgtgaccccagcagcccctacatccaccctgtgggctggtgccagaagcagggcaagcccctgaccccaccccaggactacccagaccctgacaacttctgctgggagaagtacctggaggagactggagccagcgctgtgcccacctgggccttcaaggtgcggcccccccacagcttcctggtgaacatgaagctggaggccgtggacagaagaaatcctgccctgatccgggtggcctctgtggaggatgtggaggaccaccgcatcaagatccactttgatggctggagccacggctatgacttctggattgatgctgaccacccagacatccaccctgctggctggtgcagcaagacaggccaccccctgcagccccccctgggcccccgggagcccagcagcgccagccctgggggctgcccccccctgagctaccgcagcctgccccacaccaggaccagcaagtacagcttccaccacaggaaatgtcccaccccaggctgtgatggcagcggccacgtgacaggcaagttcaccgcccaccactgcctgagcggctgccccctggccgagaggaaccagagccggctgaaggccgagctgagtgacagcgaggccagcgccaggaagaagaacctgagcggcttcagccccaggaagaagcccaggcaccacggcagaattggccggccccccaagtacaggaagatcccccaggaggacttccagaccctgaccccagatgtggtgcaccagagcctcttcatgtctgccctgagcgcccacccagacaggagcctgtctgtgtgctgggagcagcactgcaagctgctgcccggggtggccggcatcagcgccagcacagtggccaagtggaccattgatgaggtgtttggatttgtgcagaccctgaccggctgtgaggaccaggcccggctcttcaaggatgaggtgcgctgcaagtgccgggtgggggacagagctggggtgacagtgctgaagacagctggcagccgctgccccccccagaggcacttctgctag

SEQ ID NO: 157204 - DNA, 870 bp, Artificial Sequence
  Description of Artificial Sequence: Synthetic coding sequence
tgaacatctggctccatgcccacccccctgaccttcaccctgctggccggcagcagaagaagagccaccagctgcagcctgcccaagagccccccacccctgggcttccaggtgggcatgaagctggaggccgtggacaggatgaaccccagcctggtgtgtgtggcctctgtgacagatgtggtggacagccgcttcctggtgcactttgacaactgggatgacacctatgactactggtgtgaccccagcagcccctacatccaccctgtgggctggtgccagaagcagggcaagcccctgaccccaccccaggactacccagaccctgacaacttctgctgggagaagtacctggaggagaccggggccagcgctgtgcccacctgggccttcaaggtgcggcccccccacagcttcctggtgaacatgaagctggaggccgtggacagaagaaatcctgccctgatccgggtggcctctgtggaggatgtggaggaccaccgcatcaagatccactttgatggctggagccacggctatgacttctggattgatgctgaccacccagacatccaccctgctggctggtgcagcaagacaggccaccccctgcagccccccctgggcccccgggagcccagcagcgccagccctgggggctgcccccccctgagctaccgcagcctgccccacaccaggaccagcaagtacagcttccaccacaggaagtgccccaccccaggctgtgatggcagcggccacgtgacaggcaagttcaccgcccaccactgcctgagcggctgccccctggccgagaggaaccagagccggctgaaggccgagctgagtgacagcgaggccagctag

SEQ ID NO: 157205 - DNA, 327 bp, Artificial Sequence
  Description of Artificial Sequence: Synthetic coding sequence
atggctgctgccatggatgtggacaccccatctggcaccaacagcggggccggcaagaagagatttgaggtgaagaagtggaatgctgtggccctgtgggcctgggacatcgtggtggacaactgtgccatctgcaggaaccacatcatggacctgtgcatcgagtgccaggccaaccaggccagcgccaccagtgaagaatgtactgtggcctggggcgtgtgcaaccacgccttccacttccactgcatcagccgctggctgaagacccggcaggtgtgccccctggacaaccgggagtgggagttccagaagtatggccactag

SEQ ID NO: 157206 - DNA, 867 bp, Artificial Sequence
  Description of Artificial Sequence: Synthetic coding sequence
tgaagaccccacctgcagaaccagtggaggaagaggaagatgaccacctggagctgcctggtggccatgattgtgtctggagtcatcacagctgtgtgggccgtgcgggccgcccccatctggaggagccaggtgaagcagaagatgagaattggcaagcagggcaactgcaggcctccccgctgcatctgcagcgccctgggcctgctggccccctggatggctgtggtgctgagccagggcaagccacccaccaagaaggccaaggtgctgcacaaggccgcctggagcgccaagatcggggccttcctgcacagccagggcaccggccagctggctgatggcacccccaccggccaggatgccctggtgctgggctttgactggggcaagttcctgaaggaccacagctacaaggccgcccctgtgtcctgcttcaagcacgtgcccctgtatgaccagtgggaggatgtgatgaagggcatgaaggtggaggtgctgaacagtgatgctgtgctgcccagccgggtgtactggatcgccagcgtcatccagacagctggctacagagtgctgctgcgctatgagggctttgaaaatgatgccagccatgacttctggtgcaacctgggcaccgtggatgtgcaccccatcggctggtgtgccatcaacagcaagatcctggtgccccccaggaccatccacgccaagttcacagactggaagggctacctgatgaagaggctggtgggcagcaggaccctgcctgtggacttccacatcaaggtgggcagcgagcccctgacagatgtgccccccagcgccctgcccttcttctgcatcctgcacgccacccactggagctag

SEQ ID NO: 157207 - DNA, 3762 bp, Artificial Sequence
  Description of Artificial Sequence: Synthetic coding sequence
atggtggtggccctgcgctacgtgtggcccctgctgctgtgcagcccctgcctgctgatccagatccctgaggagtatgagggccaccacgtgatggagccccctgtgatcacagagcagagcccccggcggctggtggtgttccccacagatgacatcagcctgaagtgtgaggccagcggcaagccagaggtgcagttccgctggaccagagatggagtgcacttcaagcccaaggaggagctgggcgtgacagtgtaccagagcccccacagcggcagcttcaccatcaccggcaacaacagcaactttgcccagcgcttccagggcatctaccgctgctttgccagcaacaagctgggcacagccatgagccatgagatccggctgatggccgagggcgcccccaagtggcccaaggagaccgtgaagcctgtggaggtggaggagggggagagcgtggtgctgccctgcaaccccccaccttctgctgagcccctgcgcatctactggatgaacagcaagatcctgcacatcaagcaggatgagcgggtgaccatgggccagaatggaaacctgtactttgccaacgtgctgaccagtgacaaccacagcgactacatctgccacgcccacttccctggcaccaggaccatcatccagaaggagcccatcgacctgcgggtgaaggccaccaacagcatgattgacaggaagccccggctgctcttccccaccaacagcagcagccacctggtggccctgcagggccagcccctggtgctggagtgcatcgccgagggcttccccacccccaccatcaagtggctgcggcccagcggccccatgcctgctgacagagtgacctaccagaaccacaacaagaccctgcagctgctgaaggtgggggaggaggatgatggagagtaccgctgcctggccgagaacagcctgggcagcgcccggcatgcctactacgtgacagtggaggccgccccctactggctgcacaagccccagagccacctgtatggccctggagaaacagcccggctggactgccaggtgcagggccggccccagcctgaggtgacctggaggatcaatggcatccctgtggaggagctggccaaggaccagaagtaccgcatccagagaggagccctgatcctgagcaatgtgcagcccagcgacaccatggtgacccagtgtgaggccaggaacagacatggcctgctgctggccaatgcctacatctacgtggtgcagctgcctgccaagatcctgacagctgacaaccagacctacatggctgtgcagggcagcacagcctacctgctgtgcaaggcctttggagcccctgtgcccagcgtgcagtggctggatgaagatggcaccaccgtgctgcaggatgagcgcttcttcccctatgccaacggcaccctgggcatccgggacctgcaggccaatgacaccggccgctacttctgcctggccgccaatgaccagaacaacgtgaccatcatggccaacctgaaggtgaaggatgccacccagatcacccagggccccaggagcaccatcgagaagaagggcagccgggtgaccttcacctgccaggccagctttgaccccagcctgcagcccagcatcacctggagaggagatggccgggacctgcaggagctgggggacagcgacaagtacttcattgaagatggccgcctggtgatccacagcctggactacagcgaccagggcaactacagctgtgtggccagcacagagctggatgtggtggagagccgggcccagctgctggtggtgggcagccctggccctgtgccccggctggtgctgagtgacctgcacctgctgacccagagccaggtgcgggtgtcctggagccctgctgaggaccacaatgcccccatcgagaagtatgacatcgagtttgaggacaaggagatggcccctgagaagtggtacagcctgggcaaggtgcccggcaaccagaccagcaccaccctgaagctgagcccctacgtgcactacaccttccgggtgacagccatcaacaagtatggccctggagagcccagccctgtgtctgagaccgtggtgaccccagaggccgcccctgagaagaaccctgtggatgtgaagggggagggcaatgagaccaccaacatggtgatcacctggaagcccctgcgctggatggactggaatgccccccaggtgcagtacagagtgcagtggaggccccagggcacccggggcccctggcaggagcagatcgtgtctgaccccttcctggtggtgagcaacaccagcacctttgtgccctatgagatcaaggtgcaggccgtgaacagccagggcaagggccctgagccccaggtgaccatcggctacagcggggaggactacccccaggccatccctgagctggagggcatcgagatcctgaacagcagcgctgtgctggtgaagtggaggcctgtggacctggcccaggtgaagggccacctgcggggctacaacgtgacctactggagggagggcagccagaggaagcacagcaagaggcacatccacaaggaccacgtggtggtgcctgccaacaccaccagcgtcatcctgagcggcctgcggccctacagcagctaccacctggaggtgcaggccttcaacggccggggcagcggccctgccagcgagttcaccttcagcaccccagagggcgtgcccggccaccctgaggccctgcacctggagtgccagagcaacaccagcctgctgctgcgctggcagccccccctgagccacaatggagtgctgaccggctacgtgctgagctaccaccccctggatgaaggaggcaagggccagctgtccttcaacctgcgggaccctgagctgcggacccacaacctgacagacctgagcccccacctgcgctaccgcttccagctgcaggccaccaccaaggagggccctggagaggccatcgtgcgggagggcggcaccatggccctgagcggcatcagtgactttggaaacatcagcgccacagctggggagaactacagcgtggtgtcctgggtgcccaaggagggccagtgcaacttccgcttccacatcctcttcaaggccctgggggaggagaagggcggggccagcctgagcccccagtatgtgtcctacaaccagagcagctacacccagtgggacctgcagcctgacacagattatgagatccacctgttcaaggagaggatgttccgccaccagatggctgtgaagaccaatggaacaggccgggtgcggctgcccccagctggctttgccacagagggctggttcatcggctttgtgtctgccatcatcctgctgctgctggtgctgctgatcctgtgcttcatcaagaggagcaaaggaggcaagtacagcgtgaaggacaaggaggacacccaggtggacagcgaggcccggcccatgaaggatgagacctttggagagtacagcgacaatgaggagaaggccttcggcagcagccagcccagcctgaatggagacatcaagcccctgggcagtgatgacagcctggccgactatggaggctctgtggatgtgcagttcaatgaagatggcagcttcatcggccagtacagcggcaagaaggagaaggaggccgccggcggcaatgacagcagcggggccaccagccccatcaacccagctgtggccctggagtag

SEQ ID NO: 157208 - DNA, 3747 bp, Artificial Sequence
  Description of Artificial Sequence: Synthetic coding sequence
atggtggtggccctgcgctacgtgtggcccctgctgctgtgcagcccctgcctgctgatccagatccctgaggagctgatggagccccctgtgatcacagagcagagcccccggcggctggtggtgttccccacagatgacatcagcctgaagtgtgaggccagcggcaagccagaggtgcagttccgctggaccagagatggagtgcacttcaagcccaaggaggagctgggcgtgacagtgtaccagagcccccacagcggcagcttcaccatcactggaaacaacagcaactttgcccagcgcttccagggcatctaccgctgctttgccagcaacaagctgggcacagccatgagccatgagatccggctgatggccgagggcgcccccaagtggcccaaggagaccgtgaagcctgtggaggtggaggagggggagagcgtggtgctgccctgcaaccccccacccagcgctgagcccctgcgcatctactggatgaacagcaagatcctgcacatcaagcaggatgagcgggtgaccatgggccagaatggaaacctgtactttgccaacgtgctgaccagtgacaaccacagcgactacatctgccacgcccacttccctggcaccaggaccatcatccagaaggagcccatcgacctgcgggtgaaggccaccaacagcatgattgacaggaagccccggctgctcttccccaccaacagcagcagccacctggtggccctgcagggccagcccctggtgctggagtgcatcgccgagggcttccccacccccaccatcaagtggctgcggcccagcggccccatgcctgctgacagagtgacctaccagaaccacaacaagaccctgcagctgctgaaggtgggggaggaggatgatggagagtaccgctgcctggccgagaacagcctgggcagcgcccggcatgcctactacgtgacagtggaggccgccccctactggctgcacaagccccagagccacctgtatggccctggagaaacagcccggctggactgccaggtgcagggccggccccagcctgaggtgacctggaggatcaatggcatccctgtggaggagctggccaaggaccagaagtaccgcatccagagaggagccctgatcctgagcaatgtgcagcccagcgacaccatggtgacccagtgtgaggccaggaacagacatggcctgctgctggccaatgcctacatctacgtggtgcagctgcctgccaagatcctgacagctgacaaccagacctacatggctgtgcagggcagcacagcctacctgctgtgcaaggccttcggggcccctgtgcccagcgtgcagtggctggatgaagatggcaccaccgtgctgcaggatgagcgcttcttcccctatgccaacggcaccctgggcatccgggacctgcaggccaatgacaccggccgctacttctgcctggccgccaatgaccagaacaacgtgaccatcatggccaacctgaaggtgaaggatgccacccagatcacccagggccccaggagcaccatcgagaagaagggcagccgggtgaccttcacctgccaggccagctttgaccccagcctgcagcccagcatcacctggagaggagatggccgggacctgcaggagctgggggacagcgacaagtacttcattgaagatggccgcctggtgatccacagcctggactacagcgaccagggcaactacagctgtgtggccagcacagagctggatgtggtggagagccgggcccagctgctggtggtgggcagccctggccctgtgccccggctggtgctgagtgacctgcacctgctgacccagagccaggtgcgggtgtcctggagccctgctgaggaccacaatgcccccatcgagaagtatgacattgaatttgaggacaaggagatggcccctgagaagtggtacagcctgggcaaggtgcccggcaaccagaccagcaccaccctgaagctgagcccctacgtgcactacaccttccgggtgacagccatcaacaagtatggccctggagagcccagccctgtgtctgaaacagtggtgaccccagaggccgcccctgagaagaaccctgtggatgtgaagggggagggcaatgagaccaccaacatggtgatcacctggaagcccctgcgctggatggactggaatgccccccaggtgcagtacagagtgcagtggaggccccagggcacccggggcccctggcaggagcagatcgtgtctgaccccttcctggtggtgagcaacaccagcacctttgtgccctatgagatcaaggtgcaggccgtgaacagccagggcaaaggacctgagccccaggtgaccatcggctacagcggggaggactacccccaggccatccctgagctggagggcatcgagatcctgaacagcagcgctgtgctggtgaagtggaggcctgtggacctggcccaggtgaagggccacctgcggggctacaacgtgacctactggagggagggcagccagaggaagcacagcaagaggcacatccacaaggaccacgtggtggtgcctgccaacaccaccagcgtcatcctgagcggcctgcggccctacagcagctaccacctggaggtgcaggccttcaacggccggggcagcggccctgccagcgagttcaccttcagcaccccagagggcgtgcccggccaccctgaggccctgcacctggagtgccagagcaacaccagcctgctgctgcgctggcagccccccctgagccacaacggggtgctgaccggctacgtgctgagctaccaccccctggatgagggcggcaagggccagctgtccttcaacctgcgggaccctgagctgcggacccacaacctgacagacctgagcccccacctgcgctaccgcttccagctgcaggccaccaccaaggagggccctggagaggccatcgtgcgggagggcggcaccatggccctgagcggcatcagtgactttggaaacatcagcgccacagctggggagaactacagcgtggtgtcctgggtgcccaaggagggccagtgcaacttccgcttccacatcctcttcaaggccctgggggaggagaagggcggggccagcctgagcccccagtatgtgtcctacaaccagagcagctacacccagtgggacctgcagcctgacacagattatgagatccacctgttcaaggagaggatgttccgccaccagatggctgtgaagaccaacggcaccggccgggtgcggctgcccccagctggctttgccacagagggctggttcatcggctttgtgtctgccatcatcctgctgctgctggtgctgctgatcctgtgcttcatcaagaggagcaagggcggcaagtacagcgtgaaggacaaggaggacacccaggtggacagcgaggcccggcccatgaaggatgagaccttcggggagtacagcgacaatgaggagaaggccttcggcagcagccagcccagcctgaatggagacatcaagcccctgggcagtgatgacagcctggccgactatggaggctctgtggatgtgcagttcaatgaagatggcagcttcatcggccagtacagcggcaagaaggagaaggaggccgccggcggcaatgacagcagcggggccaccagccccatcaacccagctgtggccctggagtag

SEQ ID NO: 157209 - DNA, 3747 bp, Artificial Sequence; identical to SEQ ID NO: 157208
  Description of Artificial Sequence: Synthetic coding sequence

SEQ ID NO: 157210 - DNA, 3774 bp, Artificial Sequence
  Description of Artificial Sequence: Synthetic coding sequence
atggtggtggccctgcgctacgtgtggcccctgctgctgtgcagcccctgcctgctgatccagatccctgaggagtatgagggccaccacgtgatggagccccctgtgatcacagagcagagcccccggcggctggtggtgttccccacagatgacatcagcctgaagtgtgaggccagcggcaagccagaggtgcagttccgctggaccagagatggagtgcacttcaagcccaaggaggagctgggcgtgacagtgtaccagagcccccacagcggcagcttcaccatcaccggcaacaacagcaactttgcccagcgcttccagggcatctaccgctgctttgccagcaacaagctgggcacagccatgagccatgagatccggctgatggccgagggcgcccccaagtggcccaaggagaccgtgaagcctgtggaggtggaggagggggagagcgtggtgctgccctgcaaccccccaccttctgctgagcccctgcgcatctactggatgaacagcaagatcctgcacatcaagcaggatgagcgggtgaccatgggccagaatggaaacctgtactttgccaacgtgctgaccagtgacaaccacagcgactacatctgccacgcccacttccctggcaccaggaccatcatccagaaggagcccatcgacctgcgggtgaaggccaccaacagcatgattgacaggaagccccggctgctcttccccaccaacagcagcagccacctggtggccctgcagggccagcccctggtgctggagtgcatcgccgagggcttccccacccccaccatcaagtggctgcggcccagcggccccatgcctgctgacagagtgacctaccagaaccacaacaagaccctgcagctgctgaaggtgggggaggaggatgatggagagtaccgctgcctggccgagaacagcctgggcagcgcccggcatgcctactacgtgacagtggaggccgccccctactggctgcacaagccccagagccacctgtatggccctggagaaacagcccggctggactgccaggtgcagggccggccccagcctgaggtgacctggaggatcaatggcatccctgtggaggagctggccaaggaccagaagtaccgcatccagagaggagccctgatcctgagcaatgtgcagcccagcgacaccatggtgacccagtgtgaggccaggaacagacatggcctgctgctggccaatgcctacatctacgtggtgcagctgcctgccaagatcctgacagctgacaaccagacctacatggctgtgcagggcagcacagcctacctgctgtgcaaggcctttggagcccctgtgcccagcgtgcagtggctggatgaagatggcaccaccgtgctgcaggatgagcgcttcttcccctatgccaacggcaccctgggcatccgggacctgcaggccaatgacaccggccgctacttctgcctggccgccaatgaccagaacaacgtgaccatcatggccaacctgaaggtgaaggatgccacccagatcacccagggccccaggagcaccatcgagaagaagggcagccgggtgaccttcacctgccaggccagctttgaccccagcctgcagcccagcatcacctggagaggagatggccgggacctgcaggagctgggggacagcgacaagtacttcattgaagatggccgcctggtgatccacagcctggactacagcgaccagggcaactacagctgtgtggccagcacagagctggatgtggtggagagccgggcccagctgctggtggtgggcagccctggccctgtgccccggctggtgctgagtgacctgcacctgctgacccagagccaggtgcgggtgtcctggagccctgctgaggaccacaatgcccccatcgagaagtatgacatcgagtttgaggacaaggagatggcccctgagaagtggtacagcctgggcaaggtgcccggcaaccagaccagcaccaccctgaagctgagcccctacgtgcactacaccttccgggtgacagccatcaacaagtatggccctggagagcccagccctgtgtctgagaccgtggtgaccccagaggccgcccctgagaagaaccctgtggatgtgaagggggagggcaatgagaccaccaacatggtgatcacctggaagcccctgcgctggatggactggaatgccccccaggtgcagtacagagtgcagtggaggccccagggcacccggggcccctggcaggagcagatcgtgtctgaccccttcctggtggtgagcaacaccagcacctttgtgccctatgagatcaaggtgcaggccgtgaacagccagggcaagggccctgagccccaggtgaccatcggctacagcggggaggactacccccaggccatccctgagctggagggcatcgagatcctgaacagcagcgctgtgctggtgaagtggaggcctgtggacctggcccaggtgaagggccacctgcggggctacaacgtgacctactggagggagggcagccagaggaagcacagcaagaggcacatccacaaggaccacgtggtggtgcctgccaacaccaccagcgtcatcctgagcggcctgcggccctacagcagctaccacctggaggtgcaggccttcaacggccggggcagcggccctgccagcgagttcaccttcagcaccccagagggcgtgcccggccaccctgaggccctgcacctggagtgccagagcaacaccagcctgctgctgcgctggcagccccccctgagccacaatggagtgctgaccggctacgtgctgagctaccaccccctggatgaaggaggcaagggccagctgtccttcaacctgcgggaccctgagctgcggacccacaacctgacagacctgagcccccacctgcgctaccgcttccagctgcaggccaccaccaaggagggccctggagaggccatcgtgcgggagggcggcaccatggccctgagcggcatcagtgactttggaaacatcagcgccacagctggggagaactacagcgtggtgtcctgggtgcccaaggagggccagtgcaacttccgcttccacatcctcttcaaggccctgggggaggagaagggcggggccagcctgagcccccagtatgtgtcctacaaccagagcagctacacccagtgggacctgcagcctgacacagattatgagatccacctgttcaaggagaggatgttccgccaccagatggctgtgaagaccaatggaacaggccgggtgcggctgcccccagctggctttgccacagagggctggttcatcggctttgtgtctgccatcatcctgctgctgctggtgctgctgatcctgtgcttcatcaagaggagcaaaggaggcaagtacagcgtgaaggacaaggaggacacccaggtggacagcgaggcccggcccatgaaggatgagacctttggagagtaccgcagcctggagagtgacaatgaggagaaggccttcggcagcagccagcccagcctgaatggagacatcaagcccctgggcagtgatgacagcctggccgactatggaggctctgtggatgtgcagttcaatgaagatggcagcttcatcggccagtacagcggcaagaaggagaaggaggccgccggcggcaatgacagcagcggggccaccagccccatcaacccagctgtggccctggagtag

SEQ ID NO: 157211 - DNA, 3774 bp, Artificial Sequence; identical to SEQ ID NO: 157210
  Description of Artificial Sequence: Synthetic coding sequence

SEQ ID NO: 157212 - DNA, 456 bp, Artificial Sequence
  Description of Artificial Sequence: Synthetic coding sequence
atggtggtggccctgcgctacgtgtggcccctgctgctgtgcagcccctgcctgctgatccagatccctgaggagtatgagggccaccacgtgatggagccccctgtgatcacagagcagagcccccggcggctggtggtgttccccacagatgacatcagcctgaagtgtgaggccagcggcaagccagaggtgcagttccgctggaccagagatggagtgcacttcaagcccaaggaggagctgggcgtgacagtgtaccagagcccccacagcggcagcttcaccatcaccggcaacaacagcaactttgcccagcgcttccagggcatctaccgctgctttgccagcaacaagctgggcacagccatgagccatgagatccggctgatggccgagggcgcccccaagtggcccaaggagaccgtgaagcctgtggaggtggaggagggctag

SEQ ID NO: 157213 - DNA, 255 bp, Artificial Sequence
  Description of Artificial Sequence: Synthetic coding sequence
atggtggtggccctgcgctacgtgtggcccctgctgctgtgcagcccctgcctgctgatccagatccctgaggagtatgagggccaccacgtgatggagccccctgtgatcacagagcagagcccccggcggctggtggtgttccccacagatgacatcagcctgaagtgtgaggccagcggcaagccagaggtgcagttccgctggaccagagatggagtgcacttcaagcccaaggaggagctgggcgtgtag

SEQ ID NO: 157214 - DNA, 3768 bp, Artificial Sequence
  Description of Artificial Sequence: Synthetic coding sequence
atggtggtggccctgcgctacgtgtggcccctgctgctgtgcagcccctgcctgctgatccagatccctgaggagagcttccctggccaccgggtggtgatggagccccctgtgatcacagagcagagcccccggcggctggtggtgttccccacagatgacatcagcctgaagtgtgaggccagcggcaagccagaggtgcagttccgctggaccagagatggagtgcacttcaagcccaaggaggagctgggcgtgacagtgtaccagagcccccacagcggcagcttcaccatcaccggcaacaacagcaactttgcccagcgcttccagggcatctaccgctgctttgccagcaacaagctgggcacagccatgagccatgagatccggctgatggccgagggcgcccccaagtggcccaaggagaccgtgaagcctgtggaggtggaggagggggagagcgtggtgctgccctgcaaccccccaccttctgctgagcccctgcgcatctactggatgaacagcaagatcctgcacatcaagcaggatgagcgggtgaccatgggccagaatggaaacctgtactttgccaacgtgctgaccagtgacaaccacagcgactacatctgccacgcccacttccctggcaccaggaccatcatccagaaggagcccatcgacctgcgggtgaaggccaccaacagcatgattgacaggaagccccggctgctcttccccaccaacagcagcagccacctggtggccctgcagggccagcccctggtgctggagtgcatcgccgagggcttccccacccccaccatcaagtggctgcggcccagcggccccatgcctgctgacagagtgacctaccagaaccacaacaagaccctgcagctgctgaaggtgggggaggaggatgatggagagtaccgctgcctggccgagaacagcctgggcagcgcccggcatgcctactacgtgacagtggaggccgccccctactggctgcacaagccccagagccacctgtatggccctggagaaacagcccggctggactgccaggtgcagggccggccccagcctgaggtgacctggaggatcaatggcatccctgtggaggagctggccaaggaccagaagtaccgcatccagagaggagccctgatcctgagcaatgtgcagcccagcgacaccatggtgacccagtgtgaggccaggaacagacatggcctgctgctggccaatgcctacatctacgtggtgcagctgcctgccaagatcctgacagctgacaaccagacctacatggctgtgcagggcagcacagcctacctgctgtgcaaggcctttggagcccctgtgcccagcgtgcagtggctggatgaagatggcaccaccgtgctgcaggatgagcgcttcttcccctatgccaacggcaccctgggcatccgggacctgcaggccaatgacaccggccgctacttctgcctggccgccaatgaccagaacaacgtgaccatcatggccaacctgaaggtgaaggatgccacccagatcacccagggccccaggagcaccatcgagaagaagggcagccgggtgaccttcacctgccaggccagctttgaccccagcctgcagcccagcatcacctggagaggagatggccgggacctgcaggagctgggggacagcgacaagtacttcattgaagatggccgcctggtgatccacagcctggactacagcgaccagggcaactacagctgtgtggccagcacagagctggatgtggtggagagccgggcccagctgctggtggtgggcagccctggccctgtgccccggctggtgctgagtgacctgcacctgctgacccagagccaggtgcgggtgtcctggagccctgctgaggaccacaatgcccccatcgagaagtatgacatcgagtttgaggacaaggagatggcccctgagaagtggtacagcctgggcaaggtgcccggcaaccagaccagcaccaccctgaagctgagcccctacgtgcactacaccttccgggtgacagccatcaacaagtatggccctggagagcccagccctgtgtctgagaccgtggtgaccccagaggccgcccctgagaagaaccctgtggatgtgaagggggagggcaatgagaccaccaacatggtgatcacctggaagcccctgcgctggatggactggaatgccccccaggtgcagtacagagtgcagtggaggccccagggcacccggggcccctggcaggagcagatcgtgtctgaccccttcctggtggtgagcaacaccagcacctttgtgccctatgagatcaaggtgcaggccgtgaacagccagggcaagggccctgagccccaggtgaccatcggctacagcggggaggactacccccaggccatccctgagctggagggcatcgagatcctgaacagcagcgctgtgctggtgaagtggaggcctgtggacctggcccaggtgaagggccacctgcggggctacaacgtgacctactggagggagggcagccagaggaagcacagcaagaggcacatccacaaggaccacgtggtggtgcctgccaacaccaccagcgtcatcctgagcggcctgcggccctacagcagctaccacctggaggtgcaggccttcaacggccggggcagcggccctgccagcgagttcaccttcagcaccccagagggcgtgcccggccaccctgaggccctgcacctggagtgccagagcaacaccagcctgctgctgcgctggcagccccccctgagccacaatggagtgctgaccggctacgtgctgagctaccaccccctggatgaaggaggcaagggccagctgtccttcaacctgcgggaccctgagctgcggacccacaacctgacagacctgagcccccacctgcgctaccgcttccagctgcaggccaccaccaaggagggccctggagaggccatcgtgcgggagggcggcaccatggccctgagcggcatcagtgactttggaaacatcagcgccacagctggggagaactacagcgtggtgtcctgggtgcccaaggagggccagtgcaacttccgcttccacatcctcttcaaggccctgggggaggagaagggcggggccagcctgagcccccagtatgtgtcctacaaccagagcagctacacccagtgggacctgcagcctgacacagattatgagatccacctgttcaaggagaggatgttccgccaccagatggctgtgaagaccaatggaacaggccgggtgcggctgcccccagctggctttgccacagagggctggttcatcggctttgtgtctgccatcatcctgctgctgctggtgctgctgatcctgtgcttcatcaagaggagcaaaggaggcaagtacagcgtgaaggacaaggaggacacccaggtggacagcgaggcccggcccatgaaggatgagacctttggagagtacagcgacaatgaggagaaggccttcggcagcagccagcccagcctgaatggagacatcaagcccctgggcagtgatgacagcctggccgactatggaggctctgtggatgtgcagttcaatgaagatggcagcttcatcggccagtacagcggcaagaaggagaaggaggccgccggcggcaatgacagcagcggggccaccagccccatcaacccagctgtggccctggagtag

SEQ ID NO: 157215 - DNA, 351 bp, Artificial Sequence
  Description of Artificial Sequence: Synthetic coding sequence
atggccgagggcgcccccaagtggcccaaggagaccgtgaagcctgtggaggtggaggagggggagagcgtggtgctgccctgcaaccccccaccttctgctgagcccctgcgcatctactggatgaacagcaagatcctgcacatcaagcaggatgagcgggtgaccatgggccagaatggaaacctgtactttgccaacgtgctgaccagtgacaaccacagcgactacatctgccacgcccacttccctggcaccaggaccatcatccagaaggagcccatcgacctgcgggtgaaggccaccaacagcatgattgacaggaagccccggctgctcttccccacctag

SEQ ID NO: 157216 - DNA, 3780 bp, Artificial Sequence
  Description of Artificial Sequence: Synthetic coding sequence
atggtggtggccctgcgctacgtgtggcccctgctgctgtgcagcccctgcctgctgatccagatccctgaggagagcttccctggccaccgggtggtgatggagccccctgtgatcacagagcagagcccccggcggctggtggtgttccccacagatgacatcagcctgaagtgtgaggccagcggcaagccagaggtgcagttccgctggaccagagatggagtgcacttcaagcccaaggaggagctgggcgtgacagtgtaccagagcccccacagcggcagcttcaccatcaccggcaacaacagcaactttgcccagcgcttccagggcatctaccgctgctttgccagcaacaagctgggcacagccatgagccatgagatccggctgatggccgagggcgcccccaagtggcccaaggagaccgtgaagcctgtggaggtggaggagggggagagcgtggtgctgccctgcaaccccccaccttctgctgagcccctgcgcatctactggatgaacagcaagatcctgcacatcaagcaggatgagcgggtgaccatgggccagaatggaaacctgtactttgccaacgtgctgaccagtgacaaccacagcgactacatctgccacgcccacttccctggcaccaggaccatcatccagaaggagcccatcgacctgcgggtgaaggccaccaacagcatgattgacaggaagccccggctgctcttccccaccaacagcagcagccacctggtggccctgcagggccagcccctggtgctggagtgcatcgccgagggcttccccacccccaccatcaagtggctgcggcccagcggccccatgcctgctgacagagtgacctaccagaaccacaacaagaccctgcagctgctgaaggtgggggaggaggatgatggagagtaccgctgcctggccgagaacagcctgggcagcgcccggcatgcctactacgtgacagtggaggccgccccctactggctgcacaagccccagagccacctgtatggccctggagaaacagcccggctggactgccaggtgcagggccggccccagcctgaggtgacctggaggatcaatggcatccctgtggaggagctggccaaggaccagaagtaccgcatccagagaggagccctgatcctgagcaatgtgcagcccagcgacaccatggtgacccagtgtgaggccaggaacagacatggcctgctgctggccaatgcctacatctacgtggtgcagctgcctgccaagatcctgacagctgacaaccagacctacatggctgtgcagggcagcacagcctacctgctgtgcaaggcctttggagcccctgtgcccagcgtgcagtggctggatgaagatggcaccaccgtgctgcaggatgagcgcttcttcccctatgccaacggcaccctgggcatccgggacctgcaggccaatgacaccggccgctacttctgcctggccgccaatgaccagaacaacgtgaccatcatggccaacctgaaggtgaaggatgccacccagatcacccagggccccaggagcaccatcgagaagaagggcagccgggtgaccttcacctgccaggccagctttgaccccagcctgcagcccagcatcacctggagaggagatggccgggacctgcaggagctgggggacagcgacaagtacttcattgaagatggccgcctggtgatccacagcctggactacagcgaccagggcaactacagctgtgtggccagcacagagctggatgtggtggagagccgggcccagctgctggtggtgggcagccctggccctgtgccccggctggtgctgagtgacctgcacctgctgacccagagccaggtgcgggtgtcctggagccctgctgaggaccacaatgcccccatcgagaagtatgacatcgagtttgaggacaaggagatggcccctgagaagtggtacagcctgggcaaggtgcccggcaaccagaccagcaccaccctgaagctgagcccctacgtgcactacaccttccgggtgacagccatcaacaagtatggccctggagagcccagccctgtgtctgagaccgtggtgaccccagaggccgcccctgagaagaaccctgtggatgtgaagggggagggcaatgagaccaccaacatggtgatcacctggaagcccctgcgctggatggactggaatgccccccaggtgcagtacagagtgcagtggaggccccagggcacccggggcccctggcaggagcagatcgtgtctgaccccttcctggtggtgagcaacaccagcacctttgtgccctatgagatcaaggtgcaggccgtgaacagccagggcaagggccctgagccccaggtgaccatcggctacagcggggaggactacccccaggccatccctgagctggagggcatcgagatcctgaacagcagcgctgtgctggtgaagtggaggcctgtggacctggcccaggtgaagggccacctgcggggctacaacgtgacctactggagggagggcagccagaggaagcacagcaagaggcacatccacaaggaccacgtggtggtgcctgccaacaccaccagcgtcatcctgagcggcctgcggccctacagcagctaccacctggaggtgcaggccttcaacggccggggcagcggccctgccagcgagttcaccttcagcaccccagagggcgtgcccggccaccctgaggccctgcacctggagtgccagagcaacaccagcctgctgctgcgctggcagccccccctgagccacaatggagtgctgaccggctacgtgctgagctaccaccccctggatgaaggaggcaagggccagctgtccttcaacctgcgggaccctgagctgcggacccacaacctgacagacctgagcccccacctgcgctaccgcttccagctgcaggccaccaccaaggagggccctggagaggccatcgtgcgggagggcggcaccatggccctgagcggcatcagtgactttggaaacatcagcgccacagctggggagaactacagcgtggtgtcctgggtgcccaaggagggccagtgcaacttccgcttccacatcctcttcaaggccctgggggaggagaagggcggggccagcctgagcccccagtatgtgtcctacaaccagagcagctacacccagtgggacctgcagcctgacacagattatgagatccacctgttcaaggagaggatgttccgccaccagatggctgtgaagaccaatggaacaggccgggtgcggctgcccccagctggctttgccacagagggctggttcatcggctttgtgtctgccatcatcctgctgctgctggtgctgctgatcctgtgcttcatcaagaggagcaaaggaggcaagtacagcgtgaaggacaaggaggacacccaggtggacagcgaggcccggcccatgaaggatgagacctttggagagtaccgcagcctggagagtgacaatgaggagaaggccttcggcagcagccagcccagcctgaatggagacatcaagcccctgggcagtgatgacagcctggccgactatggaggctctgtggatgtgcagttcaatgaagatggcagcttcatcggccagtacagcggcaagaaggagaaggaggccgccggcggcaatgacagcagcggggccaccagccccatcaacccagctgtggccctggagtag

SEQ ID NO: 157217 - DNA, 1326 bp, Artificial Sequence
  Description of Artificial Sequence: Synthetic coding sequence
atggtgcctgccctgcgctacctggtgggcgcctgtggccgggcccggggcctgtttgctgggggcagccctggggcctgtggctttgccagcggccggccccggcccctgtgtggcggcagccgcagcgccagcaccagcagctttgatattgtgattgtgggcggcggcatcgtgggcctggccagcgcccgggccctgatcctgcggcaccccagcctgagcattggagtgctggagaaggagaaggacctggccgtgcaccagacaggccacaacagcggggtcatccacagcggcatctactacaagccagagagcctgaaggccaagctgtgtgtgcagggcgccgccctgctgtatgagtactgccagcagaagggcatctcctacaagcagtgtgggaagctgattgtggccgtggagcaggaggagatcccccggctgcaggccctgtatgagaagggcctgcagaatggagtgcccggcctgcggctcatccagcaggaggacatcaagaagaaggagccctactgccggggcctgatggccatcgactgcccccacacaggcatcgtggactaccggcaggtggccctgagctttgcccaggacttccaggaggccggcggctctgtgctgaccaactttgaggtgaagggcatcgagatggccaaggagagccccagccgcagcattgatggcatgcagtaccccatcgtcatcaagaacaccaagggggaggagatccgctgccagtatgtggtgacctgtgccggcctgtacagcgaccgcatcagcgagctgagcggctgcaccccagacccccgcatcgtgcccttccggggggactacctgctgctgaagccagagaagtgctacctggtgaagggcaacatctaccctgtgcctgacagccgcttccccttcctgggcgtgcacttcacccccaggatggatggcagcatctggctgggccccaatgctgtgctggccttcaagcgggagggctaccggccctttgacttcagcgccacagatgtgatggacatcatcatcaacagcggcctcatcaagctggccagccagaacttctcctatggagtgacagagatgtacaaggcctgcttcctgggcgccaccgtgaagtacctgcagaagttcatccctgagatcaccatcagtgacatcctgcggcaggtggccgtgcggggccccagctggctgtggcagcagcccatgaaggtgtctgacaacaacatctactgcttcctgtggcgctgctttgccctgctgctgaccggcagcgcctgcagcttcaagtag

SEQ ID NO: 157218 - DNA, 1392 bp, Artificial Sequence
  Description of Artificial Sequence: Synthetic coding sequence
atggtgcctgccctgcgctacctggtgggcgcctgtggccgggcccggggcctgtttgctgggggcagccctggggcctgtggctttgccagcggccggccccggcccctgtgtggcggcagccgcagcgccagcaccagcagctttgatattgtgattgtgggcggcggcatcgtgggcctggccagcgcccgggccctgatcctgcggcaccccagcctgagcattggagtgctggagaaggagaaggacctggccgtgcaccagacaggccacaacagcggggtcatccacagcggcatctactacaagccagagagcctgaaggccaagctgtgtgtgcagggcgccgccctgctgtatgagtactgccagcagaagggcatctcctacaagcagtgtgggaagctgattgtggccgtggagcaggaggagatcccccggctgcaggccctgtatgagaagggcctgcagaatggagtgcccggcctgcggctcatccagcaggaggacatcaagaagaaggagccctactgccggggcctgatggccatcgactgcccccacacaggcatcgtggactaccggcaggtggccctgagctttgcccaggacttccaggaggccggcggctctgtgctgaccaactttgaggtgaagggcatcgagatggccaaggagagccccagccgcagcattgatggcatgcagtaccccatcgtcatcaagaacaccaagggggaggagatccgctgccagtatgtggtgacctgtgccggcctgtacagcgaccgcatcagcgagctgagcggctgcaccccagacccccgcatcgtgcccttccggggggactacctgctgctgaagccagagaagtgctacctggtgaagggcaacatctaccctgtgcctgacagccgcttccccttcctgggcgtgcacttcacccccaggatggatggcagcatctggctgggccccaatgctgtgctggccttcaagcgggagggctaccggccctttgacttcagcgccacagatgtgatggacatcatcatcaacagcggcctcatcaagctggccagccagaacttctcctatggagtgacagagatgtacaaggcctgcttcctgggcgccaccgtgaagtacctgcagaagttcatccctgagatcaccatcagtgacatcctgcggggccctgctggggtgcgggcccaggccctggacagagatggcaacctggtggaggactttgtgtttgatgctggggtgggggacatcggcaaccgcatcctgcacgtgagaaatgcccccagccctgctgccaccagcagcatcgccatcagcggcatgattgctgatgaggtgcagcagagatttgagctgtag

SEQ ID NO: 157219 - DNA, 1392 bp, Artificial Sequence; identical to SEQ ID NO: 157218
  Description of Artificial Sequence: Synthetic coding sequence

SEQ ID NO: 157220 - DNA, 3060 bp, Artificial Sequence
  Description of Artificial Sequence: Synthetic coding sequence
atgctgtggagggtgctgctgagcaagaggcctcccttcccccaccctgagctggacttccaggaggcccccatccccagctgccccggccgcctgcccggcaggaagaacagcgtggccctggccgccgcccccaggaaggagcccaccggggaccgggagaagcccctgcccttccctgtgctggcccccttcagcaaccctgagcacagcgccccagccaaggtggtgcgggctgctgtgcccaagcagaggaagggcagcaaggtgggggactttggagatgccatcaactggcccaccccaggagaaattgcccacaagtctgtgcagccccagagccacaagccccagcccaccaggaagctgccccccaagaaggacatgaaggagcaggagaagggggagggcagtgacagcaaggagagccccaagaccaagagtgatgaaagtggagaggagaagaatggagatgaggactgccagaggggcggccagaagaagaagggcaacaagcacaagtgggtgcccctgcagattgacatgaagccagaggtgccccgggagaagctggccagccggcccacccggcccccagagcccaggcacatcccagccaacagaggagagatcaagggcagcgagagcgccacctacgtgcctgtggccccacccaccccagcctggcagcctgagatcaagccagagcccgcctggcatgaccaggatgagaccagctctgtgaagagtgatggagctggaggagcccgggccagcttccggggccggggccggggccggggccggggccggggccggggccggggcggcaccaggacccactttgactaccagtttggctacaggaagtttgatggagtggagggccccaggacccccaagtacatgaacaacatcacctactactttgacaacgtgagcagcacagagctgtacagcgtggaccaggagctgctgaaggactacatcaagaggcagatcgagtactacttctctgtggacaacctggagcgggacttcttcctgcggaggaagatggatgctgatggcttcctgcccatcaccctcatcgccagcttccaccgggtgcaggccctgaccacagacatcagcctcatctttgctgccctgaaggacagcaaggtggtggagatcgtggatgagaaggtgagaagaagagaggagcctgagaagtggcccctgccccccatcgtggactacagccagacagacttcagccagctgctgaactgcccagagtttgtgccccggcagcactaccagaaggagacagagagcgcccctggcagccccagggctgtgacccctgtgcccaccaagacagaggaggtgagcaacctgaagaccctgcccaagggcctgagcgccagcctgcctgacctggacagcgagaactggattgaggtgaagaagaggccccggcccagccctgcccggcccaagaagtctgaggagagccgcttcagccacctgaccagcctgccccagcagctgcccagccagcagctgatgagcaaggaccaggatgagcaggaggagctggacttcctgtttgatgaggagatggagcagatggatggcaggaagaacaccttcaccgcctggagcgatgaggagagtgactatgaaattgatgacagagatgtgaacaagatcctgattgtgacccagaccccccactacatgagaagacaccctggaggagacagaactggaaaccacaccagccgggccaagatgtctgctgagctggccaaggtgatcaatgatggcctcttctactatgagcaggacctgtgggccgagaagtttgagcctgagtacagccagatcaagcaggaggtggagaacttcaagaaggtgaacatgatcagccgggagcagtttgacaccctgaccccagagccccctgtggaccccaaccaggaggtgcccccaggccccccacgcttccagcaggtgcccacagatgccctggccaacaagctgtttggagcccctgagcccagcaccatcgcccggagcctgcccaccaccgtgcctgagagccccaactacagaaacaccaggacccccaggacccccaggaccccccagctgaaggacagcagccagaccagccgcttctaccctgtggtgaaggagggccgcaccctggatgccaagatgcccaggaagaggaagaccaggcacagcagcaacccccccctggagagccacgtgggctgggtgatggacagccgggagcaccggcccaggacagccagcatcagcagcagccccagcgagggcacccccaccgtgggcagctatggctgcaccccccagagcctgcccaagttccagcaccccagccatgagctgctgaaggaaaatggcttcacccagcacgtgtaccacaagtacagaagacgctgcctgaatgaaaggaagaggctgggcatcggccagagccaggagatgaacaccctcttccgcttctggagcttcttcctgcgggaccacttcaacaagaagatgtatgaggagttcaagcagctggccctggaggatgccaaggagggctaccgctatggcctggagtgcctcttccgctactacagctatggcctggagaagaagttccggctggacatcttcaaggacttccaggaggagaccgtgaaggactatgaagctggccagctgtatggcctggagaagttctgggccttcctgaagtacagcaaggccaagaacctggacatcgaccccaagctgcaggagtacctgggcaagttccggcggctggaggacttccgggtggacccccccatgggagaggagggcaaccacaagaggcacagcgtggtggccggcggcggcggcggggagggcaggaagcgctgccccagccagagcagcagcaggcctgctgccatgatcagccagccccccaccccacccaccggccagcctgtgagagaagatgccaagtggaccagccagcacagcaacacccagaccctgggcaagtag

SEQ ID NO: 157221 - DNA, 2451 bp, Artificial Sequence
  Description of Artificial Sequence: Synthetic coding sequence
atggccacccaggtggagcccctgctgcccggcggggccaccctgctgcaggccgaggagcacggcggcctggtgaggaagaagcccccaccagcccctgagggcaagggggagcccggccccaatgatgtgcggggcggggagccagatggcagcgcccggcggccccggcccccctgtgccaagccccacaaggagggcaccggccagcaggagcgggagagcccccggcccctgcagctgcccggggctgagggccctgccatcagtgatggagaggagggcggcggggagcctggagctgggggcggggccgccggggctgctggagctggaagaagagactttgtggaggcccccccacccaaggtgaacccctggaccaagaatgccctgccccctgtgctgaccaccgtgaatggccagagccccccagagcacagcgccccagccaaggtggtgcgggctgctgtgcccaagcagaggaagggcagcaaggtgggggactttggagatgccatcaactggcccaccccaggagagatcgcccacaagtctgtgcagccccagagccacaagccccagcccaccaggaagctgccccccaagaaggacatgaaggagcaggagaagggggagggcagtgacagcaaggagagccccaagaccaagagtgatgagagcggggaggagaagaatggagatgaggactgccagagaggaggccagaagaagaagggcaacaagcacaagtgggtgcccctgcagattgacatgaagccagaggtgccccgggagaagctggccagccggcccaccaggcctcctgagcccaggcacatcccagccaacagaggagagatcaagggcagcgagagcgccacctacgtgcctgtggccccacccaccccagcctggcagcctgagatcaagccagagcccgcctggcatgaccaggatgagaccagctctgtgaagagtgatggagctgggggcgcccgggccagcttccggggccggggccggggccggggccggggccggggccggggccggggcggcaccaggacccactttgactaccagtttggctacaggaagtttgatggagtggagggccccaggacccccaagtacatgaacaacatcacctactactttgacaacgtgagcagcacagagctgtacagcgtggaccaggagctgctgaaggactacatcaagaggcagatcgagtactacttctctgtggacaacctggagcgggacttcttcctgcggaggaagatggatgctgatggcttcctgcccatcaccctgattgccagcttccaccgggtgcaggccctgaccacagacatcagcctcatctttgctgccctgaaggacagcaaggtggtggagatcgtggatgagaaggtgagaagaagagaggagcctgagaagtggcccctgccccccatcgtggactacagccagacagacttcagccagctgctgaactgcccagagtttgtgccccggcagcactaccagaaggagacagaaagtgcccctggcagccccagggctgtgacccctgtgcccaccaagacagaggaggtgagcaacctgaagaccctgcccaagggcctgagcgccagcctgcctgacctggacagcgagaactggattgaggtgaagaagaggccccggcccagccctgcccggcccaagaagtctgaggagagccgcttcagccacctgaccagcctgccccagcagctgcccagccagcagctgatgagcaaggaccaggatgagcaggaggagctggacttcctgtttgatgaggagatggagcagatggatggcaggaagaacaccttcaccgcctggagcgatgaggagagtgactatgaaattgatgacagagatgtgaacaagatcctgattgtgacccagaccccccactacatgaggaggcaccctggaggagacagaacaggcaaccacaccagccgggccaagatgtctgctgagctggccaaggtgatcaatgatggcctcttctactatgagcaggacctgtgggccgagaagtttgagcctgagtacagccagatcaagcaggaggtggagaacttcaagaaggtgaacatgatcagccgggagcagtttgacaccctgaccccagagccccctgtggaccccaaccaggaggtgcccccaggccccccacgcttccagcaggtgcccacagatgccctggccaacaagctgtttggagcccctgagcccagcaccatcgcccggagcctgcccaccaccgtgcctgagagccccaactacagaaacaccaggacccccaggacccccaggaccccccagctgaaggacagcagccagaccagccgcttctaccctgtggtgaaggagggccgcaccctggatgccaagatgcccaggtag

SEQ ID NO: 157222 - DNA, 282 bp, Artificial Sequence
  Description of Artificial Sequence: Synthetic coding sequence
atgaaggagcaggagaagggggagggcagtgacagcaaggagagccccaagaccaagagtgatgaaagtggagaggagaagaatggagatgaggactgccagaggggcggccagaagaagaagggcaacaagcacaagtgggtgcccctgcagattgacatgaagccagaggtgccccgggagaagctggccagccggcccacccggcccccagagcccaggcacatcccagccaacagaggagagatcaagggcagcgagagcgccacctacgtgccctag

SEQ ID NO: 157223 - DNA, 1836 bp, Artificial Sequence
  Description of Artificial Sequence: Synthetic coding sequence
atgaaggagcaggagaagggggagggcagtgacagcaaggagagccccaagaccaagagtgatgaaagtggagaggagaagaatggagatgaggactgccagaggggcggccagaagaagaagggcaacaagcacaagtgggtgcccctgcagattgacatgaagccagaggtgccccgggagaagctggccagccggcccacccggcccccagagcccaggcacatcccagccaacagaggagagatcaagggcagcgagagcgccacctacgtgcctgtggccccacccaccccagcctggcagcctgagatcaagccagagcccgcctggcatgaccaggatgagaccagctctgtgaagagtgatggagctggaggagcccgggccagcttccggggccggggccggggccggggccggggccggggccggggccggggcggcaccaggacccactttgactaccagtttggctacaggaagtttgatggagtggagggccccaggacccccaagtacatgaacaacatcacctactactttgacaacgtgagcagcacagagctgtacagcgtggaccaggagctgctgaaggactacatcaagaggcagatcgagtactacttctctgtggacaacctggagcgggacttcttcctgcggaggaagatggatgctgatggcttcctgcccatcaccctcatcgccagcttccaccgggtgcaggccctgaccacagacatcagcctcatctttgctgccctgaaggacagcaaggtggtggagatcgtggatgagaaggtgagaagaagagaggagcctgagaagtggcccctgccccccatcgtggactacagccagacagacttcagccagctgctgaactgcccagagtttgtgccccggcagcactaccagaaggagacagagagcgcccctggcagccccagggctgtgacccctgtgcccaccaagacagaggaggtgagcaacctgaagaccctgcccaagggcctgagcgccagcctgcctgacctggacagcgagaactggattgaggtgaagaagaggccccggcccagccctgcccggcccaagaagtctgaggagagccgcttcagccacctgaccagcctgccccagcagctgcccagccagcagctgatgagcaaggaccaggatgagcaggaggagctggacttcctgtttgatgaggagatggagcagatggatggcaggaagaacaccttcaccgcctggagcgatgaggagagtgactatgaaattgatgacagagatgtgaacaagatcctgattgtgacccagaccccccactacatgagaagacaccctggaggagacagaactggaaaccacaccagccgggccaagatgtctgctgagctggccaaggtgatcaatgatggcctcttctactatgagcaggacctgtgggccgagaagtttgagcctgagtacagccagatcaagcaggaggtggagaacttcaagaaggtgaacatgatcagccgggagcagtttgacaccctgaccccagagccccctgtggaccccaaccaggaggtgcccccaggccccccacgcttccagcaggtgcccacagatgccctggccaacaagctgtttggagcccctgagcccagcaccatcgcccggagcctgcccaccaccgtgcctgagagccccaactacagaaacaccaggacccccaggacccccaggaccccccagctgaaggacagcagccagaccagccgcttctaccctgtggtgaaggagggccgcaccctggatgccaagatgcccaggtag

SEQ ID NO: 157224 - DNA, 1749 bp, Artificial Sequence
  Description of Artificial Sequence: Synthetic coding sequence
atggagacagaaagtggcaaccaggagaaggtgatggaggaggagagcacagagaagaagaaggaggtggagaagaagaagaggagccgggtgaagcaggtgctggccgacatcgccaagcaggtggacttctggtttggagatgccaacctgcacaaggaccgcttcctgcgggagcagatcgagaagagcagagatggctacgtggacatcagcctgctggtgtccttcaacaagatgaagaagctgaccacagatggcaagctgattgcccgggccctgcggagcagcgctgtggtggagctggacctggagggcacccgcatccggaggaagaagcccctgggggagcggcccaaggatgaagatgagaggacagtgtatgtggagctgctgcccaagaatgtgaaccacagctggattgagcgggtgtttggaaaatgtggaaatgtggtgtacatcagcatcccccactacaagagcactggagaccccaagggctttgcctttgtggagtttgagaccaaggagcaggccgccaaggccatcgagttcctgaacaaccccccagaggaggcccccaggaagccaggcatcttccccaagacagtgaagaacaagcccatcccagccctgcgggtggtggaggagaagaagaagaagaagaagaagaagggccgcatgaagaaggaggacaacatccaggccaaggaggagaacatggacaccagcaacaccagcatcagcaagatgaagaggagccggcccaccagcgagggcagtgacatcgagagcacagagccccagaagcagtgcagcaagaagaagaagaagagggacagagtggaggccagcagcctgcctgaggtgaggacaggcaagaggaagaggagcagcagtgaagatgctgagagcctggcccccaggagcaaggtgaagaagatcatccagaaggacatcatcaaggaggccagcgaggccagcaaggagaacagagacatcgagatcagcacagaggaggagaaggacaccggggacctgaaggacagcagcctgctgaagaccaagaggaagcacaagaagaagcacaaggagcggcacaagatgggagaggaggtgatccccctgcgggtgctgagcaagtctgagtggatggacctgaagaaggagtacctggccctgcagaaggcctccatggccagcctgaagaagaccatcagccagatcaagtctgagagcgagatggagacagattctggagtgccccagaacacaggcatgaagaatgagaagacagccaaccgggaggagtgcaggacccaggagaaggtgaatgccaccggcccccagtttgtgtctggagtcatcgtgaagatcatcagcacagagcccctgcccggcaggaagcaggtgcgggacaccctggccgccatcagcgaggtgctgtatgtggacctgctggagggggacacagagtgccacgcccgcttcaagaccccagaagatgcccaggccgtcatcaatgcctacacagagatcaacaagaagcactgctggaagctggagatcctgagcggggaccacgagcagcgctactggcagaagatcctggtggaccggcaggccaagctgaaccagccccgggagaagaagaggggcacagagaagctgatcaccaaggccgagaagatccggctggccaagacccagcaggccagcaagcacatccgcttctctgaatatgactag

SEQ ID NO: 157225 - DNA, 1749 bp, Artificial Sequence; identical to SEQ ID NO: 157224
  Description of Artificial Sequence: Synthetic coding sequence

SEQ ID NO: 157226 - DNA, 900 bp, Artificial Sequence
  Description of Artificial Sequence: Synthetic coding sequence
atggagacagaaagtggcaaccaggagaaggtgatggaggaggagagcacagagaagaagaaggaggtggagaagaagaagaggagccgggtgaagcaggtgctggccgacatcgccaagcaggtggacttctggtttggagatgccaacctgcacaaggaccgcttcctgcgggagcagatcgagaagagcagagatggctacgtggacatcagcctgctggtgtccttcaacaagatgaagaagctgaccacagatggcaagctgattgcccgggccctgcggagcagcgctgtggtggagctggacctggagggcacccgcatccggaggaagaagcccctgggggagcggcccaaggatgaagatgagaggacagtgtatgtggagctgctgcccaagaatgtgaaccacagctggattgagcgggtgtttggaaaatgtggaaatgtggtgtacatcagcatcccccactacaagagcactggagaccccaagggctttgcctttgtggagtttgagaccaaggagcaggccgccaaggccatcgagttcctgaacaaccccccagaggaggcccccaggaagccaggcatcttccccaagacagtgaagaacaagcccatcccagccctgcgggtggtggaggagaagaagaagaagaagaagaagaagggccgcatgaagaaggaggacaacatccaggccaaggaggagaacatggacaccagcaacaccagcatcagcaagatgaagaggagccggcccaccagcgagggcagtgacatcgagagcacagagccccagaagcagtgcagcaagaagaagaagaagagggacagagtggaggccagcagcctgcctgaggtgaggacaggcaagaggaagaggagcagctag

SEQ ID NO: 157227 - DNA, 390 bp, Artificial Sequence
  Description of Artificial Sequence: Synthetic coding sequence
atggagacagaaagtggcaaccaggagaaggtgatggaggaggagagcacagagaagaagaaggaggtggagaagaagaagaggagccgggtgaagcaggtgctggccgacatcgccaagcaggtggacttctggtttggagatgccaacctgcacaaggaccgcttcctgcgggagcagatcgagaagagcagagatggctacgtggacatcagcctgctggtgtccttcaacaagatgaagaagctgaccacagatggcaagctgattgcccgggccctgcggagcagcgctgtggtggagctggacctggagggcacccgcatccggaggaagaagcccctgggggagcggcccaaggatgaagatgagaggacagtgtatgtgtag

SEQ ID NO: 157228 - DNA, 360 bp, Artificial Sequence
  Description of Artificial Sequence: Synthetic coding sequence
atggagacagaaagtggcaaccaggagaaggtgatggaggaggagagcacagagaagaagaaggaggtggagaagaagaagaggagccgggtgaagcaggtgctggccgacatcgccaagcaggtggacttctggtttggagatgccaacctgcacaaggaccgcttcctgcgggagcagatcgagaagagcagagatggctacgtggacatcagcctgctggtgtccttcaacaagatgaagaagctgaccacagatggcaagctgattgcccgggccctgcggagcagcgctgtggtggagctggacctggagggcacccgcatccggaggaagaagcccctgggggagcggccctag

SEQ ID NO: 157229 - DNA, 1770 bp, Artificial Sequence
  Description of Artificial Sequence: Synthetic coding sequence
atgatccccaacatcgagggcatggagacagagagcggcaaccaggagaaggtgatggaggaggagagcacagagaagaagaaggaggtggagaagaagaagaggagccgggtgaagcaggtgctggccgacatcgccaagcaggtggacttctggtttggagatgccaacctgcacaaggaccgcttcctgcgggagcagatcgagaagagcagagatggctacgtggacatcagcctgctggtgtccttcaacaagatgaagaagctgaccacagatggcaagctgattgcccgggccctgcggagcagcgctgtggtggagctggacctggagggcacccgcatccggaggaagaagcccctgggggagcggcccaaggatgaagatgagaggacagtgtatgtggagctgctgcccaagaatgtgaaccacagctggattgaaagagtgtttggaaaatgtggaaatgtggtgtacatcagcatcccccactacaagagcactggagaccccaagggctttgcctttgtggagtttgagaccaaggagcaggccgccaaggccatcgagttcctgaacaaccccccagaggaggcccccaggaagccaggcatcttccccaagacagtgaagaacaagcccatcccagccctgcgggtggtggaggagaagaagaagaagaagaagaagaagggccgcatgaagaaggaggacaacatccaggccaaggaggagaacatggacaccagcaacaccagcatcagcaagatgaagaggagccggcccaccagcgagggcagtgacatcgagagcacagagccccagaagcagtgcagcaagaagaagaagaagagggacagagtggaggccagcagcctgcctgaggtgaggacaggcaagaggaagaggagcagcagtgaagatgctgagagcctggcccccaggagcaaggtgaagaagatcatccagaaggacatcatcaaggaggccagcgaggccagcaaagaaaatagagacatcgagatcagcacagaggaggagaaggacacaggagacctgaaggacagcagcctgctgaagaccaagaggaagcacaagaagaagcacaaggagcggcacaagatgggagaggaggtgatccccctgcgggtgctgagcaagtctgagtggatggacctgaagaaggagtacctggccctgcagaaggcctccatggccagcctgaagaagaccatcagccagatcaagtctgagagcgagatggagacagacagcggcgtgccccagaacacaggcatgaagaatgagaagacagccaaccgggaggagtgcaggacccaggagaaggtgaatgccaccggcccccagtttgtgtctggagtgattgtgaagatcatcagcacagagcccctgcccggcaggaagcaggtgcgggacaccctggccgccatcagcgaggtgctgtatgtggacctgctggagggggacacagaatgtcatgcccgcttcaagaccccagaagatgcccaggccgtcatcaatgcctacacagagatcaacaagaagcactgctggaagctggagatcctgagcggggaccacgagcagcgctactggcagaagatcctggtggaccggcaggccaagctgaaccagccccgggagaagaagaggggcacagagaagctgatcaccaaggccgagaagatccggctggccaagacccagcaggccagcaagcacatccgcttctctgaatatgactag

SEQ ID NO: 157230 - DNA, 417 bp, Artificial Sequence
  Description of Artificial Sequence: Synthetic coding sequence
atgaagttcaccaccctgctcttcctggccgctgtggccggggccctggtgtatgcagaagatgccagcagtgacagcactggagctgaccctgcccaggaggccggcaccagcaagcccaatgaggagatcagcggccctgctgagcccgccagccccccagagaccaccaccacagcccaggagaccagcgctgctgctgtgcagggcacagccaaggtgaccagcagccggcaggagctgaaccccctgaagagcatcgtggagaagagcatcctgctgacagagcaggccctggccaaggccggcaagggcatgcatggaggagtgcctgggggcaagcagttcattgaaaatggaagtgaatttgcccagaagctgctgaagaagttcagcctgctgaagccctgggcctag

SEQ ID NO: 157231 - DNA, 429 bp, Artificial Sequence
  Description of Artificial Sequence: Synthetic coding sequence
atgaggttctttgtgcccctcttcctggtgggcatcctcttccctgccatcctggccaagcagttcaccaagtgtgagctgagccagctgctgaaggacattgatggctatggaggcatcgccctgcctgagctgatctgcaccatgttccacaccagcggctatgacacccaggccatcgtggagaacaatgaaagcacagaatatggcctcttccagatcagcaacaagctgtggtgcaagagcagccaggtgccccagagcaggaacatctgtgacatcagctgtgacaagttcctggatgatgacatcacagatgacatcatgtgtgccaagaagatcctggacatcaagggcatcgactactggctggcccacaaggccctgtgcacagagaagctggagcagtggctgtgtgagaagctgtag

SEQ ID NO: 157232 - DNA, 1644 bp, Artificial Sequence
  Description of Artificial Sequence: Synthetic coding sequence
atgtaccgcctgatgtctgctgtgacagcccgggctgctgcccctgggggcctggccagcagctgtggccggcggggcgtgcaccagagagctggcctgccccccctgggccacggctgggtgggcggcctgggcctgggcctgggcctggccctgggcgtgaagctggccggcggcctgcggggagctgccccagcccagagccctgctgccccagaccctgaggccagccccctggccgagcccccccaggagcagagcctggccccctggagcccccagaccccagccccaccctgcagccgctgctttgcccgggccatcgagagcagccgggacctgctgcaccgcatcaaggatgaggtgggcgcccctggcatcgtggtgggcgtgtctgtggatggcaaggaggtgtggagcgagggcctgggctatgcagatgtggagaacagagtgccctgcaagccagagaccgtgatgagaattgccagcatcagcaagagcctgaccatggtggccctggccaagctgtgggaggccggcaagctggacctggacatccctgtgcagcactacgtgcctgagttccctgagaaggagtatgaaggagagaaggtgtctgtgaccacccggctgctgatcagccacctgagcggcatccgccactatgagaaggacatcaagaaggtgaaggaggagaaggcctacaaggccctgaagatgatgaaggaaaatgtggcctttgagcaggagaaggagggcaagagcaatgagaagaatgacttcaccaagttcaagacagagcaggagaatgaggccaagtgcaggaacagcaagccaggcaagaagaagaatgactttgagcagggcgagctgtacctgcgggagaagtttgaaaattccattgagagcctgcggctcttcaagaatgaccccctcttcttcaagccaggcagccagttcctgtacagcaccttcggctacaccctgctggccgccatcgtggagcgggccagcggctgcaagtacctggactacatgcagaagatcttccatgacctggacatgctgaccaccgtgcaggaggagaatgagcccgtcatctacaacagagcccgcttctacgtgtacaacaagaagaagaggctggtgaacaccccctacgtggacaacagctacaagtgggccggcggcggcttcctgagcacagtgggggacctgctgaagtttggaaatgccatgctgtatggctaccaggtgggcctcttcaagaacagcaatgaaaacctgctgcccggctacctgaagccagagaccatggtgatgatgtggacccctgtgcccaacacagagatgtcctgggacaaggagggcaagtatgccatggcctggggcgtggtggagaggaagcagacctacggcagctgcaggaagcagaggcactacgccagccacactggaggagctgtgggcgccagctctgtgctgctggtgctgcctgaggagctggacacagagaccatcaacaacaaggtgcccccccggggcatcatcgtgtccatcatctgcaacatgcagagcgtgggcctgaacagcacagccctgaagatcgccctggagtttgacaaggacagaagtgactag

SEQ ID NO: 157233 - DNA, 1122 bp, Artificial Sequence
  Description of Artificial Sequence: Synthetic coding sequence
atgtaccgcctgatgtctgctgtgacagcccgggctgctgcccctgggggcctggccagcagctgtggccggcggggcgtgcaccagagagctggcctgccccccctgggccacggctgggtgggcggcctgggcctgggcctgggcctggccctgggcgtgaagctggccggcggcctgcggggagctgccccagcccagagccctgctgccccagaccctgaggccagccccctggccgagcccccccaggagcagagcctggccccctggagcccccagaccccagccccaccctgcagccgctgctttgcccgggccatcgagagcagccgggacctgctgcaccgcatcaaggatgaggtgggcgcccctggcatcgtggtgggcgtgtctgtggatggcaaggaggtgtggagcgagggcctgggctatgcagatgtggagaacagagtgccctgcaagccagagaccgtgatgagaattgccagcatcagcaagagcctgaccatggtggccctggccaagctgtgggaggccggcaagctggacctggacatccctgtgcagcactacgtgcctgagttccctgagaaggagtatgaaggagagaaggtgtctgtgaccacccggctgctgatcagccacctgagcggcatccgccactatgagaaggacatcaagaaggtgaaggaggagaaggcctacaaggccctgaagatgatgaaggaaaatgtggcctttgagcaggagaaggagggcaagagcaatgagaagaatgacttcaccaagttcaagacagagcaggagaatgaggccaagtgcaggaacagcaagccaggcaagaagaagaatgactttgagcagggcgagctgtacctgcgggagaagtttgaaaattccattgagagcctgcggctcttcaagaatgaccccctcttcttcaagccaggcagccagttcctgtacagcaccttcggctacaccctgctggccgccatcgtggagcgggccagcggctgcaagtacctggactacatgcagaagatcttccatgacctggacatgctgaccaccgtgcaggaggagaatgagcccgtcatctacaacagagccaggtag

SEQ ID NO: 157234 - DNA, 5784 bp, Artificial Sequence
  Description of Artificial Sequence: Synthetic coding sequence
atggagctgtcctggcacgtggtgttcatcgccctgctgtccttcagctgctggggcagtgactgggagagtgacaggaacttcatcagcacagctggccccctgaccaatgacctgctgcacaacctgagcggcctgctgggggaccagagcagcaactttgtggccggggacaaggacatgtatgtgtgccaccagcccctgcccaccttcctgcctgagtacttcagcagcctgcacgccagccagatcacccactacaaggtgttcctgtcctgggcccagctgctgcctgctggcagcacccagaacccagatgagaagacagtgcagtgctaccgccgcctgctgaaggccctgaagacagcccggctgcagcccatggtgatcctgcaccaccagaccctgcctgccagcaccctgcggaggacagaggcctttgctgacctgtttgctgactatgccacctttgccttccacagctttggagacctggtgggcatctggttcaccttcagtgacctggaggaggtgatcaaggagctgccccaccaggagagccgggccagccagctgcagaccctgagtgatgcccacaggaaggcctatgagatctaccacgagagctatgccttccagggcggcaagctgtctgtggtgctgcgggcagaggacatccctgagctgctgctggagccccccatcagcgccctggcccaggacacagtggacttcctgagcctggacctgtcctatgagtgccagaatgaggccagcctgcggcagaagctgagcaagctgcagaccatcgagcccaaggtgaaggtgttcatcttcaacctgaagctgcctgactgccccagcaccatgaagaacccagccagcctgctcttcagcctgtttgaggccatcaacaaggaccaggtgctgaccatcggctttgacatcaatgagttcctgagctgcagcagcagcagcaagaagtccatgagctgcagcctgaccggcagcctggccctgcagcctgaccagcagcaggaccacgagaccacagacagcagccctgccagcgcctaccagaggatctgggaggcctttgccaaccagagcagagctgagagagatgccttcctgcaggacaccttccctgagggcttcctgtggggcgccagcactggagccttcaacgtggagggcggctgggccgagggcggccggggcgtgtccatctgggacccccggcggcccctgaacaccacagagggccaggccaccctggaggtggccagtgacagctaccacaaggtggccagtgatgtggccctgctgtgtggcctgcgggcccaggtgtacaagttcagcatctcctggagccgcatcttccccatgggccacggcagcagccccagcctgcccggggtggcctactacaacaagctgattgaccggctgcaggatgctggcatcgagcccatggccaccctcttccactgggacctgccccaggccctgcaggaccatggaggctggcagaatgaatctgtggtggatgccttcctggactatgctgccttctgcttcagcaccttcggggacagagtgaagctgtgggtgaccttccacgagccctgggtgatgtcctatgccggctatggaacaggccagcaccccccaggcatcagtgaccccggggtggccagcttcaaggtggcccacctggtgctgaaggcccacgcccggacctggcaccactacaacagccaccaccggccccagcagcagggccacgtgggcatcgtgctgaacagcgactgggccgagcccctgagccctgagaggcctgaggacctgcgggccagcgagcgcttcctgcacttcatgctgggctggtttgcccaccctgtgtttgtggatggagactacccagccaccctgcggacccagatccagcagatgaaccggcagtgcagccaccctgtggcccagctgcctgagttcacagaagctgagaagcagctgctgaagggcagcgctgacttcctgggcctgagccactacaccagccgcctcatcagcaatgccccccagaacacctgcatccccagctatgacaccatcggcggcttcagccagcacgtgaaccacgtgtggccccagaccagcagctcctggatccgggtggtgccctggggcatccggcggctgctgcagtttgtgtccctggagtacacccggggcaaggtgcccatctacctggccggaaatggcatgcccatcggggagagcgagaacctgtttgatgacagcctgcgggtggactacttcaaccagtacatcaatgaggtgctgaaggccatcaaggaggacagcgtggatgtgcgcagctacatcgcccggagcctgattgatggctttgagggccccagcggctacagccagagatttggcctgcaccacgtgaacttcagtgacagcagcaagagcaggacccccaggaagagcgcctacttcttcaccagcatcatcgagaagaatggcttcctgaccaagggggccaagaggctgctgccccccaacacagtgaacctgcccagcaaggtgcgggccttcaccttccccagcgaggtgcccagcaaggccaaggtggtgtgggagaagttcagcagccagcccaagtttgagcgggacctcttctaccacggcaccttcagagatgacttcctgtggggcgtgagcagcagcgcctaccagatcgagggcgcctgggatgctgatggcaagggccccagcatctgggacaacttcacccacaccccaggcagcaatgtgaaggacaatgccaccggggacatcgcctgtgacagctaccaccagctggatgctgacctgaacatgctgcgggccctgaaggtgaaggcctaccgcttcagcatctcctggagccgcatcttccccaccggcaggaacagcagcatcaacagccatggagtggactactacaacagactcatcaatggcctggtggccagcaacatcttccccatggtgaccctcttccactgggacctgccccaggccctgcaggacatcggcggctgggagaacccagccctgattgacctgtttgacagctatgctgacttctgcttccagacctttggagacagagtgaagttctggatgaccttcaatgagcccatgtacctggcctggctgggctacggcagcggggagttccccccaggagtgaaggaccccggctgggccccctacagaattgcccacgccgtcatcaaggcccacgcccgggtgtaccacacctatgatgagaagtaccggcaggagcagaagggcgtcatcagcctgagcctgagcacccactgggccgagcccaagagccctggggtgcccagagatgtggaggccgctgacaggatgctgcagttcagcctgggctggtttgcccaccccatcttcagaaatggagactacccagacaccatgaagtggaaggtgggcaacagaagtgagctgcagcacctggccaccagccggctgcccagcttcacagaggaggagaagcgcttcatccgggccacagcagatgtgttctgcctgaacacctactacagcagaattgtgcagcacaagaccccccggctgaaccccccatcctatgaagatgaccaggagatggccgaggaggaggaccccagctggcccagcacagccatgaacagagctgccccctggggcacccggcggctgctgaactggatcaaggaggagtatggagacatccccatctacatcacagaaaatggagtgggcctgaccaaccccaacacagaggacacagaccgcatcttctaccacaagacctacatcaatgaggccctgaaggcctaccgcctggatggcatcgacctgcggggctacgtggcctggagcctgatggacaactttgagtggctgaatggctacacagtgaagtttggcctgtaccacgtggacttcaacaacaccaaccggcccaggacagcccgggccagcgcccgctactacacagaggtgatcaccaacaacggcatgcccctggccagagaagatgagttcctgtatggccgcttccctgagggcttcatctggagcgctgccagcgctgcctaccagatcgagggcgcctggagggcagatggcaagggcctgagcatctgggacaccttcagccacacccccctgcgggtggagaatgatgccatcggagatgtggcctgtgacagctaccacaagattgctgaggacctggtgaccctgcagaacctgggcgtgagccactaccgcttcagcatctcctggagccgcatcctgcctgatggcaccacccgctacatcaatgaggccggcctgaactactacgtgcggctgattgacaccctgctggccgccagcatccagccccaggtgaccatctaccactgggacctgccccagaccctgcaggatgtgggcggctgggagaatgagaccatcgtgcagcgcttcaaggagtatgcagatgtgctcttccagaggctgggggacaaggtgaagttctggatcaccctgaatgagcccttcgtcatcgcctaccagggctacggctatggaacagctgcccctggggtgagcaaccggcccggcacagccccctacatcgtgggccacaacctgatcaaggcccacgccgaggcctggcacctgtacaatgatgtgtaccgggccagccagggcggcgtcatcagcatcaccatcagcagtgactgggccgagccccgggaccccagcaaccaggaggatgtggaggccgcccggcgctacgtgcagttcatgggcggctggtttgcccaccccatcttcaagaatggagactacaatgaggtgatgaagacccgcatccgggacaggagcctggccgccggcctgaacaagagccggctgcctgagttcacagagagcgagaagaggcgcatcaatggcacctatgacttcttcggcttcaaccactacaccaccgtgctggcctacaacctgaactatgccacagccatcagcagctttgatgctgacagaggagtggccagcattgctgaccgctcctggccagattctggcagcttctggctgaagatgaccccatttggcttccgccgcatcctgaactggctgaaggaggagtacaatgacccccccatctacgtgacagaaaatggagtgtcccagcgggaggagacagacctgaatgacacagcccgcatctactacctgcggacctacatcaatgaggccctgaaggctgtgcaggacaaggtggacctgcggggctacacagtgtggagcgccatggacaactttgagtgggccaccggcttcagcgagcgcttcggcctgcactttgtgaactacagcgaccccagcctgccccgcatccccaaggccagcgccaagttctacgcctctgtggtgcgctgcaatggcttcccagaccctgccaccggcccccacgcctgcctgcaccagccagatgctggccccaccatcagccctgtgcggcaggaggaggtgcagttcctgggcctgatgctgggcaccacagaggcccagacagccctgtatgtgctcttcagcctggtgctgctgggcgtgtgtggcctggccttcctgagctacaagtactgcaagaggagcaagcagggcaagacccagaggagccagcaggagctgagccctgtgagcagcttctag

SEQ ID NO: 157235 - DNA, 3012 bp, Artificial Sequence
  Description of Artificial Sequence: Synthetic coding sequence
aaggtggcccacctggtgctgaaggcccacgcccggacctggcaccactacaacagccaccaccggccccagcagcagggccacgtgggcatcgtgctgaacagcgactgggccgagcccctgagccctgagaggcctgaggacctgcgggccagcgagcgcttcctgcacttcatgctgggctggtttgcccaccctgtgtttgtggatggagactacccagccaccctgcggacccagatccagcagatgaaccggcagtgcagccaccctgtggcccagctgcctgagttcacagaagctgagaagcagctgctgaagggcagcgctgacttcctgggcctgagccactacaccagccgcctcatcagcaatgccccccagaacacctgcatccccagctatgacaccatcggcggcttcagccagcacgtgaaccacgtgtggccccagaccagcagctcctggatccgggtggtgccctggggcatccggcggctgctgcagtttgtgtccctggagtacacccggggcaaggtgcccatctacctggccggaaatggcatgcccatcggggagagcgagaacctgtttgatgacagcctgcgggtggactacttcaaccagtacatcaatgaggtgctgaaggccatcaaggaggacagcgtggatgtgcgcagctacatcgcccggagcctgattgatggctttgagggccccagcggctacagccagagatttggcctgcaccacgtgaacttcagtgacagcagcaagagcaggacccccaggaagagcgcctacttcttcaccagcatcatcgagaagaatggcttcctgaccaagggggccaagaggctgctgccccccaacacagtgaacctgcccagcaaggtgcgggccttcaccttccccagcgaggtgcccagcaaggccaaggtggtgtgggagaagttcagcagccagcccaagtttgagcgggacctcttctaccacggcaccttcagagatgacttcctgtggggcgtgagcagcagcgcctaccagatcgagggcgcctgggatgctgatggcaagggccccagcatctgggacaacttcacccacaccccaggcagcaatgtgaaggacaatgccaccggggacatcgcctgtgacagctaccaccagctggatgctgacctgaacatgctgcgggccctgaaggtgaaggcctaccgcttcagcatctcctggagccgcatcttccccaccggcaggaacagcagcatcaacagccatggagtggactactacaacagactcatcaatggcctggtggccagcaacatcttccccatggtgaccctcttccactgggacctgccccaggccctgcaggacatcggcggctgggagaacccagccctgattgacctgtttgacagctatgctgacttctgcttccagacctttggagacagagtgaagttctggatgaccttcaatgagcccatgtacctggcctggctgggctacggcagcggggagttccccccaggagtgaaggaccccggctgggccccctacagaattgcccacgccgtcatcaaggcccacgcccgggtgtaccacacctatgatgagaagtaccggcaggagcagaagggcgtcatcagcctgagcctgagcacccactgggccgagcccaagagccctggggtgcccagagatgtggaggccgctgacaggatgctgcagttcagcctgggctggtttgcccaccccatcttcagaaatggagactacccagacaccatgaagtggaaggtgggcaacagaagtgagctgcagcacctggccaccagccggctgcccagcttcacagaggaggagaagcgcttcatccgggccacagcagatgtgttctgcctgaacacctactacagcagaattgtgcagcacaagaccccccggctgaaccccccatcctatgaagatgaccaggagatggccgaggaggaggaccccagctggcccagcacagccatgaacagagctgccccctggggcacccggcggctgctgaactggatcaaggaggagtatggagacatccccatctacatcacagaaaatggagtgggcctgaccaaccccaacacagaggacacagaccgcatcttctaccacaagacctacatcaatgaggccctgaaggcctaccgcctggatggcatcgacctgcggggctacgtggcctggagcctgatggacaactttgagtggctgaatggctacacagtgaagtttggcctgtaccacgtggacttcaacaacaccaaccggcccaggacagcccgggccagcgcccgctactacacagaggtgatcaccaacaacggcatgcccctggccagagaagatgagttcctgtatggccgcttccctgagggcttcatctggagcgctgccagcgctgcctaccagatcgagggcgcctggagggcagatggcaagggcctgagcatctgggacaccttcagccacacccccctgcgggtggagaatgatgccatcggagatgtggcctgtgacagctaccacaagattgctgaggacctggtgaccctgcagaacctgggcgtgagccactaccgcttcagcatctcctggagccgcatcctgcctgatggcaccacccgctacatcaatgaggccggcctgaactactacgtgcggctgattgacaccctgctggccgccagcatccagccccaggtgaccatctaccactgggacctgccccagaccctgcaggatgtgggcggctgggagaatgagaccatcgtgcagcgcttcaaggagtatgcagatgtgctcttccagaggctgggggacaaggtgaagttctggatcaccctgaatgagcccttcgtcatcgcctaccagggctacggctatggaacagctgcccctgtgcacggccgcctggtgtgcaccagctacttccaggagtggaggctgcagtag

SEQ ID NO: 157236 - DNA, 1005 bp, Artificial Sequence
  Description of Artificial Sequence: Synthetic coding sequence
atggccaccctgaaggagaagctgattgcccctgtggccgaggaggaggccaccgtgcccaacaacaagatcaccgtggtgggcgtgggccaggtgggcatggcctgtgccatcagcatcctgggcaagagcctggctgatgagctggccctggtggatgtgctggaggacaagctgaagggggagatgatggacctgcagcacggcagcctcttcctgcagacccccaagatcgtggccgacaaggactacagcgtgacagccaacagcaagatcgtggtggtgacagctggggtgcggcagcaggagggggagagccggctgaacctggtgcagagaaatgtgaatgtgttcaagttcatcatcccccagatcgtgaagtacagcccagactgcatcatcatcgtggtgagcaaccctgtggacatcctgacctacgtgacctggaagctgagcggcctgcccaagcacagggtcatcggcagcggctgcaacctggacagcgcccgcttccgctacctgatggccgagaagctgggcatccaccccagcagctgccacggctggatcctgggggagcacggggacagctctgtggccgtgtggagcggcgtgaatgtggccggcgtgtccctgcaggagctgaaccctgagatgggcacagacaatgattctgagaactggaaggaggtgcacaagatggtggtggagagcgcctatgaggtgatcaagctgaagggctacaccaactgggccatcggcctgtctgtggccgacctgattgaatccatgctgaagaacctgagccgcatccaccctgtgtccaccatggtgaagggcatgtatggaattgaaaatgaggtgttcctgagcctgccctgcatcctgaatgcccggggcctgaccagcgtcatcaaccagaagctgaaggatgatgaggtggcccagctgaagaagtctgctgacaccctgtgggacatccagaaggacctgaaggacctgtag

SEQ ID NO: 157237 - DNA, 699 bp, Artificial Sequence
  Description of Artificial Sequence: Synthetic coding sequence
atggccaccctgaaggagaagctgattgcccctgtggccgaggaggaggccaccgtgcccaacaacaagatcaccgtggtgggcgtgggccaggtgggcatggcctgtgccatcagcatcctgggcaagagcctggctgatgagctggccctggtggatgtgctggaggacaagctgaagggggagatgatggacctgcagcacggcagcctcttcctgcagacccccaagatcgtggccgacaaggactacagcgtgacagccaacagcaagatcgtggtggtgacagctggggtgcggcagcaggagggggagagccggctgaacctggtgcagagaaatgtgaatgtgttcaagttcatcatcccccagatcgtgaagtacagcccagactgcatcatcatcgtggtgagcaaccctgtggacatcctgacctacgtgacctggaagctgagcggcctgcccaagcacagggtcatcggcagcggctgcaacctggacagcgcccgcttccgctacctgatggccgagaagctgggcatccaccccagcagctgccacggctggatcctgggggagcacggggacagctctgtggccgtgtggagcggcgtgaatgtggccggcgtgtccctgcaggagctgaaccctgagatgggcacagacaatgattctgagaactggaaggaggtgcactag

SEQ ID NO: 157238 - DNA, 1005 bp, Artificial Sequence; identical to SEQ ID NO: 157236
  Description of Artificial Sequence: Synthetic coding sequence

SEQ ID NO: 157239 - DNA, 414 bp, Artificial Sequence
  Description of Artificial Sequence: Synthetic coding sequence
atggccaccctgaaggagaagctgattgcccctgtggccgaggaggaggccaccgtgcccaacaacaagatcaccgtggtgggcgtgggccaggtgggcatggcctgtgccatcagcatcctgggcaagagcctggctgatgagctggccctggtggatgtgctggaggacaagctgaagggggagatgatggacctgcagcacggcagcctcttcctgcagacccccaagatcgtggccgacaaggactacagcgtgacagccaacagcaagatcgtggtggtgacagctggggtgcggcagcaggagggggagagccggctgaacctggtgcagagaaatgtgaatgtgttcaagttcatcatcccccagatcgtgaagtacagcccagactgcatcatcatcgtggtgtag

SEQ ID NO: 157240 - DNA, 309 bp, Artificial Sequence
  Description of Artificial Sequence: Synthetic coding sequence
atggccaccctgaaggagaagctgattgcccctgtggccgaggaggaggccaccgtgcccaacaacaagatcaccgtggtgggcgtgggccaggtgggcatggcctgtgccatcagcatcctgggcaagagcctggctgatgagctggccctggtggatgtgctggaggacaagctgaagggggagatgatggacctgcagcacggcagcctcttcctgcagacccccaagatcgtggccgacaaggactacagcgtgacagccaacagcaagatcgtggtggtgacagctggggtgcggcagcagtag

SEQ ID NO: 157241 - DNA, 999 bp, Artificial Sequence
  Description of Artificial Sequence: Synthetic coding sequence
atgagcacagtgaaggagcagctgattgagaagctgattgaagatgatgagaacagccagtgcaagatcaccatcgtgggcaccggggctgtgggcatggcctgtgccatcagcatcctgctgaaggacctggctgatgagctggccctggtggatgtggccctggacaagctgaagggggagatgatggacctgcagcacggcagcctcttcttcagcaccagcaagatcaccagcggcaaggactacagcgtgtctgccaacagcagaattgtgattgtgacagctggggcccggcagcaggagggggagacccggctggccctggtgcagagaaatgtggccatcatgaagagcatcatcccagccatcgtgcactacagcccagactgcaagatcctggtggtgagcaaccctgtggacatcctgacctacatcgtgtggaagatcagcggcctgcctgtgaccagggtgattggcagcggctgcaacctggacagcgcccgcttccgctacctgattggagagaagctgggcgtgcaccccaccagctgccacggctggatcatcggggagcacggggacagctctgtgcccctgtggagcggcgtgaatgtggccggcgtggccctgaagaccctggaccccaagctgggcacagacagcgacaaggagcactggaagaacatccacaagcaggtgatccagagcgcctatgagatcatcaagctgaagggctacacctcctgggccatcggcctgtctgtgatggacctggtgggcagcatcctgaagaacctgcggcgggtgcaccctgtgtccaccatggtgaagggcctgtatggcatcaaggaggagctgttcctgagcatcccctgtgtgctgggcagaaatggagtgtctgatgtggtgaagatcaacctgaacagcgaggaggaggccctcttcaagaagtctgctgagaccctgtggaacatccagaaggacctgatcttctag

SEQ ID NO: 157242 - DNA, 999 bp, Artificial Sequence; identical to SEQ ID NO: 157241
  Description of Artificial Sequence: Synthetic coding sequence

SEQ ID NO: 157243 - DNA, 1524 bp, Artificial Sequence
  Description of Artificial Sequence: Synthetic coding sequence
atggcccggctgctgcggagcgccacctgggagctgttcccctggaggggctactgcagccagaaggccaagggggagctgtgccgggactttgtggaggccctgaaggctgtggtgggcggcagccacgtgtccacagctgctgtggtgcgggagcagcacggcagagatgaatctgtgcaccgctgtgagcccccagatgctgtggtgtggccccagaatgtggagcaggtgtcccggctggccgccctgtgctaccggcagggcgtgcccatcatcccctttggaactggaacaggcctggagggcggcgtgtgtgctgtgcagggcggcgtgtgtgtgaacctgacccacatggaccgcatcctggagctgaaccaggaggacttctctgtggtggtggagcccggggtgaccaggaaggccctgaatgcccacctgcgggacagcggcctgtggttccctgtggaccccggggctgatgccagcctgtgtggcatggccgccaccggggccagcggcaccaatgctgtgcgctatggcaccatgagggacaacgtgctgaacctggaggtggtgctgcctgatggccgcctgctgcacacagctggccggggccgccacttccgcttcggcttctggccagagatcccccaccacacagcctggtacagcccctgtgtgtccctgggccgcaggaagtctgctgctggctacaacctgaccggcctgtttgtgggcagcgagggcaccctgggcctcatcacagccaccaccctgcggctgcacccagcccctgaggccaccgtggccgccacctgtgccttccccagcgtgcaggccgctgtggacagcacagtgcacatcctgcaggccgctgtgcctgtggccagaattgagttcctggatgaggtgatgatggatgcctgcaaccgctacagcaagctgaactgcctggtggcccccaccctcttcctggagttccacggcagccagcaggccctggaggagcagctgcagaggacagaggagatcgtgcagcagaatggagccagtgacttctcctgggccaaggaggccgaggagaggagccggctgtggacagcccggcacaatgcctggtacgccgccctggccacccggcccggctgcaagggctacagcacagatgtgtgtgtgcccatcagccggctgcctgagatcgtggtgcagaccaaggaggacctgaatgccagcggcctgaccggcagcatcgtgggccacgtgggagatggcaacttccactgcatcctgctggtgaacccagatgatgctgaggagctgggccgggtgaaggcctttgctgagcagctgggcagaagagccctggccctgcacggcacctgcacaggagagcacggcatcggcatgggcaagaggcagctgctgcaggaggaggtgggcgctgtgggcgtggagaccatgaggcagctgaaggctgtgctggacccccagggcctgatgaaccctgggaaggtgctgtag

SEQ ID NO: 157244 - DNA, 1455 bp, Artificial Sequence
  Description of Artificial Sequence: Synthetic coding sequence
atggcccggctgctgcggagcgccacctgggagctgttcccctggaggggctactgcagccagaaggccaagggggagctgtgccgggactttgtggaggccctgaaggctgtggtgggcggcagccacgtgtccacagctgctgtggtgcgggagcagcacggcagagatgaatctgtgcaccgctgtgagcccccagatgctgtggtgtggccccagaatgtggagcaggtgtcccggctggccgccctgtgctaccggcagggcgtgcccatcatcccctttggaactggaacaggcctggagggcggcgtgtgtgctgtgcagggcggcgtgtgtgtgaacctgacccacatggaccgcatcctggagctgaaccaggaggacttctctgtggtggtggagcccggggtgaccaggaaggccctgaatgcccacctgcgggacagcggcctgtggttccctgtggaccccggggctgatgccagcctgtgtggcatggccgccaccggggccagcggcaccaatgctgtgcgctatggcaccatgagggacaacgtgctgaacctggaggtggtgctgcctgatggccgcctgctgcacacagctggccggggccgccacttcaggaagtctgctgctggctacaacctgaccggcctgtttgtgggcagcgagggcaccctgggcctcatcacagccaccaccctgcggctgcacccagcccctgaggccaccgtggccgccacctgtgccttccccagcgtgcaggccgctgtggacagcacagtgcacatcctgcaggccgctgtgcctgtggcccgcatcgagttcctggatgaggtgatgatggatgcctgcaaccgctacagcaagctgaactgcctggtggcccccaccctcttcctggagttccacggcagccagcaggccctggaggagcagctgcagaggacagaggagatcgtgcagcagaatggagccagtgacttctcctgggccaaggaggccgaggagaggagccggctgtggacagcccggcacaatgcctggtatgctgccctggccaccaggcctggctgcaagggctacagcacagatgtgtgtgtgcccatcagccggctgcctgagatcgtggtgcagaccaaggaggacctgaatgccagcggcctgaccggcagcatcgtgggccacgtgggagatggcaacttccactgcatcctgctggtgaacccagatgatgctgaggagctgggccgggtgaaggcctttgctgagcagctgggccggcgggccctggccctgcacggcacctgcaccggggagcacggcatcggcatgggcaagaggcagctgctgcaggaggaggtgggcgctgtgggcgtggagaccatgaggcagctgaaggctgtgctggacccccagggcctgatgaaccctgggaaggtgctgtag

SEQ ID NO: 157245 - DNA, 2139 bp, Artificial Sequence
  Description of Artificial Sequence: Synthetic coding sequence
atgagggtgctgctgcacctgcctgccctgctggccagcctcatcctgctgcaggccgccgccagcaccacccgggcccagaccaccaggaccagcgccatcagtgacacagtgtcccaggccaaggtgcaggtgaacaaggccttcctggacagcaggacccggctgaagacagccatgagcagcgagacccccaccagccggcagctgtctgagtacctgaagcacgccaagggccgcaccaggacagccatcagaaatggccaggtgtgggaggagagcctgaagaggctgcggcagaaggccagcctgaccaacgtgacagaccccagcctggacctgaccagcctgagcctggaggtgggctgtggggccccagcccctgtggtgcgctgtgacccctgcagcccctaccgcaccatcaccggggactgcaacaacagaaggaagccagccctgggcgccgccaacagagccctggcccgctggctgcctgcagaatatgaagatggcctgagcctgcccttcggctggacccctgggaagaccagaaatggcttccccctgcccctggcccgggaggtgagcaacaagatcgtgggctacctgaatgaggagggcgtgctggaccagaacagaagcctgctcttcatgcagtggggccagatcgtggaccatgacctggactttgccccagacacagagctgggcagcagcgagtacagcaaggcccagtgtgatgagtactgcatccagggcgacaactgcttccccatcatgttccccccaaatgaccccaaggccggcacccagggcaagtgcatgcccttcttccgggccggctttgtgtgccccaccccaccctacaagagcctggcccgggagcagatcaatgccctgaccagcttcctggatgccagctttgtgtacagcagcgagcccagcctggccagccggctgaggaacctgagcagccccctgggcctgatggctgtgaaccaggaggtgtctgaccacggcctgccctacctgccctatgacagcaagaagcccagcccctgtgagttcatcaacaccacagcccgggtgccctgcttcctggccggggacagccgggccagcgagcacatcctgctggccaccagccacaccctcttcctgcgggagcacaaccggctggcccgggagctgaagaggctgaacccccagtgggatggagagaagctgtaccaggaggccaggaagatcctgggcgcctttgtgcagatcatcaccttccgggactacctgcccatcctgctgggggaccacatgcagaagtggatccccccctaccagggctacagcgagagcgtggacccccgcatcagcaatgtgttcacctttgccttccgcttcggccacctggaggtgcccagctccatgttccggctggatgagaactaccagccctggggccctgagcctgagctgcccctgcacaccctcttcttcaacacctggaggatggtgaaggatggcggcatcgaccccctggtgcggggcctgctggccaagaagagcaagctgatgaagcagaacaagatgatgactggagagctgaggaacaagctgttccagcccacccaccgcatccacggctttgacctggccgccatcaacacccagcgctgccgggaccacggccagcccggctacaacagctggagggccttctgtgacctgagccagccccagaccctggaggagctgaacacagtgctgaagagcaagatgctggccaagaagctgctgggcctgtatggcaccccagacaacatcgacatctggattggagccatcgccgagcccctggtggagcggggccgggtgggccccctgctggcctgcctgctgggcaagcagttccagcagatcagagatggagaccgcttctggtgggagaaccctggggtcttcaccaatgagcagaaggacagcctgcagaagatgtccttcagccggctggtgtgtgacaacacccgcatcaccaaggtgccccgggaccccttctgggccaacagctacccctatgactttgtggactgcagcgccatcgacaagctggacctgagcccctgggcctctgtgaagaactag

SEQ ID NO: 157246 - DNA, 1374 bp, Artificial Sequence
  Description of Artificial Sequence: Synthetic coding sequence
tgcttccctgtgcagtttcctccaaatgaccccaaggccggcacccagggcaagtgcatgcccttcttccgggccggctttgtgtgccccaccccaccctacaagagcctggcccgggagcagatcaatgccctgaccagcttcctggatgccagctttgtgtacagcagcgagcccagcctggccagccggctgaggaacctgagcagccccctgggcctgatggctgtgaaccaggaggtgtctgaccacggcctgccctacctgccctatgacagcaagaagcccagcccctgtgagttcatcaacaccacagcccgggtgccctgcttcctggccggggacagccgggccagcgagcacatcctgctggccaccagccacaccctcttcctgcgggagcacaaccggctggcccgggagctgaagaggctgaacccccagtgggatggagagaagctgtaccaggaggccaggaagatcctgggcgcctttgtgcagatcatcaccttccgggactacctgcccatcctgctgggggaccacatgcagaagtggatccccccctaccagggctacagcgagagcgtggacccccgcatcagcaatgtgttcacctttgccttccgcttcggccacctggaggtgcccagctccatgttccggctggatgagaactaccagccctggggccctgagcctgagctgcccctgcacaccctcttcttcaacacctggaggatggtgaaggatggcggcatcgaccccctggtgcggggcctgctggccaagaagagcaagctgatgaagcagaacaagatgatgaccggggagctgaggaacaagctgttccagcccacccaccgcatccacggctttgacctggccgccatcaacacccagcgctgccgggaccacggccagcccggctacaacagctggagggccttctgtgacctgagccagccccagaccctggaggagctgaacacagtgctgaagagcaagatgctggccaagaagctgctgggcctgtatggcaccccagacaacatcgacatctggattggagccatcgccgagcccctggtggagcggggccgggtgggccccctgctggcctgcctgctgggcaagcagttccagcagatcagagatggagaccgcttctggtgggagaaccctggggtcttcaccaatgagcagaaggacagcctgcagaagatgtccttcagccggctggtgtgtgacaacacccgcatcaccaaggtgccccgggaccccttctgggccaacagctacccctatgactttgtggactgcagcgccatcgacaagctggacctgagcccctgggcctctgtgaagaactag

SEQ ID NO: 157247 - DNA, 1890 bp, Artificial Sequence
  Description of Artificial Sequence: Synthetic coding sequence
atgagggtgctgctgcacctgcctgccctgctggccagcctcatcctgctgcaggccgccgccagcaccacccgggaccccagcctggacctgaccagcctgagcctggaggtgggctgtggggccccagcccctgtggtgcgctgtgacccctgcagcccctaccgcaccatcactggagactgcaacaacagaaggaagccagccctgggcgccgccaacagagccctggcccgctggctgcctgcagaatatgaagatggcctgagcctgcccttcggctggaccccaggcaagaccagaaatggcttccccctgcccctggcccgggaggtgagcaacaagatcgtgggctacctgaatgaggagggcgtgctggaccagaacagaagcctgctcttcatgcagtggggccagatcgtggaccatgacctggactttgccccagacacagagctgggcagcagcgagtacagcaaggcccagtgtgatgagtactgcatccagggcgacaactgcttccccatcatgtttcctccaaatgaccccaaggccggcacccagggcaagtgcatgcccttcttccgggccggctttgtgtgccccaccccaccctacaagagcctggcccgggagcagatcaatgccctgaccagcttcctggatgccagctttgtgtacagcagcgagcccagcctggccagccggctgaggaacctgagcagccccctgggcctgatggctgtgaaccaggaggtgtctgaccacggcctgccctacctgccctatgacagcaagaagcccagcccctgtgagttcatcaacaccacagcccgggtgccctgcttcctggccggggacagccgggccagcgagcacatcctgctggccaccagccacaccctcttcctgcgggagcacaaccggctggcccgggagctgaagaggctgaacccccagtgggatggagagaagctgtaccaggaggccaggaagatcctgggcgcctttgtgcagatcatcaccttccgggactacctgcccatcctgctgggggaccacatgcagaagtggatccccccctaccagggctacagcgagagcgtggacccccgcatcagcaatgtgttcacctttgccttccgcttcggccacctggaggtgcccagctccatgttccggctggatgagaactaccagccctggggccctgagcctgagctgcccctgcacaccctcttcttcaacacctggaggatggtgaaggatggcggcatcgaccccctggtgcggggcctgctggccaagaagagcaagctgatgaagcagaacaagatgatgaccggggagctgaggaacaagctgttccagcccacccaccgcatccacggctttgacctggccgccatcaacacccagcgctgccgggaccacggccagcccggctacaacagctggagggccttctgtgacctgagccagccccagaccctggaggagctgaacacagtgctgaagagcaagatgctggccaagaagctgctgggcctgtatggcaccccagacaacatcgacatctggattggagccatcgccgagcccctggtggagcggggccgggtgggccccctgctggcctgcctgctgggcaagcagttccagcagatcagagatggagaccgcttctggtgggagaaccctggggtcttcaccaatgagcagaaggacagcctgcagaagatgtccttcagccggctggtgtgtgacaacacccgcatcaccaaggtgccccgggaccccttctgggccaacagctacccctatgactttgtggactgcagcgccatcgacaagctggacctgagcccctgggcctctgtgaagaactag

SEQ ID NO: 157248 - DNA, 1962 bp, Artificial Sequence
  Description of Artificial Sequence: Synthetic coding sequence
atgagcagcgagacccccaccagccggcagctgtctgagtacctgaagcacgccaagggccgcaccaggacagccatcagaaatggccaggtgtgggaggagagcctgaagaggctgcggcagaaggccagcctgaccaacgtgacagaccccagcctggacctgaccagcctgagcctggaggtgggctgtggggccccagcccctgtggtgcgctgtgacccctgcagcccctaccgcaccatcactggagactgcaacaacagaaggaagccagccctgggcgccgccaacagagccctggcccgctggctgcctgcagaatatgaagatggcctgagcctgcccttcggctggaccccaggcaagaccagaaatggcttccccctgcccctggcccgggaggtgagcaacaagatcgtgggctacctgaatgaggagggcgtgctggaccagaacagaagcctgctcttcatgcagtggggccagatcgtggaccatgacctggactttgccccagacacagagctgggcagcagcgagtacagcaaggcccagtgtgatgagtactgcatccagggcgacaactgcttccccatcatgtttcctccaaatgaccccaaggccggcacccagggcaagtgcatgcccttcttccgggccggctttgtgtgccccaccccaccctacaagagcctggcccgggagcagatcaatgccctgaccagcttcctggatgccagctttgtgtacagcagcgagcccagcctggccagccggctgaggaacctgagcagccccctgggcctgatggctgtgaaccaggaggtgtctgaccacggcctgccctacctgccctatgacagcaagaagcccagcccctgtgagttcatcaacaccacagcccgggtgccctgcttcctggccggggacagccgggccagcgagcacatcctgctggccaccagccacaccctcttcctgcgggagcacaaccggctggcccgggagctgaagaggctgaacccccagtgggatggagagaagctgtaccaggaggccaggaagatcctgggcgcctttgtgcagatcatcaccttccgggactacctgcccatcctgctgggggaccacatgcagaagtggatccccccctaccagggctacagcgagagcgtggacccccgcatcagcaatgtgttcacctttgccttccgcttcggccacctggaggtgcccagctccatgttccggctggatgagaactaccagccctggggccctgagcctgagctgcccctgcacaccctcttcttcaacacctggaggatggtgaaggatggcggcatcgaccccctggtgcggggcctgctggccaagaagagcaagctgatgaagcagaacaagatgatgaccggggagctgaggaacaagctgttccagcccacccaccgcatccacggctttgacctggccgccatcaacacccagcgctgccgggaccacggccagcccggctacaacagctggagggccttctgtgacctgagccagccccagaccctggaggagctgaacacagtgctgaagagcaagatgctggccaagaagctgctgggcctgtatggcaccccagacaacatcgacatctggattggagccatcgccgagcccctggtggagcggggccgggtgggccccctgctggcctgcctgctgggcaagcagttccagcagatcagagatggagaccgcttctggtgggagaaccctggggtcttcaccaatgagcagaaggacagcctgcagaagatgtccttcagccggctggtgtgtgacaacacccgcatcaccaaggtgccccgggaccccttctgggccaacagctacccctatgactttgtggactgcagcgccatcgacaagctggacctgagcccctgggcctctgtgaagaactag

SEQ ID NO: 157249 - DNA, 1323 bp, Artificial Sequence
  Description of Artificial Sequence: Synthetic coding sequence
atgggagacctggagctgctgctgcctggagaggccgaggtgctggtgcggggcctgcgctccttccccctgcgggagatgggcagcgagggctggaaccagcagcacgagaacctggagaagctgaacatgcaggccatcctggatgccaccgtgtcccagggcgagcccatccaggagctgctggtgacccacggcaaggtgcccaccctggtggaggagctgattgctgtggagatgtggaagcagaaggtgtttcctgtgttctgccgggtggaggacttcaagccccagaacaccttccccatctacatggtggtgcaccacgaggccagcatcatcaacctgctggagaccgtcttcttccacaaggaggtgtgtgagagcgcagaagatactgtgctggacctggtggactactgccacaggaagctgaccctgctggtggcccagagcggctgcggcggccccccagagggggagggcagccaggacagcaaccccatgcaggagctgcagaagcaggccgagctgatggagtttgaaattgccctgaaggccctgtctgtgctgcgctacatcacagactgtgtggacagcctgagcctgagcaccctgagcaggatgctgagcacccacaacctgccctgcctgctggtggagctgctggagcacagcccctggagccggcgggagggcggcaagctgcagcagtttgagggcagccgctggcacacagtggcccccagcgagcagcagaagctgagcaagctggatggccaggtgtggatcgccctgtacaacctgctgctgagccctgaggcccaggcccgctactgcctgaccagctttgccaagggccgcctgctgaagctgcgggccttcctgacagacaccctgctggaccagctgcccaacctggcccacctgcagagcttcctggcccacctgaccctgacagagacccagccccccaagaaggacctggtgctggagcagatccctgagatctgggagcggctggagcgggagaacagaggcaagtggcaggccatcgccaagcaccagctgcagcacgtgttcagccccagcgagcaggacctgcggctgcaggcccggcgctgggccgagacctaccgcctggatgtgctggaggccgtggcccctgagcggccccgctgtgcctactgcagcgctgaggccagcaagcgctgcagccgctgccagaatgagtggtactgctgccgggagtgccaggtgaagcactgggagaagcacggcaagacctgtgtgctggccgcccagggcgaccgggccaagtag

SEQ ID NO: 157250 - DNA, 2001 bp, Artificial Sequence
  Description of Artificial Sequence: Synthetic coding sequence
atgaggaaggtgcggggcccccctgtgtcctgcatcaagagggacagccccatccagtgcatccaggccatcgccgagaacagagcagatgctgtgaccctggatggcggcttcatctatgaggccggcctggccccctacaagctgcggcctgtggccgctgaggtgtatggaacagagcggcagcccaggacccactactatgctgtggccgtggtgaagaagggcggcagcttccagctgaatgagctgcagggcctgaagagctgccacacaggcctgcggaggacagctggctggaatgtgcccatcggcaccctgcggcccttcctgaactggacaggccccccagagcccatcgaggccgctgtggcccgcttcttcagcgccagctgtgtgcctggagctgacaagggccagttccccaacctgtgccgcctgtgtgccggcactggagaaaataaatgtgccttcagcagccaggagccctacttctcctacagcggggccttcaagtgcctgagagatggagctggagatgtggccttcatccgggagagcacagtgtttgaggacctgagtgatgaagctgagagagatgaatatgagctgctgtgcccagacaacaccaggaagcctgtggacaagttcaaggactgccacctggcccgggtgcccagccatgctgtggtggcccggtctgtgaatggcaaggaggatgccatctggaacctgctgcggcaggcccaggagaagtttgggaaggacaagagccccaagttccagctgtttggcagccccagcggccagaaggacctgctcttcaaggacagcgccatcggcttcagccgggtgcccccaagaattgattctggcctgtacctgggcagcggctacttcaccgccatccagaacctgaggaagtctgaggaggaggtggccgcccggcgggcccgggtggtgtggtgtgctgtgggggagcaggagctgaggaagtgcaaccagtggagcggcctgtctgagggctctgtgacctgcagcagcgccagcaccacagaggactgcatcgccctggtgctgaagggggaggctgatgccatgagcctggatggcggctacgtgtacacagctggaaaatgtggcctggtgcctgtgctggccgagaactacaagagccagcagagcagtgaccctgaccccaactgtgtggacaggcctgtggagggctacctggccgtggccgtggtgagaagaagtgacaccagcctgacctggaacagcgtgaagggcaagaagagctgccacacagctgtggacagaacagctggctggaacatccccatgggcctgctcttcaaccagacaggcagctgcaagtttgatgagtacttcagccagagctgtgcccctggcagtgaccccaggagcaacctgtgtgccctgtgcattggagatgagcagggagaaaataaatgtgtgcccaacagcaatgaaagatactacggctacaccggggccttccgctgcctggccgagaatgctggagatgtggcctttgtgaaggatgtgacagtgctgcagaacacagatggcaacaacaatgaggcctgggccaaggacctgaagctggccgactttgccctgctgtgcctggatggcaagaggaagcctgtgacagaggcccggagctgccacctggccatggcccccaaccacgctgtggtgtccaggatggacaaggtggagcggctgaagcaggtgctgctgcaccagcaggccaagtttggaagaaatggaagtgactgcccagacaagttctgcctcttccagagcgagaccaagaacctgctcttcaatgacaacacagaatgtctggcccggctgcacggcaagaccacctatgagaagtacctgggcccccagtatgtggccggcatcaccaacctgaagaagtgcagcaccagccccctgctggaggcctgtgagttcctgaggaagtag

SEQ ID NO: 157251 - DNA, 453 bp, Artificial Sequence
  Description of Artificial Sequence: Synthetic coding sequence
atgaagctggtgttcctggtgctgctcttcctgggcgccctgggcctgtgcctggccggcagaagaagatctgtgcagtggtgtgctgtgtcccagcctgaggccaccaagtgcttccagtggcagaggaacatgaggaaggtgcggggcccccctgtgtcctgcatcaagagggacagccccatccagtgcatccaggccatcgccgagaacagagcagatgctgtgaccctggatggcggcttcatctatgaggccggcctggccccctacaagctgcggcctgtggccgctgaggtgtatggaacagagcggcagcctgctgtgtttcctgtgcagatcaaggacagcagccccacctgtgtggcctgtgtgcggggccagggcaagaccaacgtgcccagcccccccaggaacagaaccagcgccaccctggtgcccagctctgtgtag

SEQ ID NO: 157252 - DNA, 846 bp, Artificial Sequence
  Description of Artificial Sequence: Synthetic coding sequence
atgaccagcaaagaagatggcaaggccgcccctggagaggagcggcggcgcagccccctggaccacctgcccccaccagccaacagcaacaagcccctgacccccttcagcattgaggacatcctgaacaagcccagcgtgcggcgcagctacagcctgtgtggggccgcccacctgctggccgctgctgacaagcacgcccagggcggcctgcccctggccggccgggccctgctgagccagaccagccccctgtgtgccctggaggagctggccagcaagaccttcaagggcctggaggtgtctgtgctgcaggccgctgagggcagagatggcatgaccatcttcggccagaggcagacccccaagaagaggaggaagagcaggacagccttcaccaaccaccagatctatgagctggagaagcgcttcctgtaccagaagtacctgagccctgctgaccgggaccagatcgcccagcagctgggcctgaccaatgcccaggtgatcacctggttccagaacagaagagccaagctgaagagggacctggaggagatgaaggcagatgtggagagcgccaagaagctgggccccagcggccagatggacatcgtggccctggccgagctggagcagaacagcgaggccacagctgggggcggcggcggctgcggccgggccaagagccggcccggcagccctgtgctgcccccaggggcccccaaggcccctggagctggggccctgcagctgagccctgccagccccctgacagaccagcctgccagcagccaggactgcagtgaagatgaagaagatgaggagattgatgtggatgactag

SEQ ID NO: 157253 - DNA, 597 bp, Artificial Sequence
  Description of Artificial Sequence: Synthetic coding sequence
atgaacagcggccgggagcccaggacccccaggaccctgctgagcattgctgacatcctggcccccaggatggtgccccgggcccccagcgccccccagctgcctgagagcggccctggccccaccagccccctgtgtgccctggaggagctgaccagcaagaccttccggggcctggatgcccgggccctgcagcccagcgagggccgggccggcccagatgccctgggccctggcccctttggaaggaagaggaggaagagcaggacagccttcaccgcccagcaggtgctggagctggagaggagatttgtgttccagaagtacctggcccccagcgagagagatggcctggccacccggctgggcctggccaatgcccaggtggtgacctggttccagaacagaagagccaagctgaagagagatgtggaggagatgagagcagatgtggccagcctgcgggccctgagccctgaggtgctgtgcagcctggccctgcctgagggcgccccagaccccggcctgtgcctgggccctgctggccctgacagccggccccacctgagtgatgaggagatccaggtggatgactag

SEQ ID NO: 157254 - DNA, 585 bp, Artificial Sequence
  Description of Artificial Sequence: Synthetic coding sequence
atgggcaagaggaccagcctggaggtgtccctgggggagctgggcggggagaagtgccggggcggcagaagaagcttcccccccctggccgccagcaggcctgcccggcctgggggctggcgctgggcccggcgggacctgtgcaagacagccagcagagctgagaacaacagccaggcctgccggccccagaggagagctggcccagatgccctgggccctggcccctttggaaggaagaggaggaagagcaggacagccttcaccgcccagcaggtgctggagctggagaggagatttgtgttccagaagtacctggcccccagcgagagagatggcctggccacccggctgggcctggccaatgcccaggtggtgacctggttccagaacagaagagccaagctgaagagagatgtggaggagatgagagcagatgtggccagcctgcgggccctgagccctgaggtgctgtgcagcctggccctgcctgagggcgccccagaccccggcctgtgcctgggccctgctggccctgacagccggccccacctgagtgatgaggagatccaggtggatgactag

SEQ ID NO: 157255 - DNA, 1398 bp, Artificial Sequence
  Description of Artificial Sequence: Synthetic coding sequence
atggagacccccagccagaggcgggccaccaggtctggggcccaggccagcagcacccccctgagccccacccgcatcacccggctgcaggagaaggaggacctgcaggagctgaatgaccggctggccgtgtacatcgacagagtgcgcagcctggagacagaaaatgccggcctgcggctgcgcatcacagagagcgaggaggtggtgtcccgggaggtgtctggcatcaaggccgcctatgaagctgagctgggagatgccaggaagaccctggacagcgtggccaaggagcgggcccggctgcagctggagctgagcaaggtgcgggaggagttcaaggagctgaaggccaggaacaccaagaaggagggggacctgattgctgcccaggcccggctgaaggacctggaggccctgctgaacagcaaggaggccgccctgagcacagccctgtctgagaagaggaccctggagggggagctgcatgacctgcggggccaggtggccaagctggaggccgccctgggggaggccaagaagcagctgcaggatgagatgctgcggcgggtggatgctgagaaccggctgcagaccatgaaggaggagctggacttccagaagaacatctacagcgaggagctgcgggagaccaagagaagacatgagacccggctggtggagattgacaatggcaagcagcgggagtttgagagccggctggctgatgccctgcaggagctgcgggcccagcacgaggaccaggtggagcagtacaagaaggagctggagaagacctacagcgccaagctggacaatgcccggcagagcgctgagaggaacagcaacctggtgggcgccgcccacgaggagctgcagcagagccgcatcagaattgacagcctgagcgcccagctgagccagctgcagaagcagctggccgccaaggaggccaagctgcgggacctggaggacagcctggcccgggagcgggacaccagccggcggctgctggccgagaaggagcgggagatggccgagatgagggccaggatgcagcagcagctggatgagtaccaggagctgctggacatcaagctggccctggacatggagatccacgcctacaggaagctgctggagggggaggaggagcggctgcggctgagccccagccccaccagccagaggagccggggccgggccagcagccacagcagccagacccagggcggcggctctgtgaccaagaagaggaagctggagagcacagagagccgcagcagcttcagccagcacgcccggaccagcggccgggtggccgtggaggaggtggatgaagatgaagatggagatgacctgctgcaccaccaccacgtgtctggcagcagaagatag

SEQ ID NO: 157256 - DNA, 1905 bp, Artificial Sequence
  Description of Artificial Sequence: Synthetic coding sequence
atggagacccccagccagaggcgggccaccaggtctggggcccaggccagcagcacccccctgagccccacccgcatcacccggctgcaggagaaggaggacctgcaggagctgaatgaccggctggccgtgtacatcgacagagtgcgcagcctggagacagaaaatgccggcctgcggctgcgcatcacagagagcgaggaggtggtgtcccgggaggtgtctggcatcaaggccgcctatgaagctgagctgggagatgccaggaagaccctggacagcgtggccaaggagcgggcccggctgcagctggagctgagcaaggtgcgggaggagttcaaggagctgaaggccaggaacaccaagaaggagggggacctgattgctgcccaggcccggctgaaggacctggaggccctgctgaacagcaaggaggccgccctgagcacagccctgtctgagaagaggaccctggagggggagctgcatgacctgcggggccaggtggccaagctggaggccgccctgggggaggccaagaagcagctgcaggatgagatgctgcggcgggtggatgctgagaaccggctgcagaccatgaaggaggagctggacttccagaagaacatctacagcgaggagctgcgggagaccaagagaagacatgagacccggctggtggagattgacaatggcaagcagcgggagtttgagagccggctggctgatgccctgcaggagctgcgggcccagcacgaggaccaggtggagcagtacaagaaggagctggagaagacctacagcgccaagctggacaatgcccggcagagcgctgagaggaacagcaacctggtgggcgccgcccacgaggagctgcagcagagccgcatcagaattgacagcctgagcgcccagctgagccagctgcagaagcagctggccgccaaggaggccaagctgcgggacctggaggacagcctggcccgggagcgggacaccagccggcggctgctggccgagaaggagcgggagatggccgagatgagggccaggatgcagcagcagctggatgagtaccaggagctgctggacatcaagctggccctggacatggagatccacgcctacaggaagctgctggagggggaggaggagcggctgcggctgagccccagccccaccagccagaggagccggggccgggccagcagccacagcagccagacccagggcggcggctctgtgaccaagaagaggaagctggagagcacagagagccgcagcagcttcagccagcacgcccggaccagcggccgggtggccgtggaggaggtggatgaggagggcaagtttgtgcggctgaggaacaagagcaatgaagaccagagcatgggcaactggcagatcaagaggcagaatggagatgaccccctgctgacctaccgcttcccccccaagttcaccctgaaggccggccaggtggtgaccatctgggccgccggggccggggccacccacagccccccaacagacctggtgtggaaggcccagaacacctggggctgcggcaacagcctgaggacagccctgatcaacagcactggagagggcagccactgcagcagcagcggggaccctgctgagtacaacctgcggagcaggacagtgctgtgtggcacctgtggccagcctgctgacaaggccagcgccagcggcagcggggcccaggtgggcggccccatcagcagcggcagcagcgccagctctgtgacagtgaccaggagctacagatctgtgggcggcagcggcggcggcagctttggagacaacctggtgaccaggagctacctgctgggcaacagcagccccaggacccagagcccccagaactgcagcatcatgtag

SEQ ID NO: 157257 - DNA, 1719 bp, Artificial Sequence
  Description of Artificial Sequence: Synthetic coding sequence
atggagacccccagccagaggcgggccaccaggtctggggcccaggccagcagcacccccctgagccccacccgcatcacccggctgcaggagaaggaggacctgcaggagctgaatgaccggctggccgtgtacatcgacagagtgcgcagcctggagacagaaaatgccggcctgcggctgcgcatcacagagagcgaggaggtggtgtcccgggaggtgtctggcatcaaggccgcctatgaagctgagctgggagatgccaggaagaccctggacagcgtggccaaggagcgggcccggctgcagctggagctgagcaaggtgcgggaggagttcaaggagctgaaggccaggaacaccaagaaggagggggacctgattgctgcccaggcccggctgaaggacctggaggccctgctgaacagcaaggaggccgccctgagcacagccctgtctgagaagaggaccctggagggggagctgcatgacctgcggggccaggtggccaagctggaggccgccctgggggaggccaagaagcagctgcaggatgagatgctgcggcgggtggatgctgagaaccggctgcagaccatgaaggaggagctggacttccagaagaacatctacagcgaggagctgcgggagaccaagagaagacatgagacccggctggtggagattgacaatggcaagcagcgggagtttgagagccggctggctgatgccctgcaggagctgcgggcccagcacgaggaccaggtggagcagtacaagaaggagctggagaagacctacagcgccaagctggacaatgcccggcagagcgctgagaggaacagcaacctggtgggcgccgcccacgaggagctgcagcagagccgcatcagaattgacagcctgagcgcccagctgagccagctgcagaagcagctggccgccaaggaggccaagctgcgggacctggaggacagcctggcccgggagcgggacaccagccggcggctgctggccgagaaggagcgggagatggccgagatgagggccaggatgcagcagcagctggatgagtaccaggagctgctggacatcaagctggccctggacatggagatccacgcctacaggaagctgctggagggggaggaggagcggctgcggctgagccccagccccaccagccagaggagccggggccgggccagcagccacagcagccagacccagggcggcggctctgtgaccaagaagaggaagctggagagcacagagagccgcagcagcttcagccagcacgcccggaccagcggccgggtggccgtggaggaggtggatgaggagggcaagtttgtgcggctgaggaacaagagcaatgaagaccagagcatgggcaactggcagatcaagaggcagaatggagatgaccccctgctgacctaccgcttcccccccaagttcaccctgaaggccggccaggtggtgaccatctgggccgccggggccggggccacccacagccccccaacagacctggtgtggaaggcccagaacacctggggctgcggcaacagcctgaggacagccctgatcaacagcactggagaggaggtggccatgaggaagctggtgcgctctgtgacagtggtggaggatgatgaagatgaagatggagatgacctgctgcaccaccaccacgtgtctggcagcagaagatag

SEQ ID NO: 157258 - DNA, 1476 bp, Artificial Sequence
  Description of Artificial Sequence: Synthetic coding sequence
atgcagcccctgctgtgcctgggcaacctggaggatgcccgggagaggacaggcaccctgctggcccagcacccagcctggggccgcacccgggccaagccaggcagccccctgaacaccaagaaggagggggacctgattgctgcccaggcccggctgaaggacctggaggccctgctgaacagcaaggaggccgccctgagcacagccctgtctgagaagaggaccctggagggggagctgcatgacctgcggggccaggtggccaagctggaggccgccctgggggaggccaagaagcagctgcaggatgagatgctgcggcgggtggatgctgaaaatcggctgcagaccatgaaggaggagctggacttccagaagaacatctacagcgaggagctgcgggagaccaagagaagacatgagacccggctggtggagattgacaacgggaagcagcgggagtttgagagccggctggctgatgccctgcaggagctgcgggcccagcacgaggaccaggtggagcagtacaagaaggagctggagaagacctacagcgccaagctggacaatgcccggcagagcgctgagaggaacagcaacctggtgggcgccgcccacgaggagctgcagcagagccgcatcagaattgacagcctgagcgcccagctgagccagctgcagaagcagctggccgccaaggaggccaagctgcgggacctggaggacagcctggcccgggagcgggacaccagccggcggctgctggccgagaaggagcgggagatggccgagatgagggccaggatgcagcagcagctggatgagtaccaggagctgctggacatcaagctggccctggacatggagatccacgcctacaggaagctgctggagggggaggaggagcggctgcggctgagccccagccccaccagccagaggagccggggccgggccagcagccacagcagccagacccagggcggcggctctgtgaccaagaagaggaagctggagagcacagagagccgcagcagcttcagccagcacgcccggaccagcggccgggtggccgtggaggaggtggatgaggagggcaagtttgtgcggctgaggaacaagagcaatgaagaccagagcatgggcaactggcagatcaagaggcagaatggagatgaccccctgctgacctaccgcttcccccccaagttcaccctgaaggccggccaggtggtgaccatctgggccgccggggccggggccacccacagccccccaacagacctggtgtggaaggcccagaacacctggggctgcggcaacagcctgaggacagccctgatcaacagcactggagaggaggtggccatgaggaagctggtgcgctctgtgacagtggtggaggatgatgaagatgaagatggagatgacctgctgcaccaccaccacgtgtctggcagcagaagatag

SEQ ID NO: 157259 - DNA, 1845 bp, Artificial Sequence
  Description of Artificial Sequence: Synthetic coding sequence
atggagacccccagccagaggcgggccaccaggtctggggcccaggccagcagcacccccctgagccccacccgcatcacccggctgcaggagaaggaggacctgcaggagctgaatgaccggctggccgtgtacatcgacagagtgcgcagcctggagacagaaaatgccggcctgcggctgcgcatcacagagagcgaggaggtggtgtcccgggaggtgtctggcatcaaggccgcctatgaagctgagctgggagatgccaggaagaccctggacagcgtggccaaggagcgggcccggctgcagctggagctgagcaaggtgcgggaggagttcaaggagctgaaggccaggaacaccaagaaggagggggacctgattgctgcccaggcccggctgaaggacctggaggccctgctgaacagcaaggaggccgccctgagcacagccctgtctgagaagaggaccctggagggggagctgcatgacctgcggggccaggtggccaagctggaggccgccctgggggaggccaagaagcagctgcaggatgagatgctgcggcgggtggatgctgagaaccggctgcagaccatgaaggaggagctggacttccagaagaacatctacagcgaggagctgcgggagaccaagagaagacatgagacccggctggtggagattgacaatggcaagcagcgggagtttgagagccggctggctgatgccctgcaggagctgcgggcccagcacgaggaccaggtggagcagtacaagaaggagctggagaagacctacagcgccaagctggacaatgcccggcagagcgctgagaggaacagcaacctggtgggcgccgcccacgaggagctgcagcagagccgcatcagaattgacagcctgagcgcccagctgagccagctgcagaagcagctggccgccaaggaggccaagctgcgggacctggaggacagcctggcccgggagcgggacaccagccggcggctgctggccgagaaggagcgggagatggccgagatgagggccaggatgcagcagcagctggatgagtaccaggagctgctggacatcaagctggccctggacatggagatccacgcctacaggaagctgctggagggggaggaggagcggctgcggctgagccccagccccaccagccagaggagccggggccgggccagcagccacagcagccagacccagggcggcggctctgtgaccaagaagaggaagctggagagcacagagagccgcagcagcttcagccagcacgcccggaccagcggccgggtggccgtggaggaggtggatgaggagggcaagtttgtgcggctgaggaacaagagcaatgaagaccagagcatgggcaactggcagatcaagaggcagaatggagatgaccccctgctgacctaccgcttcccccccaagttcaccctgaaggccggccaggtggtgaccatctgggccgccggggccggggccacccacagccccccaacagacctggtgtggaaggcccagaacacctggggctgcggcaacagcctgaggacagccctgatcaacagcactggagaggaggtggccatgaggaagctggtgcgctctgtgacagtggtggaggatgatgaagatgaagatggagatgacctgctgcaccaccaccacggcagccactgcagcagcagcggggaccctgctgagtacaacctgcggagcaggacagtgctgtgtggcacctgtggccagcctgctgacaaggccagcgccagcggcagcggggcccagagcccccagaactgcagcatcatgtag

SEQ ID NO: 157260 - DNA, 1995 bp, Artificial Sequence
  Description of Artificial Sequence: Synthetic coding sequence
atggagacccccagccagaggcgggccaccaggtctggggcccaggccagcagcacccccctgagccccacccgcatcacccggctgcaggagaaggaggacctgcaggagctgaatgaccggctggccgtgtacatcgacagagtgcgcagcctggagacagaaaatgccggcctgcggctgcgcatcacagagagcgaggaggtggtgtcccgggaggtgtctggcatcaaggccgcctatgaagctgagctgggagatgccaggaagaccctggacagcgtggccaaggagcgggcccggctgcagctggagctgagcaaggtgcgggaggagttcaaggagctgaaggccaggaacaccaagaaggagggggacctgattgctgcccaggcccggctgaaggacctggaggccctgctgaacagcaaggaggccgccctgagcacagccctgtctgagaagaggaccctggagggggagctgcatgacctgcggggccaggtggccaagctggaggccgccctgggggaggccaagaagcagctgcaggatgagatgctgcggcgggtggatgctgagaaccggctgcagaccatgaaggaggagctggacttccagaagaacatctacagcgaggagctgcgggagaccaagagaagacatgagacccggctggtggagattgacaatggcaagcagcgggagtttgagagccggctggctgatgccctgcaggagctgcgggcccagcacgaggaccaggtggagcagtacaagaaggagctggagaagacctacagcgccaagctggacaatgcccggcagagcgctgagaggaacagcaacctggtgggcgccgcccacgaggagctgcagcagagccgcatcagaattgacagcctgagcgcccagctgagccagctgcagaagcagctggccgccaaggaggccaagctgcgggacctggaggacagcctggcccgggagcgggacaccagccggcggctgctggccgagaaggagcgggagatggccgagatgagggccaggatgcagcagcagctggatgagtaccaggagctgctggacatcaagctggccctggacatggagatccacgcctacaggaagctgctggagggggaggaggagcggctgcggctgagccccagccccaccagccagaggagccggggccgggccagcagccacagcagccagacccagggcggcggctctgtgaccaagaagaggaagctggagagcacagagagccgcagcagcttcagccagcacgcccggaccagcggccgggtggccgtggaggaggtggatgaggagggcaagtttgtgcggctgaggaacaagagcaatgaagaccagagcatgggcaactggcagatcaagaggcagaatggagatgaccccctgctgacctaccgcttcccccccaagttcaccctgaaggccggccaggtggtgaccatctgggccgccggggccggggccacccacagccccccaacagacctggtgtggaaggcccagaacacctggggctgcggcaacagcctgaggacagccctgatcaacagcactggagaggaggtggccatgaggaagctggtgcgctctgtgacagtggtggaggatgatgaagatgaagatggagatgacctgctgcaccaccaccacggcagccactgcagcagcagcggggaccctgctgagtacaacctgcggagcaggacagtgctgtgtggcacctgtggccagcctgctgacaaggccagcgccagcggcagcggggcccaggtgggcggccccatcagcagcggcagcagcgccagctctgtgacagtgaccaggagctacagatctgtgggcggcagcggcggcggcagctttggagacaacctggtgaccaggagctacctgctgggcaacagcagccccaggacccagagcccccagaactgcagcatcatgtag

SEQ ID NO: 157261 - DNA, 1719 bp, Artificial Sequence; identical to SEQ ID NO: 157257
  Description of Artificial Sequence: Synthetic coding sequence

SEQ ID NO: 157262 - DNA, 1476 bp, Artificial Sequence; identical to SEQ ID NO: 157258
  Description of Artificial Sequence: Synthetic coding sequence

SEQ ID NO: 157263 - DNA, 1464 bp, Artificial Sequence
  Description of Artificial Sequence: Synthetic coding sequence
atggagacccccagccagaggcgggccaccaggtctggggcccaggccagcagcacccccctgagccccacccgcatcacccggctgcaggagaaggaggacctgcaggagctgaatgaccggctggccgtgtacatcgacagagtgcgcagcctggagacagaaaatgccggcctgcggctgcgcatcacagagagcgaggaggtggtgtcccgggaggtgtctggcatcaaggccgcctatgaagctgagctgggagatgccaggaagaccctggacagcgtggccaaggagcgggcccggctgcagctggagctgagcaaggtgcgggaggagttcaaggagctgaaggccaggaacaccaagaaggagggggacctgattgctgcccaggcccggctgaaggacctggaggccctgctgaacagcaaggaggccgccctgagcacagccctgtctgagaagaggaccctggagggggagctgcatgacctgcggggccaggtggccaagctggaggccgccctgggggaggccaagaagcagctgcaggatgagatgctgcggcgggtggatgctgagaaccggctgcagaccatgaaggaggagctggacttccagaagaacatctacagcgaggagctgcgggagaccaagagaagacatgagacccggctggtggagattgacaatggcaagcagcgggagtttgagagccggctggctgatgccctgcaggagctgcgggcccagcacgaggaccaggtggagcagtacaagaaggagctggagaagacctacagcgccaagctggacaatgcccggcagagcgctgagaggaacagcaacctggtgggcgccgcccacgaggagctgcagcagagccgcatcagaattgacagcctgagcgcccagctgagccagctgcagaagcagctggccgccaaggaggccaagctgcgggacctggaggacagcctggcccgggagcgggacaccagccggcggctgctggccgagaaggagcgggagatggccgagatgagggccaggatgcagcagcagctggatgagtaccaggagctgctggacatcaagctggccctggacatggagatccacgcctacaggaagctgctggagggggaggaggagcggctgcggctgagccccagccccaccagccagaggagccggggccgggccagcagccacagcagccagacccagggcggcggctctgtgaccaagaagaggaagctggagagcacagagagccgcagcagcttcagccagcacgcccggaccagcggcaacagcctgaggacagccctgatcaacagcactggagaggaggtggccatgaggaagctggtgcgctctgtgacagtggtggaggatgatgaagatgaagatggagatgacctgctgcaccaccaccacgtgtctggcagcagaagatag

SEQ ID NO: 157264 - DNA, 1725 bp, Artificial Sequence
  Description of Artificial Sequence: Synthetic coding sequence
atgggcaacagcgagggctgcaacaccaagaaggagggggacctgattgctgcccaggcccggctgaaggacctggaggccctgctgaacagcaaggaggccgccctgagcacagccctgtctgagaagaggaccctggagggggagctgcatgacctgcggggccaggtggccaagctggaggccgccctgggggaggccaagaagcagctgcaggatgagatgctgcggcgggtggatgctgagaaccggctgcagaccatgaaggaggagctggacttccagaagaacatctacagcgaggagctgcgggagaccaagagaagacatgagacccggctggtggagattgacaatggcaagcagcgggagtttgagagccggctggctgatgccctgcaggagctgcgggcccagcacgaggaccaggtggagcagtacaagaaggagctggagaagacctacagcgccaagctggacaatgcccggcagagcgctgagaggaacagcaacctggtgggcgccgcccacgaggagctgcagcagagccgcatcagaattgacagcctgagcgcccagctgagccagctgcagaagcagctggccgccaaggaggccaagctgcgggacctggaggacagcctggcccgggagcgggacaccagccggcggctgctggccgagaaggagcgggagatggccgagatgagggccaggatgcagcagcagctggatgagtaccaggagctgctggacatcaagctggccctggacatggagatccacgcctacaggaagctgctggagggggaggaggagcggctgcggctgagccccagccccaccagccagaggagccggggccgggccagcagccacagcagccagacccagggcggcggctctgtgaccaagaagaggaagctggagagcacagagagccgcagcagcttcagccagcacgcccggaccagcggccgggtggccgtggaggaggtggatgaggagggcaagtttgtgcggctgaggaacaagagcaatgaagaccagagcatgggcaactggcagatcaagaggcagaatggagatgaccccctgctgacctaccgcttcccccccaagttcaccctgaaggccggccaggtggtgaccatctgggccgccggggccggggccacccacagccccccaacagacctggtgtggaaggcccagaacacctggggctgcggcaacagcctgaggacagccctgatcaacagcactggagaggaggtggccatgaggaagctggtgcgctctgtgacagtggtggaggatgatgaagatgaagatggagatgacctgctgcaccaccaccacggcagccactgcagcagcagcggggaccctgctgagtacaacctgcggagcaggacagtgctgtgtggcacctgtggccagcctgctgacaaggccagcgccagcggcagcggggcccaggtgggcggccccatcagcagcggcagcagcgccagctctgtgacagtgaccaggagctacagatctgtgggcggcagcggcggcggcagctttggagacaacctggtgaccaggagctacctgctgggcaacagcagccccaggacccagagcccccagaactgcagcatcatccaggagatgggcatgcgctgggaggtggaggagggccgcaggaaggtgtccctgagctgcctgccctag

SEQ ID NO: 157265 - DNA, 1848 bp, Artificial Sequence
  Description of Artificial Sequence: Synthetic coding sequence
atgcccagcaggaagtttgctgatggagaggtggtgcggggccgctggccaggcagcagcctgtactatgaggtggagatcctgagccatgacagcaccagccagctgtacacagtgaagtacaaggatggaacagagctggagctgaaggaaaatgacatcaagcccctgaccagcttccggcagaggaagggcggcagcaccagcagcagccccagcagaagaagaggcagccgcagccgcagccgcagccgcagccctggccggccccccaagagcgccaggagaagtgccagcgccagccaccaggccgacatcaaggaggcccggcgggaggtggaggtgaagctgacccccctcatcctgaagccctttggaaacagcatcagccgctacaatggagagcctgagcacattgaaagaaatgatgccccccacaagaacacccaggagaagttcagcctgagccaggagagcagctacatcgccacccagtacagcctgcggccccggcgggaggaggtgaagctgaaggagattgacagcaaggaggagaagtatgtggccaaggagctggccgtgaggacctttgaggtgacccccatccgggccaaggacctggagtttggaggagtgcctggggtcttcctgatcatgtttggcctgcctgtgttcctgttcctgctgctgctgatgtgcaagcagaaggaccccagcctgctgaacttccccccacccctgcctgccctgtatgagctgtgggagaccagggtgtttggagtgtacctgctgtggttcctgatccaggtgctcttctacctgctgcccatcggcaaggtggtggagggcacccccctgattgatggccggcggctgaagtaccgcctgaatggcttctacgccttcatcctgaccagcgctgtgattggcaccagcctcttccagggcgtggagttccactacgtgtacagccacttcctgcagtttgccctggccgccaccgtcttctgtgtggtgctgtctgtgtacctgtacatgaggagcctgaaggcccccagaaatgacctgagccctgccagcagtggaaatgctgtgtatgacttcttcatcggccgggagctgaacccccgcatcggcacctttgacctgaagtacttctgtgagctgcggcccggcctcatcggctgggtggtgatcaacctggtgatgctgctggccgagatgaagatccaggacagagctgtgcccagcctggccatgatcctggtgaacagcttccagctgctgtatgtggtggatgccctgtggaatgaggaggccctgctgaccaccatggacatcatccatgatggcttcggcttcatgctggccttcggggacctggtgtgggtgcccttcatctacagcttccaggccttctacctggtgagccaccccaatgaggtgtcctggcccatggccagcctcatcatcgtgctgaagctgtgtggctacgtgatcttccggggggccaacagccagaagaatgccttcaggaagaaccccagcgaccccaagctggcccacctgaagaccatccacaccagcacaggcaagaacctgctggtgtctggctggtggggctttgtgcgccaccccaactacctgggggacctgatcatggccctggcctggagcctgccctgtggcttcaaccacatcctgccctacttctacatcatctacttcaccatgctgctggtgcaccgggaggccagagatgagtaccactgcaagaagaagtatggagtggcctgggagaagtactgccagagggtgccctaccgcatcttcccctacatctactag

SEQ ID NO: 157266 - DNA, 1848 bp, Artificial Sequence; identical to SEQ ID NO: 157265
  Description of Artificial Sequence: Synthetic coding sequence

SEQ ID NO: 157267 - DNA, 156 bp, Artificial Sequence
  Description of Artificial Sequence: Synthetic coding sequence
atgcccagcaggaagtttgctgatggagaggtggtgcggggccgctggccaggcagcagcctgtactatgaggtggagatcctgagccatgacagcaccagccagctgtacacagtgaagtacaaggatggaacagagctggagctgaaggagtag

SEQ ID NO: 157268 - DNA, 387 bp, Artificial Sequence
  Description of Artificial Sequence: Synthetic coding sequence
attggccgggagctgaaccccagaattggcacctttgacctgaagtacttctgtgagctgcggcccggcctgattggctgggtggtgatcaacctggtgatgctgctggccgagatgaagatccaggacagagctgtgcccagcctggccatgatcctggtgaacagcttccagctgctgtatgtggtggatgccctgtggaatgaggaggccctgctgaccaccatggacatcatccatgatggcttcggcttcatgctggcctttggagacctggtgtgggtgcccttcatctacagcttccaggccttctacctggtgagccaccccaatgaggtgtcctggcccatggccagcctcatcatcgtgctgaagcgggagtactag

SEQ ID NO: 157269 - DNA, 642 bp, Artificial Sequence
  Description of Artificial Sequence: Synthetic coding sequence
atgcccagcaggaagtttgctgatggagaggtggtgcggggccgctggccaggcagcagcctgtactatgaggtggagatcctgagccatgacagcaccagccagctgtacacagtgaagtacaaggatggaacagagctggagctgaaggaaaatgacatcaagcccctgaccagcttccggcagaggaagggcggcagcaccagcagcagccccagcagaagaagaggcagccgcagccgcagccgcagccgcagccctggccggccccccaagagcgccaggagaagtgccagcgccagccaccaggccgacatcaaggaggcccggcgggaggtggaggtgaagctgacccccctcatcctgaagccctttggaaacagcatcagccgctacaatggagagcctgagcacattgaaagaaatgatgccccccacaagaacacccaggagaagttcagcctgagccaggagagcagctacatcgccacccagtacagcctgcggccccggcgggaggaggtgaagctgaaggagattgacagcaaggaggagaagtatgtggccaaggagctggccgtgaggacctttgaggtgacccccatccgggccaaggacctggagtttggaggagtgccctag

SEQ ID NO: 157270 - DNA, 324 bp, Artificial Sequence
  Description of Artificial Sequence: Synthetic coding sequence
tgaagcaccagcctgaagatgtacttctacttctacatcgacctgaagaccatccacaccagcacaggcaagaacctgctggtgtctggctggtggggctttgtgcgccaccccaactacctgggggacctgatcatggccctggcctggagcctgccctgtggcttcaaccacatcctgccctacttctacatcatctacttcaccatgctgctggtgcaccgggaggccagagatgagtaccactgcaagaagaagtatggagtggcctgggagaagtactgccagagggtgccctaccgcatcttcccctacatctactag

SEQ ID NO: 157271 - DNA, 1761 bp, Artificial Sequence
  Description of Artificial Sequence: Synthetic coding sequence
atggccacagccacccctgtgccccccaggatgggcagcagagctgggggccccaccacccccctgagccccacccggctgagccggctgcaggagaaggaggagctgcgggagctgaatgaccggctggccgtgtacatcgacaaggtgcgcagcctggagacagagaacagcgccctgcagctgcaggtgacagagcgggaggaggtgcggggccgggagctgaccggcctgaaggccctgtatgaaacagagctggctgatgcccggcgggccctggatgacacagcccgggagcgggccaagctgcagatcgagctgggcaagtgcaaggccgagcatgaccagctgctgctgaactatgccaagaaggagagtgacctgaatggagcccagatcaagctgcgggagtatgaggccgccctgaacagcaaggatgctgccctggccacagccctgggggacaagaagagcctggagggggacctggaggacctgaaggaccagatcgcccagctggaggccagcctggccgccgccaagaagcagctggctgatgagaccctgctgaaggtggacctggagaaccgctgccagagcctgacagaggacctggagttcaggaagtccatgtatgaggaggagatcaatgagaccaggaggaagcatgagacccggctggtggaggtggacagcggccggcagatcgagtatgagtacaagctggcccaggccctgcacgagatgagggagcagcatgatgcccaggtgcggctgtacaaggaggagctggagcagacctaccacgccaagctggagaatgcccggctgagcagcgagatgaacaccagcacagtgaacagcgcccgggaggagctgatggagagcaggatgagaattgagagcctgagcagccagctgagcaacctgcagaaggagagccgggcctgcctggagcgcatccaggagctggaggacctgctggccaaggagaaggacaacagcaggaggatgctgacagacaaggagcgggagatggccgagatccgggaccagatgcagcagcagctgaatgactatgagcagctgctggatgtgaagctggccctggacatggagatcagcgcctacaggaagctgctggagggggaggaggagcggctgaagctgagccccagccccagcagccgggtgacagtgtcccgggccagcagcagccgctctgtgaggaccacccggggcaagaggaagagggtggatgtggaggagagcgaggccagcagctctgtgtccatcagccacagcgccagcgccactggaaatgtgtgcatcgaggagattgatgtggatggcaagttcatccggctgaagaacaccagcgagcaggaccagcccatgggcggctgggagatgatcaggaagattggagacacctctgtgtcctacaagtacaccagccgctacgtgctgaaggccggccagacagtgaccatctgggccgccaatgctggggtgacagccagccccccaacagacctgatctggaagaaccagaacagctggggcactggagaagatgtgaaggtgatcctgaagaacagccagggcgaggaggtggcccagaggagcaccgtcttcaagaccaccatccctgaggaggaggaggaggaggaggaggccgccggcgtggtggtggaggaggagctgttccaccagcagggcaccccccgggccagcaacagaagctgtgccatcatgtag

SEQ ID NO: 157272 - DNA, 1803 bp, Artificial Sequence
  Description of Artificial Sequence: Synthetic coding sequence
atggccacccccctgcccggccgggccggcggccctgccacccccctgagccccacccggctgagccggctgcaggagaaggaggagctgcgggagctgaatgaccggctggcccactacatcgacagagtgcgggccctggagctggagaatgaccggctgctgctgaagatcagcgagaaggaggaggtgaccacccgggaggtgtctggcatcaaggccctgtatgagagcgagctggctgatgcccggcgggtgctggatgaaacagcccgggagcgggcccggctgcagattgaaattggcaagctgcgggcagagctggatgaggtgaacaagagcgccaagaagcgggagggggagctgactgtggcccagggccgggtgaaggacctggagagcctcttccacaggtctgaggtggagctggccgccgccctgagtgacaagaggggcctggagagtgatgtggccgagctgcgggcccagctggccaaggccgaggatggccatgctgtggccaagaagcagctggagaaggagaccctgatgagggtggacctggagaaccgctgccagagcctgcaggaggagctggacttcaggaagtctgtgtttgaggaggaggtgcgggagaccaggagaagacatgaaagaaggctggtggaggtggacagcagccggcagcaggagtatgacttcaagatggcccaggccctggaggagctgcggagccagcatgatgagcaggtgcggctgtacaagctggagctggagcagacctaccaggccaagctggacagcgccaagctgagcagtgaccagaatgacaaggccgccagcgctgcccgggaggagctgaaggaggccaggatgaggctggagagcctgagctaccagctgagcggcctgcagaagcaggccagcgctgctgaggaccgcatccgggagctggaggaggccatggccggggagcgggacaagttcaggaagatgctggatgccaaggagcaggagatgacagagatgagagatgtgatgcagcagcagctggccgagtaccaggagctgctggatgtgaagctggccctggacatggagatcaatgcctacaggaagctgctggagggggaggaggagcggctgaagctgagccccagccccagcagccgggtgacagtgtcccgggccaccagcagcagcagcggcagcctgagcgccaccggccgcctgggccgcagcaagaggaagaggctggaggtggaggagcccctgggcagcggccccagcgtgctgggcaccggcaccggcggcagcggcggcttccacctggcccagcaggccagcgccagcggctctgtgtccattgaggagattgacctggagggcaagtttgtgcagctgaagaacaacagcgacaaggaccagagcctgggcaactggaggatcaagaggcaggtgctggagggggaggagatcgcctacaagttcacccccaagtacatcctgcgggccggccagatggtgacagtgtgggccgccggggccggcgtggcccacagcccccccagcaccctggtgtggaagggccagagctcctggggcaccggggagagcttcagaacagtgctggtgaatgctgatggagaggaggtggccatgaggacagtgaagaagagctctgtgatgagagaaaatgaaaatggagaggaggaggaggaggaggccgagtttggagaagaagatctcttccaccagcagggcgaccccaggaccaccagccggggctgctacgtgatgtag

SEQ ID NO: 157273 - DNA, 1803 bp, Artificial Sequence; identical to SEQ ID NO: 157272
  Description of Artificial Sequence: Synthetic coding sequence

SEQ ID NO: 157274 - DNA, 651 bp, Artificial Sequence
  Description of Artificial Sequence: Synthetic coding sequence
atgctgattggaggcaacatcgaggtgcacgtgaaccctggagatggcaccggcctgaggaaggccctgctgcacgcccccaccggcacctgcagtgatggccaggcccacagcatcagcctggtgaggaacagacgcatcatcaccgtgcagctggatgagaacaaccctgtggagatgaagctgggcaccctggtggagagcaggaccatcaacgtgagcaacctgtatgtgggcggcatccctgagggggagggcaccagcctgctgaccatgagaagaagcttccacggctgcatcaagaacctgatcttcaacctggagctgctggacttcaacagcgctgtgatgagcaagagcacctggaccccagctggctgccagaagggcctgtcctggctgcccatgcagaggaccaagctgctgcctgagccccgggccttccctgtgggcgccgccagcttcaccatcagccaggtgcagagcgccaaggagggcctgggccagcgggagctgaagtggggcctggccgtgaaggtgcctgccaaggccggggccggggccggggccggggctgtgctgaagatccgggccggcaccggccgggagcgggtgccccaggccacccagatgacccggcccaacccctag

SEQ ID NO: 157275 - DNA, 9228 bp, Artificial Sequence
  Description of Artificial Sequence: Synthetic coding sequence
atgagaggaggagtgctgctggtgctgctgctgtgtgtggccgcccagtgccggcagaggggcctcttccctgccatcctgaacctggccagcaatgcccacatcagcaccaatgccacctgtggggagaagggccctgagatgttctgcaagctggtggagcacgtgcccggccggcctgtgaggaacccccagtgccgcatctgtgatggcaacagcgccaacccccgggagcggcaccccatcagccacgccattgatggcaccaacaactggtggcagagccccagcatccagaatggccgggagtaccactgggtgaccatcaccctggacctgcggcaggtgttccaggtggcctacgtgatcatcaaggccgccaatgccccccggcccggcaactggatcctggagaggagcctggatggcaccaccttcagcccctggcagtactatgctgtgtctgattctgagtgcctgagccgctacaacatcaccccccggcggggcccccccacctacagagcagatgatgaggtgatctgcaccagctactacagccggctggtgcccctggagcacggggagatccacaccagcctcatcaatggccggcccagcgcagatgacctgagccccaagctgctggagttcaccagcgcccgctacatccggctgcggctgcagaggatccgcaccctgaatgctgacctgatgaccctgagccaccgggagcccaaggagctggaccccatcgtgacccggcgctactactacagcatcaaggacatctctgtgggcggcatgtgcatctgctacggccacgccagcagctgcccctgggatgagaccaccaagaagctgcagtgccagtgtgagcacaacacctgtggggagagctgcaaccgctgctgccccggctaccaccagcagccctggaggcctggcaccgtgagcagcggcaacacctgtgaggcctgcaactgccacaacaaggccaaggactgctactatgatgaatctgtggccaagcagaagaagagcctgaacacagctggccagttccggggcggcggcgtgtgcatcaactgcctgcagaacaccatgggcatcaactgtgagacctgcattgatggctactaccggccccacaaggtgagcccctatgaagatgagccctgccggccctgcaactgtgaccctgtgggcagcctgagctctgtgtgcatcaaggatgacctgcacagcgacctgcacaacgggaagcagcccggccagtgcccctgcaaggagggctacaccggggagaagtgtgaccgctgccagctgggctacaaggactaccccacctgtgtgtcctgtggctgcaaccctgtgggcagcgccagtgatgagccctgcaccggcccctgtgtgtgcaaggaaaatgtggagggcaaggcctgtgaccgctgcaagccaggcttctacaacctgaaggagaagaacccccggggctgcagcgagtgcttctgcttcggcgtgtctgatgtgtgcagcagcctgtcctggcctgtgggccaggtgaacagcatgagcggctggctggtgacagacctgatcagccccaggaagatccccagccagcaggatgccctgggcggccgccaccaggtgtccatcaacaacacagctgtgatgcagaggctggcccccaagtactactgggccgcccctgaggcctacctgggcaacaagctgacagcctttggaggcttcctgaagtacacagtgtcctatgacatccctgtggagaccgtggacagcaacctgatgagccatgctgatgtgatcatcaagggaaatggcctgaccctgagcacccaggccgagggcctgagcctgcagccctatgaggagtacctgaatgtggtgcggctggtgcctgagaacttccaggacttccacagcaagaggcagattgaccgggaccagctgatgacagtgctggccaacgtgacccacctgctgatccgggccaactacaacagcgccaagatggccctgtaccgcctggagagcgtgtccctggacatcgccagcagcaatgccatcgacctggtggtggccgcagatgtggagcactgtgagtgcccccagggctacacaggcaccagctgtgagagctgcctgagcggctactacagagtggatggcatcctgtttggaggcatctgccagccctgtgaatgtcatggccacgccgctgagtgcaatgtgcacggcgtgtgcatcgcctgtgcccacaacaccactggagtgcactgtgagcagtgcctgcccggcttctatggagagcccagccggggcacccctggggactgccagccctgtgcctgccccctgaccatcgccagcaacaacttcagccccacctgccacctgaatgatggagatgaggtggtgtgtgactggtgtgcccctggctacagcggggcctggtgtgagcgctgtgctgatggctactacggcaaccccaccgtgcctggagagagctgtgtgccctgtgactgcagcggaaatgtggaccccagcgaggccggccactgtgacagcgtgactggagaatgtctgaagtgcctgggcaacacagatggagcccactgtgagcgctgtgctgatggcttctatggagatgctgtgacagccaagaactgccgggcctgtgaatgtcatgtgaagggcagccacagcgctgtgtgccacctggagaccggcctgtgtgactgcaagcccaacgtgacaggccagcagtgtgaccagtgcctgcacggctactacggcctggacagcggccacggctgccggccctgcaactgcagcgtggccggctctgtgtctgatggctgcacagatgagggccagtgccactgtgtgcctggggtggccggcaagagatgtgacagatgtgcccacggcttctacgcctaccaggacggcagctgcaccccctgtgactgcccccacacccagaacacctgtgaccctgagactggagaatgtgtgtgccccccccacacccagggcgtgaagtgtgaagaatgtgaagatggccactggggctatgatgctgaggtgggctgccaggcctgcaactgcagcctggtgggcagcacccaccaccgctgtgatgtggtgacaggccactgccagtgcaagagcaagtttggaggccgggcctgtgaccagtgcagcctgggctacagagacttcccagactgtgtgccctgtgactgtgacctgcggggcaccagcggagatgcctgcaacctggagcagggcctgtgtggctgtgtggaggagactggagcctgcccctgcaaggaaaatgtgtttggcccccagtgcaatgaatgtcgggagggcacctttgccctgcgggctgacaaccccctgggctgcagcccctgcttctgcagcggcctgagccacctgtgcagcgagctggaggactatgtgaggacccctgtgaccctgggcagtgaccagcccctgctgcgggtggtgtcccagagcaacctgcggggcaccacagaaggagtgtactaccaggccccagacttcctgctggatgctgccaccgtgcggcagcacatccgggcagagcccttctactggaggctgccccagcagttccagggcgaccagctgatggcctatggaggcaagctgaagtacagcgtggccttctacagcctggatggagtgggcaccagcaactttgagccccaggtgctgatcaagggcggccgcatcaggaagcaggtgatctacatggatgccccagccccagaaaatggagtgcggcaggagcaggaggtggccatgagggagaacttctggaagtacttcaacagcgtgtctgagaagcctgtgacccgggaggacttcatgtctgtgctgagtgacatcgagtacatcctgatcaaggccagctatggccagggcctgcagcagagccgcatcagtgacatctccatggaggtgggcaggaaggccgagaagctgcaccctgaggaggaggtggccagcctgctggagaactgtgtgtgccccccaggcaccgtgggcttcagctgccaggactgtgcccctggctaccaccggggcaagctgcctgctggcagtgaccggggcccccggcccctggtggccccctgtgtgccctgcagctgcaacaaccacagcgacacctgtgaccccaacacaggcaagtgcctgaactgtggggacaacacagctggggaccactgtgatgtgtgcaccagcggctactacggcaaggtgactggaagtgccagtgactgtgccctgtgtgcctgcccccacagccccccagccagcttcagccccacctgtgtgctggagggggaccatgacttccgctgtgatgcctgcctgctgggctatgagggcaagcactgtgagcgctgcagcagcagctactacggcaacccccagacccctgggggcagctgccagaagtgtgactgcaacccccacggctctgtgcacggggactgtgacaggaccagcggccagtgtgtgtgccgcctgggcgccagcggcctgcgctgtgatgaatgtgagcccaggcacatcctgatggagacagactgtgtgtcctgtgatgatgaatgtgtgggcgtgctgctgaatgacctggatgaaattggagatgctgtgctgagcctgaacctgaccggcatcatccctgtgccctacggcatcctgagcaacctggagaacaccaccaagtacctgcaggagagcctgctgaaggagaacatgcagaaggacctgggcaagatcaagctggagggcgtggccgaggagacagacaacctgcagaagaagctgaccaggatgctggccagcacccagaaggtgaacagagccacagagcgcatcttcaaggagagccaggacctggccatcgccatcgagcggctgcagatgagcatcacagagatcatggagaagaccaccctgaaccagaccctggatgaggacttcctgctgcccaacagcaccctgcagaacatgcagcagaatggcaccagcctgctggagatcatgcagatccgggacttcacccagctgcaccagaatgccaccctggagctgaaggctgctgaggacctgctgagccagatccaggagaactaccagaagcccctggaggagctggaggtgctgaaggaggccgccagccacgtgctgagcaagcacaacaatgagctgaaggctgctgaggccctggtgcgggaggccgaggccaagatgcaggagagcaaccacctgctgctgatggtgaatgccaacctgcgggagttcagtgacaagaagctgcacgtgcaggaggagcagaacctgaccagcgagctgattgtgcagggccggggcctgattgatgctgctgctgcccagacagatgctgtgcaggatgccctggagcacctggaggaccaccaggacaagctgctgctgtggagcgccaagatccgccaccacattgatgacctggtgatgcacatgagccagagaaatgctgtggacctggtgtacagagctgaggaccatgctgctgagttccagaggctggctgatgtgctgtacagcggcctggagaacatcagaaatgtgtccctgaatgccaccagcgctgcctacgtgcactacaacatccagagcctgattgaggagagcgaggagctggccagagatgcccacaggacagtgacagagaccagcctgctgtctgagagcctggtgtccaatggcaaggctgctgtgcagaggagcagccgcttcctgaaggagggcaacaacctgagcaggaagctgcccggcatcgccctggagctgtctgagctgaggaacaagaccaaccgcttccaggagaatgctgtggagatcacccggcagaccaatgaaagcctgctgatcctgcgggccatccccaagggcatccgggacaagggggccaagaccaaggagctggccaccagcgccagccagagcgctgtgtccaccctgagagatgtggccggcctgagccaggagctgctgaacaccagcgccagcctgagccgggtgaacaccaccctgcgggagacccaccagctgctgcaggacagcaccatggccaccctgctggccggcaggaaggtgaaggatgtggagatccaggccaacctgctgtttgaccggctgaagcccctgaagatgctggaggagaacctgagcaggaacctgtctgagatcaagctgctgatcagccaggccaggaagcaggccgccagcatcaaggtggccgtgtctgctgaccgggactgcatccgggcctaccagccccagatcagcagcaccaactacaacaccctgaccctgaatgtgaagacccaggagccagacaacctgctcttctacctgggcagcagcacagccagtgacttcctggccgtggagatgaggcggggccgggtggccttcctgtgggacctgggcagcggcagcacccggctggagttcccagacttccccattgatgacaaccgctggcacagcatccacgtggccaggtttggaaacatcggcagcctgtctgtgaaggagatgagcagcaaccagaagagccccaccaagaccagcaagagccctggaacagccaacgtgctggatgtgaacaacagcaccctgatgtttgtgggcggcctgggcggccagatcaagaagagccctgctgtgaaggtgacccacttcaagggctgcctgggggaggccttcctgaatggcaagagcatcggcctgtggaactacatcgagcgggagggcaaatgtcggggctgcttcggcagcagccagaatgaagaccccagcttccactttgatggcagcggctacagcgtggtggagaagagcctgcctgccaccgtgacccagatcatcatgctgttcaacaccttcagccccaacggcctgctgctgtacctgggcagctatggcaccaaggacttcctgagcattgagctgttccggggccgggtgaaggtgatgacagacctgggcagcggccccatcaccctgctgacagaccggcgctacaacaacggcacctggtacaagatcgccttccagaggaacaggaagcagggcgtgctggccgtgattgatgcctacaacaccagcaacaaggagaccaagcagggcgagacccctggggccagcagtgacctgaaccggctggacaaggaccccatctacgtgggcggcctgcccaggagccgggtggtgcggcggggcgtgaccaccaagagctttgtgggctgcatcaagaacctggagatcagccgcagcacctttgacctgctgaggaacagctatggagtgaggaagggctgcctgctggagcccatccgctctgtgtccttcctgaagggcggctacatcgagctgccccccaagagcctgagccctgagagcgagtggctggtgacctttgccaccaccaacagcagcggcatcatcctggccgccctgggcggagatgtggagaagagaggagaccgggaggaggcccacgtgcccttcttctctgtgatgctgattggaggcaacatcgaggtgcacgtgaaccctggagatggcaccggcctgaggaaggccctgctgcacgcccccaccggcacctgcagtgatggccaggcccacagcatcagcctggtgaggaacagacgcatcatcaccgtgcagctggatgagaacaaccctgtggagatgaagctgggcaccctggtggagagcaggaccatcaacgtgagcaacctgtatgtgggcggcatccctgagggggagggcaccagcctgctgaccatgaggaggagcttccacggctgcatcaagaacctgatcttcaacctggagctgctggacttcaacagcgctgtgggccacgagcaggtggacctggacacctgctggctgtctgagcggcccaagctggccccagatgctgaggacagcaagctgctgcctgagccccgggccttccctgagcagtgtgtggtggatgctgccctggagtatgtgcctggggcccaccagtttggcctgacccagaacagccacttcatcctgcccttcaaccagagcgctgtgaggaagaagctgtctgtggagctgagcatccgcacctttgccagcagcggcctcatctactacatggcccaccagaaccaggccgactatgctgtgctgcagctgcatggaggccgcctgcacttcatgtttgacctgggcaaaggaagaaccaaggtgagccacccagccctgctgagtgatggcaagtggcacacagtgaagacagattatgtgaagaggaagggcttcatcaccgtggatggccgggagagccccatggtgacagtggtgggagatggcaccatgctggatgtggagggcctcttctacctgggcggcctgcccagccagtaccaggccaggaagattggcaacatcacccacagcatcccagcctgcattggagatgtgacagtgaacagcaagcagctggacaaggacagccctgtgtctgccttcaccgtgaaccgctgctatgctgtggcccaggagggcacctactttgatggcagcggctatgctgccctggtgaaggagggctacaaggtgcagagtgatgtgaacatcaccctggagttccgcaccagcagccagaatggagtgctgctgggcatcagcacagccaaggtggatgccatcggcctggagctggtggatggcaaggtgctcttccacgtgaacaatggagctggccgcatcacagctgcctatgagcccaagacagccaccgtgctgtgtgatggcaagtggcacaccctgcaggccaacaagagcaagcaccgcatcaccctcatcgtggatggaaatgctgtgggcgctgagagcccccacacccagagcacctctgtggacaccaacaaccccatctacgtgggcggctacccagctggggtgaagcagaagtgcctgcggagccagaccagcttccggggctgcctgaggaagctggccctgatcaagagcccccaggtgcagagctttgacttcagccgggcctttgagctgcatggagtcttcctgcacagctgccctggaacagagagctag

SEQ ID NO: 157276 - DNA, 9366 bp, Artificial Sequence
  Description of Artificial Sequence: Synthetic coding sequence
atgcctggagctgctggggtgctgctgctgctgctgctgagcggcggcctgggcggcgtgcaggcccagaggccccagcagcagaggcagagccaggcccaccagcagaggggcctcttccctgctgtgctgaacctggccagcaatgccctgatcaccaccaatgccacctgtggggagaagggccctgagatgtactgcaagctggtggagcacgtgcccggccagcctgtgaggaacccccagtgccgcatctgcaaccagaacagcagcaaccccaaccagaggcaccccatcaccaatgccattgatggcaagaacacctggtggcagagccccagcatcaagaatggaattgagtaccactacgtgaccatcaccctggacctgcagcaggtgttccagatcgcctacgtgattgtgaaggccgccaacagccccaggcctggcaactggatcctggagaggagcctggatgatgtggagtacaagccctggcagtaccacgctgtgacagacacagaatgtctgaccctgtacaacatctaccccaggacaggcccccccagctatgccaaggatgatgaagtcatctgcaccagcttctacagcaagatccaccccctggagaatggagagatccacatcagcctcatcaatggccggcccagcgcagatgaccccagccctgagctgctggagttcaccagcgcccgctacatccggctgcgcttccagaggatccgcaccctgaatgctgacctgatgatgtttgcccacaaggacccccgggagattgaccccatcgtgacccggcgctactactacagcgtgaaggacatctctgtgggcggcatgtgcatctgctacggccacgcccgggcctgccccctggaccctgccaccaacaagagccgctgtgaatgtgagcacaacacctgtggggacagctgtgaccagtgctgccccggcttccaccagaagccctggagggctggcaccttcctgaccaagacagaatgtgaggcctgcaactgccacggcaaggccgaggagtgctactatgatgaaaatgtggcccggaggaacctgagcctgaacatccggggcaagtacatcggcggcggcgtgtgcatcaactgcacccagaacacagctggcatcaactgtgagacctgcacagatggcttcttccggcccaagggcgtgagccccaactacccccggccctgccagccctgccactgtgaccccatcggcagcctgaatgaggtgtgtgtgaaggatgagaagcacgcccggcggggcctggcccctggcagctgccactgcaagacaggctttggaggagtgtcctgtgacagatgtgcccggggctacacaggctacccagactgcaaggcctgcaactgcagcggcctgggcagcaagaatgaagacccctgcttcggcccctgcatctgcaaggaaaatgtggagggcggggactgcagccgctgcaagagcggcttcttcaacctgcaggaggacaactggaagggctgtgatgagtgcttctgcagcggcgtgagcaaccgctgccagagcagctactggacctacggcaagatccaggacatgagcggctggtacctgacagacctgcccggccgcatccgggtggccccccagcaggatgacctggacagcccccagcagatcagcatcagcaatgctgaggcccggcaggccctgccccacagctactactggagcgccccagccccctacctgggcaacaagctgcctgctgtgggcggccagctgaccttcaccatctcctatgacctggaggaggaggaggaggacacagagcgggtgctgcagctgatgatcatcctggagggcaatgacctgagcatcagcacagcccaggatgaggtgtacctgcaccccagcgaggagcacaccaacgtgctgctgctgaaggaggagagcttcaccatccacggcacccacttccctgtgcggaggaaggagttcatgacagtgctggccaacctgaagagggtgctgctgcagatcacctacagctttggcatggatgccatcttccggctgagctctgtgaacctggagagcgctgtgtcctaccccacagatggcagcattgctgctgctgtggaggtgtgccagtgccccccaggctacacaggcagcagctgtgagagctgctggcccaggcacagaagagtgaatggcaccatctttggaggcatctgtgagccctgccagtgcttcggccatgctgagagctgtgatgatgtgactggagagtgcctgaactgcaaggaccacactggaggcccctactgtgacaagtgcctgcccggcttctatggagagcccaccaagggcaccagcgaggactgccagccctgtgcctgccccctgaacatccccagcaacaacttcagccccacctgccacctggacaggagcctgggcctcatctgtgatggctgccctgtgggctacacaggcccccgctgtgagcgctgtgccgagggctacttcggccagcccagcgtgcctgggggcagctgccagccctgccagtgcaatgacaacctggacttcagcatccctggcagctgtgacagcctgagcggcagctgcctgatctgcaagccaggcaccaccggccgctactgtgagctgtgtgctgatggctactttggagatgctgtggatgccaagaactgccagccctgccgctgcaatgctgggggcagcttcagcgaggtgtgccacagccagacaggccagtgtgagtgccgggccaacgtgcagggccagagatgtgacaagtgcaaggccggcaccttcggcctgcagagcgcccggggctgtgtgccctgcaactgcaacagctttggcagcaagagctttgactgtgaggagagcggccagtgctggtgccagcccggggtgacaggcaagaagtgtgacagatgtgcccacggctacttcaacttccaggagggcggctgcacagcctgtgaatgtagccacctgggcaacaactgtgaccccaagacaggccgctgcatctgcccccccaacaccatcggggagaagtgcagcaaatgtgcccccaacacctggggccacagcatcaccaccggctgcaaggcctgcaactgcagcacagtgggcagcctggacttccagtgcaatgtgaacacaggccagtgcaactgccaccccaagttcagcggggccaagtgcacagagtgcagccggggccactggaactacccccgctgcaacctgtgtgactgcttcctgcctggaacagatgccaccacctgtgacagcgagaccaagaagtgcagctgcagcgaccagacaggccagtgcacctgcaaggtgaatgtggagggcatccactgtgaccgctgcaggcctgggaagtttggcctggatgccaagaaccccctgggctgcagcagctgctactgcttcggcaccaccacccagtgcagcgaggccaagggcctcatccgcacctgggtgaccctgaaggccgagcagaccatcctgcccctggtggatgaggccctgcagcacaccaccaccaagggcatcgtgttccagcaccctgagatcgtggcccacatggacctgatgagggaggacctgcacctggagcccttctactggaagctgcctgagcagtttgagggcaagaagctgatggcctatggaggcaagctgaagtatgccatctactttgaggcccgggaggagaccggcttcagcacctacaacccccaggtgatcatccggggcggcacccccacccacgcccgcatcatcgtgcgccacatggccgcccccctcatcggccagctgaccaggcatgaaattgagatgacagagaaggagtggaagtactatggagatgacccccgggtgcacaggacagtgacccgggaggacttcctggacatcctgtatgacatccactacatcctgatcaaggccacctacggcaacttcatgaggcagagccgcatcagcgagatctccatggaggtggccgagcagggccggggcaccaccatgaccccacctgctgacctgattgaaaaatgtgactgccccctgggctacagcggcctgagctgtgaggcctgcctgcccggcttctaccgcctgcggagccagcccggcggccgcaccccaggccccaccctgggcacctgtgtgccctgccagtgcaatggccacagcagcctgtgtgaccctgagaccagcatctgccagaactgccagcaccacacagctggggacttctgtgagcgctgtgccctgggctactacggcatcgtgaagggcctgcccaatgactgccagcagtgtgcctgccccctcatcagcagcagcaacaacttcagccccagctgtgtggccgagggcctggatgactaccgctgcacagcctgcccccggggctatgagggccagtactgtgagcgctgtgcccctggctacacaggcagccctggcaaccctgggggcagctgccaggagtgtgaatgtgacccctacggcagcctgcctgtgccctgtgaccctgtgacaggcttctgcacctgcaggcctggggccactggaagaaaatgtgatggctgcaagcactggcacgcccgggagggctgggagtgtgtgttctgtggagatgaatgtacaggcctgctgctgggggacctggcccggctggagcagatggtgatgagcatcaacctgaccggccccctgcctgccccctacaagatgctgtatggcctggagaacatgacccaggagctgaagcacctgctgagcccccagagggcccctgagcggctcatccagctggccgagggcaacctgaacaccctggtgacagagatgaatgagctgctgacccgggccaccaaggtgacagcagatggagagcagacaggccaggatgctgagaggaccaacacccgggccaagagcctgggggagttcatcaaggagctggccagagatgctgaggccgtgaatgagaaggccatcaagctgaatgagaccctgggcaccagagatgaggcctttgagaggaacctggagggcctgcagaaggagattgaccagatgatcaaggagctgcggaggaagaacctggagacccagaaggagattgctgaagatgagctggtggccgctgaggccctgctgaagaaggtgaagaagctgtttggagagagcagaggagaaaatgaggagatggagaaggacctgcgggagaagctggccgactacaagaacaaggtggatgatgcctgggacctgctgcgggaggccacagacaagatccgggaggccaacagactctttgctgtgaaccagaagaacatgacagccctggagaagaagaaggaggccgtggagagcggcaagaggcagatcgagaacaccctgaaggagggcaatgacatcctggatgaggccaaccggctggctgatgagatcaacagcatcattgattatgtggaggacatccagaccaagctgccccccatgtctgaggagctgaatgacaagattgatgacctgagccaggagatcaaggacaggaagctggccgagaaggtgtcccaggccgagagccatgctgcccagctgaatgacagcagcgctgtgctggatggcatcctggatgaggccaagaacatctccttcaatgccacagctgccttcaaggcctacagcaacatcaaggactacattgatgaggccgagaaggtggccaaggaggccaaggacctggcccacgaggccaccaagctggccaccggcccccggggcctgctgaaggaggatgccaagggctgcctgcagaagagcttccgcatcctgaatgaggccaagaagctggccaatgatgtgaaggaaaatgaagaccacctgaatggcctgaagaccagaattgaaaatgctgatgccagaaatggagacctgctgcggaccctgaatgacaccctgggcaagctgagcgccatccccaatgacacagctgccaagctgcaggccgtgaaggacaaggcccggcaggccaatgacacagccaaggatgtgctggcccagatcacagagctgcaccagaacctggatggcctgaagaagaactacaacaagctggccgacagcgtggccaagaccaatgctgtggtgaaggaccccagcaagaacacagtggctgatgctgatgccaccgtgaagaacctggagcaggaggccgaccggctgattgacaagctgaagcccatcaaggagctggaggacaacctgaagaagaacatcagcgagatcaaggagctgatcaaccaggccaggaagcaggccaacagcatcaaggtgtctgtgtcctctggaggagactgcatccgcacctacaagccagagatcaagaagggcagctacaacaacatcgtggtgaatgtgaagacagctgtggccgacaacctgctcttctacctgggcagcgccaagttcatcgacttcctggccatcgagatgaggaagggcaaggtgtccttcctgtgggatgtgggcagcggcgtgggccgggtggagtacccagacctgaccattgatgacagctactggtacagaattgtggccagcaggactggaagaaatggcaccatctctgtgcgggccctggatggccccaaggccagcatcgtgcccagcacccaccacagcaccagccccccaggctacaccatcctggatgtggatgccaatgccatgctgtttgtgggcggcctgaccgggaagctgaagaaggcagatgctgtgcgggtcatcaccttcaccggctgcatgggagagacctactttgacaacaagcccatcggcctgtggaacttccgggagaaggagggggactgcaagggctgcaccgtgagcccccaggtggaggacagcgagggcaccatccagtttgatggagagggctacgccctggtgtcccggcccatccgctggtaccccaacatcagcacagtgatgttcaagttccgcaccttcagcagcagcgccctgctgatgtacctggccacccgggacctgcgggacttcatgtctgtggagctgacagatggccacatcaaggtgtcctatgacctgggcagcggcatggcctctgtggtgagcaaccagaaccacaatgatggcaagtggaagagcttcaccctgagccgcatccagaagcaggccaacatcagcatcgtggacatcgacaccaaccaggaggagaacatcgccaccagcagcagcggcaacaactttggcctggacctgaaggcagatgacaagatctactttggaggcctgcccaccctgaggaacctgtccatgaaggcccggcctgaggtgaacctgaagaagtacagcggctgcctgaaggacatcgagatcagcaggaccccctacaacatcctgagcagcccagactatgtgggcgtgaccaagggctgcagcctggagaatgtgtacacagtgtccttccccaagccaggctttgtggagctgagccctgtgcccattgatgtgggcacagagatcaacctgtccttcagcaccaagaatgaaagtggcatcatcctgctgggcagcggcggcaccccagccccacccaggaggaagaggcggcagacaggccaggcctactatgccatcctgctgaacagaggccgcctggaggtgcacctgagcactggagcccggaccatgaggaagatcgtcatccggcctgagcccaacctcttccatgatggccgggagcacagcgtgcacgtggagaggacccggggcatcttcaccgtgcaggtggatgagaacagacgctacatgcagaacctgactgtggagcagcccatcgaggtgaagaagctgtttgtgggcggggcccctcctgagttccagcccagccccctgaggaacatccccccatttgagggctgcatctggaacctggtgatcaacagcgtgcccatggactttgcccggcctgtgtccttcaagaatgctgacatcggccgctgtgcccaccagaagctgcgggaggatgaagatggagctgccccagctgagatcgtcatccagcctgagcctgtgcccaccccagccttccccacccccacccctgtgctgacccacggcccctgtgccgctgagagcgagcccgccctgctgattggcagcaagcagtttggcctgagcaggaacagccacatcgccatcgcctttgatgacaccaaggtgaagaaccggctgaccatcgagctggaggtgaggacagaggccgagagcggcctgctcttctacatggcccgcatcaaccacgccgactttgccaccgtgcagctgagaaatggcctgccctacttctcctatgacctgggcagcggggacacccacaccatgatccccaccaagatcaatgatggccagtggcacaagatcaagatcatgaggagcaagcaggagggcatcctgtatgtggatggagccagcaacagaaccatcagccccaagaaggctgacatcctggatgtggtgggcatgctgtatgtgggcggcctgcccatcaactacaccacccggcgcatcggccctgtgacctacagcattgatggctgtgtgaggaacctgcacatggccgaggccccagctgacctggagcagcccaccagcagcttccacgtgggcacctgctttgccaatgcccagaggggcacctactttgatggcaccggctttgccaaggctgtgggcggcttcaaggtgggcctggacctgctggtggagtttgagttccgcaccaccaccaccactggagtgctgctgggcatcagcagccagaagatggatggcatgggcatcgagatgattgatgagaagctgatgtttcatgtggacaacggggccggccgcttcaccgctgtgtatgatgctggggtgcccggccacctgtgtgatggccagtggcacaaggtgacagccaacaagatcaagcaccgcatcgagctgactgtggatggcaaccaggtggaggcccagagccccaacccagccagcaccagcgctgacaccaatgaccctgtgtttgtgggcggcttcccagatgacctgaagcagtttggcctgaccaccagcatccccttccggggctgcatccgcagcctgaagctgaccaagggcaccgggaagcccctggaggtgaactttgccaaggccctggagctgcggggcgtgcagcctgtgtcctgcccagccaactag

SEQ ID NO: 157277 - DNA, 9369 bp, Artificial Sequence
  Description of Artificial Sequence: Synthetic coding sequence
atgcctggagctgctggggtgctgctgctgctgctgctgagcggcggcctgggcggcgtgcaggcccagaggccccagcagcagaggcagagccaggcccaccagcagaggggcctcttccctgctgtgctgaacctggccagcaatgccctgatcaccaccaatgccacctgtggggagaagggccctgagatgtactgcaagctggtggagcacgtgcccggccagcctgtgaggaacccccagtgccgcatctgcaaccagaacagcagcaaccccaaccagaggcaccccatcaccaatgccattgatggcaagaacacctggtggcagagccccagcatcaagaatggaattgagtaccactacgtgaccatcaccctggacctgcagcaggtgttccagatcgcctacgtgattgtgaaggccgccaacagccccaggcctggcaactggatcctggagaggagcctggatgatgtggagtacaagccctggcagtaccacgctgtgacagacacagaatgtctgaccctgtacaacatctaccccaggacaggcccccccagctatgccaaggatgatgaagtcatctgcaccagcttctacagcaagatccaccccctggagaatggagagatccacatcagcctcatcaatggccggcccagcgcagatgaccccagccctgagctgctggagttcaccagcgcccgctacatccggctgcgcttccagaggatccgcaccctgaatgctgacctgatgatgtttgcccacaaggacccccgggagattgaccccatcgtgacccggcgctactactacagcgtgaaggacatctctgtgggcggcatgtgcatctgctacggccacgcccgggcctgccccctggaccctgccaccaacaagagccgctgtgaatgtgagcacaacacctgtggggacagctgtgaccagtgctgccccggcttccaccagaagccctggagggctggcaccttcctgaccaagacagaatgtgaggcctgcaactgccacggcaaggccgaggagtgctactatgatgaaaatgtggcccggaggaacctgagcctgaacatccggggcaagtacatcggcggcggcgtgtgcatcaactgcacccagaacacagctggcatcaactgtgagacctgcacagatggcttcttccggcccaagggcgtgagccccaactacccccggccctgccagccctgccactgtgaccccatcggcagcctgaatgaggtgtgtgtgaaggatgagaagcacgcccggcggggcctggcccctggcagctgccactgcaagacaggctttggaggagtgtcctgtgacagatgtgcccggggctacacaggctacccagactgcaaggcctgcaactgcagcggcctgggcagcaagaatgaagacccctgcttcggcccctgcatctgcaaggaaaatgtggagggcggggactgcagccgctgcaagagcggcttcttcaacctgcaggaggacaactggaagggctgtgatgagtgcttctgcagcggcgtgagcaaccgctgccagagcagctactggacctacggcaagatccaggacatgagcggctggtacctgacagacctgcccggccgcatccgggtggccccccagcaggatgacctggacagcccccagcagatcagcatcagcaatgctgaggcccggcaggccctgccccacagctactactggagcgccccagccccctacctgggcaacaagctgcctgctgtgggcggccagctgaccttcaccatctcctatgacctggaggaggaggaggaggacacagagcgggtgctgcagctgatgatcatcctggagggcaatgacctgagcatcagcacagcccaggatgaggtgtacctgcaccccagcgaggagcacaccaacgtgctgctgctgaaggaggagagcttcaccatccacggcacccacttccctgtgcggaggaaggagttcatgacagtgctggccaacctgaagagggtgctgctgcagatcacctacagctttggcatggatgccatcttccggctgagctctgtgaacctggagagcgctgtgtcctaccccacagatggcagcattgctgctgctgtggaggtgtgccagtgccccccaggctacacaggcagcagctgtgagagctgctggcccaggcacagaagagtgaatggcaccatctttggaggcatctgtgagccctgccagtgcttcggccatgctgagagctgtgatgatgtgactggagagtgcctgaactgcaaggaccacactggaggcccctactgtgacaagtgcctgcccggcttctatggagagcccaccaagggcaccagcgaggactgccagccctgtgcctgccccctgaacatccccagcaacaacttcagccccacctgccacctggacaggagcctgggcctcatctgtgatggctgccctgtgggctacacaggcccccgctgtgagcgctgtgccgagggctacttcggccagcccagcgtgcctgggggcagctgccagccctgccagtgcaatgacaacctggacttcagcatccctggcagctgtgacagcctgagcggcagctgcctgatctgcaagccaggcaccaccggccgctactgtgagctgtgtgctgatggctactttggagatgctgtggatgccaagaactgccagccctgccgctgcaatgctgggggcagcttcagcgaggtgtgccacagccagacaggccagtgtgagtgccgggccaacgtgcagggccagagatgtgacaagtgcaaggccggcaccttcggcctgcagagcgcccggggctgtgtgccctgcaactgcaacagctttggcagcaagagctttgactgtgaggagagcggccagtgctggtgccagcccggggtgacaggcaagaagtgtgacagatgtgcccacggctacttcaacttccaggagggcggctgcacagcctgtgaatgtagccacctgggcaacaactgtgaccccaagacaggccgctgcatctgcccccccaacaccatcggggagaagtgcagcaaatgtgcccccaacacctggggccacagcatcaccaccggctgcaaggcctgcaactgcagcacagtgggcagcctggacttccagtgcaatgtgaacacaggccagtgcaactgccaccccaagttcagcggggccaagtgcacagagtgcagccggggccactggaactacccccgctgcaacctgtgtgactgcttcctgcctggaacagatgccaccacctgtgacagcgagaccaagaagtgcagctgcagcgaccagacaggccagtgcacctgcaaggtgaatgtggagggcatccactgtgaccgctgcaggcctgggaagtttggcctggatgccaagaaccccctgggctgcagcagctgctactgcttcggcaccaccacccagtgcagcgaggccaagggcctcatccgcacctgggtgaccctgaaggccgagcagaccatcctgcccctggtggatgaggccctgcagcacaccaccaccaagggcatcgtgttccagcaccctgagatcgtggcccacatggacctgatgagggaggacctgcacctggagcccttctactggaagctgcctgagcagtttgagggcaagaagctgatggcctatggaggcaagctgaagtatgccatctactttgaggcccgggaggagaccggcttcagcacctacaacccccaggtgatcatccggggcggcacccccacccacgcccgcatcatcgtgcgccacatggccgcccccctcatcggccagctgaccaggcatgaaattgagatgacagagaaggagtggaagtactatggagatgacccccgggtgcacaggacagtgacccgggaggacttcctggacatcctgtatgacatccactacatcctgatcaaggccacctacggcaacttcatgaggcagagccgcatcagcgagatctccatggaggtggccgagcagggccggggcaccaccatgaccccacctgctgacctgattgaaaaatgtgactgccccctgggctacagcggcctgagctgtgaggcctgcctgcccggcttctaccgcctgcggagccagcccggcggccgcaccccaggccccaccctgggcacctgtgtgccctgccagtgcaatggccacagcagcctgtgtgaccctgagaccagcatctgccagaactgccagcaccacacagctggggacttctgtgagcgctgtgccctgggctactacggcatcgtgaagggcctgcccaatgactgccagcagtgtgcctgccccctcatcagcagcagcaacaacttcagccccagctgtgtggccgagggcctggatgactaccgctgcacagcctgcccccggggctatgagggccagtactgtgagcgctgtgcccctggctacacaggcagccctggcaaccctgggggcagctgccaggagtgtgaatgtgacccctacggcagcctgcctgtgccctgtgaccctgtgacaggcttctgcacctgcaggcctggggccactggaagaaaatgtgatggctgcaagcactggcacgcccgggagggctgggagtgtgtgttctgtggagatgaatgtacaggcctgctgctgggggacctggcccggctggagcagatggtgatgagcatcaacctgaccggccccctgcctgccccctacaagatgctgtatggcctggagaacatgacccaggagctgaagcacctgctgagcccccagagggcccctgagcggctcatccagctggccgagggcaacctgaacaccctggtgacagagatgaatgagctgctgacccgggccaccaaggtgacagcagatggagagcagacaggccaggatgctgagaggaccaacacccgggccaagagcctgggggagttcatcaaggagctggccagagatgctgaggccgtgaatgagaaggccatcaagctgaatgagaccctgggcaccagagatgaggcctttgagaggaacctggagggcctgcagaaggagattgaccagatgatcaaggagctgcggaggaagaacctggagacccagaaggagattgctgaagatgagctggtggccgctgaggccctgctgaagaaggtgaagaagctgtttggagagagcagaggagaaaatgaggagatggagaaggacctgcgggagaagctggccgactacaagaacaaggtggatgatgcctgggacctgctgcgggaggccacagacaagatccgggaggccaacagactctttgctgtgaaccagaagaacatgacagccctggagaagaagaaggaggccgtggagagcggcaagaggcagatcgagaacaccctgaaggagggcaatgacatcctggatgaggccaaccggctggctgatgagatcaacagcatcattgattatgtggaggacatccagaccaagctgccccccatgtctgaggagctgaatgacaagattgatgacctgagccaggagatcaaggacaggaagctggccgagaaggtgtcccaggccgagagccatgctgcccagctgaatgacagcagcgctgtgctggatggcatcctggatgaggccaagaacatctccttcaatgccacagctgccttcaaggcctacagcaacatcaaggactacattgatgaggccgagaaggtggccaaggaggccaaggacctggcccacgaggccaccaagctggccaccggcccccggggcctgctgaaggaggatgccaagggctgcctgcagaagagcttccgcatcctgaatgaggccaagaagctggccaatgatgtgaaggaaaatgaagaccacctgaatggcctgaagaccagaattgaaaatgctgatgccagaaatggagacctgctgcggaccctgaatgacaccctgggcaagctgagcgccatccccaatgacacagctgccaagctgcaggccgtgaaggacaaggcccggcaggccaatgacacagccaaggatgtgctggcccagatcacagagctgcaccagaacctggatggcctgaagaagaactacaacaagctggccgacagcgtggccaagaccaatgctgtggtgaaggaccccagcaagaacaagatcgtggctgatgctgatgccaccgtgaagaacctggagcaggaggccgaccggctgattgacaagctgaagcccatcaaggagctggaggacaacctgaagaagaacatcagcgagatcaaggagctgatcaaccaggccaggaagcaggccaacagcatcaaggtgtctgtgagcagcggcggggactgcatccgcacctacaagccagagatcaagaagggcagctacaacaacatcgtggtgaatgtgaagacagctgtggccgacaacctgctcttctacctgggcagcgccaagttcatcgacttcctggccatcgagatgaggaagggcaaggtgtccttcctgtgggatgtgggcagcggcgtgggccgggtggagtacccagacctgaccattgatgacagctactggtaccgcatcgtggccagcaggactggaagaaatggcaccatctctgtgcgggccctggatggccccaaggccagcatcgtgcccagcacccaccacagcaccagccccccaggctacaccatcctggatgtggatgccaatgccatgctgtttgtgggcggcctgaccgggaagctgaagaaggcagatgctgtgcgggtcatcaccttcaccggctgcatgggagagacctactttgacaacaagcccatcggcctgtggaacttccgggagaaggagggggactgcaagggctgcaccgtgagcccccaggtggaggacagcgagggcaccatccagtttgatggagagggctacgccctggtgtcccggcccatccgctggtaccccaacatcagcacagtgatgttcaagttccgcaccttcagcagcagcgccctgctgatgtacctggccacccgggacctgcgggacttcatgtctgtggagctgacagatggccacatcaaggtgtcctatgacctgggcagcggcatggcctctgtggtgagcaaccagaaccacaatgatggcaagtggaagagcttcaccctgagccgcatccagaagcaggccaacatcagcatcgtggacatcgacaccaaccaggaggagaacatcgccaccagcagcagcggcaacaactttggcctggacctgaaggcagatgacaagatctactttggaggcctgcccaccctgaggaacctgcggctcttcaacagacctgaggtgaacctgaagaagtacagcggctgcctgaaggacatcgagatcagcaggaccccctacaacatcctgagcagcccagactatgtgggcgtgaccaagggctgcagcctggagaatgtgtacacagtgtccttccccaagccaggctttgtggagctgagccctgtgcccattgatgtgggcacagagatcaacctgtccttcagcaccaagaatgaaagtggcatcatcctgctgggcagcggcggcaccccagccccacccaggaggaagaggcggcagacaggccaggcctactatgccatcctgctgaacagaggccgcctggaggtgcacctgagcactggagcccggaccatgaggaagatcgtcatccggcctgagcccaacctcttccatgatggccgggagcacagcgtgcacgtggagaggacccggggcatcttcaccgtgcaggtggatgaaaatcgccgctacatgcagaacctgactgtggagcagcccatcgaggtgaagaagctgtttgtgggcggggcccctcctgagttccagcccagccccctgaggaacatccccccatttgagggctgcatctggaacctggtgatcaacagcgtgcccatggactttgcccggcctgtgtccttcaagaatgctgacatcggccgctgtgcccaccagaagctgagagaagatgaagatggagctgccccagctgagatcgtcatccagcctgagcctgtgcccaccccagccttccccacccccacccctgtgctgacccacggcccctgtgccgctgagagcgagcccgccctgctgattggcagcaagcagtttggcctgagcaggaacagccacatcgccatcgcctttgatgacaccaaggtgaagaaccggctgaccatcgagctggaggtgaggacagaagctgagagcggcctgctcttctacatggcccgcatcaaccacgccgactttgccaccgtgcagctgagaaatggcctgccctacttctcctatgacctgggcagcggggacacccacaccatgatccccaccaagatcaatgatggccagtggcacaagatcaagatcatgaggagcaagcaggagggcatcctgtatgtggatggagccagcaacagaaccatcagccccaagaaggctgacatcctggatgtggtgggcatgctgtatgtgggcggcctgcccatcaactacaccaccaggagaattggccctgtgacctacagcattgatggctgtgtgaggaacctgcacatggccgaggccccagctgacctggagcagcccaccagcagcttccacgtgggcacctgctttgccaatgcccagaggggcacctactttgatggcactggatttgccaaggctgtgggcggcttcaaggtgggcctggacctgctggtggagtttgagttccgcaccaccaccaccaccggggtgctgctgggcatcagcagccagaagatggatggcatgggcatcgagatgattgatgagaagctgatgttccacgtggacaatggagctggccgcttcaccgctgtgtatgatgctggggtgcccggccacctgtgtgatggccagtggcacaaggtgacagccaacaagatcaagcacagaattgagctgactgtggatggcaaccaggtggaggcccagagccccaacccagccagcaccagcgctgacaccaatgaccctgtgtttgtgggcggcttcccagatgacctgaagcagtttggcctgaccaccagcatccccttccggggctgcatccgcagcctgaagctgaccaagggcaccgggaagcccctggaggtgaactttgccaaggccctggagctgcggggcgtgcagcctgtgtcctgcccagccaactag

SEQ ID NO: 157278 - DNA, 9369 bp, Artificial Sequence
  Description of Artificial Sequence: Synthetic coding sequence
atgcctggagctgctggggtgctgctgctgctgctgctgagcggcggcctgggcggcgtgcaggcccagaggccccagcagcagaggcagagccaggcccaccagcagaggggcctcttccctgctgtgctgaacctggccagcaatgccctgatcaccaccaatgccacctgtggggagaagggccctgagatgtactgcaagctggtggagcacgtgcccggccagcctgtgaggaacccccagtgccgcatctgcaaccagaacagcagcaaccccaaccagaggcaccccatcaccaatgccattgatggcaagaacacctggtggcagagccccagcatcaagaatggaattgagtaccactacgtgaccatcaccctggacctgcagcaggtgttccagatcgcctacgtgattgtgaaggccgccaacagccccaggcctggcaactggatcctggagaggagcctggatgatgtggagtacaagccctggcagtaccacgctgtgacagacacagaatgtctgaccctgtacaacatctaccccaggacaggcccccccagctatgccaaggatgatgaagtcatctgcaccagcttctacagcaagatccaccccctggagaatggagagatccacatcagcctcatcaatggccggcccagcgcagatgaccccagccctgagctgctggagttcaccagcgcccgctacatccggctgcgcttccagaggatccgcaccctgaatgctgacctgatgatgtttgcccacaaggacccccgggagattgaccccatcgtgacccggcgctactactacagcgtgaaggacatctctgtgggcggcatgtgcatctgctacggccacgcccgggcctgccccctggaccctgccaccaacaagagccgctgtgaatgtgagcacaacacctgtggggacagctgtgaccagtgctgccccggcttccaccagaagccctggagggctggcaccttcctgaccaagacagaatgtgaggcctgcaactgccacggcaaggccgaggagtgctactatgatgaaaatgtggcccggaggaacctgagcctgaacatccggggcaagtacatcggcggcggcgtgtgcatcaactgcacccagaacacagctggcatcaactgtgagacctgcacagatggcttcttccggcccaagggcgtgagccccaactacccccggccctgccagccctgccactgtgaccccatcggcagcctgaatgaggtgtgtgtgaaggatgagaagcacgcccggcggggcctggcccctggcagctgccactgcaagacaggctttggaggagtgtcctgtgacagatgtgcccggggctacacaggctacccagactgcaaggcctgcaactgcagcggcctgggcagcaagaatgaagacccctgcttcggcccctgcatctgcaaggaaaatgtggagggcggggactgcagccgctgcaagagcggcttcttcaacctgcaggaggacaactggaagggctgtgatgagtgcttctgcagcggcgtgagcaaccgctgccagagcagctactggacctacggcaagatccaggacatgagcggctggtacctgacagacctgcccggccgcatccgggtggccccccagcaggatgacctggacagcccccagcagatcagcatcagcaatgctgaggcccggcaggccctgccccacagctactactggagcgccccagccccctacctgggcaacaagctgcctgctgtgggcggccagctgaccttcaccatctcctatgacctggaggaggaggaggaggacacagagcgggtgctgcagctgatgatcatcctggagggcaatgacctgagcatcagcacagcccaggatgaggtgtacctgcaccccagcgaggagcacaccaacgtgctgctgctgaaggaggagagcttcaccatccacggcacccacttccctgtgcggaggaaggagttcatgacagtgctggccaacctgaagagggtgctgctgcagatcacctacagctttggcatggatgccatcttccggctgagctctgtgaacctggagagcgctgtgtcctaccccacagatggcagcattgctgctgctgtggaggtgtgccagtgccccccaggctacacaggcagcagctgtgagagctgctggcccaggcacagaagagtgaatggcaccatctttggaggcatctgtgagccctgccagtgcttcggccatgctgagagctgtgatgatgtgactggagagtgcctgaactgcaaggaccacactggaggcccctactgtgacaagtgcctgcccggcttctatggagagcccaccaagggcaccagcgaggactgccagccctgtgcctgccccctgaacatccccagcaacaacttcagccccacctgccacctggacaggagcctgggcctcatctgtgatggctgccctgtgggctacacaggcccccgctgtgagcgctgtgccgagggctacttcggccagcccagcgtgcctgggggcagctgccagccctgccagtgcaatgacaacctggacttcagcatccctggcagctgtgacagcctgagcggcagctgcctgatctgcaagccaggcaccaccggccgctactgtgagctgtgtgctgatggctactttggagatgctgtggatgccaagaactgccagccctgccgctgcaatgctgggggcagcttcagcgaggtgtgccacagccagacaggccagtgtgagtgccgggccaacgtgcagggccagagatgtgacaagtgcaaggccggcaccttcggcctgcagagcgcccggggctgtgtgccctgcaactgcaacagctttggcagcaagagctttgactgtgaggagagcggccagtgctggtgccagcccggggtgacaggcaagaagtgtgacagatgtgcccacggctacttcaacttccaggagggcggctgcacagcctgtgaatgtagccacctgggcaacaactgtgaccccaagacaggccgctgcatctgcccccccaacaccatcggggagaagtgcagcaaatgtgcccccaacacctggggccacagcatcaccaccggctgcaaggcctgcaactgcagcacagtgggcagcctggacttccagtgcaatgtgaacacaggccagtgcaactgccaccccaagttcagcggggccaagtgcacagagtgcagccggggccactggaactacccccgctgcaacctgtgtgactgcttcctgcctggaacagatgccaccacctgtgacagcgagaccaagaagtgcagctgcagcgaccagacaggccagtgcacctgcaaggtgaatgtggagggcatccactgtgaccgctgcaggcctgggaagtttggcctggatgccaagaaccccctgggctgcagcagctgctactgcttcggcaccaccacccagtgcagcgaggccaagggcctcatccgcacctgggtgaccctgaaggccgagcagaccatcctgcccctggtggatgaggccctgcagcacaccaccaccaagggcatcgtgttccagcaccctgagatcgtggcccacatggacctgatgagggaggacctgcacctggagcccttctactggaagctgcctgagcagtttgagggcaagaagctgatggcctatggaggcaagctgaagtatgccatctactttgaggcccgggaggagaccggcttcagcacctacaacccccaggtgatcatccggggcggcacccccacccacgcccgcatcatcgtgcgccacatggccgcccccctcatcggccagctgaccaggcatgaaattgagatgacagagaaggagtggaagtactatggagatgacccccgggtgcacaggacagtgacccgggaggacttcctggacatcctgtatgacatccactacatcctgatcaaggccacctacggcaacttcatgaggcagagccgcatcagcgagatctccatggaggtggccgagcagggccggggcaccaccatgaccccacctgctgacctgattgaaaaatgtgactgccccctgggctacagcggcctgagctgtgaggcctgcctgcccggcttctaccgcctgcggagccagcccggcggccgcaccccaggccccaccctgggcacctgtgtgccctgccagtgcaatggccacagcagcctgtgtgaccctgagaccagcatctgccagaactgccagcaccacacagctggggacttctgtgagcgctgtgccctgggctactacggcatcgtgaagggcctgcccaatgactgccagcagtgtgcctgccccctcatcagcagcagcaacaacttcagccccagctgtgtggccgagggcctggatgactaccgctgcacagcctgcccccggggctatgagggccagtactgtgagcgctgtgcccctggctacacaggcagccctggcaaccctgggggcagctgccaggagtgtgaatgtgacccctacggcagcctgcctgtgccctgtgaccctgtgacaggcttctgcacctgcaggcctggggccactggaagaaaatgtgatggctgcaagcactggcacgcccgggagggctgggagtgtgtgttctgtggagatgaatgtacaggcctgctgctgggggacctggcccggctggagcagatggtgatgagcatcaacctgaccggccccctgcctgccccctacaagatgctgtatggcctggagaacatgacccaggagctgaagcacctgctgagcccccagagggcccctgagcggctcatccagctggccgagggcaacctgaacaccctggtgacagagatgaatgagctgctgacccgggccaccaaggtgacagcagatggagagcagacaggccaggatgctgagaggaccaacacccgggccaagagcctgggggagttcatcaaggagctggccagagatgctgaggccgtgaatgagaaggccatcaagctgaatgagaccctgggcaccagagatgaggcctttgagaggaacctggagggcctgcagaaggagattgaccagatgatcaaggagctgcggaggaagaacctggagacccagaaggagattgctgaagatgagctggtggccgctgaggccctgctgaagaaggtgaagaagctgtttggagagagcagaggagaaaatgaggagatggagaaggacctgcgggagaagctggccgactacaagaacaaggtggatgatgcctgggacctgctgcgggaggccacagacaagatccgggaggccaacagactctttgctgtgaaccagaagaacatgacagccctggagaagaagaaggaggccgtggagagcggcaagaggcagatcgagaacaccctgaaggagggcaatgacatcctggatgaggccaaccggctggctgatgagatcaacagcatcattgattatgtggaggacatccagaccaagctgccccccatgtctgaggagctgaatgacaagattgatgacctgagccaggagatcaaggacaggaagctggccgagaaggtgtcccaggccgagagccatgctgcccagctgaatgacagcagcgctgtgctggatggcatcctggatgaggccaagaacatctccttcaatgccacagctgccttcaaggcctacagcaacatcaaggactacattgatgaggccgagaaggtggccaaggaggccaaggacctggcccacgaggccaccaagctggccaccggcccccggggcctgctgaaggaggatgccaagggctgcctgcagaagagcttccgcatcctgaatgaggccaagaagctggccaatgatgtgaaggaaaatgaagaccacctgaatggcctgaagaccagaattgaaaatgctgatgccagaaatggagacctgctgcggaccctgaatgacaccctgggcaagctgagcgccatccccaatgacacagctgccaagctgcaggccgtgaaggacaaggcccggcaggccaatgacacagccaaggatgtgctggcccagatcacagagctgcaccagaacctggatggcctgaagaagaactacaacaagctggccgacagcgtggccaagaccaatgctgtggtgaaggaccccagcaagaacaagatcatcgcagatgctgatgccaccgtgaagaacctggagcaggaggccgaccggctgattgacaagctgaagcccatcaaggagctggaggacaacctgaagaagaacatcagcgagatcaaggagctgatcaaccaggccaggaagcaggccaacagcatcaaggtgtctgtgagcagcggcggggactgcatccgcacctacaagccagagatcaagaagggcagctacaacaacatcgtggtgaatgtgaagacagctgtggccgacaacctgctcttctacctgggcagcgccaagttcatcgacttcctggccatcgagatgaggaagggcaaggtgtccttcctgtgggatgtgggcagcggcgtgggccgggtggagtacccagacctgaccattgatgacagctactggtaccgcatcgtggccagcaggactggaagaaatggcaccatctctgtgcgggccctggatggccccaaggccagcatcgtgcccagcacccaccacagcaccagccccccaggctacaccatcctggatgtggatgccaatgccatgctgtttgtgggcggcctgaccgggaagctgaagaaggcagatgctgtgcgggtcatcaccttcaccggctgcatgggagagacctactttgacaacaagcccatcggcctgtggaacttccgggagaaggagggggactgcaagggctgcaccgtgagcccccaggtggaggacagcgagggcaccatccagtttgatggagagggctacgccctggtgtcccggcccatccgctggtaccccaacatcagcacagtgatgttcaagttccgcaccttcagcagcagcgccctgctgatgtacctggccacccgggacctgcgggacttcatgtctgtggagctgacagatggccacatcaaggtgtcctatgacctgggcagcggcatggcctctgtggtgagcaaccagaaccacaatgatggcaagtggaagagcttcaccctgagccgcatccagaagcaggccaacatcagcatcgtggacatcgacaccaaccaggaggagaacatcgccaccagcagcagcggcaacaactttggcctggacctgaaggcagatgacaagatctactttggaggcctgcccaccctgaggaacctgtccatgaaggcccggcctgaggtgaacctgaagaagtacagcggctgcctgaaggacatcgagatcagcaggaccccctacaacatcctgagcagcccagactatgtgggcgtgaccaagggctgcagcctggagaatgtgtacacagtgtccttccccaagccaggctttgtggagctgagccctgtgcccattgatgtgggcacagagatcaacctgtccttcagcaccaagaatgaaagtggcatcatcctgctgggcagcggcggcaccccagccccacccaggaggaagaggcggcagacaggccaggcctactatgccatcctgctgaacagaggccgcctggaggtgcacctgagcactggagcccggaccatgaggaagatcgtcatccggcctgagcccaacctcttccatgatggccgggagcacagcgtgcacgtggagaggacccggggcatcttcaccgtgcaggtggatgaaaatcgccgctacatgcagaacctgactgtggagcagcccatcgaggtgaagaagctgtttgtgggcggggcccctcctgagttccagcccagccccctgaggaacatccccccatttgagggctgcatctggaacctggtgatcaacagcgtgcccatggactttgcccggcctgtgtccttcaagaatgctgacatcggccgctgtgcccaccagaagctgagagaagatgaagatggagctgccccagctgagatcgtcatccagcctgagcctgtgcccaccccagccttccccacccccacccctgtgctgacccacggcccctgtgccgctgagagcgagcccgccctgctgattggcagcaagcagtttggcctgagcaggaacagccacatcgccatcgcctttgatgacaccaaggtgaagaaccggctgaccatcgagctggaggtgaggacagaagctgagagcggcctgctcttctacatggcccgcatcaaccacgccgactttgccaccgtgcagctgagaaatggcctgccctacttctcctatgacctgggcagcggggacacccacaccatgatccccaccaagatcaatgatggccagtggcacaagatcaagatcatgaggagcaagcaggagggcatcctgtatgtggatggagccagcaacagaaccatcagccccaagaaggctgacatcctggatgtggtgggcatgctgtatgtgggcggcctgcccatcaactacaccaccaggagaattggccctgtgacctacagcattgatggctgtgtgaggaacctgcacatggccgaggccccagctgacctggagcagcccaccagcagcttccacgtgggcacctgctttgccaatgcccagaggggcacctactttgatggcactggatttgccaaggctgtgggcggcttcaaggtgggcctggacctgctggtggagtttgagttccgcaccaccaccaccaccggggtgctgctgggcatcagcagccagaagatggatggcatgggcatcgagatgattgatgagaagctgatgttccacgtggacaatggagctggccgcttcaccgctgtgtatgatgctggggtgcccggccacctgtgtgatggccagtggcacaaggtgacagccaacaagatcaagcacagaattgagctgactgtggatggcaaccaggtggaggcccagagccccaacccagccagcaccagcgctgacaccaatgaccctgtgtttgtgggcggcttcccagatgacctgaagcagtttggcctgaccaccagcatccccttccggggctgcatccgcagcctgaagctgaccaagggcaccgggaagcccctggaggtgaactttgccaaggccctggagctgcggggcgtgcagcctgtgtcctgcccagccaactag

SEQ ID NO: 157279 - DNA, 3387 bp, Artificial Sequence
  Description of Artificial Sequence: Synthetic coding sequence
aagaagctggccaatgatgtgaaggaaaatgaagaccacctgaatggcctgaagaccagaattgaaaatgctgatgccagaaatggagacctgctgcggaccctgaatgacaccctgggcaagctgagcgccatccccaatgacacagctgccaagctgcaggccgtgaaggacaaggcccggcaggccaatgacacagccaaggatgtgctggcccagatcacagagctgcaccagaacctggatggcctgaagaagaactacaacaagctggccgacagcgtggccaagaccaatgctgtggtgaaggaccccagcaagaacacagtggctgatgctgatgccaccgtgaagaacctggagcaggaggccgaccggctgattgacaagctgaagcccatcaaggagctggaggacaacctgaagaagaacatcagcgagatcaaggagctgatcaaccaggccaggaagcaggccaacagcatcaaggtgtctgtgagcagcggcggggactgcatccgcacctacaagccagagatcaagaagggcagctacaacaacatcgtggtgaatgtgaagacagctgtggccgacaacctgctcttctacctgggcagcgccaagttcatcgacttcctggccatcgagatgaggaagggcaaggtgtccttcctgtgggatgtgggcagcggcgtgggccgggtggagtacccagacctgaccattgatgacagctactggtaccgcatcgtggccagcaggactggaagaaatggcaccatctctgtgcgggccctggatggccccaaggccagcatcgtgcccagcacccaccacagcaccagccccccaggctacaccatcctggatgtggatgccaatgccatgctgtttgtgggcggcctgaccgggaagctgaagaaggcagatgctgtgcgggtcatcaccttcaccggctgcatgggagagacctactttgacaacaagcccatcggcctgtggaacttccgggagaaggagggggactgcaagggctgcaccgtgagcccccaggtggaggacagcgagggcaccatccagtttgatggagagggctacgccctggtgtcccggcccatccgctggtaccccaacatcagcacagtgatgttcaagttccgcaccttcagcagcagcgccctgctgatgtacctggccacccgggacctgcgggacttcatgtctgtggagctgacagatggccacatcaaggtgtcctatgacctgggcagcggcatggcctctgtggtgagcaaccagaaccacaatgatggcaagtggaagagcttcaccctgagccgcatccagaagcaggccaacatcagcatcgtggacatcgacaccaaccaggaggagaacatcgccaccagcagcagcggcaacaactttggcctggacctgaaggcagatgacaagatctactttggaggcctgcccaccctgaggaacctgtccatgaaggcccggcctgaggtgaacctgaagaagtacagcggctgcctgaaggacatcgagatcagcaggaccccctacaacatcctgagcagcccagactatgtgggcgtgaccaagggctgcagcctggagaatgtgtacacagtgtccttccccaagccaggctttgtggagctgagccctgtgcccattgatgtgggcacagagatcaacctgtccttcagcaccaagaatgaaagtggcatcatcctgctgggcagcggcggcaccccagccccacccaggaggaagaggcggcagacaggccaggcctactatgccatcctgctgaacagaggccgcctggaggtgcacctgagcactggagcccggaccatgaggaagatcgtcatccggcctgagcccaacctcttccatgatggccgggagcacagcgtgcacgtggagaggacccggggcatcttcaccgtgcaggtggatgaaaatcgccgctacatgcagaacctgactgtggagcagcccatcgaggtgaagaagctgtttgtgggcggggcccctcctgagttccagcccagccccctgaggaacatccccccatttgagggctgcatctggaacctggtgatcaacagcgtgcccatggactttgcccggcctgtgtccttcaagaatgctgacatcggccgctgtgcccaccagaagctgagagaagatgaagatggagctgccccagctgagatcgtcatccagcctgagcctgtgcccaccccagccttccccacccccacccctgtgctgacccacggcccctgtgccgctgagagcgagcccgccctgctgattggcagcaagcagtttggcctgagcaggaacagccacatcgccatcgcctttgatgacaccaaggtgaagaaccggctgaccatcgagctggaggtgaggacagaagctgagagcggcctgctcttctacatggcccgcatcaaccacgccgactttgccaccgtgcagctgagaaatggcctgccctacttctcctatgacctgggcagcggggacacccacaccatgatccccaccaagatcaatgatggccagtggcacaagatcaagatcatgaggagcaagcaggagggcatcctgtatgtggatggagccagcaacagaaccatcagccccaagaaggctgacatcctggatgtggtgggcatgctgtatgtgggcggcctgcccatcaactacaccaccaggagaattggccctgtgacctacagcattgatggctgtgtgaggaacctgcacatggccgaggccccagctgacctggagcagcccaccagcagcttccacgtgggcacctgctttgccaatgcccagaggggcacctactttgatggcactggatttgccaaggctgtgggcggcttcaaggtgggcctggacctgctggtggagtttgagttccgcaccaccaccaccaccggggtgctgctgggcatcagcagccagaagatggatggcatgggcatcgagatgattgatgagaagctgatgttccacgtggacaatggagctggccgcttcaccgctgtgtatgatgctggggtgcccggccacctgtgtgatggccagtggcacaaggtgacagccaacaagatcaagcacagaattgagctgactgtggatggcaaccaggtggaggcccagagccccaacccagccagcaccagcgctgacaccaatgaccctgtgtttgtgggcggcttcccagatgacctgaagcagtttggcctgaccaccagcatccccttccggggctgcatccgcagcctgaagctgaccaagggcacagccagccactggaggctcatcctgccccggccctggaactag

SEQ ID NO: 157280 - DNA, 5175 bp, Artificial Sequence
  Description of Artificial Sequence: Synthetic coding sequence
atgcccccagctgtgcggcgcagcgcctgcagcatgggctggctgtggatctttggagctgccctgggccagtgcctgggctacagcagccagcagcagagggtgcccttcctgcagcccccaggccagagccagctgcaggccagctatgtggagttccggcccagccagggctgcagccctggctactacagagaccacaagggcctgtacacaggccgctgtgtgccctgcaactgcaatggccacagcaaccagtgccaggacggcagcggcatctgtgtgaactgccagcacaacacagctggggagcactgtgagcgctgccaggagggctactatggaaatgctgtgcacggcagctgccgggcctgcccctgcccccacaccaacagctttgccaccggctgtgtggtgaatggaggagatgtgcgctgcagctgcaaggccggctacacaggcacccagtgtgagcgctgtgcccctggctactttggaaacccccagaagtttggaggcagctgccagccctgcagctgcaacagcaatggccagctgggcagctgccaccccctgactggagactgcatcaaccaggagcccaaggacagcagccctgcagaagaatgtgatgactgtgacagctgtgtgatgaccctgctgaatgacctggccaccatgggagagcagctgcggctggtgaagagccagctgcagggcctgagcgccagcgctggcctgctggagcagatgaggcacatggagacccaggccaaggacctgaggaaccagctgctgaactaccgcagcgccatcagcaaccacggcagcaagattgagggcctggagcgggagctgacagacctgaaccaggagtttgagaccctgcaggagaaggcccaggtgaacagcaggaaggcccagaccctgaacaacaacgtgaacagagccacccagagcgccaaggagctggatgtgaagatcaagaatgtcatcagaaatgtgcacatcctgctgaagcagatctctggaacagatggagagggcaacaacgtgcccagcggggacttcagccgggagtgggccgaggcccagaggatgatgagggagctgaggaacagaaactttgggaagcacctgcgggaggccgaggccgacaagcgggagagccagctgctgctgaaccgcatccgcacctggcagaagacccaccagggagaaaataatggcctggccaacagcatccgggacagcctgaatgaatatgaggccaagctgagtgacctgcgggcccggctgcaggaggccgccgcccaggccaagcaggccaacggcctgaaccaggagaatgaaagagccctgggcgccatccagaggcaggtgaaggagatcaacagcctgcagagcgacttcaccaagtacctgaccacagctgacagcagcctgctgcagaccaacatcgccctgcagctgatggagaagagccagaaggagtatgagaagctggccgccagcctgaatgaggcccggcaggagctgagtgacaaggtgcgggagctgagccgctctgctgggaagaccagcctggtggaggaggccgagaagcacgcccggagcctgcaggagctggccaagcagctggaggagatcaagagaaatgccagcggagatgagctggtgcgctgtgctgtggatgctgccacagcctatgagaacatcctgaatgccatcaaggccgcagaagatgctgccaacagagctgccagcgccagcgagagcgccctgcagaccgtcatcaaggaggacctgcccaggaaggccaagaccctgagcagcaacagcgacaagctgctgaatgaggccaagatgacccagaagaagctgaagcaggaggtgtccccagccctgaacaacctgcagcagaccctgaacatcgtgacagtgcagaaggaggtgattgacaccaacctgaccaccctgagagatggcctgcacggcatccagagaggagacattgatgccatgatcagcagcgccaagtccatggtgaggaaggccaatgacatcacagatgaggtgctggatggcctgaaccccatccagacagatgtggagcgcatcaaggacacctacggccgcacccagaatgaagacttcaagaaggccctgacagatgctgacaacagcgtgaacaagctgaccaacaagctgcctgacctgtggaggaagattgagagcatcaaccagcagctgctgcccctgggcaacatcagtgacaacatggaccgcatccgggagctgatccagcaggccagagatgctgccagcaaggtggccgtgcccatgaggttcaacgggaagagcggcgtggaggtgcggctgcccaatgacctggaggacctgaagggctacaccagcctgagcctcttcctgcagaggcccaacagccgggagaatggaggaacagagaacatgtttgtgatgtacctgggcaacaaggatgccagccgggactacatcggcatggctgtggtggatggccagctgacctgtgtgtacaacctgggggaccgggaggccgagctgcaggtggaccagatcctgaccaagtctgagaccaaggaggccgtgatggacagagtgaagttccagaggatctaccagtttgcccggctgaactacaccaagggggccaccagcagcaagccagagaccccaggagtgtatgacatggatggcaggaacagcaacaccctgctgaacctggaccctgaaaatgtggtgttctacgtgggcggctaccccccagacttcaagctgcccagccggctgtccttccccccctacaagggctgcatcgagctggatgacctgaatgaaaatgtgctgagcctgtacaacttcaagaagaccttcaacctgaacaccacagaggtggagccctgcagaagaaggaaggaggagagtgacaagaactactttgagggcaccggctacgcccgggtgcccacccagccccacgcccccatccccaccttcggccagaccatccagaccaccgtggaccggggcctgctcttctttgctgaaaatggagaccgcttcatcagcctgaacattgaagatggcaagctgatggtgcgctacaagctgaacagcgagctgcccaaggagcggggcgtgggagatgccatcaacaacggccgggaccacagcatccagatcaagattggcaagctgcagaagaggatgtggatcaacgtggatgtgcagaacaccatcattgatggagaggtgtttgacttcagcacctactacctgggcggcatccccatcgccatccgggagcgcttcaacatcagcaccccagccttccggggctgcatgaagaacctgaagaagaccagcggcgtggtgcggctgaatgacacagtgggcgtgaccaagaagtgcagcgaggactggaagctggtgcgcagcgccagcttcagccggggcggccagctgtccttcacagacctgggcctgcccccaacagaccacctgcaggccagctttggcttccagaccttccagcccagcggcatcctgctggaccaccagacctggaccaggaacctgcaggtgaccctggaggatggctacatcgagctgagcaccagtgacagcggcagccccatcttcaagagcccccagacctacatggatggcctgctgcactacgtgtctgtcatcagtgacaacagcggcctgcggctgctgattgatgaccagctgctgaggaacagcaagaggctgaagcacatcagcagcagccggcagagcctgcggctgggcggcagcaactttgagggctgcatcagcaatgtgtttgtgcagaggctgagcctgagccctgaggtgctggacctgaccagcaacagcctgaagagagatgtgtccctgggcggctgcagcctgaacaagccacccttcctgatgctgctgaagggcagcacccgcttcaacaagaccaagaccttccgcatcaaccagctgctgcaggacacccctgtggccagccccaggtctgtgaaggtgtggcaggatgcctgcagccccctgcccaagacccaggccaaccacggggccctgcagtttggagacatccccaccagccacctgctcttcaagctgccccaggagctgctgaagcccaggagccagtttgctgtggacatgcagaccaccagcagccggggcctggtgttccacacaggcaccaagaacagcttcatggccctgtacctgagcaagggccgcctggtgtttgccctgggcacagatggcaagaagctgcgcatcaagagcaaggagaagtgcaatgatggcaagtggcacacagtggtgtttggacatgatggagagaagggccgcctggtggtggatggcctgcgggcccgggagggcagcctgcccggcaacagcaccatcagcatccgggcccctgtgtacctgggcagcccccccagcggcaagcccaagagcctgcccaccaacagctttgtgggctgcctgaagaacttccagctggacagcaagcccctgtacacccccagcagcagctttggagtgagcagctgcctgggcggccccctggagaagggcatctacttcagcgaggagggcggccacgtggtgctggcccacagcgtgctgctgggccctgagttcaagctggtgttcagcatccggcccaggagcctgaccggcatcctgatccacatcggcagccagcccgggaagcacctgtgtgtgtacctggaggccggcaaggtgacagcctccatggacagcggggccggcggcaccagcacctctgtgacccccaagcagagcctgtgtgatggccagtggcacagcgtggccgtgaccatcaagcagcacatcctgcacctggagctggacacagacagcagctacacagctggccagatccccttccccccagccagcacccaggagcccctgcacctgggcggggccccagccaacctgaccaccctgcgcatccctgtgtggaagagcttcttcggctgcctgaggaacatccacgtgaaccacatccctgtgcctgtgacagaggccctggaggtgcagggccctgtgtccctgaatggctgcccagaccagtag

SEQ ID NO: 157281 - DNA, 10002 bp, Artificial Sequence
  Description of Artificial Sequence: Synthetic coding sequence
atggctgctgctgcccggccccggggccgggccctgggccctgtgctgccccccacccccctgctgctgctggtgctgcgggtgctgcctgcctgtggggccacagcccgggaccctggagctgctgctggcctgagcctgcaccccacctacttcaacctggccgaggccgcccgcatctgggccacagccacctgtggggagcggggccctggagagggccggccccagcctgagctgtactgcaagctggtgggcggccccacagcccctggcagcggccacaccatccagggccagttctgtgactactgcaacagcgaggaccccaggaaggcccaccctgtgaccaatgccattgatggcagcgagcgctggtggcagagcccccccctgagcagcggcacccagtacaacagagtgaacctgaccctggacctgggccagctgttccacgtggcctacatcctgatcaagtttgccaacagccccaggccagacctgtgggtgctggagaggtctgtggactttggcagcacctacagcccctggcagtactttgcccacagcaaggtggactgcctgaaggagtttggccgggaggccaacatggctgtgaccagagatgatgatgtgctgtgtgtgacagagtacagcagaattgtgcccctggagaatggagaggtggtggtgtccctcatcaatggccggcctggggccaagaacttcaccttcagccacaccctgcgggagttcaccaaggccaccaacatccggctgcgcttcctgcggaccaacaccctgctgggccacctgatcagcaaggcccagagggaccccaccgtgacccggcgctactactacagcatcaaggacatcagcattggaggccagtgtgtgtgcaatggacatgctgaggtgtgcaacatcaacaaccctgagaagctgttccgctgtgagtgccagcaccacacctgtggggagacctgtgaccgctgctgcaccggctacaaccagaggcgctggaggcctgctgcctgggagcagagccatgaatgtgaggcctgcaactgccacggccacgccagcaactgctactatgaccctgatgtggagcggcagcaggccagcctgaacacccagggcatctatgccggcggcggcgtgtgcatcaactgccagcacaacacagctggggtgaactgtgagcagtgtgccaagggctactaccggccctatggagtgcctgtggatgccccagatggctgcatcccctgcagctgtgaccctgagcacgcagatggctgtgagcagggcagcggccgctgccactgcaagcccaacttccacggggacaactgtgagaagtgtgccatcggctactacaacttccccttctgcctgcgcatccccatcttccctgtgtccacccccagcagtgaagatcctgtggccggggacatcaagggctgtgactgcaacctggagggcgtgctgcctgagatctgtgatgcccacggccgctgcctgtgcaggcctggggtggagggcccccgctgtgacacctgccgcagcggcttctacagcttccccatctgccaggcctgctggtgcagcgccctgggcagctaccagatgccctgcagctctgtgacaggccagtgtgagtgcaggcctggggtgacaggccagagatgtgaccgctgcctgagcggggcctatgacttcccccactgccagggcagcagcagcgcctgtgaccctgctggcaccatcaacagcaacctgggctactgccagtgcaagctgcacgtggagggccccacctgcagccgctgcaagctgctgtactggaacctggacaaggagaaccccagcggctgcagcgagtgcaagtgccacaaggccggcaccgtgtctggcaccggggagtgccggcagggagatggagactgccactgcaagagccacgtgggcggggacagctgtgacacctgtgaagatggctactttgccctggagaagagcaactacttcggctgccagggctgccagtgtgacatcggcggggccctgagctccatgtgcagcggccccagcggcgtgtgccagtgccgggagcacgtggtgggcaaggtgtgccagaggcctgagaacaactactacttcccagacctgcaccacatgaagtatgaaattgaagatggcagcacccccaacggccgggacctgcgcttcggctttgaccccctggccttccctgagttctcctggaggggctacgcccagatgacctctgtgcagaatgatgtgcgcatcaccctgaatgtgggcaagagcagcggcagcctcttccgggtcatcctgcgctacgtgaaccctggaacagaggccgtgtctggccacatcaccatctaccccagctggggcgccgcccagagcaaggagatcatcttcctgcccagcaaggagcccgcctttgtgacagtgcctggaaatggatttgctgaccccttcagcatcaccccaggcatctgggtggcctgcatcaaggccgagggcgtgctgctggactacctggtgctgctgccccgggactactatgaggcctctgtgctgcagctgcctgtgacagagccctgtgcctatgccggccccccccaggagaactgcctgctgtaccagcacctgcctgtgacccgcttcccctgcaccctggcctgtgaggcccggcacttcctgctggatggagagcccaggcctgtggccgtgcggcagcccaccccagcccaccctgtgatggtggacctgagcggccgggaggtggagctgcacctgcggctgcgcatcccccaggtgggccactacgtggtggtggtggagtacagcacagaggccgcccagctgtttgtggtggatgtgaatgtgaagagcagcggctctgtgctggccggccaggtgaacatctacagctgcaactacagcgtgctgtgccgctctgctgtgattgaccacatgagcagaattgccatgtatgagctgctggctgatgctgacatccagctgaagggccacatggcccgcttcctgctgcaccaggtgtgcatcatccccatcgaggagttcagcgcagaatatgtgcggccccaggtgcactgcatcgccagctatggccgctttgtgaaccagagcgccacctgtgtgtccctggcccacgagaccccacccacagccctgatcctggatgtgctgagcggccggcccttcccccacctgccccagcagagcagccccagcgtggatgtgctgcccggggtgaccctgaaggccccccagaaccaggtgaccctgcggggccgggtgccccacctgggccgctacgtgtttgtgatccacttctaccaggccgcccaccccaccttccctgcccaggtgtctgtggatggcggctggccccgggccggcagcttccacgccagcttctgcccccacgtgctgggctgccgggaccaggtgattgctgagggccagatcgagtttgacatcagcgagcctgaggtggccgccaccgtgaaggtgcctgagggcaagagcctggtgctggtgcgggtgctggtggtgcctgctgagaactatgactaccagatcctgcacaagaagtccatggacaagagcctggagttcatcaccaactgtgggaagaacagcttctacctggacccccagacagccagccgcttctgcaagaacagcgcccggagcctggtggccttctaccacaagggggccctgccctgtgagtgccaccccactggagccaccggcccccactgcagccctgagggcggccagtgcccctgccagcccaacgtcatcggccggcagtgcacccgctgtgccaccggccactacggcttcccccgctgcaagccctgcagctgtggccggcggctgtgtgaggagatgacaggccagtgccgctgcccccccaggacagtgcggccccagtgtgaggtgtgtgagacccacagcttctccttccaccccatggccggctgtgagggctgcaactgcagccggcggggcaccatcgaggccgccatgccagaatgtgaccgggacagcggccagtgccgctgcaagccccgcatcaccggccggcagtgtgacagatgtgccagcggcttctaccgcttcccagaatgtgtgccctgcaactgcaacagagatggaacagagcccggggtgtgtgaccccggcactggagcctgcctgtgcaaggaaaatgtggagggcacagagtgcaatgtgtgccgggagggcagcttccacctggaccctgccaacctgaagggctgcaccagctgcttctgctttggagtgaacaaccagtgccacagcagccacaagaggaggaccaagtttgtggacatgctgggctggcacctggagacagctgacagagtggacatccctgtgtccttcaaccctggcagcaacagcatggtggccgacctgcaggagctgcctgccaccatccacagcgcctcctgggtggcccccaccagctacctgggggacaaggtgtcctcctatggaggctacctgacctaccaggccaagagctttggcctgcccggggacatggtgctgctggagaagaagccagatgtgcagctgaccggccagcacatgagcatcatctatgaggagaccaacacccccaggccagaccggctgcaccacggccgggtgcacgtggtggagggcaacttcagacatgccagcagccgggcccctgtgtcccgggaggagctgatgacagtgctgagccggctggctgatgtgcgcatccagggcctgtacttcacagagacccagaggctgaccctgtctgaggtgggcctggaggaggccagtgacaccggcagcggcagaattgccctggccgtggagatctgtgcctgccccccagcctatgctggggacagctgccagggctgcagccctggctactacagagaccacaagggcctgtacacaggccgctgtgtgccctgcaactgcaatggccacagcaaccagtgccaggacggcagcggcatctgtgtgaactgccagcacaacacagctggggagcactgtgagcgctgccaggagggctactatggaaatgctgtgcacggcagctgccgggcctgcccctgcccccacaccaacagctttgccaccggctgtgtggtgaatggaggagatgtgcgctgcagctgcaaggccggctacacaggcacccagtgtgagcgctgtgcccctggctacttcggcaacccccagaagtttggaggcagctgccagccctgcagctgcaacagcaatggccagctgggcagctgccaccccctgaccggggactgcatcaaccaggagcccaaggacagcagccctgctgaggagtgtgatgactgtgacagctgtgtgatgaccctgctgaatgacctggccaccatgggagagcagctgcggctggtgaagagccagctgcagggcctgagcgccagcgctggcctgctggagcagatgaggcacatggagacccaggccaaggacctgaggaaccagctgctgaactacagaagtgccatcagcaaccacggcagcaagattgagggcctggagcgggagctgacagacctgaaccaggagtttgagaccctgcaggagaaggcccaggtgaacagcaggaaggcccagaccctgaacaacaacgtgaacagagccacccagagcgccaaggagctggatgtgaagatcaagaatgtcatcagaaatgtgcacatcctgctgaagcagatcagcggcacagatggagagggcaacaacgtgcccagcggggacttcagccgggagtgggccgaggcccagaggatgatgagggagctgaggaacagaaactttgggaagcacctgcgggaggccgaggccgacaagcgggagagccagctgctgctgaaccgcatccgcacctggcagaagacccaccagggcgagaacaacggcctggccaacagcatccgggacagcctgaatgaatatgaggccaagctgagtgacctgcgggcccggctgcaggaggccgccgcccaggccaagcaggccaacggcctgaaccaggagaatgaaagagccctgggcgccatccagaggcaggtgaaggagatcaacagcctgcagagcgacttcaccaagtacctgaccacagctgacagcagcctgctgcagaccaacatcgccctgcagctgatggagaagagccagaaggagtatgagaagctggccgccagcctgaatgaggcccggcaggagctgagtgacaaggtgcgggagctgagccgctctgctgggaagaccagcctggtggaggaggccgagaagcacgcccggagcctgcaggagctggccaagcagctggaggagatcaagagaaatgccagcggagatgagctggtgcgctgtgctgtggatgctgccacagcctatgagaacatcctgaatgccatcaaggctgctgaagatgctgccaacagagctgccagcgccagcgagagcgccctgcagaccgtcatcaaggaggacctgcccaggaaggccaagaccctgagcagcaacagcgacaagctgctgaatgaggccaagatgacccagaagaagctgaagcaggaggtgtccccagccctgaacaacctgcagcagaccctgaacatcgtgacagtgcagaaggaggtgattgacaccaacctgaccaccctgagagatggcctgcacggcatccagagaggagacattgatgccatgatcagcagcgccaagtccatggtgaggaaggccaatgacatcacagatgaggtgctggatggcctgaaccccatccagacagatgtggagcgcatcaaggacacctacggccgcacccagaatgaagacttcaagaaggccctgacagatgctgacaacagcgtgaacaagctgaccaacaagctgcctgacctgtggaggaagattgagagcatcaaccagcagctgctgcccctgggcaacatcagtgacaacatggaccgcatccgggagctgatccagcaggccagagatgctgccagcaaggtggccgtgcccatgaggttcaacgggaagtctggagtggaggtgcggctgcccaatgacctggaggacctgaagggctacaccagcctgagcctcttcctgcagaggcccaacagcagagaaaatggaggaacagagaacatgtttgtgatgtacctgggcaacaaggatgccagccgggactacatcggcatggctgtggtggatggccagctgacctgtgtgtacaacctgggggaccgggaggccgagctgcaggtggaccagatcctgaccaagtctgagaccaaggaggccgtgatggacagagtgaagttccagaggatctaccagtttgcccggctgaactacaccaagggggccaccagcagcaagccagagaccccaggagtgtatgacatggatggaagaaacagcaacaccctgctgaacctggaccctgaaaatgtggtgttctacgtgggcggctaccccccagacttcaagctgcccagccggctgtccttccccccctacaagggctgcatcgagctggatgacctgaatgaaaatgtgctgagcctgtacaacttcaagaagaccttcaacctgaacaccacagaggtggagccctgcagaagaaggaaggaggagagtgacaagaactactttgagggcaccggctacgcccgggtgcccacccagccccacgcccccatccccaccttcggccagaccatccagaccaccgtggaccggggcctgctcttctttgctgaaaatggagaccgcttcatcagcctgaacattgaagatggcaagctgatggtgcgctacaagctgaacagcgagctgcccaaggagcggggcgtgggagatgccatcaacaacggccgggaccacagcatccagatcaagattggcaagctgcagaagaggatgtggatcaacgtggatgtgcagaacaccatcattgatggagaggtgtttgacttcagcacctactacctgggcggcatccccatcgccatccgggagcgcttcaacatcagcaccccagccttccggggctgcatgaagaacctgaagaagaccagcggcgtggtgcggctgaatgacacagtgggcgtgaccaagaagtgcagcgaggactggaagctggtgcgcagcgccagcttcagcagaggaggccagctgtccttcacagacctgggcctgcccccaacagaccacctgcaggccagctttggcttccagaccttccagcccagcggcatcctgctggaccaccagacctggaccaggaacctgcaggtgaccctggaggatggctacatcgagctgagcaccagtgacagcggcagccccatcttcaagagcccccagacctacatggatggcctgctgcactacgtgtctgtcatcagtgacaacagcggcctgcggctgctgattgatgaccagctgctgaggaacagcaagaggctgaagcacatcagcagcagccggcagagcctgcggctgggcggcagcaactttgagggctgcatcagcaatgtgtttgtgcagaggctgagcctgagccctgaggtgctggacctgaccagcaacagcctgaagagagatgtgtccctgggcggctgcagcctgaacaagccacccttcctgatgctgctgaagggcagcacccgcttcaacaagaccaagaccttccgcatcaaccagctgctgcaggacacccctgtggccagccccaggtctgtgaaggtgtggcaggatgcctgcagccccctgcccaagacccaggccaaccacggggccctgcagtttggagacatccccaccagccacctgctcttcaagctgccccaggagctgctgaagcccaggagccagtttgctgtggacatgcagaccaccagcagccggggcctggtgttccacacaggcaccaagaacagcttcatggccctgtacctgagcaagggccgcctggtgtttgccctgggcacagatggcaagaagctgcgcatcaagagcaaggagaagtgcaatgatggcaagtggcacacagtggtgtttggacatgatggagagaagggccgcctggtggtggatggcctgcgggcccgggagggcagcctgcccggcaacagcaccatcagcatccgggcccctgtgtacctgggcagccccccatctgggaagcccaagagcctgcccaccaacagctttgtgggctgcctgaagaacttccagctggacagcaagcccctgtacacccccagcagcagctttggagtgagcagctgcctgggcggccccctggagaagggcatctacttcagcgaggagggcggccacgtggtgctggcccacagcgtgctgctgggccctgagttcaagctggtgttcagcatccggcccaggagcctgaccggcatcctgatccacatcggcagccagcccgggaagcacctgtgtgtgtacctggaggccggcaaggtgacagcctccatggattctggagctgggggcaccagcacctctgtgacccccaagcagagcctgtgtgatggccagtggcacagcgtggccgtgaccatcaagcagcacatcctgcacctggagctggacacagacagcagctacacagctggccagatccccttccccccagccagcacccaggagcccctgcacctgggcggggccccagccaacctgaccaccctgcgcatccctgtgtggaagagcttcttcggctgcctgaggaacatccacgtgaaccacatccctgtgcctgtgacagaggccctggaggtgcagggccctgtgtccctgaatggctgcccagaccagtag

SEQ ID NO: 157282 - DNA, 9834 bp, Artificial Sequence
  Description of Artificial Sequence: Synthetic coding sequence
atggctgctgctgcccggccccggggccgggccctgggccctgtgctgccccccacccccctgctgctgctggtgctgcgggtgctgcctgcctgtggggccacagcccgggaccctggagctgctgctggcctgagcctgcaccccacctacttcaacctggccgaggccgcccgcatctgggccacagccacctgtggggagcggggccctggagagggccggccccagcctgagctgtactgcaagctggtgggcggccccacagcccctggcagcggccacaccatccagggccagttctgtgactactgcaacagcgaggaccccaggaaggcccaccctgtgaccaatgccattgatggcagcgagcgctggtggcagagcccccccctgagcagcggcacccagtacaacagagtgaacctgaccctggacctgggccagctgttccacgtggcctacatcctgatcaagtttgccaacagccccaggccagacctgtgggtgctggagaggtctgtggactttggcagcacctacagcccctggcagtactttgcccacagcaaggtggactgcctgaaggagtttggccgggaggccaacatggctgtgaccagagatgatgatgtgctgtgtgtgacagagtacagcagaattgtgcccctggagaatggagaggtggtggtgtccctcatcaatggccggcctggggccaagaacttcaccttcagccacaccctgcgggagttcaccaaggccaccaacatccggctgcgcttcctgcggaccaacaccctgctgggccacctgatcagcaaggcccagagggaccccaccgtgacccggcgctactactacagcatcaaggacatcagcattggaggccagtgtgtgtgcaatggacatgctgaggtgtgcaacatcaacaaccctgagaagctgttccgctgtgagtgccagcaccacacctgtggggagacctgtgaccgctgctgcaccggctacaaccagaggcgctggaggcctgctgcctgggagcagagccatgaatgtgaggcctgcaactgccacggccacgccagcaactgctactatgaccctgatgtggagcggcagcaggccagcctgaacacccagggcatctatgccggcggcggcgtgtgcatcaactgccagcacaacacagctggggtgaactgtgagcagtgtgccaagggctactaccggccctatggagtgcctgtggatgccccagatggctgcatcccctgcagctgtgaccctgagcacgcagatggctgtgagcagggcagcggccgctgccactgcaagcccaacttccacggggacaactgtgagaagtgtgccatcggctactacaacttccccttctgcctgcgcatccccatcttccctgtgtccacccccagcagtgaagatcctgtggccggggacatcaagggctgtgactgcaacctggagggcgtgctgcctgagatctgtgatgcccacggccgctgcctgtgcaggcctggggtggagggcccccgctgtgacacctgccgcagcggcttctacagcttccccatctgccaggcctgctggtgcagcgccctgggcagctaccagatgccctgcagctctgtgacaggccagtgtgagtgcaggcctggggtgacaggccagagatgtgaccgctgcctgagcggggcctatgacttcccccactgccagggcagcagcagcgcctgtgaccctgctggcaccatcaacagcaacctgggctactgccagtgcaagctgcacgtggagggccccacctgcagccgctgcaagctgctgtactggaacctggacaaggagaaccccagcggctgcagcgagtgcaagtgccacaaggccggcaccgtgtctggcaccggggagtgccggcagggagatggagactgccactgcaagagccacgtgggcggggacagctgtgacacctgtgaagatggctactttgccctggagaagagcaactacttcggctgccagggctgccagtgtgacatcggcggggccctgagctccatgtgcagcggccccagcggcgtgtgccagtgccgggagcacgtggtgggcaaggtgtgccagaggcctgagaacaactactacttcccagacctgcaccacatgaagtatgaaattgaagatggcagcacccccaacggccgggacctgcgcttcggctttgaccccctggccttccctgagttctcctggaggggctacgcccagatgacctctgtgcagaatgatgtgcgcatcaccctgaatgtgggcaagagcagcggcagcctcttccgggtcatcctgcgctacgtgaaccctggaacagaggccgtgtctggccacatcaccatctaccccagctggggcgccgcccagagcaaggagatcatcttcctgcccagcaaggagcccgcctttgtgacagtgcctggaaatggatttgctgaccccttcagcatcaccccaggcatctgggtggcctgcatcaaggccgagggcgtgctgctggactacctggtgctgctgccccgggactactatgaggcctctgtgctgcagctgcctgtgacagagccctgtgcctatgccggccccccccaggagaactgcctgctgtaccagcacctgcctgtgacccgcttcccctgcaccctggcctgtgaggcccggcacttcctgctggatggagagcccaggcctgtggccgtgcggcagcccaccccagcccaccctgtgatggtggacctgagcggccgggaggtggagctgcacctgcggctgcgcatcccccaggtgggccactacgtggtggtggtggagtacagcacagaggccgcccagctgtttgtggtggatgtgaatgtgaagagcagcggctctgtgctggccggccaggtgaacatctacagctgcaactacagcgtgctgtgccgctctgctgtgattgaccacatgagcagaattgccatgtatgagctgctggctgatgctgacatccagctgaagggccacatggcccgcttcctgctgcaccaggtgtgcatcatccccatcgaggagttcagcgcagaatatgtgcggccccaggtgcactgcatcgccagctatggccgctttgtgaaccagagcgccacctgtgtgtccctggcccacgagaccccacccacagccctgatcctggatgtgctgagcggccggcccttcccccacctgccccagcagagcagccccagcgtggatgtgctgcccggggtgaccctgaaggccccccagaaccaggtgaccctgcggggccgggtgccccacctgggccgctacgtgtttgtgatccacttctaccaggccgcccaccccaccttccctgcccaggtgtctgtggatggcggctggccccgggccggcagcttccacgccagcttctgcccccacgtgctgggctgccgggaccaggtgattgctgagggccagatcgagtttgacatcagcgagcctgaggtggccgccaccgtgaaggtgcctgagggcaagagcctggtgctggtgcgggtgctggtggtgcctgctgagaactatgactaccagatcctgcacaagaagtccatggacaagagcctggagttcatcaccaactgtgggaagaacagcttctacctggacccccagacagccagccgcttctgcaagaacagcgcccggagcctggtggccttctaccacaagggggccctgccctgtgagtgccaccccactggagccaccggcccccactgcagccctgagggcggccagtgcccctgccagcccaacgtcatcggccggcagtgcacccgctgtgccaccggccactacggcttcccccgctgcaagccctgcagctgtggccggcggctgtgtgaggagatgacaggccagtgccgctgcccccccaggacagtgcggccccagtgtgaggtgtgtgagacccacagcttctccttccaccccatggccggctgtgagggctgcaactgcagccggcggggcaccatcgaggccgccatgccagaatgtgaccgggacagcggccagtgccgctgcaagccccgcatcaccggccggcagtgtgacagatgtgccagcggcttctaccgcttcccagaatgtgtgccctgcaactgcaacagagatggaacagagcccggggtgtgtgaccccggcactggagcctgcctgtgcaaggaaaatgtggagggcacagagtgcaatgtgtgccgggagggcagcttccacctggaccctgccaacctgaagggctgcaccagctgcttctgctttggagtgaacaaccagtgccacagcagccacaagaggaggaccaagtttgtggacatgctgggctggcacctggagacagctgacagagtggacatccctgtgtccttcaaccctggcagcaacagcatggtggccgacctgcaggagctgcctgccaccatccacagcgcctcctgggtggcccccaccagctacctgggggacaaggtgtcctcctatggaggctacctgacctaccaggccaagagctttggcctgcccggggacatggtgctgctggagaagaagccagatgtgcagctgaccggccagcacatgagcatcatctatgaggagaccaacacccccaggccagaccggctgcaccacggccgggtgcacgtggtggagggcaacttcagacatgccagcagccgggcccctgtgtcccgggaggagctgatgacagtgctgagccggctggctgatgtgcgcatccagggcctgtacttcacagagacccagaggctgaccctgtctgaggtgggcctggaggaggccagtgacaccggcagcggcagaattgccctggccgtggagatctgtgcctgccccccagcctatgctggggacagctgccagggctgcagccctggctactacagagaccacaagggcctgtacacaggccgctgtgtgccctgcaactgcaatggccacagcaaccagtgccaggacggcagcggcatctgtgtgaactgccagcacaacacagctggggagcactgtgagcgctgccaggagggctactatggaaatgctgtgcacggcagctgccgggcctgcccctgcccccacaccaacagctttgccaccggctgtgtggtgaatggaggagatgtgcgctgcagctgcaaggccggctacacaggcacccagtgtgagcgctgtgcccctggctacttcggcaacccccagaagtttggaggcagctgccagccctgcagctgcaacagcaatggccagctgggcagctgccaccccctgaccggggactgcatcaaccaggagcccaaggacagcagccctgctgaggagtgtgatgactgtgacagctgtgtgatgaccctgctgaatgacctggccaccatgggagagcagctgcggctggtgaagagccagctgcagggcctgagcgccagcgctggcctgctggagcagatgaggcacatggagacccaggccaaggacctgaggaaccagctgctgaactacagaagtgccatcagcaaccacggcagcaagattgagggcctggagcgggagctgacagacctgaaccaggagtttgagaccctgcaggagaaggcccaggtgaacagcaggaaggcccagaccctgaacaacaacgtgaacagagccacccagagcgccaaggagctggatgtgaagatcaagaatgtcatcagaaatgtgcacatgctgaaccgcatccgcacctggcagaagacccaccagggcgagaacaacggcctggccaacagcatccgggacagcctgaatgaatatgaggccaagctgagtgacctgcgggcccggctgcaggaggccgccgcccaggccaagcaggccaacggcctgaaccaggagaatgaaagagccctgggcgccatccagaggcaggtgaaggagatcaacagcctgcagagcgacttcaccaagtacctgaccacagctgacagcagcctgctgcagaccaacatcgccctgcagctgatggagaagagccagaaggagtatgagaagctggccgccagcctgaatgaggcccggcaggagctgagtgacaaggtgcgggagctgagccgctctgctgggaagaccagcctggtggaggaggccgagaagcacgcccggagcctgcaggagctggccaagcagctggaggagatcaagagaaatgccagcggagatgagctggtgcgctgtgctgtggatgctgccacagcctatgagaacatcctgaatgccatcaaggctgctgaagatgctgccaacagagctgccagcgccagcgagagcgccctgcagaccgtcatcaaggaggacctgcccaggaaggccaagaccctgagcagcaacagcgacaagctgctgaatgaggccaagatgacccagaagaagctgaagcaggaggtgtccccagccctgaacaacctgcagcagaccctgaacatcgtgacagtgcagaaggaggtgattgacaccaacctgaccaccctgagagatggcctgcacggcatccagagaggagacattgatgccatgatcagcagcgccaagtccatggtgaggaaggccaatgacatcacagatgaggtgctggatggcctgaaccccatccagacagatgtggagcgcatcaaggacacctacggccgcacccagaatgaagacttcaagaaggccctgacagatgctgacaacagcgtgaacaagctgaccaacaagctgcctgacctgtggaggaagattgagagcatcaaccagcagctgctgcccctgggcaacatcagtgacaacatggaccgcatccgggagctgatccagcaggccagagatgctgccagcaaggtggccgtgcccatgaggttcaacgggaagtctggagtggaggtgcggctgcccaatgacctggaggacctgaagggctacaccagcctgagcctcttcctgcagaggcccaacagcagagaaaatggaggaacagagaacatgtttgtgatgtacctgggcaacaaggatgccagccgggactacatcggcatggctgtggtggatggccagctgacctgtgtgtacaacctgggggaccgggaggccgagctgcaggtggaccagatcctgaccaagtctgagaccaaggaggccgtgatggacagagtgaagttccagaggatctaccagtttgcccggctgaactacaccaagggggccaccagcagcaagccagagaccccaggagtgtatgacatggatggaagaaacagcaacaccctgctgaacctggaccctgaaaatgtggtgttctacgtgggcggctaccccccagacttcaagctgcccagccggctgtccttccccccctacaagggctgcatcgagctggatgacctgaatgaaaatgtgctgagcctgtacaacttcaagaagaccttcaacctgaacaccacagaggtggagccctgcagaagaaggaaggaggagagtgacaagaactactttgagggcaccggctacgcccgggtgcccacccagccccacgcccccatccccaccttcggccagaccatccagaccaccgtggaccggggcctgctcttctttgctgaaaatggagaccgcttcatcagcctgaacattgaagatggcaagctgatggtgcgctacaagctgaacagcgagctgcccaaggagcggggcgtgggagatgccatcaacaacggccgggaccacagcatccagatcaagattggcaagctgcagaagaggatgtggatcaacgtggatgtgcagaacaccatcattgatggagaggtgtttgacttcagcacctactacctgggcggcatccccatcgccatccgggagcgcttcaacatcagcaccccagccttccggggctgcatgaagaacctgaagaagaccagcggcgtggtgcggctgaatgacacagtgggcgtgaccaagaagtgcagcgaggactggaagctggtgcgcagcgccagcttcagcagaggaggccagctgtccttcacagacctgggcctgcccccaacagaccacctgcaggccagctttggcttccagaccttccagcccagcggcatcctgctggaccaccagacctggaccaggaacctgcaggtgaccctggaggatggctacatcgagctgagcaccagtgacagcggcagccccatcttcaagagcccccagacctacatggatggcctgctgcactacgtgtctgtcatcagtgacaacagcggcctgcggctgctgattgatgaccagctgctgaggaacagcaagaggctgaagcacatcagcagcagccggcagagcctgcggctgggcggcagcaactttgagggctgcatcagcaatgtgtttgtgcagaggctgagcctgagccctgaggtgctggacctgaccagcaacagcctgaagagagatgtgtccctgggcggctgcagcctgaacaagccacccttcctgatgctgctgaagggcagcacccgcttcaacaagaccaagaccttccgcatcaaccagctgctgcaggacacccctgtggccagccccaggtctgtgaaggtgtggcaggatgcctgcagccccctgcccaagacccaggccaaccacggggccctgcagtttggagacatccccaccagccacctgctcttcaagctgccccaggagctgctgaagcccaggagccagtttgctgtggacatgcagaccaccagcagccggggcctggtgttccacacaggcaccaagaacagcttcatggccctgtacctgagcaagggccgcctggtgtttgccctgggcacagatggcaagaagctgcgcatcaagagcaaggagaagtgcaatgatggcaagtggcacacagtggtgtttggacatgatggagagaagggccgcctggtggtggatggcctgcgggcccgggagggcagcctgcccggcaacagcaccatcagcatccgggcccctgtgtacctgggcagccccccatctgggaagcccaagagcctgcccaccaacagctttgtgggctgcctgaagaacttccagctggacagcaagcccctgtacacccccagcagcagctttggagtgagcagctgcctgggcggccccctggagaagggcatctacttcagcgaggagggcggccacgtggtgctggcccacagcgtgctgctgggccctgagttcaagctggtgttcagcatccggcccaggagcctgaccggcatcctgatccacatcggcagccagcccgggaagcacctgtgtgtgtacctggaggccggcaaggtgacagcctccatggattctggagctgggggcaccagcacctctgtgacccccaagcagagcctgtgtgatggccagtggcacagcgtggccgtgaccatcaagcagcacatcctgcacctggagctggacacagacagcagctacacagctggccagatccccttccccccagccagcacccaggagcccctgcacctgggcggggccccagccaacctgaccaccctgcgcatccctgtgtggaagagcttcttcggctgcctgaggaacatccacgtgaaccacatccctgtgcctgtgacagaggccctggaggtgcagggccctgtgtccctgaatggctgcccagaccagtag

SEQ ID NO: 157283 - DNA, 4560 bp, Artificial Sequence
  Description of Artificial Sequence: Synthetic coding sequence
atggctgctgctgcccggccccggggccgggccctgggccctgtgctgccccccacccccctgctgctgctggtgctgcgggtgctgcctgcctgtggggccacagcccgggaccctggagctgctgctggcctgagcctgcaccccacctacttcaacctggccgaggccgcccgcatctgggccacagccacctgtggggagcggggccctggagagggccggccccagcctgagctgtactgcaagctggtgggcggccccacagcccctggcagcggccacaccatccagggccagttctgtgactactgcaacagcgaggaccccaggaaggcccaccctgtgaccaatgccattgatggcagcgagcgctggtggcagagcccccccctgagcagcggcacccagtacaacagagtgaacctgaccctggacctgggccagctgttccacgtggcctacatcctgatcaagtttgccaacagccccaggccagacctgtgggtgctggagaggtctgtggactttggcagcacctacagcccctggcagtactttgcccacagcaaggtggactgcctgaaggagtttggccgggaggccaacatggctgtgaccagagatgatgatgtgctgtgtgtgacagagtacagcagaattgtgcccctggagaatggagaggtggtggtgtccctcatcaatggccggcctggggccaagaacttcaccttcagccacaccctgcgggtgtaccagggcaacaagcaccccctcttcctgcggaccaacaccctgctgggccacctgatcagcaaggcccagagggaccccaccgtgacccggcgctactactacagcatcaaggacatcagcattggaggccagtgtgtgtgcaatggacatgctgaggtgtgcaacatcaacaaccctgagaagctgttccgctgtgagtgccagcaccacacctgtggggagacctgtgaccgctgctgcaccggctacaaccagaggcgctggaggcctgctgcctgggagcagagccatgaatgtgaggcctgcaactgccacggccacgccagcaactgctactatgaccctgatgtggagcggcagcaggccagcctgaacacccagggcatctatgccggcggcggcgtgtgcatcaactgccagcacaacacagctggggtgaactgtgagcagtgtgccaagggctactaccggccctatggagtgcctgtggatgccccagatggctgcatcccctgcagctgtgaccctgagcacgcagatggctgtgagcagggcagcggccgctgccactgcaagcccaacttccacggggacaactgtgagaagtgtgccatcggctactacaacttccccttctgcctgcgcatccccatcttccctgtgtccacccccagcagtgaagatcctgtggccggggacatcaagggctgtgactgcaacctggagggcgtgctgcctgagatctgtgatgcccacggccgctgcctgtgcaggcctggggtggagggcccccgctgtgacacctgccgcagcggcttctacagcttccccatctgccaggcctgctggtgcagcgccctgggcagctaccagatgccctgcagctctgtgacaggccagtgtgagtgcaggcctggggtgacaggccagagatgtgaccgctgcctgagcggggcctatgacttcccccactgccagggcagcagcagcgcctgtgaccctgctggcaccatcaacagcaacctgggctactgccagtgcaagctgcacgtggagggccccacctgcagccgctgcaagctgctgtactggaacctggacaaggagaaccccagcggctgcagcgagtgcaagtgccacaaggccggcaccgtgtctggcaccggggagtgccggcagggagatggagactgccactgcaagagccacgtgggcggggacagctgtgacacctgtgaagatggctactttgccctggagaagagcaactacttcggctgccagggctgccagtgtgacatcggcggggccctgagctccatgtgcagcggccccagcggcgtgtgccagtgccgggagcacgtggtgggcaaggtgtgccagaggcctgagaacaactactacttcccagacctgcaccacatgaagtatgaaattgaagatggcagcacccccaacggccgggacctgcgcttcggctttgaccccctggccttccctgagttctcctggaggggctacgcccagatgacctctgtgcagaatgatgtgcgcatcaccctgaatgtgggcaagagcagcggcagcctcttccgggtcatcctgcgctacgtgaaccctggaacagaggccgtgtctggccacatcaccatctaccccagctggggcgccgcccagagcaaggagatcatcttcctgcccagcaaggagcccgcctttgtgacagtgcctggaaatggatttgctgaccccttcagcatcaccccaggcatctgggtggcctgcatcaaggccgagggcgtgctgctggactacctggtgctgctgccccgggactactatgaggcctctgtgctgcagctgcctgtgacagagccctgtgcctatgccggccccccccaggagaactgcctgctgtaccagcacctgcctgtgacccgcttcccctgcaccctggcctgtgaggcccggcacttcctgctggatggagagcccaggcctgtggccgtgcggcagcccaccccagcccaccctgtgatggtggacctgagcggccgggaggtggagctgcacctgcggctgcgcatcccccaggtgggccactacgtggtggtggtggagtacagcacagaggccgcccagctgtttgtggtggatgtgaatgtgaagagcagcggctctgtgctggccggccaggtgaacatctacagctgcaactacagcgtgctgtgccgctctgctgtgattgaccacatgagcagaattgccatgtatgagctgctggctgatgctgacatccagctgaagggccacatggcccgcttcctgctgcaccaggtgtgcatcatccccatcgaggagttcagcgcagaatatgtgcggccccaggtgcactgcatcgccagctatggccgctttgtgaaccagagcgccacctgtgtgtccctggcccacgagaccccacccacagccctgatcctggatgtgctgagcggccggcccttcccccacctgccccagcagagcagccccagcgtggatgtgctgcccggggtgaccctgaaggccccccagaaccaggtgaccctgcggggccgggtgccccacctgggccgctacgtgtttgtgatccacttctaccaggccgcccaccccaccttccctgcccaggtgtctgtggatggcggctggccccgggccggcagcttccacgccagcttctgcccccacgtgctgggctgccgggaccaggtgattgctgagggccagatcgagtttgacatcagcgagcctgaggtggccgccaccgtgaaggtgcctgagggcaagagcctggtgctggtgcgggtgctggtggtgcctgctgagaactatgactaccagatcctgcacaagaagtccatggacaagagcctggagttcatcaccaactgtgggaagaacagcttctacctggacccccagacagccagccgcttctgcaagaacagcgcccggagcctggtggccttctaccacaagggggccctgccctgtgagtgccaccccactggagccaccggcccccactgcagccctgagggcggggcccacgccagccccaccagcagcggcggcagcgccccagctgtgcagcaggcctacggcttcccccgctgcaagaggaagagctgcagctgtggccggcggctgtgtgaggagatgacaggccagtgccgctgcccccccaggacagtgcggccccagtgtgaggtgtgtgagacccacagcttctccttccaccccatggccggctgtgagggctgcaactgcagccggcggggcaccatcgaggccgccatgccagaatgtgaccgggacagcggccagtgccgctgcaagccccgcatcaccggccggcagtgtgacagatgtgccagcggcttctaccgcttcccagaatgtgtgccctgcaactgcaacagagatggaacagagcccggggtgtgtgaccccggcactggagcctgcctgtgcaaggaaaatgtggagggcacagagtgcaatgtgtgccgggagggcagcttccacctggaccctgccaacctgaagggctgcaccagctgcttctgctttggagtgaacaaccagtgccacagcagccacaagaggaggaccaagtttgtggacatgctgggctggcacctggagacagctgacagagtggacatccctgtgtccttcaaccctggcagcaacagcatggtggccgacctgcaggagctgcctgccaccatccacagcgcctcctgggtggccccctag

SEQ ID NO: 157284 - DNA, 1743 bp, Artificial Sequence
  Description of Artificial Sequence: Synthetic coding sequence
atggctgctgctgcccggccccggggccgggccctgggccctgtgctgccccccacccccctgctgctgctggtgctgcgggtgctgcctgcctgtggggccacagcccgggaccctggagctgctgctggcctgagcctgcaccccacctacttcaacctggccgaggccgcccgcatctgggccacagccacctgtggggagcggggccctggagagggccggccccagcctgagctgtactgcaagctggtgggcggccccacagcccctggcagcggccacaccatccagggccagttctgtgactactgcaacagcgaggaccccaggaaggcccaccctgtgaccaatgccattgatggcagcgagcgctggtggcagagcccccccctgagcagcggcacccagtacaacagagtgaacctgaccctggacctgggccagctgttccacgtggcctacatcctgatcaagtttgccaacagccccaggccagacctgtgggtgctggagaggtctgtggactttggcagcacctacagcccctggcagtactttgcccacagcaaggtggactgcctgaaggagtttggccgggaggccaacatggctgtgaccagagatgatgatgtgctgtgtgtgacagagtacagcagaattgtgcccctggagaatggagaggtggtggtgtccctcatcaatggccggcctggggccaagaacttcaccttcagccacaccctgcgggagttcaccaaggccaccaacatccggctgcgcttcctgcggaccaacaccctgctgggccacctgatcagcaaggcccagagggaccccaccgtgacccggcgctactactacagcatcaaggacatcagcattggaggccagtgtgtgtgcaatggacatgctgaggtgtgcaacatcaacaaccctgagaagctgttccgctgtgagtgccagcaccacacctgtggggagacctgtgaccgctgctgcaccggctacaaccagaggcgctggaggcctgctgcctgggagcagagccatgaatgtgaggcctgcaactgccacggccacgccagcaactgctactatgaccctgatgtggagcggcagcaggccagcctgaacacccagggcatctatgccggcggcggcgtgtgcatcaactgccagcacaacacagctggggtgaactgtgagcagtgtgccaagggctactaccggccctatggagtgcctgtggatgccccagatggctgcatcccctgcagctgtgaccctgagcacgcagatggctgtgagcagggcagcggccgctgccactgcaagcccaacttccacggggacaactgtgagaagtgtgccatcggctactacaacttccccttctgcctgcgcatccccatcttccctgtgtccacccccagcagtgaagatcctgtggccggggacatcaagggcaactggtgtgactgcaacctggagggcgtgctgcctgagatctgtgatgcccacggccgctgcctgtgcaggcctggggtggagggcccccgctgtgacacctgccgcagcggcttctacagcttccccatctgccagggccccagcgagaaggtggccatctacaagccagagagccggcccagcgctgagacagagcccgccagcacctggatcctggacttccctgccagcaggactggagagatcaacttctactgcctgagcccctag

SEQ ID NO: 157285 - DNA, 5007 bp, Artificial Sequence
  Description of Artificial Sequence: Synthetic coding sequence
atgcccccagctgtgcggcgcagcgcctgcagcatgggctggctgtggatctttggagctgccctgggccagtgcctgggctacagcagccagcagcagagggtgcccttcctgcagcccccaggccagagccagctgcaggccagctatgtggagttccggcccagccagggctgcagccctggctactacagagaccacaagggcctgtacacaggccgctgtgtgccctgcaactgcaatggccacagcaaccagtgccaggacggcagcggcatctgtgtgaactgccagcacaacacagctggggagcactgtgagcgctgccaggagggctactatggaaatgctgtgcacggcagctgccgggcctgcccctgcccccacaccaacagctttgccaccggctgtgtggtgaatggaggagatgtgcgctgcagctgcaaggccggctacacaggcacccagtgtgagcgctgtgcccctggctactttggaaacccccagaagtttggaggcagctgccagccctgcagctgcaacagcaatggccagctgggcagctgccaccccctgactggagactgcatcaaccaggagcccaaggacagcagccctgcagaagaatgtgatgactgtgacagctgtgtgatgaccctgctgaatgacctggccaccatgggagagcagctgcggctggtgaagagccagctgcagggcctgagcgccagcgctggcctgctggagcagatgaggcacatggagacccaggccaaggacctgaggaaccagctgctgaactaccgcagcgccatcagcaaccacggcagcaagattgagggcctggagcgggagctgacagacctgaaccaggagtttgagaccctgcaggagaaggcccaggtgaacagcaggaaggcccagaccctgaacaacaacgtgaacagagccacccagagcgccaaggagctggatgtgaagatcaagaatgtcatcagaaatgtgcacatgctgaaccgcatccgcacctggcagaagacccaccagggagaaaataatggcctggccaacagcatccgggacagcctgaatgaatatgaggccaagctgagtgacctgcgggcccggctgcaggaggccgccgcccaggccaagcaggccaacggcctgaaccaggagaatgaaagagccctgggcgccatccagaggcaggtgaaggagatcaacagcctgcagagcgacttcaccaagtacctgaccacagctgacagcagcctgctgcagaccaacatcgccctgcagctgatggagaagagccagaaggagtatgagaagctggccgccagcctgaatgaggcccggcaggagctgagtgacaaggtgcgggagctgagccgctctgctgggaagaccagcctggtggaggaggccgagaagcacgcccggagcctgcaggagctggccaagcagctggaggagatcaagagaaatgccagcggagatgagctggtgcgctgtgctgtggatgctgccacagcctatgagaacatcctgaatgccatcaaggccgcagaagatgctgccaacagagctgccagcgccagcgagagcgccctgcagaccgtcatcaaggaggacctgcccaggaaggccaagaccctgagcagcaacagcgacaagctgctgaatgaggccaagatgacccagaagaagctgaagcaggaggtgtccccagccctgaacaacctgcagcagaccctgaacatcgtgacagtgcagaaggaggtgattgacaccaacctgaccaccctgagagatggcctgcacggcatccagagaggagacattgatgccatgatcagcagcgccaagtccatggtgaggaaggccaatgacatcacagatgaggtgctggatggcctgaaccccatccagacagatgtggagcgcatcaaggacacctacggccgcacccagaatgaagacttcaagaaggccctgacagatgctgacaacagcgtgaacaagctgaccaacaagctgcctgacctgtggaggaagattgagagcatcaaccagcagctgctgcccctgggcaacatcagtgacaacatggaccgcatccgggagctgatccagcaggccagagatgctgccagcaaggtggccgtgcccatgaggttcaacgggaagagcggcgtggaggtgcggctgcccaatgacctggaggacctgaagggctacaccagcctgagcctcttcctgcagaggcccaacagccgggagaatggaggaacagagaacatgtttgtgatgtacctgggcaacaaggatgccagccgggactacatcggcatggctgtggtggatggccagctgacctgtgtgtacaacctgggggaccgggaggccgagctgcaggtggaccagatcctgaccaagtctgagaccaaggaggccgtgatggacagagtgaagttccagaggatctaccagtttgcccggctgaactacaccaagggggccaccagcagcaagccagagaccccaggagtgtatgacatggatggcaggaacagcaacaccctgctgaacctggaccctgaaaatgtggtgttctacgtgggcggctaccccccagacttcaagctgcccagccggctgtccttccccccctacaagggctgcatcgagctggatgacctgaatgaaaatgtgctgagcctgtacaacttcaagaagaccttcaacctgaacaccacagaggtggagccctgcagaagaaggaaggaggagagtgacaagaactactttgagggcaccggctacgcccgggtgcccacccagccccacgcccccatccccaccttcggccagaccatccagaccaccgtggaccggggcctgctcttctttgctgaaaatggagaccgcttcatcagcctgaacattgaagatggcaagctgatggtgcgctacaagctgaacagcgagctgcccaaggagcggggcgtgggagatgccatcaacaacggccgggaccacagcatccagatcaagattggcaagctgcagaagaggatgtggatcaacgtggatgtgcagaacaccatcattgatggagaggtgtttgacttcagcacctactacctgggcggcatccccatcgccatccgggagcgcttcaacatcagcaccccagccttccggggctgcatgaagaacctgaagaagaccagcggcgtggtgcggctgaatgacacagtgggcgtgaccaagaagtgcagcgaggactggaagctggtgcgcagcgccagcttcagccggggcggccagctgtccttcacagacctgggcctgcccccaacagaccacctgcaggccagctttggcttccagaccttccagcccagcggcatcctgctggaccaccagacctggaccaggaacctgcaggtgaccctggaggatggctacatcgagctgagcaccagtgacagcggcagccccatcttcaagagcccccagacctacatggatggcctgctgcactacgtgtctgtcatcagtgacaacagcggcctgcggctgctgattgatgaccagctgctgaggaacagcaagaggctgaagcacatcagcagcagccggcagagcctgcggctgggcggcagcaactttgagggctgcatcagcaatgtgtttgtgcagaggctgagcctgagccctgaggtgctggacctgaccagcaacagcctgaagagagatgtgtccctgggcggctgcagcctgaacaagccacccttcctgatgctgctgaagggcagcacccgcttcaacaagaccaagaccttccgcatcaaccagctgctgcaggacacccctgtggccagccccaggtctgtgaaggtgtggcaggatgcctgcagccccctgcccaagacccaggccaaccacggggccctgcagtttggagacatccccaccagccacctgctcttcaagctgccccaggagctgctgaagcccaggagccagtttgctgtggacatgcagaccaccagcagccggggcctggtgttccacacaggcaccaagaacagcttcatggccctgtacctgagcaagggccgcctggtgtttgccctgggcacagatggcaagaagctgcgcatcaagagcaaggagaagtgcaatgatggcaagtggcacacagtggtgtttggacatgatggagagaagggccgcctggtggtggatggcctgcgggcccgggagggcagcctgcccggcaacagcaccatcagcatccgggcccctgtgtacctgggcagcccccccagcggcaagcccaagagcctgcccaccaacagctttgtgggctgcctgaagaacttccagctggacagcaagcccctgtacacccccagcagcagctttggagtgagcagctgcctgggcggccccctggagaagggcatctacttcagcgaggagggcggccacgtggtgctggcccacagcgtgctgctgggccctgagttcaagctggtgttcagcatccggcccaggagcctgaccggcatcctgatccacatcggcagccagcccgggaagcacctgtgtgtgtacctggaggccggcaaggtgacagcctccatggacagcggggccggcggcaccagcacctctgtgacccccaagcagagcctgtgtgatggccagtggcacagcgtggccgtgaccatcaagcagcacatcctgcacctggagctggacacagacagcagctacacagctggccagatccccttccccccagccagcacccaggagcccctgcacctgggcggggccccagccaacctgaccaccctgcgcatccctgtgtggaagagcttcttcggctgcctgaggaacatccacgtgaaccacatccctgtgcctgtgacagaggccctggaggtgcagggccctgtgtccctgaatggctgcccagaccagtag

SEQ ID NO: 157286 - DNA, 1065 bp, Artificial Sequence
  Description of Artificial Sequence: Synthetic coding sequence
atgcagggcctgctcttcagcaccctgctgctggccggcctggcccagttctgctgccgggtgcagggcaccggccccctggacaccaccccagagggccggcctggagaggtgtctgatgccccccagaggaagcagttctgccactggccctgcaagtgcccccagcagaagccccgctgccccccaggagtgtccctggtgagagatggctgcggctgctgcaagatctgtgccaagcagcccggggagatctgcaatgaagctgacctgtgtgacccccacaagggcctgtactgtgactacagcgtggaccggcccaggtatgaaacaggagtgtgtgcctacctggtggccgtgggctgtgagttcaaccaggtgcactaccacaacggccaggtgttccagcccaaccccctcttcagctgcctgtgtgtgtctggggccatcggctgcacccccctcttcatccccaagctggccggcagccactgcagcggggccaagggcggcaagaagagtgaccagagcaactgcagcctggagcccctgctgcagcagctgagcaccagctacaagaccatgcctgcctacagaaacctgcccctcatctggaagaagaagtgcctggtgcaggccaccaagtggaccccctgcagcaggacctgtggcatgggcatcagcaacagagtgaccaatgaaaacagcaactgtgagatgaggaaggagaagaggctgtgctacatccagccctgtgacagcaacatcctgaagaccatcaagatccccaagggcaagacctgccagcccaccttccagctgagcaaggccgagaagtttgtgttttctggctgcagcagcacccagagctacaagcccaccttctgtggcatctgcctggacaagcgctgctgcatccccaacaagagcaagatgatcaccatccagtttgactgccccaatgaaggcagcttcaagtggaagatgctgtggatcaccagctgtgtgtgccagaggaactgccgggagcccggggacatcttcagcgagctgaagatcctgtag

SEQ ID NO: 157287 - DNA, 267 bp, Artificial Sequence
  Description of Artificial Sequence: Synthetic coding sequence
atggccctgagcagcgcctggaggtctgtgctgcccctgtggctgctgtggagcgctgcctgcagccgggccgccagcggagatgacaatgccttcccctttgacatcgagggcagcagcgctgtgggccggcaggaccccccagagaccagcgagccccgggtggccctgggccgcctgcccccagctgctgagaagtgcaatgccggcttcttccacaccctgagcggggagtgtgtgccctgtgactgcaatggaaacagctag

SEQ ID NO: 157288 - DNA, 363 bp, Artificial Sequence
  Description of Artificial Sequence: Synthetic coding sequence
atggccctgagcagcgcctggaggtctgtgctgcccctgtggctgctgtggagcgctgcctgcagccgggccgccagcggagatgacaatgccttcccctttgacatcgagggcagcagcgctgtgggccggcaggaccccccagagaccagcgagccccgggtggccctgggccgcctgcccccagctgctgaggtgcagtgcccctgccactgccaccctgctggggccccagccccacccagggctgtgccccacagcagcttcagcctgagcccccccctgagcagcccccagtgcctggagagcttcacctgggcccggtctgtgaggaagctggagatcaagagcttccccctgtag

SEQ ID NO: 157289 - DNA, 549 bp, Artificial Sequence
  Description of Artificial Sequence: Synthetic coding sequence
atggccctgagcagcgcctggaggtctgtgctgcccctgtggctgctgtggagcgctgcctgcagccgggccgccagcggagatgacaatgccttcccctttgacatcgagggcagcagcgctgtgggccggcaggaccccccagagaccagcgagccccgggtggccctgggccgcctgcccccagctgctgagaagtgcaatgccggcttcttccacaccctgagcggggagtgtgtgccctgtgactgcaatggaaacagcaatgaatgtctggatggcagcggctactgtgtgcactgccagaggaacaccaccggggagcactgtgagaagtgcctggatggctacatcggggacagcatccggggggccccccagttctgccagccctgcccctgccccctgccccacctggccaactttgctgagagctgctacaggaagaatggagctgtgcgctgcatctgcaatgaaaattatgccggccccaactgtgagcggcccagcccccagagcacccggggcttccccctgaatgacagctag

SEQ ID NO: 157290 - DNA, 537 bp, Artificial Sequence
  Description of Artificial Sequence: Synthetic coding sequence
tgaatttttgaggactgtgatgaggtgacaggccagtgcaggaactgcctgaggaacaccaccggcttcaagtgtgagcgctgtgcccctggctactatggagatgcccgcatcgccaagaactgtgctgtgtgcaactgtggcggcggcccctgtgacagcgtgactggagagtgcctggaggagggctttgagccccccaccggcatggactgccccaccatcagctgtgacaagtgtgtgtgggacctgacagatgccctgcggctggccgccctgagcattgaggagggcaagagcggcgtgctgtctgtgtcctctggagctgctgcccaccgccacgtgaatgagatcaatgccaccatctacctgctgaagaccaagctgtctgaaagagagaaccagtatgccctgaggaagatccagatcaacaatgctgagaacaccatgaagagcctgctgagtgatgtggaggagctggtggagaagcactggaacaagccccggcggcggctggagctgcaggagggcgtgtag

SEQ ID NO: 157291 - DNA, 5451 bp, Artificial Sequence
  Description of Artificial Sequence: Synthetic coding sequence
atggccctgagcagcgcctggaggtctgtgctgcccctgtggctgctgtggagcgctgcctgcagccgggccgccagcggagatgacaatgccttcccctttgacatcgagggcagcagcgctgtgggccggcaggaccccccagagaccagcgagccccgggtggccctgggccgcctgcccccagctgctgagaagtgcaatgccggcttcttccacaccctgagcggggagtgtgtgccctgtgactgcaatggaaacagcaatgaatgtctggatggcagcggctactgtgtgcactgccagaggaacaccaccggggagcactgtgagaagtgcctggatggctacatcggggacagcatccggggggccccccagttctgccagccctgcccctgccccctgccccacctggccaactttgctgagagctgctacaggaagaatggagctgtgcgctgcatctgcaatgaaaattatgccggccccaactgtgagcgctgtgcccctggctactacggcaaccccctgctgattggcagcacctgcaagaagtgtgactgcagcggcaacagcgaccccaacctgatctttgaggactgtgatgaggtgacaggccagtgcaggaactgcctgaggaacaccaccggcttcaagtgtgagcgctgtgcccctggctactatggagatgcccgcatcgccaagaactgtgctgtgtgcaactgtggcggcggcccctgtgacagcgtgactggagagtgcctggaggagggctttgagccccccaccggctgtgacaagtgtgtgtgggacctgacagatgccctgcggctggccgccctgagcattgaggagggcaagtctggagtgctgtctgtgagcagcggggctgctgcccacagacatgtgaatgagatcaatgccaccatctacctgctgaagaccaagctgtctgagcgggagaaccagtatgccctgaggaagatccagatcaacaatgctgagaacaccatgaagagcctgctgagtgatgtggaggagctggtggagaaggagaaccaggccagcaggaagggccagctggtgcagaaggagagcatggacaccatcaaccacgccagccagctggtggagcaggcccatgacatgagggacaagatccaggagatcaacaacaagatgctgtactacggggaggagcacgagctgagccccaaggagatcagcgagaagctggtgctggcccagaagatgctggaggagatccgcagccggcagcccttcttcacccagcgggagctggtggatgaggaggctgatgaggcctatgagctgctgagccaggccgagagctggcagaggctgcacaatgagaccaggaccctcttccctgtggtgctggagcagctggatgactacaatgccaagctgagtgacctgcaggaggccctggaccaggccctgaactacgtgagagatgctgaggacatgaacagagccacagctgcccggcagagggaccacgagaagcagcaggagcgggtgcgggagcagatggaggtggtgaacatgagcctgagcaccagcgctgacagcctgaccaccccccggctgaccctgtctgagctggatgacatcatcaagaatgccagcggcatctatgcagaaattgatggagccaagtctgagctgcaggtgaagctgagcaacctgagcaacctgagccatgacctggtgcaggaggccatcgaccacgcccaggacctgcagcaggaggccaatgagctgagcaggaagctgcacagcagtgacatgaatggcctggtgcagaaggccctggatgccagcaatgtgtatgaaaatattgtgaactacgtgtctgaggccaatgaaacagctgagtttgccctgaacaccacagaccgcatctatgatgctgtgtctggaattgacacccagatcatctaccacaaggatgaaagtgagaacctgctgaaccaggcccgggagctgcaggccaaggccgagagcagcagtgatgaagctgtggccgacaccagcagaagagtgggcggggccctggccaggaagagcgccctgaagacccggctgagtgatgctgtgaagcagctgcaggccgctgagagaggagatgcccagcagaggctgggccagagccgcctcatcacagaggaggccaacagaaccaccatggaggtgcagcaggccacagcccccatggccaacaacctgaccaactggagccagaacctgcagcactttgacagcagcgcctacaacacagctgtgaacagcgccagagatgctgtgaggaacctgacagaggtggtgccccagctgctggaccagctgaggacagtggagcagaagaggcctgccagcaatgtgtctgccagcatccagaggatccgggagctgattgcccagaccaggtctgtggccagcaagatccaggtgtccatgatgtttgatggccagagcgctgtggaggtgcacagcaggacctccatggatgacctgaaggccttcaccagcctgagcctgtacatgaagccccctgtgaagaggcctgagctgacagaaacagctgaccagttcatcctgtacctgggcagcaagaatgccaagaaggagtacatgggcctggccatcaagaatgacaacctggtgtatgtgtacaacctgggcaccaaggatgtggagatccccctggacagcaagcctgtgtcctcctggccagcctacttcagcatcgtgaagattgagcgggtgggcaagcacggcaaggtgttcctgactgtgcccagcctgagcagcacagctgaggagaagttcatcaagaagggggagttctctggagatgacagcctgctggacctggaccctgaagatactgtgttctacgtgggcggcgtgcccagcaacttcaagctgcccaccagcctgaacctgcccggctttgtgggctgcctggagctggccaccctgaacaatgatgtgatcagcctgtacaacttcaagcacatctacaacatggaccccagcacctctgtgccctgtgcccgggacaagctggccttcacccagagccgggccgccagctacttctttgatggcagcggctatgctgtggtgcgggacatcacccggcggggcaagtttggccaggtgaccaggtttgacatcgaggtgaggaccccagctgacaatggcctcatcctgctgatggtgaatggctccatgttcttccggctggagatgagaaatggctacctgcacgtgttctatgactttggcttcagcggcggccctgtgcacctggaggacaccctgaagaaggcccagatcaatgatgccaagtaccacgagatcagcatcatctaccacaatgacaagaagatgatcctggtggtggaccggcggcacgtgaagtccatggacaatgagaagatgaagatccccttcacagacatctacatcggcggggcccctcctgagatcctgcagagccgggccctgcgggcccacctgcccctggacatcaacttccggggctgcatgaagggcttccagttccagaagaaggacttcaacctgctggagcagacagagaccctgggcgtgggctacggctgcccagaggacagcctcatcagccggcgggcctacttcaacggccagagcttcatcgccagcatccagaagatctccttctttgatggctttgagggcggcttcaacttccgcaccctgcagcccaacggcctgctcttctactatgccagcggcagtgatgtgttcagcatcagcctggacaatggaacagtcatcatggatgtgaagggcatcaaggtgcagagcgtggacaagcagtacaatgatggcctgagccactttgtgatcagctctgtgagccccaccaggtatgagctgattgtggacaagagccgggtgggcagcaagaaccccaccaagggcaagattgagcagacccaggccagcgagaagaagttctactttggaggcagccccatcagcgcccagtatgccaacttcaccggctgcatcagcaatgcctacttcaccagggtggacagagatgtggaggtggaggacttccagcgctacacagagaaggtgcacaccagcctgtatgagtgccccatcgagagcagccccctcttcctgctgcacaagaagggcaagaacctgagcaagcccaaggccagccagaacaagaagggcggcaagagcaaggatgcccccagctgggaccctgtggccctgaagctgcctgagaggaacacccccaggaacagccactgccacctgagcaacagcccccgggccattgaacatgcctaccagtatggaggaacagccaacagccggcaggagtttgagcacctgaagggggactttggagccaagagccagttcagcatccggctgcggaccaggagcagccacggcatgatcttctacgtgtctgaccaggaggagaatgacttcatgaccctcttcctggcccacggccgcctggtgtacatgtttaatgtgggccacaagaagctgaagatccgcagccaggagaagtacaatgatggcctgtggcatgatgtgatcttcatccgggagaggagcagcggccgcctggtgattgatggcctgcgggtgctggaggagagcctgcccccaacagaggccacctggaagatcaagggccccatctacctgggcggcgtggcccctgggaaggctgtgaagaatgtgcagatcaacagcatctacagcttcagcggctgcctgagcaacctgcagctgaatggagccagcatcaccagcgccagccagaccttctctgtgaccccctgctttgagggccccatggagaccggcacctacttcagcacagagggcggctacgtggtgctggatgagagcttcaacatcggcctgaagtttgaaattgcctttgaggtgcggcccaggagcagcagcggcaccctggtgcacggccacagcgtgaatggagagtacctgaatgtgcacatgaagaatggccaggtgattgtgaaggtgaacaacggcatccgggacttcagcacctctgtgacccccaagcagagcctgtgtgatggccgctggcaccgcatcaccgtcatccgggacagcaatgtggtgcagctggatgtggacagcgaggtgaaccacgtggtgggccccctgaaccccaagcccatcgaccaccgggagcctgtgtttgtgggcggcgtgcctgagagcctgctgaccccccggctggcccccagcaagcccttcaccggctgcatccgccactttgtgattgatggccaccctgtgtccttcagcaaggccgccctggtgtctggagctgtgtccatcaacagctgcccagctgcctag

SEQ ID NO: 157292 - DNA, 5451 bp, Artificial Sequence; identical to SEQ ID NO: 157291
  Description of Artificial Sequence: Synthetic coding sequence

SEQ ID NO: 157293 - DNA, 390 bp, Artificial Sequence
  Description of Artificial Sequence: Synthetic coding sequence
atggccctgagcagcgcctggaggtctgtgctgcccctgtggctgctgtggagcgctgcctgcagccgggccgccagcggagatgacaatgccttcccctttgacatcgagggcagcagcgctgtgggccggcaggaccccccagagaccagcgagccccgggtggccctgggccgcctgcccccagctgctgagaagtgcaatgccggcttcttccacaccctgagcggggagtgtgtgccctgtgactgcaatggaaacagcaatgaatgtctggatggcagcggctactgtgtgaccacagatggagaggaccccggcttcagcgccagcgccctgtccttcatcctgagcagccagggcgcccgggaggcccgggcccccacctag

SEQ ID NO: 157294 - DNA, 363 bp, Artificial Sequence; identical to SEQ ID NO: 157288
  Description of Artificial Sequence: Synthetic coding sequence

SEQ ID NO: 157295 - DNA, 1125 bp, Artificial Sequence
  Description of Artificial Sequence: Synthetic coding sequence
atggccctgagcagcgcctggaggtctgtgctgcccctgtggctgctgtggagcgctgcctgcagccgggccgccagcggagatgacaatgccttcccctttgacatcgagggcagcagcgctgtgggccggcaggaccccccagagaccagcgagccccgggtggccctgggccgcctgcccccagctgctgagaagtgcaatgccggcttcttccacaccctgagcggggagtgtgtgccctgtgactgcaatggaaacagcaatgaatgtctggatggcagcggctactgtgtgcactgccagaggaacaccaccggggagcactgtgagaagtgcctggatggctacatcggggacagcatccggggggccccccagttctgccagccctgcccctgccccctgccccacctggccaactttgctgagagctgctacaggaagaatggagctgtgcgctgcatctgcaatgaaaattatgccggccccaactgtgagcgctgtgcccctggctactacggcaaccccctgctgattggcagcacctgcaagaagtgtgactgcagcggcaacagcgaccccaacctgatctttgaggactgtgatgaggtgacaggccagtgcaggaactgcctgaggaacaccaccggcttcaagtgtgagcgctgtgcccctggctactatggagatgcccgcatcgccaagaactgtgctgtgtgcaactgtggcggcggcccctgtgacagcgtgactggagagtgcctggaggagggctttgagccccccaccggcatggactgccccaccatcagctgtgacaagtgtgtgtgggacctgacagatgccctgcggctggccgccctgagcattgaggagggcaagagcggcgtgctgtctgtgtcctctggagctgctgcccaccgccacgtgaatgagatcaatgccaccatctacctgctgaagaccaagctgtctgaaagagagaaccagtatgccctgaggaagatccagatcaacaatgctgagaacaccatgaagagcctgctgagtgatgtggaggagctggtggagaagcactggaacaagccccggcggcggctggagctgcaggagggcgtgtag

SEQ ID NO: 157296 - DNA, 363 bp, Artificial Sequence; identical to SEQ ID NO: 157288
  Description of Artificial Sequence: Synthetic coding sequence

SEQ ID NO: 157297 - DNA, 324 bp, Artificial Sequence
  Description of Artificial Sequence: Synthetic coding sequence
atggccctgagcagcgcctggaggtctgtgctgcccctgtggctgctgtggagcgctgcctgcagccgggccgccagcggagatgacaatgccttcccctttgacatcgagggcagcagcgctgtgggccggcaggaccccccagagaccagcgagccccgggtggccctgggccgcctgcccccagctgctgagaagtgcaatgccggcttcttccacaccctgagcggggagtgtgtgccctgtgactgcaatggaaacagcaatgaatgtctggatggcagcggctactgtgtgcactgccagaggaacaccaccggctag

SEQ ID NO: 157298 - DNA, 996 bp, Artificial Sequence
  Description of Artificial Sequence: Synthetic coding sequence
atggccctgagcagcgcctggaggtctgtgctgcccctgtggctgctgtggagcgctgcctgcagccgggccgccagcggagatgacaatgccttcccctttgacatcgagggcagcagcgctgtgggccggcaggaccccccagagaccagcgagccccgggtggccctgggccgcctgcccccagctgctgagaagtgcaatgccggcttcttccacaccctgagcggggagtgtgtgccctgtgactgcaatggaaacagcaatgaatgtctggatggcagcggctactgtgtgcactgccagaggaacaccaccggggagcactgtgagaagtgcctggatggctacatcggggacagcatccggggggccccccagttctgccagccctgcccctgccccctgccccacctggccaactttgctgagagctgctacaggaagaatggagctgtgcgctgcatctgcaatgaaaattatgccggccccaactgtgagcgctgtgcccctggctactacggcaaccccctgctgattggcagcacctgcaagaagtgtgactgcagcggcaacagcgaccccaacctgatctttgaggactgtgatgaggtgacaggccagtgcaggaactgcctgaggaacaccaccggcttcaagtgtgagcgctgtgcccctggctactatggagatgcccgcatcgccaagaactgtgctgtgtgcaactgtggcggcggcccctgtgacagcgtgactggagagtgcctggaggagggctttgagccccccaccggcatggactgccccaccatcagctgtgacaagtgtgtgtgggacctgacagatgccctgcggctggccgccctgagcattgaggagggcaagagcggcgtgctgtctgtgtcctctggagctgctgcccaccgccacgtgaatgagatcaatgccaccatctacctgctgaagaccaagctgtctgaaagagagaaccagtag

SEQ ID NO: 157299 - DNA, 246 bp, Artificial Sequence
  Description of Artificial Sequence: Synthetic coding sequence
atggccctgagcagcgcctggaggtctgtgctgcccctgtggctgctgtggagcgctgcctgcagccgggccgccagcggagatgacaatgccttcccctttgacatcgagggcagcagcgctgtgggccggcaggaccccccagagaccagcgagccccgggtggccctgggccgcctgcccccagctgctgagaagtgcaatgccggcttcttccacaccctgagcggggagtgtgtgccctag

SEQ ID NO: 157300 - DNA, 5451 bp, Artificial Sequence; identical to SEQ ID NO: 157291
  Description of Artificial Sequence: Synthetic coding sequence

SEQ ID NO: 157301 - DNA, 975 bp, Artificial Sequence
  Description of Artificial Sequence: Synthetic coding sequence
atggccctgagcagcgcctggaggtctgtgctgcccctgtggctgctgtggagcgctgcctgcagccgggccgccagcggagatgacaatgccttcccctttgacatcgagggcagcagcgctgtgggccggcaggaccccccagagaccagcgagccccgggtggccctgggccgcctgcccccagctgctgagaagtgcaatgccggcttcttccacaccctgagcggggagtgtgtgccctgtgactgcaatggaaacagcaatgaatgtctggatggcagcggctactgtgtgcactgccagaggaacaccaccggggagcactgtgagaagtgcctggatggctacatcggggacagcatccggggggccccccagttctgccagccctgcccctgccccctgccccacctggccaactttgctgagagctgctacaggaagaatggagctgtgcgctgcatctgcaatgaaaattatgccggccccaactgtgagcgctgtgcccctggctactacggcaaccccctgctgattggcagcacctgcaagaagtgtgactgcagcggcaacagcgaccccaacctgatctttgaggactgtgatgaggtgacaggccagtgcaggaactgcctgaggaacaccaccggcttcaagtgtgagcgctgtgcccctggctactatggagatgcccgcatcgccaagaactgtgctgtgtgcaactgtggcggcggcccctgtgacagcgtgactggagagtgcctggaggagggctttgagccccccaccggctgtgacaagtgtgtgtgggacctgacagatgccctgcggctggccgccctgagcattgaggagggcaagtctggagtgctgtctgtgagcagcggggctgctgcccacagacatgtgaatgagatcaatgccaccatctacctgctgaagaagaccaagcagaagaacaacaagaagtag

SEQ ID NO: 157302 - DNA, 11088 bp, Artificial Sequence
  Description of Artificial Sequence: Synthetic coding sequence
atggccaagaggctgtgtgccggcagcgccctgtgtgtgcggggcccccggggccctgcccccctgctgctggtgggcctggccctgctgggcgccgcccgggcccgggaggaggccggcggcggcttcagcctgcaccccccctacttcaacctggccgagggcgccagaattgctgccagcgccacctgtggggaggaggccccagcccggggcagcccccggcccacagaggacctgtactgcaagctggtgggcggccctgtggccggcggggaccccaaccagaccatccggggccagtactgtgacatctgcacagctgccaacagcaacaaggcccacccagccagcaatgccattgatggaacagagcgctggtggcagagcccccccctgagccggggcctggagtacaatgaggtgaatgtgaccctggacctgggccaggtgttccacgtggcctacgtgctgatcaagtttgccaacagccccaggccagacctgtgggtgctggagaggtccatggactttggccgcacctaccagccctggcagttctttgccagcagcaagagggactgcctggagagatttggcccccagaccctggagcgcatcaccagagatgatgctgccatctgcaccacagagtacagccgcatcgtgcccctggagaatggagagatcgtggtgtccctggtgaatggccggcctggggccatgaacttctcctacagccccctgctgcgggagttcaccaaggccaccaacgtgcggctgcgcttcctgcggaccaacaccctgctgggccacctgatgggcaaggccctgcgggaccccaccgtgacccggcgctactactacagcatcaaggacatcagcatcggcggccgctgtgtgtgccacggccacgcagatgcctgtgatgccaaggaccccacagaccccttccggctgcagtgcacctgccagcacaacacctgtggcggcacctgtgaccgctgctgccccggcttcaaccagcagccctggaagccagccacagccaacagcgccaatgaatgccagagctgcaactgctacggccacgccacagactgctactatgaccctgaggtggacagaagaagagccagccagagcctggatggcacctaccagggcggcggcgtgtgcatcgactgccagcaccacaccactggagtgaactgtgagcgctgcctgcccggcttctaccgcagccccaaccaccccctggacagcccccacgtgtgccgccgctgcaactgtgagagtgacttcacagatggcacctgtgaggacctgaccggccgctgctactgccggcccaacttcagcggggagcgctgtgatgtgtgtgccgagggcttcaccggcttccccagctgctaccccacccccagcagcagcaatgacacccgggagcaggtgctgcctgctggccagatcgtgaactgtgactgcagcgctgctggcacccagggcaatgcctgcaggaaggacccccgggtgggccgctgcctgtgcaagcccaacttccagggcacccactgtgagctgtgtgcccctggcttctacggccctggctgccagccctgccagtgcagcagccctggggtggctgatgacagatgtgaccctgacaccggccagtgccgctgccgggtgggctttgagggcgccacctgtgacagatgtgcccctggctacttccacttccccctgtgccagctgtgtggctgcagccctgctggcaccctgcctgagggctgtgatgaggccggccgctgcctgtgccagcctgagtttgctggcccccactgtgaccgctgcaggcctggctaccacggcttccccaactgccaggcctgcacctgtgaccccaggggggccctggaccagctgtgtggggccggcggcctgtgccgctgccggcccggctacacaggaacagcctgccaggagtgcagccctggcttccacggcttccccagctgtgtgccctgccactgcagcgctgagggcagcctgcatgctgcctgtgaccccaggagcggccagtgcagctgccggccccgggtgacaggcctgcgctgtgacacctgtgtgcctggggcctacaacttcccctactgtgaggccggcagctgccaccctgctggcctggcccctgtggaccctgccctgcctgaggcccaggtgccctgcatgtgccgggcccacgtggagggccccagctgtgaccgctgcaagccaggcttctggggcctgagccccagcaaccctgagggctgcacccgctgcagctgtgacctgcggggcaccctgggcggcgtggccgagtgccagcccggcaccggccagtgcttctgcaagccccacgtgtgtggccaggcctgtgccagctgcaaggatggcttcttcggcctggaccaggccgactacttcggctgccgcagctgccgctgtgacattggaggagccctgggccagagctgtgagcccaggactggagtgtgccgctgccggcccaacacccagggccccacctgcagcgagcccgcccgggaccactacctgcctgacctgcaccacctgcggctggagctggaggaggccgccaccccagagggccatgctgtgcgcttcggcttcaaccccctggagtttgagaacttctcctggaggggctacgcccagatggcccctgtgcagccccgcatcgtggcccggctgaacctgaccagcccagacctcttctggctggtgttccgctacgtgaacagaggagccatgtctgtgtctggccgggtgtctgtgcgggaggagggccgcagcgccacctgtgccaactgcacagcccagagccagcctgtggccttcccccccagcacagagcccgccttcatcaccgtgccccagaggggctttggagagccctttgtgctgaaccctggcacctgggccctgcgggtggaggccgagggcgtgctgctggactatgtggtgctgctgcccagcgcctactatgaggccgccctgctgcagctgcgggtgacagaggcctgcacctaccggcccagcgcccagcagagcggggacaactgcctgctgtacacccacctgcccctggatggcttccccagcgctgctggcctggaggccctgtgccggcaggacaacagcctgccccggccctgccccacagagcagctgagccccagccaccccccactcatcacctgcaccggcagtgatgtggatgtgcagctgcaggtggccgtgccccagcccggccgctatgccctggtggtggagtatgccaatgaagatgcccggcaggaggtgggcgtggccgtgcacaccccccagagggccccccagcagggcctgctgagcctgcacccctgcctgtacagcaccctgtgccggggcacagcccgggacacccaggaccacctggccgtgttccacctggacagcgaggcctctgtgcggctgacagctgagcaggcccgcttcttcctgcatggagtgaccctggtgcccatcgaggagttcagccctgagtttgtggagccccgggtgtcctgcatcagcagccacggggccttcggccccaacagcgctgcctgcctgcccagccgcttccccaagccaccccagcccatcatcctgcgggactgccaggtgatccccctgcccccaggcctgcccctgacccacgcccaggacctgaccccagccatgagccctgctggcccccggcccaggcctcccacagctgtggaccctgatgctgagcccaccctgctgcgggagccccaggccaccgtggtgttcaccacccacgtgcccaccctgggccgctatgccttcctgctgcacggctaccagcctgcccaccccaccttccctgtggaggtgctgatcaatgccggccgggtgtggcagggccacgccaatgccagcttctgcccccacggctacggctgcaggaccctggtggtgtgtgagggccaggccctgctggatgtgacccacagcgagctgactgtgacagtgcgggtgcccaagggccgctggctgtggctggactatgtgctggtggtgcctgaaaatgtgtacagctttggctacctgcgggaggagcccctggacaagagctatgacttcatcagccactgtgccgcccagggctaccacatcagccccagcagcagcagcctcttctgcagaaatgctgctgccagcctgagcctcttctacaacaatggagcccggccctgtggctgccacgaggtgggcgccaccggccccacctgtgagccctttggaggccagtgcccctgccacgcccacgtgattggccgggactgcagccgctgtgccaccggctactggggcttccccaactgccggccctgtgactgtggggcccggctgtgtgatgagctgaccggccagtgcatctgcccccccaggaccatccccccagactgcctgctgtgccagccccagaccttcggctgccaccccctggtgggctgtgaggagtgcaactgcagcggccctggcatccaggagctgacagaccccacctgtgacacagattctggccagtgcaagtgccggcccaacgtgactggaagaagatgtgacacctgcagccctggcttccacggctacccccgctgccggccctgtgactgccacgaggccggcacagcccctggggtgtgtgaccccctgaccggccagtgctactgcaaggaaaatgtgcagggccccaagtgtgaccagtgcagcctgggcaccttcagcctggatgctgccaaccccaagggctgcacccgctgcttctgctttggagccacagagcgctgccgcagcagcagctacacccggcaggagtttgtggacatggagggctgggtgctgctgagcacagaccggcaggtggtgccccatgagcggcagcctggaacagagatgctgcgggctgacctgcggcacgtgcctgaggccgtgcctgaggccttccctgagctgtactggcaggcccctccttcctacctgggggacagagtgtcctcctatggaggcaccctgcgctatgagctgcacagcgagacccagagaggagatgtgtttgtgcccatggagagcaggccagatgtggtgctgcagggcaaccagatgagcatcaccttcctggagcccgcctaccccaccccaggccacgtgcaccggggccagctgcagctggtggagggcaacttccgccacacagagaccaggaacacagtgtcccgggaggagctgatgatggtgctggccagcctggagcagctgcagatccgggccctcttcagccagatcagcagcgctgtgttcctgcggcgggtggccctggaggtggccagccctgctggccagggcgccctggccagcaatgtggagctgtgcctgtgcccagccagctacagaggagacagctgccaggagtgtgcccctggcttctacagagatgtgaagggcctcttcctgggccgctgtgtgccctgccagtgccacggccacagcgaccgctgcctgcccggcagcggcgtgtgtgtggactgccagcacaacacagaaggagcccactgtgagcgctgccaggccggctttgtgagcagcagagatgaccccagcgccccctgtgtgtcctgcccctgccccctgtctgtgcccagcaacaactttgctgagggctgtgtgctgcggggcggccgcacccagtgcctgtgcaagccaggctacgccggggccagctgtgagcgctgtgcccctggcttcttcggcaaccccctggtgctgggcagcagctgccagccctgtgactgcagcggaaatggagaccccaacctgctcttcagtgactgtgaccccctgaccggggcctgccggggctgcctgcggcacaccaccggcccccgctgtgagatctgtgcccctggcttctatggaaatgccctgctgcccggcaactgcacccgctgtgactgcaccccctgtggcacagaggcctgtgacccccacagcggccactgcctgtgcaaggccggcgtgactggaagaagatgtgaccgctgccaggagggccactttggatttgatggctgcggcggctgccggccctgtgcctgtggccctgctgctgagggcagcgagtgccacccccagagcggccagtgccactgccggcccggcaccatgggcccccagtgcagagaatgtgcccctggctactggggcctgcctgagcagggctgccgccgctgccagtgccctgggggccgctgtgacccccacacaggccgctgcaactgccccccaggcctgagcggggagcgctgtgacacctgcagccagcagcaccaggtgcctgtgcctgggggccctgtgggccacagcatccactgtgaggtgtgtgaccactgtgtggtgctgctgctggatgacctggagagagctggggccctgctgcctgccatccacgagcagctgcggggcatcaatgccagctccatggcctgggcccggctgcaccggctgaatgccagcattgctgacctgcagagccagctgcggagccccctgggccccaggcatgaaacagcccagcagctggaggtgctggagcagcagagcaccagcctgggccaggatgcccggcggctgggcggccaggccgtgggcacccgggaccaggccagccagctgctggccggcacagaggccaccctgggccacgccaagaccctgctggccgccatccgggctgtggacaggaccctgtctgagctgatgagccagacaggccacctgggcctggccaatgccagcgcccccagcggggagcagctgctgcggaccctggccgaggtggagcggctgctgtgggagatgagggcccgggacctgggcgccccccaggccgctgctgaggccgagctggccgccgcccagaggctgctggcccgggtgcaggagcagctgagcagcctgtgggaggagaaccaggccctggccacccagacccgggaccggctggcccagcatgaagctggcctgatggacctgcgggaggccctgaacagagctgtggatgccacccgggaggcccaggagctgaacagcaggaaccaggagcggctggaggaggccctgcagaggaagcaggagctgagccgggacaatgccaccctgcaggccaccctgcacgccgcccgggacaccctggcctctgtgttccggctgctgcacagcctggaccaggccaaggaggagctggagcggctggccgccagcctggatggagcccggacccccctgctgcagaggatgcagaccttctccccagctggcagcaagctgcggctggtggaggccgctgaggcccacgcccagcagctgggccagctggccctgaacctgagcagcatcatcctggatgtgaaccaggaccggctgacccagagggccatcgaggccagcaatgcctacagccgcatcctgcaggccgtgcaggccgcagaagatgctgctggccaggccctgcagcaggccgaccacacctgggccaccgtggtgcggcagggcctggtggaccgggcccagcagctgctggccaacagcacagccctggaggaggccatgctgcaggagcagcagaggctgggcctggtgtgggccgccctgcagggcgcccggacccagctgagagatgtgcgggccaagaaggaccagctggaggcccacatccaggccgcccaggccatgctggccatggacacagatgagaccagcaagaagatcgcccacgccaaggctgtggccgctgaggcccaggacacagccaccagggtgcagagccagctgcaggccatgcaggagaatgtggagcgctggcagggccagtatgagggcctgcggggccaggacctgggccaggccgtgctggatgctggccacagcgtgtccaccctggagaagaccctgccccagctgctggccaagctgagcatcctggagaacagaggagtgcacaatgccagcctggccctgagcgccagcatcggccgggtgcgggagctgattgcccaggcccggggagctgccagcaaggtgaaggtgcccatgaagttcaacggccgctctggagtgcagctgcggaccccccgggacctggccgacctggccgcctacacagccctgaagttctacctgcagggccctgagcctgagcccggccagggcacagaggacagatttgtgatgtacatgggcagccggcaggccactggagactacatgggcgtgtccctgcgggacaagaaggtgcactgggtgtaccagctgggggaggccggccctgctgtgctgagcattgatgaggacatcggggagcagtttgctgctgtgtccctggacaggaccctgcagtttggccacatgtctgtgacagtggagcggcagatgatccaggagaccaagggggacacagtggcccctggagctgagggcctgctgaacctgcggccagatgactttgtgttctacgtgggcggctaccccagcaccttcaccccaccacccctgctgcgcttccctggctaccggggctgcatcgagatggacaccctgaatgaggaggtggtgtccctgtacaactttgagaggaccttccagctggacacagctgtggaccggccctgtgcccggagcaagagcactggagacccctggctgacagatggcagctacctggatggcactggatttgcccgcatcagctttgacagccagatcagcaccaccaagagatttgagcaggagctgcggctggtgtcctacagcggcgtgctcttcttcctgaagcagcagagccagttcctgtgcctggccgtgcaggagggcagcctggtgctgctgtatgactttggagctggcctgaagaaggctgtgcccctgcagcccccaccacccctgaccagcgccagcaaggccatccaggtgttcctgctgggcggcagcaggaagagggtgctggtgcgggtggagcgggccaccgtgtacagcgtggagcaggacaatgacctggagctggctgatgcctactacctgggcggcgtgcccccagaccagctgccccccagcctgcggcggctcttccccactggaggctctgtgcggggctgtgtgaagggcatcaaggccctgggcaagtatgtggacctgaagaggctgaacaccactggagtgtctgctggctgcacagctgacctgctggtgggccgggccatgaccttccacggccacggcttcctgcggctggccctgagcaatgtggcccccctgactggaaatgtgtacagcggcttcggcttccacagcgcccaggacagcgccctgctgtactaccgggccagcccagatggcctgtgccaggtgtccctgcagcagggccgggtgtccctgcagctgctgaggacagaggtgaagacccaggccggctttgctgatggagccccccactacgtggccttctacagcaatgccactggagtgtggctgtatgtggatgaccagctgcagcagatgaagccccaccggggccccccacctgagctgcagccccagcctgagggccccccccggctgctgctgggcggcctgcctgagagcggcaccatctacaacttcagcggctgcatcagcaatgtgtttgtgcagaggctgctgggcccccagagggtgtttgacctgcagcagaacctgggctctgtgaatgtgtccacaggctgtgccccagccctgcaggcccagaccccaggcctgggcccccggggcctgcaggccacagccaggaaggccagcagaagaagccggcagcctgcccggcacccagcctgcatgctgcccccccacctgcggaccacccgggacagctaccagtttggaggcagcctgagcagccacctggagtttgtgggcatcctggcccggcacaggaactggcccagcctgtccatgcacgtgctgcccaggagcagccggggcctgctgctcttcaccgcccggctgcggcccggcagccccagcctggccctcttcctgagcaatggccactttgtggcccagatggagggcctgggcacccggctgcgggcccagagccggcagaggagccggcccggccgctggcacaaggtgtctgtgcgctgggagaagaaccgcatcctgctggtgacagatggagcccgggcctggagccaggagggcccccaccggcagcaccagggcgctgagcacccccagccccacaccctgtttgtgggcggcctgcctgccagcagccacagcagcaagctgcctgtgacagtgggcttcagcggctgtgtgaagaggctgcggctgcacggccggcccctgggcgcccccaccaggatggccggcgtgaccccctgcatcctgggccccctggaggccggcctcttcttccctggcagcggaggagtcatcaccctggacctgcccggggccaccctgcctgatgtgggcctggagctggaggtgcggcccctggccgtgacaggcctcatcttccacctgggccaggcccggaccccaccctacctgcagctgcaggtgacagagaagcaggtgctgctgcgggcagatgatggagctggggagttcagcacctctgtgacccggcccagcgtgctgtgtgatggccagtggcaccggctggccgtgatgaagtctggaaatgtgctgcggctggaggtggatgcccagagcaaccacacagtgggccccctgctggccgctgctgctggggccccagcccccctgtacctgggcggcctgcctgagcccatggctgtgcagccctggcccccagcctactgcggctgcatgaggcggctggccgtgaacagaagccctgtggccatgaccaggtctgtggaggtgcacggggctgtgggcgccagcggctgcccagctgcctag

SEQ ID NO: 157303 - DNA, 1503 bp, Artificial Sequence
  Description of Artificial Sequence: Synthetic coding sequence
atggccaagaggctgtgtgccggcagcgccctgtgtgtgcggggcccccggggccctgcccccctgctgctggtgggcctggccctgctgggcgccgcccgggcccgggaggaggccggcggcggcttcagcctgcaccccccctacttcaacctggccgagggcgccagaattgctgccagcgccacctgtggggaggaggccccagcccggggcagcccccggcccacagaggacctgtactgcaagctggtgggcggccctgtggccggcggggaccccaaccagaccatccggggccagtactgtgacatctgcacagctgccaacagcaacaaggcccacccagccagcaatgccattgatggaacagagcgctggtggcagagcccccccctgagccggggcctggagtacaatgaggtgaatgtgaccctggacctgggccaggtgttccacgtggcctacgtgctgatcaagtttgccaacagccccaggccagacctgtgggtgctggagaggtccatggactttggccgcacctaccagccctggcagttctttgccagcagcaagagggactgcctggagagatttggcccccagaccctggagcgcatcaccagagatgatgctgccatctgcaccacagagtacagccgcatcgtgcccctggagaatggagagatcgtggtgtccctggtgaatggccggcctggggccatgaacttctcctacagccccctgctgcgggagttcaccaaggccaccaacgtgcggctgcgcttcctgcggaccaacaccctgctgggccacctgatgggcaaggccctgcgggaccccaccgtgacccggcgctactactacagcatcaaggacatcagcatcggcggccgctgtgtgtgccacggccacgcagatgcctgtgatgccaaggaccccacagaccccttccggctgcagtgcacctgccagcacaacacctgtggcggcacctgtgaccgctgctgccccggcttcaaccagcagccctggaagccagccacagccaacagcgccaatgaatgccagagctgcaactgctacggccacgccacagactgctactatgaccctgaggtggacagaagaagagccagccagagcctggatggcacctaccagggcggcggcgtgtgcatcgactgccagcaccacaccactggagtgaactgtgagcgctgcctgcccggcttctaccgcagccccaaccaccccctggacagcccccacgtgtgccgccgctgcaactgtgagagtgacttcacagatggcacctgtgaggacctgaccggccgctgctactgccggcccaacttcagcggggagcgctgtgatgtgtgtgccgagggcttcaccggcttccccagctgctaccccacccccagcagcagcaatgacacccgggagcaggtgctgcctgctggccagatcgtgaccaacaccaagatctcctgggtgtag

SEQ ID NO: 157304 - DNA, 1587 bp, Artificial Sequence
  Description of Artificial Sequence: Synthetic coding sequence
atggccaagaggctgtgtgccggcagcgccctgtgtgtgcggggcccccggggccctgcccccctgctgctggtgggcctggccctgctgggcgccgcccgggcccgggaggaggccggcggcggcttcagcctgcaccccccctacttcaacctggccgagggcgccagaattgctgccagcgccacctgtggggaggaggccccagcccggggcagcccccggcccacagaggacctgtactgcaagctggtgggcggccctgtggccggcggggaccccaaccagaccatccggggccagtactgtgacatctgcacagctgccaacagcaacaaggcccacccagccagcaatgccattgatggaacagagcgctggtggcagagcccccccctgagccggggcctggagtacaatgaggtgaatgtgaccctggacctgggccaggtgttccacgtggcctacgtgctgatcaagtttgccaacagccccaggccagacctgtgggtgctggagaggtccatggactttggccgcacctaccagccctggcagttctttgccagcagcaagagggactgcctggagagatttggcccccagaccctggagcgcatcaccagagatgatgctgccatctgcaccacagagtacagccgcatcgtgcccctggagaatggagagatcgtggtgtccctggtgaatggccggcctggggccatgaacttctcctacagccccctgctgcgggagttcaccaaggccaccaacgtgcggctgcgcttcctgcggaccaacaccctgctgggccacctgatgggcaaggccctgcgggaccccaccgtgacccggcgctactactacagcatcaaggacatcagcatcggcggccgctgtgtgtgccacggccacgcagatgcctgtgatgccaaggaccccacagaccccttccggctgcagtgcacctgccagcacaacacctgtggcggcacctgtgaccgctgctgccccggcttcaaccagcagccctggaagccagccacagccaacagcgccaatgaatgccagagctgcaactgctacggccacgccacagactgctactatgaccctgaggtggacagaagaagagccagccagagcctggatggcacctaccagggcggcggcgtgtgcatcgactgccagcaccacaccactggagtgaactgtgagcgctgcctgcccggcttctaccgcagccccaaccaccccctggacagcccccacgtgtgccgccgctgcaactgtgagagtgacttcacagatggcacctgtgaggacctgaccggccgctgctactgccggcccaacttcagcggggagcgctgtgatgtgtgtgccgagggcttcaccggcttccccagctgctaccccacccccagcagcagcaatgacacccgggagcaggtgctgcctgctggccagatcgtgaatggagtgtccctgtgccggcccggctggagcgctgtggcccggagccggctgaccagcaccagcgcctcctgggtgcaggccatcctgctgccccagagccctgagtag

SEQ ID NO: 157305 - DNA, 2187 bp, Artificial Sequence
  Description of Artificial Sequence: Synthetic coding sequence
atgtgggtgaccaagctgctgcctgccctgctgctgcagcacgtgctgctgcacctgctgctgctgcccatcgccatcccctatgcagagggccagaggaagagaagaaacaccatccacgagttcaagaagagcgccaagaccaccctcatcaagattgatcctgccctgaagatcaagaccaagaaggtgaacacagctgaccagtgtgccaaccgctgcaccaggaacaagggcctgcccttcacctgcaaggcctttgtgtttgacaaggccaggaagcagtgcctgtggttccccttcaacagcatgagcagcggcgtgaagaaggagtttggccacgagtttgacctgtatgagaacaaggactacatccggaactgcatcatcggcaagggccgcagctacaagggcaccgtgtccatcaccaagagcggcatcaagtgccagccctggagctccatgatcccccatgagcacagcttcctgcccagcagctaccggggcaaggacctgcaggagaactactgcaggaaccccagaggagaggagggcggcccctggtgcttcaccagcaaccctgaggtgcgctatgaggtgtgtgacatcccccagtgcagcgaggtggagtgcatgacctgcaatggagagagctaccggggcctgatggaccacacagagagcggcaagatctgccagcgctgggaccaccagaccccccaccgccacaagttcctgcctgagcgctacccagacaagggctttgatgacaactactgcagaaatccagatggccagccccggccctggtgctacaccctggacccccacacccgctgggagtactgtgccatcaagacctgtgccgacaacaccatgaatgacacagatgtgcccctggagaccacagagtgcatccagggccagggcgagggctaccggggcaccgtgaacaccatctggaatggcatcccctgccagcgctgggacagccagtacccccatgaacatgacatgaccccagagaacttcaagtgcaaggacctgcgggagaactactgcagaaatccagatggcagcgagagcccctggtgcttcaccacagaccccaacatccgggtgggctactgcagccagatccccaactgtgacatgagccacggccaggactgctacagaggaaatggcaagaactacatgggcaacctgagccagaccaggagcggcctgacctgcagcatgtgggacaagaacatggaggacctgcaccgccacatcttctgggagccagatgccagcaagctgaatgaaaactactgcagaaatccagatgatgatgcccacggcccctggtgctacacaggcaaccccctcatcccctgggactactgccccatcagccgctgtgagggggacaccacccccaccatcgtgaacctggaccaccctgtgatcagctgtgccaagaccaagcagctgcgggtggtgaatggcatccccaccaggaccaacatcggctggatggtgtccctgcgctacagaaacaagcacatctgtggcggcagcctcatcaaggagagctgggtgctgacagcccggcagtgcttccccagccgggacctgaaggactatgaggcctggctgggcatccatgatgtgcacggcagaggagatgagaagtgcaagcaggtgctgaatgtgtcccagctggtgtatggccctgagggcagtgacctggtgctgatgaagctggcccggcctgctgtgctggatgactttgtgtccaccatcgacctgcccaactacggctgcaccatccctgagaagaccagctgcagcgtgtatggctggggctacacaggcctcatcaactatgatggcctgctgcgggtggcccacctgtacatcatgggaaatgagaagtgcagccagcaccaccggggcaaggtgaccctgaatgaaagtgagatctgtgccggggctgagaagattggcagcggcccctgtgagggggactatggaggccccctggtgtgtgagcagcacaagatgaggatggtgctgggcgtgattgtgcccggccggggctgtgccatccccaacagacctggcatctttgtgcgggtggcctactatgccaagtggatccacaagatcatcctgacctacaaggtgccccagagctag

SEQ ID NO: 157306 - DNA, 276 bp, Artificial Sequence
  Description of Artificial Sequence: Synthetic coding sequence
atgggcctgctgcagctgctggccttctccttcctggccctgtgccgggcccgggtgcgggcccaggagcctgagttctcctatggctgtgccgagggcagctgctacccagccactggagacctgctgattggccgggcccagaagctgtctgtgaccagcacctgtggcctgcacaagccagagccctactgcatcgtgagccacctgcaggaggacaagaagtgcttcatctgcaacagccaggacccctaccacgagaccctgaacccctag

SEQ ID NO: 157307 - DNA, 2553 bp, Artificial Sequence
  Description of Artificial Sequence: Synthetic coding sequence
atgggcctgctgcagctgctggccttctccttcctggccctgtgccgggcccgggtgcgggcccaggagcctgagttctcctatggctgtgccgagggcagctgctacccagccactggagacctgctgattggccgggcccagaagctgtctgtgaccagcacctgtggcctgcacaagccagagccctactgcatcgtgagccacctgcaggaggacaagaagtgcttcatctgcaacagccaggacccctaccacgagaccctgaacccagacagccacctgattgaaaatgtggtgaccacctttgcccccaaccggctgaagatctggtggcagagtgaaaatggagtggagaatgtgaccatccagctggacctggaggccgagttccacttcacccacctgatcatgaccttcaagaccttccggcctgctgccatgctgattgaaagaagcagtgactttgggaagacctggggcgtgtaccgctactttgcctatgactgtgaggccagcttccctggcatcagcacaggccccatgaagaaggtggatgacatcatctgtgacagccgctacagcgacatcgagcccagcacagaaggagaggtgatcttccgggccctggaccctgccttcaagattgaggacccctacagcccccgcatccagaacctgctgaagatcaccaacctgcgcatcaagtttgtgaagctgcacaccctgggggacaacctgctggacagcaggatggagatccgggagaagtactactatgctgtgtatgacatggtggtgcggggcaactgcttctgctacggccacgcctctgaatgtgcccctgtggatggcttcaatgaggaggtggagggcatggtgcacggccactgcatgtgccgccacaacaccaagggcctgaactgtgagctgtgcatggacttctaccatgacctgccctggaggcctgctgagggcaggaacagcaatgcctgcaagaagtgcaactgcaatgagcacagcatcagctgccactttgacatggctgtgtacctggccactggaaatgtgtctgggggcgtgtgtgatgactgccagcacaacaccatgggcaggaactgtgagcagtgcaagcccttctactaccagcaccctgagcgggacatccgggaccccaacttctgtgagcgctgcacctgtgaccctgctggcagccagaatgaaggcatctgtgacagctacacagacttcagcacaggcctgattgctggccagtgccgctgcaagctgaatgtggagggggagcactgtgatgtgtgcaaggagggcttctatgacctgagcagcgaggaccccttcggctgcaagagctgtgcctgcaaccccctgggcaccatccctgggggcaacccctgtgacagcgagaccggccactgctactgcaagaggctggtgacaggccagcactgtgaccagtgcctgcctgagcactggggcctgagcaatgacctggatggctgccggccctgtgactgtgacctgggcggggccctgaacaacagctgctttgctgagagcggccagtgcagctgccggccccacatgattggccggcagtgcaatgaggtggagcccggctactactttgccaccctggaccactacctgtatgaagctgaggaggccaacctgggccctggggtgtccatcgtggagcggcagtacatccaggaccgcatccccagctggacaggagctggctttgtgcgggtgcctgagggcgcctacctggagttcttcatcgacaacatcccctacagcatggagtatgacatcctgatccgctatgagccccagctgcctgaccactgggagaaggctgtgatcaccgtgcagaggcctggccgcatccccaccagcagccgctgtggcaacaccatcccagatgatgacaaccaggtggtgtccctgagccctggcagccgctacgtggtgctgcccaggcctgtgtgctttgagaagggcaccaactacacagtgcggctggagctgccccagtacaccagcagtgacagtgatgtggagagcccctacaccctgattgacagcctggtgctgatgccctactgcaagagcctggacatcttcaccgtgggcggcagcggagatggagtggtgaccaacagcgcctgggagaccttccagcgctaccgctgcctggagaacagccgctctgtggtgaagacccccatgacagatgtgtgcaggaacatcatcttcagcatcagcgccctgctgcaccagacaggcctggcctgtgaatgtgacccccagggcagcctgagctctgtgtgtgaccccaacggcggccagtgccagtgccggcccaacgtggtgggccgcacctgcaacagatgtgcccctggcacctttggatttggccccagcggctgcaagaggcgcttcctgaagagcatcgtgatgcacagcttccggctgacccagcccctgtggcagggcagcattgctgctgagcccatgctgcccagctag

SEQ ID NO: 157308 - DNA, 5397 bp, Artificial Sequence
  Description of Artificial Sequence: Synthetic coding sequence
atggagctgaccagccgggagcggggccggggccagcccctgccctgggagctgcggctgggcctgctgctgtctgtgctggccgccaccctggcccaggccccagccccagatgtgcccggctgcagccggggcagctgctacccagccactggagacctgctggtgggccgggctgaccggctgacagccagcagcacctgtggcctgaatggcccccagccctactgcatcgtgagccacctgcaggatgagaagaagtgcttcctgtgtgacagccggcggcccttcagcgcccgggacaacccccacagccaccgcatccagaatgtggtgaccagctttgccccccagaggagagctgcctggtggcagagtgaaaatggcatcccagctgtgaccatccagctggacctggaggccgagttccacttcacccacctgatcatgaccttcaagaccttccggcctgctgccatgctggtggagaggtctgctgactttggccgcacctggcacgtgtaccgctacttctcctatgactgtggggctgacttccctggggtgcccctggccccacccaggcactgggatgatgtggtgtgtgagagccgctacagcgagattgagcccagcacagaaggagaggtgatctacagagtgctggaccctgccatccccatcccagacccctacagcagccgcatccagaacctgctgaagatcaccaacctgcgggtgaacctgacccggctgcacaccctgggggacaacctgctggacccccggcgggagatccgggagaagtactactatgccctgtatgagctggtggtgcggggcaactgcttctgctacggccacgcctctgaatgtgccccagcccctggggccccagcccacgccgagggcatggtgcatggagcctgcatctgcaagcacaacacccggggcctgaactgtgagcagtgccaggacttctacagagacctgccctggaggcctgcagaagatggccacagccacgcctgcaggaaatgtgagtgccacggccacacccacagctgccactttgacatggctgtgtacctggccagcggaaatgtgtctgggggcgtgtgtgatggctgccagcacaacacagctggccgccactgtgagctgtgccggcccttcttctacagagaccccaccaaggacctgcgggaccctgctgtgtgccgcagctgtgactgtgaccccatgggcagccaggacggcggccgctgtgacagccatgatgatcctgccctgggcctggtgtctggccagtgccgctgcaaggagcacgtggtgggcacccgctgccagcagtgcagagatggcttcttcggcctgagcatcagtgaccggctgggctgccgccgctgccagtgcaatgcccggggcaccgtgcccggcagcaccccctgtgaccccaacagcggcagctgctactgcaagaggctggtgacaggccggggctgtgaccgctgcctgcccggccactggggcctgagccatgacctgctgggctgccggccctgtgactgtgatgtgggcggggccctggacccccagtgtgatgagggcaccggccagtgccactgccggcagcacatggtgggccgccgctgtgagcaggtgcagcccggctacttccggcccttcctggaccacctgatctgggaggccgaggacacccggggccaggtgctggatgtggtggagcggctggtgaccccaggagagacccccagctggacaggcagcggctttgtgcggctgcaggagggccagaccctggagttcctggtggcctctgtgcccaaggccatggactatgacctgctgctgcggctggagccccaggtgcctgagcagtgggccgagctggagctgattgtgcagaggcctggccctgtgcctgcccacagcctgtgtggccacctggtgcccaaggatgaccgcatccagggcaccctgcagccccacgcccgctacctgatcttccccaaccctgtgtgcctggagcccggcatctcctacaagctgcacctgaagctggtgaggactggaggcagcgcccagcctgagaccccctacagcggccctggcctgctgattgacagcctggtgctgctgccccgggtgctggtgctggagatgttttctggaggagatgctgctgccctggagcggcaggccacctttgagcgctaccagtgccacgaggagggcctggtgcccagcaagaccagccccagcgaggcctgtgcccccctgctgatcagcctgagcaccctcatctacaacggggccctgccctgccagtgcaacccccagggcagcctgagcagcgagtgcaacccccacggcggccagtgcctgtgcaagccaggagtggtgggcagaagatgtgacctgtgtgcccctggctactacggcttcggccccaccggctgccaggcctgccagtgcagccatgaaggagccctgagcagcctgtgtgagaagaccagcggccagtgcctgtgcaggactggagccttcggcctgcgctgtgaccgctgccagaggggccagtggggcttccccagctgccggccctgtgtgtgcaatggacatgctgatgagtgcaacacccacactggagcctgcctgggctgccgggaccacactggaggagagcactgtgagcgctgcatcgccggcttccatggagacccccggctgccctacggcggccagtgccggccctgcccctgcccagagggccctggcagccagaggcactttgccaccagctgccaccaggatgagtacagccagcagatcgtgtgccactgccgggccggctacacaggcctgcgctgtgaggcctgtgcccctggccactttggagaccccagcaggcctgggggccgctgccagctgtgtgaatgttctggcaacatcgaccccatggaccctgatgcctgtgacccccacacaggccagtgcctgcgctgcctgcaccacacagagggcccccactgtgcccactgcaagccaggcttccacggccaggccgcccggcagagctgccaccgctgcacctgcaacctgctgggcaccaacccccagcagtgccccagcccagaccagtgccactgtgaccccagcagcggccagtgcccctgcctgcccaacgtgcagggccccagctgtgacagatgtgcccccaacttctggaacctgaccagcggccacggctgccagccctgtgcctgccaccccagccgggcccggggccccacctgcaatgagttcaccggccagtgccactgccgggccggctttggaggccgcacctgcagcgagtgccaggagctgcactggggagaccccggcctgcagtgccacgcctgtgactgtgacagccggggcatcgacaccccccagtgccaccgcttcaccggccactgcagctgcaggcctggggtgtctggagtgcgctgtgaccagtgtgcccggggcttcagcggcatcttccctgcctgccacccctgccacgcctgcttcggggactgggacagagtggtgcaggacctggccgcccggacccagaggctggagcagagggcccaggagctgcagcagacaggagtgctgggcgcctttgagagcagcttctggcacatgcaggagaagctgggcatcgtgcagggcatcgtgggcgccaggaacaccagcgctgccagcacagcccagctggtggaggccacagaggagctgcggcgggagattggagaggccacagagcacctgacccagctggaggccgacctgacagatgtgcaggatgagaacttcaatgccaaccacgccctgagcggcctggagcgggaccggctggccctgaacctgaccctgcggcagctggaccagcacctggacctgctgaagcacagcaacttcctgggcgcctatgacagcatcagacatgcccacagccagagcgctgaggccgagcggcgggccaacaccagcgccctggccgtgcccagccctgtgagcaacagcgccagcgcccggcacaggacagaggccctgatggatgcccagaaggaggacttcaacagcaagcacatggccaaccagagggccctgggcaagctgagcgcccacacccacaccctgagcctgacagacatcaatgagctggtgtgtggggcccctggagatgccccctgtgccaccagcccctgtggcggggccggctgcagagatgaagatggccagccccgctgtggcggcctgagctgcaatggagctgctgccacagctgacctggccctgggccgggcccggcacacccaggccgagctgcagagggccctggccgagggcggcagcatcctgagccgggtggccgagacccggcggcaggccagcgaggcccagcagagggcccaggccgccctggacaaggccaatgccagccggggccaggtggagcaggccaaccaggagctgcaggagctgatccagagcgtgaaggacttcctgaaccaggagggcgctgaccctgacagcattgagatggtggccaccagggtgctggagctgagcatcccagccagcgctgagcagatccagcacctggccggggccatcgccgagcgggtgcgcagcctggctgatgtggatgccatcctggccaggacagtgggagatgtgagaagagctgagcagctgctgcaggatgcccggcgggcccgctcctgggccgaggatgagaagcagaaggccgagaccgtgcaggccgccctggaggaggcccagagggcccagggcatcgcccagggcgccatcagaggagctgtggccgacacccgggacacagagcagaccctgtaccaggtgcaggagaggatggccggggctgagcgggccctgagcagcgctggggagcgggcccggcagctggatgccctgctggaggccctgaagctgaagagagctggcaacagcctggccgccagcacagctgaggagacagctggcagcgcccagggccgggcccaggaggccgagcagctgctgcggggccccctgggggaccagtaccagacagtgaaggccctggccgagaggaaggcccagggcgtgctggccgcccaggcccgggcagagcagctgagagatgaggcccgggacctgctgcaggccgcccaggacaagctgcagaggctgcaggagctggagggcacctatgaagaaaatgaaagagccctggagagcaaggccgcccagctggatggcctggaggccaggatgaggtctgtgctgcaggccatcaacctgcaggtgcagatctacaacacctgccagtag

SEQ ID NO: 157309 - DNA, 1143 bp, Artificial Sequence
  Description of Artificial Sequence: Synthetic coding sequence
atgcaggagaagctgggcatcgtgcagggcatcgtgggcgccaggaacaccagcgctgccagcacagcccagctggtggaggccacagaggagctgcggcgggagatcggggaggccacagagcacctgacccagctggaggccgacctgacagatgtgcaggatgagaacttcaatgccaaccacgccctgagcggcctggagcgggaccggctggccctgaacctgaccctgcggcagctggaccagcacctggacctgctgaagcacagcaacttcctgggcgcctatgacagcatcagacatgcccacagccagagcgctgaggccgagcggcgggccaacaccagcgccctggccgtgcccagccctgtgagcaacagcgccagcgcccggcacaggacagaggccctgatggatgcccagaaggaggacttcaacagcaagcacatggccaaccagagggccctgggcaagctgagcgcccacacccacaccctgagcctgacagacatcaatgagctggtgtgtggggcccctggagatgccccctgtgccaccagcccctgtggcggggccggctgcagagatgaagatggccagccccgctgtggcggcctgagctgcaatggagctgctgccacagctgacctggccctgggccgggcccggcacacccaggccgagctgcagagggccctggccgagggcggcagcatcctgagccgggtggccgagacccggcggcaggccagcgaggcccagcagagggcccaggccgccctggacaaggccaatgccagccggggccaggtggagcaggccaaccaggagctgcaggagctgatccagagcgtgaaggacttcctgaaccaggagggcgctgaccctgacagcattgagatggtggccaccagggtgctggagctgagcatcccagccagcgctgagcagatccagcacctggccggggccatcgccgagcgggtgcgcagcctggctgatgtggatgccatcctggcccagggcatcgcccagggcgccatcagaggagctgtggccgacacccgggacacagagcagcctgtgcccggcaccggggaggatggccgctgccgggccggcacagagctgtgcaggtag

SEQ ID NO: 157310 - DNA, 5397 bp, Artificial Sequence; identical to SEQ ID NO: 157308
  Description of Artificial Sequence: Synthetic coding sequence

SEQ ID NO: 157311 - DNA, 3519 bp, Artificial Sequence
  Description of Artificial Sequence: Synthetic coding sequence
atgaggcccttcttcctgctgtgctttgccctgcccggcctgctgcacgcccagcaggcctgcagcagaggagcctgctacccacctgtgggggacctgctggtgggccgcacccgcttcctgcgggccagcagcacctgtggcctgaccaagccagagacctactgcacccagtatggagagtggcagatgaagtgctgcaagtgtgacagccggcagccccacaactactacagccaccgggtggagaatgtggccagcagcagcggccccatgcgctggtggcagagccagaatgatgtgaaccctgtgtccctgcagctggacctggaccggcgcttccagctgcaggaggtgatgatggagttccagggccccatgcctgctggcatgctgattgaaagaagcagtgactttgggaagacctggagggtgtaccagtacctggccgctgactgcaccagcaccttcccccgggtgcggcagggccggccccagagctggcaggatgtgcgctgccagagcctgccccagaggcccaatgcccggctgaatggaggcaaggtgcagctgaacctgatggacctggtgtctggcatcccagccacccagagccagaagatccaggaggtgggggagatcaccaacctgcgggtgaacttcacccggctggcccctgtgccccagaggggctaccacccccccagcgcctactatgctgtgtcccagctgcggctgcagggcagctgcttctgccacggccacgccgacagatgtgcccccaagccaggggccagcgctggccccagcacagctgtgcaggtgcatgatgtgtgtgtgtgccagcacaacacagctggccccaactgtgagcgctgtgcccccttctacaacaaccggccctggaggcctgctgagggccaggatgcccacgagtgccagagatgtgactgcaatggccacagcgagacctgccactttgatcctgctgtgtttgctgccagccagggcgcctatggaggagtgtgtgacaactgccgggaccacacagagggcaagaactgtgagcgctgccagctgcactacttcaggaacagaagacctggggccagcatccaggagacctgcatcagctgtgaatgtgaccctgatggagctgtgcctggggccccctgtgaccctgtgacaggccagtgtgtgtgcaaggagcacgtgcagggcgagcgctgtgacctgtgcaagccaggcttcaccggcctgacctacgccaacccccagggctgccaccgctgtgactgcaacatcctgggcagcagaagagacatgccctgtgatgaggagagcggccgctgcctgtgcctgcccaacgtggtgggccccaagtgtgaccagtgtgccccctaccactggaagctggccagcggccagggctgtgagccctgtgcctgtgacccccacaacagcctgagcccccagtgcaaccagttcaccggccagtgcccctgccgggagggctttggaggcctgatgtgcagcgctgctgccatccggcagtgcccagacaggacctatggagatgtggccaccggctgccgggcctgtgactgtgacttccggggcacagagggccctggctgtgacaaggccagcggccgctgcctgtgcaggcctggcctgaccggcccccgctgtgaccagtgccagaggggctactgcaaccgctaccctgtgtgtgtggcctgccacccctgcttccagacctatgatgctgacctgcgggagcaggccctgcgcttcggccgcctgagaaatgccacagccagcctgtggagcggccctggcctggaggaccggggcctggccagccgcatcctggatgccaagagcaagattgagcagatccgggctgtgctgagcagccctgctgtgacagagcaggaggtggcccaggtggccagcgccatcctgagcctgcggaggaccctgcagggcctgcagctggacctgcccctggaggaggagaccctgagcctgccccgggacctggagagcctggacaggagcttcaacggcctgctgaccatgtaccagaggaagcgggagcagtttgagaagatcagcagcgctgaccccagcggggccttcaggatgctgagcacagcctatgagcagagcgcccaggccgcccagcaggtgtctgacagcagccggctgctggaccagctgcgggacagccggcgggaggccgagcggctggtgcggcaggccggcggcggcggcggcaccggcagccccaagctggtggccctgcggctggagatgagcagcctgcctgacctgacccccaccttcaacaagctgtgtggcaacagccggcagatggcctgcacccccatcagctgccctggagagctgtgcccccaggacaatggaacagcctgtggcagccgctgccggggcgtgctgcccagggctggaggagccttcctgatggccggccaggtggccgagcagctgcggggcttcaatgcccagctgcagaggacccggcagatgatccgggctgctgaggagagcgccagccagatccagagcagcgcccagaggctggagacccaggtgtctgccagccgcagccagatggaggaggatgtgcggaggacccggctgctgatccagcaggtgcgggacttcctgacagatcctgacacagatgctgccaccatccaggaggtgtctgaggccgtgctggccctgtggctgcccacagattctgccaccgtgctgcagaagatgaatgagatccaggccatcgccgcccggctgcccaacgtggacctggtgctgagccagaccaagcaggacatcgcccgggcccggcggctgcaggccgaggccgaggaggcccggagccgggcccatgctgtggagggccaggtggaggatgtggtgggcaacctgcggcagggcaccgtggccctgcaggaggcccaggacaccatgcagggcaccagccgcagcctgcggctcatccaggacagagtggccgaggtgcagcaggtgctgcggcctgctgagaagctggtgacctccatgaccaagcagctgggggacttctggaccaggatggaggagctgcggcaccaggcccggcagcagggcgctgaggccgtgcaggcccagcagctggccgagggcgccagcgagcaggccctgagcgcccaggagggctttgagcgcatcaagcagaagtatgcagagctgaaggaccggctgggccagagctccatgctgggggagcagggcgcccgcatccagagcgtgaagacagaggccgaggagctgtttggagagaccatggagatgatggacaggatgaaggacatggagctggagctgctgcggggcagccaggccatcatgctgcggtctgctgacctgaccggcctggagaagagggtggagcagatccgggaccacatcaatggccgggtgctgtactatgccacctgcaagtag

SEQ ID NO: 157312 - DNA, 3519 bp, Artificial Sequence; identical to SEQ ID NO: 157311
  Description of Artificial Sequence: Synthetic coding sequence

SEQ ID NO: 157313 - DNA, 3519 bp, Artificial Sequence; identical to SEQ ID NO: 157311
  Description of Artificial Sequence: Synthetic coding sequence

SEQ ID NO: 157314 - DNA, 567 bp, Artificial Sequence
  Description of Artificial Sequence: Synthetic coding sequence
atgaggcccttcttcctgctgtgctttgccctgcccggcctgctgcacgcccagcaggcctgcagcagaggagcctgctacccacctgtgggggacctgctggtgggccgcacccgcttcctgcgggccagcagcacctgtggcctgaccaagccagagacctactgcacccagtatggagagtggcagatgaagtgctgcaagtgtgacagccggcagccccacaactactacagccaccgggtggagaatgtggccagcagcagcggccccatgcgctggtggcagagccagaatgatgtgaaccctgtgtccctgcagctggacctggaccggcgcttccagctgcaggaggtgatgatggagttccagggccccatgcctgctggcatgctgattgaaagaagcagtgactttgggaagacctggagggtgtaccagtacctggccgctgactgcaccagcaccttcccccgggtgcggcagggccggccccagagctggcaggatgtgcgctgccagagcctgccccagaggcccaatgcccggctgaatggaggcaagtag

SEQ ID NO: 157315 - DNA, 483 bp, Artificial Sequence
  Description of Artificial Sequence: Synthetic coding sequence
atgaatgagatccaggccatcgccgcccggctgcccaacgtggacctggtgctgagccagaccaagcaggacatcgcccgggcccggcggctgcaggccgaggccgaggaggcccggagccgggcccatgctgtggagggccaggtggaggatgtggtgggcaacctgcggcagggcaccgtggccctgcaggaggcccaggacaccatgcagggcaccagccgcagcctgcggctcatccaggacagagtggccgaggtgcagcaggtgctgcggcctgctgagaagctggtgacctccatgaccaagcagctgggggacttctggaccaggatggaggagctgcggcaccaggcccggcagcagggcgctgaggccgtgcaggcccagcagctggccgagggcgccagcgagcaggccctgagcgcccaggagggctttgagcgcatcaagcagaagtatgcagagctgaaggacagatag

SEQ ID NO: 157316 - DNA, 4830 bp, Artificial Sequence
  Description of Artificial Sequence: Synthetic coding sequence
atgaggggcagccacagagctgccccagccctgcggccccggggccgcctgtggcctgtgctggccgtgctggccgctgctgctgctgctggctgtgcccaggccgccatggatgaatgtacagatgagggcggccggccccagcgctgcatgcctgagtttgtgaatgctgccttcaacgtgacagtggtggccaccaacacctgtggcaccccacctgaggagtactgtgtgcagacaggagtgactggagtgaccaagagctgccacctgtgtgatgctggccagccccacctgcagcacggggccgccttcctgacagactacaacaaccaggccgacaccacctggtggcagagccagaccatgctggccggcgtgcagtaccccagcagcatcaacctgaccctgcacctgggcaaggcctttgacatcacctacgtgcggctgaagttccacaccagcaggcctgagagctttgccatctacaagaggacccgggaggatggcccctggatcccctaccagtactacagcggcagctgtgagaacacctacagcaaggccaacagaggcttcatcagaactggaggagatgagcagcaggccctgtgcacagatgagttcagtgacatcagccccctgaccggcggcaatgtggccttcagcaccctggagggccggcccagcgcctacaactttgacaacagccctgtgctgcaggagtgggtgacagccacagacatccgggtgaccctgaaccggctgaacacctttggagatgaggtgttcaatgaccccaaggtgctgaagagctactactatgccatcagtgactttgctgtgggcggccgctgcaagtgcaatggacatgccagcgagtgcatgaagaatgaatttgacaagctggtgtgcaactgcaagcacaacacctacggcgtggactgtgagaagtgcctgcccttcttcaatgaccggccctggaggcgggccacagctgagagcgccagcgagtgcctgccctgtgactgcaatggccgcagccaggagtgctactttgatcctgagctgtaccgcagcactggacatggaggccactgcaccaactgccaggacaacacagatggagcccactgtgagcgctgccgggagaacttcttccggctgggcaacaatgaggcctgcagcagctgccactgcagccctgtgggcagcctgagcacccagtgtgacagctatggccgctgcagctgcaagccaggagtgatgggagacaagtgtgaccgctgccagcccggcttccacagcctgacagaggccggctgccggccctgcagctgtgaccccagcggcagcattgatgagtgcaacatcgagaccggccgctgtgtgtgcaaggacaacgtggagggcttcaactgtgagcgctgcaagccaggcttcttcaacctggagagcagcaacccccggggctgcaccccctgcttctgcttcggccacagctctgtgtgcaccaatgctgtgggctacagcgtgtacagcatcagcagcaccttccagattgatgaagatggctggagggctgagcagagagatggcagcgaggccagcctggagtggagcagcgagcggcaggacattgctgtgatcagtgacagctacttcccccgctacttcatcgccccagccaagttcctgggcaagcaggtgctgtcctatggccagaacctgtccttctccttccgggtggacagaagagacacccggctgtctgctgaggacctggtgctggagggcgccggcctgcgggtgtctgtgcccctgattgcccagggcaacagctaccccagcgagaccaccgtgaagtatgtgttccggctgcacgaggccacagactacccctggaggcctgccctgaccccatttgagttccagaagctgctgaacaacctgaccagcatcaagatccggggcacctacagcgagaggtctgctggctacctggatgatgtgaccctggccagcgcccggcccggccctggggtgcctgccacctgggtggagagctgcacctgccctgtgggctacggcggccagttctgtgagatgtgcctgagcggctacagaagagagacccccaacctgggcccctacagcccctgtgtgctgtgtgcctgcaatggccacagcgagacctgtgaccctgagactggagtgtgcaactgccgggacaacacagctggcccccactgtgagaagtgcagtgatggctactatggagacagcacagctggcaccagcagtgactgccagccctgcccctgccctgggggcagcagctgtgctgtggtgcccaagaccaaggaggtggtgtgcaccaactgccccaccggcaccaccgggaagagatgtgagctgtgtgatgatggctactttggagaccccctgggcagaaatggacctgtgcggctgtgccgcctgtgccagtgcagcgacaacatcgaccccaatgctgtgggcaactgcaaccggctgaccggggagtgcctgaagtgcatctacaacacagctggcttctactgtgaccgctgcaaggatggcttctttggaaaccccctggcccccaacccagctgacaagtgcaaggcctgcaactgcaacctgtatggcaccatgaagcagcagagcagctgcaaccctgtgacaggccagtgtgagtgcctgccccacgtgacaggccaggactgtggggcctgtgaccccggcttctacaacctgcagagcggccagggctgtgagcgctgtgactgccacgccctgggcagcaccaacggccagtgtgacatcagaacaggccagtgtgagtgccagcccggcatcaccggccagcactgtgagcgctgtgaggtgaaccactttggatttggacctgagggctgcaagccctgtgactgccaccctgagggcagcctgagcctgcagtgcaaggatgatggccgctgtgagtgccgggagggctttgtgggcaacagatgtgaccagtgtgaggagaactacttctacaacagatcctggccaggctgccaggagtgcccagcctgctaccgcctggtgaaggacaaggtggccgaccaccgggtgaagctgcaggagctggagagcctcatcgccaacctgggcactggagatgagatggtgacagaccaggcctttgaggaccggctgaaggaggccgagcgggaggtgatggacctgctgcgggaggcccaggatgtgaaggatgtggaccagaacctgatggaccggctgcagagggtgaacaacaccctgagcagccagatcagccggctgcagaacatccggaacaccatcgaggagactggaaacctggccgagcaggcccgggcccacgtggagaacacagagcggctgattgaaattgccagccgggagctggagaaggccaaggtggccgccgccaacgtgtctgtgacccagcctgagagcactggagaccccaacaacatgaccctgctggccgaggaggccaggaagctggccgagcggcacaagcaggaggctgatgacatcgtgcgggtggccaagacagccaatgacaccagcacagaggcctacaacctgctgctgcggaccctggccggggagaaccagacagcctttgaaattgaggagctgaacagaaaatatgagcaggccaagaacatcagccaggacctggagaagcaggccgcccgggtgcatgaggaggccaagagagctggggacaaggctgtggagatctatgcctctgtggcccagctgagccccctggacagcgagaccctggagaatgaggccaacaacatcaagatggaggccgagaacctggagcagctgattgaccagaagctgaaggactatgaggacctgcgggaggacatgaggggcaaggagctggaggtgaagaacctgctggagaagggcaagacagagcagcagacagctgaccagctgctggcccgggcagatgctgccaaggccctggccgaggaggccgccaagaagggccgggacaccctgcaggaggccaatgacatcctgaacaacctgaaggactttgacagaagagtgaatgacaacaagacagctgctgaggaggccctgaggaagatcccagccatcaaccagaccatcacagaggccaatgagaagacccgggaggcccagcaggccctgggcagcgctgctgctgatgccacagaggccaagaacaaggcccatgaagctgagcgcatcgccagcgctgtgcagaagaatgccaccagcaccaaggccgaggccgagaggacctttgctgaggtgacagacctggacaatgaggtgaacaacatgctgaagcagctgcaggaggccgagaaggagctgaagaggaagcaggatgatgctgaccaggacatgatgatggccggcatggccagccaggccgcccaggaggccgagatcaatgccaggaaggccaagaacagcgtgaccagcctgctgagcatcatcaatgacctgctggagcagctgggccagctggacacagtggacctgaacaagctgaatgaaattgagggcaccctgaacaaggccaaggatgagatgaaggtgtctgacctggacaggaaggtgtctgacctggagaatgaggccaagaagcaggaggccgccatcatggactacaacagagacatcgaggagatcatgaaggacatccggaacctggaggacatcaggaagaccctgcccagcggctgcttcaacacccccagcattgagaagccctag

SEQ ID NO: 157317 - DNA, 3582 bp, Artificial Sequence
  Description of Artificial Sequence: Synthetic coding sequence
atgcctgccctgtggctgggctgctgcctgtgcttcagcctgctgctgcctgctgcccgggccaccagccggcgggaggtgtgtgactgcaatggcaagagccggcagtgcatctttgaccgggagctgcaccggcagacaggaaatggcttccgctgcctgaactgcaatgacaacacagatggcatccactgtgagaagtgcaagaatggcttctaccgccaccgggagcgggaccgctgcctgccctgcaactgcaacagcaagggcagcctgagcgcccgctgtgacaacagcggccgctgcagctgcaagccaggagtgactggagcccgctgtgaccgctgcctgcccggcttccacatgctgacagatgctggctgcacccaggaccagaggctgctggacagcaaatgtgactgtgaccctgctggcattgctggcccctgtgatgctggccgctgtgtgtgcaagccagctgtgactggagagcgctgtgaccgctgccgcagcggctactacaacctggatggcggcaaccctgagggctgcacccagtgcttctgctacggccacagcgccagctgccgcagcagcgctgagtacagcgtgcacaagatcaccagcaccttccaccaggatgtggatggctggaaggctgtgcagagaaatggcagccctgccaagctgcagtggagccagaggcaccaggatgtgttcagcagcgcccagaggctggaccctgtgtactttgtggccccagccaagttcctgggcaaccagcaggtgtcctatggccagagcctgagctttgactacagagtggaccggggcggccgccaccccagcgcccatgatgtgatcctggagggcgccggcctgcgcatcacagcccccctgatgcccctgggcaagaccctgccctgtggcctgaccaagacctacaccttccggctgaatgagcaccccagcaacaactggagcccccagctgagctactttgagtacagaaggctgctgaggaacctgacagccctgcgcatccgggccacctacggggagtacagcacaggctacatcgacaacgtgaccctcatcagcgcccggcctgtgtctggggccccagccccctgggtggagcagtgcatctgccctgtgggctacaagggccagttctgccaggactgtgccagcggctacaagagggacagcgcccggctgggccccttcggcacctgcatcccctgcaactgccagggcggcggggcctgtgaccctgacaccggggactgctacagcggagatgagaacccagacattgaatgtgccgactgccccatcggcttctacaatgacccccatgaccccaggagctgcaagccctgcccctgccacaacggcttcagctgcagcgtgatgcctgagacagaggaggtggtgtgcaacaactgccccccaggagtgactggagcccgctgtgagctgtgtgctgatggctactttggagacccctttggagagcacggccctgtgcggccctgccagccctgccagtgcaacaacaacgtggaccccagcgccagcggcaactgtgaccggctgaccggccgctgcctgaagtgcatccacaacacagctggcatctactgtgaccagtgcaaggccggctactttggagaccccctggcccccaacccagctgacaagtgccgggcctgcaactgcaaccccatgggcagcgagcctgtgggctgccgcagtgatggcacctgtgtgtgcaagccaggctttggaggccccaactgtgagcacggggccttcagctgcccagcctgctacaaccaggtgaagatccagatggaccagttcatgcagcagctgcagaggatggaggccctgatcagcaaggcccagggcggagatggagtggtgcctgacacagagctggagggccgcatgcagcaggccgagcaggccctgcaggacatcctgagagatgcccagatcagcgagggcgccagccgcagcctgggcctgcagctggccaaggtgcgcagccaggagaacagctaccagagccggctggatgacctgaagatgacagtggagcgggtgcgggccctgggcagccagtaccagaacagagtgcgggacacccacaggctcatcacccagatgcagctgagcctggccgagagcgaggccagcctgggcaacaccaacatcccagccagtgaccactacgtgggccccaacggcttcaagagcctggcccaggaggccacccggctggccgagagccacgtggagagcgccagcaacatggagcagctgacccgggagacagaggactacagcaagcaggccctgagcctggtgaggaaggccctgcacgagggcgtgggcagcggcagcggcagcccagatggagctgtggtgcagggcctggtggagaagctggagaagaccaagagcctggcccagcagctgacccgggaggccacccaggccgagattgaagctgacaggagctaccagcacagcctgcggctgctggacagcgtgtcccggctgcagggcgtgtctgaccagagcttccaggtggaggaggccaagaggatcaagcagaaggctgacagcctgagcagcctggtgaccaggcacatggatgagttcaagaggacccagaagaacctgggcaactggaaggaggaggcccagcagctgctgcagaatggcaagagcggccgggagaagagtgaccagctgctgagccgggccaacctggccaagagccgggcccaggaggccctgtccatgggaaatgccaccttctatgaggtggagagcatcctgaagaacctgcgggagtttgacctgcaggtggacaacaggaaggccgaggccgaggaggccatgaagaggctgagctacatcagccagaaggtgtctgatgccagtgacaagacccagcaggccgagcgggccctgggcagcgctgctgctgatgcccagagggccaagaatggagctggggaggccctggagatcagcagcgagattgagcaggagatcggcagcctgaacctggaggccaacgtgacagcagatggagccctggccatggagaagggcctggccagcctgaagtctgagatgagggaggtggagggggagctggagaggaaggagctggagtttgacaccaacatggatgctgtgcagatggtgatcacagaggcccagaaggtggacacccgggccaagaatgctggggtgaccatccaggacaccctgaacaccctggatggcctgctgcacctgatggaccagcccctgtctgtggatgaggagggcctggtgctgctggagcagaagctgagccgggccaagacccagatcaacagccagctgcggcccatgatgtctgagctggaggagcgggcccggcagcagaggggccacctgcacctgctggagaccagcattgatggcatcctggctgatgtgaagaacctggagaacatccgggacaacctgcccccaggctgctacaacacccaggccctggagcagcagtag

SEQ ID NO: 157318 - DNA, 3336 bp, Artificial Sequence
  Description of Artificial Sequence: Synthetic coding sequence
atgcctgccctgtggctgggctgctgcctgtgcttcagcctgctgctgcctgctgcccgggccaccagccggcgggaggtgtgtgactgcaatggcaagagccggcagtgcatctttgaccgggagctgcaccggcagacaggaaatggcttccgctgcctgaactgcaatgacaacacagatggcatccactgtgagaagtgcaagaatggcttctaccgccaccgggagcgggaccgctgcctgccctgcaactgcaacagcaagggcagcctgagcgcccgctgtgacaacagcggccgctgcagctgcaagccaggagtgactggagcccgctgtgaccgctgcctgcccggcttccacatgctgacagatgctggctgcacccaggaccagaggctgctggacagcaaatgtgactgtgaccctgctggcattgctggcccctgtgatgctggccgctgtgtgtgcaagccagctgtgactggagagcgctgtgaccgctgccgcagcggctactacaacctggatggcggcaaccctgagggctgcacccagtgcttctgctacggccacagcgccagctgccgcagcagcgctgagtacagcgtgcacaagatcaccagcaccttccaccaggatgtggatggctggaaggctgtgcagagaaatggcagccctgccaagctgcagtggagccagaggcaccaggatgtgttcagcagcgcccagaggctggaccctgtgtactttgtggccccagccaagttcctgggcaaccagcaggtgtcctatggccagagcctgagctttgactacagagtggaccggggcggccgccaccccagcgcccatgatgtgatcctggagggcgccggcctgcgcatcacagcccccctgatgcccctgggcaagaccctgccctgtggcctgaccaagacctacaccttccggctgaatgagcaccccagcaacaactggagcccccagctgagctactttgagtacagaaggctgctgaggaacctgacagccctgcgcatccgggccacctacggggagtacagcacaggctacatcgacaacgtgaccctcatcagcgcccggcctgtgtctggggccccagccccctgggtggagcagtgcatctgccctgtgggctacaagggccagttctgccaggactgtgccagcggctacaagagggacagcgcccggctgggccccttcggcacctgcatcccctgcaactgccagggcggcggggcctgtgaccctgacaccggggactgctacagcggagatgagaacccagacattgaatgtgccgactgccccatcggcttctacaatgacccccatgaccccaggagctgcaagccctgcccctgccacaacggcttcagctgcagcgtgatgcctgagacagaggaggtggtgtgcaacaactgccccccaggagtgactggagcccgctgtgagctgtgtgctgatggctactttggagacccctttggagagcacggccctgtgcggccctgccagccctgccagtgcaacaacaacgtggaccccagcgccagcggcaactgtgaccggctgaccggccgctgcctgaagtgcatccacaacacagctggcatctactgtgaccagtgcaaggccggctactttggagaccccctggcccccaacccagctgacaagtgccgggcctgcaactgcaaccccatgggcagcgagcctgtgggctgccgcagtgatggcacctgtgtgtgcaagccaggctttggaggccccaactgtgagcacggggccttcagctgcccagcctgctacaaccaggtgaagatccagatggaccagttcatgcagcagctgcagaggatggaggccctgatcagcaaggcccagggcggagatggagtggtgcctgacacagagctggagggccgcatgcagcaggccgagcaggccctgcaggacatcctgagagatgcccagatcagcgagggcgccagccgcagcctgggcctgcagctggccaaggtgcgcagccaggagaacagctaccagagccggctggatgacctgaagatgacagtggagcgggtgcgggccctgggcagccagtaccagaacagagtgcgggacacccacaggctcatcacccagatgcagctgagcctggccgagagcgaggccagcctgggcaacaccaacatcccagccagtgaccactacgtgggccccaacggcttcaagagcctggcccaggaggccacccggctggccgagagccacgtggagagcgccagcaacatggagcagctgacccgggagacagaggactacagcaagcaggccctgagcctggtgaggaaggccctgcacgagggcgtgggcagcggcagcggcagcccagatggagctgtggtgcagggcctggtggagaagctggagaagaccaagagcctggcccagcagctgacccgggaggccacccaggccgagattgaagctgacaggagctaccagcacagcctgcggctgctggacagcgtgtcccggctgcagggcgtgtctgaccagagcttccaggtggaggaggccaagaggatcaagcagaaggctgacagcctgagcagcctggtgaccaggcacatggatgagttcaagaggacccagaagaacctgggcaactggaaggaggaggcccagcagctgctgcagaatggcaagagcggccgggagaagagtgaccagctgctgagccgggccaacctggccaagagccgggcccaggaggccctgtccatgggaaatgccaccttctatgaggtggagagcatcctgaagaacctgcgggagtttgacctgcaggtggacaacaggaaggccgaggccgaggaggccatgaagaggctgagctacatcagccagaaggtgtctgatgccagtgacaagacccagcaggccgagcgggccctgggcagcgctgctgctgatgcccagagggccaagaatggagctggggaggccctggagatcagcagcgagattgagcaggagatcggcagcctgaacctggaggccaacgtgacagcagatggagccctggccatggagaagggcctggccagcctgaagtctgagatgagggaggtggagggggagctggagaggaaggagctggagtttgacaccaacatggatgctgtgcagatggtgatcacagaggcccagaaggtggacacccgggccaagaatgctggggtgaccatccaggacaccctgaacaccctggatggcctgctgcacctgatgggcatgtag

SEQ ID NO: 157319 - DNA, 3033 bp, Artificial Sequence
  Description of Artificial Sequence: Synthetic coding sequence
atgcctgccctgtggctgggctgctgcctgtgcttcagcctgctgctgcctgctgcccgggccaccagccggcgggaggtgtgtgactgcaatggcaagagccggcagtgcatctttgaccgggagctgcaccggcagacaggaaatggcttccgctgcctgaactgcaatgacaacacagatggcatccactgtgagaagtgcaagaatggcttctaccgccaccgggagcgggaccgctgcctgccctgcaactgcaacagcaagggcagcctgagcgcccgctgtgacaacagcggccgctgcagctgcaagccaggagtgactggagcccgctgtgaccgctgcctgcccggcttccacatgctgacagatgctggctgcacccaggaccagaggctgctggacagcaaatgtgactgtgaccctgctggcattgctggcccctgtgatgctggccgctgtgtgtgcaagccagctgtgactggagagcgctgtgaccgctgccgcagcggctactacaacctggatggcggcaaccctgagggctgcacccagtgcttctgctacggccacagcgccagctgccgcagcagcgctgagtacagcgtgcacaagatcaccagcaccttccaccaggatgtggatggctggaaggctgtgcagagaaatggcagccctgccaagctgcagtggagccagaggcaccaggatgtgttcagcagcgcccagaggctggaccctgtgtactttgtggccccagccaagttcctgggcaaccagcaggtgtcctatggccagagcctgagctttgactacagagtggaccggggcggccgccaccccagcgcccatgatgtgatcctggagggcgccggcctgcgcatcacagcccccctgatgcccctgggcaagaccctgccctgtggcctgaccaagacctacaccttccggctgaatgagcaccccagcaacaactggagcccccagctgagctactttgagtacagaaggctgctgaggaacctgacagccctgcgcatccgggccacctacggggagtacagcacaggctacatcgacaacgtgaccctcatcagcgcccggcctgtgtctggggccccagccccctgggtggagcagtgcatctgccctgtgggctacaagggccagttctgccaggactgtgccagcggctacaagagggacagcgcccggctgggccccttcggcacctgcatcccctgcaactgccagggcggcggggcctgtgaccctgacaccggggactgctacagcggagatgagaacccagacattgaatgtgccgactgccccatcggcttctacaatgacccccatgaccccaggagctgcaagccctgcccctgccacaacggcttcagctgcagcgtgatgcctgagacagaggaggtggtgtgcaacaactgccccccaggagtgactggagcccgctgtgagctgtgtgctgatggctactttggagacccctttggagagcacggccctgtgcggccctgccagccctgccagtgcaacaacaacgtggaccccagcgccagcggcaactgtgaccggctgaccggccgctgcctgaagtgcatccacaacacagctggcatctactgtgaccagtgcaaggccggctactttggagaccccctggcccccaacccagctgacaagtgccgggcctgcaactgcaaccccatgggcagcgagcctgtgggctgccgcagtgatggcacctgtgtgtgcaagccaggctttggaggccccaactgtgagcacggggccttcagctgcccagcctgctacaaccaggtgaagatccagatggaccagttcatgcagcagctgcagaggatggaggccctgatcagcaaggcccagggcggagatggagtggtgcctgacacagagctggagggccgcatgcagcaggccgagcaggccctgcaggacatcctgagagatgcccagatcagcgagggcgccagccgcagcctgggcctgcagctggccaaggtgcgcagccaggagaacagctaccagagccggctggatgacctgaagatgacagtggagcgggtgcgggccctgggcagccagtaccagaacagagtgcgggacacccacaggctcatcacccagatgcagctgagcctggccgagagcgaggccagcctgggcaacaccaacatcccagccagtgaccactacgtgggccccaacggcttcaagagcctggcccaggaggccacccggctggccgagagccacgtggagagcgccagcaacatggagcagctgacccgggagacagaggactacagcaagcaggccctgagcctggtgaggaaggccctgcacgagggcgtgggcagcggcagcggcagcccagatggagctgtggtgcagggcctggtggagaagctggagaagaccaagagcctggcccagcagctgacccgggaggccacccaggccgagattgaagctgacaggagctaccagcacagcctgcggctgctggacagcgtgtcccggctgcagggcgtgtctgaccagagcttccaggtggaggaggccaagaggatcaagcagaaggctgacagcctgagcagcctggtgaccaggcacatggatgagttcaagaggacccagaagaacctgggcaactggaaggaggaggcccagcagctgctgcagaatggcaagagcggccgggagaagagtgaccagctgctgagccgggccaacctggccaagagccgggcccaggaggccctgtccatgggaaatgccaccttctatgaggtggagagcatcctgaagaacctgcgggagtttgacctgcaggtggacaacaggaaggccgaggccttccccagccaggaccctgaccagcagcccacagctgcccatgatgtgcgggccggccgggagggcaccagcgctgagggccccccaccatttgctggggacaagcaccgctgggacagcggctag

SEQ ID NO: 157320 - DNA, 1590 bp, Artificial Sequence
  Description of Artificial Sequence: Synthetic coding sequence
atggctgctgctgccctgctgctgggcctggccctgctggcccccagggctgctggggccggcatgggcgcctgctatgatggagctggccggccccagcgctgcctgcctgtgtttgaaaatgctgccttcggccgcctggcccaggccagccacacctgtggcagccccccagaggacttctgcccccacgtgggcgccgccggggccggggcccactgccagagatgtgatgctgctgacccccagaggcaccacaatgccagctacctgacagacttccacagccaggatgagagcacctggtggcagagccccagcatggccttcggcgtgcagtaccccacctctgtgaacatcaccctgcggctgggcaaggcctatgagatcacctacgtgcggctgaagttccacaccagcaggcctgagagctttgccatctacaagaggagcagagcagatggcccctgggagccctaccagttctacagcgccagctgccagaagacctacggccggcctgagggccagtacctgcggcctggagaagatgagcgggtggccttctgcaccagcgagttcagtgacatcagccccctgagcggcggcaatgtggccttcagcaccctggagggccggcccagcgcctacaactttgaggagagccctggcctgcaggagtgggtgaccagcacagagctgctgatcagcctggaccggctgaacacctttggagatgacatcttcaaggaccccaaggtgctgcagagctactactatgctgtgtctgacttctctgtgggcggccgctgcaagtgcaatggccacgcctctgaatgtggcccagatgtggccggccagctggcctgccgctgccagcacaacaccactggaacagactgtgagcgctgcctgcccttcttccaggaccggccctgggcccggggcacagctgaggccgcccatgaatgtctgccctgcaactgcagcggccgctcagaagaatgtacctttgaccgggagctgttccgcagcacaggccacggcggccgctgccaccactgccgggaccacacagctggcccccactgtgagcgctgccaggagaacttctaccactgggaccccaggatgccctgccagccctgtgactgccagagcgctggcagcctgcacctgcagtgtgatgacaccggcacctgtgcctgcaagcccaccgtgacaggctggaagtgtgaccgctgcctgcccggcttccacagcctgtctgagggcggctgccggccctgcacctgcaacccagctggcagcctggacacctgtgaccccaggagcggccgctgcccctgcaaggaaaatgtggagggcaacctgtgtgaccgctgccggcccggcaccttcaacctgcagccccacaacccagctggccgcagctgccgcagccgggccagccgggtgaccagccccaggtctgcccccaccaacagaacctggaggcccttctgcacagcctgccccaggacagtgcctgctggcagcgagggctgcccagaccccaggcacaccctgccccacctgctcttcacctag

SEQ ID NO: 157321 - DNA, 4728 bp, Artificial Sequence
  Description of Artificial Sequence: Synthetic coding sequence
atggctgctgctgccctgctgctgggcctggccctgctggcccccagggctgctggggccggcatgggcgcctgctatgatggagctggccggccccagcgctgcctgcctgtgtttgaaaatgctgccttcggccgcctggcccaggccagccacacctgtggcagccccccagaggacttctgcccccacgtgggcgccgccggggccggggcccactgccagagatgtgatgctgctgacccccagaggcaccacaatgccagctacctgacagacttccacagccaggatgagagcacctggtggcagagccccagcatggccttcggcgtgcagtaccccacctctgtgaacatcaccctgcggctgggcaaggcctatgagatcacctacgtgcggctgaagttccacaccagcaggcctgagagctttgccatctacaagaggagcagagcagatggcccctgggagccctaccagttctacagcgccagctgccagaagacctacggccggcctgagggccagtacctgcggcctggagaagatgagcgggtggccttctgcaccagcgagttcagtgacatcagccccctgagcggcggcaatgtggccttcagcaccctggagggccggcccagcgcctacaactttgaggagagccctggcctgcaggagtgggtgaccagcacagagctgctgatcagcctggaccggctgaacacctttggagatgacatcttcaaggaccccaaggtgctgcagagctactactatgctgtgtctgacttctctgtgggcggccgctgcaagtgcaatggccacgcctctgaatgtggcccagatgtggccggccagctggcctgccgctgccagcacaacaccactggaacagactgtgagcgctgcctgcccttcttccaggaccggccctgggcccggggcacagctgaggccgcccatgaatgtctgccctgcaactgcagcggccgctcagaagaatgtacctttgaccgggagctgttccgcagcacaggccacggcggccgctgccaccactgccgggaccacacagctggcccccactgtgagcgctgccaggagaacttctaccactgggaccccaggatgccctgccagccctgtgactgccagagcgctggcagcctgcacctgcagtgtgatgacaccggcacctgtgcctgcaagcccaccgtgacaggctggaagtgtgaccgctgcctgcccggcttccacagcctgtctgagggcggctgccggccctgcacctgcaacccagctggcagcctggacacctgtgaccccaggagcggccgctgcccctgcaaggaaaatgtggagggcaacctgtgtgaccgctgccggcccggcaccttcaacctgcagccccacaacccagctggctgcagcagctgcttctgctacggccacagcaaggtgtgtgccagcacagcccagttccaggtgcaccacatcctgagtgacttccaccagggcgctgagggctggtgggcccggtctgtgggcggcagcgagcaccccccccagtggagccccaacggggtgctgctgagcccagaagatgaggaggagctgacagcccctgagaagttcctgggggaccagcgcttctcctatggccagcccctcatcctgaccttccgggtgcccccaggggacagccccctgcctgtgcagctgcggctggagggcaccggcctggccctgagcctgcggcacagcagcctgagcggcccccaggatgctggccacccccgggaggtggagctgcgcttccacctgcaggagaccagtgaagatgtggccccacccctgccccccttccacttccagaggctgctggccaacctgaccagcctgcggctgcgggtgtccccaggccccagccctgctggccctgtgttcctgacagaggtgcggctgaccagcgcccggcccggcctgagccccccagcctcctgggtggagatctgcagctgccccaccggctacacaggccagttctgtgagagctgtgcccctggctacaagcgggagatgccccagggcggcccctatgccagctgtgtgccctgcacctgcaaccagcacggcacctgtgaccccaacacaggcatctgtgtgtgcagccaccacacagagggccccagctgtgagcgctgcctgcccggcttctacggcaacccctttgctggccaggctgatgactgccagccctgcccctgccccggccagagcgcctgcaccaccatccctgagagccgggaggtggtgtgcacccactgccccccaggccagaggggccgccgctgtgaggtgtgtgatgatggcttcttcggggaccccctgggcctgtttggccacccccagccctgccaccagtgccagtgcagcggaaatgtggaccccaatgctgtgggcaactgtgaccccctgagcggccactgcctgcgctgcctgcacaacaccactggagaccactgtgagcactgccaggagggcttctacggcagcgccctggcccccaggcctgctgacaagtgcatgccctgcagctgccacccccagggctctgtgtctgagcagatgccctgtgaccctgtgacaggccagtgcagctgcctgccccacgtgacagcccgggactgcagccgctgctacccaggcttctttgacctgcagcccggccggggctgccgcagctgcaagtgccaccccctgggcagccaggaggaccagtgccaccccaagacaggccagtgcacctgcaggcctggggtgacaggccaggcctgtgaccgctgccagctgggcttcttcggcttcagcatcaagggctgccgggcctgccgctgcagccccctgggcgccgccagcgcccagtgccatgaaaatggcacctgtgtgtgcaggcctggctttgagggctacaagtgtgaccgctgccacgacaacttcttcctgacagcagatggcacccactgccagcagtgccccagctgctacgccctggtgaaggaggaggccgccaagctgaaggcccggctgaccctgacagagggctggctgcagggcagtgactgtggcagcccctggggccccctggacatcctgctgggggaggcccccagaggagatgtgtaccagggccaccacctgctgcccggggcccgggaggccttcctggagcagatgatgagcctggagggcgctgtgaaggccgcccgggagcagctgcagaggctgaacaagggggcccgctgtgcccaggccggcagccagaagacctgcacccagctggccgacctggaggccgtgctggagagcagcgaggaggagatcctgcacgccgccgccatcctggccagcctggagatcccccaggagggccccagccagcccaccaagtggagccacctggccacagaggcccgggccctggcccggagccaccgggacacagccaccaagattgctgccacagcctggagggccctgctggccagcaacaccagctatgccctgctgtggaacctgctggagggccgggtggccctggagacccagagggacctggaggaccgctaccaggaggtgcaggccgcccagaaggccctgaggacagctgtggccgaggtgctgcctgaggccgagagcgtgctggccaccgtgcagcaggtgggcgctgacacagccccctacctggccctgctggccagccctggggccctgccccagaagagcagagctgaggacctgggcctgaaggccaaggccctggagaagacagtggcctcctggcagcacatggccacagaagctgcccggaccctgcagacagctgcccaggccaccctgcggcagacagagcccctgaccaagctgcaccaggaggcccgggccgccctgacccaggccagcagctctgtgcaggccgccaccgtgacagtgatgggcgcccggaccctgctggccgacctggagggcatgaagctgcagttcccccggcccaaggaccaggccgccctgcagaggaaggctgacagcgtgtctgaccggctgctggccgacaccaggaagaagaccaagcaggccgagaggatgctgggcaatgctgcccccctgagcagcagcgccaagaagaagggccgggaggccgaggtgctggccaaggacagcgccaagctggccaaggccctgctgcgggagaggaagcaggcccaccggcgggccagccggctgaccagccagacccaggccaccctgcagcaggccagccagcaggtgctggccagcgaggcccggcggcaggagctggaggaggccgagcgggtgggcgccggcctgtctgagatggagcagcagatccgggagagccgcatcagcctggagaaggacatcgagaccctgtctgagctgctggcccggctgggcagcctggacacccaccaggccccagcccaggccctgaatgagacccagtgggccctggagcggctgcggctgcagctgggcagccctggcagcctgcagaggaagctgagcctgctggagcaggagagccagcagcaggagctgcagatccagggctttgaaagtgacctggccgagatccgggctgacaagcagaacctggaggccatcctgcacagcctgcctgagaactgtgcctcctggcagtag

SEQ ID NO: 157322 - DNA, 459 bp, Artificial Sequence
  Description of Artificial Sequence: Synthetic coding sequence
atgaggctgcccctgagccacagccctgagcacgtggagatggccctgctgagcaacatcctggccgcctacagctttgtgtctgaaaatcctgagcgggccgccctgtactttgtgtctggagtgtgcatcggcctggtgctgaccctggccgccctggtgatccgcatcagctgccacacagactgcagaagaagacctgggaagaagttcctgcaggaccgggagagcagcagtgacagcagtgacagtgaagatggctctgaagatactgtgtctgacctgtctgtgcggcggcacagaagatttgagaggaccctgaacaagaatgtgttcaccagcgctgaggagctggagcgggcccagaggctggaggagcgggagcgcatcatccgggagatctggatgaatggccagcctgaggtgcccggcaccaggagcctgaaccgctactactag

SEQ ID NO: 157323 - DNA, 1200 bp, Artificial Sequence
  Description of Artificial Sequence: Synthetic coding sequence
atggcccagagggccttccccaacccctatgctgactacaacaagagcctggccgagggctactttgatgctgctggccgcctgaccccagagttcagccagaggctgaccaacaagatccgggagctgctgcagcagatggagcggggcctgaagtctgctgaccccagagatggcaccggctacacaggctgggccggcattgctgtgctgtacctgcacctgtatgatgtgtttggagaccctgcctacctgcagctggcccacggctacgtgaagcagagcctgaactgcctgaccaagaggagcatcaccttcctgtgtggagatgctggccccctggccgtggccgctgtgctgtaccacaagatgaacaatgagaagcaggccgaggactgcatcaccaggctcatccacctgaacaagattgacccccacgccccaaatgagatgctgtatggccgcatcggctacatctatgccctgctgtttgtgaacaagaactttggagtggagaagatcccccagagccacatccagcagatctgtgagaccatcctgaccagcggggagaacctggccaggaagaggaacttcaccgccaagagccccctgatgtatgagtggtaccaggagtactacgtgggcgccgcccacggcctggccggcatctactactacctgatgcagcccagcctgcaggtgtcccagggcaagctgcacagcctggtgaagcccagcgtggactatgtgtgccagctgaagttccccagcggcaactacccaccctgcattggagacaacagagacctgctggtgcactggtgccacggggcccctggggtcatctacatgctgatccaggcctacaaggtgttccgggaggagaagtacctgtgtgatgcctaccagtgtgctgatgtgatctggcagtatggcctgctgaagaagggctacggcctgtgccacggcagcgctggaaatgcctatgccttcctgaccctgtacaacctgacccaggacatgaagtacctgtaccgggcctgcaagtttgctgagtggtgcctggagtatggagaacatggctgcaggaccccagacacccccttcagcctgtttgagggcatggccggcaccatctacttcctggccgacctgctggtgcccaccaaggcccgcttccctgcctttgagctgtag

SEQ ID NO: 157324 - DNA, 1200 bp, Artificial Sequence; identical to SEQ ID NO: 157323
  Description of Artificial Sequence: Synthetic coding sequence

SEQ ID NO: 157325 - DNA, 1200 bp, Artificial Sequence; identical to SEQ ID NO: 157323
  Description of Artificial Sequence: Synthetic coding sequence

SEQ ID NO: 157326 - DNA, 591 bp, Artificial Sequence
  Description of Artificial Sequence: Synthetic coding sequence
atggcccagagggccttccccaacccctatgctgactacaacaagagcctggccgagggctactttgatgctgctggccgcctgaccccagagttcagccagaggctgaccaacaagatccgggagctgctgcagcagatggagcggggcctgaagtctgctgaccccagagatggcaccggctacacaggctgggccggcattgctgtgctgtacctgcacctgtatgatgtgtttggagaccctgcctacctgcagctggcccacggctacgtgaagcagagcctgaactgcctgaccaagaggagcatcaccttcctgtgtggagatgctggccccctggccgtggccgctgtgctgtaccacaagatgaacaatgagaagcaggccgaggactgcatcaccaggctcatccacctgaacaagattgacccccacgccccaaatgagatgctgtatggccgcatcggctacatctatgccctgctgtttgtgaacaagaactttggagtggagaagatcccccagagccacatccagcagatctgtgagaccatcctgaccagcggggagaacctggccaggaagtag

SEQ ID NO: 157327 - DNA, 1200 bp, Artificial Sequence; identical to SEQ ID NO: 157323
  Description of Artificial Sequence: Synthetic coding sequence

SEQ ID NO: 157328 - DNA, 1353 bp, Artificial Sequence
  Description of Artificial Sequence: Synthetic coding sequence
atgggagagaccatgagcaagaggctgaagctgcacctgggcggggaggccgagatggaggagcgggcctttgtgaaccccttcccagactatgaagctgctgctggggccctgctggccagcggggctgctgaggagaccggctgtgtgcggcccccagccaccacagatgagcccggcctgcccttccaccaggacggcaagatcatccacaacttcatccgccgcatccagaccaagatcaaggacctgctgcagcagatggaggagggcctgaagacagctgacccccatgactgcagcgcctacacaggctggacaggaattgccctgctgtacctgcagctgtacagagtgacctgtgaccagacctacctgctgcggagcctggactatgtgaagaggaccctgaggaacctgaatggaagaagagtgaccttcctgtgtggagatgctggccccctggccgtgggcgctgtgatctaccacaagctgcggagtgactgtgagagccaggagtgtgtgaccaagctgctgcagctgcagaggtctgtggtgtgccaggagagtgacctgcctgatgagctgctgtatggccgggccggctacctgtatgccctgctgtacctgaacacagagatcggccctggcaccgtgtgtgagagcgccatcaaggaggtggtgaatgccatcatcgagagcggcaagaccctgagccgggaggagaggaagacagagcgctgccccctgctgtaccagtggcacaggaagcagtatgtgggcgccgcccacggcatggccggcatctactacatgctgatgcagcctgctgccaaggtggaccaggagaccctgacagagatggtgaagcccagcattgattatgtgcgccacaagaagttccgcagcggcaactaccccagcagcctgagcaatgaaacagaccggctggtgcactggtgccacggggcccctggggtcatccacatgctgatgcaggcctacaaggtgttcaaggaggagaagtacctgaaggaggccatggagtgcagtgatgtgatctggcagaggggcctgctgaggaagggctacggcatctgccacggcacagctggaaatggctacagcttcctgagcctgtaccgcctgacccaggacaagaagtacctgtaccgggcctgcaagtttgctgagtggtgcctggactatggagcccacggctgccgcatcccagaccggccctacagcctgtttgagggcatggccggggccatccacttcctgagtgatgtgctgggccctgagaccagccgcttccctgcctttgagctggacagcagcaagagggactag

SEQ ID NO: 157329 - DNA, 2199 bp, Artificial Sequence
  Description of Artificial Sequence: Synthetic coding sequence
atgacagagggcacctgcctgcggaggagaggaggcccctacaagacagagcccgccacagacctgggccgctggaggctgaactgtgagcggggccggcagacctggacctacctgcaggatgagcgggccggccgggagcagacaggcctggaggcctatgccctgggcctggacaccaagaactacttcaaggacctgcccaaggcccacacagcctttgagggcgccctgaatggcatgaccttctacgtgggcctgcaggccgaggatggccactggacaggagactatggaggccccctcttcctgctgcccggcctgctgatcacctgccacgtggcccgcatccccctgcctgctggctaccgggaggagatcgtgcgctacctgcggtctgtgcagctgcctgatggcggctggggcctgcacatcgaggacaagagcacagtgtttggaacagccctgaactacgtgtccctgcgcatcctgggcgtgggcccagatgatcctgacctggtgcgggccaggaacatcctgcacaagaagggcggcgctgtggccatccccagctggggcaagttctggctggccgtgctgaatgtgtacagctgggagggcctgaacaccctcttccctgagatgtggctgttcccagactgggccccagcccaccccagcaccctgtggtgccactgccggcaggtgtacctgcccatgagctactgctatgctgtgcggctgtctgctgctgaggaccccctggtgcagagcctgcggcaggagctgtatgtggaggactttgccagcattgactggctggcccagagaaataatgtggccccagatgagctgtacaccccccacagctggctgctgcgggtggtgtatgccctgctgaacctgtatgagcaccaccacagcgcccacctgcggcagagagctgtgcagaagctgtatgagcacatcgtggctgatgaccgcttcaccaagagcatcagcatcggccccatcagcaagaccatcaacatgctggtgcgctggtacgtggatggccctgccagcacagccttccaggagcacgtgagccgcatcccagactacctgtggatgggcctggatggcatgaagatgcagggcaccaacggcagccagatctgggacacagcctttgccatccaggccctgctggaggccggcggccaccacaggcctgagttcagcagctgcctgcagaaggcccacgagttcctgcggctgagccaggtgcctgacaaccccccagactaccagaagtactaccggcagatgaggaaaggaggcttctccttcagcaccctggactgtggctggatcgtgtctgactgcacagctgaggccctgaaggctgtgctgctgctgcaggagaagtgcccccacgtgacagagcacatcccccgggagcggctgtgtgatgctgtggccgtgctgctgaacatgaggaacccagatggcggctttgccacctatgagaccaagaggggcggccacctgctggagctgctgaaccccagcgaggtgtttggagacatcatgattgactacacctacgtggagtgcaccagcgctgtgatgcaggccctgaagtacttccacaagcgcttccctgagcacagagctgctgagatccgggagaccctgacccagggcctggagttctgccggcggcagcagagagcagatggctcctgggagggctcctggggcgtgtgcttcacctacggcacctggtttggcctggaggcctttgcctgcatgggccagacctacagagatggaacagcctgtgccgaggtgtcccgggcctgtgacttcctgctgagccggcagatggctgatggcggctggggagaagattttgagagctgtgaggagcggcgctacctgcagagcgcccagagccagatccacaacacctgctgggccatgatgggcctgatggctgtgcgccacccagacatcgaggcccaggagcggggcgtgcgctgcctgctggagaagcagctgcccaacggggactggccccaggagaacattgctggggtcttcaacaagagctgtgccatctcctacaccagctacagaaacatcttccccatctgggccctgggccgcttcagccagctgtacccagagcgggccctggccggccacccctag

SEQ ID NO: 157330 - DNA, 2199 bp, Artificial Sequence; identical to SEQ ID NO: 157329
  Description of Artificial Sequence: Synthetic coding sequence

SEQ ID NO: 157331 - DNA, 1959 bp, Artificial Sequence
  Description of Artificial Sequence: Synthetic coding sequence
atgaccttctacgtgggcctgcaggccgaggatggccactggacaggagactatggaggccccctcttcctgctgcccggcctgctgatcacctgccacgtggcccgcatccccctgcctgctggctaccgggaggagatcgtgcgctacctgcggtctgtgcagctgcctgatggcggctggggcctgcacatcgaggacaagagcacagtgtttggaacagccctgaactacgtgtccctgcgcatcctgggcgtgggcccagatgatcctgacctggtgcgggccaggaacatcctgcacaagaagggcggcgctgtggccatccccagctggggcaagttctggctggccgtgctgaatgtgtacagctgggagggcctgaacaccctcttccctgagatgtggctgttcccagactgggccccagcccaccccagcaccctgtggtgccactgccggcaggtgtacctgcccatgagctactgctatgctgtgcggctgtctgctgctgaggaccccctggtgcagagcctgcggcaggagctgtatgtggaggactttgccagcattgactggctggcccagagaaataatgtggccccagatgagctgtacaccccccacagctggctgctgcgggtggtgtatgccctgctgaacctgtatgagcaccaccacagcgcccacctgcggcagagagctgtgcagaagctgtatgagcacatcgtggctgatgaccgcttcaccaagagcatcagcatcggccccatcagcaagaccatcaacatgctggtgcgctggtacgtggatggccctgccagcacagccttccaggagcacgtgagccgcatcccagactacctgtggatgggcctggatggcatgaagatgcagggcaccaacggcagccagatctgggacacagcctttgccatccaggccctgctggaggccggcggccaccacaggcctgagttcagcagctgcctgcagaaggcccacgagttcctgcggctgagccaggtgcctgacaaccccccagactaccagaagtactaccggcagatgaggaaaggaggcttctccttcagcaccctggactgtggctggatcgtgtctgactgcacagctgaggccctgaaggctgtgctgctgctgcaggagaagtgcccccacgtgacagagcacatcccccgggagcggctgtgtgatgctgtggccgtgctgctgaacatgaggaacccagatggcggctttgccacctatgagaccaagaggggcggccacctgctggagctgctgaaccccagcgaggtgtttggagacatcatgattgactacacctacgtggagtgcaccagcgctgtgatgcaggccctgaagtacttccacaagcgcttccctgagcacagagctgctgagatccgggagaccctgacccagggcctggagttctgccggcggcagcagagagcagatggctcctgggagggctcctggggcgtgtgcttcacctacggcacctggtttggcctggaggcctttgcctgcatgggccagacctacagagatggaacagcctgtgccgaggtgtcccgggcctgtgacttcctgctgagccggcagatggctgatggcggctggggagaagattttgagagctgtgaggagcggcgctacctgcagagcgcccagagccagatccacaacacctgctgggccatgatgggcctgatggctgtgcgccacccagacatcgaggcccaggagcggggcgtgcgctgcctgctggagaagcagctgcccaacggggactggccccaggagaacattgctggggtcttcaacaagagctgtgccatctcctacaccagctacagaaacatcttccccatctgggccctgggccgcttcagccagctgtacccagagcgggccctggccggccacccctag

SEQ ID NO: 157332 - DNA, 2166 bp, Artificial Sequence
  Description of Artificial Sequence: Synthetic coding sequence
atgacagagggcacctgcctgcggaggagaggaggcccctacaagacagagcccgccacagacctgggccgctggaggctgaactgtgagcggggccggcagacctggacctacctgcaggatgagcgggccggccgggagcagacaggcctggaggcctatgccctgggcctggacaccaagaactacttcaaggacctgcccaaggcccacacagcctttgagggcgccctgaatggcatgaccttctacgtgggcctgcaggccgaggatggccactggacaggagactatggaggccccctcttcctgctgcccggcctgctgatcacctgccacgtggcccgcatccccctgcctgctggctaccgggaggagatcgtgcgctacctgcggcacatcgaggacaagagcacagtgtttggaacagccctgaactacgtgtccctgcgcatcctgggcgtgggcccagatgatcctgacctggtgcgggccaggaacatcctgcacaagaagggcggcgctgtggccatccccagctggggcaagttctggctggccgtgctgaatgtgtacagctgggagggcctgaacaccctcttccctgagatgtggctgttcccagactgggccccagcccaccccagcaccctgtggtgccactgccggcaggtgtacctgcccatgagctactgctatgctgtgcggctgtctgctgctgaggaccccctggtgcagagcctgcggcaggagctgtatgtggaggactttgccagcattgactggctggcccagaggaacaacgtggccccagatgagctgtacaccccccacagctggctgctgcgggtggtgtatgccctgctgaacctgtatgagcaccaccacagcgcccacctgcggcagagagctgtgcagaagctgtatgagcacatcgtggctgatgaccgcttcaccaagagcatcagcatcggccccatcagcaagaccatcaacatgctggtgcgctggtacgtggatggccctgccagcacagccttccaggagcacgtgagccgcatcccagactacctgtggatgggcctggatggcatgaagatgcagggcaccaacggcagccagatctgggacacagcctttgccatccaggccctgctggaggccggcggccaccacaggcctgagttcagcagctgcctgcagaaggcccacgagttcctgcggctgagccaggtgcctgacaaccccccagactaccagaagtactaccggcagatgaggaagggcggcttctccttcagcaccctggactgtggctggatcgtgtctgactgcacagctgaggccctgaaggctgtgctgctgctgcaggagaagtgcccccacgtgacagagcacatcccccgggagcggctgtgtgatgctgtggccgtgctgctgaacatgagaaatccagatggcggctttgccacctatgagaccaagagaggaggccacctgctggagctgctgaaccccagcgaggtgtttggagacatcatgattgactacacctacgtggagtgcaccagcgctgtgatgcaggccctgaagtacttccacaagcgcttccctgagcacagagctgctgagatccgggagaccctgacccagggcctggagttctgccggcggcagcagagagcagatggctcctgggagggctcctggggcgtgtgcttcacctacggcacctggtttggcctggaggcctttgcctgcatgggccagacctacagagatggaacagcctgtgccgaggtgtcccgggcctgtgacttcctgctgagccggcagatggctgatggcggctggggcgaggactttgagagctgtgaggagcggcgctacctgcagagcgcccagagccagatccacaacacctgctgggccatgatgggcctgatggctgtgcgccacccagacatcgaggcccaggagcggggcgtgcgctgcctgctggagaagcagctgcccaatggagactggccccaggagaacattgctggggtcttcaacaagagctgtgccatctcctacaccagctacagaaacatcttccccatctgggccctgggccgcttcagccagctgtacccagagcgggccctggccggccacccctag

SEQ ID NO: 157333 - DNA, 1977 bp, Artificial Sequence
  Description of Artificial Sequence: Synthetic coding sequence
atgggcagaagaagagccccagctgggggcagcctgggccgggccctgatgaggcaccagacccagaggagccgcagccaccgccacacagacagctggctgcacaccagcgagctgaatgatggctatgactggggccgcctgaacctgcagagcgtgacagagcagagcagcctggatgacttcctggccacagctgagctggccggcacagaatttgtggccgagaagctgaacatcaagtttgtgcctgctgaggccaggacaggcctgctgagctttgaggagagccagaggatcaagaagctgcacgaggagaacaagcagttcctgtgcatcccccggcggcccaactggaaccagaacaccaccccagaggagctgaagcaggccgagaaggacaacttcctggagtggaggcggcagctggtgcggctggaggaggagcagaagctgatcctgaccccatttgaaagaaacctggacttctggaggcagctgtggagggtgattgaaagaagtgacatcgtggtgcagatcgtggatgccaggaaccccctgctcttccgctgtgaggacctggagtgctacgtgaaggagatggatgccaacaaggaaaatgtcatcctgatcaacaaggctgacctgctgacagctgagcagaggtctgcctgggccatgtactttgagaaggaggatgtgaaggtgatcttctggagcgccctggccggggccatccccctgaatggagacagcgaggaggaggccaacagagatgaccggcagagcaacaccaccaagtttggccacagcagctttgaccaggccgagatcagccacagcgagagcgagcacctgcctgcccgggacagccccagcctgtctgagaaccccaccacagatgaagatgattctgaatatgaggactgcccagaggaggaggaggatgactggcagacctgcagcgaggaggatggccccaaggaggaggactgcagccaggactggaaggagagcagcacagctgacagcgaggcccggagcaggaagaccccccagaagaggcagatccacaacttcagccacctggtgtccaagcaggagctgctggagctgttcaaggagctgcacacaggcaggaaggtgaaggatggccagctgactgtgggcctggtgggctaccccaacgtgggcaagagcagcaccatcaacaccatcatgggcaacaagaaggtgtctgtgtctgccaccccaggccacaccaagcacttccagaccctgtatgtggagcccggcctgtgcctgtgtgactgccccggcctggtgatgcccagctttgtgtccaccaaggccgagatgacctgcagcggcatcctgcccatcgaccagatgagggaccacgtgccccctgtgtccctggtgtgccagaacatccccaggcatgtgctggaggccacctacggcatcaacatcatcaccccccgggaggatgaggacccccacaggcctcccaccagcgaggagctgctgacagcctacggctacatgaggggcttcatgacagcccacggccagcctgaccagcccaggtctgcccgctacatcctgaaggactatgtgtctgggaagctgctgtactgccaccccccacctggccgggaccctgtgaccttccagcaccagcaccagaggctgctggagaacaagatgaacagtgatgagatcaagatgcagctgggcaggaacaagaaggccaagcagattgaaaatattgtggacaagaccttcttccaccaggagaatgtgcgggccctgaccaagggcgtgcaggccgtgatgggctacaagccaggcagcggcgtggtgacagccagcacagccagcagtgaaaatggagctgggaagccctggaagaagcacggcaacagaaacaagaaggagaagagccggcggctgtacaagcacctggacatgtag

SEQ ID NO: 157334 - DNA, 333 bp, Artificial Sequence
  Description of Artificial Sequence: Synthetic coding sequence
atgagctgccagcagagccagcagcagtgccagcccccacccaagtgcacccccaagtgcccccccaagtgccccacccccaagtgcccccccaagtgcccccccaagtgcccccctgtgagcagctgctgcagcgtgagcagcggcggctgctgcggcagcagcagcggcggcggctgcagcagcggcggcggcggctgctgcctgagccaccacagaagacacaggagccaccgccaccggctgcagagcagcggctgctgcagccagcccagcggcggcagcagctgctgcggcggggacagcggccagcacagcggcggctgctgctag

SEQ ID NO: 157335 - DNA, 333 bp, Artificial Sequence; identical to SEQ ID NO: 157334
  Description of Artificial Sequence: Synthetic coding sequence

SEQ ID NO: 157336 - DNA, 357 bp, Artificial Sequence
  Description of Artificial Sequence: Synthetic coding sequence
atgagctgccagcagaaccagcagcagtgccagcccccacccaagtgcatccccaagtgcccccccaagtgcctgaccccccgctgcccccccaagtgcccccccaagtgcccccctgtgagcagctgctgcagcgtgagcagcggcggctgctgcggcagcagcagcggcggcagctgtggcagcagcagcggcggctgctgcagcagcggcggcggcggctgctgcctgagccaccacagaagaagaagaagccactgccaccggccccagagcagcggctgctgcagccagcccagcggcggcagcagctgctgcggcggcggcagcggccagcacagcggcggctgctgctag

SEQ ID NO: 157337 - DNA, 333 bp, Artificial Sequence
  Description of Artificial Sequence: Synthetic coding sequence
atgagctgccagcagaaccagcagcagtgccagcccccacccaagtgcatccccaagtgcccccccaagtgcctgaccccccgctgcccccccaagtgcccccccaagtgcccccctgtgagcagctgctgcagcgtgagcagcggcggctgctgcggcagcagcagcggcggctgctgcagcagcggcggcggcggctgctgcctgagccaccacagaagaagaagaagccactgccaccggccccagagcagcggctgctgcagccagcccagcggcggcagcagctgctgcggcggcggcagcggccagcacagcggcggctgctgctag

SEQ ID NO: 157338 - DNA, 357 bp, Artificial Sequence
  Description of Artificial Sequence: Synthetic coding sequence
atgagctgccagcagagccagcagcagtgccagcccccacccaagtgcacccccaagtgcccccccaagtgccccacccccaagtgcccccccaagtgcccccccaagtgcccccctgtgagcagctgctgcagcgtgagcagcggcggctgctgcggcagcagcagcggcggcagctgtggcagcagcagcggcggctgctgcagcagcggcggcggcggctgctgcctgagccaccacagaagaagaagaagccactgccaccggccccagagcagcggctgctgcagccagcccagcggcggcagcagctgctgcggcggcggcagcggccagcacagcggcggctgctgctag

SEQ ID NO: 157339 - DNA, 345 bp, Artificial Sequence
  Description of Artificial Sequence: Synthetic coding sequence
atgagctgccagcagagccagcagcagtgccagcccccacccaagtgcacccccaagtgcacccccaagtgcccagcccccaagtgcccccccaagtgcccccctgtgagcagctgctgcagcgtgagcagcggcggctgctgcggcagcagcagcggcggcggctgcggcagcaacagcggcggctgctgcagcagcggcggcggcggctgctgcctgagccaccacagaagacacaggagccacagaagaagaccccagagcagtgactgctgcagccagcccagcggcggcagcagctgctgcggcggcggcagcagccagcacagcggcggctgctgctag

SEQ ID NO: 157340 - DNA, 357 bp, Artificial Sequence
  Description of Artificial Sequence: Synthetic coding sequence
atgagctgccagcagagccagcagcagtgccagcccccacccaagtgcacccccaagtgcccccccaagtgccccacccccaagtgcccccccaagtgcccccccaagtgcccccctgtgagcagctgctgcagcgtgagcagcggcggctgctgcggcagcagcagcggcggcagctgtggcagcagcagcggcggctgctgcagcagcggcggcggcggctgctgcctgagccaccaccgccaccacaggagccaccgccaccggccccagagcagtgactgctgcagccagcccagcggcggcagcagctgctgcggcggcggcagcggccagcacagcggcggctgctgctag

SEQ ID NO: 157341 - DNA, 357 bp, Artificial Sequence; identical to SEQ ID NO: 157340
  Description of Artificial Sequence: Synthetic coding sequence

SEQ ID NO: 157342 - DNA, 357 bp, Artificial Sequence
  Description of Artificial Sequence: Synthetic coding sequence
atgagctgccagcagagccagcagcagtgccagcccccacccaagtgcacccccaagtgcccccccaagtgccccacccccaagtgcccccccaagtgcccccccaagtgcccccctgtgagcagctgctgcagcgtgagcagcggcggctgctgcggcagcagcagcggcggctgctgcagcagcggcggcggcggctgctgcagcagcggcggcggcggctgctgcctgagccaccacagaagaagaagaagccaccgccaccggccccagagcagtgactgctgcagccagcccagcgctggcagcagctgctgcggcggcggcagcggccagcacagcggcggctgctgctag

SEQ ID NO: 157343 - DNA, 321 bp, Artificial Sequence
  Description of Artificial Sequence: Synthetic coding sequence
atgagctgccagcagaaccagcagcagtgccagcccccacccaagtgcccccccaagtgcccccccaagtgcccccccaagtgccggccccagtgcccagccccctgccccccacctgtgagcagctgctgcggccccagcagcggcggctgctgcggcagcagcagcggcggctgctgcagcagcggcggcggcggctgctgcctgagccaccaccggcccaggctcttccaccgccaccgccaccagagcccagactgctgtgaatgtgagcccagcggcggcagcggctgctgccacagcagcggggactgctgctag

SEQ ID NO: 157344 - DNA, 333 bp, Artificial Sequence
  Description of Artificial Sequence: Synthetic coding sequence
atgagctgccagcagaaccagcagcagtgccagcccccacccaagtgcccccccaagtgcacccccaagtgcccccccaagtgcccccccaagtgcctgccccagtgcccagccccctgcagccctgctgtgagcagctgctgcggccccatcagcggcggctgctgcggccccagcagcggcggctgctgcaacagcggggccggcggctgctgcctgagccaccaccggcccaggctcttccacagaagaagacaccagagcccagactgctgtgagagcgagcccagcggcggcagcggctgctgccacagcagcggcggctgctgctag

SEQ ID NO: 157345 - DNA, 333 bp, Artificial Sequence; identical to SEQ ID NO: 157344
  Description of Artificial Sequence: Synthetic coding sequence

SEQ ID NO: 157346 - DNA, 333 bp, Artificial Sequence
  Description of Artificial Sequence: Synthetic coding sequence
atgagctgccagcagaaccagcagcagtgccagcccccacccaagtgcccccccaagtgcacccccaagtgcccccccaagtgcccccccaagtgccccccccagtgcccagccccctgcttccctgctgtgagcagctgctgcggccccagcagcggcagctgctgcggccccagcagcggcggctgctgcagcagcggggccggcggctgcagcctgagccaccaccggcccaggctcttccacagaagaagacaccagagcccagactgctgtgagagcgagcccagcggcggcagcggctgctgccacagcagcggcggctgctgctag

SEQ ID NO: 157347 - DNA, 333 bp, Artificial Sequence
  Description of Artificial Sequence: Synthetic coding sequence
atgagctgccagcagaaccagcagcagtgccagcccccacccaagtgcccccccaagtgcacccccaagtgcccccccaagtgcccccccaagtgccccccccagtgcccagccccctgcagccctgctgtgagcagctgctgcggccccagcagcggcagctgctgcggccccagcagcggcggctgctgcagcagcggcggcggcggctgctgcctgagccaccaccggcccaggctcttccacagaagaagacaccagagcccagactgctgtgagagcgagcccagcggggccagcggctgctgccacagcagcggcggctgctgctag

SEQ ID NO: 157348 - DNA, 270 bp, Artificial Sequence
  Description of Artificial Sequence: Synthetic coding sequence
atgagctgccagcagaaccagcagcagtgccagcccccacccaagtgcccagccaagagccctgcccagtgcctgcccccagccagcagcagctgtgcccccagcagcggcggctgcggccccagcagcgagaggagctgctgcctgagccaccaccgctgcagaagaagccaccgctgccgctgccagagcagcaacagctgtgaccggggcagcggccagcagggcggcagcagcagctgtggccacagcagcgctggctgctgctag

SEQ ID NO: 157349 - DNA, 288 bp, Artificial Sequence
  Description of Artificial Sequence: Synthetic coding sequence
atgagctgccagcagaaccagcagcagtgccagcccctgcccaagtgccccagccccaagtgcccccccaagagcagcgcccagtgcctgcccccagccagcagctgctgtgcccccaggcctggctgctgcggcggccccagcagcgagggcggctgctgcctgagccaccaccgctgctgccgcagccaccgctgccggcggcagagcagcaacagctgtgaccggggcagcggccagcaggatggagccagtgactgtggctacggcagcggcggctgctgctag

SEQ ID NO: 157350 - DNA, 285 bp, Artificial Sequence
  Description of Artificial Sequence: Synthetic coding sequence
atgagctgccagcagaaccagcagcagtgccagcccccacccagctgccccagccccaagtgcccccccaagagccctgcccagtgcctgcccccacccagcagtgactgtgccctgagcagcggcggctgcggccccagcagcgagagcggctgctgcctgagccaccaccgccacttccgcagccaccagtgccggcggcagaggagcaacagctgtgaccggggcagcggccagcagggcggcggcagctgccggggccacggcagcggcggctgctgctag

SEQ ID NO: 157351 - DNA, 279 bp, Artificial Sequence
  Description of Artificial Sequence: Synthetic coding sequence
atgagctgccagcagaaccagcagcagtgccagcccccacccaagtgccccagccccaagtgcccccccaagagccctgtgcagtgcctgcccccagccagcagcggctgtgcccccagcagcggcggctgcggccccagcagcgagggcggctgcttcctgaaccaccaccggcggcaccaccgctgccggcggcagaggcccaacagctgtgaccggggcagcggccagcagggcggcggcagcggctgcggccacggcagcggcggctgctgctag

SEQ ID NO: 157352 - DNA, 279 bp, Artificial Sequence
  Description of Artificial Sequence: Synthetic coding sequence
atgagctgccagcagaaccagaagcagtgccagcccccacccaagtgccccagccccaagtgcccccccaagaaccctgtgcagtgcctgcccccagccagcagcggctgtgcccccagcagcggcggctgcggccccagcagcgagggcggctgcttcctgaaccaccaccggcggcaccaccgctgccggcggcagaggagcaacagctgtgaccggggcagcggccagcagggcggcggcagcggctgctgccacggcagcggcggctgctgctag

SEQ ID NO: 157353 - DNA, 300 bp, Artificial Sequence
  Description of Artificial Sequence: Synthetic coding sequence
atgagctgccagcagaaccagcagcagtgccagcccccacccaagtgccccatccccaagtacccacccaagtgccccagcaaatgtgccagcagctgccccccacccatcagcagctgctgcggcagcagcagcggcggctgcggctgctgcagcagcgagggcggcggctgctgcctgagccaccaccgccaccacaggagccactgccaccggcccaagagcagcaactgctacggcagcggcagcggccagcagagcggcggcagcggctgctgcagcggcggcggctgctgctag

SEQ ID NO: 157354 - DNA, 300 bp, Artificial Sequence; identical to SEQ ID NO: 157353
  Description of Artificial Sequence: Synthetic coding sequence

SEQ ID NO: 157355 - DNA, 357 bp, Artificial Sequence
  Description of Artificial Sequence: Synthetic coding sequence
atgagctgccagcagagccagcagcagtgccagcccccacccaagtgcacccccaagtgcccccccaagtgcacccccaagtgcccccccaagtgcccccccaagtgccccccccagtgcagcgccccctgccccccacctgtgagcagctgctgcggcagcagcagcggcggctgctgcagcagcgagggcggcggctgctgcctgagccaccaccggccccggcagagcctgcggcggcggccccagagcagcagctgctgcggcagcggcagcggccagcagagcggcggcagcagctgctgccacagcagcggcggcagcggctgctgccacagcagcggcggctgctgctag

SEQ ID NO: 157356 - DNA, 297 bp, Artificial Sequence
  Description of Artificial Sequence: Synthetic coding sequence
atgagcagtgatgacaagagcaagagcaatgaccccaagacagagcccaagaactgtgaccccaagtgtgagcagaagtgtgagagcaagtgccagcccagctgcctgaagaagctgctgcagcgctgctttgagaagtgcccctgggagaagtgcccagccccacccaagtgcctgccctgccccagccagagccccagcagctgccccccccagccctgcaccaagccctgcccccccaagtgccccagcagctgcccccacgcctgccccccaccctgccccccacctgagtag

SEQ ID NO: 157357 - DNA, 1860 bp, Artificial Sequence
  Description of Artificial Sequence: Synthetic coding sequence
atgtgcagctgccacaagggctacaccaggaccccagaccacaagcactgccgggacattgatgagtgccagcagggcaacctgtgtgtgaatggccagtgcaagaacacagagggcagcttccgctgcacctgtggccagggctaccagctgtctgctgccaaggaccagtgtgaagatattgatgagtgccagcaccgccacctgtgtgcccacggccagtgcaggaacacagagggcagcttccagtgtgtgtgtgaccagggctaccgggccagcggcctgggggaccactgtgaggacatcaatgaatgtctggaggacaagtctgtgtgccagagaggagactgcatcaacacagctggcagctatgactgcacctgcccagatggcttccagctggatgacaacaagacctgccaggacatcaatgaatgtgagcaccctggcctgtgtggcccccagggagaatgtctgaacacagagggcagcttccactgtgtgtgccagcagggcttcagcatctctgcagatggccgcacctgtgaagatgtgaatgaatgtgagctgctgagcggcgtgtgtggggaggccttctgtgaaaatgtggagggcagcttcctgtgtgtgtgtgctgatgagaaccaggagtacagccccatgacaggccagtgccgcagcaggaccagcacagacctggatgtggatgtggaccagcccaaggaggagaagaaggagtgctactacaacctgaatgatgccagcctgtgtgacaacgtgctggcccccaacgtgaccaagcaggagtgctgctgcaccagcggcgtgggctggggagacaactgtgagatcttcccctgccctgtgctgggcacagctgagttcacagagatgtgccccaagggcaaaggatttgtgcctgctggggagagcagcagcgaggccggcggggagaactacaaggatgctgatgaatgtctgctgtttggccaggagatctgcaagaatggcttctgcctgaacacccggcccggctatgagtgctactgcaagcagggcacctactatgaccctgtgaagctgcagtgctttgacatggatgagtgccaggaccccagcagctgcattgatggccagtgtgtgaacacagagggcagctacaactgcttctgcacccaccccatggtgctggatgccagcgagaagcgctgcatccggcctgctgagagcaatgagcagatcgaggagacagatgtgtaccaggacctgtgctgggagcacctgagtgatgaatatgtgtgcagccggcccctggtgggcaagcagaccacctacacagagtgctgctgcctgtatggagaggcctggggcatgcagtgtgccctgtgccccctgaaggacagtgatgattatgcccagctgtgcaacatccctgtgacaggccggcggcagccctacggcagagatgccctggtggacttcagcgagcagtacaccccagaggccgacccctacttcatccaggaccgcttcctgaacagctttgaggagctgcaggccgaggagtgtggcatcctgaatggctgtgaaaatggccgctgtgtgcgggtgcaggagggctacacctgtgactgctttgatggctaccacctggacacagccaagatgacctgtgtggatgtgaatgaatgtgatgagctgaacaacaggatgagcctgtgcaagaatgccaagtgcatcaacacagatggcagctacaagtgcctgtgcctgcccggctacgtgcccagcgacaagcccaactactgcacccccctgaacacagccctgaacctggagaaggacagcgacctggagtag

SEQ ID NO: 157358 - DNA, 5169 bp, Artificial Sequence
  Description of Artificial Sequence: Synthetic coding sequence
atggccggggcctggctgcgctggggcctgctgctgtgggccggcctgctggccagcagcgcccacggccgcctgcggcgcatcacctacgtggtgcaccctggccctggcctggccgccggggccctgcccctgagcggcccccccaggagcaggaccttcaacgtggccctgaatgcccgctacagccgcagcagcgctgctgctggggcccccagccgggccagccctggggtgcccagcgagaggaccaggaggaccagcaagccaggaggagctgccctgcagggcctgcggcccccacctcctcctcctcctgagcccgcccggcctgctgtgcctgggggccagctgcaccccaaccctgggggccaccctgctgctgcccccttcaccaagcagggccggcaggtggtgcgcagcaaggtgccccaggagacccagagcggcggcggcagccggctgcaggtgcaccagaagcagcagctgcagggcgtgaatgtgtgtggcggccgctgctgccacggctggagcaaggcccctggcagccagcgctgcaccaagcccagctgtgtgcccccctgccagaatggaggcatgtgcctgcggccccagctgtgtgtgtgcaagccaggcaccaagggcaaggcctgtgagaccatcgccgcccaggacaccagcagccctgtgtttggaggccagagccctggggccgccagctcctggggccccccagagcaggccgccaagcacaccagcagcaagaaggctgacaccctgccccgggtgtcccctgtggcccagatgaccctgaccctgaagcccaagcccagcgtgggcctgccccagcagatccacagccaggtgacccccctgagcagccagagcgtggtgatccaccacggccagacccaggagtatgtgctgaagcccaagtacttccctgcccagaagggcatctctggagagcagagcacagagggcagcttccccctgcgctacgtgcaggaccaggtggccgcccccttccagctgagcaaccacacaggccgcatcaaggtggtgttcacccccagcatctgcaaggtgacctgcaccaagggcagctgccagaacagctgtgagaagggcaacaccaccaccctcatcagtgaaaatggacatgctgctgacaccctgacagccaccaacttccgggtggtgatctgccacctgccctgcatgaatggaggccagtgcagcagccgggacaagtgccagtgcccccccaacttcaccgggaagctgtgccagatccctgtgcatggagcctctgtgcccaagctgtaccagcacagccagcagcccgggaaggccctgggcacccacgtgatccacagcacccacaccctgcccctgactgtgaccagccagcagggcgtgaaggtgaagtttcctcccaacatcgtgaacatccacgtgaagcaccccccagaggcctctgtgcagatccaccaggtgtccagaattgatggccccaccggccagaagaccaaggaggcccagcccggccagagccaggtgtcctaccagggcctgcctgtgcagaagacccagaccatccacagcacctacagccaccagcaggtgatcccccacgtgtaccctgtggccgccaagacccagctgggccgctgcttccaggagaccatcggcagccagtgtgggaaggccctgcccggcctgagcaagcaggaggactgctgcggcaccgtgggcacctcctggggcttcaacaagtgccagaagtgccccaagaagcccagctaccacggctacaaccagatgatggagtgcctgcccggctacaagagggtgaacaacaccttctgccaggacatcaatgaatgccagctgcagggcgtgtgccccaacggggagtgcctgaacaccatgggcagctaccgctgcacctgcaagattggcttcggccctgaccccaccttcagcagctgtgtgcctgacccccctgtgatcagcgaggagaagggcccctgctaccgcctggtgagcagcggccggcagtgcatgcaccccctgtctgtgcacctgaccaagcagctgtgctgctgcagcgtgggcaaggcctggggcccccactgtgagaagtgccccctgcccggcacagctgccttcaaggagatctgccctgggggcatgggctacacagtgtctggagtgcacagaagaagacccatccaccaccacgtgggcaagggccctgtgtttgtgaagcccaagaacacccagcctgtggccaagagcacccaccccccacccctgcctgccaaggaggagcctgtggaggccctgaccttcagccgggagcacggccctggggtggccgagcctgaggtggccacagcccctcctgagaaggagatccccagcctggaccaggagaagaccaagctggagcccggccagccccagctgagccctggcatcagcaccatccacctgcacccccagtttcctggcatcgtgattgagaagaccagcccccctgtgcctgtggaggtggcccctgaggccagcaccagcagcgccagccaggtgattgcccccacccaggtgacagagatcaatgaatgtactgtgaacccagacatctgtggggccggccactgcatcaacctgcctgtgcgctacacctgcatctgctatgagggctaccgcttcagcgagcagcagaggaaatgtgtggacattgatgaatgtacccaggtgcagcacctgtgcagccagggccgctgtgaaaatacagagggcagcttcctgtgcatctgcccagctggcttcatggccagcgaggagggcaccaactgcattgatgtggatgaatgtctgcggccagatgtgtgtggggagggccactgtgtgaacacagtgggcgccttccgctgtgagtactgtgacagcggctacaggatgacccagaggggccgctgtgaggacattgatgagtgcctgaaccccagcacctgcccagatgagcagtgtgtgaacagccctggcagctaccagtgtgtgccctgcacagagggcttccggggctggaatggccagtgcctggatgtggatgagtgcctggagcccaacgtgtgtgccaatggagactgcagcaacctggagggcagctacatgtgcagctgccacaagggctacaccaggaccccagaccacaagcactgccgggacattgatgagtgccagcagggcaacctgtgtgtgaatggccagtgcaagaacacagagggcagcttccgctgcacctgtggccagggctaccagctgtctgctgccaaggaccagtgtgaggacattgatgagtgccagcaccgccacctgtgtgcccacggccagtgcaggaacacagagggcagcttccagtgtgtgtgtgaccagggctaccgggccagcggcctgggggaccactgtgaggacatcaatgaatgtctggaggacaagtctgtgtgccagagaggagactgcatcaacacagctggcagctatgactgcacctgcccagatggcttccagctggatgacaacaagacctgccaggacatcaatgaatgtgagcaccctggcctgtgtggcccccagggcgagtgcctgaacacagagggcagcttccactgtgtgtgccagcagggcttcagcatctctgcagatggccgcacctgtgaggacattgatgaatgtgtgaacaacacagtgtgtgacagccacggcttctgtgacaacacagctggcagcttccgctgcctgtgctaccagggcttccaggccccccaggacggccagggctgtgtggatgtgaatgaatgtgagctgctgtctggagtgtgtggggaggccttctgtgaaaatgtggagggcagcttcctgtgtgtgtgtgctgatgagaaccaggagtacagccccatgacaggccagtgccgcagcaggaccagcacagacctggatgtggatgtggaccagcccaaggaggagaagaaggagtgctactacaacctgaatgatgccagcctgtgtgacaacgtgctggccccaaatgtgaccaagcaggagtgctgctgcaccagcggcgtgggctggggagacaactgtgagatcttcccctgccctgtgctgggcacagctgagttcacagagatgtgccccaagggcaagggctttgtgcctgctggggagagcagcagcgaggccggaggagagaactacaaggatgctgatgagtgcctgctgtttggccaggagatctgcaagaatggcttctgcctgaacaccaggcctggctatgagtgctactgcaagcagggcacctactatgaccctgtgaagctgcagtgctttgacatggatgagtgccaggaccccagcagctgcattgatggccagtgtgtgaacacagagggcagctacaactgcttctgcacccaccccatggtgctggatgccagcgagaagcgctgcatccggcctgctgagagcaatgagcagatcgaggagacagatgtgtaccaggacctgtgctgggagcacctgagtgatgaatatgtgtgcagccggcccctggtgggcaagcagaccacctacacagagtgctgctgcctgtatggagaggcctggggcatgcagtgtgccctgtgccccctgaaggacagtgatgattatgcccagctgtgcaacatccctgtgactggaagacggcagccctacggcagagatgccctggtggacttcagcgagcagtacaccccagaggccgacccctacttcatccaggaccgcttcctgaacagctttgaggagctgcaggccgaggagtgtggcatcctgaatggctgtgaaaatggccgctgtgtgcgggtgcaggagggctacacctgtgactgctttgatggctaccacctggacacagccaagatgacctgtgtggatgtgaatgaatgtgatgagctgaacaacaggatgagcctgtgcaagaatgccaagtgcatcaacacagatggcagctacaagtgcctgtgcctgcccggctacgtgcccagcgacaagcccaactactgcacccccctgaacacagccctgaacctggagaaggacagcgacctggagtag

SEQ ID NO: 157359 - DNA, 4191 bp, Artificial Sequence
  Description of Artificial Sequence: Synthetic coding sequence
atggacaccaagctgatgtgcctgctcttcttcttcagcctgccccccctgctggtgagcaaccacacaggccgcatcaaggtggtgttcacccccagcatctgcaaggtgacctgcaccaagggcagctgccagaacagctgtgagaagggcaacaccaccaccctcatcagtgaaaatggacatgctgctgacaccctgacagccaccaacttccgggtggtgatctgccacctgccctgcatgaatggaggccagtgcagcagccgggacaagtgccagtgcccccccaacttcaccgggaagctgtgccagatccctgtgcatggagcctctgtgcccaagctgtaccagcacagccagcagcccgggaaggccctgggcacccacgtgatccacagcacccacaccctgcccctgactgtgaccagccagcagggcgtgaaggtgaagtttcctcccaacatcgtgaacatccacgtgaagcaccccccagaggcctctgtgcagatccaccaggtgtccagaattgatggccccaccggccagaagaccaaggaggcccagcccggccagagccaggtgtcctaccagggcctgcctgtgcagaagacccagaccatccacagcacctacagccaccagcaggtgatcccccacgtgtaccctgtggccgccaagacccagctgggccgctgcttccaggagaccatcggcagccagtgtgggaaggccctgcccggcctgagcaagcaggaggactgctgcggcaccgtgggcacctcctggggcttcaacaagtgccagaagtgccccaagaagcccagctaccacggctacaaccagatgatggagtgcctgcccggctacaagagggtgaacaacaccttctgccaggacatcaatgaatgccagctgcagggcgtgtgccccaacggggagtgcctgaacaccatgggcagctaccgctgcacctgcaagattggcttcggccctgaccccaccttcagcagctgtgtgcctgacccccctgtgatcagcgaggagaagggcccctgctaccgcctggtgagcagcggccggcagtgcatgcaccccctgtctgtgcacctgaccaagcagctgtgctgctgcagcgtgggcaaggcctggggcccccactgtgagaagtgccccctgcccggcacagctgccttcaaggagatctgccctgggggcatgggctacacagtgtctggagtgcacagaagaagacccatccaccaccacgtgggcaagggccctgtgtttgtgaagcccaagaacacccagcctgtggccaagagcacccaccccccacccctgcctgccaaggaggagcctgtggaggccctgaccttcagccgggagcacggccctggggtggccgagcctgaggtggccacagcccctcctgagaaggagatccccagcctggaccaggagaagaccaagctggagcccggccagccccagctgagccctggcatcagcaccatccacctgcacccccagtttcctggcatcgtgattgagaagaccagcccccctgtgcctgtggaggtggcccctgaggccagcaccagcagcgccagccaggtgattgcccccacccaggtgacagagatcaatgaatgtactgtgaacccagacatctgtggggccggccactgcatcaacctgcctgtgcgctacacctgcatctgctatgagggctaccgcttcagcgagcagcagaggaaatgtgtggacattgatgaatgtacccaggtgcagcacctgtgcagccagggccgctgtgaaaatacagagggcagcttcctgtgcatctgcccagctggcttcatggccagcgaggagggcaccaactgcattgatgtggatgaatgtctgcggccagatgtgtgtggggagggccactgtgtgaacacagtgggcgccttccgctgtgagtactgtgacagcggctacaggatgacccagaggggccgctgtgaggacattgatgagtgcctgaaccccagcacctgcccagatgagcagtgtgtgaacagccctggcagctaccagtgtgtgccctgcacagagggcttccggggctggaatggccagtgcctggatgtggatgagtgcctggagcccaacgtgtgtgccaatggagactgcagcaacctggagggcagctacatgtgcagctgccacaagggctacaccaggaccccagaccacaagcactgccgggacattgatgagtgccagcagggcaacctgtgtgtgaatggccagtgcaagaacacagagggcagcttccgctgcacctgtggccagggctaccagctgtctgctgccaaggaccagtgtgaggacattgatgagtgccagcaccgccacctgtgtgcccacggccagtgcaggaacacagagggcagcttccagtgtgtgtgtgaccagggctaccgggccagcggcctgggggaccactgtgaggacatcaatgaatgtctggaggacaagtctgtgtgccagagaggagactgcatcaacacagctggcagctatgactgcacctgcccagatggcttccagctggatgacaacaagacctgccaggacatcaatgaatgtgagcaccctggcctgtgtggcccccagggcgagtgcctgaacacagagggcagcttccactgtgtgtgccagcagggcttcagcatctctgcagatggccgcacctgtgaggacattgatgaatgtgtgaacaacacagtgtgtgacagccacggcttctgtgacaacacagctggcagcttccgctgcctgtgctaccagggcttccaggccccccaggacggccagggctgtgtggatgtgaatgaatgtgagctgctgtctggagtgtgtggggaggccttctgtgaaaatgtggagggcagcttcctgtgtgtgtgtgctgatgagaaccaggagtacagccccatgacaggccagtgccgcagcaggaccagcacagacctggatgtggatgtggaccagcccaaggaggagaagaaggagtgctactacaacctgaatgatgccagcctgtgtgacaacgtgctggccccaaatgtgaccaagcaggagtgctgctgcaccagcggcgtgggctggggagacaactgtgagatcttcccctgccctgtgctgggcacagctgagttcacagagatgtgccccaagggcaagggctttgtgcctgctggggagagcagcagcgaggccggaggagagaactacaaggatgctgatgagtgcctgctgtttggccaggagatctgcaagaatggcttctgcctgaacaccaggcctggctatgagtgctactgcaagcagggcacctactatgaccctgtgaagctgcagtgctttgacatggatgagtgccaggaccccagcagctgcattgatggccagtgtgtgaacacagagggcagctacaactgcttctgcacccaccccatggtgctggatgccagcgagaagcgctgcatccggcctgctgagagcaatgagcagatcgaggagacagatgtgtaccaggacctgtgctgggagcacctgagtgatgaatatgtgtgcagccggcccctggtgggcaagcagaccacctacacagagtgctgctgcctgtatggagaggcctggggcatgcagtgtgccctgtgccccctgaaggacagtgatgattatgcccagctgtgcaacatccctgtgactggaagacggcagccctacggcagagatgccctggtggacttcagcgagcagtacaccccagaggccgacccctacttcatccaggaccgcttcctgaacagctttgaggagctgcaggccgaggagtgtggcatcctgaatggctgtgaaaatggccgctgtgtgcgggtgcaggagggctacacctgtgactgctttgatggctaccacctggacacagccaagatgacctgtgtggatgtgaatgaatgtgatgagctgaacaacaggatgagcctgtgcaagaatgccaagtgcatcaacacagatggcagctacaagtgcctgtgcctgcccggctacgtgcccagcgacaagcccaactactgcacccccctgaacacagccctgaacctggagaaggacagcgacctggagtag

SEQ ID NO: 157360 - DNA, 5166 bp, Artificial Sequence
  Description of Artificial Sequence: Synthetic coding sequence
atggccggggcctggctgcgctggggcctgctgctgtgggccggcctgctggccagcagcgcccacggccgcctgcggcgcatcacctacgtggtgcaccctggccctggcctggccgccggggccctgcccctgagcggcccccccaggagcaggaccttcaacgtggccctgaatgcccgctacagccgcagcagcgctgctgctggggcccccagccgggccagccctggggtgcccagcgagaggaccaggaggaccagcaagccaggaggagctgccctgcagggcctgcggcccccacctcctcctcctcctgagcccgcccggcctgctgtgcctgggggccagctgcaccccaaccctgggggccaccctgctgctgcccccttcaccaagcagggccggcaggtggtgcgcagcaaggtgccccaggagacccagagcggcggcggcagccggctgcaggtgcaccagaagcagcagctgcagggcgtgaatgtgtgtggcggccgctgctgccacggctggagcaaggcccctggcagccagcgctgcaccaagcccagctgtgtgcccccctgccagaatggaggcatgtgcctgcggccccagctgtgtgtgtgcaagccaggcaccaagggcaaggcctgtgagaccatcgccgcccaggacaccagcagccctgtgtttggaggccagagccctggggccgccagctcctggggccccccagagcaggccgccaagcacaccagcagcaagaaggctgacaccctgccccgggtgtcccctgtggcccagatgaccctgaccctgaagcccaagcccagcgtgggcctgccccagcagatccacagccaggtgacccccctgagcagccagagcgtggtgatccaccacggccagacccaggagtatgtgctgaagcccaagtacttccctgcccagaagggcatctctggagagcagagcacagagggcagcttccccctgcgctacgtgcaggaccaggtggccgcccccttccagctgagcaaccacacaggccgcatcaaggtggtgttcacccccagcatctgcaaggtgacctgcaccaagggcagctgccagaacagctgtgagaagggcaacaccaccaccctcatcagtgaaaatggacatgctgctgacaccctgacagccaccaacttccgggtggtgatctgccacctgccctgcatgaatggaggccagtgcagcagccgggacaagtgccagtgcccccccaacttcaccgggaagctgtgccagatccctgtgcatggagcctctgtgcccaagctgtaccagcacagccagcagcccgggaaggccctgggcacccacgtgatccacagcacccacaccctgcccctgactgtgaccagccagcagggcgtgaaggtgaagtttcctcccaacatcgtgaacatccacgtgaagcaccccccagaggcctctgtgcagatccaccaggtgtccagaattgatggccccaccggccagaagaccaaggaggcccagcccggccagagccaggtgtcctaccagggcctgcctgtgcagaagacccagaccatccacagcacctacagccaccagcaggtgatcccccacgtgtaccctgtggccgccaagacccagctgggccgctgcttccaggagaccatcggcagccagtgtgggaaggccctgcccggcctgagcaagcaggaggactgctgcggcaccgtgggcacctcctggggcttcaacaagtgccagaagtgccccaagaagcccagctaccacggctacaaccagatgatggagtgcctgcccggctacaagagggtgaacaacaccttctgccaggacatcaatgaatgccagctgcagggcgtgtgccccaacggggagtgcctgaacaccatgggcagctaccgctgcacctgcaagattggcttcggccctgaccccaccttcagcagctgtgtgcctgacccccctgtgatcagcgaggagaagggcccctgctaccgcctggtgagcagcggccggcagtgcatgcaccccctgtctgtgcacctgaccaagcagctgtgctgctgcagcgtgggcaaggcctggggcccccactgtgagaagtgccccctgcccggcacagctgccttcaaggagatctgccctgggggcatgggctacacagtgtctggagtgcacagaagaagacccatccaccaccacgtgggcaagggccctgtgtttgtgaagcccaagaacacccagcctgtggccaagagcacccaccccccacccctgcctgccaaggaggagcctgtggaggccctgaccttcagccgggagcacggccctggggtggccgagcctgaggtggccacagcccctcctgagaaggagatccccagcctggaccaggagaagaccaagctggagcccggccagccccagctgagccctggcatcagcaccatccacctgcacccccagtttcctgtggtgattgagaagaccagcccccctgtgcctgtggaggtggcccctgaggccagcaccagcagcgccagccaggtgattgcccccacccaggtgacagagatcaatgaatgtactgtgaacccagacatctgtggggccggccactgcatcaacctgcctgtgcgctacacctgcatctgctatgagggctaccgcttcagcgagcagcagaggaaatgtgtggacattgatgagtgcacccaggtgcagcacctgtgcagccagggccgctgtgagaacacagagggcagcttcctgtgcatctgcccagctggcttcatggccagcgaggagggcaccaactgcattgatgtggatgagtgcctgcggccagatgtgtgtggggagggccactgtgtgaacacagtgggcgccttccgctgtgagtactgtgacagcggctacaggatgacccagaggggccgctgtgaagatattgatgaatgtctgaaccccagcacctgcccagatgagcagtgtgtgaacagccctggcagctaccagtgtgtgccctgcacagagggcttccggggctggaatggccagtgcctggatgtggatgaatgtctggagcccaacgtgtgtgccaacggggactgcagcaacctggagggcagctacatgtgcagctgccacaagggctacaccaggaccccagaccacaagcactgccgggacattgatgagtgccagcagggcaacctgtgtgtgaatggccagtgcaagaacacagagggcagcttccgctgcacctgtggccagggctaccagctgtctgctgccaaggaccagtgtgaagatattgatgagtgccagcaccgccacctgtgtgcccacggccagtgcaggaacacagagggcagcttccagtgtgtgtgtgaccagggctaccgggccagcggcctgggggaccactgtgaggacatcaatgaatgtctggaggacaagtctgtgtgccagagaggagactgcatcaacacagctggcagctatgactgcacctgcccagatggcttccagctggatgacaacaagacctgccaggacatcaatgaatgtgagcaccctggcctgtgtggcccccagggagaatgtctgaacacagagggcagcttccactgtgtgtgccagcagggcttcagcatctctgcagatggccgcacctgtgaagatattgatgaatgtgtgaacaacacagtgtgtgacagccacggcttctgtgacaacacagctggcagcttccgctgcctgtgctaccagggcttccaggccccccaggacggccagggctgtgtggatgtgaatgaatgtgagctgctgagcggcgtgtgtggggaggccttctgtgaaaatgtggagggcagcttcctgtgtgtgtgtgctgatgagaaccaggagtacagccccatgacaggccagtgccgcagcaggaccagcacagacctggatgtggatgtggaccagcccaaggaggagaagaaggagtgctactacaacctgaatgatgccagcctgtgtgacaacgtgctggcccccaacgtgaccaagcaggagtgctgctgcaccagcggcgtgggctggggagacaactgtgagatcttcccctgccctgtgctgggcacagctgagttcacagagatgtgccccaagggcaaaggatttgtgcctgctggggagagcagcagcgaggccggcggggagaactacaaggatgctgatgaatgtctgctgtttggccaggagatctgcaagaatggcttctgcctgaacacccggcccggctatgagtgctactgcaagcagggcacctactatgaccctgtgaagctgcagtgctttgacatggatgagtgccaggaccccagcagctgcattgatggccagtgtgtgaacacagagggcagctacaactgcttctgcacccaccccatggtgctggatgccagcgagaagcgctgcatccggcctgctgagagcaatgagcagatcgaggagacagatgtgtaccaggacctgtgctgggagcacctgagtgatgaatatgtgtgcagccggcccctggtgggcaagcagaccacctacacagagtgctgctgcctgtatggagaggcctggggcatgcagtgtgccctgtgccccctgaaggacagtgatgattatgcccagctgtgcaacatccctgtgacaggccggcggcagccctacggcagagatgccctggtggacttcagcgagcagtacaccccagaggccgacccctacttcatccaggaccgcttcctgaacagctttgaggagctgcaggccgaggagtgtggcatcctgaatggctgtgaaaatggccgctgtgtgcgggtgcaggagggctacacctgtgactgctttgatggctaccacctggacacagccaagatgacctgtgtggatgtgaatgaatgtgatgagctgaacaacaggatgagcctgtgcaagaatgccaagtgcatcaacacagatggcagctacaagtgcctgtgcctgcccggctacgtgcccagcgacaagcccaactactgcacccccctgaacacagccctgaacctggagaaggacagcgacctggagtag

SEQ ID NO: 157361 - DNA, 4188 bp, Artificial Sequence
  Description of Artificial Sequence: Synthetic coding sequence
atggacaccaagctgatgtgcctgctcttcttcttcagcctgccccccctgctggtgagcaaccacacaggccgcatcaaggtggtgttcacccccagcatctgcaaggtgacctgcaccaagggcagctgccagaacagctgtgagaagggcaacaccaccaccctcatcagtgaaaatggacatgctgctgacaccctgacagccaccaacttccgggtggtgatctgccacctgccctgcatgaatggaggccagtgcagcagccgggacaagtgccagtgcccccccaacttcaccgggaagctgtgccagatccctgtgcatggagcctctgtgcccaagctgtaccagcacagccagcagcccgggaaggccctgggcacccacgtgatccacagcacccacaccctgcccctgactgtgaccagccagcagggcgtgaaggtgaagtttcctcccaacatcgtgaacatccacgtgaagcaccccccagaggcctctgtgcagatccaccaggtgtccagaattgatggccccaccggccagaagaccaaggaggcccagcccggccagagccaggtgtcctaccagggcctgcctgtgcagaagacccagaccatccacagcacctacagccaccagcaggtgatcccccacgtgtaccctgtggccgccaagacccagctgggccgctgcttccaggagaccatcggcagccagtgtgggaaggccctgcccggcctgagcaagcaggaggactgctgcggcaccgtgggcacctcctggggcttcaacaagtgccagaagtgccccaagaagcccagctaccacggctacaaccagatgatggagtgcctgcccggctacaagagggtgaacaacaccttctgccaggacatcaatgaatgccagctgcagggcgtgtgccccaacggggagtgcctgaacaccatgggcagctaccgctgcacctgcaagattggcttcggccctgaccccaccttcagcagctgtgtgcctgacccccctgtgatcagcgaggagaagggcccctgctaccgcctggtgagcagcggccggcagtgcatgcaccccctgtctgtgcacctgaccaagcagctgtgctgctgcagcgtgggcaaggcctggggcccccactgtgagaagtgccccctgcccggcacagctgccttcaaggagatctgccctgggggcatgggctacacagtgtctggagtgcacagaagaagacccatccaccaccacgtgggcaagggccctgtgtttgtgaagcccaagaacacccagcctgtggccaagagcacccaccccccacccctgcctgccaaggaggagcctgtggaggccctgaccttcagccgggagcacggccctggggtggccgagcctgaggtggccacagcccctcctgagaaggagatccccagcctggaccaggagaagaccaagctggagcccggccagccccagctgagccctggcatcagcaccatccacctgcacccccagtttcctgtggtgattgagaagaccagcccccctgtgcctgtggaggtggcccctgaggccagcaccagcagcgccagccaggtgattgcccccacccaggtgacagagatcaatgaatgtactgtgaacccagacatctgtggggccggccactgcatcaacctgcctgtgcgctacacctgcatctgctatgagggctaccgcttcagcgagcagcagaggaaatgtgtggacattgatgagtgcacccaggtgcagcacctgtgcagccagggccgctgtgagaacacagagggcagcttcctgtgcatctgcccagctggcttcatggccagcgaggagggcaccaactgcattgatgtggatgagtgcctgcggccagatgtgtgtggggagggccactgtgtgaacacagtgggcgccttccgctgtgagtactgtgacagcggctacaggatgacccagaggggccgctgtgaagatattgatgaatgtctgaaccccagcacctgcccagatgagcagtgtgtgaacagccctggcagctaccagtgtgtgccctgcacagagggcttccggggctggaatggccagtgcctggatgtggatgaatgtctggagcccaacgtgtgtgccaacggggactgcagcaacctggagggcagctacatgtgcagctgccacaagggctacaccaggaccccagaccacaagcactgccgggacattgatgagtgccagcagggcaacctgtgtgtgaatggccagtgcaagaacacagagggcagcttccgctgcacctgtggccagggctaccagctgtctgctgccaaggaccagtgtgaagatattgatgagtgccagcaccgccacctgtgtgcccacggccagtgcaggaacacagagggcagcttccagtgtgtgtgtgaccagggctaccgggccagcggcctgggggaccactgtgaggacatcaatgaatgtctggaggacaagtctgtgtgccagagaggagactgcatcaacacagctggcagctatgactgcacctgcccagatggcttccagctggatgacaacaagacctgccaggacatcaatgaatgtgagcaccctggcctgtgtggcccccagggagaatgtctgaacacagagggcagcttccactgtgtgtgccagcagggcttcagcatctctgcagatggccgcacctgtgaagatattgatgaatgtgtgaacaacacagtgtgtgacagccacggcttctgtgacaacacagctggcagcttccgctgcctgtgctaccagggcttccaggccccccaggacggccagggctgtgtggatgtgaatgaatgtgagctgctgagcggcgtgtgtggggaggccttctgtgaaaatgtggagggcagcttcctgtgtgtgtgtgctgatgagaaccaggagtacagccccatgacaggccagtgccgcagcaggaccagcacagacctggatgtggatgtggaccagcccaaggaggagaagaaggagtgctactacaacctgaatgatgccagcctgtgtgacaacgtgctggcccccaacgtgaccaagcaggagtgctgctgcaccagcggcgtgggctggggagacaactgtgagatcttcccctgccctgtgctgggcacagctgagttcacagagatgtgccccaagggcaaaggatttgtgcctgctggggagagcagcagcgaggccggcggggagaactacaaggatgctgatgaatgtctgctgtttggccaggagatctgcaagaatggcttctgcctgaacacccggcccggctatgagtgctactgcaagcagggcacctactatgaccctgtgaagctgcagtgctttgacatggatgagtgccaggaccccagcagctgcattgatggccagtgtgtgaacacagagggcagctacaactgcttctgcacccaccccatggtgctggatgccagcgagaagcgctgcatccggcctgctgagagcaatgagcagatcgaggagacagatgtgtaccaggacctgtgctgggagcacctgagtgatgaatatgtgtgcagccggcccctggtgggcaagcagaccacctacacagagtgctgctgcctgtatggagaggcctggggcatgcagtgtgccctgtgccccctgaaggacagtgatgattatgcccagctgtgcaacatccctgtgacaggccggcggcagccctacggcagagatgccctggtggacttcagcgagcagtacaccccagaggccgacccctacttcatccaggaccgcttcctgaacagctttgaggagctgcaggccgaggagtgtggcatcctgaatggctgtgaaaatggccgctgtgtgcgggtgcaggagggctacacctgtgactgctttgatggctaccacctggacacagccaagatgacctgtgtggatgtgaatgaatgtgatgagctgaacaacaggatgagcctgtgcaagaatgccaagtgcatcaacacagatggcagctacaagtgcctgtgcctgcccggctacgtgcccagcgacaagcccaactactgcacccccctgaacacagccctgaacctggagaaggacagcgacctggagtag

SEQ ID NO: 157362 - DNA, 4062 bp, Artificial Sequence
  Description of Artificial Sequence: Synthetic coding sequence
atggacaccaagctgatgtgcctgctcttcttcttcagcctgccccccctgctggtgagcaaccacacaggccgcatcaaggtggtgttcacccccagcatctgcaaggtgacctgcaccaagggcagctgccagaacagctgtgagaagggcaacaccaccaccctcatcagtgaaaatggacatgctgctgacaccctgacagccaccaacttccgggtggtgatctgccacctgccctgcatgaatggaggccagtgcagcagccgggacaagtgccagtgcccccccaacttcaccgggaagctgtgccagatccctgtgcatggagcctctgtgcccaagctgtaccagcacagccagcagcccgggaaggccctgggcacccacgtgatccacagcacccacaccctgcccctgactgtgaccagccagcagggcgtgaaggtgaagtttcctcccaacatcgtgaacatccacgtgaagcaccccccagaggcctctgtgcagatccaccaggtgtccagaattgatggccccaccggccagaagaccaaggaggcccagcccggccagagccaggtgtcctaccagggcctgcctgtgcagaagacccagaccatccacagcacctacagccaccagcaggtgatcccccacgtgtaccctgtggccgccaagacccagctgggccgctgcttccaggagaccatcggcagccagtgtgggaaggccctgcccggcctgagcaagcaggaggactgctgcggcaccgtgggcacctcctggggcttcaacaagtgccagaagtgccccaagaagcccagctaccacggctacaaccagatgatggagtgcctgcccggctacaagagggtgaacaacaccttctgccaggacatcaatgaatgccagctgcagggcgtgtgccccaacggggagtgcctgaacaccatgggcagctaccgctgcacctgcaagattggcttcggccctgaccccaccttcagcagctgtgtgcctgacccccctgtgatcagcgaggagaagggcccctgctaccgcctggtgagcagcggccggcagtgcatgcaccccctgtctgtgcacctgaccaagcagctgtgctgctgcagcgtgggcaaggcctggggcccccactgtgagaagtgccccctgcccggcacagctgccttcaaggagatctgccctgggggcatgggctacacagtgtctggagtgcacagaagaagacccatccaccaccacgtgggcaagggccctgtgtttgtgaagcccaagaacacccagcctgtggccaagagcacccaccccccacccctgcctgccaaggaggagcctgtggaggccctgaccttcagccgggagcacggccctggggtggccgagcctgaggtggccacagcccctcctgagaaggagatccccagcctggaccaggagaagaccaagctggagcccggccagccccagctgagccctggcatcagcaccatccacctgcacccccagtttcctgtggtgattgagaagaccagcccccctgtgcctgtggaggtggcccctgaggccagcaccagcagcgccagccaggtgattgcccccacccaggtgacagagatcaatgaatgtactgtgaacccagacatctgtggggccggccactgcatcaacctgcctgtgcgctacacctgcatctgctatgagggctaccgcttcagcgagcagcagaggaaatgtgtggacattgatgagtgcacccaggtgcagcacctgtgcagccagggccgctgtgagaacacagagggcagcttcctgtgcatctgcccagctggcttcatggccagcgaggagggcaccaactgcattgatgtggatgagtgcctgcggccagatgtgtgtggggagggccactgtgtgaacacagtgggcgccttccgctgtgagtactgtgacagcggctacaggatgacccagaggggccgctgtgaagatattgatgaatgtctgaaccccagcacctgcccagatgagcagtgtgtgaacagccctggcagctaccagtgtgtgccctgcacagagggcttccggggctggaatggccagtgcctggatgtggatgaatgtctggagcccaacgtgtgtgccaacggggactgcagcaacctggagggcagctacatgtgcagctgccacaagggctacaccaggaccccagaccacaagcactgccgggacattgatgagtgccagcagggcaacctgtgtgtgaatggccagtgcaagaacacagagggcagcttccgctgcacctgtggccagggctaccagctgtctgctgccaaggaccagtgtgaagatattgatgagtgccagcaccgccacctgtgtgcccacggccagtgcaggaacacagagggcagcttccagtgtgtgtgtgaccagggctaccgggccagcggcctgggggaccactgtgaggacatcaatgaatgtctggaggacaagtctgtgtgccagagaggagactgcatcaacacagctggcagctatgactgcacctgcccagatggcttccagctggatgacaacaagacctgccaggacatcaatgaatgtgagcaccctggcctgtgtggcccccagggagaatgtctgaacacagagggcagcttccactgtgtgtgccagcagggcttcagcatctctgcagatggccgcacctgtgaagatgtgaatgaatgtgagctgctgagcggcgtgtgtggggaggccttctgtgaaaatgtggagggcagcttcctgtgtgtgtgtgctgatgagaaccaggagtacagccccatgacaggccagtgccgcagcaggaccagcacagacctggatgtggatgtggaccagcccaaggaggagaagaaggagtgctactacaacctgaatgatgccagcctgtgtgacaacgtgctggcccccaacgtgaccaagcaggagtgctgctgcaccagcggcgtgggctggggagacaactgtgagatcttcccctgccctgtgctgggcacagctgagttcacagagatgtgccccaagggcaaaggatttgtgcctgctggggagagcagcagcgaggccggcggggagaactacaaggatgctgatgaatgtctgctgtttggccaggagatctgcaagaatggcttctgcctgaacacccggcccggctatgagtgctactgcaagcagggcacctactatgaccctgtgaagctgcagtgctttgacatggatgagtgccaggaccccagcagctgcattgatggccagtgtgtgaacacagagggcagctacaactgcttctgcacccaccccatggtgctggatgccagcgagaagcgctgcatccggcctgctgagagcaatgagcagatcgaggagacagatgtgtaccaggacctgtgctgggagcacctgagtgatgaatatgtgtgcagccggcccctggtgggcaagcagaccacctacacagagtgctgctgcctgtatggagaggcctggggcatgcagtgtgccctgtgccccctgaaggacagtgatgattatgcccagctgtgcaacatccctgtgacaggccggcggcagccctacggcagagatgccctggtggacttcagcgagcagtacaccccagaggccgacccctacttcatccaggaccgcttcctgaacagctttgaggagctgcaggccgaggagtgtggcatcctgaatggctgtgaaaatggccgctgtgtgcgggtgcaggagggctacacctgtgactgctttgatggctaccacctggacacagccaagatgacctgtgtggatgtgaatgaatgtgatgagctgaacaacaggatgagcctgtgcaagaatgccaagtgcatcaacacagatggcagctacaagtgcctgtgcctgcccggctacgtgcccagcgacaagcccaactactgcacccccctgaacacagccctgaacctggagaaggacagcgacctggagtag

SEQ ID NO: 157363 - DNA, 4029 bp, Artificial Sequence
  Description of Artificial Sequence: Synthetic coding sequence
atggacaccaagctgatgtgcctgctcttcttcttcagcctgccccccctgctggtgagcaaccacacaggccgcatcaaggtggtgttcacccccagcatctgcaaggtgacctgcaccaagggcagctgccagaacagctgtgagaagggcaacaccaccaccctcatcagtgaaaatggacatgctgctgacaccctgacagccaccaacttccgggtggtgatctgccacctgccctgcatgaatggaggccagtgcagcagccgggacaagtgccagtgcccccccaacttcaccgggaagctgtgccagatccctgtgcatggagcctctgtgcccaagctgtaccagcacagccagcagcccgggaaggccctgggcacccacgtgatccacagcacccacaccctgcccctgactgtgaccagccagcagggcgtgaaggtgaagtttcctcccaacatcgtgaacatccacgtgaagcaccccccagaggcctctgtgcagatccaccaggtgtccagaattgatggccccaccggccagaagaccaaggaggcccagcccggccagagccaggtgtcctaccagggcctgcctgtgcagaagacccagaccatccacagcacctacagccaccagcaggtgatcccccacgtgtaccctgtggccgccaagacccagctgggccgctgcttccaggagaccatcggcagccagtgtgggaaggccctgcccggcctgagcaagcaggaggactgctgcggcaccgtgggcacctcctggggcttcaacaagtgccagaagtgccccaagaagcccagctaccacggctacaaccagatgatggagtgcctgcccggctacaagagggtgaacaacaccttctgccaggacatcaatgaatgccagctgcagggcgtgtgccccaacggggagtgcctgaacaccatgggcagctaccgctgcacctgcaagattggcttcggccctgaccccaccttcagcagctgtgtgcctgacccccctgtgatcagcgaggagaagggcccctgctaccgcctggtgagcagcggccggcagtgcatgcaccccctgtctgtgcacctgaccaagcagctgtgctgctgcagcgtgggcaaggcctggggcccccactgtgagaagtgccccctgcccggcacagccaaggaggagcctgtggaggccctgaccttcagccgggagcacggccctggggtggccgagcctgaggtggccacagcccctcctgagaaggagatccccagcctggaccaggagaagaccaagctggagcccggccagccccagctgagccctggcatcagcaccatccacctgcacccccagtttcctgtggtgattgagaagaccagcccccctgtgcctgtggaggtggcccctgaggccagcaccagcagcgccagccaggtgattgcccccacccaggtgacagagatcaatgaatgtactgtgaacccagacatctgtggggccggccactgcatcaacctgcctgtgcgctacacctgcatctgctatgagggctaccgcttcagcgagcagcagaggaaatgtgtggacattgatgaatgtacccaggtgcagcacctgtgcagccagggccgctgtgaaaatacagagggcagcttcctgtgcatctgcccagctggcttcatggccagcgaggagggcaccaactgcattgatgtggatgaatgtctgcggccagatgtgtgtggggagggccactgtgtgaacacagtgggcgccttccgctgtgagtactgtgacagcggctacaggatgacccagaggggccgctgtgaggacattgatgagtgcctgaaccccagcacctgcccagatgagcagtgtgtgaacagccctggcagctaccagtgtgtgccctgcacagagggcttccggggctggaatggccagtgcctggatgtggatgagtgcctggagcccaacgtgtgtgccaatggagactgcagcaacctggagggcagctacatgtgcagctgccacaagggctacaccaggaccccagaccacaagcactgccgggacattgatgagtgccagcagggcaacctgtgtgtgaatggccagtgcaagaacacagagggcagcttccgctgcacctgtggccagggctaccagctgtctgctgccaaggaccagtgtgaggacattgatgagtgccagcaccgccacctgtgtgcccacggccagtgcaggaacacagagggcagcttccagtgtgtgtgtgaccagggctaccgggccagcggcctgggggaccactgtgaggacatcaatgaatgtctggaggacaagtctgtgtgccagagaggagactgcatcaacacagctggcagctatgactgcacctgcccagatggcttccagctggatgacaacaagacctgccaggacatcaatgaatgtgagcaccctggcctgtgtggcccccagggcgagtgcctgaacacagagggcagcttccactgtgtgtgccagcagggcttcagcatctctgcagatggccgcacctgtgaggacattgatgaatgtgtgaacaacacagtgtgtgacagccacggcttctgtgacaacacagctggcagcttccgctgcctgtgctaccagggcttccaggccccccaggacggccagggctgtgtggatgtgaatgaatgtgagctgctgtctggagtgtgtggggaggccttctgtgaaaatgtggagggcagcttcctgtgtgtgtgtgctgatgagaaccaggagtacagccccatgacaggccagtgccgcagcaggaccagcacagacctggatgtggatgtggaccagcccaaggaggagaagaaggagtgctactacaacctgaatgatgccagcctgtgtgacaacgtgctggccccaaatgtgaccaagcaggagtgctgctgcaccagcggcgtgggctggggagacaactgtgagatcttcccctgccctgtgctgggcacagctgagttcacagagatgtgccccaagggcaagggctttgtgcctgctggggagagcagcagcgaggccggaggagagaactacaaggatgctgatgagtgcctgctgtttggccaggagatctgcaagaatggcttctgcctgaacaccaggcctggctatgagtgctactgcaagcagggcacctactatgaccctgtgaagctgcagtgctttgacatggatgagtgccaggaccccagcagctgcattgatggccagtgtgtgaacacagagggcagctacaactgcttctgcacccaccccatggtgctggatgccagcgagaagcgctgcatccggcctgctgagagcaatgagcagatcgaggagacagatgtgtaccaggacctgtgctgggagcacctgagtgatgaatatgtgtgcagccggcccctggtgggcaagcagaccacctacacagagtgctgctgcctgtatggagaggcctggggcatgcagtgtgccctgtgccccctgaaggacagtgatgattatgcccagctgtgcaacatccctgtgactggaagacggcagccctacggcagagatgccctggtggacttcagcgagcagtacaccccagaggccgacccctacttcatccaggaccgcttcctgaacagctttgaggagctgcaggccgaggagtgtggcatcctgaatggctgtgaaaatggccgctgtgtgcgggtgcaggagggctacacctgtgactgctttgatggctaccacctggacacagccaagatgacctgtgtggatgtgaatgaatgtgatgagctgaacaacaggatgagcctgtgcaagaatgccaagtgcatcaacacagatggcagctacaagtgcctgtgcctgcccggctacgtgcccagcgacaagcccaactactgcacccccctgaacacagccctgaacctggagaaggacagcgacctggagtag

SEQ ID NO: 157364 - DNA, 5466 bp, Artificial Sequence
  Description of Artificial Sequence: Synthetic coding sequence
atgaggcccaggaccaaggcccggagccctggccgggccctgaggaacccctggaggggcttcctgcccctgaccctggccctgtttgtgggcgccggccacgcccagagggaccctgtgggccgctatgagcctgctggaggagatgccaaccggctgcggcggcctgggggcagctacccagctgctgctgctgccaaggtgtacagcctcttccgggagcaggatgcccctgtggccggcctgcagcctgtggagcgggcccagcccggctggggcagcccccggcggcccacagaagctgaggcccggcggcccagccgggcccagcagagcagaagagtgcagcccccagcccagacccggcgcagcacccccctgggccagcagcagcctgcccccaggacccgggccgccccagccctgccccggctgggcaccccccagaggtctggagctgccccacccaccccaccccggggccgcctgaccggcagaaatgtgtgtggcggccagtgctgccccggctggaccacagccaacagcaccaaccactgcatcaagcctgtgtgtgagcccccctgccagaacagaggcagctgcagccggccccagctgtgtgtgtgccgcagcggcttccggggggcccgctgtgaggaggtgatcccagatgaggagtttgacccccagaacagccggctggccccccggcgctgggccgagaggagccccaacctgcggcgcagcagcgctgctggggagggcaccctggcccgggcccagcccccagccccccagagccccccagccccccagagccccccagctggcaccctgagcggcctgagccagacccaccccagccagcagcacgtgggcctgagcaggacagtgcggctgcaccccacagccacagccagcagccagctgagcagcaatgccctgcccccaggccctggcctggagcagagagatggcacccagcaggccgtgcccctggagcaccccagcagcccctggggcctgaacctgacagagaagatcaagaagatcaagatcgtgttcacccccaccatctgcaagcagacctgtgcccggggccactgtgccaacagctgtgagcggggggacaccaccaccctgtacagccagggcggccacggccatgaccccaagagcggcttccgcatctacttctgccagatcccctgcctgaatggaggccgctgcatcggcagagatgagtgctggtgcccagccaacagcacaggcaagttctgccacctgcccatcccccagcctgaccgggagcccccaggccggggcagccggccccgggccctgctggaggcccccctgaagcagagcaccttcaccctgcccctgagcaaccagctggcctctgtgaaccccagcctggtgaaggtgcacatccaccaccccccagaggcctctgtgcagatccaccaggtggcccaggtgcggggcggcgtggaggaggccctggtggagaacagcgtggagacccggcccccaccctggctgcctgccagccctggccacagcctgtgggacagcaacaacatcccagcccggtctggagagcccccccggcccctgcccccagctgccccccggccccggggcctgctgggccgctgctacctgaacacagtgaatggccagtgtgccaaccccctgctggagctgaccacccaggaggactgctgcggctctgtgggcgccttctggggcgtgaccctgtgtgccccctgcccccccaggcctgccagccctgtgattgaaaatggccagctggagtgcccccagggctacaagaggctgaacctgacccactgccaggacatcaatgaatgtctgaccctgggcctgtgcaaggatgctgaatgtgtgaacacccggggcagctacctgtgcacctgccggcccggcctgatgctggaccccagccgcagccgctgtgtgtctgacaaggccatctccatgctgcagggcctgtgctaccgcagcctgggccctggcacctgcaccctgcccctggcccagaggatcaccaagcagatctgctgctgcagccgggtgggcaaggcctggggctctgaatgtgagaagtgccccctgcctggaacagaggccttccgggagatctgcccagctggccacggctacacctacgccagcagtgacatccggctgtccatgaggaaggccgaggaggaggagctggcccggcccccccgggagcagggccagaggagcagcggggccctgcccggccctgctgagcggcagcccctgcgggtggtgacagacacctggctggaggccggcaccatcccagacaagggggacagccaggccggccaggtgaccacctctgtgacccacgccccagcctgggtgactggaaatgccaccaccccacccatgcctgagcagggcattgctgagatccaggaggagcaggtgacccccagcacagatgtgctggtgaccctgagcaccccaggcatcgacagatgtgccgccggggccaccaacgtgtgtggccctggcacctgtgtgaacctgcctgatggctaccgctgtgtgtgcagccctggctaccagctgcaccccagccaggcctactgcacagatgacaatgaatgtctgcgggacccctgcaagggcaagggccgctgcatcaacagagtgggcagctacagctgcttctgctacccaggctacaccctggccaccagcggggccacccaggagtgccaggacatcaatgaatgtgagcagcccggggtgtgcagcggcggccagtgcaccaacacagagggcagctaccactgtgaatgtgaccagggctacatcatggtgaggaagggccactgccaggacatcaatgaatgtcgccaccctggcacctgcccagatggccgctgtgtgaacagccctggcagctacacctgcctggcctgtgaggagggctaccggggccagagcggcagctgtgtggatgtgaatgaatgtctgaccccaggagtgtgtgcccacggcaagtgcaccaacctggagggcagcttccgctgcagctgtgagcagggctatgaggtgaccagtgatgagaagggctgccaggatgtggatgaatgtgccagccgggccagctgccccaccggcctgtgcctgaacacagagggcagctttgcctgcagcgcctgtgaaaatggctactgggtgaatgaagatggaacagcctgtgaggacctggatgaatgtgccttccctggggtgtgccccagcggcgtgtgcaccaacacagctggcagcttcagctgcaaggactgtgatggcggctaccggcccagccccctgggggacagctgtgaagatgtggatgaatgtgaggacccccagagcagctgcctgggcggggagtgcaagaacacagtgggcagctaccagtgcctgtgcccccagggcttccagctggccaacggcaccgtgtgtgaagatgtgaatgaatgcatgggagaggagcactgtgcccctcatggagaatgtctgaacagccacggcagcttcttctgcctgtgtgcccctggctttgtgtctgctgagggcggcaccagctgccaggatgtggatgaatgtgccaccacagacccctgtgtgggcggccactgtgtgaacacagagggcagcttcaactgcctgtgtgagaccggcttccagcccagccctgagagcggggagtgtgtggacattgatgaatgtgaggactatggagaccctgtgtgtggcacctggaagtgtgagaacagccctggcagctaccgctgtgtgctgggctgccagcccggcttccacatggcccccaacggggactgcatcgacattgatgaatgtgccaatgacaccatgtgtggcagccacggcttctgtgacaacacagatggcagcttccgctgcctgtgtgaccagggctttgagatcagccccagcggctgggactgtgtggatgtgaatgaatgtgagctgatgctggccgtgtgtggggccgccctgtgtgaaaatgtggagggcagcttcctgtgcctgtgtgccagtgacctggaggagtatgatgcccaggagggccactgccggcccagaggagctgggggccagagcatgtctgaggcccccactggagaccacgccccagcccccaccaggatggactgctacagcggccagaagggccacgccccctgcagctctgtgctgggcaggaacaccacccaggccgagtgctgctgcacccagggcgcctcctggggagatgcctgtgacctgtgccccagcgaggacagcgctgagttcagcgagatctgccccagcggcaagggctacatccctgtggagggcgcctggaccttcggccagaccatgtacacagatgctgatgaatgtgtgatcttcggccctggcctgtgccccaacggccgctgcctgaacacagtgcccggctacgtgtgcctgtgcaaccctggcttccactatgatgccagccacaagaagtgtgaagatcatgatgagtgccaggacctggcctgtgaaaatggagaatgtgtgaacacagagggcagcttccactgcttctgcagcccccccctgaccctggacctgagccagcagcgctgcatgaacagcaccagcagcacagaggacctgcctgaccatgacatccacatggacatctgctggaagaaggtgaccaatgatgtgtgcagcgagcccctgcggggccacaggaccacctacacagagtgctgctgccaggatggagaggcctggagccagcagtgtgccctgtgccccccaagaagcagcgaggtgtatgcccagctgtgcaatgtggccagaattgaagctgagcgggaggccggcgtgcacttccggcccggctatgaatatggccctggcccagatgacctgcactacagcatctacggcccagatggagcccccttctacaactacctgggcccagaagatactgtgcctgagcccgccttccccaacacagctggccacagcgctgacaggacccccatcctggagagccccctgcagcccagcgagctgcagccccactacgtggccagccaccctgagcccccagctggctttgagggcctgcaggccgaggagtgtggcatcctgaatggctgtgaaaatggccgctgtgtgcgggtgcgggagggctacacctgtgactgctttgagggcttccagctggatgctgcccacatggcctgtgtggatgtgaatgaatgtgatgacctgaatggacctgctgtgctgtgtgtgcacggctactgtgagaacacagagggcagctaccgctgccactgcagccctggctacgtggccgaggccggccccccccactgcacagccaaggagtag

SEQ ID NO: 157365 - DNA, 3912 bp, Artificial Sequence
  Description of Artificial Sequence: Synthetic coding sequence
atgcctggccccagaggagctgctgggggcctggcccctgagatgagaggagctggagctgctggcctgctggccctgctgctgctgctgctgctgctgctgctgggcctgggcggccgggtggagggcggccctgctggggagagaggagctgggggcggcggggccctggcccgggagcgcttcaaggtggtgtttgcccctgtgatctgcaagaggacctgcctgaagggccagtgccgggacagctgccagcagggcagcaacatgaccctgattggagaaaatggccacagcacagacaccctgaccggcagcggcttccgggtggtggtgtgccccctgccctgcatgaatggaggccagtgcagcagcaggaaccagtgcctgtgccccccagacttcaccggccgcttctgccaggtgcctgctgggggcgccggcggcggcactggaggcagcggccctggcctgagcaggactggagccctgagcactggagccctgccccccctggcccctgagggggacagcgtggccagcaagcacgccatctatgctgtgcaggtgattgctgaccccccaggccctggagagggccccccagcccagcacgccgccttcctggtgcccctgggccctggccagatctctgctgaggtgcaggcccctcctcctgtggtgaatgtgcgggtgcaccaccccccagaggcctctgtgcaggtgcacagaattgagagcagcaatgctgagagcgctgcccccagccagcacctgctgccccaccccaagcccagccacccccggccccccacccagaagcccctgggccgctgcttccaggacaccctgcccaagcagccctgtggcagcaaccccctgcccggcctgaccaagcaggaggactgctgcggcagcattggaacagcctggggccagagcaagtgccacaagtgcccccagctgcagtacacaggagtgcagaagccaggccctgtgcggggggaggtgggcgctgactgcccccagggctacaagaggctgaacagcacccactgccaggacatcaatgaatgtgccatgcctggggtgtgcagacatggagactgcctgaacaaccctggcagctaccgctgtgtgtgccccccaggccacagcctgggccccagcaggacccagtgcatcgctgacaagccagaggagaagagcctgtgcttccggctggtgtccccagagcaccagtgccagcaccccctgaccacccggctgacccggcagctgtgctgctgcagcgtgggcaaggcctggggcgcccgctgccagcgctgccccacagatggaacagctgccttcaaggagatctgcccagctgggaagggctaccacatcctgaccagccaccagaccctgaccatccagggcgagagtgacttcagcctcttcctgcacccagatggcccccccaagccccagcagctgcctgagagccccagccaggcccctcctcctgaggacacagaggaggagcggggcgtgaccacagacagccctgtgtctgaggagaggtctgtgcagcagagccaccccacagccaccaccaccccagcccggccctacccagagctgatcagccggcccagcccccccaccatgcgctggttcctgcctgacctgccccccagccgctctgctgtggagatcgcccccacccaggtgacagaaacagatgaatgtcggctgaaccagaacatctgtggccatggagaatgtgtgcccggccccccagactacagctgccactgcaaccctggctaccgcagccacccccagcaccgctactgtgtggatgtgaatgaatgtgaggccgagccctgtggccctggccggggcatctgcatgaacacaggaggcagctacaactgccactgcaacagaggctaccgcctgcacgtgggcgccggcggccgcagctgtgtggacctgaatgaatgtgccaagccccacctgtgtggagatggcggcttctgcatcaacttccctggccactacaagtgcaactgctacccaggctaccgcctgaaggccagccggccccctgtgtgtgaggacattgatgagtgccgggaccccagcagctgcccagatggaaaatgtgagaacaagccaggcagcttcaagtgcatcgcctgccagcccggctaccgcagccagggcggcggggcctgcagagatgtgaatgaatgtgccgagggcagcccctgcagccctggctggtgtgagaacctgcccggcagcttccgctgcacctgtgcccagggctacgccccagccccagatggccgcagctgcctggatgtggatgaatgtgaggccggagatgtgtgtgacaatggcatctgcagcaacaccccaggcagcttccagtgccagtgcctgagcggctaccacctgagccgggacaggagccactgtgaagatattgatgaatgtgacttccctgctgcctgcattggaggagactgcatcaacaccaacggcagctaccgctgcctgtgcccccagggccaccggctggtgggcggcaggaagtgccaggacattgatgaatgttcccaggaccccagcctgtgcctgccccacggggcctgcaagaacctgcagggcagctatgtgtgtgtgtgtgatgagggcttcacccccacccaggaccagcacggctgtgaggaggtggagcagccccaccacaagaaggagtgctacctgaactttgatgacaccgtcttctgtgacagcgtgctggccaccaacgtgacccagcaggagtgctgctgcagcctgggcgccggctggggagaccactgtgagatctacccctgccctgtgtacagcagcgctgagttccacagcctgtgcccagatggcaagggctacacccaggacaacaacatcgtgaactacggcatcccagcccaccgggacattgatgagtgcatgctgtttggcagcgagatctgcaaggagggcaaatgtgtgaacacccagcccggctatgagtgctactgcaagcagggcttctactatgatggcaacctgctggagtgtgtggatgtggatgaatgtctggatgagagcaactgcagaaatggagtgtgtgagaacacccggggcggctaccgctgtgcctgcaccccacctgctgagtacagccctgcccagaggcagtgcctgagccctgaggagatggatgtggatgagtgccaggaccctgctgcctgccggcccggccgctgtgtgaacctgcccggcagctaccgctgtgaatgtcggcccccctgggtgcccggccccagcggccgggactgccagctgcctgagagccctgctgagcgggcccctgagaggagagatgtgtgctggagccagagaggagaagatggcatgtgtgccggccccctggccggccctgccctgacctttgatgactgctgctgccggcagggccggggctggggcgcccagtgccggccctgcccccccaggggggccggcagccactgccccaccagccagagcgagagcaacagcttctgggacaccagccccctgctgctgggcaagcccccaagagatgaggacagcagcgaggaggacagtgatgagtgccgctgtgtgtctggccgctgtgtgcccaggcctgggggcgctgtgtgtgagtgccctgggggcttccagctggatgccagccgggcccgctgtgtggacattgatgaatgtcgggagctgaaccagaggggcctgctgtgcaagtctgagcgctgtgtgaacaccagcggcagcttccgctgtgtgtgcaaggccggctttgcccggagccggccccacggggcctgtgtgccccagaggagaagatag

SEQ ID NO: 157366 - DNA, 792 bp, Artificial Sequence
  Description of Artificial Sequence: Synthetic coding sequence
atgctgtttggaagtgagatctgcaaggagggcaaatgtgtgaacacccagcccggctatgagtgctactgcaagcagggcttctactatgatggcaacctgctggagtgtgtggatgtggatgagtgcctggatgagagcaactgcagaaatggagtgtgtgagaacacccggggcggctaccgctgtgcctgcaccccacctgctgagtacagccctgcccagaggcagtgcctgagccctgaggagatggatgtggatgagtgccaggaccctgctgcctgcaggcctggccgctgtgtgaacctgcccggcagctaccgctgtgagtgcaggcctccctgggtgcccggccccagcggccgggactgccagctgcctgagagccctgctgagcgggcccctgagaggagagatgtgtgctggagccagagaggagaagatggcatgtgtgccggccccctggccggccctgccctgacctttgatgactgctgctgccggcagggccggggctggggcgcccagtgccggccctgccccccaagaggagctggcagccactgccccaccagccagagcgagagcaacagcttctgggacaccagccccctgctgctgggcaagcccccaagagatgaggacagcagtgaagaagattctgatgaatgtcgctgtgtgtctgctgctgcctgccggggccgggccgccccctgtgcctctgtgcctgctgccagcagcagcaccccaccagccccagctgcctggatcagcaccagcgctgagagctag

SEQ ID NO: 157367 - DNA, 3771 bp, Artificial Sequence
  Description of Artificial Sequence: Synthetic coding sequence
atgcctggccccagaggagctgctgggggcctggcccctgagatgagaggagctggagctgctggcctgctggccctgctgctgctgctgctgctgctgctgctgggcctgggcggccgggtggagggcggccctgctggggagagaggagctgggggcggcggggccctggcccgggagcgcttcaaggtggtgtttgcccctgtgatctgcaagaggacctgcctgaagggccagtgccgggacagctgccagcagggcagcaacatgaccctgattggagaaaatggccacagcacagacaccctgaccggcagcggcttccgggtggtggtgtgccccctgccctgcatgaatggaggccagtgcagcagcaggaaccagtgcctgtgccccccagacttcaccggccgcttctgccaggtgcctgctgggggcgccggcggcggcactggaggcagcggccctggcctgagcaggactggagccctgagcactggagccctgccccccctggcccctgagggggacagcgtggccagcaagcacgccatctatgctgtgcaggtgattgctgaccccccaggccctggagagggccccccagcccagcacgccgccttcctggtgcccctgggccctggccagatctctgctgaggtgcaggcccctcctcctgtggtgaatgtgcgggtgcaccaccccccagaggcctctgtgcaggtgcacagaattgagagcagcaatgctgagagcgctgcccccagccagcacctgctgccccaccccaagcccagccacccccggccccccacccagaagcccctgggccgctgcttccaggacaccctgcccaagcagccctgtggcagcaaccccctgcccggcctgaccaagcaggaggactgctgcggcagcattggaacagcctggggccagagcaagtgccacaagtgcccccagctgcagtacacaggagtgcagaagccaggccctgtgcggggggaggtgggcgctgactgcccccagggctacaagaggctgaacagcacccactgccaggacatcaatgaatgtgccatgcctggggtgtgcagacatggagactgcctgaacaaccctggcagctaccgctgtgtgtgccccccaggccacagcctgggccccagcaggacccagtgcatcgctgacaagccagaggagaagagcctgtgcttccggctggtgtccccagagcaccagtgccagcaccccctgaccacccggctgacccggcagctgtgctgctgcagcgtgggcaaggcctggggcgcccgctgccagcgctgccccacagatggaacagctgccttcaaggagatctgcccagctgggaagggctaccacatcctgaccagccaccagaccctgaccatccagggcgagagtgacttcagcctcttcctgcacccagatggcccccccaagccccagcagctgcctgagagccccagccaggcccctcctcctgaggacacagaggaggagcggggcgtgaccacagacagccctgtgtctgaggagaggtctgtgcagcagagccaccccacagccaccaccaccccagcccggccctacccagagctgatcagccggcccagcccccccaccatgcgctggttcctgcctgacctgccccccagccgctctgctgtggagatcgcccccacccaggtgacagaaacagatgaatgtcggctgaaccagaacatctgtggccatggagaatgtgtgcccggccccccagactacagctgccactgcaaccctggctaccgcagccacccccagcaccgctactgtgtggatgtgaatgaatgtgaggccgagccctgtggccctggccggggcatctgcatgaacacaggaggcagctacaactgccactgcaacagaggctaccgcctgcacgtgggcgccggcggccgcagctgtgtggacctgaatgaatgtgccaagccccacctgtgtggagatggcggcttctgcatcaacttccctggccactacaagtgcaactgctacccaggctaccgcctgaaggccagccggccccctgtgtgtgaggacattgatgagtgccgggaccccagcagctgcccagatggaaaatgtgagaacaagccaggcagcttcaagtgcatcgcctgccagcccggctaccgcagccagggcggcggggcctgcagagatgtgaatgaatgtgccgagggcagcccctgcagccctggctggtgtgagaacctgcccggcagcttccgctgcacctgtgcccagggctacgccccagccccagatggccgcagctgcctggatgtggatgaatgtgaggccggagatgtgtgtgacaatggcatctgcagcaacaccccaggcagcttccagtgccagtgcctgagcggctaccacctgagccgggacaggagccactgtgaagatattgatgaatgtgacttccctgctgcctgcattggaggagactgcatcaacaccaacggcagctaccgctgcctgtgcccccagggccaccggctggtgggcggcaggaagtgccaggacattgatgaatgttcccaggaccccagcctgtgcctgccccacggggcctgcaagaacctgcagggcagctatgtgtgtgtgtgtgatgagggcttcacccccacccaggaccagcacggctgtgaggaggtggagcagccccaccacaagaaggagtgctacctgaactttgatgacaccgtcttctgtgacagcgtgctggccaccaacgtgacccagcaggagtgctgctgcagcctgggcgccggctggggagaccactgtgagatctacccctgccctgtgtacagcagcgctgagttccacagcctgtgcccagatggcaagggctacacccaggacaacaacatcgtgaactacggcatcccagcccaccgggacattgatgagtgcatgctgtttggcagcgagatctgcaaggagggcaaatgtgtgaacacccagcccggctatgagtgctactgcaagcagggcttctactatgatggcaacctgctggagtgtgtggatgtggatgaatgtctggatgagagcaactgcagaaatggagtgtgtgagaacacccggggcggctaccgctgtgcctgcaccccacctgctgagtacagccctgcccagaggcagtgcctgagccctgaggagatggagcgggcccctgagaggagagatgtgtgctggagccagagaggagaagatggcatgtgtgccggccccctggccggccctgccctgacctttgatgactgctgctgccggcagggccggggctggggcgcccagtgccggccctgccccccaagaggagctggcagccactgccccaccagccagagcgagagcaacagcttctgggacaccagccccctgctgctgggcaagcccccaagagatgaggacagcagtgaagaagattctgatgaatgtcgctgtgtgtctggccgctgtgtgcccaggcctggaggagctgtgtgtgaatgtcctgggggcttccagctggatgccagccgggcccgctgtgtggacattgatgagtgccgggagctgaaccagaggggcctgctgtgcaagtctgagcgctgtgtgaacaccagcggcagcttccgctgtgtgtgcaaggccggctttgcccggagccggccccatggagcctgtgtgccccagaggagaagatag

SEQ ID NO: 157368 - DNA, 921 bp, Artificial Sequence
  Description of Artificial Sequence: Synthetic coding sequence
atgctgtttggaagtgagatctgcaaggagggcaaatgtgtgaacacccagcccggctatgagtgctactgcaagcagggcttctactatgatggcaacctgctggagtgtgtggatgtggatgagtgcctggatgagagcaactgcagaaatggagtgtgtgagaacacccggggcggctaccgctgtgcctgcaccccacctgctgagtacagccctgcccagaggcagtgcctgagccctgaggagatggatgtggatgagtgccaggaccctgctgcctgcaggcctggccgctgtgtgaacctgcccggcagctaccgctgtgagtgcaggcctccctgggtgcccggccccagcggccgggactgccagctgcctgagagccctgctgagcgggcccctgagaggagagatgtgtgctggagccagagaggagaagatggcatgtgtgccggccccctggccggccctgccctgacctttgatgactgctgctgccggcagggccggggctggggcgcccagtgccggccctgccccccaagaggagctggcagccactgccccaccagccagagcgagagcaacagcttctgggacaccagccccctgctgctgggcaagcccccaagagatgaggacagcagtgaagaagattctgatgaatgtcgctgtgtgtctggccgctgtgtgcccaggcctggaggagctgtgtgtgaatgtcctgggggcttccagctggatgccagccgggcccgctgtgtggacattgatgagtgccgggagctgaaccagaggggcctgctgtgcaagtctgagcgctgtgtgaacaccagcggcagcttccgctgtgtgtgcaaggccggctttgcccggagccggccccatggagcctgtgtgccccagaggagaagatag

SEQ ID NO: 157369 - DNA, 3414 bp, Artificial Sequence
  Description of Artificial Sequence: Synthetic coding sequence
atgaccctcatcggggagaatggccacagcacagacaccctgactggaagtggcttccgggtggtggtgtgccccctgccctgcatgaatggaggccagtgcagcagcaggaaccagtgcctgtgccccccagacttcaccggccgcttctgccaggtgcctgctggaggagctgggggcggcaccggcggcagcggccctggcctgagcaggactggagccctgagcactggagccctgccccccctggcccctgagggggacagcgtggccagcaagcacgccatctatgctgtgcaggtgattgctgaccccccaggccctggagagggccccccagcccagcacgccgccttcctggtgcccctgggccctggccagatctctgctgaggtgcaggcccctcctcctgtggtgaatgtgcgggtgcaccaccccccagaggcctctgtgcaggtgcaccgcatcgagagcagcaatgctgagagcgctgcccccagccagcacctgctgccccaccccaagcccagccaccccaggcctcccacccagaagcccctgggccgctgcttccaggacaccctgcccaagcagccctgtggcagcaaccccctgcccggcctgaccaagcaggaggactgctgcggcagcatcggcacagcctggggccagagcaagtgccacaagtgcccccagctgcagtacacaggagtgcagaagccaggccctgtgcggggggaggtgggcgctgactgcccccagggctacaagaggctgaacagcacccactgccaggacatcaatgaatgtgccatgcctggggtgtgccgccacggggactgcctgaacaaccctggcagctaccgctgtgtgtgccccccaggccacagcctgggccccagcaggacccagtgcatcgctgacaagccagaggagaagagcctgtgcttccggctggtgtccccagagcaccagtgccagcaccccctgaccacccggctgacccggcagctgtgctgctgcagcgtgggcaaggcctggggcgcccgctgccagcgctgccccacagatggaacagctgccttcaaggagatctgcccagctgggaagggctaccacatcctgaccagccaccagaccctgaccatccagggcgagagtgacttcagcctcttcctgcacccagatggcccccccaagccccagcagctgcctgagagccccagccaggcccctcctcctgaggacacagaggaggagcggggcgtgaccacagacagccctgtgtctgaggagaggtctgtgcagcagagccaccccacagccaccaccaccccagcccggccctacccagagctgatcagccggcccagcccccccaccatgcgctggttcctgcctgacctgccccccagccgctctgctgtggagatcgcccccacccaggtgacagaaacagatgagtgccgcctgaaccagaacatctgtggccacggggagtgtgtgcccggccccccagactacagctgccactgcaaccctggctaccgcagccacccccagcaccgctactgtgtggatgtgaatgaatgtgaggccgagccctgtggccctggccggggcatctgcatgaacacaggaggcagctacaactgccactgcaacagaggctaccgcctgcacgtgggcgctgggggccgcagctgtgtggacctgaatgaatgtgccaagccccacctgtgtggagatggcggcttctgcatcaacttccctggccactacaagtgcaactgctacccaggctaccgcctgaaggccagcaggcctcctgtgtgtgaagatattgatgaatgtcgggaccccagcagctgcccagatggaaaatgtgagaacaagccaggcagcttcaagtgcatcgcctgccagcccggctaccgcagccagggcggcggggcctgcagagatgtgaatgaatgtgccgagggcagcccctgcagccctggctggtgtgagaacctgcccggcagcttccgctgcacctgtgcccagggctacgccccagccccagatggccgcagctgcctggatgtggatgaatgtgaggccggagatgtgtgtgacaatggcatctgcagcaacaccccaggcagcttccagtgccagtgcctgagcggctaccacctgagccgggacaggagccactgtgaggacattgatgaatgtgacttccctgctgcctgcatcggcggggactgcatcaacaccaacggcagctaccgctgcctgtgcccccagggccaccggctggtgggcggcaggaagtgccaggacattgatgagtgcagccaggaccccagcctgtgcctgccccatggagcctgcaagaacctgcagggcagctatgtgtgtgtgtgtgatgagggcttcacccccacccaggaccagcacggctgtgaggaggtggagcagccccaccacaagaaggagtgctacctgaactttgatgacacagtgttctgtgacagcgtgctggccaccaacgtgacccagcaggagtgctgctgcagcctgggcgccggctggggagaccactgtgagatctacccctgccctgtgtacagcagcgctgagttccacagcctgtgcccagatggcaagggctacacccaggacaacaacatcgtgaactacggcatcccagcccaccgggacattgatgagtgcatgctgtttggaagtgagatctgcaaggagggcaaatgtgtgaacacccagcccggctatgagtgctactgcaagcagggcttctactatgatggcaacctgctggagtgtgtggatgtggatgagtgcctggatgagagcaactgcagaaatggagtgtgtgagaacacccggggcggctaccgctgtgcctgcaccccacctgctgagtacagccctgcccagaggcagtgcctgagccctgaggagatggatgtggatgagtgccaggaccctgctgcctgcaggcctggccgctgtgtgaacctgcccggcagctaccgctgtgagtgcaggcctccctgggtgcccggccccagcggccgggactgccagctgcctgagagccctgctgagcgggcccctgagaggagagatgtgtgctggagccagagaggagaagatggcatgtgtgccggccccctggccggccctgccctgacctttgatgactgctgctgccggcagggccggggctggggcgcccagtgccggccctgccccccaagaggagctggcagccactgccccaccagccagagcgagagcaacagcttctgggacaccagccccctgctgctgggcaagcccccaagagatgaggacagcagtgaagaagattctgatgaatgtcgctgtgtgtctggatag

SEQ ID NO: 157370 - DNA, 2202 bp, Artificial Sequence
  Description of Artificial Sequence: Synthetic coding sequence
atgcctgctgagacagatgaatgtcggctgaaccagaacatctgtggccatggagaatgtgtgcccggccccccagactacagctgccactgcaaccctggctaccgcagccacccccagcaccgctactgtgtggatgtgaatgaatgtgaggccgagccctgtggccctggccggggcatctgcatgaacacaggaggcagctacaactgccactgcaacagaggctaccgcctgcacgtgggcgccggcggccgcagctgtgtggacctgaatgaatgtgccaagccccacctgtgtggagatggcggcttctgcatcaacttccctggccactacaagtgcaactgctacccaggctaccgcctgaaggccagccggccccctgtgtgtgaggacattgatgagtgccgggaccccagcagctgcccagatggaaaatgtgagaacaagccaggcagcttcaagtgcatcgcctgccagcccggctaccgcagccagggcggcggggcctgcagagatgtgaatgaatgtgccgagggcagcccctgcagccctggctggtgtgagaacctgcccggcagcttccgctgcacctgtgcccagggctacgccccagccccagatggccgcagctgcctggatgtggatgaatgtgaggccggagatgtgtgtgacaatggcatctgcagcaacaccccaggcagcttccagtgccagtgcctgagcggctaccacctgagccgggacaggagccactgtgaagatattgatgaatgtgacttccctgctgcctgcattggaggagactgcatcaacaccaacggcagctaccgctgcctgtgcccccagggccaccggctggtgggcggcaggaagtgccaggacattgatgaatgttcccaggaccccagcctgtgcctgccccacggggcctgcaagaacctgcagggcagctatgtgtgtgtgtgtgatgagggcttcacccccacccaggaccagcacggctgtgaggaggtggagcagccccaccacaagaaggagtgctacctgaactttgatgacaccgtcttctgtgacagcgtgctggccaccaacgtgacccagcaggagtgctgctgcagcctgggcgccggctggggagaccactgtgagatctacccctgccctgtgtacagcagcgctgagttccacagcctgtgcccagatggcaagggctacacccaggacaacaacatcgtgaactacggcatcccagcccaccgggacattgatgagtgcatgctgtttggcagcgagatctgcaaggagggcaaatgtgtgaacacccagcccggctatgagtgctactgcaagcagggcttctactatgatggcaacctgctggagtgtgtggatgtggatgaatgtctggatgagagcaactgcagaaatggagtgtgtgagaacacccggggcggctaccgctgtgcctgcaccccacctgctgagtacagccctgcccagaggcagtgcctgagccctgaggagatggatgtggatgagtgccaggaccctgctgcctgccggcccggccgctgtgtgaacctgcccggcagctaccgctgtgaatgtcggcccccctgggtgcccggccccagcggccgggactgccagctgcctgagagccctgctgagcgggcccctgagaggagagatgtgtgctggagccagagaggagaagatggcatgtgtgccggccccctggccggccctgccctgacctttgatgactgctgctgccggcagggccggggctggggcgcccagtgccggccctgcccccccaggggggccggcagccactgccccaccagccagagcgagagcaacagcttctgggacaccagccccctgctgctgggcaagcccccaagagatgaggacagcagcgaggaggacagtgatgagtgccgctgtgtgtctggccgctgtgtgcccaggcctgggggcgctgtgtgtgagtgccctgggggcttccagctggatgccagccgggcccgctgtgtggacattgatgaatgtcgggagctgaaccagaggggcctgctgtgcaagtctgagcgctgtgtgaacaccagcggcagcttccgctgtgtgtgcaaggccggctttgcccggagccggccccacggggcctgtgtgccccagaggagaagatag

SEQ ID NO: 157371 - DNA, 2649 bp, Artificial Sequence
  Description of Artificial Sequence: Synthetic coding sequence
atgaccctcatcggggagaatggccacagcacagacaccctgactggaagtggcttccgggtggccgacaagccagaggagaagagcctgtgcttccggctggtgtccccagagcaccagtgccagcaccccctgaccacccggctgacccggcagctgtgctgctgcagcgtgggcaaggcctggggcgcccgctgccagcgctgccccacagatggaacagctgccttcaaggagatctgcccagctgggaagggctaccacatcctgaccagccaccagaccctgaccatccagggcgagagtgacttcagcctcttcctgcacccagatggcccccccaagccccagcagctgcctgagagccccagccaggcccctcctcctgaggacacagaggaggagcggggcgtgaccacagacagccctgtgtctgaggagaggtctgtgcagcagagccaccccacagccaccaccaccccagcccggccctacccagagctgatcagccggcccagcccccccaccatgcgctggttcctgcctgacctgccccccagccgctctgctgtggagatcgcccccacccaggtgacagaaacagatgaatgtcggctgaaccagaacatctgtggccatggagaatgtgtgcccggccccccagactacagctgccactgcaaccctggctaccgcagccacccccagcaccgctactgtgtggatgtgaatgaatgtgaggccgagccctgtggccctggccggggcatctgcatgaacacaggaggcagctacaactgccactgcaacagaggctaccgcctgcacgtgggcgccggcggccgcagctgtgtggacctgaatgaatgtgccaagccccacctgtgtggagatggcggcttctgcatcaacttccctggccactacaagtgcaactgctacccaggctaccgcctgaaggccagccggccccctgtgtgtgaggacattgatgagtgccgggaccccagcagctgcccagatggaaaatgtgagaacaagccaggcagcttcaagtgcatcgcctgccagcccggctaccgcagccagggcggcggggcctgcagagatgtgaatgaatgtgccgagggcagcccctgcagccctggctggtgtgagaacctgcccggcagcttccgctgcacctgtgcccagggctacgccccagccccagatggccgcagctgcctggatgtggatgaatgtgaggccggagatgtgtgtgacaatggcatctgcagcaacaccccaggcagcttccagtgccagtgcctgagcggctaccacctgagccgggacaggagccactgtgaagatattgatgaatgtgacttccctgctgcctgcattggaggagactgcatcaacaccaacggcagctaccgctgcctgtgcccccagggccaccggctggtgggcggcaggaagtgccaggacattgatgaatgttcccaggaccccagcctgtgcctgccccacggggcctgcaagaacctgcagggcagctatgtgtgtgtgtgtgatgagggcttcacccccacccaggaccagcacggctgtgaggaggtggagcagccccaccacaagaaggagtgctacctgaactttgatgacaccgtcttctgtgacagcgtgctggccaccaacgtgacccagcaggagtgctgctgcagcctgggcgccggctggggagaccactgtgagatctacccctgccctgtgtacagcagcgctgagttccacagcctgtgcccagatggcaagggctacacccaggacaacaacatcgtgaactacggcatcccagcccaccgggacattgatgagtgcatgctgtttggcagcgagatctgcaaggagggcaaatgtgtgaacacccagcccggctatgagtgctactgcaagcagggcttctactatgatggcaacctgctggagtgtgtggatgtggatgaatgtctggatgagagcaactgcagaaatggagtgtgtgagaacacccggggcggctaccgctgtgcctgcaccccacctgctgagtacagccctgcccagaggcagtgcctgagccctgaggagatggagcgggcccctgagaggagagatgtgtgctggagccagagaggagaagatggcatgtgtgccggccccctggccggccctgccctgacctttgatgactgctgctgccggcagggccggggctggggcgcccagtgccggccctgccccccaagaggagctggcagccactgccccaccagccagagcgagagcaacagcttctgggacaccagccccctgctgctgggcaagcccccaagagatgaggacagcagtgaagaagattctgatgaatgtcgctgtgtgtctggccgctgtgtgcccaggcctggaggagctgtgtgtgaatgtcctgggggcttccagctggatgccagccgggcccgctgtgtggacattgatgagtgccgggagctgaaccagaggggcctgctgtgcaagtctgagcgctgtgtgaacaccagcggcagcttccgctgtgtgtgcaaggccggctttgcccggagccggccccatggagcctgtgtgccccagaggagaagatag

SEQ ID NO: 157372 - DNA, 4761 bp, Artificial Sequence
  Description of Artificial Sequence: Synthetic coding sequence
atgggagatgtgaaggccctgctgtttgtggccgccgcccgggcccggcggctgggcggggccgccgccagcgagagcctggccgtgtctgaggccttctgccgggtgcgcagctgccagcccaagaagtgtgccggcccccagcgctgcctgaaccctgtgcctgctgtgcccagccccagccccagcgtgaggaagaggcaggtgtccctgaactggcagcccctgaccctgcaggaggcccgggccctgctgaagagaagaagaccccggggccctgggggccggggcctgctgcggcggcggcccccccagagggccccagctgggaaggcccctgtgctgtgccccctcatctgccacaacggcggcgtgtgtgtgaagccagaccgctgcctgtgccccccagactttgctgggaagttctgccagctgcacagcagcggggcccggcccccagccccagctgtgcccggcctgaccaggtctgtgtacaccatgcccctggccaaccacagagatgatgaacatggagtggcctccatggtgtctgtgcacgtggagcacccccaggaggcctctgtggtggtgcaccaggtggagcgggtgtctggcccctgggaggaggctgatgctgaggccgtggcccgggcagaggccgccgcccgggcagaggccgccgccccctacacagtgctggcccagagcgccccccgggaggatggctacagtgatgccagcggcttcggctactgcttccgggagctgcggggcggggagtgtgccagccccctgcccggcctgcggacccaggaggtgtgctgccgcggggccggcctggcctggggcgtgcatgactgccagctgtgcagcgagcggctgggcaacagcgagcgggtgtctgccccagatggcccctgccccactggatttgagcgggtgaatggcagctgtgaagatgtggatgaatgtgccaccggcggccgctgccagcacggggagtgtgccaacacccggggcggctacacctgtgtgtgcccagatggcttcctgctggacagcagccgcagcagctgcatcagccagcacgtgatcagcgaggccaagggcccctgcttccgggtgctgagagatggcggctgcagcctgcccatcctgaggaacatcaccaagcagatctgctgctgcagccgggtgggcaaggcctggggccggggctgccagctgtgccccccatttggaagtgagggcttccgggagatctgcccagctggccctggctaccactacagcgccagtgacctgcgctacaacacccggcccctgggccaggagcccccccgggtgtccctgagccagcccaggaccctgcctgccaccagccggcccagcgctggcttcctgcccacccaccggctggagcccaggcctgagcccaggccagaccccaggcctggccctgagctgcccctgcccagcatcccagcctggacaggccctgagatccctgagagcggccccagcagcggcatgtgccagaggaacccccaggtgtgtggccctggccgctgcatcagccggcccagcggctacacctgtgcctgtgacagcggcttccggctgagcccccagggcacccgctgcattgatgtggatgaatgtagaagagtgcccccaccctgtgcccctggccgctgtgagaacagccctggcagcttccgctgtgtgtgtggccctggcttccgggccggccccagggctgctgaatgtctggatgtggatgagtgccaccgggtgcccccaccctgtgacctgggccgctgtgagaacaccccaggcagcttcctgtgtgtgtgcccagctggctaccaggccgccccccacggggccagctgccaggatgtggatgaatgtacccagagccctggcctgtgtggccgcggggcctgcaagaacctgcccggcagcttccgctgtgtgtgcccagctggcttccggggcagcgcctgtgaggaggatgtggatgaatgtgcccaggagcccccaccctgtggccctggccgctgtgacaacacagctggcagcttccactgtgcctgcccagctggcttccgcagccggggccctggggccccctgccaggatgtggatgaatgtgcccggagccccccaccctgcacctacggccgctgtgagaacacagagggcagcttccagtgtgtgtgccccatgggcttccagcccaacacagctggctctgaatgtgaagatgtggatgaatgtgagaaccacctggcctgccccggccaggagtgtgtgaacagccctggcagcttccagtgcaggacctgccccagcggccaccacctgcaccggggccgctgcacagatgtggatgagtgcagcagcggggccccaccctgtggcccccacggccactgcaccaacacagagggcagcttccgctgcagctgtgcccctggctaccgggcccccagcggccggcccggcccctgtgctgatgtgaatgaatgtctggagggggacttctgcttcccccacggggagtgcctgaacacagatggcagctttgcctgcacctgtgcccctggctaccggcccggccccaggggggccagctgcctggatgtggatgagtgcagcgaggaggacctgtgccagagcggcatctgcaccaacacagatggcagctttgagtgcatctgccccccaggccacagagctggccctgacctggccagctgcctggatgtggatgaatgtcgggagcggggccctgccctgtgtggcagccagagatgtgagaacagccctggcagctaccgctgtgtgcgggactgtgaccccggctaccacgccggccctgagggcacctgtgatgatgtggatgagtgccaggagtatggccctgagatctgtggggcccagagatgtgagaacaccccaggcagctaccgctgcaccccagcctgtgaccccggctaccagcccacccctgggggcggctgccaggatgtggatgaatgtagaaacagaagcttctgtggggcccatgctgtgtgccagaacctgcccggcagcttccagtgcctgtgtgaccagtatgagggcgccagagatggccgccactgtgtggatgtgaatgaatgtgagaccctgcagggcgtgtgtggggccgccctgtgtgaaaatgtggagggcagcttcctgtgtgtgtgccccaacagccctgaggagtttgaccccatgacaggccgctgtgtgccccccaggaccagcgctggcaccttccctggcagccagccccaggccccagccagccctgtgctgcctgcccggcccccacctccacccctgccccggcggcccagcaccccccggcagggccctgtgggcagcggccggcgggagtgctactttgacacagctgccccagatgcctgtgacaacatcctggccagaaatgtgacctggcaggagtgctgctgcaccgtgggggagggctggggcagcggctgccgcatccagcagtgccccggcacagaaacagctgagtaccagagcctgtgcccccacggccggggctacctggcccccagcggggacctgagcctgcggagagatgtggatgagtgccagctgttccgggaccaggtgtgcaagtctggagtgtgtgtgaacacagcccctggctacagctgctactgcagcaatggctactactaccacacccagaggctggagtgcatcgacaatgatgaatgtgctgatgaggagcccgcctgtgagggcggccgctgtgtgaacacagtgggcagctaccactgcacctgtgagccccccctggtgctggatggcagccagaggcgctgtgtgtccaatgaaagccagagcctggatgacaacctgggcgtgtgctggcaggaggtgggcgctgacctggtgtgcagccacccccggctggaccggcaggccacctacacagagtgctgctgcctgtatggagaggcctggggcatggactgtgccctgtgcccagcccaggacagtgatgactttgaggccctgtgcaatgtgctgcggcccccagcctacagcccccccaggcctgggggcttcggcctgccctatgaatatggccctgacctgggccccccctaccagggcctgccctacggccctgagctgtacccacctccagccctgccctatgacccctacccacctcctcctggcccctttgcccggcgggaggccccctacggggcccccaggtttgacatgccagactttgaagatgatggcggcccctatggagagagcgaggccccagcccctcctggccctggcacccgctggccctaccgcagccgggacacccggcgctccttccctgagcctgaggagcccccagagggcggcagctatgccggcagcctggccgagccctatgaggagctggaggccgaggagtgtggcatcctggatggctgcaccaacggccgctgtgtgcgggtgcctgagggcttcacctgccgctgctttgatggctaccgcctggacatgaccaggatggcctgtgtggacatcaatgaatgtgatgaagctgaggccgccagccccctgtgtgtgaatgcccgctgcctgaacacagatggcagcttccgctgcatctgccggcccggctttgcccccacccaccagccccaccactgtgccccagcccggccccgggcctag

SEQ ID NO: 157373 - DNA, 561 bp, Artificial Sequence
  Description of Artificial Sequence: Synthetic coding sequence
atgctgggcggggccggcggcggccctggcctgcggaccccctgcccagcagatgtggatgaatgttctgaggaggacctgtgccagagcggcatctgcaccaacacagatggcagctttgagtgcatctgccccccaggccaccgggccggccctgacctggccagctgcctggatgtggatgagtgccgggagcggggccctgccctgtgtggcagccagagatgtgagaacagccctggcagctaccgctgtgtgcgggactgtgaccccggctaccacgccggccctgagggcacctgtgatgatgtggatgagtgcaggaacagaagcttctgtggggcccatgctgtgtgccagaacctgcccggcagcttccagtgcctgtgtgaccagtatgaaggagccagagatggccgccactgtgtggatgtgaatgaatgtgagaccctgcagggcgtgtgtggggccgccctgtgtgaaaatgtggagggcagcttcctgtgtgtgtgccccaacagccctgaggagtttgaccccatgacaggccgctgtgtgtag

SEQ ID NO: 157374 - DNA, 4872 bp, Artificial Sequence
  Description of Artificial Sequence: Synthetic coding sequence
atgccccggcccggcaccagcggcagaagacccctgctgctggtgctgctgctgcccctgtttgctgctgccaccagcgctgccagccccagccccagccccagccaggtggtggaggtgcctggggtgcccagcaggcctgcctctgtggccgtgtgccgctgctgccccggccagaccagccgccgcagccgctgcatccgggccttctgccgggtgcgcagctgccagcccaagaagtgtgccggcccccagcgctgcctgaaccctgtgcctgctgtgcccagccccagccccagcgtgaggaagaggcaggtgtccctgaactggcagcccctgaccctgcaggaggcccgggccctgctgaagagaagaagaccccggggccctgggggccggggcctgctgcggcggcggcccccccagagggccccagctgggaaggcccctgtgctgtgccccctcatctgccacaatggaggagtgtgtgtgaagccagaccgctgcctgtgccccccagactttgctgggaagttctgccagctgcacagcagcggggcccggcccccagccccagctgtgcccggcctgaccaggtctgtgtacaccatgcccctggccaaccacagagatgatgagcacggcgtggcctccatggtgtctgtgcacgtggagcacccccaggaggcctctgtggtggtgcaccaggtggagcgggtgtctggcccctgggaggaggctgatgctgaggccgtggcccgggcagaggccgccgcccgggcagaggccgccgccccctacacagtgctggcccagagcgcccccagagaagatggctacagtgatgccagcggcttcggctactgcttccgggagctgcggggaggagaatgtgccagccccctgcccggcctgcggacccaggaggtgtgctgcagaggagctggcctggcctggggcgtgcatgactgccagctgtgcagcgagcggctgggcaacagcgagcgggtgtctgccccagatggcccctgccccaccggctttgagcgggtgaatggcagctgtgaagatgtggatgaatgtgccactggaggccgctgccagcacggagaatgtgccaacacccggggcggctacacctgtgtgtgcccagatggcttcctgctggacagcagccgcagcagctgcatcagccagcacgtgatcagcgaggccaagggcccctgcttccgggtgctgagagatggcggctgcagcctgcccatcctgaggaacatcaccaagcagatctgctgctgcagccgggtgggcaaggcctggggccggggctgccagctgtgcccccccttcggcagcgagggcttccgggagatctgcccagctggccctggctaccactacagcgccagtgacctgcgctacaacacccggcccctgggccaggagcccccccgggtgtccctgagccagcccaggaccctgcctgccaccagccggcccagcgctggcttcctgcccacccaccggctggagcccaggcctgagcccaggccagacccccggcccggccctgagctgcccctgcccagcatcccagcctggacaggccctgagatccctgagagcggccccagcagcggcatgtgccagaggaacccccaggtgtgtggccctggccgctgcatcagccggcccagcggctacacctgtgcctgtgacagcggcttccggctgagcccccagggcacccgctgcattgatgtggatgagtgccggcgggtgcccccaccctgtgcccctggccgctgtgagaacagccctggcagcttccgctgtgtgtgtggccctggcttccgggccggccccagggctgctgagtgcctggatgtggatgagtgccaccgggtgcccccaccctgtgacctgggccgctgtgagaacaccccaggcagcttcctgtgtgtgtgcccagctggctaccaggccgcccctcatggagccagctgccaggatgtggatgagtgcacccagagccctggcctgtgtggccgcggggcctgcaagaacctgcccggcagcttccgctgtgtgtgcccagctggcttccggggcagcgcctgtgaagaagatgtggatgaatgtgcccaggagcccccaccctgtggccctggccgctgtgacaacacagctggcagcttccactgtgcctgcccagctggcttccgcagccggggccctggggccccctgccaggatgtggatgaatgtgcccggagccccccaccctgcacctacggccgctgtgaaaatacagagggcagcttccagtgtgtgtgccccatgggcttccagcccaacacagctggctctgaatgtgaagatgtggatgaatgtgagaaccacctggcctgccccggccaggagtgtgtgaacagccctggcagcttccagtgcaggacctgccccagcggccaccacctgcaccggggccgctgcacagatgtggatgaatgtagcagcggggccccaccctgtggcccccacggccactgcaccaacacagagggcagcttccgctgcagctgtgcccctggctaccgggcccccagcggccggcccggcccctgtgctgatgtgaatgaatgtctggagggggacttctgcttcccccatggagaatgtctgaacacagatggcagctttgcctgcacctgtgcccctggctacagacctggccccaggggggccagctgcctggatgtggatgaatgttctgaggaggacctgtgccagagcggcatctgcaccaacacagatggcagctttgagtgcatctgccccccaggccaccgggccggccctgacctggccagctgcctggatgtggatgagtgccgggagcggggccctgccctgtgtggcagccagagatgtgagaacagccctggcagctaccgctgtgtgcgggactgtgaccccggctaccacgccggccctgagggcacctgtgatgatgtggatgagtgccaggagtatggccctgagatctgtggggcccagagatgtgagaacaccccaggcagctaccgctgcaccccagcctgtgaccccggctaccagcccaccccaggcggcggctgccaggatgtggatgagtgcaggaacagaagcttctgtggggcccatgctgtgtgccagaacctgcccggcagcttccagtgcctgtgtgaccagtatgaaggagccagagatggccgccactgtgtggatgtgaatgaatgtgagaccctgcagggcgtgtgtggggccgccctgtgtgaaaatgtggagggcagcttcctgtgtgtgtgccccaacagccctgaggagtttgaccccatgacaggccgctgtgtgccccccaggaccagcgctggcaccttccctggcagccagccccaggccccagccagccctgtgctgcctgcccggcccccacctccacccctgccccggcggcccagcaccccccggcagggccctgtgggcagcggcagaagagagtgctactttgacacagctgccccagatgcctgtgacaacatcctggccagaaatgtgacctggcaggagtgctgctgcaccgtgggggagggctggggcagcggctgccgcatccagcagtgccctggaacagaaacagctgagtaccagagcctgtgcccccacggccggggctacctggcccccagcggggacctgagcctgcggagagatgtggatgagtgccagctgttccgggaccaggtgtgcaagagcggcgtgtgtgtgaacacagcccctggctacagctgctactgcagcaatggctactactaccacacccagaggctggagtgcatcgacaatgatgaatgtgctgatgaggagcccgcctgtgagggcggccgctgtgtgaacacagtgggcagctaccactgcacctgtgagccccccctggtgctggatggcagccagaggcgctgtgtgtccaatgaaagccagagcctggatgacaacctgggcgtgtgctggcaggaggtgggcgctgacctggtgtgcagccacccccggctggaccggcaggccacctacacagagtgctgctgcctgtatggagaggcctggggcatggactgtgccctgtgcccagcccaggacagtgatgactttgaggccctgtgcaatgtgctgcggcccccagcctacagcccccccaggcctgggggcttcggcctgccctatgaatatggccctgacctgggccccccctaccagggcctgccctacggccctgagctgtacccacctccagccctgccctatgacccctacccacctcctcctggcccctttgcccggcgggaggccccctatggagcccccaggtttgacatgccagactttgaagatgatggcggcccctacggggagagcgaggccccagcccctcctggccctggcacccgctggccctaccgcagccgggacaccaggaggagcttccctgagcctgaggagcccccagagggcggcagctatgccggcagcctggccgagccctatgaggagctggaggccgaggagtgtggcatcctggatggctgcaccaacggccgctgtgtgcgggtgcctgagggcttcacctgccgctgctttgatggctaccgcctggacatgaccaggatggcctgtgtggacatcaatgaatgtgatgaggccgaggccgccagccccctgtgtgtgaatgcccgctgcctgaacacagatggcagcttccgctgcatctgcaggcctggctttgcccccacccaccagccccaccactgtgccccagcccggccccgggcctag

SEQ ID NO: 157375 - DNA, 1155 bp, Artificial Sequence
  Description of Artificial Sequence: Synthetic coding sequence
atgacaggccgctgtgtgccccccaggaccagcgcagatgtggatgagtgccagctgttccgggaccaggtgtgcaagtctggagtgtgtgtgaacacagcccctggctacagctgctactgcagcaatggctactactaccacacccagaggctggagtgcatcgacaatgatgaatgtgctgatgaggagcccgcctgtgagggcggccgctgtgtgaacacagtgggcagctaccactgcacctgtgagccccccctggtgctggatggcagccagaggcgctgtgtgtccaatgaaagccagagcctggatgacaacctgggcgtgtgctggcaggaggtgggcgctgacctggtgtgcagccacccccggctggaccggcaggccacctacacagagtgctgctgcctgtatggagaggcctggggcatggactgtgccctgtgcccagcccaggacagtgatgactttgaggccctgtgcaatgtgctgcggcccccagcctacagcccccccaggcctgggggcttcggcctgccctatgaatatggccctgacctgggccccccctaccagggcctgccctacggccctgagctgtacccacctccagccctgccctatgacccctacccacctcctcctggcccctttgcccggcgggaggccccctacggggcccccaggtttgacatgccagactttgaagatgatggcggcccctatggagagagcgaggccccagcccctcctggccctggcacccgctggccctaccgcagccgggacacccggcgctccttccctgagcctgaggagcccccagagggcggcagctatgccggcagcctggccgagccctatgaggagctggaggccgaggagtgtggcatcctggatggctgcaccaacggccgctgtgtgcgggtgcctgagggcttcacctgccgctgctttgatggctaccgcctggacatgaccaggatggcctgtgtggacatcaatgaatgtgatgaagctgaggccgccagccccctgtgtgtgaatgcccgctgcctgaacacagatggcagcttccgctgcatctgccggcccggctttgcccccacccaccagccccaccactgtgccccagcccggccccgggcctag

SEQ ID NO: 157376 - DNA, 4671 bp, Artificial Sequence
  Description of Artificial Sequence: Synthetic coding sequence
atggccggcggcgtgcggctgctgtgggtgtccctgctggtgctgctggcccagctgggcccccagcccggcctgggccgcctgggggagcggctgcgggtgcgcttcacccctgtggtgtgtggcctgcgctgtgtgcacggccccaccggcagccgctgcacccccacctgtgcccccagaaatgccacctctgtggacagcggggcccctggaggagctgcccctgggggccctggcttccgggccttcctgtgccccctcatctgccacaacggcggcgtgtgtgtgaagccagaccgctgcctgtgccccccagactttgctgggaagttctgccagctgcacagcagcggggcccggcccccagccccagctgtgcccggcctgaccaggtctgtgtacaccatgcccctggccaaccacagagatgatgaacatggagtggcctccatggtgtctgtgcacgtggagcacccccaggaggcctctgtggtggtgcaccaggtggagcgggtgtctggcccctgggaggaggctgatgctgaggccgtggcccgggcagaggccgccgcccgggcagaggccgccgccccctacacagtgctggcccagagcgccccccgggaggatggctacagtgatgccagcggcttcggctactgcttccgggagctgcggggcggggagtgtgccagccccctgcccggcctgcggacccaggaggtgtgctgccgcggggccggcctggcctggggcgtgcatgactgccagctgtgcagcgagcggctgggcaacagcgagcgggtgtctgccccagatggcccctgccccactggatttgagcgggtgaatggcagctgtgaagatgtggatgaatgtgccaccggcggccgctgccagcacggggagtgtgccaacacccggggcggctacacctgtgtgtgcccagatggcttcctgctggacagcagccgcagcagctgcatcagccagcacgtgatcagcgaggccaagggcccctgcttccgggtgctgagagatggcggctgcagcctgcccatcctgaggaacatcaccaagcagatctgctgctgcagccgggtgggcaaggcctggggccggggctgccagctgtgccccccatttggaagtgagggcttccgggagatctgcccagctggccctggctaccactacagcgccagtgacctgcgctacaacacccggcccctgggccaggagcccccccgggtgtccctgagccagcccaggaccctgcctgccaccagccggcccagcgctggcttcctgcccacccaccggctggagcccaggcctgagcccaggccagaccccaggcctggccctgagctgcccctgcccagcatcccagcctggacaggccctgagatccctgagagcggccccagcagcggcatgtgccagaggaacccccaggtgtgtggccctggccgctgcatcagccggcccagcggctacacctgtgcctgtgacagcggcttccggctgagcccccagggcacccgctgcattgatgtggatgaatgtagaagagtgcccccaccctgtgcccctggccgctgtgagaacagccctggcagcttccgctgtgtgtgtggccctggcttccgggccggccccagggctgctgaatgtctggatgtggatgagtgccaccgggtgcccccaccctgtgacctgggccgctgtgagaacaccccaggcagcttcctgtgtgtgtgcccagctggctaccaggccgccccccacggggccagctgccaggatgtggatgaatgtacccagagccctggcctgtgtggccgcggggcctgcaagaacctgcccggcagcttccgctgtgtgtgcccagctggcttccggggcagcgcctgtgaggaggatgtggatgaatgtgcccaggagcccccaccctgtggccctggccgctgtgacaacacagctggcagcttccactgtgcctgcccagctggcttccgcagccggggccctggggccccctgccaggatgtggatgaatgtgcccggagccccccaccctgcacctacggccgctgtgagaacacagagggcagcttccagtgtgtgtgccccatgggcttccagcccaacacagctggctctgaatgtgaagatgtggatgaatgtgagaaccacctggcctgccccggccaggagtgtgtgaacagccctggcagcttccagtgcaggacctgccccagcggccaccacctgcaccggggccgctgcacagatgtggatgagtgcagcagcggggccccaccctgtggcccccacggccactgcaccaacacagagggcagcttccgctgcagctgtgcccctggctaccgggcccccagcggccggcccggcccctgtgctgatgtgaatgaatgtctggagggggacttctgcttcccccacggggagtgcctgaacacagatggcagctttgcctgcacctgtgcccctggctaccggcccggccccaggggggccagctgcctggatgtggatgagtgcagcgaggaggacctgtgccagagcggcatctgcaccaacacagatggcagctttgagtgcatctgccccccaggccacagagctggccctgacctggccagctgcctggatgtggatgaatgtcgggagcggggccctgccctgtgtggcagccagagatgtgagaacagccctggcagctaccgctgtgtgcgggactgtgaccccggctaccacgccggccctgagggcacctgtgatgatgtggatgagtgccaggagtatggccctgagatctgtggggcccagagatgtgagaacaccccaggcagctaccgctgcaccccagcctgtgaccccggctaccagcccacccctgggggcggctgccaggatgtggatgaatgtagaaacagaagcttctgtggggcccatgctgtgtgccagaacctgcccggcagcttccagtgcctgtgtgaccagtatgagggcgccagagatggccgccactgtgtggatgtgaatgaatgtgagaccctgcagggcgtgtgtggggccgccctgtgtgaaaatgtggagggcagcttcctgtgtgtgtgccccaacagccctgaggagtttgaccccatgacaggccgctgtgtgccccccaggaccagcgctggcaccttccctggcagccagccccaggccccagccagccctgtgctgcctgcccggcccccacctccacccctgccccggcggcccagcaccccccggcagggccctgtgggcagcggccggcgggagtgctactttgacacagctgccccagatgcctgtgacaacatcctggccagaaatgtgacctggcaggagtgctgctgcaccgtgggggagggctggggcagcggctgccgcatccagcagtgccccggcacagaaacagctgagtaccagagcctgtgcccccacggccggggctacctggcccccagcggggacctgagcctgcggagagatgtggatgagtgccagctgttccgggaccaggtgtgcaagtctggagtgtgtgtgaacacagcccctggctacagctgctactgcagcaatggctactactaccacacccagaggctggagtgcatcgacaatgatgaatgtgctgatgaggagcccgcctgtgagggcggccgctgtgtgaacacagtgggcagctaccactgcacctgtgagccccccctggtgctggatggcagccagaggcgctgtgtgtccaatgaaagccagagcctggatgacaacctgggcgtgtgctggcaggaggtgggcgctgacctggtgtgcagccacccccggctggaccggcaggccacctacacagagtgctgctgcctgtatggagaggcctggggcatggactgtgccctgtgcccagcccaggacagtgatgactttgaggccctgtgcaatgtgctgcggcccccagcctacagcccccccaggcctgggggcttcggcctgccctatgaatatggccctgacctgggccccccctaccagggcctgccctacggccctgagctgtacccacctccagccctgccctatgacccctacccacctcctcctggcccctttgcccggcgggaggccccctacggggcccccaggtttgacatgccagactttgaagatgatggcggcccctatggagagagcgaggccccagcccctcctggccctggcacccgctggccctaccgcagccgggacacccggcgctccttccctgagcctgaggagcccccagagggcggcagctatgccggcagcctggccgagccctatgaggagctggaggccgaggagtgtggcatcctggatggctgcaccaacggccgctgtgtgcgggtgcctgagggcttcacctgccgctgctttgatggctaccgcctggacatgaccaggatggcctgtgtggacatcaatgaatgtgatgaagctgaggccgccagccccctgtgtgtgaatgcccgctgcctgaacacagatggcagcttccgctgcatctgccggcccggctttgcccccacccaccagccccaccactgtgccccagcccggccccgggcctag

SEQ ID NO: 157377 - DNA, 2700 bp, Artificial Sequence
  Description of Artificial Sequence: Synthetic coding sequence
atgtgccagaggaacccccaggtgtgtggccctggccgctgcatcagccggcccagcggctacacctgtgcctgtgacagcggcttccggctgagcccccagggcacccgctgcattgatgtggatgaatgtagaagagtgcccccaccctgtgcccctggccgctgtgagaacagccctggcagcttccgctgtgtgtgtggccctggcttccgggccggccccagggctgctgaatgtctggatgtggatgagtgccaccgggtgcccccaccctgtgacctgggccgctgtgagaacaccccaggcagcttcctgtgtgtgtgcccagctggctaccaggccgccccccacggggccagctgccaggatgtggatgaatgtacccagagccctggcctgtgtggccgcggggcctgcaagaacctgcccggcagcttccgctgtgtgtgcccagctggcttccggggcagcgcctgtgaggaggatgtggatgaatgtgcccaggagcccccaccctgtggccctggccgctgtgacaacacagctggcagcttccactgtgcctgcccagctggcttccgcagccggggccctggggccccctgccaggatgtggatgaatgtgcccggagccccccaccctgcacctacggccgctgtgagaacacagagggcagcttccagtgtgtgtgccccatgggcttccagcccaacacagctggctctgaatgtgaagatgtggatgaatgtgagaaccacctggcctgccccggccaggagtgtgtgaacagccctggcagcttccagtgcaggacctgccccagcggccaccacctgcaccggggccgctgcacagatgtggatgagtgcagcagcggggccccaccctgtggcccccacggccactgcaccaacacagagggcagcttccgctgcagctgtgcccctggctaccgggcccccagcggccggcccggcccctgtgctgatgtgaatgaatgtctggagggggacttctgcttcccccacggggagtgcctgaacacagatggcagctttgcctgcacctgtgcccctggctaccggcccggccccaggggggccagctgcctggatgtggatgagtgcagcgaggaggacctgtgccagagcggcatctgcaccaacacagatggcagctttgagtgcatctgccccccaggccacagagctggccctgacctggccagctgcctggatgtggatgaatgtcgggagcggggccctgccctgtgtggcagccagagatgtgagaacagccctggcagctaccgctgtgtgcgggactgtgaccccggctaccacgccggccctgagggcacctgtgatgatgtgaatgaatgtgagaccctgcagggcgtgtgtggggccgccctgtgtgaaaatgtggagggcagcttcctgtgtgtgtgccccaacagccctgaggagtttgaccccatgacaggccgctgtgtgccccccaggaccagcgctggcaccttccctggcagccagccccaggccccagccagccctgtgctgcctgcccggcccccacctccacccctgccccggcggcccagcaccccccggcagggccctgtgggcagcggcagaagagagtgctactttgacacagctgccccagatgcctgtgacaacatcctggccagaaatgtgacctggcaggagtgctgctgcaccgtgggggagggctggggcagcggctgccgcatccagcagtgccctggaacagaaacagctgagtaccagagcctgtgcccccacggccggggctacctggcccccagcggggacctgagcctgcggagagatgtggatgagtgccagctgttccgggaccaggtgtgcaagagcggcgtgtgtgtgaacacagcccctggctacagctgctactgcagcaatggctactactaccacacccagaggctggagtgcatcgacaatgatgaatgtgctgatgaggagcccgcctgtgagggcggccgctgtgtgaacacagtgggcagctaccactgcacctgtgagccccccctggtgctggatggcagccagaggcgctgtgtgtccaatgaaagccagagcctggatgacaacctgggcgtgtgctggcaggaggtgggcgctgacctggtgtgcagccacccccggctggaccggcaggccacctacacagagtgctgctgcctgtatggagaggcctggggcatggactgtgccctgtgcccagcccaggacagtgatgactttgaggccctgtgcaatgtgctgcggcccccagcctacagcccccccaggcctgggggcttcggcctgccctatgaatatggccctgacctgggccccccctaccagggcctgccctacggccctgagctgtacccacctccagccctgccctatgacccctacccacctcctcctggcccctttgcccggcgggaggccccctatggagcccccaggtttgacatgccagactttgaagatgatggcggcccctacggggagagcgaggccccagcccctcctggccctggcacccgctggccctaccgcagccgggacaccaggaggagcttccctgagcctgaggagcccccagagggcggcagctatgccggcagcctggccgagccctatgaggagctgtag

SEQ ID NO: 157378 - DNA, 639 bp, Artificial Sequence
  Description of Artificial Sequence: Synthetic coding sequence
atgtggaccagcgccacagcctgcagaagaagagtgaccagcggggccgcccggacccggcaggccgccagctgtgcctgtgcccctcctggcacccggctgcacaggacagagcctgctgccaggatgtggatgtctgtgcctgaggccccccacccagcccccacagctggggtgaggacccagaaggccgccagctctgtgtctgccccctgggccagcaaccccaccctgctggcccccaacgtggatgaatgtgagaaccacctggcctgccccggccaggagtgtgtgaacagccctggcagcttccagtgcaggacctgccccagcggccaccacctgcaccggggccgctgcacagatgtggatgaatgtagcagcggggccccaccctgtggcccccacggccactgcaccaacacagagggcagcttccgctgcagctgtgcccctggctaccgggcccccagcggccggcccggcccctgtgctgatgtgaatgaatgtctggagggggacttctgcttcccccatggagaatgtctgaacacagatggcagctttgcctgcacctgtgcccctggctacagacctggccccaggggggccagctgcctgggcagctacccaggatag

SEQ ID NO: 157379 - DNA, 669 bp, Artificial Sequence
  Description of Artificial Sequence: Synthetic coding sequence
atggagatcccccccaccaactacccagccagcagagctgccctggtggcccagaactacatcaactaccagcagggcaccccccaccgggtgtttgaggtgcagaaggtgaagcaggcctccatggaggacatccctggccggggccacaagtaccacctgaagtttgctgtggaggagatcatccagaagcaggtgaaggtgaactgcacagctgaggtgctgtaccccagcacaggccaggagacagcccctgaggtgaacttcacctttgaaggagaaacaggcaagaacccagatgaggaggacaacaccttctaccagaggctgaagtccatgaaggagcccctggaggcccagaacatcccagacaactttggaaatgtgtccccagagatgaccctggtgctgcacctggcctgggtggcctgtggctacatcatctggcagaacagcacagaggacacctggtacaagatggtgaagatccagacagtgaagcaggtgcagagaaatgatgacttcatcgagctggactacaccatcctgctgcacaacatcgccagccaggagatcatcccctggcagatgcaggtgctgtggcacccccagtatggcaccaaggtgaagcacaacagccggctgcccaaggaggtgcagctggagtag

SEQ ID NO: 157380 - DNA, 888 bp, Artificial Sequence
  Description of Artificial Sequence: Synthetic coding sequence
atgggcctgcctgtgtcctgggcccccccagccctgtgggtgctgggctgctgtgccctgctgctgagcctgtgggccctgtgcacagcctgccggcggccagaagatgctgtggcccccaggaagagggcccggcggcagagggcccggctgcagggcagcgccacagctgctgaggccagcctgctgcggaggacccacctgtgcagcctgagcaagagtgacacccggctgcacgagctgcaccggggccccaggagcagccgggccctgcggcctgcctccatggacctgctgcggccccactggctggaggtgtcccgggacatcaccggcccccaggccgcccccagcgccttcccccaccaggagctgccccgggccctgcctgctgctgctgccacagctggctgtgccggcctggaggccacctacagcaatgtgggcctggccgccctgcccggggtgtccctggccgccagccctgtggtggccgagtatgcccgggtgcagaagaggaagggcacccacaggagcccccaggagccccagcagggcaagacagaggtgaccccagctgcccaggtggatgtgctgtacagccgggtgtgcaagcccaagaggcgggaccccggccccaccacagaccccctggaccccaagggccagggcgccatcctggccctggccggggacctggcctaccagaccctgcccctgcgggccctggatgtggacagcggccccctggagaatgtgtatgagagcatccgggagctgggggaccctgctggccgcagcagcacctgtggggccggcaccccaccagccagcagctgccccagcctgggccggggctggaggcccctgcctgccagcctgccctag

SEQ ID NO: 157381 - DNA, 324 bp, Artificial Sequence
  Description of Artificial Sequence: Synthetic coding sequence
atgggcctgcctgtgtcctgggcccccccagccctgtgggtgctgggctgctgtgccctgctgctgagcctgtgggccctgtgcacagcctgccggcggccagaagatgctgtggcccccaggaagagggcccggcggcagagggcccggctgcagggcagcgccacagctgctgaggccagcctgctgcggaggacccacctgtgcagcctgagcaagagtgacacccggctgcacgagctgcaccggggccccaggagcagccgggccctgcggcctgcctccatggacctgctgcggccccactggctggaggtgtcctag

SEQ ID NO: 157382 - DNA, 2094 bp, Artificial Sequence
  Description of Artificial Sequence: Synthetic coding sequence
atgggagagagagctggcagccctggaacagaccaggagaggaaggccggcaagcaccactacagctacctgagtgactttgagaccccccagagcagcggccgcagcagcctggtgagcagcagccctgcctctgtgcggaggaagaaccccaagaggcagaccagtgatggccaggtgcaccaccaggcccccaggaagcccagccccaagggcctgcccaacagaaaaggagtgcgggtgggcttccgcagccagagcctgaaccgggagcccctgaggaaggacacagacctggtgaccaagaggatcctgagcgcccggctgctgaagatcaatgagctgcagaatgaggtgtctgagctgcaggtgaagctggccgagctgctgaaggagaacaagagcctgaagaggctgcagtaccggcaggagaaggccctgaacaagtttgaagatgctgaaaatgagatcagccagctgatcttccgccacaacaatgagatcacagccctgaaggagcggctgaggaagagccaggagaaggagcgggccacagagaagagggtgaaggacacagagagcgagctgttccgcaccaagttcagcctgcagaagctgaaggagatcagcgaggcccggcacctgcctgagagagatgacctggccaagaagctggtgtctgctgagctgaagctggatgacacagaaagacgcatcaaggagctgagcaagaacctggagctgagcaccaacagcttccagaggcagctgctggccgagaggaagagggcctatgaggcccatgatgagaacaaggtgctgcagaaggaggtgcagaggctgtaccacaagctgaaggagaaggagcgggagctggacatcaagaacatctacagcaaccggctgcccaagagcagccccaacaaggagaaggagctggccctgaggaagaatgctgcctgccagagcgactttgctgacctgtgcaccaagggcgtgcagaccatggaggacttcaagccagaggagtaccccctgaccccagagaccatcatgtgctatgagaacaagtgggaggagcccggccacctgaccctggacctgcagagccagaagcaggacagacatggagaggccggcatcctgaaccccatcatggagcgggaggagaagtttgtgacagatgaggagctgcacgtggtgaagcaggaggtggagaagctggaggatgagtgggagcgggaggagctggacaagaagcagaaggagaaggccagcctgctggagcgggaggagaagccagagtgggagaccggccgctaccagctgggcatgtaccccatccagaacatggacaagctgcagggcgaggaggaggagcggctgaagcgggagatgctgctggccaagctgaatgaaattgaccgggagctgcaggacagcaggaacctgaagtaccctgtgctgcccctgctgcctgactttgagagcaagctgcacagccctgagaggagccccaagacctaccgcttcagcgagagcagcgagcggctcttcaacggccaccacctgcaggacatctccttcagcacccccaagggggagggccagaacagcggaaatgtgcgcagccctgccagccccaatgaatttgccttcggcagctatgtgcccagctttgccaagaccagcgagaggagcaaccccttcagccagaagagcagcttcctggacttccagagaaattccatggagaagctgagcaaggatggagtggacctgatcaccaggaaggagaagaaggccaacctgatggagcagctgtttggagccagcggcagcagcaccatcagcagcaagagcagtgaccccaacagcgtggccagcagcaaaggagacatcgaccccctgaacttcctgcccggcaacaagggcagccgggaccaggagcatgatgaagatgagggcttcttcctgtctgagggccgctccttcaaccccaacagacaccggctgaagcatgctgatgacaagccagctgtgaaggctgctgacagcgtggaggatgaaattgaggaggtggccctgaggtag

SEQ ID NO: 157383 - DNA, 2094 bp, Artificial Sequence; identical to SEQ ID NO: 157382
  Description of Artificial Sequence: Synthetic coding sequence

SEQ ID NO: 157384 - DNA, 693 bp, Artificial Sequence
  Description of Artificial Sequence: Synthetic coding sequence
atgaagaaccccatgctggaggtggtgtccctgctgctggagaagctgctgctgatcagcaacttcaccctcttcagcagtggagctgctggggaggacaagggcaggaacagcttctatgagaccagcagcttccacagaggagatgtgctggaggtgcccaggacccacctgacccactacggcatctacctgggggacaacagagtggcccacatgatgccagacatcctgctggccctgacagatgacatgggccgcacccagaaggtggtgagcaacaagaggctcatcctgggcgtcatcgtgaaggtggccagcatccgggtggacacagtggaggactttgcctacggggccaacatcctggtgaaccacctggatgagagcctgcagaagaaggccctgctgaatgaggaggtggccaggagagctgagaagctgctgggcttcaccccctacagcctgctgtggaacaactgtgagcactttgtgacctactgccgctatggcacccccatcagcccccagagcgacaagttctgtgagaccgtgaagatcatcatccgggaccagaggtctgtgctggccagcgctgtgctgggcctggccagcatcgtgtgcaccggcctggtgtcctacaccaccctgcctgccatcttcatccccttcttcctgtggatggccggctag

SEQ ID NO: 157385 - DNA, 210 bp, Artificial Sequence
  Description of Artificial Sequence: Synthetic coding sequence
atgaagaaccccatgctggaggtggtgtccctgctgctggagaagctgctgctgatcagcaacttcaccctcttcagcagtggagctgctggggaggacaagggcaggaacagcttctatgagaccagcagcttccacagaggagatgtgctggaggtgcccaggacccacctgacccactacggcatctacctgggggacaacagatag

SEQ ID NO: 157386 - DNA, 693 bp, Artificial Sequence; identical to SEQ ID NO: 157384
  Description of Artificial Sequence: Synthetic coding sequence

SEQ ID NO: 157387 - DNA, 1110 bp, Artificial Sequence
  Description of Artificial Sequence: Synthetic coding sequence
atggtgtgggcccccctgggcccccccaggacagactgcctgaccctgctgcacacccccagcaaggacagccccaagatgagcctggagtggctggtggcctggagctggagcctggatggcctgcgggactgcatcgccaccggcatccagagcgtgcgggactgtgacaccacagctgtgatcaccgtggcctgcctgctggtgctgtttgtgtggtactgctaccacgtgggccgggagcagccccggccctacgtgtctgtgaacagcctgatgcaggccgcagatgccaacggcctgcagaatggctacgtgtactgccagagcccagaatgtgtgcgctgcacccacaatgaaggcctgaaccagaagctgtaccacaacctgcaggagtatgccaagcgctacagctggagcggcatgggccgcatccacaagggcatccgggagcagggccgctacctgaacagccggcccagcatccagaagccagaggtgttcttcctgcctgacctgcccaccaccccctacttcagcagagatgcccagaagcatgatgtggaggtgctggagaggaacttccagaccatcctgtgtgaatttgagaccctgtacaaggccttcagcaactgcagcctgccccagggctggaagatgaacagcaccccatctggagagtggttcaccttctacctggtgaaccagggcgtgtgtgtgcccaggaactgcaggaagtgccccaggacctaccgcctgctgggcagcctgcggacctgcatcggcaacaacgtgtttggaaatgcctgcatctctgtgctgagccctggcaccgtcatcacagagcactacggccccaccaacatccgcatccgctgccacctgggcctgaagaccccaaatggctgtgagctggtggtgggcggggagccccagtgctgggccgagggccgctgcctgctgtttgatgacagcttcctgcatgctgccttccacgagggcagcgcagaagatggcccccgggtggtgttcatggtggacctgtggcaccccaacgtggccgctgctgagcggcaggccctggacttcatctttgcccctggaagatag

SEQ ID NO: 157388 - DNA, 984 bp, Artificial Sequence
  Description of Artificial Sequence: Synthetic coding sequence
atgagccagcccagcggcggccgggcccctggcacccgcatctacagctggagctgccccaccgtgatgagccctggagagaagctggaccccatcccagacagcttcatcctgcagccccctgtgttccaccctgtggtgccctacgtgaccaccatctttggaggcctgcatgctgggaagatggtgatgctgcagggcgtggtgcccctggatgcccaccgcttccaggtggacttccagtgtggctgcagcctgtgccccaggccagacatcgccttccacttcaacccccgcttccacaccaccaagccccacgtgatctgcaacaccctgcatggaggccgctggcagcgggaggcccgctggccccacctggccctgcggcggggcagcagcttcctgatcctcttcctgtttggaaatgaggaggtgaaggtgtctgtgaatggccagcacttcctgcacttccgctaccgcctgcccctgagccacgtggacaccctgggcatctttggagacatcctggtggaggccgtgggcttcctgaacatcaacccctttgtggagggcagccgggagtacccagctggccacgaggtgccctgcagccacgccctgccccagggcctgagccctggccaggtgatcatcgtgcggggcctggtgctgcaggagcccaagcacttcaccgtgtccctgcgggaccaggccgcccacgcccctgtgaccctgcgggccagctttgctgacaggaccctggcctggatcagccgctggggccagaagaagctgatcagcgcccccttcctgttctacccccagcgcttctttgaggtgctgctgctcttccaggagggcggcctgaagctggccctgaatggccagggcctgggcgccacctccatgaaccagcaggccctggagcagctgcgggagctgcgcatcagcggctctgtgcagctgtactgtgtgcacagctag

SEQ ID NO: 157389 - DNA, 1014 bp, Artificial Sequence
  Description of Artificial Sequence: Synthetic coding sequence
atgagccagcccagcggcggccgggcccctggcacccgcatctacagctggagctgccccaccgtgatgagccctggagagaagctggaccccatcccagacagcttcatcctgcagccccctgtgttccaccctgtggtgccctacgtgaccaccatctttggaggcctgcatgctgggaagatggtgatgctgcagggcgtggtgcccctggatgcccacagccgcttccaggtggacttccagtgtggctgcagcctgtgccccaggccagacatcgccttccacttcaacccccgcttccacaccaccaagccccacgtgatctgcaacaccctgcacggcggccgctggcagcgggaggcccgctggccccacctggccctgcggcggggcagcagcttcctgatcctcttcctgtttggaaatgaggaggtgaaggtgtctgtgaatggccagcacttcctgcacttccgctaccgcctgcccctgagccacgtggacaccctgggcatctttggagacatcctggtggaggccgtgggcttcctgaacatcaacccctttgtggagggcagccgggagtacccagctggccaccccttcctgctgatgagcccccggctggaggtgccctgcagccacgccctgccccagggcctgagccctggccaggtgatcatcgtgcggggcctggtgctgcaggagcccaagcacttcaccgtgtccctgcgggaccaggccgcccacgcccctgtgaccctgcgggccagctttgctgacaggaccctggcctggatcagccgctggggccagaagaagctgatcagcgcccccttcctgttctacccccagcgcttctttgaggtgctgctgctcttccaggagggcggcctgaagctggccctgaatggccagggcctgggcgccacctccatgaaccagcaggccctggagcagctgcgggagctgcgcatcagcggctctgtgcagctgtactgtgtgcacagctag

SEQ ID NO: 157390 - DNA, 1011 bp, Artificial Sequence
  Description of Artificial Sequence: Synthetic coding sequence
atgagccagcccagcggcggccgggcccctggcacccgcatctacagctggagctgccccaccgtgatgagccctggagagaagctggaccccatcccagacagcttcatcctgcagccccctgtgttccaccctgtggtgccctacgtgaccaccatctttggaggcctgcatgctgggaagatggtgatgctgcagggcgtggtgcccctggatgcccaccgcttccaggtggacttccagtgtggctgcagcctgtgccccaggccagacatcgccttccacttcaacccccgcttccacaccaccaagccccacgtgatctgcaacaccctgcatggaggccgctggcagcgggaggcccgctggccccacctggccctgcggcggggcagcagcttcctgatcctcttcctgtttggaaatgaggaggtgaaggtgtctgtgaatggccagcacttcctgcacttccgctaccgcctgcccctgagccacgtggacaccctgggcatctttggagacatcctggtggaggccgtgggcttcctgaacatcaacccctttgtggagggcagccgggagtacccagctggccaccccttcctgctgatgagcccccggctggaggtgccctgcagccacgccctgccccagggcctgagccctggccaggtgatcatcgtgcggggcctggtgctgcaggagcccaagcacttcaccgtgtccctgcgggaccaggccgcccacgcccctgtgaccctgcgggccagctttgctgacaggaccctggcctggatcagccgctggggccagaagaagctgatcagcgcccccttcctgttctacccccagcgcttctttgaggtgctgctgctcttccaggagggcggcctgaagctggccctgaatggccagggcctgggcgccacctccatgaaccagcaggccctggagcagctgcgggagctgcgcatcagcggctctgtgcagctgtactgtgtgcacagctag

SEQ ID NO: 157391 - DNA, 828 bp, Artificial Sequence
  Description of Artificial Sequence: Synthetic coding sequence
atggtgatgctgcagggcgtggtgcccctggatgcccaccgcttccaggtggacttccagtgtggctgcagcctgtgccccaggccagacatcgccttccacttcaacccccgcttccacaccaccaagccccacgtgatctgcaacaccctgcacggcggccgctggcagcgggaggcccgctggccccacctggccctgcggcggggcagcagcttcctgatcctcttcctgtttggaaatgaggaggtgaaggtgtctgtgaatggccagcacttcctgcacttccgctaccgcctgcccctgagccacgtggacaccctgggcatctttggagacatcctggtggaggccgtgggcttcctgaacatcaacccctttgtggagggcagccgggagtacccagctggccaccccttcctgctgatgagcccccggctggaggtgccctgcagccacgccctgccccagggcctgagccctggccaggtgatcatcgtgcggggcctggtgctgcaggagcccaagcacttcaccgtgtccctgcgggaccaggccgcccacgcccctgtgaccctgcgggccagctttgctgacaggaccctggcctggatcagccgctggggccagaagaagctgatcagcgcccccttcctgttctacccccagcgcttctttgaggtgctgctgctcttccaggagggcggcctgaagctggccctgaatggccagggcctgggcgccacctccatgaaccagcaggccctggagcagctgcgggagctgcgcatcagcggctctgtgcagctgtactgtgtgcacagctag

SEQ ID NO: 157392 - DNA, 801 bp, Artificial Sequence
  Description of Artificial Sequence: Synthetic coding sequence
atggtgatgctgcagggcgtggtgcccctggatgcccaccgcttccaggtggacttccagtgtggctgcagcctgtgccccaggccagacatcgccttccacttcaacccccgcttccacaccaccaagccccacgtgatctgcaacaccctgcacggcggccgctggcagcgggaggcccgctggccccacctggccctgcggcggggcagcagcttcctgatcctcttcctgtttggaaatgaggaggtgaaggtgtctgtgaatggccagcacttcctgcacttccgctaccgcctgcccctgagccacgtggacaccctgggcatctttggagacatcctggtggaggccgtgggcttcctgaacatcaacccctttgtggagggcagccgggagtacccagctggccacgaggtgccctgcagccacgccctgccccagggcctgagccctggccaggtgatcatcgtgcggggcctggtgctgcaggagcccaagcacttcaccgtgtccctgcgggaccaggccgcccacgcccctgtgaccctgcgggccagctttgctgacaggaccctggcctggatcagccgctggggccagaagaagctgatcagcgcccccttcctgttctacccccagcgcttctttgaggtgctgctgctcttccaggagggcggcctgaagctggccctgaatggccagggcctgggcgccacctccatgaaccagcaggccctggagcagctgcgggagctgcgcatcagcggctctgtgcagctgtactgtgtgcacagctag

SEQ ID NO: 157393 - DNA, 378 bp, Artificial Sequence
  Description of Artificial Sequence: Synthetic coding sequence
atggctgatgaggagctggaggccctgcggcggcagaggctggccgagctgcaggccaagcatggagaccctggagatgctgcccagcaggaggccaagcaccgggaggccgagatgaggaacagcatcctggcccaggtgctggaccagagcgcccgggcccggctgagcaacctggccctggtgaagccagagaagaccaaggctgtggagaactacctgatccagatggcccgctatggccagctgtctgagaaggtgtctgagcagggcctgattgagatcctgaagaaggtgtcccagcagacagagaagaccaccaccgtgaagttcaacagaaggaaggtgatggacagtgatgaagatgatgactactag

SEQ ID NO: 157394 - DNA, 1530 bp, Artificial Sequence
  Description of Artificial Sequence: Synthetic coding sequence
atgggcgtgcaggccggcctgtttggcatgctgggcttcctgggcgtggccctgggcggcagccctgccctgcgctggtaccgcaccagctgccacctgaccaaggctgtgcccggcaaccccctgggctacctgtccttcctggccaaggatgcccagggcctggccctgattcatgcccgctgggatgcccaccggcggctgcagagctgctcctgggaggatgagcctgagctgacagctgcctatggagccctgtgtgcccatgaaacagcctggggcagcttcatccacaccccaggccctgagctgcagagggccctggccaccctgcagagccagtgggaggcctgccgggccctggaggagagccctgctggggccaggaagaagagagctgctggccagagcggcgtgcctgggggcggccaccagcgggagaagaggggctggaccatgcctggcaccctgtggtgtggggtgggggacagcgctggcaacagcagcgagctgggcgtcttccagggccctgacctgtgctgccgggagcatgaccgctgcccccagaacatcagccccctgcagtacaactacggcatccggaactaccgcttccacaccatcagccactgtgactgtgacacccgcttccagcagtgcctgcagaaccagcacgacagcatcagtgacatcgtgggcgtggccttcttcaacgtgctggagatcccctgctttgtgctggaggagcaggaggcctgtgtggcctggtactggtggggcggctgcaggatgtatggaacagtgcccctggcccggctgcagcccaggaccttctacaatgcctcctggagcagccgggccaccagccccacccccagcagccgcagccctgccccacccaagccccggcagaagcagcacctgaggaagggccccccccaccagaagggcagcaagaggcccagcaaggccaacaccacagccctgcaggaccccatggtgagcccccggctggatgtggcccccaccggcctgcagggcccccagggcggcctgaagccccagggcgcccgctgggtgtgccgctccttcagaagacacctggaccagtgtgagcaccagatcggcccccgggagattgagttccagctgctgaacagcgcccaggagcccctcttccactgcaactgcacccggcggctggcccgcttcctgcggctgcacagccccccagaggtgaccaacatgctgtgggagctgctgggcaccacctgcttcaagctggccccacccctggactgtgtggagggcaagaactgcagccgggacccccgggccatccgggtgtctgcccggcacctgcggcggctgcagcagaggaggcaccagctgcaggacaagggcacagatgagcggcagccctggcccagcgagcccctgcggggccccatgtccttctacaaccagtgcctgcagctgacccaggccgcccggcggccagaccggcagcagaagtcctggagccagtag

SEQ ID NO: 157395 - DNA, 93 bp, Artificial Sequence
  Description of Artificial Sequence: Synthetic coding sequence
atgaccggggagctggaggtgaagaacatggacatgaagccaggcagcaccctgaagatcaccggcagcattgctgatggaacagatggatag

SEQ ID NO: 157396 - DNA, 1758 bp, Artificial Sequence
  Description of Artificial Sequence: Synthetic coding sequence
atgaccccacccaggctcttctgggtgtggctgctggtggccggcacccagggcgtgaatgatggagacatgaggctggctgatggaggagccaccaaccagggccgggtggagatcttctaccggggccagtggggcaccgtgtgtgacaacctgtgggacctgacagatgcctctgtggtgtgccgggccctgggctttgaaaatgccacccaggccctgggccgggccgccttcggccagggcagcggccccatcatgctggatgaggtgcagtgcaccggcacagaggccagcctggccgactgcaagagcctgggctggctgaagagcaactgcagacatgaaagagatgctggggtggtgtgcaccaatgagaccaggagcacccacaccctggacctgagccgggagctgtctgaggccctgggccagatctttgacagccagaggggctgtgacctgagcatctctgtgaatgtgcagggagaagatgccctgggcttctgtggccacacagtcatcctgacagccaacctggaggcccaggccctgtggaaggagcccggcagcaatgtgaccatgtctgtggatgctgaatgtgtgcccatggtgcgggacctgctgcgctacttctacagcagaagaattgacatcaccctgagctctgtgaagtgcttccacaagctggccagcgcctacggggcccggcagctgcagggctactgtgccagcctgtttgccatcctgctgccccaggaccccagcttccagatgcccctggacctgtatgcctatgctgtggccactggagatgccctgctggagaagctgtgcctgcagttcctggcctggaactttgaggccctgacccaggccgaggcctggcccagcgtgcccacagacctgctgcagctgctgctgcccaggagtgacctggccgtgcccagcgagctggccctgctgaaggctgtggacacctggagctggggcgagcgggccagccatgaggaggtggagggcctggtggagaagatccgcttccccatgatgctgcctgaggagctgtttgagctgcagttcaacctgagcctgtactggagccatgaggccctcttccagaagaagaccctgcaggccctggagttccacacagtgcccttccagctgctggcccgctacaagggcctgaacctgacagaggacacctacaagccccgcatctacaccagccccacctggagcgcctttgtgacagacagctcctggagcgccaggaagagccagctggtgtaccagagcagaagaggccccctggtgaagtacagcagtgactacttccaggcccccagcgactaccgctactacccctaccagagcttccagaccccccagcaccccagcttcctgttccaggacaagagggtgtcctggagcctggtgtacctgcccaccatccagagctgctggaactacggcttcagctgcagcagtgatgagctgcctgtgctgggcctgaccaagagcggcggcagtgacaggaccatcgcctatgagaacaaggccctgatgctgtgtgagggcctgtttgtggctgatgtgacagactttgagggctggaaggccgccatccccagcgccctggacaccaacagcagcaagagcaccagcagcttcccctgcccagctggccacttcaacggcttcagaactgtcatccggcccttctacctgaccaacagcagcggcgtggactag

SEQ ID NO: 157397 - DNA, 1722 bp, Artificial Sequence
  Description of Artificial Sequence: Synthetic coding sequence
atgaccccacccaggctcttctgggtgtggctgctggtggccggcacccagggcgtgaatgatggagacatgaggctggctgatggaggagccaccaaccagggccgggtggagatcttctaccggggccagtggggcaccgtgtgtgacaacctgtgggacctgacagatgcctctgtggtgtgccgggccctgggctttgaaaatgccacccaggccctgggccgggccgccttcggccagggcagcggccccatcatgctggccgactgcaagagcctgggctggctgaagagcaactgcagacatgaaagagatgctggggtggtgtgcaccaatgagaccaggagcacccacaccctggacctgagccgggagctgtctgaggccctgggccagatctttgacagccagaggggctgtgacctgagcatctctgtgaatgtgcagggagaagatgccctgggcttctgtggccacacagtcatcctgacagccaacctggaggcccaggccctgtggaaggagcccggcagcaatgtgaccatgtctgtggatgctgaatgtgtgcccatggtgcgggacctgctgcgctacttctacagcagaagaattgacatcaccctgagctctgtgaagtgcttccacaagctggccagcgcctacggggcccggcagctgcagggctactgtgccagcctgtttgccatcctgctgccccaggaccccagcttccagatgcccctggacctgtatgcctatgctgtggccactggagatgccctgctggagaagctgtgcctgcagttcctggcctggaactttgaggccctgacccaggccgaggcctggcccagcgtgcccacagacctgctgcagctgctgctgcccaggagtgacctggccgtgcccagcgagctggccctgctgaaggctgtggacacctggagctggggcgagcgggccagccatgaggaggtggagggcctggtggagaagatccgcttccccatgatgctgcctgaggagctgtttgagctgcagttcaacctgagcctgtactggagccatgaggccctcttccagaagaagaccctgcaggccctggagttccacacagtgcccttccagctgctggcccgctacaagggcctgaacctgacagaggacacctacaagccccgcatctacaccagccccacctggagcgcctttgtgacagacagctcctggagcgccaggaagagccagctggtgtaccagagcagaagaggccccctggtgaagtacagcagtgactacttccaggcccccagcgactaccgctactacccctaccagagcttccagaccccccagcaccccagcttcctgttccaggacaagagggtgtcctggagcctggtgtacctgcccaccatccagagctgctggaactacggcttcagctgcagcagtgatgagctgcctgtgctgggcctgaccaagagcggcggcagtgacaggaccatcgcctatgagaacaaggccctgatgctgtgtgagggcctgtttgtggctgatgtgacagactttgagggctggaaggccgccatccccagcgccctggacaccaacagcagcaagagcaccagcagcttcccctgcccagctggccacttcaacggcttcagaactgtcatccggcccttctacctgaccaacagcagcggcgtggactag

SEQ ID NO: 157398 - DNA, 411 bp, Artificial Sequence
  Description of Artificial Sequence: Synthetic coding sequence
atgagcaatgtgccccacaagagcagcctgcctgagggcatccggcccggcaccgtgctgcgcatccggggcctggtgcccccaaatgccagccgcttccacgtgaacctgctgtgtggggaggagcagggcagtgatgctgccctgcacttcaacccccggctggacaccagcgaggtggtgttcaacagcaaggagcagggctcctggggccgggaggagcggggccctggggtgcccttccagaggggccagccctttgaggtgctgatcatcgccagtgatgatggcttcaaggctgtggtgggagatgcccagtaccaccacttccgccaccggctgcccctggcccgggtgcggctggtggaggtgggcggagatgtgcagctggacagcgtgcgcatcttctag

SEQ ID NO: 157399 - DNA, 954 bp, Artificial Sequence
  Description of Artificial Sequence: Synthetic coding sequence
atgatgctgagcctgaacaacctgcagaacatcatctacaaccctgtgatcccctttgtgggcaccatcccagaccagctggaccccggcaccctgattgtcatccggggccacgtgcccagtgatgctgaccgcttccaggtggacctgcagaatggcagctccatgaagcccagggcagatgtggccttccacttcaacccccgcttcaagagagctggctgcatcgtgtgcaacaccctcatcaatgagaagtggggccgggaggagatcacctatgacacccccttcaagcgggagaagagctttgaaattgtcatcatggtgctgaaggacaagttccaggtggccgtgaatggcaagcacaccctgctgtatggccaccgcatcggccctgagaagattgacaccctgggcatctacggcaaggtgaacatccacagcatcggcttctccttcagcagtgacctgcagagcacccaggccagcagcctggagctgacagagatcagcagagaaaatgtgcccaagagcggcaccccccagctgcggctgccctttgctgcccggctgaacacccccatgggccctggccgcacagtggtggtgaagggggaggtgaatgccaatgccaagagcttcaacgtggacctgctggccggcaagagcaaggacatcgccctgcacctgaacccccggctgaacatcaaggcctttgtgagaaattccttcctgcaggagagctggggcgaggaggagaggaacatcaccagcttccccttcagccctggcatgtactttgagatgatcatctactgtgatgtgcgggagttcaaggtggccgtgaatggagtgcacagcctggagtacaagcaccgcttcaaggagctgagcagcattgacaccctggagatcaacggggacatccacctgctggaggtgcgctcctggtag

SEQ ID NO: 157400 - DNA, 1080 bp, Artificial Sequence
  Description of Artificial Sequence: Synthetic coding sequence
atgatgctgagcctgaacaacctgcagaacatcatctacaaccctgtgatcccctttgtgggcaccatcccagaccagctggaccccggcaccctgattgtcatccggggccacgtgcccagtgatgctgaccgcttccaggtggacctgcagaatggcagctccatgaagcccagggcagatgtggccttccacttcaacccccgcttcaagagagctggctgcatcgtgtgcaacaccctcatcaatgagaagtggggccgggaggagatcacctatgacacccccttcaagcgggagaagagctttgaaattgtcatcatggtgctgaaggacaagttccaggtggccgtgaatggcaagcacaccctgctgtatggccaccgcatcggccctgagaagattgacaccctgggcatctacggcaaggtgaacatccacagcatcggcttctccttcagcagtgacctgcagagcacccaggccagcagcctggagctgacagagatcagcagagaaaatgtgcccaagagcggcaccccccagctgcccagcaacagaggaggagacatcagcaagatcgcccccaggacagtgtacaccaagagcaaggacagcacagtgaaccacaccctgacctgcaccaagatcccccccatgaactacgtgtccaagaggctgccctttgctgcccggctgaacacccccatgggccctggccgcacagtggtggtgaagggggaggtgaatgccaatgccaagagcttcaacgtggacctgctggccggcaagagcaaggacatcgccctgcacctgaacccccggctgaacatcaaggcctttgtgagaaattccttcctgcaggagagctggggcgaggaggagaggaacatcaccagcttccccttcagccctggcatgtactttgagatgatcatctactgtgatgtgcgggagttcaaggtggccgtgaatggagtgcacagcctggagtacaagcaccgcttcaaggagctgagcagcattgacaccctggagatcaacggggacatccacctgctggaggtgcgctcctggtag

SEQ ID NO: 157401 - DNA, 1077 bp, Artificial Sequence
  Description of Artificial Sequence: Synthetic coding sequence
atgatgctgagcctgaacaacctgcagaacatcatctacaaccctgtgatcccctttgtgggcaccatcccagaccagctggaccccggcaccctgattgtcatccggggccacgtgcccagtgatgctgaccgcttccaggtggacctgcagaatggcagctccatgaagcccagggcagatgtggccttccacttcaacccccgcttcaagagagctggctgcatcgtgtgcaacaccctcatcaatgagaagtggggccgggaggagatcacctatgacacccccttcaagcgggagaagagctttgaaattgtcatcatggtgctgaaggacaagttccaggtggccgtgaatggcaagcacaccctgctgtatggccaccgcatcggccctgagaagattgacaccctgggcatctacggcaaggtgaacatccacagcatcggcttctccttcagcagtgacctgcagagcacccaggccagcagcctggagctgacagagatcagcagagaaaatgtgcccaagagcggcaccccccagctgcggctgagcctgcccagctgggacctgcagggccacggcagcgagaccttccgctctgtgctgtggaccagggtgtttgaaattgccttctgccggcccctgggcaccgtggccagcttccagaggctgccctttgctgcccggctgaacacccccatgggccctggccgcacagtggtggtgaagggggaggtgaatgccaatgccaagagcttcaacgtggacctgctggccggcaagagcaaggacatcgccctgcacctgaacccccggctgaacatcaaggcctttgtgaggaacagcttcctgcaggagagctggggcgaggaggagaggaacatcaccagcttccccttcagccctggcatgtactttgagatgatcatctactgtgatgtgcgggagttcaaggtggccgtgaatggagtgcacagcctggagtacaagcaccgcttcaaggagctgagcagcattgacaccctggagatcaatggagacatccacctgctggaggtgcgctcctggtag

SEQ ID NO: 157402 - DNA, 954 bp, Artificial Sequence; identical to SEQ ID NO: 157399
  Description of Artificial Sequence: Synthetic coding sequence

SEQ ID NO: 157403 - DNA, 627 bp, Artificial Sequence
  Description of Artificial Sequence: Synthetic coding sequence
atgatgctgagcctgaacaacctgcagaacatcatctacaaccctgtgatcccctttgtgggcaccatcccagaccagctggaccccggcaccctgattgtcatccggggccacgtgcccagtgatgctgaccgcttccaggtggacctgcagaatggcagctccatgaagcccagggcagatgtggccttccacttcaacccccgcttcaagagagctggctgcatcgtgtgcaacaccctcatcaatgagaagtggggccgggaggagatcacctatgacacccccttcaagcgggagaagagctttgaaattgtcatcatggtgctgaaggacaagttccaggtggccgtgaatggcaagcacaccctgctgtatggccaccgcatcggccctgagaagattgacaccctgggcatctacggcaaggtgaacatccacagcatcggcttctccttcagcagtgacctgcagagcacccaggccagcagcctggagctgacagagatcagcagagaaaatgtgcccaagagcggcaccccccagctgcccagcaacagaggaggagacatcagcaagatcgcccccaggacagtgtacaccaagagcaaggacagcacagtgtag

SEQ ID NO: 157404 - DNA, 903 bp, Artificial Sequence
  Description of Artificial Sequence: Synthetic coding sequence
atgatgctgagcctgaacaacctgcagaacatcatctacaaccctgtgatcccctttgtgggcaccatcccagaccagctggaccccggcaccctgattgtcatccggggccacgtgcccagtgatgctgaccgcttccaggtggacctgcagaatggcagctccatgaagcccagggcagatgtggccttccacttcaacccccgcttcaagagagctggctgcatcgtgtgcaacaccctcatcaatgagaagtggggccgggaggagatcacctatgacacccccttcaagcgggagaagagctttgaaattgtcatcatggtgctgaaggacaagttccaggtgcccaagagcggcaccccccagctgcccagcaacagaggaggagacatcagcaagatcgcccccaggacagtgtacaccaagagcaaggacagcacagtgaaccacaccctgacctgcaccaagatcccccccatgaactacgtgtccaagaggctgccctttgctgcccggctgaacacccccatgggccctggccgcacagtggtggtgaagggggaggtgaatgccaatgccaagagcttcaacgtggacctgctggccggcaagagcaaggacatcgccctgcacctgaacccccggctgaacatcaaggcctttgtgaggaacagcttcctgcaggagagctggggcgaggaggagaggaacatcaccagcttccccttcagccctggcatgtactttgagatgatcatctactgtgatgtgcgggagttcaaggtggccgtgaatggagtgcacagcctggagtacaagcaccgcttcaaggagctgagcagcattgacaccctggagatcaatggagacatccacctgctggaggtgcgctcctggtag

SEQ ID NO: 157405 - DNA, 1080 bp, Artificial Sequence; identical to SEQ ID NO: 157400
  Description of Artificial Sequence: Synthetic coding sequence

SEQ ID NO: 157406 - DNA, 507 bp, Artificial Sequence
  Description of Artificial Sequence: Synthetic coding sequence
atgatgctgagcctgaacaacctgcagaacatcatctacaaccctgtgatcccctttgtgggcaccatcccagaccagctggaccccggcaccctgattgtcatccggggccacgtgcccagtgatgctgaccgcttccaggtggacctgcagaatggcagctccatgaagcccagggcagatgtggccttccacttcaacccccgcttcaagagagctggctgcatcgtgtgcaacaccctcatcaatgagaagtggggccgggaggagatcacctatgacacccccttcaagcgggagaagagctttgaaattgtcatcatggtgctgaaggacaagttccaggtggccgtgaatggcaagcacaccctgctgtatggccaccgcatcggccctgagaagattgacaccctgggcatctacggcaaggtgaacatccacagcatcggcttctccttcagcagtgacctgcagagcacccaggccagcagcctggagctgacctag

SEQ ID NO: 157407 - DNA, 321 bp, Artificial Sequence
  Description of Artificial Sequence: Synthetic coding sequence
atgatgctgagcctgaacaacctgcagaacatcatctacaaccctgtgatcccctttgtgggcaccatcccagaccagctggaccccggcaccctgattgtcatccggggccacgtgcccagtgatgctgaccgcttccaggtggacctgcagaatggcagctccatgaagcccagggcagatgtggccttccacttcaacccccgcttcaagagagctggctgcatcgtgtgcaacaccctcatcaatgagaagtggggccgggaggagatcacctatgacacccccttcaagcgggagaagagctttgaaattgtgtag

SEQ ID NO: 157408 - DNA, 1080 bp, Artificial Sequence; identical to SEQ ID NO: 157400
  Description of Artificial Sequence: Synthetic coding sequence

SEQ ID NO: 157409 - DNA, 954 bp, Artificial Sequence; identical to SEQ ID NO: 157399
  Description of Artificial Sequence: Synthetic coding sequence

SEQ ID NO: 157410 - DNA, 1080 bp, Artificial Sequence; identical to SEQ ID NO: 157400
  Description of Artificial Sequence: Synthetic coding sequence

SEQ ID NO: 157411 - DNA, 132 bp, Artificial Sequence
  Description of Artificial Sequence: Synthetic coding sequence
atgatgctgagcctgaacaacctgcagaacatcatctacaaccctgtgatcccctttgtgggcaccatcccagaccagctggaccccggcaccctgattgtcatccggggccacgtgcccagtgatgcctag

SEQ ID NO: 157412 - DNA, 972 bp, Artificial Sequence
  Description of Artificial Sequence: Synthetic coding sequence
atggccttcagcggcagccaggccccctacctgagccctgctgtgcccttcagcggcaccatccagggcggcctgcaggacggcctgcagatcaccgtgaatggcaccgtgctgagcagcagcggcaccaggtttgctgtgaacttccagacaggcttctctggaaatgacatcgccttccacttcaaccccaggtttgaagatggcggctacgtggtgtgcaacacccggcagaatggctcctggggccctgaggagaggaagacccacatgcccttccagaagggcatgccctttgacctgtgcttcctggtgcagagcagtgacttcaaggtgatggtgaatggcatcctgtttgtgcagtacttccaccgggtgcccttccaccgggtggacaccatctctgtgaatggatctgtgcagctgagctacatctccttccagcccccaggagtgtggccagccaacccagcccccatcacccagaccgtcatccacacagtgcagagcgcccctggccagatgttcagcaccccagccatcccccccatgatgtacccccacccagcctaccccatgcccttcatcaccaccatcctgggcggcctgtaccccagcaagagcatcctgctgagcggcaccgtgctgcccagcgcccagcgcttccacatcaacctgtgcagcggcaaccacatcgccttccacctgaaccccaggtttgatgaaaatgctgtggtgaggaacacccagattgacaacagctggggcagcgaggagaggagcctgcccaggaagatgccctttgtgcggggccagagcttctctgtgtggatcctgtgtgaggcccactgcctgaaggtggccgtggatggccagcacctgtttgagtactaccaccggctgaggaacctgcccaccatcaaccggctggaggtgggcggggacatccagctgacccacgtgcagacctag

SEQ ID NO: 157413 - DNA, 936 bp, Artificial Sequence
  Description of Artificial Sequence: Synthetic coding sequence
atggccttcagcggcagccaggccccctacctgagccctgctgtgcccttcagcggcaccatccagggcggcctgcaggacggcctgcagatcaccgtgaatggcaccgtgctgagcagcagcggcaccaggtttgctgtgaacttccagacaggcttctctggaaatgacatcgccttccacttcaaccccaggtttgaagatggcggctacgtggtgtgcaacacccggcagaatggctcctggggccctgaggagaggaagacccacatgcccttccagaagggcatgccctttgacctgtgcttcctggtgcagagcagtgacttcaaggtgatggtgaatggcatcctgtttgtgcagtacttccaccgggtgcccttccaccgggtggacaccatctctgtgaatggatctgtgcagctgagctacatctccttccagacccagaccgtcatccacacagtgcagagcgcccctggccagatgttcagcaccccagccatcccccccatgatgtacccccacccagcctaccccatgcccttcatcaccaccatcctgggcggcctgtaccccagcaagagcatcctgctgagcggcaccgtgctgcccagcgcccagcgcttccacatcaacctgtgcagcggcaaccacatcgccttccacctgaaccccaggtttgatgaaaatgctgtggtgaggaacacccagattgacaacagctggggcagcgaggagaggagcctgcccaggaagatgccctttgtgcggggccagagcttctctgtgtggatcctgtgtgaggcccactgcctgaaggtggccgtggatggccagcacctgtttgagtactaccaccggctgaggaacctgcccaccatcaaccggctggaggtgggcggggacatccagctgacccacgtgcagacctag

SEQ ID NO: 157414 - DNA, 741 bp, Artificial Sequence
  Description of Artificial Sequence: Synthetic coding sequence
atggccttcagcggcagccaggccccctacctgagccctgctgtgcccttcagcggcaccatccagggcggcctgcaggacggcctgcagatcaccgtgaatggcaccgtgctgagcagcagcggcaccaggtttgctgtgaacttccagacaggcttctctggaaatgacatcgccttccacttcaaccccaggtttgaagatggcggctacgtggtgtgcaacacccggcagaatggctcctggggccctgaggagaggaagacccacatgcccttccagaagggcatgccctttgacctgtgcttcctggtgcagagcagtgacttcaaggtgatggtgaatggcatcctgtttgtgcagtacttccaccgggtgcccttccaccgggtggacaccatctctgtgaatggatctgtgcagctgagctacatctccttccagcccccaggagtgtggccagccaacccagcccccatcacccagaccgtcatccacacagtgcagagcgcccctggccagatgttcagcaccccagccatcccccccatgatgtacccccacccagcctaccccatgcccttcatcaccaccatcctgggcggcctgtaccccagcaagagcatcctgctgagcggcaccgtgctgcccagcgcccagagatgtggcagctgtgtgaagctgacagccagccgctggccctggatggtgtccacctgcctgaacaccaccatcgcctag

SEQ ID NO: 157415 - DNA, 1068 bp, Artificial Sequence
  Description of Artificial Sequence: Synthetic coding sequence
atggccttcagcggcagccaggccccctacctgagccctgctgtgcccttcagcggcaccatccagggcggcctgcaggacggcctgcagatcaccgtgaatggcaccgtgctgagcagcagcggcaccaggtttgctgtgaacttccagacaggcttctctggaaatgacatcgccttccacttcaaccccaggtttgaagatggcggctacgtggtgtgcaacacccggcagaatggctcctggggccctgaggagaggaagacccacatgcccttccagaagggcatgccctttgacctgtgcttcctggtgcagagcagtgacttcaaggtgatggtgaatggcatcctgtttgtgcagtacttccaccgggtgcccttccaccgggtggacaccatctctgtgaatggatctgtgcagctgagctacatctccttccagaaccccaggacagtgcctgtgcagcctgccttcagcacagtgcccttcagccagcctgtgtgcttccccccccggccccggggccggcggcagaagcccccaggagtgtggccagccaacccagcccccatcacccagaccgtcatccacacagtgcagagcgcccctggccagatgttcagcaccccagccatcccccccatgatgtacccccacccagcctaccccatgcccttcatcaccaccatcctgggcggcctgtaccccagcaagagcatcctgctgagcggcaccgtgctgcccagcgcccagcgcttccacatcaacctgtgcagcggcaaccacatcgccttccacctgaaccccaggtttgatgaaaatgctgtggtgaggaacacccagattgacaacagctggggcagcgaggagaggagcctgcccaggaagatgccctttgtgcggggccagagcttctctgtgtggatcctgtgtgaggcccactgcctgaaggtggccgtggatggccagcacctgtttgagtactaccaccggctgaggaacctgcccaccatcaaccggctggaggtgggcggggacatccagctgacccacgtgcagacctag

SEQ ID NO: 157416 - DNA, 666 bp, Artificial Sequence
  Description of Artificial Sequence: Synthetic coding sequence
atgggccccttcagcgcccctgtggagccagatggcggctacgtggtgtgcaacacccggcagaatggctcctggggccctgaggagaggaagacccacatgcccttccagaagggcatgccctttgacctgtgcttcctggtgcagagcagtgacttcaaggtgatggtgaatggcatcctgtttgtgcagtacttccaccgggtgcccttccaccgggtggacaccatctctgtgaatggatctgtgcagctgagctacatctccttccagaaccccaggacagtgcctgtgcagcctgccttcagcacagtgcccttcagccagcctgtgtgcttccccccccggccccggggccggcggcagaagcccccaggagtgtggccagccaacccagcccccatcacccagaccgtcatccacacagtgcagagcgcccctggccagatgttcagcaccccagccatcccccccatgatgtacccccacccagcctaccccatgcccttcatcaccaccatcctgggcggcctgtaccccagcaagagcatcctgctgtctggaacagtgctgcccagcgcccagagatgtggcagctgtgtgaagctgacagccagccgctggccctggatggtgtccacctgcctgaacaccaccatcgcctag

SEQ ID NO: 157417 - DNA, 360 bp, Artificial Sequence
  Description of Artificial Sequence: Synthetic coding sequence
atggccttcagcggcagccaggccccctacctgagccctgctgtgcccttcagcggcaccatccagggcggcctgcaggacggcctgcagatcaccgtgaatggcaccgtgctgagcagcagcggcaccaggtttgctgtgaacttccagacaggcttctctggaaatgacatcgccttccacttcaaccccaggtttgaagatggcggctacgtggtgtgcaacacccggcagaatggctcctggggccctgaggagaggaagacccacatgcccttccagaagggcatgccctttgacctgtgcttcctggtgcagagcagtgacttcaaggtgcacctgctgctgctgctgctgtag

SEQ ID NO: 157418 - DNA, 1533 bp, Artificial Sequence
  Description of Artificial Sequence: Synthetic coding sequence
atggccggcagccggcagaggggcctgcgggcccgggtgcggcccctcttctgtgccctgctgctgagcctgggccgctttgtgagaggagatggagtgggcggggaccctgctgtggccctgccccacagaagatttgagtacaagtacagcttcaagggcccccacctggtgcagagtgatggcaccgtgcccttctgggcccacgccggaaatgccatccccagcagtgaccagatccgggtggcccccagcctgaagagccagaggggctctgtgtggaccaagaccaaggccgcctttgagaactgggaggtggaggtgaccttccgggtgacaggccggggccgcatcggggctgatggcctggccatctggtatgcagagaaccagggcctggagggccctgtgtttggcagcgctgacctgtggaatggagtgggcatcttctttgacagctttgacaatgatggcaagaagaacaacccagccatcgtcatcatcggcaacaacggccagatccactatgaccaccagaatgatggagccagccaggccctggccagctgccagagggacttcaggaacaagccctaccctgtgcgggccaagatcacctactaccagaacaccctgactgtgatgatcaacaacggcttcaccccagacaagaatgactatgagttctgtgccaaggtggagaacatgatcatcccagcccagggccacttcggcatctctgctgccaccggcggcctggctgatgaccatgatgtgctgtccttcctgaccttccagctgacagagcccgggaaggagccccccaccccagacaaggagatcagcgagaaggagaaggagaagtaccaggaggagtttgagcacttccagcaggagctggacaagaagaaggaggagttccagaagggccacccagacctgcagggccagcctgctgaggagatctttgaatctgtgggggaccgggagctgcggcaggtgtttgagggccagaaccgcatccacctggagatcaagcagctgaaccggcagctggacatgatcctggatgagcagaggcgctacgtgagcagcctgacagaggagatcagcaagagaggagctggcatgcctggccagcacggccagatcacccagcaggagctggacacagtggtgaagacccagcacgagatcctgcggcaggtgaatgagatgaagaacagcatgtctgaaacagtgcggctggtgtctggcatgcagcaccctggcagcgctgggggcgtgtatgagaccacccagcacttcatcgacatcaaggagcacctgcacatcgtgaagagggacatcgacaacctggtgcagaggaacatgcccagcaatgagaagcccaagtgcccagagctgccccccttccccagctgcctgagcacagtgcacttcatcatctttgtggtggtgcagacagtgctcttcatcggctacatcatgtaccgcagccagcaggaggccgccgccaagaagttcttctag

SEQ ID NO: 157419 - DNA, 1101 bp, Artificial Sequence
  Description of Artificial Sequence: Synthetic coding sequence
atgcagcccctgtggctgtgctgggccctgtgggtgctgcccctggccagccctggggccgccctgactggagagcagctgctgggcagcctgctgcggcagctgcagctgaaggaggtgcccaccctggacagagctgacatggaggagctggtgatccccacccacgtgcgggcccagtatgtggccctgctgcagaggagccatggagacaggagccggggcaagcgcttcagccagagcttccgggaggtggccggccgcttcctggccctggaggccagcacccacctgctggtgtttggcatggagcagaggctgccccccaacagcgagctggtgcaggccgtgctgcggctcttccaggagcctgtgcccaaggccgccctgcacagacatggccgcctgagccccaggtctgcccgggcccgggtgacagtggagtggctgcgggtgagagatgatggcagcaacagaaccagcctgattgacagccggctggtgtctgtgcatgaaagtggctggaaggcctttgatgtgacagaagctgtgaacttctggcagcagctgagccggccccggcagcccctgctgctgcaggtgtctgtgcagcgggagcacctgggccccctggccagcggggcccacaagctggtgcgctttgccagccagggcgccccagctggcctgggggagccccagctggagctgcacaccctggacctgggggactatggagcccagggcgactgtgaccctgaggcccccatgacagagggcacccgctgctgccggcaggagatgtacatcgacctgcagggcatgaagtgggccgagaactgggtgctggagcccccaggcttcctggcctatgaatgtgtgggcacctgccggcagcccccagaggccctggccttcaagtggcccttcctgggcccccggcagtgcatcgccagcgagacagacagcctgcccatgattgtgtccatcaaggagggcggccgcacccggccccaggtggtgtccctgcccaacatgagggtgcagaagtgcagctgtgccagtgatggagccctggtgccccggcggctgcagccctag

SEQ ID NO: 157420 - DNA, 1101 bp, Artificial Sequence
  Description of Artificial Sequence: Synthetic coding sequence
atgtggcccctgtggctgtgctgggccctgtgggtgctgcccctggccggccctggggccgccctgacagaggagcagctgctgggcagcctgctgcggcagctgcagctgtctgaggtgcctgtgctggacagagctgacatggagaagctggtgatcccagcccacgtgcgggcccagtatgtggtgctgctgcggcgcagccatggagacaggagccggggcaagcgcttcagccagagcttccgggaggtggccggccgcttcctggccagcgaggccagcacccacctgctggtgtttggcatggagcagaggctgccccccaacagcgagctggtgcaggccgtgctgcggctcttccaggagcctgtgcccaaggccgccctgcacagacatggccgcctgagccccaggtctgcccaggcccgggtgacagtggagtggctgcgggtgagagatgatggcagcaacagaaccagcctgattgacagccggctggtgtctgtgcatgaaagtggctggaaggcctttgatgtgacagaagctgtgaacttctggcagcagctgagccggccccggcagcccctgctgctgcaggtgtctgtgcagcgggagcacctgggccccctggccagcggggcccacaagctggtgcgctttgccagccagggcgccccagctggcctgggggagccccagctggagctgcacaccctggacctgcgggactatggagcccagggcgactgtgaccctgaggcccccatgacagagggcacccgctgctgccggcaggagatgtacatcgacctgcagggcatgaagtgggccaagaactgggtgctggagcccccaggcttcctggcctatgaatgtgtgggcacctgccagcagcccccagaggccctggccttcaactggcccttcctgggcccccggcagtgcatcgccagcgagacagccagcctgcccatgattgtgtccatcaaggagggcggccgcacccggccccaggtggtgtccctgcccaacatgagggtgcagaagtgcagctgtgccagtgatggagccctggtgccccggcggctgcagccctag

SEQ ID NO: 157421 - DNA, 999 bp, Artificial Sequence
  Description of Artificial Sequence: Synthetic coding sequence
atgtggcccctgtggctgtgctgggccctgtgggtgctgcccctggccggccctggggccgccctgacagaggagcagctgctgggcagcctgctgcggcagctgcagctgtctgaggtgcctgtgctggacagagctgacatggagaagctggtgatcccagcccacgtgcgggcccagtatgtggtgctgctgcggcgcagccatggagacaggagccggggcaagcgcttcagccagagcttccgggaggtggccggccgcttcctggccagcgaggccgccctgcacagacatggccgcctgagccccaggtctgcccaggcccgggtgacagtggagtggctgcgggtgagagatgatggcagcaacagaaccagcctgattgacagccggctggtgtctgtgcatgaaagtggctggaaggcctttgatgtgacagaagctgtgaacttctggcagcagctgagccggccccggcagcccctgctgctgcaggtgtctgtgcagcgggagcacctgggccccctggccagcggggcccacaagctggtgcgctttgccagccagggcgccccagctggcctgggggagccccagctggagctgcacaccctggacctgcgggactatggagcccagggcgactgtgaccctgaggcccccatgacagagggcacccgctgctgccggcaggagatgtacatcgacctgcagggcatgaagtgggccaagaactgggtgctggagcccccaggcttcctggcctatgaatgtgtgggcacctgccagcagcccccagaggccctggccttcaactggcccttcctgggcccccggcagtgcatcgccagcgagacagccagcctgcccatgattgtgtccatcaaggagggcggccgcacccggccccaggtggtgtccctgcccaacatgagggtgcagaagtgcagctgtgccagtgatggagccctggtgccccggcggctgcagccctag

SEQ ID NO: 157422 - DNA, 1131 bp, Artificial Sequence
  Description of Artificial Sequence: Synthetic coding sequence
atggtgtggaaggtggccgtgttcctgtctgtggccctgggcattggagctgtgcccattgatgatcctgaagatggcggcaagcactgggtggtgattgtggccggcagcaatggctggtacaactaccgccaccaggctgatgcctgccacgcctaccagatcatccacagaaatggcatcccagatgagcagatcgtggtgatgatgtatgatgacatcgcctacagcgaggacaaccccaccccaggcatcgtcatcaaccggcccaatggaacagatgtgtaccagggcgtgcccaaggactacaccggggaggatgtgaccccccagaacttcctggccgtgctgcggggagatgctgaggccgtgaagggcatcggcagcggcaaggtgctgaagagcggcccccaggaccacgtgttcatctacttcacagaccacggcagcacaggcatcctggtgttccccaatgaagacctgcacgtgaaggacctgaatgagaccatccactacatgtacaagcacaagatgtacaggaagatggtgttctacatcgaggcctgtgagagcggctccatgatgaaccacctgcctgacaacatcaacgtgtatgccaccacagctgccaacccccgggagagcagctatgcctgctactatgatgagaagaggagcacctacctgggggactggtacagcgtgaactggatggaggacagtgatgtggaggacctgaccaaggagaccctgcacaagcagtaccacctggtgaagagccacaccaacaccagccacgtgatgcagtatggcaacaagaccatcagcaccatgaaggtgatgcagttccagggcatgaagaggaaggccagcagccctgtgcccctgccccctgtgacccacctggacctgacccccagcccagatgtgcccctgaccatcatgaagaggaagctgatgaacaccaatgacctggaggagagccggcagctgacagaggagatccagaggcacctggactatgaatatgccctgcggcacctgtatgtgctggtgaacctgtgtgagaagccctaccccctgcaccgcatcaagctgtccatggaccacgtgtgcctgggccactactag

SEQ ID NO: 157423 - DNA, 1119 bp, Artificial Sequence
  Description of Artificial Sequence: Synthetic coding sequence
atggtgtggaaggtggccgtgttcctgtctgtggccctgggcattggagctgtgcccattgatgatcctgaagatggcggcaagcactgggtggtgattgtggccggcagcaatggctggtacaactaccgccaccaggctgatgcctgccacgcctaccagatcatccacagaaatggcatcccagatgagcagatcgtggtgatgatgtatgatgacatcgcctacagcgaggacaaccccaccccaggcatcgtcatcaaccggcccaatggaacagatgtgtaccagggcgtgcccaaggactacaccggggaggatgtgaccccccagaacttcctggccgtgctgcggggagatgctgaggccgtgaagggcatcggcagcggcaaggtgctgaagagcggcccccaggaccacgtgttcatctacttcacagaccacggcagcacaggcatcctggtgttccccaatgaagacctgcacgtgaaggacctgaatgagaccatccactacatgtacaagcacaagatgtacaggaagatggtgttctacatcgaggcctgtgagagcggctccatgatgaaccacctgcctgacaacatcaacgtgtatgccaccacagctgccaacccccgggagagcagctatgcctgctactatgatgagaagaggagcacctacctgggggactggtacagcgtgaactggatggaggacagtgatgtggaggacctgaccaaggagaccctgcacaagcagtaccacctggtgaagagccacaccaacaccagccacgtgatgcagtatggcaacaagaccatcagcaccatgaaggtgatgcagttccagggcatgaagaggaaggccagcagccctgtgcccctgccccctgtgacccacctggacctgacccccagcccagatgtgcccctgaccatcatgaagaggaagctgatgaacaccaatgacctggaggagagccggcagctgacagaggagatccagaggcacctggatgacaagatcgtgcacggcccccgggtgccctggagcctgctgaagagctgcctgctggaggccttccccagcgtgtctgccccacccaccgtgtgctag

SEQ ID NO: 157424 - DNA, 1302 bp, Artificial Sequence
  Description of Artificial Sequence: Synthetic coding sequence
atggtgtggaaggtggccgtgttcctgtctgtggccctgggcattggagctgtgcccattgatgatcctgaagatggcggcaagcactgggtggtgattgtggccggcagcaatggctggtacaactaccgccaccaggctgatgcctgccacgcctaccagatcatccacagaaatggcatcccagatgagcagatcgtggtgatgatgtatgatgacatcgcctacagcgaggacaaccccaccccaggcatcgtcatcaaccggcccaatggaacagatgtgtaccagggcgtgcccaaggactacaccggggaggatgtgaccccccagaacttcctggccgtgctgcggggagatgctgaggccgtgaagggcatcggcagcggcaaggtgctgaagagcggcccccaggaccacgtgttcatctacttcacagaccacggcagcacaggcatcctggtgttccccaatgaagacctgcacgtgaaggacctgaatgagaccatccactacatgtacaagcacaagatgtacaggaagatggtgttctacatcgaggcctgtgagagcggctccatgatgaaccacctgcctgacaacatcaacgtgtatgccaccacagctgccaacccccgggagagcagctatgcctgctactatgatgagaagaggagcacctacctgggggactggtacagcgtgaactggatggaggacagtgatgtggaggacctgaccaaggagaccctgcacaagcagtaccacctggtgaagagccacaccaacaccagccacgtgatgcagtatggcaacaagaccatcagcaccatgaaggtgatgcagttccagggcatgaagaggaaggccagcagccctgtgcccctgccccctgtgacccacctggacctgacccccagcccagatgtgcccctgaccatcatgaagaggaagctgatgaacaccaatgacctggaggagagccggcagctgacagaggagatccagaggcacctggatgcccggcacctgattgagaagtctgtgaggaagatcgtgtccctgctggccgccagcgaggccgaggtggagcagctgctgtctgagcgggcccccctgaccggccacagctgctacccagaggccctgctgcacttccgcacccactgcttcaactggcacagccccacctatgaatatgccctgcggcacctgtatgtgctggtgaacctgtgtgagaagccctaccccctgcaccgcatcaagctgtccatggaccacgtgtgcctgggccactactag

SEQ ID NO: 157425 - DNA, 1302 bp, Artificial Sequence; identical to SEQ ID NO: 157424
  Description of Artificial Sequence: Synthetic coding sequence

SEQ ID NO: 157426 - DNA, 1197 bp, Artificial Sequence
  Description of Artificial Sequence: Synthetic coding sequence
atggtgtggaaggtggccgtgttcctgtctgtggccctgggcattggagctgtgcccattgatgatcctgaagatggcggcaagcactgggtggtgattgtggccggcagcaatggctggtacaactaccgccaccaggctgatgcctgccacgcctaccagatcatccacagaaatggcatcccagatgagcagatcgtggtgatgatgtatgatgtgaccccccagaacttcctggccgtgctgcggggagatgctgaggccgtgaagggcatcggcagcggcaaggtgctgaagagcggcccccaggaccacgtgttcatctacttcacagaccacggcagcacaggcatcctggtgttccccaatgaagacctgcacgtgaaggacctgaatgagaccatccactacatgtacaagcacaagatgtacaggaagatggtgttctacatcgaggcctgtgagagcggctccatgatgaaccacctgcctgacaacatcaacgtgtatgccaccacagctgccaacccccgggagagcagctatgcctgctactatgatgagaagaggagcacctacctgggggactggtacagcgtgaactggatggaggacagtgatgtggaggacctgaccaaggagaccctgcacaagcagtaccacctggtgaagagccacaccaacaccagccacgtgatgcagtatggcaacaagaccatcagcaccatgaaggtgatgcagttccagggcatgaagaggaaggccagcagccctgtgcccctgccccctgtgacccacctggacctgacccccagcccagatgtgcccctgaccatcatgaagaggaagctgatgaacaccaatgacctggaggagagccggcagctgacagaggagatccagaggcacctggatgcccggcacctgattgagaagtctgtgaggaagatcgtgtccctgctggccgccagcgaggccgaggtggagcagctgctgtctgagcgggcccccctgaccggccacagctgctacccagaggccctgctgcacttccgcacccactgcttcaactggcacagccccacctatgaatatgccctgcggcacctgtatgtgctggtgaacctgtgtgagaagccctaccccctgcaccgcatcaagctgtccatggaccacgtgtgcctgggccactactag

SEQ ID NO: 157427 - DNA, 1233 bp, Artificial Sequence
  Description of Artificial Sequence: Synthetic coding sequence
atggtgtggaaggtggccgtgttcctgtctgtggccggcagcaatggctggtacaactaccgccaccaggctgatgcctgccacgcctaccagatcatccacagaaatggcatcccagatgagcagatcgtggtgatgatgtatgatgacatcgcctacagcgaggacaaccccaccccaggcatcgtcatcaaccggcccaacggcacagatgtgtaccagggcgtgcccaaggactacacaggagaagatgtgaccccccagaacttcctggccgtgctgcggggagatgctgaggccgtgaagggcatcggcagcggcaaggtgctgaagagcggcccccaggaccacgtgttcatctacttcacagaccacggcagcacaggcatcctggtgttccccaatgaagacctgcacgtgaaggacctgaatgagaccatccactacatgtacaagcacaagatgtacaggaagatggtgttctacatcgaggcctgtgagagcggctccatgatgaaccacctgcctgacaacatcaacgtgtatgccaccacagctgccaacccccgggagagcagctatgcctgctactatgatgagaagaggagcacctacctgggggactggtacagcgtgaactggatggaggacagtgatgtggaggacctgaccaaggagaccctgcacaagcagtaccacctggtgaagagccacaccaacaccagccacgtgatgcagtatggcaacaagaccatcagcaccatgaaggtgatgcagttccagggcatgaagaggaaggccagcagccctgtgcccctgccccctgtgacccacctggacctgacccccagcccagatgtgcccctgaccatcatgaagaggaagctgatgaacaccaatgacctggaggagagccggcagctgacagaggagatccagaggcacctggatgcccggcacctgattgagaagtctgtgaggaagatcgtgtccctgctggccgccagcgaggccgaggtggagcagctgctgtctgagcgggcccccctgaccggccacagctgctacccagaggccctgctgcacttccgcacccactgcttcaactggcacagccccacctatgaatatgccctgcggcacctgtatgtgctggtgaacctgtgtgagaagccctaccccctgcaccgcatcaagctgtccatggaccacgtgtgcctgggccactactag

SEQ ID NO: 157428 - DNA, 174 bp, Artificial Sequence
  Description of Artificial Sequence: Synthetic coding sequence
atggtgtggaaggtggccgtgttcctgtctgtggccctgggcattggagctgtgcccattgatgatcctgaagatggcggcaagcactgggtggtgattgtggccggcagcaatggctggtacaactaccgccaccaggctgatgcctgccacgcctaccagatcatccactag

SEQ ID NO: 157429 - DNA, 60 bp, Artificial Sequence
  Description of Artificial Sequence: Synthetic coding sequence
atggtgtggaaggtggccgtgttcctgtctgtggccctgggcattggagctgtgccctag

SEQ ID NO: 157430 - DNA, 177 bp, Artificial Sequence
  Description of Artificial Sequence: Synthetic coding sequence
atggtgtggaaggtggccgtgttcctgtctgtggccctgggcattggagctgtgcccattgatgatcctgaagatggcggcaagcactgggtggtgattgtggccggcagcaatggctggtacaactaccgccaccaggctgatgcctgccacgcctaccagatcatccacaggtag

SEQ ID NO: 157431 - DNA, 237 bp, Artificial Sequence
  Description of Artificial Sequence: Synthetic coding sequence
atggtgtggaaggtggccgtgttcctgtctgtggccctgggcattggagctgtgcccattgatgatcctgaagatggcggcaagcactgggtggtgattgtggccggcagcaatggctggtacaactaccgccaccaggctgatgcctgccacgcctaccagatcatccacagaaatggcatcccagatgagcagatcgtggtgatgatgtatgatgacatcgcctacagcgagtag

SEQ ID NO: 157432 - DNA, 237 bp, Artificial Sequence; identical to SEQ ID NO: 157431
  Description of Artificial Sequence: Synthetic coding sequence

SEQ ID NO: 157433 - DNA, 2736 bp, Artificial Sequence
  Description of Artificial Sequence: Synthetic coding sequence
atggctgctgctgctgccagcgccccccagcagctgagtgatgaggagctgttcagccagctgcggcgctatggcctgagccctggccctgtgacagagagcaccaggcctgtgtacctgaagaagctgaagaagctgcgggaggaggagcagcagcagcacaggtctgggggccggggcaacaagaccaggaacagcaacaacaacaacacagctgctgccaccgtggccgctgctggccctgctgctgctgctgctgctggcatgggcgtgcggcctgtgtctggggacctgagctacctgcggacccctgggggcctgtgccgcatcagcgccagcggccctgagagcctgctgggcggccctgggggcgccagcgctgccccagctgctggcagcaaggtgctgctgggcttcagcagtgatgaaagtgatgtggaggccagcccccgggaccaggccggcggcggcggcaggaaggaccgggccagcctgcagtaccggggcctgaaggcccccccagcccccctggccgccagcgaggtgaccaacagcaacagcgctgagaggaggaagccccacagctggtggggcgcccggcggcctgctggccctgagctgcagaccccacctgggaaggatggagctgtggaggatgaggagggggagggagaagatggagaggagcgggaccctgagacagaggagcccctgtgggccagcaggacagtgaatggcagccggctggtgccctacagctgccgggagaactacagcgacagcgaggaggaggatgatgatgatgtggccagcagccggcaggtgctgaaggatgacagcctgagccgccaccggcccaggaggacccacagcaagcccctgccccccctgacagccaagtctgctgggggccgcctggagacctctgtgcagggcggcggcggcctggccatgaatgacagagctgctgctgctggcagcctggacaggagcaggaacctggaggaggccgctgctgctgagcagggcggcggctgtgaccaggtggacagcagccctgtgccccgctacagagtgaatgccaagaagctgacccccctgctgcccccacccctgacagacatggacagcaccctggacagcagcacaggcagcctgctgaagaccaacaaccacatcggcggcggggccttctctgtggacagcccccgcatctacagcaacagcctgcccccatctgctgctgtggccgccagcagcagcctgcgcatcaaccacgccaaccacacaggcagcaaccacacctacctgaagaacacctacaacaagcccaagctgtctgagcctgaggaggagctgctgcagcagttcaagcgggaggaggtgagccccaccggcagcttcagcgcccactacctgtccatgttcctgctgacagctgcctgcctcttcttcctgatcctgggcctgacctacctgggcatgaggggcaccggggtgtctgaagatggagagctgagcattgagaacccctttggagagaccttcggcaagatccaggagagcgagaagaccctgatgatgaacaccctgtacaagctgcatgaccggctggcccagctggccggggaccatgaatgtggcagcagcagccagaggaccctgtctgtgcaggaggccgccgcctacctgaaggacctgggcccagaatatgagggcatcttcaacaccagcctgcagtggatcctggagaatggcaaggatgtgggcatccgctgtgtgggcttcggccctgaggaggagctgaccaacatcacagatgtgcagttcctgcagagcacccggcccctgatgtccttctggtgccgcttcagaagagcctttgtgacagtgacccaccggctgctgctgctgtgcctgggcgtggtgatggtgtgtgtggtgctgcgctacatgaagtaccgctggaccaaggaggaggaggagacccggcagatgtatgacatggtggtgaagatcattgatgtgctgcggagccacaatgaggcctgccaggagaacaaggacctgcagccctacatgcccatcccccacgtgcgggacagcctcatccagccccatgacaggaagaagatgaagaaggtgtgggacagagctgtggacttcctggccgccaatgaaagccgggtgaggacagagaccaggagaattggaggagctgacttcctggtgtggcgctggatccagcccagcgccagctgtgacaagatcctggtgatccccagcaaggtgtggcagggccaggccttccacctggacagaagaaacagcccccccaacagcctgaccccctgcctgaagatccggaacatgtttgatcctgtgatggagatcggggaccagtggcacctggccatccaggaggccatcctggagaagtgcagcgacaatgatggcatcgtgcacatcgctgtggacaagaacagccgggagggctgtgtgtatgtgaagtgcctgagcccagaatatgctgggaaggccttcaaggccctgcacggctcctggtttgatggcaagctggtgacagtgaagtacctgcggctggaccgctaccaccaccgcttcccccaggccctgaccagcaacacccccctgaagcccagcaacaagcacatgaacagcatgagccacctgcggctgaggacaggcctgaccaacagccagggcagcagctag

SEQ ID NO: 157434 - DNA, 4512 bp, Artificial Sequence
  Description of Artificial Sequence: Synthetic coding sequence
atgcctggccccccagccctgcggcggcggctgctgctgctgctgctggtgctgctgattgctggcagcgctggggccgcccccctgccccagacaggagctggggaggcccccccagctgctgaggtgagcagcagctttgtgatcctgtgtgtgtgcagcctcatcatcctgattgtgctgattgccaactgtgtgtcctgctgcaaggaccctgagattgacttcaaggagtttgaggacaactttgatgatgaaattgacttcaccccacctgctgaggacacccccagcgtgcagagccctgctgaggtgttcaccctgtctgtgcccaacatcagcctgcctgcccccagccagttccagcccagcgtggagggcctgaagagccaggtggcccggcacagcctgaactacatccaggagattggaaatggctggtttgggaaggtgctgctgggggagatctacacaggcacctctgtggcccgggtcatcgtgaaggagctgaaggccagcgccaaccccaaggagcaggacaccttcctgaagaatggagagccctactacatcctgcagcaccccaacatcctgcagtgtgtgggccagtgtgtggaggccatcccctacctgctggtgtttgagttctgtgacctgggggacctgaaggcctacctgcggtctgagcaggagcacatgagaggagacagccagaccatgctgctgcagaggatggcctgtgaggtggccgccggcctggccgccatgcacaagctgcacttcctgcacagcgacctggccctgaggaactgcttcctgaccagtgacctgaatgtgaaggtgggggactatggcatcggcttcagccgctacaaggaggactacatcgagacagatgacaagaaggtgttccccctgcgctggacagcccctgagctggtgaccagcttccaggaccggctgctgacagctgaccagaccaagtacagcaacatctggagcctgggcgtgaccctgtgggagctgtttgacaatgctgcccagccctacagcaacctgagcaacctggatgtgctgaaccaggtgatccgggagcgggacaccaagctgcccaagccccagctggagcagccctacagcgaccgctggtatgaggtgctgcagttctgctggctgagccctgagaagaggcctgctgctgaagatgtgcaccggctgctgacctacctgcggctgcagagccagagggacagcgaggtggactttgagcagcagtggaatgccctgaagcccaacaccaacagccgggacagcagcaacaatgctgccttccccatcctggaccactttgcccgggaccggctgggccgggagatggaggaggtgctgactgtgacagagaccagccagggcctgagctttgaatatgtgtgggaggccgccaagcatgaccactttgatgagaggagccggggccacctggatgagggcctgagctacaccagcatcttctaccctgtggaggtgtttgagagcagcctgagtgaccccggccctgggaagcaggatgattctggccaggatgtgcccctgcgggtgcctggggtggtgcctgtgtttgatgcccacaacctgtctgtgggcagtgactactacatccagctggaggagaagagcggcagcaacctggagctggactaccccccagccctgctgaccacagacatggacaaccctgagaggacaggccctgagctgagccagctgacagccctgcggtctgtggagctggaggagagcagcacagatgaggacttcttccagagcagcacagaccccaaggacagcagcctgcccggggacctgcacgtgaccagcggccctgagagccccttcaacaacatcttcaatgatgtggacaagtctgaggacctgcccagccaccagaagatctttgacctgatggagctgaatggagtgcaggccgacttcaagccagccaccctgagcagcagcctggacaaccccaaggagagcgtcatcaccggccactttgagaaggagaagcccaggaagatctttgacagcgagcccctgtgcctgagtgacaacctgatgcaccaggacaactttgaccccctgaatgtgcaggagctgtctgagaacttcctgttcctgcaggagaagaacctgctgaagggcagcctgagcagcaaggagcacatcaatgacctgcagacagagctgaagaatgccggcttcacagaggccatgctggagaccagctgcaggaacagcctggacacagagctgcagtttgctgagaacaagccaggcctgagcctgctgcaggagaatgtgtccaccaagggagatgacacagatgtgatgctgactggagacaccctgagcaccagcctgcagagcagccctgaggtgcaggtgccccccaccagctttgaaacagaggagaccccaagaagagtgcccccagacagcctgcccacccagggcgagacccagcccacctgcctggatgtgattgtgcctgaggactgcctgcaccaggacatcagcccagatgctgtgacagtgcctgtggagatcctgagcacagatgcccggacccacagcctggacaacagaagccaggacagccctggagagagcgaggagaccctgcggctgacagaaagtgacagcgtgctggctgatgacatcctggccagccgggtgtctgtgggcagcagcctgcctgagctgggccaggagctgcacaacaagcccttcagcgaggaccaccacagccaccggcggctggagaagaacctggaggccgtggagaccctgaaccagctgaacagcaaggatgctgccaaggaggccggcctggtgtctgccctgagcagtgacagcaccagccaggacagcctgctggaggacagcctgagcgcccccttccctgccagcgagcccagcctggagaccccagacagcctggagagcgtggatgtgcatgaggccctgctggacagcctgggcagccacaccccccagaagctggtgcccccagacaagccagctgacagcggctatgaaacagagaacctggagagccctgagtggaccctgcacccagcccctgagggcacagctgacagcgagcccgccaccactggagatggcggccacagcggcctgccccccaaccctgtgattgtcatcagtgatgctggagatggccaccggggcacagaggtgaccccagagaccttcaccgctggcagccagggcagctacagagattctgcctacttcagtgacaatgattctgagcctgagaagaggtctgaggaggtgcccggcaccagccccagcgccctggtgctggtgcaggagcagcccctgcctgagcctgtgctgcctgagcagagccctgctgcccaggacagctgcctggaggccaggaagagccagccagatgagagctgcctgagcgccctgcacaacagcagtgacctggagctgcgggccaccccagagcccgcccagacaggagtgccccagcaggtgcaccccacagaagatgaggccagcagcccctggagcgtgctgaatgctgagctgagcagtggagatgactttgagacccaggatgaccggccctgcaccctggccagcacaggcaccaacaccaatgagctgctggcctacaccaacagcgccctggacaagagcctgagcagccacagcgagggccccaagctgaaggagccagacatcgagggcaagtacctgggcaagctgggcgtgtctggcatgctggacctgtctgaagatggcatggatgctgatgaagaagatgaaaattctgatgacagtgatgaggacctgcgggccttcaacctgcacagcctgagcagcgagagtgaagatgaaacagagcaccctgtgcccatcatcctgagcaatgaagatggccgccacctgcggagcctgctgaagcccacagctgccaatgccccagaccccctgcctgaggactggaagaaggagaagaaggctgtgaccttctttgatgatgtgacagtgtacctgtttgaccaggagacccccaccaaggagctgggcccctgtggcggggaggcctgtggccctgacctgagcggccctgccccagccagcggcagcccctacctgagccgctgcatcaacagcgagagcagcacagatgaggagggcggcggctttgagtgggatgatgacttctccccagaccccttcatgagcaagaccaccagcaacctgctgagcagcaagcccagcctgcagaccagcaagtacttcagccccccacctccagcccggagcacagagcagagctggccccacagcgccccctacagccgcttcagcatcagccctgccaacatcgccagcttcagcctgacccacctgacagacagcgacatcgagcagggcggcagcagtgaagatggagagaaggactag

SEQ ID NO: 157435 - DNA, 186 bp, Artificial Sequence
  Description of Artificial Sequence: Synthetic coding sequence
atgcagcccaggacccagcccctggcccagaccctgcccttcttcctgggcggggccccccgggacaccggcctgcgggtgcctgtgatcaagatgggcaccggctgggagggcttccagaggaccctgaaggaggtggcctacatcctgctgtgctgctggtgcatcaaggagctgctggactag

SEQ ID NO: 157436 - DNA, 186 bp, Artificial Sequence; identical to SEQ ID NO: 157435
  Description of Artificial Sequence: Synthetic coding sequence

SEQ ID NO: 157437 - DNA, 522 bp, Artificial Sequence
  Description of Artificial Sequence: Synthetic coding sequence
atgtacagcttcatgggcggcggcctcttctgtgcctgggtgggcaccatcctgctggtggtggccatggccacagaccactggatgcagtaccgcctgagcggcagctttgcccaccagggcctgtggagatactgcctgggcaacaagtgctacctgcagacagacagcatcgcctactggaatgccacccgggccttcatgatcctgagcgccctgtgtgccatcagcggcatcatcatgggcatcatggcctttgcccaccagcccaccttcagccgcatcagccggcccttctctgctggcatcatgttcttcagcagcaccctgtttgtggtgctggccctggccatctacacaggagtgacagtgtccttcctgggcagaagatttggagactggaggttctcctggagctacatcctgggctgggtggccgtgctgatgaccttctttgctggcatcttctacatgtgtgcctacagagtgcatgaatgtagaaggctgagcaccccaagatag

SEQ ID NO: 157438 - DNA, 681 bp, Artificial Sequence
  Description of Artificial Sequence: Synthetic coding sequence
atgcctgggggccctggggtgctgcaggccctgcctgccaccatcttcctgctcttcctgctgtctgctgtgtacctgggccctggctgccaggccctgtggatgcacaaggtgcctgccagcctgatggtgtccctgggggaggatgcccacttccagtgcccccacaacagcagcaacaatgccaacgtgacctggtggagggtgctgcacggcaactacacctggcccccagagttcctgggccctggagaggaccccaacggcaccctcatcatccagaatgtgaacaagagccacggcggcatctacgtgtgccgggtgcaggagggcaatgaaagctaccagcagagctgtggcacctacctgcgggtgcggcagcccccaccccggcccttcctggacatgggagagggcaccaagaaccgcatcatcacagctgagggcatcatcctgctcttctgtgctgtggtgcccggcaccctgctgctcttcaggaagcgctggcagaatgagaagctgggcctggatgctggagatgaatatgaagatgagaacctgtatgagggcctgaacctggatgactgcagcatgtatgaggacatcagccggggcctgcagggcacctaccaggatgtgggcagcctgaacattggagatgtgcagctggagaagccctag

SEQ ID NO: 157439 - DNA, 2001 bp, Artificial Sequence
  Description of Artificial Sequence: Synthetic coding sequence
atggctgacatggaggacctgtttggaagtgatgctgacagcgaggccgagaggaaggacagcgacagcggcagtgacagcgacagcgaccaggagaatgctgccagcggcagcaatgccagcggcagcgagagtgaccaggatgagcggggggacagcggccagcccagcaacaaggagctgtttggagatgacagtgaagatgagggcgccagccaccacagcggcagtgacaaccacagcgagaggagtgacaacagaagtgaggccagcgagaggagtgaccatgaagataatgaccccagtgatgtggaccagcacagcggcagcgaggccccaaatgatgatgaagatgagggccacagaagtgatggcggcagccaccacagcgaggccgagggcagcgagaaggcccacagtgatgatgagaagtggggccgggaggacaagagtgaccagagtgatgatgagaagatccagaacagtgatgatgaggagcgggcccagggcagtgatgaggacaagctgcagaacagtgatgatgatgagaagatgcagaacacagatgatgaggagcggccccagctgagtgatgatgagcggcagcagctgtctgaggaggagaaggccaacagtgatgatgagaggcctgtggccagtgacaatgatgatgagaagcagaacagtgatgatgaggagcagccccagctgagtgatgaggagaagatgcagaacagtgatgatgagcggccccaggccagtgatgaggagcaccgccacagtgatgatgaggaggagcaggaccacaagtctgagagcgcccggggcagtgacagtgaagatgaggtgctgaggatgaagaggaagaatgccatcgccagtgacagcgaggccgacagcgacacagaggtgcccaaggacaacagcggcaccatggacctgtttggaggagcagatgacatcagcagcggcagtgatggagaggacaagccacccaccccaggccagcctgtggatgaaaatggcctgccccaggaccagcaggaggaggagcccatccctgagacccgcatcgaggtggagatccccaaggtgaacacagacctgggcaatgacctgtactttgtgaagctgcccaacttcctgtctgtggagccccggccctttgacccccagtactatgaagatgaatttgaagatgaggagatgctggatgaggagggccgcacccggctgaagctgaaggtggagaacaccatccgctggaggatcagaagagatgaggagggcaatgagatcaaggagagcaatgcccgcatcgtgaagtggagcgatggctccatgagcctgcacctgggcaatgaggtgtttgatgtgtacaaggcccccctgcagggcgaccacaaccacctgttcatccggcagggcaccggcctgcagggccaggccgtgttcaagaccaagctgaccttccggccccacagcacagacagcgccacccacaggaagatgaccctgagcctggccgaccgctgcagcaagacccagaagatccgcatcctgcccatggccggccgggaccctgagtgccagaggacagagatgatcaagaaggaggaggagcggctgcgggccagcatccggcgggagagccagcagaggaggatgagggagaagcagcaccagaggggcctgagcgccagctacctggagccagacagatatgatgaggaggaggagggggaggagagcatcagcctggccgccatcaagaaccgctacaagggcggcatccgggaggagcgggcccgcatctacagcagtgacagtgatgagggcagcgaggaggacaaggcccagaggctgctgaaggccaagaagctgaccagtgatgaggagggggagcccagcggcaagaggaaggcagaagatgatgacaaggccaacaagaagcacaagaagtatgtgatcagtgatgaggaggaggaggatgatgactag

SEQ ID NO: 157440 - DNA, 1821 bp, Artificial Sequence
  Description of Artificial Sequence: Synthetic coding sequence
atggctgacatggaggacctgtttggaagtgatgctgacagcgaggccgagaggaaggacagcgacagcggcagtgacagcgacagcgaccaggagaatgctgccagcggcagcaatgccagcggcagcgagagtgaccaggatgagcggggggacagcggccagcccagcaacaaggagctgtttggagatgacagtgaagatgagggcgccagccaccacagcggcagtgacaaccacagcgagaggagtgacaacagaagtgaggccagcgagaggagtgaccatgaagataatgaccccagtgatgtggaccagcacagcggcagcgaggccccaaatgatgatgaagatgagggccacagaagtgatggcggcagccaccacagcgaggccgagggcagcgagaaggcccacagtgatgatgagaagtggggccgggaggacaagagtgaccagagtgatgatgagaagatccagaacagtgatgatgaggagcgggcccagggcagtgatgaggacaagctgcagaacagtgatgatgatgagaagatgcagaacacagatgatgaggagcggccccagctgagtgatgatgagcggcagcagctgtctgaggaggagaaggccaacagtgatgatgagaggcctgtggccagtgacaatgatgatgagaagcagaacagtgatgatgaggagcagccccagctgagtgatgaggagaagatgcagaacagtgatgatgagcggccccaggccagtgatgaggagcaccgccacagtgatgatgaggaggagcaggaccacaagtctgagagcgcccggggcagtgacagtgaagatgaggtgctgaggatgaagaggaagaatgccatcgccagtgacagcgaggccgacagcgacacagaggtgcccaaggacaacagcggcaccatggacctgtttggaggagcagatgacatcagcagcggcagtgatggagaggacaagccacccaccccaggccagcctgtggatgaaaatggcctgccccaggaccagcaggaggaggagcccatccctgagacccgcatcgaggtggagatccccaaggtgaacacagacctgggcaatgacctgtactttgtgaagctgcccaacttcctgtctgtggagcccagcatgagcctgcacctgggcaatgaggtgtttgatgtgtacaaggcccccctgcagggcgaccacaaccacctgttcatccggcagggcaccggcctgcagggccaggccgtgttcaagaccaagctgaccttccggccccacagcacagacagcgccacccacaggaagatgaccctgagcctggccgaccgctgcagcaagacccagaagatccgcatcctgcccatggccggccgggaccctgagtgccagaggacagagatgatcaagaaggaggaggagcggctgcgggccagcatccggcgggagagccagcagaggaggatgagggagaagcagcaccagaggggcctgagcgccagctacctggagccagacagatatgatgaggaggaggagggggaggagagcatcagcctggccgccatcaagaaccgctacaagggcggcatccgggaggagcgggcccgcatctacagcagtgacagtgatgagggcagcgaggaggacaaggcccagaggctgctgaaggccaagaagctgaccagtgatgaggagggggagcccagcggcaagaggaaggcagaagatgatgacaaggccaacaagaagcacaagaagtatgtgatcagtgatgaggaggaggaggatgatgactag

SEQ ID NO: 157441 - DNA, 1935 bp, Artificial Sequence
  Description of Artificial Sequence: Synthetic coding sequence
atggctgacatggaggacctgtttggaagtgatgctgacagcgaggccgagaggaaggacagcgacagcggcagtgacagcgacagcgaccaggagaatgctgccagcggcagcaatgccagcggcagcgagagtgaccaggatgagcggggggacagcggccagcccagcaacaaggagctgtttggagatgacagtgaagatgagggcgccagccaccacagcggcagtgacaaccacagcgagaggagtgacaacagaagtgaggccagcgagaggagtgaccatgaagataatgaccccagtgatgtggaccagcacagcggcagcgaggccccaaatgatgatgaagatgagggccacagaagtgatggcggcagccaccacagcgaggccgagggcagcgagaaggcccacagtgatgatgagaagtggggccgggaggacaagagtgaccagagtgatgatgagaagatccagaacagtgatgatgaggagcgggcccagggcagtgatgaggacaagctgcagaacagtgatgatgatgagaagatgcagaacacagatgatgaggagcggccccagctgagtgatgatgagcggcagcagctgtctgaggaggagaaggccaacagtgatgatgagaggcctgtggccagtgacaatgatgatgatgatgagcggccccaggccagtgatgaggagcaccgccacagtgatgatgaggaggagcaggaccacaagtctgagagcgcccggggcagtgacagtgaagatgaggtgctgaggatgaagaggaagaatgccatcgccagtgacagcgaggccgacagcgacacagaggtgcccaaggacaacagcggcaccatggacctgtttggaggagcagatgacatcagcagcggcagtgatggagaggacaagccacccaccccaggccagcctgtggatgaaaatggcctgccccaggaccagcaggaggaggagcccatccctgagacccgcatcgaggtggagatccccaaggtgaacacagacctgggcaatgacctgtactttgtgaagctgcccaacttcctgtctgtggagccccggccctttgacccccagtactatgaagatgaatttgaagatgaggagatgctggatgaggagggccgcacccggctgaagctgaaggtggagaacaccatccgctggaggatcagaagagatgaggagggcaatgagatcaaggagagcaatgcccgcatcgtgaagtggagcgatggctccatgagcctgcacctgggcaatgaggtgtttgatgtgtacaaggcccccctgcagggcgaccacaaccacctgttcatccggcagggcaccggcctgcagggccaggccgtgttcaagaccaagctgaccttccggccccacagcacagacagcgccacccacaggaagatgaccctgagcctggccgaccgctgcagcaagacccagaagatccgcatcctgcccatggccggccgggaccctgagtgccagaggacagagatgatcaagaaggaggaggagcggctgcgggccagcatccggcgggagagccagcagaggaggatgagggagaagcagcaccagaggggcctgagcgccagctacctggagccagacagatatgatgaggaggaggagggggaggagagcatcagcctggccgccatcaagaaccgctacaagggcggcatccgggaggagcgggcccgcatctacagcagtgacagtgatgagggcagcgaggaggacaaggcccagaggctgctgaaggccaagaagctgaccagtgatgaggagggggagcccagcggcaagaggaaggcagaagatgatgacaaggccaacaagaagcacaagaagtatgtgatcagtgatgaggaggaggaggatgatgactag

SEQ ID NO: 157442 - DNA, 2127 bp, Artificial Sequence
  Description of Artificial Sequence: Synthetic coding sequence
atgagggagcgcatctgggccccacccctgctgctgctgctgcccctgctgctgcccccacccctgtggggcggccccccagacagcccccggcgggagctggagctggagcccggccccctgcagccctttgacctgctgtatgccagcggggctgctgcctactacagcggggactatgaaagagctgtgcgggacctggaggccgccctgcggagccaccggcggctgcgggagatccgcacccgctgtgcccggcactgtgccgcccggcaccccctgcccccacctcctcctggagagggccctggagctgagctgcccctcttccgcagcctgctgggccgggcccgctgctaccgcagctgtgagacccagaggctgggcggccctgccagccgccaccgggtgtctgaagatgtgcggagtgacttccagaggagagtgccctacaactacctgcagagggcctacatcaagctgaaccagctggagaaggctgtggaggccgcccacaccttctttgtggccaaccctgagcacatggagatgcagcagaacatcgagaactaccgggccacagctggggtggaggccctgcagctggtggaccgggaggccaagccccacatggagagctacaatgctggggtgaagcactatgaagcagatgactttgagatggccatccgccactttgagcaggccctgcgggagtactttgtggaggacacagagtgcaggaccctgtgtgagggcccccagagatttgaggagtatgagtacctgggctacaaggccggcctgtatgaggccatcgctgaccactacatgcaggtgctggtgtgccagcatgaatgtgtgcgggagctggccaccaggcctggccgcctgagccccatcgagaacttcctgcccctgcactatgactacctgcagtttgcctactacagagtgggggagtatgtgaaggccctggagtgtgccaaggcctacctgctgtgccacccagatgatgaagatgtgctggacaacgtggactactatgagagcctgctggatgacagcattgatcctgccagcattgaggcccgggaggacctgaccatgtttgtgaagaggcacaagctggagagcgagctgatcaagtctgctgctgagggcctgggcttctcctacacagagcccaactactggatccgctatggaggccggcaggatgagaacagagtgcccagcggcgtgaatgtggagggcgctgaggtgcacggcttctccatgggcaagaagctgagccccaagattgaccgggacctgcgggagggcggccccctgctgtatgagaacatcacctttgtgtacaacagcgagcagctgaatggcacccagagggtgctgctggacaacgtgctgtctgaggagcagtgccgggagctgcacagcgtggccagcggcatcatgctggtgggagatggctaccggggcaagaccagcccccacaccccaaatgagaagtttgagggcgccaccgtgctgaaggccctgaagagcggctatgagggccgggtgcccctgaagagcgcccggctcttctatgacatcagcgagaaggccaggagaattgtggagagctacttcatgctgaacagcaccctgtacttctcctacacccacatggtgtgcaggacagccctgagcggccagcaggacagaagaaatgacctgagccaccccatccatgctgacaactgcctgctggaccctgaggccaatgaatgctggaaggagcccccagcctacaccttccgggactacagcgccctgctgtacatgaatgatgactttgaaggaggagagttcatcttcacagagatggatgccaagacagtgacagccagcatcaagcccaagtgtggccgcatgatctccttcagcagtggaggagagaacccccacggcgtgaaggctgtgaccaagggcaagagatgtgctgtggccctgtggttcaccctggaccccctgtaccgggagctggagcgcatccaggctgatgaggtgattgccatcctggaccaggagcagcagggcaagcatgagctgaacatcaaccccaaggatgagctgtag

SEQ ID NO: 157443 - DNA, 1584 bp, Artificial Sequence
  Description of Artificial Sequence: Synthetic coding sequence
atggagatgcagcagaacatcgagaactaccgggccacagctggggtggaggccctgcagctggtggaccgggaggccaagccccacatggagagctacaatgccggcgtgaagcactatgaagcagatgactttgagatggccatccgccactttgagcaggccctgcgggagtactttgtggaggacacagaatgtaggaccctgtgtgagggcccccagagatttgaggagtatgagtacctgggctacaaggccggcctgtatgaggccatcgctgaccactacatgcaggtgctggtgtgccagcatgaatgtgtgcgggagctggccacccggcccggccgcctgagccccatcgagaacttcctgcccctgcactatgactacctgcagtttgcctactacagagtgggggagtatgtgaaggccctggagtgtgccaaggcctacctgctgtgccacccagatgatgaagatgtgctggacaacgtggactactatgagagcctgctggatgacagcattgatcctgccagcattgaggcccgggaggacctgaccatgtttgtgaagaggcacaagctggagagcgagctgatcaagtctgctgctgagggcctgggcttctcctacacagagcccaactactggatccgctatggaggccggcaggatgaaaatagagtgcccagcggcgtgaatgtggagggcgctgaggtgcacggcttctccatgggcaagaagctgagccccaagattgaccgggacctgcgggagggcggccccctgctgtatgagaacatcacctttgtgtacaacagcgagcagctgaatggcacccagagggtgctgctggacaacgtgctgtctgaggagcagtgccgggagctgcacagcgtggccagcggcatcatgctggtgggagatggctaccggggcaagaccagcccccacaccccaaatgagaagtttgaaggagccaccgtgctgaaggccctgaagagcggctatgagggccgggtgcccctgaagagcgcccggctcttctatgacatcagcgagaaggcccggcgcatcgtggagagctacttcatgctgaacagcaccctgtacttctcctacacccacatggtgtgcaggacagccctgagcggccagcaggacagaagaaatgacctgagccaccccatccacgccgacaactgcctgctggaccctgaggccaatgaatgctggaaggagcccccagcctacaccttccgggactacagcgccctgctgtacatgaatgatgactttgagggcggggagttcatcttcacagagatggatgccaagacagtgacagccagcatcaagcccaagtgtggccgcatgatctccttcagcagtggaggagagaacccccatggagtgaaggctgtgaccaagggcaagagatgtgctgtggccctgtggttcaccctggaccccctgtaccgggagctggagcgcatccaggctgatgaagtcatcgccatcctggaccaggagcagcagggcaagcatgagctgaacatcaaccccaaggatgagctgtag

SEQ ID NO: 157444 - DNA, 2721 bp, Artificial Sequence
  Description of Artificial Sequence: Synthetic coding sequence
atgatctgccagaagttctgtgtggtgctgctgcactgggagttcatctacgtgatcacagccttcaacctgagctaccccatcaccccctggaggttcaagctgagctgcatgccacccaacagcacctatgactacttcctgctgcctgctggcctgagcaagaacaccagcaacagcaatggccactatgaaacagctgtggagcccaagttcaacagcagcggcacccacttcagcaacctgagcaagaccaccttccactgctgcttccgctctgagcaggacaggaactgcagcctgtgtgccgacaacatcgagggcaagacctttgtgtccacagtgaacagcctggtgttccagcagattgatgccaactggaacatccagtgctggctgaagggggacctgaagctgttcatctgctacgtggagagcctcttcaagaacctcttcaggaactacaactacaaggtgcacctgctgtatgtgctgcctgaggtgctggaggacagccccctggtgccccagaagggcagcttccagatggtgcactgcaactgcagcgtgcatgagtgctgtgaatgtctggtgcctgtgcccacagccaagctgaatgacaccctgctgatgtgcctgaagatcaccagcggaggagtcatcttccagagccccctgatgtctgtgcagcccatcaacatggtgaagccagacccccccctgggcctgcacatggagatcacagatgatggcaacctgaagatctcctggagcagcccccccctggtgcccttccccctgcagtaccaggtgaagtacagcgagaacagcaccaccgtcatccgggaggccgacaagatcgtgtctgccaccagcctgctggtggacagcatcctgcccggcagcagctatgaggtgcaggtgcggggcaagaggctggatggccctggcatctggagcgactggagcacccccagggtcttcaccacccaggacgtcatctacttcccccccaagatcctgacctctgtgggcagcaatgtgtccttccactgcatctacaagaaggagaacaagatcgtgcccagcaaggagatcgtgtggtggatgaacctggccgagaagatcccccagagccagtatgatgtggtgtctgaccacgtgtccaaggtgaccttcttcaacctgaatgagaccaagccccggggcaagttcacctatgatgctgtgtactgctgcaatgaacatgagtgccaccacagatatgcagagctgtatgtgattgatgtgaacatcaacatcagctgtgaaacagatggctacctgaccaagatgacctgccgctggagcaccagcaccatccagagcctggccgagagcaccctgcagctgcgctaccacaggagcagcctgtactgcagcgacatccccagcatccaccccatcagcgagcccaaggactgctacctgcagagtgatggcttctatgagtgcatcttccagcccatcttcctgctgagcggctacaccatgtggatccgcatcaaccacagcctgggcagcctggacagcccccccacctgtgtgctgcctgattctgtggtgaagcccctgccccccagctctgtgaaggccgagatcaccatcaacatcggcctgctgaagatctcctgggagaagcctgtgtttcctgagaacaacctgcagttccagatccgctatggcctgagcggcaaggaggtgcagtggaagatgtatgaggtgtatgatgccaagagcaagtctgtgtccctgcctgtgcctgacctgtgtgctgtgtatgctgtgcaggtgcgctgcaagaggctggatggcctgggctactggagcaactggagcaacccagcctacacagtggtgatggacatcaaggtgcccatgaggggccctgagttctggaggatcatcaacggggacaccatgaagaaggagaagaatgtgaccctgctgtggaagcccctgatgaagaatgacagcctgtgcagcgtgcagagatatgtgatcaaccaccacaccagctgcaatggcacctggagcgaagatgtgggcaaccacaccaagttcaccttcctgtggacagagcaggcccacacagtgacagtgctggccatcaacagcatcggggcctctgtggccaacttcaacctgaccttctcctggcccatgagcaaggtgaacatcgtgcagagcctgagcgcctaccccctgaacagcagctgtgtgattgtgtcctggatcctgagccccagcgactacaagctgatgtacttcatcatcgagtggaagaacctgaatgaagatggagagatcaagtggctgcgcatcagcagctctgtgaagaagtactacatccatgaccacttcatccccatcgagaagtaccagttcagcctgtaccccatcttcatggagggcgtgggcaagcccaagatcatcaacagcttcacccaggatgacatcgagaagcaccagagtgatgctggcctgtatgtgattgtgcctgtgatcatcagcagcagcatcctgctgctgggcaccctgctgatcagccaccagaggatgaagaagctgttctgggaggatgtgcccaaccccaagaactgctcctgggcccagggcctgaacttccagaagaagatgcctggcaccaaggagctgctgggcggcggctggctgacctag

SEQ ID NO: 157445 - DNA, 3498 bp, Artificial Sequence
  Description of Artificial Sequence: Synthetic coding sequence
atgatctgccagaagttctgtgtggtgctgctgcactgggagttcatctacgtgatcacagccttcaacctgagctaccccatcaccccctggaggttcaagctgagctgcatgccacccaacagcacctatgactacttcctgctgcctgctggcctgagcaagaacaccagcaacagcaatggccactatgaaacagctgtggagcccaagttcaacagcagcggcacccacttcagcaacctgagcaagaccaccttccactgctgcttccgctctgagcaggacaggaactgcagcctgtgtgccgacaacatcgagggcaagacctttgtgtccacagtgaacagcctggtgttccagcagattgatgccaactggaacatccagtgctggctgaagggggacctgaagctgttcatctgctacgtggagagcctcttcaagaacctcttcaggaactacaactacaaggtgcacctgctgtatgtgctgcctgaggtgctggaggacagccccctggtgccccagaagggcagcttccagatggtgcactgcaactgcagcgtgcatgagtgctgtgaatgtctggtgcctgtgcccacagccaagctgaatgacaccctgctgatgtgcctgaagatcaccagcggaggagtcatcttccagagccccctgatgtctgtgcagcccatcaacatggtgaagccagacccccccctgggcctgcacatggagatcacagatgatggcaacctgaagatctcctggagcagcccccccctggtgcccttccccctgcagtaccaggtgaagtacagcgagaacagcaccaccgtcatccgggaggccgacaagatcgtgtctgccaccagcctgctggtggacagcatcctgcccggcagcagctatgaggtgcaggtgcggggcaagaggctggatggccctggcatctggagcgactggagcacccccagggtcttcaccacccaggacgtcatctacttcccccccaagatcctgacctctgtgggcagcaatgtgtccttccactgcatctacaagaaggagaacaagatcgtgcccagcaaggagatcgtgtggtggatgaacctggccgagaagatcccccagagccagtatgatgtggtgtctgaccacgtgtccaaggtgaccttcttcaacctgaatgagaccaagccccggggcaagttcacctatgatgctgtgtactgctgcaatgaacatgagtgccaccacagatatgcagagctgtatgtgattgatgtgaacatcaacatcagctgtgaaacagatggctacctgaccaagatgacctgccgctggagcaccagcaccatccagagcctggccgagagcaccctgcagctgcgctaccacaggagcagcctgtactgcagcgacatccccagcatccaccccatcagcgagcccaaggactgctacctgcagagtgatggcttctatgagtgcatcttccagcccatcttcctgctgagcggctacaccatgtggatccgcatcaaccacagcctgggcagcctggacagcccccccacctgtgtgctgcctgattctgtggtgaagcccctgccccccagctctgtgaaggccgagatcaccatcaacatcggcctgctgaagatctcctgggagaagcctgtgtttcctgagaacaacctgcagttccagatccgctatggcctgagcggcaaggaggtgcagtggaagatgtatgaggtgtatgatgccaagagcaagtctgtgtccctgcctgtgcctgacctgtgtgctgtgtatgctgtgcaggtgcgctgcaagaggctggatggcctgggctactggagcaactggagcaacccagcctacacagtggtgatggacatcaaggtgcccatgaggggccctgagttctggaggatcatcaacggggacaccatgaagaaggagaagaatgtgaccctgctgtggaagcccctgatgaagaatgacagcctgtgcagcgtgcagagatatgtgatcaaccaccacaccagctgcaatggcacctggagcgaagatgtgggcaaccacaccaagttcaccttcctgtggacagagcaggcccacacagtgacagtgctggccatcaacagcatcggggcctctgtggccaacttcaacctgaccttctcctggcccatgagcaaggtgaacatcgtgcagagcctgagcgcctaccccctgaacagcagctgtgtgattgtgtcctggatcctgagccccagcgactacaagctgatgtacttcatcatcgagtggaagaacctgaatgaagatggagagatcaagtggctgcgcatcagcagctctgtgaagaagtactacatccatgaccacttcatccccatcgagaagtaccagttcagcctgtaccccatcttcatggagggcgtgggcaagcccaagatcatcaacagcttcacccaggatgacatcgagaagcaccagagtgatgctggcctgtatgtgattgtgcctgtgatcatcagcagcagcatcctgctgctgggcaccctgctgatcagccaccagaggatgaagaagctgttctgggaggatgtgcccaaccccaagaactgctcctgggcccagggcctgaacttccagaagccagagacctttgagcacctgttcatcaagcacacagcctctgtgacctgtggccccctgctgctggagcctgagaccatcagcgaggacatctctgtggacacctcctggaagaacaaggatgagatgatgcccaccaccgtggtgtccctgctgagcaccacagacctggagaagggctctgtgtgcatcagtgaccagttcaacagcgtgaacttcagcgaggccgagggcacagaggtgacctatgaagatgagagccagaggcagccctttgtgaagtatgccaccctcatcagcaacagcaagcccagcgagaccggggaggagcagggcctcatcaacagctctgtgaccaagtgcttcagcagcaagaacagccccctgaaggacagcttcagcaacagctcctgggagattgaggcccaggccttcttcatcctgagtgaccagcaccccaacatcatcagcccccacctgaccttcagcgagggcctggatgagctgctgaagctggagggcaacttccctgaggagaacaatgacaagaagagcatctactacctgggcgtgaccagcatcaagaagcgggagagcggcgtgctgctgacagacaagagccgggtgtcctgccccttccctgccccctgcctcttcacagacatccgggtgctgcaggacagctgcagccactttgtggagaacaacatcaacctgggcaccagcagcaagaagacctttgccagctacatgccccagttccagacctgcagcacccagacccacaagatcatggagaacaagatgtgtgacctgactgtgtag

SEQ ID NO: 157446 - DNA, 2721 bp, Artificial Sequence; identical to SEQ ID NO: 157444
  Description of Artificial Sequence: Synthetic coding sequence

SEQ ID NO: 157447 - DNA, 2877 bp, Artificial Sequence
  Description of Artificial Sequence: Synthetic coding sequence
atgatctgccagaagttctgtgtggtgctgctgcactgggagttcatctacgtgatcacagccttcaacctgagctaccccatcaccccctggaggttcaagctgagctgcatgccacccaacagcacctatgactacttcctgctgcctgctggcctgagcaagaacaccagcaacagcaatggccactatgaaacagctgtggagcccaagttcaacagcagcggcacccacttcagcaacctgagcaagaccaccttccactgctgcttccgctctgagcaggacaggaactgcagcctgtgtgccgacaacatcgagggcaagacctttgtgtccacagtgaacagcctggtgttccagcagattgatgccaactggaacatccagtgctggctgaagggggacctgaagctgttcatctgctacgtggagagcctcttcaagaacctcttcaggaactacaactacaaggtgcacctgctgtatgtgctgcctgaggtgctggaggacagccccctggtgccccagaagggcagcttccagatggtgcactgcaactgcagcgtgcatgagtgctgtgaatgtctggtgcctgtgcccacagccaagctgaatgacaccctgctgatgtgcctgaagatcaccagcggaggagtcatcttccagagccccctgatgtctgtgcagcccatcaacatggtgaagccagacccccccctgggcctgcacatggagatcacagatgatggcaacctgaagatctcctggagcagcccccccctggtgcccttccccctgcagtaccaggtgaagtacagcgagaacagcaccaccgtcatccgggaggccgacaagatcgtgtctgccaccagcctgctggtggacagcatcctgcccggcagcagctatgaggtgcaggtgcggggcaagaggctggatggccctggcatctggagcgactggagcacccccagggtcttcaccacccaggacgtcatctacttcccccccaagatcctgacctctgtgggcagcaatgtgtccttccactgcatctacaagaaggagaacaagatcgtgcccagcaaggagatcgtgtggtggatgaacctggccgagaagatcccccagagccagtatgatgtggtgtctgaccacgtgtccaaggtgaccttcttcaacctgaatgagaccaagccccggggcaagttcacctatgatgctgtgtactgctgcaatgaacatgagtgccaccacagatatgcagagctgtatgtgattgatgtgaacatcaacatcagctgtgaaacagatggctacctgaccaagatgacctgccgctggagcaccagcaccatccagagcctggccgagagcaccctgcagctgcgctaccacaggagcagcctgtactgcagcgacatccccagcatccaccccatcagcgagcccaaggactgctacctgcagagtgatggcttctatgagtgcatcttccagcccatcttcctgctgagcggctacaccatgtggatccgcatcaaccacagcctgggcagcctggacagcccccccacctgtgtgctgcctgattctgtggtgaagcccctgccccccagctctgtgaaggccgagatcaccatcaacatcggcctgctgaagatctcctgggagaagcctgtgtttcctgagaacaacctgcagttccagatccgctatggcctgagcggcaaggaggtgcagtggaagatgtatgaggtgtatgatgccaagagcaagtctgtgtccctgcctgtgcctgacctgtgtgctgtgtatgctgtgcaggtgcgctgcaagaggctggatggcctgggctactggagcaactggagcaacccagcctacacagtggtgatggacatcaaggtgcccatgaggggccctgagttctggaggatcatcaacggggacaccatgaagaaggagaagaatgtgaccctgctgtggaagcccctgatgaagaatgacagcctgtgcagcgtgcagagatatgtgatcaaccaccacaccagctgcaatggcacctggagcgaagatgtgggcaaccacaccaagttcaccttcctgtggacagagcaggcccacacagtgacagtgctggccatcaacagcatcggggcctctgtggccaacttcaacctgaccttctcctggcccatgagcaaggtgaacatcgtgcagagcctgagcgcctaccccctgaacagcagctgtgtgattgtgtcctggatcctgagccccagcgactacaagctgatgtacttcatcatcgagtggaagaacctgaatgaagatggagagatcaagtggctgcgcatcagcagctctgtgaagaagtactacatccatgaccacttcatccccatcgagaagtaccagttcagcctgtaccccatcttcatggagggcgtgggcaagcccaagatcatcaacagcttcacccaggatgacatcgagaagcaccagagtgatgctggcctgtatgtgattgtgcctgtgatcatcagcagcagcatcctgctgctgggcaccctgctgatcagccaccagaggatgaagaagctgttctgggaggatgtgcccaaccccaagaactgctcctgggcccagggcctgaacttccagaagatgctggagggctccatgtttgtgaagagccaccaccacagcctcatcagcagcacccagggccacaagcactgcggccggccccagggccccctgcacaggaagacccgggacctgtgcagcctggtgtacctgctgaccctgccccccctgctgtcctatgaccctgccaagagccccagcgtgaggaacacccaggagtag

SEQ ID NO: 157448 - DNA, 2691 bp, Artificial Sequence
  Description of Artificial Sequence: Synthetic coding sequence
atgatctgccagaagttctgtgtggtgctgctgcactgggagttcatctacgtgatcacagccttcaacctgagctaccccatcaccccctggaggttcaagctgagctgcatgccacccaacagcacctatgactacttcctgctgcctgctggcctgagcaagaacaccagcaacagcaatggccactatgaaacagctgtggagcccaagttcaacagcagcggcacccacttcagcaacctgagcaagaccaccttccactgctgcttccgctctgagcaggacaggaactgcagcctgtgtgccgacaacatcgagggcaagacctttgtgtccacagtgaacagcctggtgttccagcagattgatgccaactggaacatccagtgctggctgaagggggacctgaagctgttcatctgctacgtggagagcctcttcaagaacctcttcaggaactacaactacaaggtgcacctgctgtatgtgctgcctgaggtgctggaggacagccccctggtgccccagaagggcagcttccagatggtgcactgcaactgcagcgtgcatgagtgctgtgaatgtctggtgcctgtgcccacagccaagctgaatgacaccctgctgatgtgcctgaagatcaccagcggaggagtcatcttccagagccccctgatgtctgtgcagcccatcaacatggtgaagccagacccccccctgggcctgcacatggagatcacagatgatggcaacctgaagatctcctggagcagcccccccctggtgcccttccccctgcagtaccaggtgaagtacagcgagaacagcaccaccgtcatccgggaggccgacaagatcgtgtctgccaccagcctgctggtggacagcatcctgcccggcagcagctatgaggtgcaggtgcggggcaagaggctggatggccctggcatctggagcgactggagcacccccagggtcttcaccacccaggacgtcatctacttcccccccaagatcctgacctctgtgggcagcaatgtgtccttccactgcatctacaagaaggagaacaagatcgtgcccagcaaggagatcgtgtggtggatgaacctggccgagaagatcccccagagccagtatgatgtggtgtctgaccacgtgtccaaggtgaccttcttcaacctgaatgagaccaagccccggggcaagttcacctatgatgctgtgtactgctgcaatgaacatgagtgccaccacagatatgcagagctgtatgtgattgatgtgaacatcaacatcagctgtgaaacagatggctacctgaccaagatgacctgccgctggagcaccagcaccatccagagcctggccgagagcaccctgcagctgcgctaccacaggagcagcctgtactgcagcgacatccccagcatccaccccatcagcgagcccaaggactgctacctgcagagtgatggcttctatgagtgcatcttccagcccatcttcctgctgagcggctacaccatgtggatccgcatcaaccacagcctgggcagcctggacagcccccccacctgtgtgctgcctgattctgtggtgaagcccctgccccccagctctgtgaaggccgagatcaccatcaacatcggcctgctgaagatctcctgggagaagcctgtgtttcctgagaacaacctgcagttccagatccgctatggcctgagcggcaaggaggtgcagtggaagatgtatgaggtgtatgatgccaagagcaagtctgtgtccctgcctgtgcctgacctgtgtgctgtgtatgctgtgcaggtgcgctgcaagaggctggatggcctgggctactggagcaactggagcaacccagcctacacagtggtgatggacatcaaggtgcccatgaggggccctgagttctggaggatcatcaacggggacaccatgaagaaggagaagaatgtgaccctgctgtggaagcccctgatgaagaatgacagcctgtgcagcgtgcagagatatgtgatcaaccaccacaccagctgcaatggcacctggagcgaagatgtgggcaaccacaccaagttcaccttcctgtggacagagcaggcccacacagtgacagtgctggccatcaacagcatcggggcctctgtggccaacttcaacctgaccttctcctggcccatgagcaaggtgaacatcgtgcagagcctgagcgcctaccccctgaacagcagctgtgtgattgtgtcctggatcctgagccccagcgactacaagctgatgtacttcatcatcgagtggaagaacctgaatgaagatggagagatcaagtggctgcgcatcagcagctctgtgaagaagtactacatccatgaccacttcatccccatcgagaagtaccagttcagcctgtaccccatcttcatggagggcgtgggcaagcccaagatcatcaacagcttcacccaggatgacatcgagaagcaccagagtgatgctggcctgtatgtgattgtgcctgtgatcatcagcagcagcatcctgctgctgggcaccctgctgatcagccaccagaggatgaagaagctgttctgggaggatgtgcccaaccccaagaactgctcctgggcccagggcctgaacttccagaagaggacagacatcctgtag

SEQ ID NO: 157449 - DNA, 699 bp, Artificial Sequence
  Description of Artificial Sequence: Synthetic coding sequence
atgatgcccaccaccgtggtgtccctgctgagcaccacagacctggagaagggctctgtgtgcatcagtgaccagttcaacagcgtgaacttcagcgaggccgagggcacagaggtgacctatgaagatgagagccagaggcagccctttgtgaagtatgccaccctcatcagcaacagcaagcccagcgagactggagaggagcagggcctcatcaacagctctgtgaccaagtgcttcagcagcaagaacagccccctgaaggacagcttcagcaacagctcctgggagattgaggcccaggccttcttcatcctgagtgaccagcaccccaacatcatcagcccccacctgaccttcagcgagggcctggatgagctgctgaagctggagggcaacttcccagaagaaaataatgacaagaagagcatctactacctgggcgtgaccagcatcaagaagcgggagagcggcgtgctgctgacagacaagagccgggtgtcctgccccttccctgccccctgcctcttcacagacatccgggtgctgcaggacagctgcagccactttgtggagaacaacatcaacctgggcaccagcagcaagaagacctttgccagctacatgccccagttccagacctgcagcacccagacccacaagatcatggagaacaagatgtgtgacctgactgtgtag

SEQ ID NO: 157450 - DNA, 396 bp, Artificial Sequence
  Description of Artificial Sequence: Synthetic coding sequence
atggccggcgtgaaggccctggtggccctgtccttcagcggggccatcggcctgaccttcctgatgctgggctgtgccctggaggactatggagtgtactggcccctgtttgtgctgatcttccacgccatcagccccatcccccacttcatcgccaagagggtgacctatgacagtgatgccaccagcagcgcctgccgggagctggcctacttcttcaccactggaattgtggtgtctgccttcggcttccctgtgatcctggcccgggtggccgtcatcaagtggggcgcctgtggcctggtgctggccggaaatgctgtgatcttcctgaccatccagggcttcttcctgatcttcggcagaggagatgacttctcctgggagcagtggtag

SEQ ID NO: 157451 - DNA, 396 bp, Artificial Sequence
  Description of Artificial Sequence: Synthetic coding sequence
atggccggcatcaaggccctgatcagcctgagctttggaggagccatcggcctgatgttcctgatgctgggctgtgccctgcccatctacaacaagtactggcccctgtttgtgctcttcttctacatcctgagccccatcccctactgcatcgcccggcggctggtggatgacacagatgccatgagcaatgcctgcaaggagctggccatcttcctgaccactggaattgtggtgtctgccttcggcctgcccatcgtgtttgcccgggcccacctgattgagtggggcgcctgtgccctggtgctgaccggcaacacagtcatctttgccaccatcctgggcttcttcctggtgtttggcagcaatgatgacttctcctggcagcagtggtag

SEQ ID NO: 157452 - DNA, 510 bp, Artificial Sequence
  Description of Artificial Sequence: Synthetic coding sequence
atggccggcatcaaggccctgatcagcctgagctttggaggagccatcggcctgatgttcctgatgctgggctgtgccctgcccatctacaacaagtactggcccctgtttgtgctcttcttctacatcctgagccccatcccctactgcatcgcccggcggctggtggatgacacagatgccatgagcaatgcctgcaaggagctggccatcttcctgaccactggaattgtggtgtctgccttcggcctgcccatcgtgtttgcccgggcccacctgatgggccgcctgcccttcttcagcaagatgggcacagctgagagcgagggccgggagaccctgacccagcagctgcccctgcctgctgctgccatgaggcggctgctgcctgccagccgggtgtccacccagcctgtgctgcggctggccgacagcgctgagagcctgctgggccgcccagccctgtgggccctgggcttcctgctgtgcccccccagccaggcccagtag

SEQ ID NO: 157453 - DNA, 3195 bp, Artificial Sequence
  Description of Artificial Sequence: Synthetic coding sequence
atgatgaagttccgcttccggcggcagggcgctgacccccagcgggagaagctgaagcaggagctgtttgccttcaacaagacagtggagcacggcttccccaaccagcccagcgccctggcctttgatcctgagctgcgcatcatggccatcggcaccaggtctggagctgtgaagatctatggagcccctggggtggagttcaccggcctgcacagagatgctgccaccgtgacccagatgcacttcctgaccggccagggccgcctgctgagcctgctggatgacagcagcctgcacctgtgggagatcgtgcaccacaacggctgtgcccacctggaggaggccctgtccttccagctgcccagcaggcctggctttgatggagccagcgcccccctgagcctgaccagggtgacagtggtgctgctggtggccgccagtgacattgctgccctgggcacagagggcagctctgtgttcttcctggatgtgaccaccctgaccctgctggagggccagaccctggcccctggagaggtgctgcggtctgtgcctgatgactaccgctgtgggaaggccctgggccctgtggagagcctgcagggccacctgcgggaccccaccaagatcctgattggctacagccggggcctgctggtgatctggaaccaggccagccagtgtgtggaccacatcttcctgggcaaccagcagctggagagcctgtgctggggccgggacagcagcacagtggtgagcagccacagtgatggcagctatgctgtgtggagcgtggatgctggcagcttccccaccctgcagcccaccgtggccaccaccccctacggccccttcccctgcaaggccatcaacaagatcctgtggaggaactgtgagagcggcggccacttcatcatcttcagcggcggcatgccccgggccagctatggagacagacactgtgtgtctgtgctgcgggcagagaccctggtgaccctggacttcaccagccgcatcatcgacttcttcaccgtgcacagcaccaggccagaagatgaatttgatgacccccaggccctggccgtgctgctggaggaggagctggtggtgctggacctgcagaccccaggctggccagctgtgcctgccccctacctggcccccctgcacagcagcgccatcacctgcagcgcccacgtggcctctgtgcctgccaagctgtgggcccgcatcgtgtctgctggggagcagcagagcccccagcctgtgagcagcgccctgtcctggcccatcactggaggcaggaacctggcccaggagcccagccagaggggcctgctgctgaccggccatgaagatggcaccgtgcgcttctgggatgccagcggcgtggccctgcggcccctgtacaagctgagcacagctggcctcttccagacagactgtgaacatgctgacagcctggcccaggccgcagaagatgactggccacccttcaggaaggtgggctgctttgacccctacagtgatgacccccggctgggcgtgcagaaggtggccctgtgcaagtacacagcccagatggtggtggccggcacagctggccaggtgctggtgctggagctgagtgatgtgcctgtggagcaggccgtgtctgtggccatcatcgacctgctgcaggaccgggagggcttcacctggaagggccacgagcggctgagccccaggacaggccccctgccctggccagctggcttccagccccgggtgctggtgcagtgcctgcccccagctgctgtgacagctgtgaccctgcacacagagtggagcctggtggccttcggcaccagccacggcttcggcctgtttgactaccagaggaagagccctgtgctggcccgctgcaccctgcaccccaatgacagcctggccatggagggccccctgagccgggtgaagagcctgaagaagagcctgcggcagagcttccgccgcatcaggaagagccgggtgtctgggaagaagagagctgccaatgccagcagcaagctgcaggaggccaatgcccagctggccgagcaggcctgcccccatgatgtggagatgacccctgtgcagaggcgcatcgagcccaggtctgcagatgacagcctgagcggcgtggtgcgctgcctgtactttgctgacaccttcctgagagatggagcccaccacggccccaccatgtgggccggcaccaacagcggctctgtgtttgcctatgccctggaggtgcctgctgctgctgtgggcggggagaagaggcctgagcaggccgtggaggccgtgctgggcaaggaggtgcagctgatgcaccgggcccctgtggtggccatcgctgtgctggatggccggggccggcccctgcctgagccctatgaggccagccgggacctggcccaggccccagacatgcagggcggccatgctgtgctgattgccagcgaggagcagttcaaggtgttcaccctgcccaaggtgtctgccaagaccaagttcaagctgacagcccacgagggctgccgggtgaggaaggtggccctggccacctttgcctctgtggcctgtgaagattatgcagagacctgcctggcctgcctgaccaacctgggagatgtgcacgtgttttctgtgcccggcctgcggccccaggtgcactacagctgcatcagaaaagaagacatcagcggcatcgccagctgtgtgttcaccaggcatggccagggcttctacctgatcagccccagcgagtttgagcgcttcagcctgagcgccaggaacatcacagagcccctgtgcagcctggacatcaactggcccagagatgccacccaggccagctaccgcatccgggagagccccaagctgagccaggccaacggcacccccagcatcctgctggccccccagagcctggatggcagcccagaccctgcccacagcatgggccctgacaccccagagcccccagaggccgccctgagccccatgagcattgattctgccaccagcgctgacaccaccctggacaccactggagatgtgacagtggaggatgtgaaggacttcctgggcagcagcgaggagagcgagaagaacctgaggaacctggctgaagatgaggcccacgcctgtgccatcctgatcaagtag

SEQ ID NO: 157454 - DNA, 1056 bp, Artificial Sequence
  Description of Artificial Sequence: Synthetic coding sequence
gagctgcccagcgctgccccagacagcaccctgctgctgacagcccagcactgggtggccaacctcttcatcctggccaccctgattggctggacagtgcgctccttcttcctgggccgcatggagacctgctgcagccacctgggcctgcggagcggccgccgctttgctgtgtccatcggctactggcatgacccctacatccagcactttgtgcggctgagcaaggagaggaaggcccctgagatcaacagaggctactttgcccgggtgcacggcgtgtcccagctgatcaaggccttcctgaggaagacagagtgccactgccagatcgtgaacctgggcgccggcatggacaccaccttctggaggctgaaggatgaggacctgctgcccagcaagtactttgaggtggacttccccatgattgtgaccaggaagctgcacagcatcaagtgcaagccacccctgagcagccccatcctggagctgcacagcgaggacaccctgcagatggatggccacatcctggacagcaagagatatgctgtgattggagctgacctgcgggacctgtctgagctggaggagaagctgaagaagtgcaacatgaacacccagctgcccaccctgctgattgctgaatgtgtgctggtgtacatgaccccagagcagagcgccaacctgctgaagtgggccgccaacagctttgagcgggccatgttcatcaactatgagcaggtgaacatgggagaccgcttcggccagatcatgattgagaacctgcggcggcggcagtgtgacctggccggcgtggagacctgcaagagcctggagagccagaaggagcggctgctgagcaatggctgggagacagccagcgctgtggacatgatggagctgtacaaccggctgcccagggctgaggtgtccagaattgagagcctggagttcctggatgagatggagctgctggagcagctgatgaggcactactgcctgtgctgggccaccaagggcggcaatgagctgggcctgaaggagatcacctactag

SEQ ID NO: 157455 - DNA, 840 bp, Artificial Sequence
  Description of Artificial Sequence: Synthetic coding sequence
atggccacccggcagcgggagagcagcatcaccagctgctgcagcaccagcagctgtgatgctgatgatgaaggagtgcggggcacctgtgaagatgccagcctgtgcaagagatttgctgtgtccatcggctactggcatgacccctacatccagcactttgtgcggctgagcaaggagaggaaggcccctgagatcaacagaggctactttgcccgggtgcatggagtgtcccagctgatcaaggccttcctgaggaagacagagtgccactgccagatcgtgaacctgggcgccggcatggacaccaccttctggaggctgaaggatgaggacctgctgcccagcaagtactttgaggtggacttccccatgattgtgaccaggaagctgcacagcatcaagctgcccaccctgctgattgctgaatgtgtgctggtgtacatgaccccagagcagagcgccaacctgctgaagtgggccgccaacagctttgagcgggccatgttcatcaactatgagcaggtgaacatgggagaccgcttcggccagatcatgattgagaacctgcggcggcggcagtgtgacctggccggcgtggagacctgcaagagcctggagagccagaaggagcggctgctgagcaatggctgggagacagccagcgctgtggacatgatggagctgtacaaccggctgcccagggctgaggtgtccagaattgagagcctggagttcctggatgagatggagctgctggagcagctgatgaggcactactgcctgtgctgggccaccaagggcggcaatgagctgggcctgaaggagatcacctactag

SEQ ID NO: 157456 - DNA, 1005 bp, Artificial Sequence
  Description of Artificial Sequence: Synthetic coding sequence
atggccacccggcagcgggagagcagcatcaccagctgctgcagcaccagcagctgtgatgctgatgatgaaggagtgcggggcacctgtgaagatgccagcctgtgcaagagatttgctgtgtccatcggctactggcatgacccctacatccagcactttgtgcggctgagcaaggagaggaaggcccctgagatcaacagaggctactttgcccgggtgcatggagtgtcccagctgatcaaggccttcctgaggaagacagagtgccactgccagatcgtgaacctgggcgccggcatggacaccaccttctggaggctgaaggatgaggacctgctgcccagcaagtactttgaggtggacttccccatgattgtgaccaggaagctgcacagcatcaagtgcaagccacccctgagcagccccatcctggagctgcacagcgaggacaccctgcagatggatggccacatcctggacagcaagagatatgctgtgattggagctgacctgcgggacctgtctgagctggaggagaagctgaagaagtgcaacatgaacacccagctgcccaccctgctgattgctgaatgtgtgctggtgtacatgaccccagagcagagcgccaacctgctgaagtgggccgccaacagctttgagcgggccatgttcatcaactatgagcaggtgaacatgggagacagatttggccagatcatgattgagaacctgcggcggcggcagtgtgacctggccggcgtggagacctgcaagagcctggagagccagaaggagcggctgctgagcaatggctgggagacagccagcgctgtggacatgatggagctgtacaaccggctgcccagggctgaggtgagccgcatcgagagcctggagttcctggatgagatggagctgctggagcagctgatgaggcactactgcctgtgctgggccaccaagggcggcaatgagctgggcctgaaggagatcacctactag

SEQ ID NO: 157457 - DNA, 2415 bp, Artificial Sequence
  Description of Artificial Sequence: Synthetic coding sequence
atggctgtgcgggccctgaagctgctgaccaccctgctggccgtggtggccgccgccagccaggccgaggtggagagcgaggccggctggggcatggtgaccccagacctgctgtttgctgagggcacagctgcctatgcccggggggactggccaggagtggtgctgtccatggagcgggccctgcggagccgggccgccctgcgggccctgcggctgcgctgcaggacccagtgtgccgctgacttcccctgggagctggaccctgactggagccccagccctgcccaggccagcggggccgccgccctgcgggacctgtccttcttcggcggcctgctgcggcgggccgcctgcctgcggcgctgcctgggccccccagctgcccacagcctgtctgaggagatggagctggagttcaggaagaggagcccctacaactacctgcaggtggcctacttcaagatcaacaagctggagaaggctgtggccgccgcccacaccttctttgtgggcaaccctgagcacatggagatgcagcagaacctggactactaccagaccatgtctggagtgaaggaggccgacttcaaggacctggagacccagccccacatgcaggagttccggctgggcgtgcggctgtacagcgaggagcagccccaggaggccgtgccccacctggaggccgccctgcaggagtactttgtggcctatgaagaatgtcgggccctgtgtgagggcccctatgactatgatggctacaactacctggagtacaatgctgacctcttccaggccatcacagaccactacatccaggtgctgaactgcaagcagaactgtgtgacagagctggccagccaccccagccgggagaagccctttgaggacttcctgcccagccactacaactacctgcagtttgcctactacaacatcggcaactacacccaggccgtggagtgtgccaagacctacctgctcttcttccccaatgatgaggtgatgaaccagaacctggcctactatgctgccatgctgggggaggagcacaccaggagcatcggcccccgggagagcgccaaggagtaccggcagaggagcctgctggagaaggagctgctcttctttgcctatgatgtgtttggcatcccctttgtggaccctgacagctggaccccagaggaggtgatccccaagaggctgcaggagaagcagaagtctgagcgggagacagctgtgcgcatcagccaggagatcggcaacctgatgaaggagattgagaccctggtggaggagaagaccaaggagagcctggatgtgtcccggctgacccgggagggcggccccctgctgtatgagggcatcagcctgaccatgaacagcaagctgctgaatggcagccagagggtggtgatggatggagtcatcagtgaccacgagtgccaggagctgcagaggctgaccaacgtggccgccaccagcggagatggctaccggggccagaccagcccccacaccccaaatgagaagttctacggcgtgacagtgttcaaggccctgaagctgggccaggagggcaaggtgcccctgcagagcgcccacctgtactacaacgtgacagagaaggtgcggcgcatcatggagagctacttccggctggacacccccctgtacttctcctacagccacctggtgtgcaggacagccatcgaggaggtgcaggccgagaggaaggatgacagccaccctgtgcacgtggacaactgcatcctgaatgctgagaccctggtgtgtgtgaaggagcccccagcctacaccttccgggactacagcgccatcctgtacctgaatggagactttgatggcggcaacttctacttcacagagctggatgccaagacagtgacagctgaggtgcagccccagtgtggccgggctgtgggcttcagcagcggcacagagaacccccatggagtgaaggctgtgacccggggccagagatgtgccatcgccctgtggttcaccctggaccccaggcacagcgagcgggtgcgggccgcccgggccggggagagctcctggtgctgcggggaccccttccctgagcggccctggtttgccttcctgttccccaagagccactgccagtggctgcggcatgagaggagcacctgggacaccagcagcaatgccctgagcctgtggagccactgcctggtgctgcccggccctgctgtgaatggcatccaggtgggcaaggaggtgaagacaggcagtgatgctgagttcctggtgcccagcctgggccccaccagcgctgtgctcttccagagggtgggccctgctgggaaggagatgagcctgggccccctgaggaacctgccctgccccctgggcagcagcagctag

SEQ ID NO: 157458 - DNA, 2211 bp, Artificial Sequence
  Description of Artificial Sequence: Synthetic coding sequence
atggctgtgcgggccctgaagctgctgaccaccctgctggccgtggtggccgccgccagccaggccgaggtggagagcgaggccggctggggcatggtgaccccagacctgctgtttgctgagggcacagctgcctatgcccggggggactggccaggagtggtgctgtccatggagcgggccctgcggagccgggccgccctgcgggccctgcggctgcgctgcaggacccagtgtgccgctgacttcccctgggagctggaccctgactggagccccagccctgcccaggccagcggggccgccgccctgcgggacctgtccttcttcggcggcctgctgcggcgggccgcctgcctgcggcgctgcctgggccccccagctgcccacagcctgtctgaggagatggagctggagttcaggaagaggagcccctacaactacctgcaggtggcctacttcaagatcaacaagctggagaaggctgtggccgccgcccacaccttctttgtgggcaaccctgagcacatggagatgcagcagaacctggactactaccagaccatgtctggagtgaaggaggccgacttcaaggacctggagacccagccccacatgcaggagttccggctgggcgtgcggctgtacagcgaggagcagccccaggaggccgtgccccacctggaggccgccctgcaggagtactttgtggcctatgaagaatgtcgggccctgtgtgagggcccctatgactatgatggctacaactacctggagtacaatgctgacctcttccaggccatcacagaccactacatccaggtgctgaactgcaagcagaactgtgtgacagagctggccagccaccccagccgggagaagccctttgaggacttcctgcccagccactacaactacctgcagtttgcctactacaacatcggcaactacacccaggccgtggagtgtgccaagacctacctgctcttcttccccaatgatgaggtgatgaaccagaacctggcctactatgctgccatgctgggggaggagcacaccaggagcatcggcccccgggagagcgccaaggagtaccggcagaggagcctgctggagaaggagctgctcttctttgcctatgatgtgtttggcatcccctttgtggaccctgacagctggaccccagaggaggtgatccccaagaggctgcaggagaagcagaagtctgagcgggagacagctgtgcgcatcagccaggagatcggcaacctgatgaaggagattgagaccctggtggaggagaagaccaaggagagcctggatgtgtcccggctgacccgggagggcggccccctgctgtatgagggcatcagcctgaccatgaacagcaagctgctgaatggcagccagagggtggtgatggatggagtcatcagtgaccacgagtgccaggagctgcagaggctgaccaacgtggccgccaccagcggagatggctaccggggccagaccagcccccacaccccaaatgagaagttctacggcgtgacagtgttcaaggccctgaagctgggccaggagggcaaggtgcccctgcagagcgcccacctgtactacaacgtgacagagaaggtgcggcgcatcatggagagctacttccggctggacacccccctgtacttctcctacagccacctggtgtgcaggacagccatcgaggaggtgcaggccgagaggaaggatgacagccaccctgtgcacgtggacaactgcatcctgaatgctgagaccctggtgtgtgtgaaggagcccccagcctacaccttccgggactacagcgccatcctgtacctgaatggagactttgatggcggcaacttctacttcacagagctggatgccaagacagtgacagctgaggtgcagccccagtgtggccgggctgtgggcttcagcagcggcacagagaacccccatggagtgaaggctgtgacccggggccagagatgtgccatcgccctgtggttcaccctggaccccaggcacagcgagcgggacagagtgcaggctgatgacctggtgaagatgctgttcagccctgaggagatggacctgagccaggagcagcccctggatgcccagcagggccccccagagcccgcccaggagagcctgagcggcagcgagagcaagcccaaggatgagctgtag

SEQ ID NO: 157459 - DNA, 2094 bp, Artificial Sequence
  Description of Artificial Sequence: Synthetic coding sequence
atggctgtgcgggccctgaagctgctgaccaccctgctggccgtggtggccgccgccagccaggccgaggtggagagcgaggccggctggggcatggtgaccccagacctgctgtttgctgagggcacagctgcctatgcccggggggactggccaggagtggtgctgtccatggagcgggccctgcggagccgggccgccctgcgggccctgcggctgcgctgcaggacccagtgtgccgctgacttcccctgggagctggaccctgactggagccccagccctgcccaggccagcggggccgccgccctgcgggacctgtccttcttcggcggcctgctgcggcgggccgcctgcctgcggcgctgcctgggccccccagctgcccacagcctgtctgaggagatggagctggagttcaggaagaggagcccctacaactacctgcaggtggcctacttcaagatcaacaagctggagaaggctgtggccgccgcccacaccttctttgtgggcaaccctgagcacatggagatgcagcagaacctggactactaccagaccatgtctggagtgaaggaggccgacttcaaggacctggagacccagccccacatgcaggagttccggctgggcgtgcggctgtacagcgaggagcagccccaggaggccgtgccccacctggaggccgccctgcaggagtactttgtggcctatgaagaatgtcgggccctgtgtgagggcccctatgactatgatggctacaactacctggagtacaatgctgacctcttccaggccatcacagaccactacatccaggtgctgaactgcaagcagaactgtgtgacagagctggccagccaccccagccgggagaagccctttgaggacttcctgcccagccactacaactacctgcagtttgcctactacaacatcggcaactacacccaggccgtggagtgtgccaagacctacctgctcttcttccccaatgatgaggtgatgaaccagaacctggcctactatgctgccatgctgggggaggagcacaccaggagcatcggcccccgggagagcgccaaggagtaccggcagaggagcctgctggagaaggagctgctcttctttgcctatgatgtgtttggcatcccctttgtggaccctgacagctggaccccagaggaggtgatccccaagaggctgcaggagaagcagaagtctgagcgggagacagctgtgcgcatcagccaggagatcggcaacctgatgaaggagattgagaccctggtggaggagaagaccaaggagagcctggatgtgtcccggctgacccgggagggcggccccctgctgtatgagggcatcagcctgaccatgaacagcaagctgctgaatggcagccagagggtggtgatggatggagtcatcagtgaccacgagtgccaggagctgcagaggctgaccaacgtggccgccaccagcggagatggctaccggggccagaccagcccccacaccccaaatgagaagttctacggcgtgacagtgttcaaggccctgaagctgggccaggagggcaaggtgcccctgcagagcgcccacctgtactacaacgtgacagagaaggtgcggcgcatcatggagagctacttccggctggacacccccctgtacttctcctacagccacctggtgtgcaggacagccatcgaggaggtgcaggccgagaggaaggatgacagccaccctgtgcacgtggacaactgcatcctgaatgctgagaccctggtgtgtgtgaaggagcccccagcctacaccttccgggactacagcgccatcctgtacctgaatggagactttgatggcggcaacttctacttcacagagctggatgccaagacagtgacagctgaggtgcagccccagtgtggccgggctgtgggcttcagcagcggcacagagaacccccatggagtgaaggctgtgacccggggccagagatgtgccatcgccctgtggttcaccctggaccccaggcacagcgagcgggtgcgggccgcccgggccggccagggcgccggccgctag

SEQ ID NO: 157460 - DNA, 459 bp, Artificial Sequence
  Description of Artificial Sequence: Synthetic coding sequence
tgagaaagagaaacagctgtgcgcatcagccaggagatcggcaacctgatgaaggagattgagaccctggtggaggagaagaccaaggagagcctggatgtgtcccggctgacccgggagggcggccccctgctgtatgagggcatcagcctgaccatgaacagcaagctgctgaatggcagccagagggtggtgatggatggagtcatcagtgaccacgagtgccaggagctgcagaggctgaccaacgtggccgccaccagcggagatggctaccggggccagaccagcccccacaccccaaatgagaagttctacggcgtgacagtgttcaaggccctgaagaggggcgtggtgctggtgcgcttccacacagctgacaaggatgtgcctgagaccggccagttcaccaaggagcggggcctgctgggcctgactgtgccctgtggctggggctag

SEQ ID NO: 157461 - DNA, 1806 bp, Artificial Sequence
  Description of Artificial Sequence: Synthetic coding sequence
atggagctggagttcaggaagaggagcccctacaactacctgcaggtggcctacttcaagatcaacaagctggagaaggctgtggccgccgcccacaccttctttgtgggcaaccctgagcacatggagatgcagcagaacctggactactaccagaccatgtctggagtgaaggaggccgacttcaaggacctggagacccagccccacatgcaggagttccggctgggcgtgcggctgtacagcgaggagcagccccaggaggccgtgccccacctggaggccgccctgcaggagtactttgtggcctatgaggagtgccgggccctgtgtgagggcccctatgactatgatggctacaactacctggagtacaatgctgacctcttccaggccatcacagaccactacatccaggtgctgaactgcaagcagaactgtgtgacagagctggccagccaccccagccgggagaagccctttgaggacttcctgcccagccactacaactacctgcagtttgcctactacaacatcggcaactacacccaggccgtggagtgtgccaagacctacctgctcttcttccccaatgatgaggtgatgaaccagaacctggcctactatgctgccatgctgggggaggagcacaccaggagcatcggcccccgggagagcgccaaggagtaccggcagaggagcctgctggagaaggagctgctcttctttgcctatgatgtgtttggcatcccctttgtggaccctgacagctggaccccagaggaggtgatccccaagaggctgcaggagaagcagaagtctgagcgggagacagctgtgcgcatcagccaggagatcggcaacctgatgaaggagattgagaccctggtggaggagaagaccaaggagagcctggatgtgtcccggctgacccgggagggcggccccctgctgtatgagggcatcagcctgaccatgaacagcaagctgctgaatggcagccagagggtggtgatggatggagtcatcagtgaccacgagtgccaggagctgcagaggctgaccaacgtggccgccaccagcggagatggctaccggggccagaccagcccccacaccccaaatgagaagttctatggagtgaccgtcttcaaggccctgaagctgggccaggagggcaaggtgcccctgcagagcgcccacctgtactacaacgtgacagagaaggtgcggcgcatcatggagagctacttccggctggacacccccctgtacttctcctacagccacctggtgtgcaggacagccatcgaggaggtgcaggccgagaggaaggatgacagccaccctgtgcacgtggacaactgcatcctgaatgctgagaccctggtgtgtgtgaaggagcccccagcctacaccttccgggactacagcgccatcctgtacctgaatggagactttgatggcggcaacttctacttcacagagctggatgccaagacagtgacagctgaggtgcagccccagtgtggccgggctgtgggcttcagcagcggcacagagaacccccacggcgtgaaggctgtgacccggggccagagatgtgccatcgccctgtggttcaccctggaccccaggcacagcgagcgggacagagtgcaggctgatgacctggtgaagatgctgttcagccctgaggagatggacctgagccaggagcagcccctggatgcccagcagggccccccagagcccgcccaggagagcctgagcggcagcgagagcaagcccaaggatgagctgtag

SEQ ID NO: 157462 - DNA, 2355 bp, Artificial Sequence
  Description of Artificial Sequence: Synthetic coding sequence
atgaccagccctgctgctgcccagagccgggagattgactgcctgagccctgaggcccagaagctggccgaggcccggctggccgccaagagagctgcccgggcagaggcccgggagatccgcatgaaggagctggagcggcagcagaaggaggaggacagcgagcgctacagcagaagaagcagaagaaacaccagcgccagtgatgaagatgagaggatgtctgtgggcagccggggcagcctgcgggtggaggagaggcctgagaaggacttcacagagaagggcagcaggaacatgcctggcctgtctgctgccaccctggccagcctgggcggcaccagcagcagaagaggcagcggggacaccagcatcagcattgacacagaggccagcatccgggagatcaaggacagcctggccgaggtggaggagaagtacaagaaggccatggtgtccaatgcccagctggacaatgagaagaccaacttcatgtaccaggtggacaccctgaaggacatgctgctggagctggaggagcagctggccgagagccggcggcagtatgaggagaagaacaaggagtttgagcgggagaagcacgcccacagcatcctgcagttccagtttgctgaggtgaaggaggccctgaagcagcgggaggagatgctggagaagcacggcatcatcctgaacagcgagatcgccaccaacggggagaccagtgacaccctgaacaacgtgggctaccagggccccaccaagatgaccaaggaggagctgaatgccctgaagagcactggagatggcaccctgggccgggccagcgaggtggaggtgaagaatgagatcgtggccaacgtgggcaagcgggagatcctgcacaacacagagaaggagcagcacacagaggacacagtgaaggactgtgtggacatcgaggtgtttcctgctggggagaacacagaggaccagaagagcagcgaggacacagcccccttcctgggcaccctggccggggccacctatgaggagcaggtgcagagccagatcctggagagcagcagcctgcctgaaaatacagtgcaggtggagagcaatgaggtgatgggcgccccagatgacaggaccaggacccccctggagcccagcaactgctggagcgacctggatggcggcaaccacacagaaaatgtgggggaggccgctgtgacccaggtggaggagcaggccggcaccgtggccagctgccccctgggccacagtgatgacacagtgtaccatgatgacaagtgcatggtggaggtgccccaggagctggagaccagcacaggccacagcctggagaaggagttcaccaaccaggaggccgctgagcccaaggaggtgcctgcccacagcacagaggtgggccgggaccacaatgaggaggagggggaggagaccggcctgagagatgagaagcccatcaagacagaggtgcccggcagccctgctggaacagagggcaactgccaggaggccaccggccccagcacagtggacacccagaatgagcccctggacatgaaggagccagatgaggagaagagtgaccagcagggcgaggccctggacagcagccagaagaagaccaagaacaagaagaagaagaacaagaagaagaagagccctgtgcctgtggagaccctgaaggatgtgaagaaggagctgacctaccagaacacagacctgtctgagatcaaggaggaggagcaggtgaagagcacagacaggaagtctgctgtggaggcccagaatgaggtgacagagaaccccaagcagaagattgctgctgagagcagtgaaaatgtggactgcccagagaaccccaagatcaagctggatggcaagctggaccaggagggagatgatgtgcagacagctgctgaggaggtgctggctgatggagacaccctggactttgaagatgacacagtgcagagcagcggccccagggctggaggagaggagctggatgaaggagtggccaaggacaatgccaagattgatggagccacccagagcagccctgctgagcccaagtcagaagatgctgaccgctgcaccctgcctgagcacgagagccccagccaggacatcagtgatgcctgtgaggccgagagcacagagcgctgtgagatgtctgagcaccccagccagacagtgaggaaggccctggacagcaacagcctggagaatgatgacctgagcgcccctggccgggagcccggccacttcaaccctgagagccgggaggacacccggggcggcaatgagaagggcaagagcaaagaagactgcaccatgtcctag

SEQ ID NO: 157463 - DNA, 2259 bp, Artificial Sequence
  Description of Artificial Sequence: Synthetic coding sequence
atgaccagccctgctgctgcccagagccgggagattgactgcctgagccctgaggcccagaagctggccgaggcccggctggccgccaagagagctgcccgggcagaggcccgggagatccgcatgaaggagctggagcggcagcagaaggaggtggaggagaggcctgagaaggacttcacagagaagggcagcaggaacatgcctggcctgtctgctgccaccctggccagcctgggcggcaccagcagcagaagaggcagcggggacaccagcatcagcattgacacagaggccagcatccgggagatcaaggacagcctggccgaggtggaggagaagtacaagaaggccatggtgtccaatgcccagctggacaatgagaagaccaacttcatgtaccaggtggacaccctgaaggacatgctgctggagctggaggagcagctggccgagagccggcggcagtatgaggagaagaacaaggagtttgagcgggagaagcacgcccacagcatcctgcagttccagtttgctgaggtgaaggaggccctgaagcagcgggaggagatgctggagaagcacggcatcatcctgaacagcgagatcgccaccaacggggagaccagtgacaccctgaacaacgtgggctaccagggccccaccaagatgaccaaggaggagctgaatgccctgaagagcactggagatggcaccctgggccgggccagcgaggtggaggtgaagaatgagatcgtggccaacgtgggcaagcgggagatcctgcacaacacagagaaggagcagcacacagaggacacagtgaaggactgtgtggacatcgaggtgtttcctgctggggagaacacagaggaccagaagagcagcgaggacacagcccccttcctgggcaccctggccggggccacctatgaggagcaggtgcagagccagatcctggagagcagcagcctgcctgaaaatacagtgcaggtggagagcaatgaggtgatgggcgccccagatgacaggaccaggacccccctggagcccagcaactgctggagcgacctggatggcggcaaccacacagaaaatgtgggggaggccgctgtgacccaggtggaggagcaggccggcaccgtggccagctgccccctgggccacagtgatgacacagtgtaccatgatgacaagtgcatggtggaggtgccccaggagctggagaccagcacaggccacagcctggagaaggagttcaccaaccaggaggccgctgagcccaaggaggtgcctgcccacagcacagaggtgggccgggaccacaatgaggaggagggggaggagaccggcctgagagatgagaagcccatcaagacagaggtgcccggcagccctgctggaacagagggcaactgccaggaggccaccggccccagcacagtggacacccagaatgagcccctggacatgaaggagccagatgaggagaagagtgaccagcagggcgaggccctggacagcagccagaagaagaccaagaacaagaagaagaagaacaagaagaagaagagccctgtgcctgtggagaccctgaaggatgtgaagaaggagctgacctaccagaacacagacctgtctgagatcaaggaggaggagcaggtgaagagcacagacaggaagtctgctgtggaggcccagaatgaggtgacagagaaccccaagcagaagattgctgctgagagcagtgaaaatgtggactgcccagagaaccccaagatcaagctggatggcaagctggaccaggagggagatgatgtgcagacagctgctgaggaggtgctggctgatggagacaccctggactttgaagatgacacagtgcagagcagcggccccagggctggaggagaggagctggatgaaggagtggccaaggacaatgccaagattgatggagccacccagagcagccctgctgagcccaagtcagaagatgctgaccgctgcaccctgcctgagcacgagagccccagccaggacatcagtgatgcctgtgaggccgagagcacagagcgctgtgagatgtctgagcaccccagccagacagtgaggaaggccctggacagcaacagcctggagaatgatgacctgagcgcccctggccgggagcccggccacttcaaccctgagagccgggaggacacccggggcggcaatgagaagggcaagagcaaagaagactgcaccatgtcctag

SEQ ID NO: 157464 - DNA, 1893 bp, Artificial Sequence
  Description of Artificial Sequence: Synthetic coding sequence
atgaccagccctgctgctgcccagagccgggagattgactgcctgagccctgaggcccagaagctggccgaggcccggctggccgccaagagagctgcccgggcagaggcccgggagatccgcatgaaggagctggagcggcagcagaaggaggtgaccagcgcccaggagaagtactacggcctggacaccaagtggggagacatcgagcagtggatggaggacagcgagcgctacagcagaagaagcagaagaaacaccagcgccagtgatgaagatgagaggatgtctgtgggcagccggggcagcctgcggagccagcctgacctggagtatggaggcccctatgcctggaccaacggctatgatggagagctgtatggcagccagagcctgaacagaagaagtggccggcccagctgcctgtacagcgctgcccggcccagcggcagctaccgggcctctgtgctggatgagggcagctttggaggcacccggcggggcagcaccagcggcagccgggcccccagcgagtacagcggccacctgaacagcagcagccgggccagcagccgggccagcagcgcccgggccagccctgtggtggaggagaggcctgagaaggacttcacagagaagggcagcaggaacatgcctggcctgtctgctgccaccctggccagcctgggcggcaccagcagcagaagaggcagcggggacaccagcatcagcattgacacagaggccagcatccgggagatcaaggagctgaatgagctgaaggaccagatccaggatgtggagggcaagtacatgcagggcctgaaggagatgaaggacagcctggccgaggtggaggagaagtacaagaaggccatggtgtccaatgcccagctggacaatgagaagaccaacttcatgtaccaggtggacaccctgaaggacatgctgctggagctggaggagcagctggccgagagccggcggcagtatgaggagaagaacaaggagtttgagcgggagaagcacgcccacagcatcctgcagttccagtttgctgaggtgaaggaggccctgaagcagcgggaggagatgctggaggagatccggcagctgcagcagaagcaggccagcagcatccgggagatcagtgacctgcaggagaccatcgagtggaaggacaagaagattggagccctggagcggcagaaggagttctttgattctgtgcgctcagaaagagatgacctgcgggaggaggtggtgatgctgaaggaggagctgaagaagcacggcatcatcctgaacagcgagatcgccaccaacggggagaccagtgacaccctgaacaacgtgggctaccagggccccaccaagatgaccaaggaggagctgaatgccctgaagagcactggagatggcaccctggacatccggctgaagaagctggtggatgagcgggagtgcctgctggagcagatcaagaagctgaagggccagctggaggagcggcagaagattggcaagctggacaacctgcggagtgaagatgatgtgctggagaatggaacagacatgcacgtgatggacctgcagagagatgccaaccggcagatcagtgacctgaagttcaagctggccaagtctgagcaggagatcacagccctggagcagaatgtcatccggctggagagccaggtgagccgctacaagtctgctgctgaaaatgctgagaagattgaagatgagctgaaggccgagaagaggaagctgcagcgggagctgcggagcgccctggacaagacagaggagctggaggtgtccaatggccacctggtgaagaggctggagaagatgaaggccaacagaagtgccctgctgagccagcagtag

SEQ ID NO: 157465 - DNA, 2427 bp, Artificial Sequence
  Description of Artificial Sequence: Synthetic coding sequence
atgaccagccctgctgctgcccagagccgggagattgactgcctgagccctgaggcccagaagctggccgaggcccggctggccgccaagagagctgcccgggcagaggcccgggagatccgcatgaaggagctggagcggcagcagaaggaggaggacagcgagcgctacagcagaagaagcagaagaaacaccagcgccagtgatgaagatgagaggatgtctgtgggcagccggggcagcctgcgggtggaggagaggcctgagaaggacttcacagagaagggcagcaggaacatgcctggcctgtctgctgccaccctggccagcctgggcggcaccagcagcagaagaggcagcggggacaccagcatcagcattgacacagaggccagcatccgggagatcaaggagctgaatgagctgaaggaccagatccaggatgtggagggcaagtacatgcagggcctgaaggagatgaaggacagcctggccgaggtggaggagaagtacaagaaggccatggtgtccaatgcccagctggacaatgagaagaccaacttcatgtaccaggtggacaccctgaaggacatgctgctggagctggaggagcagctggccgagagccggcggcagtatgaggagaagaacaaggagtttgagcgggagaagcacgcccacagcatcctgcagttccagtttgctgaggtgaaggaggccctgaagcagcgggaggagatgctggagaagcacggcatcatcctgaacagcgagatcgccaccaacggggagaccagtgacaccctgaacaacgtgggctaccagggccccaccaagatgaccaaggaggagctgaatgccctgaagagcactggagatggcaccctgggccgggccagcgaggtggaggtgaagaatgagatcgtggccaacgtgggcaagcgggagatcctgcacaacacagagaaggagcagcacacagaggacacagtgaaggactgtgtggacatcgaggtgtttcctgctggggagaacacagaggaccagaagagcagcgaggacacagcccccttcctgggcaccctggccggggccacctatgaggagcaggtgcagagccagatcctggagagcagcagcctgcctgaaaatacagtgcaggtggagagcaatgaggtgatgggcgccccagatgacaggaccaggacccccctggagcccagcaactgctggagcgacctggatggcggcaaccacacagaaaatgtgggggaggccgctgtgacccaggtggaggagcaggccggcaccgtggccagctgccccctgggccacagtgatgacacagtgtaccatgatgacaagtgcatggtggaggtgccccaggagctggagaccagcacaggccacagcctggagaaggagttcaccaaccaggaggccgctgagcccaaggaggtgcctgcccacagcacagaggtgggccgggaccacaatgaggaggagggggaggagaccggcctgagagatgagaagcccatcaagacagaggtgcccggcagccctgctggaacagagggcaactgccaggaggccaccggccccagcacagtggacacccagaatgagcccctggacatgaaggagccagatgaggagaagagtgaccagcagggcgaggccctggacagcagccagaagaagaccaagaacaagaagaagaagaacaagaagaagaagagccctgtgcctgtggagaccctgaaggatgtgaagaaggagctgacctaccagaacacagacctgtctgagatcaaggaggaggagcaggtgaagagcacagacaggaagtctgctgtggaggcccagaatgaggtgacagagaaccccaagcagaagattgctgctgagagcagtgaaaatgtggactgcccagagaaccccaagatcaagctggatggcaagctggaccaggagggagatgatgtgcagacagctgctgaggaggtgctggctgatggagacaccctggactttgaagatgacacagtgcagagcagcggccccagggctggaggagaggagctggatgaaggagtggccaaggacaatgccaagattgatggagccacccagagcagccctgctgagcccaagtcagaagatgctgaccgctgcaccctgcctgagcacgagagccccagccaggacatcagtgatgcctgtgaggccgagagcacagagcgctgtgagatgtctgagcaccccagccagacagtgaggaaggccctggacagcaacagcctggagaatgatgacctgagcgcccctggccgggagcccggccacttcaaccctgagagccgggaggacacccggggcggcaatgagaagggcaagagcaaagaagactgcaccatgtcctag

SEQ ID NO: 157466 - DNA, 1923 bp, Artificial Sequence
  Description of Artificial Sequence: Synthetic coding sequence
atggacatgggcacccagggcagcggcaggaagaggctgcccaaccgggagcggctgacagcagaagatgatgccctgaaccagatcgcccgggaggccgaggcccggctggccgccaagagagctgcccgggcagaggcccgggagatccgcatgaaggagctggagcggcagcagaaggagatctaccaggtgcagaagaagtactacggcctggacaccaagtggggagacatcgagcagtggatggaggacagcgagcgctacagcagaagaagcagaagaaacaccagcgccagtgatgaagatgagaggatgtctgtgggcagccggggcagcctgcggagccagcctgacctggagtatggaggcccctatgcctggaccaacggctatgatggagagctgtatggcagccagagcctgaacagaagaagtggccggcccagctgcctgtacagcgctgcccggcccagcggcagctaccgggcctctgtgctggatgagggcagctttggaggcacccggcggggcagcaccagcggcagccgggcccccagcgagtacagcggccacctgaacagcagcagccgggccagcagccgggccagcagcgcccgggccagccctgtggtggaggagaggcctgagaaggacttcacagagaagggcagcaggaacatgcctggcctgtctgctgccaccctggccagcctgggcggcaccagcagcagaagaggcagcggggacaccagcatcagcattgacacagaggccagcatccgggagatcaaggagctgaatgagctgaaggaccagatccaggatgtggagggcaagtacatgcagggcctgaaggagatgaaggacagcctggccgaggtggaggagaagtacaagaaggccatggtgtccaatgcccagctggacaatgagaagaccaacttcatgtaccaggtggacaccctgaaggacatgctgctggagctggaggagcagctggccgagagccggcggcagtatgaggagaagaacaaggagtttgagcgggagaagcacgcccacagcatcctgcagttccagtttgctgaggtgaaggaggccctgaagcagcgggaggagatgctggaggagatccggcagctgcagcagaagcaggccagcagcatccgggagatcagtgacctgcaggagaccatcgagtggaaggacaagaagattggagccctggagcggcagaaggagttctttgattctgtgcgctcagaaagagatgacctgcgggaggaggtggtgatgctgaaggaggagctgaagaagcacggcatcatcctgaacagcgagatcgccaccaacggggagaccagtgacaccctgaacaacgtgggctaccagggccccaccaagatgaccaaggaggagctgaatgccctgaagagcactggagatggcaccctggacatccggctgaagaagctggtggatgagcgggagtgcctgctggagcagatcaagaagctgaagggccagctggaggagcggcagaagattggcaagctggacaacctgcggagtgaagatgatgtgctggagaatggaacagacatgcacgtgatggacctgcagagagatgccaaccggcagatcagtgacctgaagttcaagctggccaagtctgagcaggagatcacagccctggagcagaatgtcatccggctggagagccaggtgagccgctacaagtctgctgctgaaaatgctgagaagattgaagatgagctgaaggccgagaagaggaagctgcagcgggagctgcggagcgccctggacaagacagaggagctggaggtgtccaatggccacctggtgaagaggctggagaagatgaaggccaacagaagtgccctgctgagccagcagtag

SEQ ID NO: 157467 - DNA, 2166 bp, Artificial Sequence
  Description of Artificial Sequence: Synthetic coding sequence
atgggcaccccagccagcggcaggaagaggacccctgtgaaggaccgcttcagcgcagaagatgaggccctgagcaacatcgcccgggaggccgaggcccggctggccgccaagagagctgcccgggcagaggcccgggacatccgcatgagggagctggagcggcagcagaaggagtacagcctgcacagctttgacaggaagtggggccagatccagaagtggctggaggacagcgagcgggcccgctacagccacaggagcagccaccaccggccctacctgggcgtggaggatgccctgagcatccgctctgtgggcagccacagatatgacatgttcaaggacaggagcagccggctgagcagcctgaaccacagctacagccacagccacggcatgaagaagaggagcagtgacagccacaaggacctgctgagcggcctgtactttgaccagaggaactacagcagcctgcggcacagcaagcccaccagcgcctactacacccggcagagcagcagcctgtacagcgaccccctggccacctacaagagtgaccgggccagccccacagccaacagcggcctgctgcggagcgccagcctggccagcctgtacaacggcggcctgtacaacccctacggccccaggaccccatctgagtgcagctactacagcagccgcatcagcagcgcccggagcagccctggcttcaccaatgatgacacagccagcatcgtgtccagtgaccgggccagccggggcagaagagagagcgtggtgtctgctgctgactacttcagccgcagcaacagaagaggctctgtggtgtctgaggtggatgacatcagcatcccagacctgagcagcctggatgagaagagtgacaagcagtatgcagagaactacacccggcccagcagcaggaacagcgccagcgccaccacccccctgagcggcaacagcagcagaagaggcagcggggacaccagcagcctgattgatcctgacaccagcctgtctgagctgcgggacatctatgacctgaaggaccagatccaggatgtggagggccgctacatgcagggcctgaaggagctgaaggagagcctgtctgaggtggaggagaagtacaagaaggccatggtgtccaatgcccagctggacaatgagaagaacaacctgatctaccaggtggacaccctgaaggatgtgattgaggagcaggaggagcagatggccgagttctaccgggagaatgaggagaagagcaaggagctggagcggcagaagcacatgtgcagcgtgctgcagcacaagatggaggagctgaaggagggcctgcggcagagagatgagctgattgaggagaagcagaggatgcagcagaagattgacaccatgaccaaggaggtgtttgacctgcaggagaccctgctgtggaaggacaagaagattggagccctggagaagcagaaggagtacatcgcctgcctgagaaatgaaagagacatgctgcgggaggagctggccgacctgcaggagaccgtgaagacaggagagaagcacggcctggtgatcatcccagatggcaccccaaatggagatgtgtcccatgagcctgtggccggggccatcaccgtggtgtcccaggaggccgcccaggtgctggagagcgctggggagggccccctggatgtgcggctgaggaagctggccggggagaaggaggagctgctgagccagatcaggaagctgaagctgcagctggaggaggagcggcagaagtgcagcagaaatgatggcaccgtgggggacctggccggcctgcagaatggaagtgacctgcagttcatcgagatgcagagagatgccaaccggcagatcagcgagtacaagttcaagctgagcaaggccgagcaggacatcaccaccctggagcagagcatcagccggctggagggccaggtgctgcgctacaagacagctgctgaaaatgctgagaaggtggaggatgagctgaaggccgagaagaggaagctgcagcgggagctgaggacagccctggacaagattgaggagatggagatgaccaacagccacctggccaagaggctggagaagatgaaggccaacagaacagccctgctggcccagcagtag

SEQ ID NO: 157468 - DNA, 1203 bp, Artificial Sequence
  Description of Artificial Sequence: Synthetic coding sequence
atgggcaccccagccagcggcaggaagaggacccctgtgaaggaccgcttcagcgcagaagatgaggccctgagcaacatcgcccgggaggccgaggcccggctggccgccaagagagctgcccgggcagaggcccgggacatccgcatgagggagctggagcggcagcagaaggagctggatgagaagagtgacaagcagtatgcagagaactacacccggcccagcagcaggaacagcgccagcgccaccacccccctgagcggcaacagcagcagaagaggcagcggggacaccagcagcctgattgatcctgacaccagcctgtctgagctgcgggagagcctgtctgaggtggaggagaagtacaagaaggccatggtgtccaatgcccagctggacaatgagaagaacaacctgatctaccaggtggacaccctgaaggatgtgattgaggagcaggaggagcagatggccgagttctaccgggagaatgaggagaagagcaaggagctggagcggcagaagcacatgtgcagcgtgctgcagcacaagatggaggagctgaaggagggcctgcggcagagagatgagctgattgagaagcacggcctggtgatcatcccagatggcaccccaaatggagatgtgtcccatgagcctgtggccggggccatcaccgtggtgtcccaggaggccgcccaggtgctggagagcgctggggagggccccctggatgtgcggctgaggaagctggccggggagaaggaggagctgctgagccagatcaggaagctgaagctgcagctggaggaggagcggcagaagtgcagcagaaatgatggcaccgtgggggacctggccggcctgcagaatggaagtgacctgcagttcatcgagatgcagagagatgccaaccggcagatcagcgagtacaagttcaagctgagcaaggccgagcaggacatcaccaccctggagcagagcatcagccggctggagggccaggtgctgcgctacaagacagctgctgaaaatgctgagaaggtggaggatgagctgaaggccgagaagaggaagctgcagcgggagctgaggacagccctggacaagattgaggagatggagatgaccaacagccacctggccaagaggctggagaagatgaaggccaacagaacagccctgctggcccagcagtag

SEQ ID NO: 157469 - DNA, 2166 bp, Artificial Sequence; identical to SEQ ID NO: 157467
  Description of Artificial Sequence: Synthetic coding sequence

SEQ ID NO: 157470 - DNA, 180 bp, Artificial Sequence
  Description of Artificial Sequence: Synthetic coding sequence
atgggcaccccagccagcggcaggaagaggacccctgtgaaggaccgcttcagcgcagaagatgaggccctgagcaacatcgcccgggaggccgaggcccggctggccgccaagagagctgcccgggcagaggcccgggacatccgcatgagggagctggagcggcagcagaaggagtag

SEQ ID NO: 157471 - DNA, 180 bp, Artificial Sequence; identical to SEQ ID NO: 157470
  Description of Artificial Sequence: Synthetic coding sequence

SEQ ID NO: 157472 - DNA, 180 bp, Artificial Sequence; identical to SEQ ID NO: 157470
  Description of Artificial Sequence: Synthetic coding sequence

SEQ ID NO: 157473 - DNA, 1275 bp, Artificial Sequence
  Description of Artificial Sequence: Synthetic coding sequence
atgggcaccccagccagcggcaggaagaggacccctgtgaaggaccgcttcagcgcagaagatgaggccctgagcaacatcgcccgggaggccgaggcccggctggccgccaagagagctgcccgggcagaggcccgggacatccgcatgagggagctggagcggcagcagaaggagctggatgagaagagtgacaagcagtatgcagagaactacacccggcccagcagcaggaacagcgccagcgccaccacccccctgagcggcaacagcagcagaagaggcagcggggacaccagcagcctgattgatcctgacaccagcctgtctgagctgcgggacatctatgacctgaaggaccagatccaggatgtggagggccgctacatgcagggcctgaaggagctgaaggagagcctgtctgaggtggaggagaagtacaagaaggccatggtgtccaatgcccagctggacaatgagaagaacaacctgatctaccaggtggacaccctgaaggatgtgattgaggagcaggaggagcagatggccgagttctaccgggagaatgaggagaagagcaaggagctggagcggcagaagcacatgtgcagcgtgctgcagcacaagatggaggagctgaaggagggcctgcggcagagagatgagctgattgagaagcacggcctggtgatcatcccagatggcaccccaaatggagatgtgtcccatgagcctgtggccggggccatcaccgtggtgtcccaggaggccgcccaggtgctggagagcgctggggagggccccctggatgtgcggctgaggaagctggccggggagaaggaggagctgctgagccagatcaggaagctgaagctgcagctggaggaggagcggcagaagtgcagcagaaatgatggcaccgtgggggacctggccggcctgcagaatggaagtgacctgcagttcatcgagatgcagagagatgccaaccggcagatcagcgagtacaagttcaagctgagcaaggccgagcaggacatcaccaccctggagcagagcatcagccggctggagggccaggtgctgcgctacaagacagctgctgaaaatgctgagaaggtggaggatgagctgaaggccgagaagaggaagctgcagcgggagctgaggacagccctggacaagattgaggagatggagatgaccaacagccacctggccaagaggctggagaagatgaaggccaacagaacagccctgctggcccagcagtag

SEQ ID NO: 157474 - DNA, 2316 bp, Artificial Sequence
  Description of Artificial Sequence: Synthetic coding sequence
atggcccctggccccttcagcagcgccctgctgagccccccacctgctgccctgcccttcctgctgctgctgtgggccggggccagccggggccagccctgccccggccgctgcatctgccagaatgtggcccccaccctgaccatgctgtgtgccaagacaggcctgctgtttgtgcccccagccatcgacagaagagtggtggagctgcggctgacagacaacttcatcgctgctgtgagaagaagagactttgccaacatgaccagcctggtgcacctgaccctgagcaggaacaccatcggccaggtggccgccggggcctttgctgacctgcgggccctgcgggccctgcacctggacagcaaccggctggccgaggtgcggggggaccagctgcggggcctgggcaacctgcggcacctgatcctgggcaacaaccagatccggcgggtggagagcgctgcctttgatgccttcctgagcacagtggaggacctggacctgagctacaacaacctggaggccctgccctgggaggccgtgggccagatggtgaacctgaacaccctgaccctggaccacaacctgattgaccacatcgccgagggcacctttgtgcagctgcacaagctggtgcggctggacatgaccagcaaccggctgcacaagctgcccccagatggcctcttcctgcggagccagggcaccggccccaagccacccacccccctgactgtgtcctttggaggcaaccccctgcactgcaactgtgagctgctgtggctgcggcggctgaccagagaagatgacctggagacctgtgccaccccagagcacctgacagaccgctacttctggagcatccctgaggaggagttcctgtgtgagcccccactcatcacccggcaggccggcggccgggccctggtggtggagggccaggccgtgtccctgcgctgcagagctgtgggggaccctgagcctgtggtgcactgggtggccccagatggccgcctgctgggcaacagcagcaggaccagggtgagaggagatggcaccctggatgtgaccatcaccaccctgcgggacagcggcaccttcacctgcatcgccagcaatgctgctggggaggccacagcccctgtggaggtgtgtgtggtgcccctgcccctgatggcccctcctcctgctgcccccccacccctgacagagcccggcagcagtgacatcgccaccccaggccggcctggggccaatgacagcgctgctgagcggcggctggtggccgctgagctgaccagcaacagcgtgctgatccgctggccagcccagaggcctgtgcccggcatccgcatgtaccaggtgcagtacaacagctctgtggatgacagcctggtgtacaggatgatccccagcaccagccagaccttcctggtgaatgacctggccgccggccgggcctatgacctgtgtgtgctggccgtgtatgatgatggagccacagccctgcctgccaccagggtggtgggctgtgtgcagttcaccacagctggggaccctgccccctgccggcccctgcgggcccacttcctgggcggcaccatgatcatcgccatcggcggcgtcatcgtggcctctgtgctggtgttcatcgtgctgctgatgatccgctacaaggtgtatggagatggagacagccggcgggtgaagggcagccgcagcctgccccgggtgagccacgtgtgcagccagaccaatggagctggcactggagctgcccaggccccagccctgcctgcccaggaccactatgaggccctgcgggaggtggagagccaggccgccccagctgtggccgtggaggccaaggccatggaggccgagacagccagcgctgagcctgaggtggtgctgggccgcagcctgggcggcagcgccaccagcctgtgcctgctgcccagcgaggagaccagcggggaggagagcagagctgctgtgggcccccggcgcagccgcagcggggccctggagccccccaccagcgccccacccaccctggccctggtgcctggaggagctgctgcccggccccggccccagcagcgctacagctttgatggagactatggagccctcttccagagccacagctacccccggcgggcccggaggaccaagaggcacaggagcaccccccacctggatggagctgggggcggcgctgctggagaagatggagacctgggcctgggcagcgcccgggcctgcctggccttcaccagcacagagtggatgctggagagcacagtgtag

SEQ ID NO: 157475 - DNA, 2370 bp, Artificial Sequence
  Description of Artificial Sequence: Synthetic coding sequence
atggagaccctgctgggcggcctgctggccttcggcatggcctttgctgtggtggatgcctgccccaagtactgtgtgtgccagaacctgtctgagagcctgggcaccctgtgccccagcaagggcctgctgtttgtgcccccagacatcgacagaagaacagtggagctgcggctgggcggcaacttcatcatccacatcagccggcaggactttgccaacatgacaggcctggtggacctgaccctgagcaggaacaccatcagccacatccagcccttctccttcctggacctggagagcctgcggagcctgcacctggacagcaaccggctgcccagcctgggggaggacaccctgcggggcctggtgaacctgcagcacctgattgtgaacaacaaccagctgggcggcattgctgatgaggcctttgaggacttcctgctgaccctggaggacctggacctgagctacaacaacctgcacggcctgccctgggacagcgtgcggaggatggtgaacctgcaccagctgagcctggaccacaacctgctggaccacatcgccgagggcacctttgctgacctgcagaagctggcccggctggacctgaccagcaaccggctgcagaagctgcccccagaccccatctttgcccggagccaggccagcgccctgacagccaccccatttgccccacccctgtccttctcctttggaggcaaccccctgcactgcaactgtgagctgctgtggctgcggcggctggagagagatgatgacctggagacctgtggcagccctgggggcctgaagggccgctacttctggcacgtgcgggaggaggagtttgtgtgtgagcccccactcatcacccagcacacccacaagctgctggtgctggagggccaggccgccaccctgaagtgcaaggccatcggggaccccagccccctcatccactgggtggccccagatgaccggctggtgggcaacagcagcaggacagctgtgtatgacaatggcaccctggacatcttcatcaccaccagccaggacagcggggccttcacctgcatcgccgccaatgctgctggggaggccacagccatggtggaggtgtccatcgtgcagctgccccacctgagcaacagcaccagcaggacagccccacccaagagccggctgagtgacatcaccggcagcagcaagaccagccggggcggcggcggcagcggcggcggggagccccccaagagccccccagagagagctgtgctggtgtctgaggtgaccaccaccagcgccctggtgaagtggagcgtgtccaagagcgccccccgggtgaagatgtaccagctgcagtacaactgcagtgatgatgaggtgctgatctacaggatgatcccagccagcaacaaggcctttgtggtgaacaacctggtgtctggaacaggctatgacctgtgtgtgctggccatgtgggatgacacagccaccaccctgacagccaccaacatcgtgggctgtgcccagttcttcaccaaggctgactacccccagtgccagagcatgcacagccagatcctgggcggcaccatgatcctggtgattggaggcatcatcgtggccaccctgctggtgttcatcgtcatcctgatggtgcgctacaaggtgtgcaaccacgaggcccccagcaagatggctgctgctgtgtccaatgtgtacagccagaccaacggggcccagcccccaccacccagcagcgccccagctggggccccaccccagggcccccccaaggtggtggtgagaaatgagctgctggacttcaccgccagcctggcccgggccagtgacagcagcagcagcagcagcctgggcagcggggaggccgccggcctgggccgggccccctggagaattcctccttctgccccccggcccaagcccagcctggaccggctgatgggcgcctttgccagcctggacctgaagagccagaggaaggaggagctgctggacagcaggaccccagctggccgcggggccggcaccagcgcccggggccaccacagcgaccgggagcccctgctgggccccccagctgcccgggcccggagcctgctgcccctgcccctggagggcaaggccaagaggagccacagctttgacatgggagactttgctgctgctgctgctgggggcgtggtgcctgggggctacagcccccccaggaaggtgagcaacatctggaccaagaggagcctgtctgtgaatggcatgctgctgccctttgaggagagtgacctggtgggcgcccggggcaccttcggcagcagcgagtgggtgatggagagcacagtgtag

SEQ ID NO: 157476 - DNA, 1887 bp, Artificial Sequence
  Description of Artificial Sequence: Synthetic coding sequence
atggccatcctgcccctgctgctgtgcctgctgcccctggccccagccagcagccccccccagagcgccacccccagcccctgcccccggcgctgccgctgccagacccagagcctgcccctgtctgtgctgtgccctggggccggcctgctgtttgtgccccccagcctggacagaagagctgctgagctgcggctggccgacaacttcatcgcctctgtgagaagaagagacctggccaacatgacaggcctgctgcacctgagcctgagcaggaacaccatcagacatgtggccgccggggcctttgctgacctgcgggccctgcgggccctgcacctggatggcaaccggctgaccagcctgggggagggccagctgcggggcctggtgaacctgcggcacctgatcctgagcaacaaccagctggccgccctggccgccggggccctggatgactgtgccgagaccctggaggacctggacctgagctacaacaacctggagcagctgccctgggaggccctgggccgcctgggcaatgtgaacaccctgggcctggaccacaacctgctggcctctgtgcctgctggggccttcagccggctgcacaagctggcccggctggacatgaccagcaaccggctgaccaccatccccccagaccccctcttcagccggctgcccctgctggcccggccccggggcagccctgccagcgccctggtgctggccttcggcggcaaccccctgcactgcaactgtgagctggtgtggctgcggcggctggcccgggaggatgacctggaggcctgtgccagccccccagccctgggcggccgctacttctgggccgtgggggaggaggagtttgtgtgtgagccccctgtggtgacccacaggagcccccccctggccgtgcctgctggccggcctgctgccctgcgctgcagagctgtgggggaccctgagccccgggtgcgctgggtgagcccccagggccgcctgctgggcaacagcagccgggcccgggccttccccaacggcaccctggagctgctggtgacagagcctggagatggcggcatcttcacctgcatcgccgccaatgctgctggggaggccacagctgctgtggagctgactgtgggccccccacctccaccccagctggccaacagcaccagctgtgaccccccaagagatggagaccctgatgccctgaccccacccagcgctgccagcgccagcgccaaggtggccgacaccggccccccaacagaccggggcgtgcaggtgacagagcacggggccacagctgccctggtgcagtggccagaccagaggcccatccctggcatccgcatgtaccagatccagtacaacagcagcgcagatgacatcctggtgtacaggatgatcccagctgagagccgctccttcctgctgacagacctggccagcggccgcacctatgacctgtgtgtgctggccgtgtatgaagattctgccaccggcctgacagccaccaggcctgtgggctgtgcccgcttcagcacagagcccgccctgcggccctgtggggcccctcatgcccccttcctgggcggcaccatgatcatcgccctgggcggcgtgattgtggcctctgtgctggtgttcatctttgtgctgctgatgagatacaaggtgcatggaggccagcccccaggcaaggccaagatcccagcccctgtgtcctctgtgtgcagccagaccaatggagccctgggccccacccccaccccagcccccccagcccctgagcctgctgccctgcgggcccacacagtggtgcagctggactgtgagccctggggccctggccacgagcctgtgggcccctag

SEQ ID NO: 157477 - DNA, 1887 bp, Artificial Sequence; identical to SEQ ID NO: 157476
  Description of Artificial Sequence: Synthetic coding sequence

SEQ ID NO: 157478 - DNA, 1908 bp, Artificial Sequence
  Description of Artificial Sequence: Synthetic coding sequence
atggccccacccctgctgctgctgctgctggccagcggggctgctgcctgccccctgccctgtgtgtgccagaacctgtctgagagcctgagcaccctgtgtgcccaccggggcctgctgtttgtgcccccaaatgtggacagaagaacagtggagctgcggctggccgacaacttcatccaggccctgggccccccagacttcaggaacatgacaggcctggtggacctgaccctgagcagaaatgccatcaccagaattggagcccgggccttcggggacctggagagcctgcggagcctgcacctggatggcaaccggctggtggagctgggcaccggcagcctgcggggccctgtgaacctgcagcacctgatcctgagcggcaaccagctgggcagaattgcccctggggcctttgatgacttcctggagagcctggaggacctggacctgagctacaacaacctgcggcaggtgccctgggccggcattggagccatgcctgccctgcacaccctgaacctggaccacaacctgattgatgccctgcccccaggggcctttgcccagctgggccagctgagccggctggacctgaccagcaaccggctggccaccctggccccagaccccctcttcagccggggcagagatgctgaggccagccctgcccccctggtgctgtccttcagcggcaaccccctgcactgcaactgtgagctgctgtggctgcggcggctggcccggccagatgacctggagacctgtgccagccccccaggcctggccggccgctacttctgggccgtgcctgagggggagttcagctgtgagccccccctgattgcccggcacacccagaggctgtgggtgctggagggccagagggccaccctgcgctgccgggccctgggggaccctgcccccaccatgcactgggtgggcccagatgaccggctggtgggcaacagcagccgggcccgggccttccccaacggcaccctggagattggagtgactggagctggagatgctgggggctacacctgcatcgccaccaacccagctggggaggccacagcccgggtggagctgcgggtgctggccctgccccatggaggcaacagcagcgctgagggcggccggcccggccccagcgacattgctgccagcgccaggacagctgctgagggggagggcaccctggagagcgagcctgctgtgcaggtgacagaggtgacagccaccagcggcctggtgtcctggggccctggccggcctgctgaccctgtgtggatgttccagatccagtacaacagcagtgaagatgagaccctcatctacagaattgtgcctgccagcagccaccacttcctgctgaagcacctggtgcctggagctgactatgacctgtgcctgctggccctgagccctgctgctggccccagcgacctgacagccacccggctgctgggctgtgcccacttcagcaccctgcctgccagccccctgtgccacgccctgcaggcccacgtgctgggcggcaccctgactgtggccgtgggcggcgtgctggtggccgccctgctggtgttcaccgtggccctgctggtgcggggccgcggggctggaaatggccgcctgcccctgaagctgagccacgtgcagagccagaccaatggaggccccagccccacccccaaggcccacccccccaggagccccccaccccggccccagaggagctgcagcctggacctgggagatgctggctgctacggctacgcccggcggctgggcggggcctgggcccggcgcagccacagcgtgcacggcggcctgctgggcgccggctgccggggcgtgggcggcagcgctgagcggctggaggagagcgtggtgtag

SEQ ID NO: 157479 - DNA, 2160 bp, Artificial Sequence
  Description of Artificial Sequence: Synthetic coding sequence
atggagaagatcctcttctacctgttcctgattggaattgctgtgaaggcccagatctgccccaagagatgtgtgtgccagatcctgagccccaacctggccaccctgtgtgccaagaagggcctgctgtttgtgccccccaacatcgacagaagaacagtggagctgcggctggccgacaactttgtgaccaacatcaagaggaaggactttgccaacatgaccagcctggtggacctgaccctgagcaggaacaccatctccttcatcacccctcatgcctttgctgacctgaggaacctgcgggccctgcacctgaacagcaaccggctgaccaagatcaccaatgacatgttcagcggcctgagcaacctgcaccacctgatcctgaacaacaaccagctgaccctcatcagcagcacagcctttgatgatgtgtttgccctggaggagctggacctgagctacaacaacctggagaccatcccctgggatgctgtggagaagatggtgtccctgcacaccctgagcctggaccacaacatgattgacaacatccccaagggcaccttcagccacctgcacaagatgacccggctggatgtgaccagcaacaagctgcagaagctgcccccagaccccctcttccagagggcccaggtgctggccaccagcggcatcatcagccccagcacctttgccctgagctttggaggcaaccccctgcactgcaactgtgagctgctgtggctgcggcggctgagcagagaagatgacctggagacctgtgccagcccccccctgctgaccggccgctacttctggagcatccctgaggaggagttcctgtgtgagcccccactcatcaccaggcacacccatgagatgagggtgctggagggccagagggccaccctgcgctgcaaggcccggggggaccctgagcccgccatccactggatcagccctgagggcaagctgatcagcaatgccaccaggagcctggtgtatgacaatggcaccctggacatcctgatcaccaccgtgaaggacaccggggccttcacctgcatcgccagcaacccagctggggaggccacccagatcgtggacctgcacatcatcaagctgccccacctgctgaacagcaccaaccacatccacgagccagaccccggcagcagtgacatcagcaccagcaccaagagcggcagcaacaccagcagcagcaatggagacaccaagctgagccaggacaagatcgtggtggccgaggccaccagcagcacagccctgctgaagttcaacttccagaggaacatccctggcatccgcatgttccagatccagtacaacggcacctatgatgacaccctggtgtacaggatgatcccccccaccagcaagaccttcctggtgaacaacctggccgccggcaccatgtatgacctgtgtgtgctggccatctatgatgatggcatcaccagcctgacagccaccagggtggtgggctgcatccagttcaccacagagcaggactatgtgcgctgccacttcatgcagagccagttcctgggcggcaccatgatcatcatcattggaggcatcatcgtggcctctgtgctggtgttcatcatcatcctgatgatccgctacaaggtgtgcaacaacaacggccagcacaaggtgaccaaggtgtccaatgtgtacagccagaccaacggggcccagatccagggctgcagcgtgaccctgccccagagcgtgtccaagcaggccgtgggccacgaggagaatgcccagtgctgcaaggccaccagtgacaacgtcatccagagcagcgagacctgcagcagccaggacagcagcaccaccaccagcgccctgccccccagctggaccagcagcacctctgtgtcccagaagcagaagaggaagacaggcaccaagcccagcacagagccccagaatgaagctgtgaccaacgtggagagccagaacaccaacagaaacaacagcacagccctgcagctggccagccggcccccagattctgtgacagagggccccaccagcaagagggcccacatcaagcccaatgccctgctgaccaacgtggaccagatcgtgcaggagacccagaggctggagctgatctag

SEQ ID NO: 157480 - DNA, 1863 bp, Artificial Sequence
  Description of Artificial Sequence: Synthetic coding sequence
atgcaggtgtccaagaggatgctggccggcggcgtgcgctccatgcccagccccctgctggcctgctggcagcccatcctgctgctggtgctgggctctgtgctgagcggcagcgccaccggctgccccccaagatgtgaatgttctgcccaggacagagctgtgctgtgccacaggaagagatttgtggccgtgcctgagggcatccccacagagacccggctgctggacctgggcaagaaccgcatcaagaccctgaaccaggatgaatttgccagcttcccccacctggaggagctggagctgaatgaaaacatcgtgtctgctgtggagcccggggccttcaacaacctcttcaacctgcggaccctgggcctgcggagcaaccggctgaagctgatccccctgggcgtcttcaccggcctgagcaacctgaccaagctggacatcagcgagaacaagatcgtcatcctgctggactacatgttccaggacctgtacaacctgaagagcctggaggtgggggacaatgacctggtgtacatcagccaccgggccttcagcggcctgaacagcctggagcagctgaccctggagaagtgcaacctgaccagcatccccacagaggccctgagccacctgcacggcctcatcgtgctgcggctgcggcacctgaacatcaatgccatccgggactacagcttcaagaggctgtaccgcctgaaggtgctggagatcagccactggccctacctggacaccatgacccccaactgcctgtatggcctgaacctgaccagcctgagcatcacccactgcaacctgacagctgtgccctacctggccgtgcgccacctggtgtacctgcgcttcctgaacctgagctacaaccccatcagcaccatcgagggctccatgctgcacgagctgctgcggctgcaggagatccagctggtgggcggccagctggccgtggtggagccctatgccttccggggcctgaactacctgcgggtgctgaatgtgtctggcaaccagctgaccaccctggaggagagcgtcttccacagcgtgggcaacctggagaccctcatcctggacagcaaccccctggcctgtgactgccgcctgctgtgggtgttcagaagacgctggaggctgaacttcaaccggcagcagcccacctgtgccaccccagagtttgtgcagggcaaggagttcaaggacttcccagatgtgctgctgcccaactacttcacctgccggcgggcccgcatccgggacaggaaggcccagcaggtgtttgtggatgagggccacacagtgcagtttgtgtgcagagcagatggagaccccccaccagccatcctgtggctgagccccaggaagcacctggtgtctgccaagagcaatggccgcctgactgtgtttcctgatggcaccctggaggtgcgctatgcccaggtgcaggacaatggcacctacctgtgcatcgccgccaatgctggaggaaatgacagcatgcctgcccacctgcacgtgcgcagctacagcccagactggccccaccagcccaacaagacctttgccttcatcagcaaccagcccggggagggggaggccaacagcacccgggccaccgtgcccttcccctttgacatcaagaccctcatcatcgccaccaccatgggcttcatctccttcctgggcgtggtgctcttctgcctggtgctgctcttcctgtggagccggggcaagggcaacaccaagcacaacattgaaattgaatatgtgcccaggaagagtgatgctggcatcagcagcgcagatgcccccaggaagttcaacatgaagatgatctag

SEQ ID NO: 157481 - DNA, 168 bp, Artificial Sequence
  Description of Artificial Sequence: Synthetic coding sequence
atgctggccggcggcgtgcgctccatgcccagccccctgctggcctgctggcagcccatcctgctgctggtgctgggctctgtgctgagcggcagcgccaccggctgccccccaagatgtgaatgttctgcccaggacagagctgtgctgtgccacaggaagaggtag

SEQ ID NO: 157482 - DNA, 1845 bp, Artificial Sequence
  Description of Artificial Sequence: Synthetic coding sequence
atgctggccggcggcgtgcgctccatgcccagccccctgctggcctgctggcagcccatcctgctgctggtgctgggctctgtgctgagcggcagcgccaccggctgccccccaagatgtgaatgttctgcccaggacagagctgtgctgtgccacaggaagagatttgtggccgtgcctgagggcatccccacagagacccggctgctggacctgggcaagaaccgcatcaagaccctgaaccaggatgaatttgccagcttcccccacctggaggagctggagctgaatgaaaacatcgtgtctgctgtggagcccggggccttcaacaacctcttcaacctgcggaccctgggcctgcggagcaaccggctgaagctgatccccctgggcgtcttcaccggcctgagcaacctgaccaagctggacatcagcgagaacaagatcgtcatcctgctggactacatgttccaggacctgtacaacctgaagagcctggaggtgggggacaatgacctggtgtacatcagccaccgggccttcagcggcctgaacagcctggagcagctgaccctggagaagtgcaacctgaccagcatccccacagaggccctgagccacctgcacggcctcatcgtgctgcggctgcggcacctgaacatcaatgccatccgggactacagcttcaagaggctgtaccgcctgaaggtgctggagatcagccactggccctacctggacaccatgacccccaactgcctgtatggcctgaacctgaccagcctgagcatcacccactgcaacctgacagctgtgccctacctggccgtgcgccacctggtgtacctgcgcttcctgaacctgagctacaaccccatcagcaccatcgagggctccatgctgcacgagctgctgcggctgcaggagatccagctggtgggcggccagctggccgtggtggagccctatgccttccggggcctgaactacctgcgggtgctgaatgtgtctggcaaccagctgaccaccctggaggagagcgtcttccacagcgtgggcaacctggagaccctcatcctggacagcaaccccctggcctgtgactgccgcctgctgtgggtgttcagaagacgctggaggctgaacttcaaccggcagcagcccacctgtgccaccccagagtttgtgcagggcaaggagttcaaggacttcccagatgtgctgctgcccaactacttcacctgccggcgggcccgcatccgggacaggaaggcccagcaggtgtttgtggatgagggccacacagtgcagtttgtgtgcagagcagatggagaccccccaccagccatcctgtggctgagccccaggaagcacctggtgtctgccaagagcaatggccgcctgactgtgtttcctgatggcaccctggaggtgcgctatgcccaggtgcaggacaatggcacctacctgtgcatcgccgccaatgctggaggaaatgacagcatgcctgcccacctgcacgtgcgcagctacagcccagactggccccaccagcccaacaagacctttgccttcatcagcaaccagcccggggagggggaggccaacagcacccgggccaccgtgcccttcccctttgacatcaagaccctcatcatcgccaccaccatgggcttcatctccttcctgggcgtggtgctcttctgcctggtgctgctcttcctgtggagccggggcaagggcaacaccaagcacaacattgaaattgaatatgtgcccaggaagagtgatgctggcatcagcagcgcagatgcccccaggaagttcaacatgaagatgatctag

SEQ ID NO: 157483 - DNA, 1821 bp, Artificial Sequence
  Description of Artificial Sequence: Synthetic coding sequence
atgctgcacacagccatcagctgctggcagcccttcctgggcctggccgtggtgctgatcttcatgggcagcaccatcggctgcccagcccgctgtgaatgttctgcccagaacaagtctgtgtcctgccacagaagaaggctgattgccatccctgagggcatccccatcgagaccaagatcctggacctgagcaagaaccggctgaagtctgtgaaccctgaggagttcatctcctaccccctgctggaggagattgacctgagtgacaacatcatcgccaacgtggagcccggggccttcaacaacctcttcaacctgcggagcctgcggctgaagggcaaccggctgaagctggtgcccctgggcgtcttcaccggcctgagcaacctgaccaagctggacatcagcgagaacaagatcgtcatcctgctggactacatgttccaggacctgcacaacctgaagagcctggaggtgggggacaatgacctggtgtacatcagccaccgggccttcagcggcctgctgagcctggagcagctgaccctggagaagtgcaacctgacagctgtgcccacagaggccctgagccacctgcggagcctcatcagcctgcacctgaagcacctgaacatcaacaacatgcctgtgtatgccttcaagaggctcttccacctgaagcacctggagattgactactggcccctgctggacatgatgcctgccaacagcctgtatggcctgaacctgaccagcctgtctgtgaccaacaccaacctgagcacagtgcccttcctggccttcaagcacctggtgtacctgacccacctgaacctgagctacaaccccatcagcaccatcgaggccggcatgttcagtgacctgatccggctgcaggagctgcacatcgtgggcgcccagctgcggaccatcgagccccacagcttccagggcctgcgcttcctgcgggtgctgaatgtgtcccagaacctgctggagaccctggaggagaatgtgttcagcagcccccgggccctggaggtgctgagcatcaacaacaaccccctggcctgtgactgccgcctgctgtggatcctgcagaggcagcccaccctgcagtttggaggccagcagcccatgtgtgccggccctgacaccatccgggagaggagcttcaaggacttccacagcacagccctgtccttctacttcacctgcaagaagcccaagatccgggagaagaagctgcagcacctgctggtggatgagggccagacagtgcagctggagtgcagcgcagatggagacccccagcccgtcatctcctgggtgaccccccggcggcgcttcatcaccaccaagagcaatggccgggccaccgtgctgggagatggcaccctggagatccgctttgcccaggaccaggacagcggcatgtatgtgtgcatcgccagcaatgctgctggaaatgacaccttcaccgccagcctgactgtgaagggctttgccagtgaccgcttcctgtatgccaacagaacacccatgtacatgacagacagcaatgacaccatcagcaatggcaccaatgccaacaccttcagcctggacctgaagaccatcctggtgtccacagccatgggctgcttcaccttcctgggcgtggtgctcttctgcttcctgctgctgtttgtgtggagccggggcaagggcaagcacaagaacagcattgacctggagtatgtgcccaggaagaacaatggagctgtggtggagggggaggtggccggcccccggcgcttcaacatgaagatgatctag

SEQ ID NO: 157484 - DNA, 1821 bp, Artificial Sequence; identical to SEQ ID NO: 157483
  Description of Artificial Sequence: Synthetic coding sequence

SEQ ID NO: 157485 - DNA, 1779 bp, Artificial Sequence
  Description of Artificial Sequence: Synthetic coding sequence
atgacctgctggctgtgtgtgctgagcctgcccctgctgctgctgcctgctgcccctcctcctgctgggggctgcccagcccgctgtgagtgcaccgtgcagaccagggctgtggcctgcacccggcggcggctgacagctgtgcctgatggcatcccagctgagacccggctgctggagctgagcaggaaccgcatccgctgcctgaaccctggggacctggccgccctgcctgccctggaggagctggacctgtctgaaaatgccatcgcccacgtggagcccggggcctttgccaacctgccccggctgcgggtgctgcggctgcggggcaaccagctgaagctgatccccccaggagtcttcacccggctggacaacctgaccctgctggacctgtctgagaacaagctggtgatcctgctggactacaccttccaggacctgcacagcctgcggcggctggaggtgggggacaatgacctggtgtttgtgtccagaagagcctttgctggcctgctggccctggaggagctgaccctggagcgctgcaacctgacagccctgagcggggagagcctgggccacctgcggagcctgggcgccctgcggctgcggcacctggccatcgccagcctggaggaccagaacttccggcggctgcccggcctgctgcacctggagattgacaactggcccctgctggaggaggtggccgccggcagcctgcggggcctgaacctgaccagcctgtctgtgacccacaccaacatcacagctgtgcctgctgctgccctgcggcaccaggcccacctgacctgcctgaacctgagccacaaccccatcagcacagtgccccggggcagcttccgggacctggtgcggctgcgggagctgcacctggccggggccctgctggccgtggtggagccccaggccttcctgggcctgcggcagatccggctgctgaacctgagcaacaacctgctgagcaccctggaggagagcaccttccacagcgtgaacaccctggagaccctgcgggtggatggcaaccccctggcctgtgactgccgcctgctgtggatcgtgcagaggaggaagaccctgaactttgatggccgcctgcctgcctgtgccaccccagctgaggtgagaggagatgccctgaggaacctgcctgacagcgtgctgtttgagtactttgtgtgcaggaagcccaagatccgggagcggcggctgcagagggtgacagccacagctggagaagatgtgcgcttcctgtgcagagctgagggggagcccgcccccaccgtggcctgggtgaccccccagcacaggcctgtgacagccaccagcgctggccgggcccgggtgctgcccggcggcaccctggagatccaggatgcccggccccaggacagcggcacctacacctgtgtggccagcaatgccggcggcaatgacacctactttgccaccctgactgtgcggcctgagcctgctgccaacagaacacctggagaggcccacaatgagaccctggccgccctgcgggcccccctggacctgaccaccatcctggtgtccacagccatgggctgcatcaccttcctgggcgtggtgctcttctgctttgtgctgctgtttgtgtggagccggggccggggccagcacaagaacaacttctctgtggagtacagcttcaggaaggtggatggccctgctgctgctgctggccagggcggggccaggaagttcaacatgaagatgatctag

SEQ ID NO: 157486 - DNA, 2172 bp, Artificial Sequence
  Description of Artificial Sequence: Synthetic coding sequence
atgcccctcttcttcaggaagaggaagcccagcgaggaggccaggaagaggctggagtaccagatgtgcctggccaaggaggccggggctgatgacatcctggacatcagcaaatgtgagctgtctgagatcccctttggagcctttgccacctgcaaggtgctgcagaagaaggtgctgattgtgcacaccaaccacctgaccagcctgctgcccaagagctgcagcctgctgagcctggccaccatcaaggtgctggacctgcatgacaaccagctgacagccctgcctgatgacctgggccagctgacagccctgcaggtgctgaatgtggagaggaaccagctgatgcagctgcccaggagcatcggcaacctgacccagctgcagaccctgaatgtgaaggacaacaagctgaaggagctgcctgacacagtgggggagctgcggagcctgcggaccctgaacatctctggaaatgagatccagaggctgccccagatgctggcccacgtgaggaccctggagatgctgagcctggatgccagcgccatggtgtacccaccccgggaggtgtgtggggccggcacagctgccatcctgcagttcctgtgcaaggagagcggcctggagtactacccacccagccagtacctgctgcccatcctggagcaggacggcatcgagaacagccgggacagcccagatggccccacagaccgcttcagccgggaggagctggagtggcagaaccgcttcagtgactatgagaagaggaaggagcagaagatgctggagaagctggagtttgagcggcggctggagctgggccagcgggagcacacccagctgctgcagcagagcagcagccagaaggatgagatcctgcagacagtgaaggaggagcagagccggctggagcagggcctgtctgagcaccagaggcacctgaatgctgagcggcagaggctgcaggagcagctgaagcagacagagcagaacatcagcagccgcatccagaagctgctgcaggacaaccagaggcagaagaagagcagcgagatcctgaagagcctggagaatgaaagaatccgcatggagcagctgatgagcatcacccaggaggagacagagagcctgcggaggagagatgtggccagcgccatgcagcagatgctgacagagagctgcaagaacagactcatccagatggcctatgagagccagaggcagaacctggtgcagcaggcctgcagctccatggccgagatggatgagcgcttccagcagatcctgtcctggcagcagatggaccagaacaaggccatcagccagatcctgcaggagagcgccatgcagaaggccgcctttgaggccctgcaggtgaagaaggacctgatgcaccggcagatccgcagccagatcaagctgattgaaacagagctgctgcagctgacccagctggagctgaagaggaagagcctggacacagagagcctgcaggagatgatcagcgagcagcgctgggccctgagcagcctgctgcagcagctgctgaaggagaagcagcagcgggaggaggagctgcgggagatcctgacagagctggaggccaagtctgagacccggcaggagaactactggctgatccagtaccagaggctgctgaaccagaagcccctgagcctgaagctgcaggaggagggcatggagcggcagctggtggccctgctggaggagctgtctgctgagcactacctgcccatctttgcccaccaccggctgagcctggacctgctgagccagatgagccctggggacctggccaaggtgggcgtgtctgaggccggcctgcagcacgagatcctgcggcgggtgcaggagctgctggatgctgcccgcatccagcctgagctgaagccacccatgggagaggtggtgacccccacagccccccaggagcccccagagagcgtgcggcccagcgcccccccagctgagctggaggtgcaggcctctgaatgtgtggtgtgcctggagcgggaggcccagatgatcttcctgaactgtggccacgtgtgctgctgccagcagtgctgccagcccctgcggacctgccccctgtgccggcaggacatcgcccagaggctgcgcatctaccacagcagctag

SEQ ID NO: 157487 - DNA, 2172 bp, Artificial Sequence; identical to SEQ ID NO: 157486
  Description of Artificial Sequence: Synthetic coding sequence

SEQ ID NO: 157488 - DNA, 2172 bp, Artificial Sequence; identical to SEQ ID NO: 157486
  Description of Artificial Sequence: Synthetic coding sequence

SEQ ID NO: 157489 - DNA, 2091 bp, Artificial Sequence
  Description of Artificial Sequence: Synthetic coding sequence
atgcccctcttcttcaggaagaggaagcccagcgaggaggccaggaagaggctggagtaccagatgtgcctggccaaggaggccggggctgatgacatcctggacatcagcaaatgtgagctgtctgagatcccctttggagcctttgccacctgcaaggtgctgcagaagaaggtgctgattgtgcacaccaaccacctgaccagcctgctgcccaagagctgcagcctgctgagcctggccaccatcaaggtgctggacctgcatgacaaccagctgacagccctgcctgatgacctgggccagctgacagccctgcaggtgctgaatgtggagaggaaccagctgatgcagctgcccaggagcatcggcaacctgacccagctgcagaccctgaatgtgaaggacaacaagctgaaggagctgcctgacacagtgggggagctgcggagcctgcggaccctgaacatctctggaaatgagatccagaggctgccccagatgctggcccacgtgaggaccctggagatgctgagcctggatgccagcgccatggtgtacccaccccgggaggtgtgtggggccggcacagctgccatcctgcagttcctgtgcaaggagagcggcctggagtactacccacccagccagtacctgctgcccatcctggagcaggacggcatcgagaacagccgggacagcccagatggccccacagaccgcttcagccgggaggagctggagtggcagaaccgcttcagtgactatgagaagaggaaggagcagaagatgctggagaagctggagtttgagcggcggctggagctgggccagcgggagcacacccagctgctgcagcagagcagcagccagaaggatgagatcctgcagacagtgaaggaggagcagagccggctggagcagggcctgtctgagcaccagaggcacctgaatgctgagcggcagaggctgcaggagcagctgaagcagacagagcagaacatcagcagccgcatccagaagctgctgcaggacaaccagaggcagaagaagagcagcgagatcctgaagagcctggagaatgaaagaatccgcatggagcagctgatgagcatcacccaggaggagacagagagcctgcggaggagagatgtggccagcgccatgcagcagatgctgacagagagctgcaagaacagactcatccagatggcctatgagagccagaggcagaacctggtgcagcaggcctgcagctccatggccgagatggatgagcgcttccagcagatcctgtcctggcagcagatggaccagaacaaggccatcagccagatcctgcaggagagcgccatgcagaaggccgcctttgaggccctgcaggtgaagaaggacctgatgcaccggcagatccgcagccaggagatgatcagcgagcagcgctgggccctgagcagcctgctgcagcagctgctgaaggagaagcagcagcgggaggaggagctgcgggagatcctgacagagctggaggccaagtctgagacccggcaggagaactactggctgatccagtaccagaggctgctgaaccagaagcccctgagcctgaagctgcaggaggagggcatggagcggcagctggtggccctgctggaggagctgtctgctgagcactacctgcccatctttgcccaccaccggctgagcctggacctgctgagccagatgagccctggggacctggccaaggtgggcgtgtctgaggccggcctgcagcacgagatcctgcggcgggtgcaggagctgctggatgctgcccgcatccagcctgagctgaagccacccatgggagaggtggtgacccccacagccccccaggagcccccagagagcgtgcggcccagcgcccctcctgctgagctggaggtgcaggcctctgaatgtgtggtgtgcctggagcgggaggcccagatgatcttcctgaactgtggccacgtgtgctgctgccagcagtgctgccagcccctgcggacctgccccctgtgccggcaggacatcgcccagaggctgcgcatctaccacagcagctag

SEQ ID NO: 157490 - DNA, 465 bp, Artificial Sequence
  Description of Artificial Sequence: Synthetic coding sequence
atgttccactgcatccccctgtggcgctgcaacagacatgtggagagcattgacaagaggcactgcagcctggtgtatgtgcctgaggagatctaccgctatgcccggagcctggaggagctgctgctggatgccaaccagctgcgggagctgcctgagcagttcttccagctggtgaagctgaggaagctgggcctgagtgacaatgagatccagaggctgcccccagagatcgccaacttcatgcagctggtggagctggatgtgtccagaaatgagatccctgagatccctgagagcatctccttctgcaaggccctgcaggtggccgacttcagcggcaaccccctgacccggctgcctgagagcttccctgagctgcagaacctgacctgcctgtctgtgaatgacatcagcctgcagagcctgcctgaaaatattggcaagcagaagaccaccagctag

SEQ ID NO: 157491 - DNA, 1575 bp, Artificial Sequence
  Description of Artificial Sequence: Synthetic coding sequence
atgttccactgcatccccctgtggcgctgcaacagacatgtggagagcattgacaagaggcactgcagcctggtgtatgtgcctgaggagatctaccgctatgcccggagcctggaggagctgctgctggatgccaaccagctgcgggagctgcctgagcagttcttccagctggtgaagctgaggaagctgggcctgagtgacaatgagatccagaggctgcccccagagatcgccaacttcatgcagctggtggagctggatgtgtccagaaatgagatccctgagatccctgagagcatctccttctgcaaggccctgcaggtggccgacttcagcggcaaccccctgacccggctgcctgagagcttccctgagctgcagaacctgacctgcctgtctgtgaatgacatcagcctgcagagcctgcctgaaaatattggcaacctgtacaacctggccagcctggagctgcgggagaacctgctgacctacctgcctgacagcctgacccagctgcggcggctggaggagctggacctgggcaacaatgagatctacaacctgcctgagagcattggagccctgctgcacctgaaggacctgtggctggatggcaaccagctgtctgagctgccccaggagatcggcaacctgaagaacctgctgtgcctggatgtgtctgaaaatcggctggagcggctgcctgaggagatcagcggcctgaccagcctgacagacctggtgatcagccagaacctgctggagaccatcccagatggcatcggcaagctgaagaagctgagcatcctgaaggtggaccagaaccggctgacccagctgcctgaggccgtgggagaatgtgagagcctgacagagctggtgctgacagagaaccagctgctgaccctgcccaagagcatcggcaagctgaagaagctgagcaacctgaatgctgacaggaacaagctggtgtccctgcccaaggagattggaggctgctgcagcctgaccgtcttctgtgtgcgggacaaccggctgacccgcatcccagctgaggtgtcccaggccacagagctgcacgtgctggatgtggccggcaaccggctgctgcacctgcccctgagcctgacagccctgaagctgaaggccctgtggctgagtgacaaccagagccagcccctgctgaccttccagacagacacagactacaccaccggggagaagatcctgacctgtgtgctgctgccccagctgcccagcgagcccacctgccaggagaacctgccccgctgtggggccctggagaacctggtgaatgatgtgtctgatgaggcctggaatgaaagagctgtgaacagagtgtctgccatccgctttgtggaggatgagaaggatgaggaggacaatgagaccaggaccctgctgcggcgggccaccccccaccctggagagctgaagcacatgaagaagacagtggagaacctgagaaatgacatgaatgctgccaagggcctggacagcaacaagaatgaggtgaaccacgccatcgacagagtgaccacctctgtgtag

SEQ ID NO: 157492 - DNA, 834 bp, Artificial Sequence
  Description of Artificial Sequence: Synthetic coding sequence
atgggcaacaccatccgggccctggtggccttcatcccagctgaccgctgccagaactacgtggtgcgggacctgcgggagatgcccctggacaagatggtggacctgagcggcagccagctgcggcgcttccccctgcacgtgtgcagcttccgggagctggtgaagctgtacctgagtgacaaccacctgaacagcctgcccccagagctgggccagctgcagaacctgcagatcctggccctggacttcaacaacttcaaggccctgccccaggtggtgtgcaccctgaagcagctgtgcatcctgtacctgggcaacaacaagctgtgtgacctgcccagcgagctgagcctgctgcagaacctgcggaccctgtggattgaggccaactgcctgacccagctgcctgatgtggtgtgtgagctgagcctgctgaagaccctgcatgctggcagcaatgccctgcggctgctgcccggccagctgcggcggctgcaggagctgcggaccatctggctgagcggcaaccggctgacagacttccccaccgtgctgctgcacatgcccttcctggaggtgattgatgtggactggaacagcatccgctacttccccagcctggcccacctgagcagcctgaagctggtgatctatgaccacaacccctgcagaaatgcccccaaggtggccaagggcgtgagaagagtgggccgctgggccgaggagaccccagagccagaccccaggaaggccaggagatatgccctggtgcgggaggagagccaggagctgcaggcccctgtgcccctgctgccccccaccaacagctag

SEQ ID NO: 157493 - DNA, 4116 bp, Artificial Sequence
  Description of Artificial Sequence: Synthetic coding sequence
atgacagaggagagcagtgatgtgccccgggagctgattgagagcatcaaggatgtgattggaaggaagatcaagatctctgtgaagaagaaggtgaagctggaggtgaagggggacaaggtggagaacaaggtgctggtgctgaccagctgccgggccttcctggtgacagcccgcatccccaccaagctggagctgaccttctcctacctggagatccacggcgtggtgtgcagcaagagcgcccagatgattgtggagacagagaagtgcagcatctccatgaagatggccagcccagaagatgtgtctgaggtgctggcccacatcggcacctgcctgaggaagatcttccctggcctgagccctgtgcgcatcatgaagaaggtgtccatggagcccagcgagcggctggccagcctgcaggccctgtgggacagccagacagtggccgagcagggcccctgtggcggcttcagccagatgtatgcctgtgtgtgtgactggctgggcttctcctaccgggaggaggtgcagtgggatgtggacaccatctacctgacccaggacacccgggagctgaacctgcaggacttcagccacctggaccaccgggacctgatccccatcatcgccgccctggagtacaaccagtggttcaccaagctgagcagcaaggacctgaagctgagcacagatgtgtgtgagcagatcctgcgggtggtgagccgcagcaaccggctggaggagctggtgctggagaatgccggcctgaggacagactttgcccagaagctggccagcgccctggcccacaaccccaacagcggcctgcacaccatcaacctggccggcaaccccctggaggaccggggcgtgagcagcctgagcatccagtttgccaagctgcccaagggcctgaagcacctgaacctgagcaagaccagcctgagccccaagggcgtgaacagcctgagccagagcctgagcgccaaccccctgacagccagcaccctggtgcacctggacctgtctggaaatgtgctgcggggagatgacctgagccacatgtacaacttcctggcccagcccaatgccatcgtgcacctggacctgagcaacacagagtgcagcctggacatggtgtgtggggccctgctgcggggctgcctgcagtacctggccgtgctgaacctgagcaggacagtgttcagccacaggaagggcaaggaggtgcccccatccttcaagcagttcttcagcagcagcctggccctgatgcacatcaacctgagcggcaccaagctgagccctgagcccctgaaggccctgctgctgggcctggcctgcaaccacaacctgaagggcgtgtccctggacctgagcaactgtgagctgcggagcggcggggcccaggtgctggagggctgcatcgccgagatccacaacatcaccagcctggacatcagtgacaatggcctggagagtgacctgagcaccctcatcgtgtggctgagcaagaacagaagcatccagcacctggccctgggcaagaacttcaacaacatgaagagcaagaacctgacccctgtgctggacaacctggtgcagatgatccaggatgaggagagccccctgcagagcctgagcctggccgacagcaagctgaagacagaggtgaccatcatcatcaatgccctgggcagcaacaccagcctgaccaaggtggacatctctggaaatggcatgggagacatgggcgccaagatgctggccaaggccctgcagatcaacaccaagctgaggacagtcatctgggacaagaacaacatcacagcccagggcttccaggacattgctgtggccatggagaagaactacaccctgcgcttcatgcccatccccatgtatgatgccagccaggccctgaagaccaaccctgagaagacagaagatgccctgcagaagattgagaactacctgctgagaaatcatgagaccaggaagtacctgcaggagcaggcctaccgcctgcagcagggcatcgtgaccagcaccacccagcagatgattgaccgcatctgtgtgaaggtgcaggaccacctgaacagcctgaggaactgtggaggagatgccatccaggaggacctgaagtctgctgagcggctgatgagagatgccaagaacagcaagaccctgctgcccaacctgtaccacgtgggcggggcctcctgggccggggccagcggcctgctgagcagccccatccaggagaccctggagagcatggccggggaggtgaccagggtggtggatgagcagctgaaggccctgctggagagcatggtggatgctgctgagaacctgtgccccaacgtgatgaagaaggcccacatccggcaggacctgattcatgccagcacagagaagatcagcatccccaggacctttgtgaagaatgtgctgctggagcagagcggcatcgacatcctgaacaagatcagcgaggtgaagctgactgtggccagcttcctgagtgacagaattgtggatgagatcctggatgccctgagccactgccaccacaagctggccgaccacttcagccggcggggcaagaccctgccccagcaggagagcctggagattgagctggccgaggagaagcctgtgaagaggagcatcatcaccgtggaggagctgacagaaattgaaaggctggaggacctggacacctgcatgatgacccccaagagcaagaggaagagcatccacagcaggatgctgcggcctgtgtcccgggcctttgagatggagtttgacctggacaaggccctggaggaggtgcccatccacatcgaggacccccccttccccagcctgcggcaggagaagaggagcagcggcttcatcagcgagctgcccagcgaggagggcaagaagctggagcacttcaccaagctgcggcccaagaggaacaagaagcagcagcccacccaggccgctgtgtgtgccgccaacatcgtgtcccaggatggagagcagaatggcctgatgggccgggtggatgaaggagtggatgagttcttcaccaagaaggtgaccaagatggacagcaagaagtggagcacccggggcagcgagagccatgagctgaatgaaggaggagatgagaagaagaagagggacagcaggaagagcagcggcttcctgaacctgatcaagagccgcagcaagtctgagaggcctcccaccatcctgatgacagaggagcccagcagccccaagggagctgtgcgcagcccccctgtggactgccccaggaaggacaccaaggctgctgagcacaatggaaacagcgagagaattgaggagatcaagaccccagacagctttgaggagagccagggcgaggagatcggcaaggtggagaggagtgacagcaagagcagcccccaggccggccgccgctatggagtgcaggtgatgggcagcggcctgctggccgagatgaaggccaagcaggagaagagagctgcctgtgcccagaagaagctgggcaatgatgctgtgtcccaggacagcagcagccctgccctgtctggagtggagaggagtgatggcggcggcgctgtgcccaagctgcaccctggcctgcctgaaaatcgcttcggcctgggcaccccagagaagaacaccaaggccgagcccaaggccgaggccggcagccgcagccgcagcagcagcagcacccccaccagccccaagcccctgctgcagagccccaagcccagcctggccgcccggcctgtgatcccccagaagcccaggacagccagcaggccagatgacatcccagacagccccagcagccccaaggtggccctgctgccccctgtgctgaagaaggtgcccagcgacaaggagagagatggccagagcagcccccagcccagccccaggaccttcagccaggaggtgtccagaagatcctggggccagcaggcccaggagtaccaggagcagaagcagaggagcagcagcaaggatggccaccagggcagcaagagcaatgacagcggggaggaggccgagaaggagttcatctttgtgtag

SEQ ID NO: 157494 - DNA, 531 bp, Artificial Sequence
  Description of Artificial Sequence: Synthetic coding sequence
atgtatgcctgtgtgtgtgactggctgggcttctcctaccgggaggaggtgcagtgggatgtggacaccatctacctgacccaggacacccgggagctgaacctgcaggacttcagccacctggaccaccgggacctgatccccatcatcgccgccctggagtacaaccagtggttcaccaagctgagcagcaaggacctgaagctgagcacagatgtgtgtgagcagatcctgcgggtggtgagccgcagcaaccggctggaggagctggtgctggagaatgccggcctgaggacagactttgcccagaagctggccagcgccctggcccacaaccccaacagcggcctgcacaccatcaacctggccggcaaccccctggaggaccgggagaccaccaccaagatcaagaggcagaatgtgcccaccgtgctgcagacctacctggtggtgtgccccagcgactaccagccctgccccctgcccctgggcaaggacaactactacagcgacttcagccatgatggatag

SEQ ID NO: 157495 - DNA, 3981 bp, Artificial Sequence
  Description of Artificial Sequence: Synthetic coding sequence
atgacagaggagagcagtgatgtgccccgggagctgattgagagcatcaaggatgtgattggaaggaagatcaagatctctgtgaagaagaaggtgaagctggaggtgaagggggacaaggtggagaacaaggtgctggtgctgaccagctgccgggccttcctggtgacagcccgcatccccaccaagctggagctgaccttctcctacctggagatccacggcgtggtgtgcagcaagagcgcccagatgattgtggagacagagaagtgcagcatctccatgaagatggccagcccagaagatgtgtctgaggtgctggcccacatcggcacctgcctgaggaagatcttccctggcctgagccctgtgcgcatcatgaagaaggtgtccatggagcccagcgagcggctggccagcctgcaggccctgtgggacagccagacagtggccgagcagggcccctgtggcggcttcagccagatgtatgcctgtgtgtgtgactggctgggcttctcctaccgggaggaggtgcagtgggatgtggacaccatctacctgacccaggacacccgggagctgaacctgcaggacttcagccacctggaccaccgggacctgatccccatcatcgccgccctggagtacaaccagtggttcaccaagctgagcagcaaggacctgaagctgagcacagatgtgtgtgagcagatcctgcgggtggtgagccgcagcaaccggctggaggagctggtgctggagaatgccggcctgaggacagactttgcccagaagctggccagcgccctggcccacaaccccaacagcggcctgcacaccatcaacctggccggcaaccccctggaggaccggggcgtgagcagcctgagcatccagtttgccaagctgcccaagggcctgaagcacctgaacctgagcaagaccagcctgagccccaagggcgtgaacagcctgagccagagcctgagcgccaaccccctgacagccagcaccctggtgcacctggacctgtctggaaatgtgctgcggggagatgacctgagccacatgtacaacttcctggcccagcccaatgccatcgtgcacctggacctgagcaacacagagtgcagcctggacatggtgtgtggggccctgctgcggggctgcctgcagtacctggccgtgctgaacctgagcaggacagtgttcagccacaggaagggcaaggaggtgcccccatccttcaagcagttcttcagcagcagcctggccctgatgcacatcaacctgagcggcaccaagctgagccctgagcccctgaaggccctgctgctgggcctggcctgcaaccacaacctgaagggcgtgtccctggacctgagcaactgtgagctgcggagcggcggggcccaggtgctggagggctgcatcgccgagatccacaacatcaccagcctggacatcagtgacaatggcctggagagtgacctgagcaccctcatcgtgtggctgagcaagaacagaagcatccagcacctggccctgggcaagaacttcaacaacatgaagagcaagaacctgacccctgtgctggacaacctggtgcagatgatccaggatgaggagagccccctgcagagcctgagcctggccgacagcaagctgaagacagaggtgaccatcatcatcaatgccctgggcagcaacaccagcctgaccaaggtggacatctctggaaatggcatgggagacatgggcgccaagatgctggccaaggccctgcagatcaacaccaagctgaggacagtcatctgggacaagaacaacatcacagcccagggcttccaggacattgctgtggccatggagaagaactacaccctgcgcttcatgcccatccccatgtatgatgccagccaggccctgaagaccaaccctgagaagacagaagatgccctgcagaagattgagaactacctgctgagaaatcatgagaccaggaagtacctgcaggagcaggcctaccgcctgcagcagggcatcgtgaccagcaccacccagcagatgattgaccgcatctgtgtgaaggtgcaggaccacctgaacagcctgaggaactgtggaggagatgccatccaggaggacctgaagtctgctgagcggctgatgagagatgccaagaacagcaagaccctgctgcccaacctgtaccacgtgggcggggcctcctgggccggggccagcggcctgctgagcagccccatccaggagaccctggagagcatggccggggaggtgaccagggtggtggatgagcagctgaaggccctgctggagagcatggtggatgctgctgagaacctgtgccccaacgtgatgaagaaggcccacatccggcaggacctgattcatgccagcacagagaagatcagcatccccaggacctttgtgaagaatgtgctgctggagcagagcggcatcgacatcctgaacaagatcagcgaggtgaagctgactgtggccagcttcctgagtgacagaattgtggatgagatcctggatgccctgagccactgccaccacaagctggccgaccacttcagccggcggggcaagaccctgccccagcaggagagcctggagattgagctggccgaggagaagcctgtgaagaggagcatcatcaccgtggaggagctgacagaaattgaaaggctggaggacctggacacctgcatgatgacccccaagagcaagaggaagagcatccacagcaggatgctgcggcctgtgtcccgggcctttgagatggagtttgacctggacaaggccctggaggaggtgcccatccacatcgaggacccccccttccccagcctgcggcaggagaagaggagcagcggcttcatcagcgagctgcccagcgaggagggcaagaagctggagcacttcaccaagctgcggcccaagaggaacaagaagcagcagcccacccaggccgctgtgtgtgccgccaacatcgtgtcccaggatggagagcagaatggcctgatgggccgggtggatgaaggagtggatgagttcttcaccaagaaggtgaccaagatggacagcaagaagtggagcacccggggcagcgagagccatgagctgaatgaaggaggagatgagaagaagaagagggacagcaggaagagcagcggcttcctgaacctgatcaagagccgcagcaagtctgagaggcctcccaccatcctgatgacagaggagcccagcagccccaagggagctgtgcgcagcccccctgtggactgccccaggaaggacaccaaggctgctgagcacaatggaaacagcgagagaattgaggagatcaagaccccagacagctttgaggagagccagggcgaggagatcggcaaggtggagaggagtgacagcaagagcagcccccaggccggccgccgctatggagtgcaggtgatgggcagcggcctgctggccgagatgaaggccaagcaggagaacagatttggcctgggcaccccagagaagaacaccaaggccgagcccaaggccgaggccggcagccgcagccgcagcagcagcagcacccccaccagccccaagcccctgctgcagagccccaagcccagcctggccgcccggcctgtgatcccccagaagcccaggacagccagcaggccagatgacatcccagacagccccagcagccccaaggtggccctgctgccccctgtgctgaagaaggtgcccagcgacaaggagagagatggccagagcagcccccagcccagccccaggaccttcagccaggaggtgagccgccgctcctggggccagcaggcccaggagtaccaggagcagaagcagaggagcagcagcaaggatggccaccagggcagcaagagcaatgattctggagaggaggccgagaaggagttcatctttgtgtag

SEQ ID NO: 157496 - DNA, 1116 bp, Artificial Sequence
  Description of Artificial Sequence: Synthetic coding sequence
atgggccacaaggtggtggtgtttgacatcagcgtcatccgggccctgtgggagaccagggtgaagaagcacaaggcctggcagaagaaggaggtggagcggctggagaagagcgccctggagaagatcaaggaggagtggaactttgtggccgagtgcaggaggaagggcatcccccaggccgtgtactgcaagaatggcttcatcgacacctctgtgcggctgctggacaagattgaaagaaacaccctgacccggcagagcagcctgcccaaggaccggggcaagaggagcagcgcctttgtgtttgagctgagcggggagcactggacagagctgcctgacagcctgaaggagcagacccacctgcgggagtggtacatcagcaacaccctcatccagatcatccccacctacatccagctgttccaggccatgaggatcctggacctgcccaagaaccagatcagccacctgcctgctgagatcggctgcctgaagaacctgaaggagctgaatgtgggcttcaactacctgaagagcatccccccagagctgggggactgtgagaacctggagcggctggactgcagcggcaacctggagctgatggagctgccctttgagctgagcaacctgaagcaggtgacctttgtggacatcagcgccaacaagttcagctctgtgcccatctgtgtgctgaggatgagcaacctgcagtggctggacatcagcagcaacaacctgacagacctgccccaggacatcgaccggctggaggagctgcagagcttcctgctgtacaagaacaagctgacctacctgccctacagcatgctgaacctgaagaagctgaccctgctggtggtgtctggggaccacctggtggagctgcccacagccctgtgtgacagcagcacccccctgaagtttgtgtccctgatggacaaccccatcgacaatgcccagtgtgaagatggaaatgagatcatggagagcgagcgggaccggcagcactttgacaaggaggtgatgaaggcctacatcgaggacctgaaggagcgggagagcgtgcccagctacaccaccaaggtgtccttcagcctgcagctgtag

SEQ ID NO: 157497 - DNA, 1116 bp, Artificial Sequence; identical to SEQ ID NO: 157496
  Description of Artificial Sequence: Synthetic coding sequence

SEQ ID NO: 157498 - DNA, 918 bp, Artificial Sequence
  Description of Artificial Sequence: Synthetic coding sequence
atgggcggcaccctggcctggaccctgctgctgcccctgctgctgcgggagagtgacagcctggagcccagctgcaccgtgtcctctgcagatgtggactggaatgctgagttcagcgccacctgcctgaacttcagcggcctgagcctgagcctgccccacaaccagagcctgcgggccagcaatgtcatcctgctggacctgtctggaaatggcctgcgggagctgcctgtgaccttctttgcccacctgcagaagctggaggtgctgaatgtgctgaggaaccccctgagccgggtggatggagccctggccgcccgctgtgacctggacctgcaggccgactgcaactgtgccctggagagctggcatgacatcagaagagacaactgcagcggccagaagcccctgctgtgctgggacaccaccagcagccagcacaacctgagcgccttcctggaggtgtcctgtgcccctggcctggccagcgccaccatcggggctgtggtggtgtctggctgcctgctgctgggcctggccatcgccggccctgtgctggcctggaggctgtggcgctgccgggtggcccggagccgggagctgaacaagccctgggccgcccaggacggccccaagccaggcctgggcctgcagcccaggtatggcagccgcagcgcccccaagccccaggtggccgtgcccagctgccccagcaccccagactatgagaacatgtttgtgggccagcctgctgctgagcaccagtgggatgagcagggcgcccaccccagtgaagataatgacttctacatcaactacaaggacatcgacctggccagccagcctgtgtactgcaacctgcagagcctgggccaggcccccatggatgaggaggagtatgtgattcctggccactag

SEQ ID NO: 157499 - DNA, 1005 bp, Artificial Sequence
  Description of Artificial Sequence: Synthetic coding sequence
atgaggggccccagctggagccggccccggcccctgctgctgctgctgctgctgctgagcccctggcctgtgtgggcccaggtgtctgccacagccagccccagcggcagcctgggcgccccagactgcccagaggtgtgcacctgtgtgcctgggggcctggccagctgcagcgccctgagcctgcctgctgtgcccccaggcctgagcctgcggctgcgggccctgctgctggaccacaacagagtgcgggccctgcccccaggggcctttgctggggccggggccctgcagaggctggacctgcgggagaatggcctgcacagcgtgcacgtgcgggccttctggggcctgggcgccctgcagctgctggacctgagcgccaaccagctggaggccctggcccctggcacctttgcccccctgcgggccctgaggaacctgagcctggccggcaaccggctggcccggctggagcctgctgccctgggcgccctgcccctgctgcggagcctgagcctgcaggacaatgagctggccgccctggcccctggcctgctgggccgcctgcctgccctggatgccctgcacctgcggggcaacccctggggctgcggctgtgccctgcggcccctgtgtgcctggctgcggcggcaccccctgcctgccagcgaggccgagaccgtgctgtgtgtgtggccaggccgcctgaccctgagccccctgacagccttcagtgatgctgccttcagccactgtgcccagcccctggccctgcgggacctggccgtggtgtacaccctgggccctgccagcttcctggtgtccctggccagctgcctggccctgggcagcggcctgacagcctgccgggccaggagaagaaggctgaggacagctgccctgcggcccccccggcccccagaccccaacccagaccctgacccccacggctgtgccagccctgctgaccccggcagccctgctgctgctgcccaggcctag

SEQ ID NO: 157500 - DNA, 1923 bp, Artificial Sequence
  Description of Artificial Sequence: Synthetic coding sequence
atgctgaacaagatgaccctgcacccccagcagatcatgattggcccccgcttcaacagagccctgtttgaccccctgctggtggtgctgctggccctgcagctgctggtggtggccggcctggtgcgggcccagacctgccccagcgtgtgcagctgcagcaaccagttcagcaaggtgatctgtgtgaggaagaacctgcgggaggtgcctgatggcatcagcaccaacacccggctgctgaacctgcacgagaaccagatccagatcatcaaggtgaacagcttcaagcacctgcggcacctggagatcctgcagctgagcaggaaccacatccgcaccattgaaattggagccttcaacggcctggccaacctgaacaccctggagctgtttgacaaccggctgaccaccatccccaatggagcctttgtgtacctgagcaagctgaaggagctgtggctgaggaacaaccccatcgagagcatccccagctatgccttcaaccgcatccccagcctgcggcggctggacctgggggagctgaagaggctgagctacatcagcgagggcgcctttgagggcctgagcaacctgcgctacctgaacctggccatgtgcaacctgcgggagatccccaacctgacccccctcatcaagctggatgagctggacctgagcggcaaccacctgagcgccatccggcccggcagcttccagggcctgatgcacctgcagaagctgtggatgatccagagccagatccaggtgattgaaagaaatgcctttgacaacctgcagagcctggtggagatcaacctggcccacaacaacctgaccctgctgccccatgacctcttcacccccctgcaccacctggagcgcatccacctgcaccacaacccctggaactgcaactgtgacatcctgtggctgtcctggtggatcaaggacatggcccccagcaacacagcctgctgtgcccgctgcaacaccccacccaacctgaagggccgctacatcggggagctggaccagaactacttcacctgctacgcccctgtgattgtggagcccccagctgacctgaatgtgacagagggcatggctgctgagctgaagtgccgggccagcaccagcctgacctctgtgtcctggatcacccccaacggcaccgtgatgacccacggggcctacaaggtgagaattgctgtgctgagtgatggcaccctgaacttcaccaacgtgacagtgcaggacaccggcatgtacacctgcatggtgagcaacagcgtgggcaacaccacagccagcgccaccctgaatgtgacagctgccaccaccacccccttctcctacttcagcacagtgacagtggagaccatggagcccagccaggatgaggcccggaccacagacaacaacgtgggccccacccctgtggtggactgggagaccaccaacgtgaccaccagcctgaccccccagagcaccaggagcacagagaagaccttcaccatccctgtgacagacatcaacagcggcatccctggcattgatgaggtgatgaagaccaccaagatcatcatcggctgctttgtggccatcaccctgatggctgctgtgatgctggtgatcttctacaagatgaggaagcagcaccaccggcagaaccaccacgcccccaccaggacagtggagatcatcaacgtggatgatgagatcaccggggacacccccatggagagccacctgcccatgcctgccatcgagcacgagcacctgaaccactacaacagctacaagagccccttcaaccacaccaccaccgtgaacaccatcaacagcatccacagctctgtgcatgagcccctgctgatccgcatgaacagcaaggacaacgtgcaggagacccagatctag

SEQ ID NO: 157501 - DNA, 1923 bp, Artificial Sequence; identical to SEQ ID NO: 157500
  Description of Artificial Sequence: Synthetic coding sequence

SEQ ID NO: 157502 - DNA, 1923 bp, Artificial Sequence; identical to SEQ ID NO: 157500
  Description of Artificial Sequence: Synthetic coding sequence

SEQ ID NO: 157503 - DNA, 1923 bp, Artificial Sequence; identical to SEQ ID NO: 157500
  Description of Artificial Sequence: Synthetic coding sequence

SEQ ID NO: 157504 - DNA, 126 bp, Artificial Sequence
  Description of Artificial Sequence: Synthetic coding sequence
atgctgaacaagatgaccctgcacccccagcagatcatgattggcccccgcttcaacagagccctgtttgaccccctgctggtggtgctgctggccctgcagctgctggtggtggccggcctgtag

SEQ ID NO: 157505 - DNA, 4614 bp, Artificial Sequence
  Description of Artificial Sequence: Synthetic coding sequence
atgaccaccaagaggaagatcatcggccgcctggtgccctgccgctgcttccggggggaggaggagatcatctctgtgctggactacagccactgcagcctgcagcaggtgcccaaggaggtgttcaactttgagaggaccctggaggagctgtacctggatgccaaccagatcgaggagctgcccaagcagctgttcaactgccaggccctgaggaagctgagcatcccagacaatgacctgagcaacctgcccaccaccatcgccagcctggtgaacctgaaggagctggacatcagcaagaatggagtgcaggagttccctgagaacatcaagtgctgcaagtgcctgaccatcatcgaggcctctgtgaaccccatcagcaagctgcctgatggcttcacccagctgctgaacctgacccagctgtacctgaatgatgccttcctggagttcctgcctgccaactttggccgcctggtgaagctgcgcatcctggagctgcgggagaaccacctgaagaccctgcccaagtccatgcacaagctggcccagctggagcggctggacctgggcaacaatgaatttggagagctgcctgaggtgctggaccagatccagaacctgcgggagctgtggatggacaacaatgccctgcaggtgctgcccggcagcatcggcaagctgaagatgctggtgtacctggacatgagcaagaaccgcatcgagaccgtggacatggacatcagcggctgtgaggccctggaggacctgctgctgagcagcaacatgctgcagcagctgcctgacagcatcggcctgctgaagaagctgaccaccctgaaggtggatgacaaccagctgaccatgctgcccaacaccatcggcaacctgagcctgctggaggagtttgactgcagctgcaatgagctggagagcctgcccagcaccatcggctacctgcacagcctgcggaccctggccgtggatgagaacttcctgcctgagctgccccgggagatcggcagctgcaagaatgtgacagtgatgagcctgcggagcaacaagctggagttcctgcctgaggagatcggccagatgcagaagctgcgggtgctgaacctgagtgacaaccggctgaagaacctgcccttctccttcaccaagctgaaggagctggccgccctgtggctgagtgacaaccagagcaaggccctgatccccctgcagacagaggcccaccctgagaccaagcagagggtgctgaccaactacatgttcccccagcagcccagaggagatgaggacttccagagcgacagcgacagcttcaaccccaccctgtgggaggagcagaggcagcagaggatgacagtggcctttgaatttgaggacaagaaggaggatgatgaaaatgccggcaaggtgaaggacctgagctgccaggccccctgggagcggggccagaggggcatcaccctgcagcctgcccggctgagcggggactgctgcaccccctgggcccgctgtgaccagcagatccaggacatgcctgtgccccagaatgacccccagctggcctggggctgcatcagcggcctgcagcaggagaggtccatgtgcacccccctgcctgtggccgcccagagcaccaccctgcccagcctgagcggccggcaggtggagatcaacctgaagcgctaccccaccccctacccagaggacctgaagaacatggtgaagtctgtgcagaacctggtgggcaagcccagccacggcgtgcgggtggagaacagcaaccccacagccaacacagagcagacagtgaaggagaagtatgagcacaagtggcctgtggcccccaaggagatcaccgtggaggacagctttgtgcacccagccaatgagatgagaattggagagctgcaccccagcctggccgagacccccctgtacccacccaagctggtgctgctgggcaaggacaagaaggagagcacagatgagagcgaggtggacaagacccactgcctgaacaacagcgtgagcagcggcacctacagcgactacagccccagccaggccagcagcggcagcagcaacaccagggtgaaggtgggcagcctgcagaccacagccaaggatgctgtgcacaacagcctgtggggcaaccgcatcgcccccagcttcccccagcccctggacagcaagcccctgctgagccagcgggaggccgtgcccccaggcaacatcccccagaggccagaccggctgcccatgtctgacaccttcacagacaactggacagatggcagccactatgacaacacaggctttgtggccgaggagaccacagcagaaaatgccaacagcaaccccctgctgagcagcaagagccgcagcaccagcagccatggaagaagacccctcatccggcaggaccgcatcgtgggcgtgcccctggagctggagcagagcacccaccgccacaccccagagacagaggtgccccccagcaacccctggcagaactggaccaggacccccagcccctttgaggacagaacagccttccccagcaagctggagaccacccccaccaccagccccctgcctgagaggaaggagcacatcaaggagagcacagagatccccagccccttcagccctggggtgccctgggagtaccatgacagcaaccccaacagaagcctgagcaatgtgttcagccagatccactgcaggcctgagagcagcaagggcgtcatcagcatcagcaagagcacagagcggctgagccccctgatgaaggacatcaagagcaacaagttcaagaagagccagagcattgatgaaattgatattggcacctacaaggtgtacaacatccccctggagaactatgccagcggcagtgaccacctgggcagccatgagaggccagacaagatgctgggccctgagcacggcatgagctccatgagccgcagccagagcgtgcccatgctggatgatgagatgctgacctacggcagcagcaagggcccccagcagcagaaggcctccatgaccaagaaggtgtaccagtttgaccagagcttcaacccccagggctctgtggaggtgaaggccgagaagagaattcctccacccttccagcacaacccagaatatgtgcagcaggccagcaagaacatcgccaaggacctgatcagcccccgggcctaccggggctacccacccatggagcagatgttctccttcagccagcccagcgtgaatgaagatgctgtggtgaatgcccagtttgccagccagggcgcccgggccggcttcctgcggcgggctgacagcctggtgtctgccacagagatggccatgttcagaagagtgaatgagccccatgagctgcccccaacagacagatatggccggcccccctaccggggcggcctggaccggcagagctctgtgacagtgacagagagccagttcctgaagagaaatggccgctatgaagatgagcaccccagctaccaggaggtgaaggcccaggccggcagcttccctgtgaagaacctgacccagaggcggcccctgagcgcccggagctacagcacagagagctatggagccagccagaccaggcctgtgtctgcccggcccaccatggccgccctgctggagaagatccccagcgactacaacctgggcaactacggggacaagcccagcgacaacagcgacctgaagacccggcccacccctgtgaagggggaggagagctgtgggaagatgcctgctgactggaggcagcagctgctgcggcacatcgaggcccggcggctggacagaaatgctgcctacaagcacaacacagtgaacctgggcatgctgccctatggaggcatcagcgccatgcatgctggccgctccatgaccctgaacctgcagaccaagagcaagtttgaccaccaggagctgcccctgcagaagacccccagccagcagagcaacatcctggacaatggccaggaggatgtgagccccagcggccagtggaacccctaccccctgggcagaagagatgtgcccccagacaccatcaccaagaaggccggcagccacatccagaccctgatgggcagccagagcctgcagcacaggagccgggagcagcagccctatgagggcaacatcaacaaggtgaccatccagcagttccagagccccctgcccatccagatccccagcagccaggccacccggggcccccagcccggccgctgcctgatccagaccaagggccagaggtccatggatggctacccagagcagttctgtgtgagaattgagaagaaccctggcctgggcttcagcatcagcggcggcatcagcggccagggcaaccccttcaagcccagcgacaagggcatctttgtgaccagggtgcagccagatggccctgccagcaacctgctgcagcccggggacaagatcctgcaggccaacggccacagctttgtgcacatggagcacgagaaggctgtgctgctgctgaagagcttccagaacacagtggacctggtgatccagcgggagctgactgtgtag

SEQ ID NO: 157506 - DNA, 4488 bp, Artificial Sequence
  Description of Artificial Sequence: Synthetic coding sequence
atgcagtgcctggagatgaccaccaagaggaagatcatcggccgcctggtgccctgccgctgcttccggggggaggaggagatcatctctgtgctggactacagccactgcagcctgcagcaggtgcccaaggaggtgttcaactttgagaggaccctggaggagctgtacctggatgccaaccagatcgaggagctgcccaagcagctgttcaactgccaggccctgaggaagctgagcatcccagacaatgacctgagcaacctgcccaccaccatcgccagcctggtgaacctgaaggagctggacatcagcaagaatggagtgcaggagttccctgagaacatcaagtgctgcaagtgcctgaccatcatcgaggcctctgtgaaccccatcagcaagctgcctgatggcttcacccagctgctgaacctgacccagctgtacctgaatgatgccttcctggagttcctgcctgccaactttggccgcctggtgaagctgcgcatcctggagctgcgggagaaccacctgaagaccctgcccaagtccatgcacaagctggcccagctggagcggctggacctgggcaacaatgaatttggagagctgcctgaggtgctggaccagatccagaacctgcgggagctgtggatggacaacaatgccctgcaggtgctgcccggcagcatcggcaagctgaagatgctggtgtacctggacatgagcaagaacagaattgaaacagtggacatggacatcagcggctgtgaggccctggaggacctgctgctgagcagcaacatgctgcagcagctgcctgacagcatcggcctgctgaagaagctgaccaccctgaaggtggatgacaaccagctgaccatgctgcccaacaccatcggcaacctgagcctgctggaggagtttgactgcagctgcaatgagctggagagcctgcccagcaccatcggctacctgcacagcctgcggaccctggccgtggatgagaacttcctgcctgagctgccccgggagatcggcagctgcaagaatgtgacagtgatgagcctgcggagcaacaagctggagttcctgcctgaggagatcggccagatgcagaagctgcgggtgctgaacctgagtgacaaccggctgaagaacctgcccttctccttcaccaagctgaaggagctggccgccctgtggctgagtgacaaccagagcaaggccctgatccccctgcagacagaggcccaccctgagaccaagcagagggtgctgaccaactacatgttcccccagcagcccagaggagatgaggacttccagagcgacagcgacagcttcaaccccaccctgtgggaggagcagaggcagcagaggatgacagtggcctttgaatttgaggacaagaaggaggatgatgaaaatgctgggaaggtgaaggacctgagctgccaggccccctgggagcggggccagaggggcatcaccctgcagcctgcccggctgagcggggactgctgcaccccctgggcccgctgtgaccagcagatccaggacatgcctgtgccccagaatgacccccagctggcctggggctgcatcagcggcctgcagcaggagaggtccatgtgcacccccctgcctgtggccgcccagagcaccaccctgcccagcctgagcggccggcaggtggagatcaacctgaagcgctaccccaccccctacccagaggacctgaagaacatggtgaagtctgtgcagaacctggtgggcaagcccagccatggagtgcgggtggagaacagcaaccccacagccaacacagagcagacagtgaaggagaagtatgagcacaagtggcctgtggcccccaaggagatcaccgtggaggacagctttgtgcacccagccaatgagatgagaattggagagctgcaccccagcctggccgagacccccctgtacccacccaagctggtgctgctgggcaaggacaagaaggagagcacagatgaaagtgaggtggacaagacccactgcctgaacaacagcgtgagcagcggcacctacagcgactacagccccagccaggccagcagcggcagcagcaacaccagggtgaaggtgggcagcctgcagaccacagccaaggatgctgtgcacaacagcctgtggggcaacagaattgcccccagcttcccccagcccctggacagcaagcccctgctgagccagcgggaggccgtgcccccaggcaacatcccccagaggccagaccggctgcccatgtctgacaccttcacagacaactggacagatggcagccactatgacaacacaggctttgtggccgaggagaccacagcagaaaatgccaacagcaaccccctgctgagcagcaagagccgcagcaccagcagccacggccggcggcccctcatccggcaggacagaattgtgggcgtgcccctggagctggagcagagcacccaccgccacaccccagagacagaggtgccccccagcaacccctggcagaactggaccaggacccccagcccctttgaggacagaacagccttccccagcaagctggagaccacccccaccaccagccccctgcctgagaggaaggagcacatcaaggagagcacagagatccccagccccttcagccctggggtgccctgggagtaccatgacagcaaccccaacagaagcctgagcaatgtgttcagccagatccactgcaggcctgagagcagcaaaggagtcatcagcatcagcaagagcacagagcggctgagccccctgatgaaggacatcaagagcaacaagttcaagaagagccagagcattgatgaaattgacatcggcacctacaaggtgtacaacatccccctggagaactatgccagcggcagtgaccacctgggcagccatgagaggccagacaagatgctgggccctgagcacggcatgagctccatgagccgcagccagagcgtgcccatgctggatgatgagatgctgacctacggcagcagcaagggcccccagcagcagaaggcctccatgaccaagaaggtgtaccagtttgaccagagcttcaacccccagggctctgtggaggtgaaggccgagaagaggatccccccacccttccagcacaacccagaatatgtgcagcaggccagcaagaacatcgccaaggacctgatcagcccccgggcctaccggggctacccacccatggagcagatgttctccttcagccagcccagcgtgaatgaagatgctgtggtgaatgcccagtttgccagccagggcgcccgggccggcttcctgcggcgggctgacagcctggtgtctgccacagagatggccatgttccggcgggtgaatgagccccatgagctgcccccaacagacagatatggccggcccccctacagaggaggcctggaccggcagagctctgtgacagtgacagagagccagttcctgaagagaaatggccgctatgaagatgagcaccccagctaccaggaggtgaaggcccaggccggcagcttccctgtgaagaacctgacccagaggcggcccctgagcgcccggagctacagcacagagagctatggagccagccagaccaggcctgtgtctgcccggcccaccatggccgccctgctggagaagatccccagcgactacaacctgggcaactatggagacaagcccagcgacaacagcgacctgaagacccggcccacccctgtgaagggggaggagagctgtgggaagatgcctgctgactggaggcagcagctgctgcggcacatcgaggcccggcggctggacaggacccccagccagcagagcaacatcctggacaatggccaggaggatgtgagccccagcggccagtggaacccctaccccctgggcagaagagatgtgcccccagacaccatcaccaagaaggccggcagccacatccagaccctgatgggcagccagagcctgcagcacaggagccgggagcagcagccctatgagggcaacatcaacaaggtgaccatccagcagttccagagccccctgcccatccagatccccagcagccaggccacccggggcccccagcccggccgctgcctgatccagaccaagggccagaggtccatggatggctacccagagcagttctgtgtgagaattgagaagaaccctggcctgggcttcagcatcagcggcggcatcagcggccagggcaaccccttcaagcccagcgacaagggcatctttgtgaccagggtgcagccagatggccctgccagcaacctgctgcagcccggggacaagatcctgcaggccaacggccacagctttgtgcacatggagcacgagaaggctgtgctgctgctgaagagcttccagaacacagtggacctggtgatccagcgggagctgactgtgtag

SEQ ID NO: 157507 - DNA, 540 bp, Artificial Sequence
  Description of Artificial Sequence: Synthetic coding sequence
atgaccaccaagaggaagatcatcggccgcctggtgccctgccgctgcttccggggggaggaggagatcatctctgtgctggactacagccactgcagcctgcagcaggtgcccaaggaggtgttcaactttgagaggaccctggaggagctgtacctggatgccaaccagatcgaggagctgcccaagcagctgttcaactgccaggccctgaggaagctgagcatcccagacaatgacctgagcaacctgcccaccaccatcgccagcctggtgaacctgaaggagctggacatcagcaagaatggagtgcaggagttccctgagaacatcaagtgctgcaagtgcctgaccatcatcgaggcctctgtgaaccccatcagcaagctgcctgatggcttcacccagctgctgaacctgacccagctgtacctgaatgatgccttcctggagttcctgcctgccaactttggccgcctggtgaagctgcgcatcctggagctgcgggagaaccacctgaagaccctgcccaagatctag

SEQ ID NO: 157508 - DNA, 3942 bp, Artificial Sequence
  Description of Artificial Sequence: Synthetic coding sequence
cgctccatgcacaagctggcccagctggagcggctggacctgggcaacaatgaatttggagagctgcctgaggtgctggaccagatccagaacctgcgggagctgtggatggacaacaatgccctgcaggtgctgcccggcagcatcggcaagctgaagatgctggtgtacctggacatgagcaagaacagaattgaaacagtggacatggacatcagcggctgtgaggccctggaggacctgctgctgagcagcaacatgctgcagcagctgcctgacagcatcggcctgctgaagaagctgaccaccctgaaggtggatgacaaccagctgaccatgctgcccaacaccatcggcaacctgagcctgctggaggagtttgactgcagctgcaatgagctggagagcctgcccagcaccatcggctacctgcacagcctgcggaccctggccgtggatgagaacttcctgcctgagctgccccgggagatcggcagctgcaagaatgtgacagtgatgagcctgcggagcaacaagctggagttcctgcctgaggagatcggccagatgcagaagctgcgggtgctgaacctgagtgacaaccggctgaagaacctgcccttctccttcaccaagctgaaggagctggccgccctgtggctgagtgacaaccagagcaaggccctgatccccctgcagacagaggcccaccctgagaccaagcagagggtgctgaccaactacatgttcccccagcagcccagaggagatgaggacttccagagcgacagcgacagcttcaaccccaccctgtgggaggagcagaggcagcagaggatgacagtggcctttgaatttgaggacaagaaggaggatgatgaaaatgctgggaaggtgaaggacctgagctgccaggccccctgggagcggggccagaggggcatcaccctgcagcctgcccggctgagcggggactgctgcaccccctgggcccgctgtgaccagcagatccaggacatgcctgtgccccagaatgacccccagctggcctggggctgcatcagcggcctgcagcaggagaggtccatgtgcacccccctgcctgtggccgcccagagcaccaccctgcccagcctgagcggccggcaggtggagatcaacctgaagcgctaccccaccccctacccagaggacctgaagaacatggtgaagtctgtgcagaacctggtgggcaagcccagccatggagtgcgggtggagaacagcaaccccacagccaacacagagcagacagtgaaggagaagtatgagcacaagtggcctgtggcccccaaggagatcaccgtggaggacagctttgtgcacccagccaatgagatgagaattggagagctgcaccccagcctggccgagacccccctgtacccacccaagctggtgctgctgggcaaggacaagaaggagagcacagatgaaagtgaggtggacaagacccactgcctgaacaacagcgtgagcagcggcacctacagcgactacagccccagccaggccagcagcggcagcagcaacaccagggtgaaggtgggcagcctgcagaccacagccaaggatgctgtgcacaacagcctgtggggcaacagaattgcccccagcttcccccagcccctggacagcaagcccctgctgagccagcgggaggccgtgcccccaggcaacatcccccagaggccagaccggctgcccatgtctgacaccttcacagacaactggacagatggcagccactatgacaacacaggctttgtggccgaggagaccacagcagaaaatgccaacagcaaccccctgctgagcagcaagagccgcagcaccagcagccacggccggcggcccctcatccggcaggacagaattgtgggcgtgcccctggagctggagcagagcacccaccgccacaccccagagacagaggtgccccccagcaacccctggcagaactggaccaggacccccagcccctttgaggacagaacagccttccccagcaagctggagaccacccccaccaccagccccctgcctgagaggaaggagcacatcaaggagagcacagagatccccagccccttcagccctggggtgccctgggagtaccatgacagcaaccccaacagaagcctgagcaatgtgttcagccagatccactgcaggcctgagagcagcaaaggagtcatcagcatcagcaagagcacagagcggctgagccccctgatgaaggacatcaagagcaacaagttcaagaagagccagagcattgatgaaattgacatcggcacctacaaggtgtacaacatccccctggagaactatgccagcggcagtgaccacctgggcagccatgagaggccagacaagatgctgggccctgagcacggcatgagctccatgagccgcagccagagcgtgcccatgctggatgatgagatgctgacctacggcagcagcaagggcccccagcagcagaaggcctccatgaccaagaaggtgtaccagtttgaccagagcttcaacccccagggctctgtggaggtgaaggccgagaagaggatccccccacccttccagcacaacccagaatatgtgcagcaggccagcaagaacatcgccaaggacctgatcagcccccgggcctaccggggctacccacccatggagcagatgttctccttcagccagcccagcgtgaatgaagatgctgtggtgaatgcccagtttgccagccagggcgcccgggccggcttcctgcggcgggctgacagcctggtgtctgccacagagatggccatgttccggcgggtgaatgagccccatgagctgcccccaacagacagatatggccggcccccctacagaggaggcctggaccggcagagctctgtgacagtgacagagagccagttcctgaagagaaatggccgctatgaagatgagcaccccagctaccaggaggtgaaggcccaggccggcagcttccctgtgaagaacctgacccagaggcggcccctgagcgcccggagctacagcacagagagctatggagccagccagaccaggcctgtgtctgcccggcccaccatggccgccctgctggagaagatccccagcgactacaacctgggcaactatggagacaagcccagcgacaacagcgacctgaagacccggcccacccctgtgaagggggaggagagctgtgggaagatgcctgctgactggaggcagcagctgctgcggcacatcgaggcccggcggctggacaggacccccagccagcagagcaacatcctggacaatggccaggaggatgtgagccccagcggccagtggaacccctaccccctgggcagaagagatgtgcccccagacaccatcaccaagaaggccggcagccacatccagaccctgatgggcagccagagcctgcagcacaggagccgggagcagcagccctatgagggcaacatcaacaaggtgaccatccagcagttccagagccccctgcccatccagatccccagcagccaggccacccggggcccccagcccggccgctgcctgatccagaccaagggccagaggtccatggatggctacccagagcagttctgtgtgagaattgagaagaaccctggcctgggcttcagcatcagcggcggcatcagcggccagggcaaccccttcaagcccagcgacaagggcatctttgtgaccagggtgcagccagatggccctgccagcaacctgctgcagcccggggacaagatcctgcaggccaacggccacagctttgtgcacatggagcacgagaaggctgtgctgctgctgaagagcttccagaacacagtggacctggtgatccagcgggagctgactgtgtag

SEQ ID NO: 157509 - DNA, 654 bp, Artificial Sequence
  Description of Artificial Sequence: Synthetic coding sequence
atgatggagaacctgatccggggcagaaatccaccccagtaccagaggagcccctgcaaggaggtgcgggccgccctgaggaagaggcctgaggaggagctgcagtgcctggagatgaccaccaagaggaagatcatcggccgcctggtgccctgccgctgcttccggggggaggaggagatcatctctgtgctggactacagccactgcagcctgcagcaggtgcccaaggaggtgttcaactttgagaggaccctggaggagctgtacctggatgccaaccagatcgaggagctgcccaagcagctgttcaactgccaggccctgaggaagctgagcatcccagacaatgacctgagcaacctgcccaccaccatcgccagcctggtgaacctgaaggagctggacatcagcaagaatggagtgcaggagttccctgagaacatcaagtgctgcaagtgcctgaccatcatcgaggcctctgtgaaccccatcagcaagctgcctgatggcttcacccagctgctgaacctgacccagctgtacctgaatgatgccttcctggagttcctgcctgccaactttggccgcctggtgaagctgcgcatcctggagctgcgggagaaccacctgaagaccctgcccaacatctag

SEQ ID NO: 157510 - DNA, 2466 bp, Artificial Sequence
  Description of Artificial Sequence: Synthetic coding sequence
atgaccaagatgctgggcaagctgcgcatcgcccccagcttcccccagcccctggacagcaagcccctgctgagccagcgggaggccgtgcccccaggcaacatcccccagaggccagaccggctgcccatgtctgacaccttcacagacaactggacagatggcagccactatgacaacacaggctttgtggccgaggagaccacagcagaaaatgccaacagcaaccccctgctgagcagcaagagccgcagcaccagcagccatggaagaagacccctcatccggcaggaccgcatcgtgggcgtgcccctggagctggagcagagcacccaccgccacaccccagagacagaggtgccccccagcaacccctggcagaactggaccaggacccccagcccctttgaggacagaacagccttccccagcaagctggagaccacccccaccaccagccccctgcctgagaggaaggagcacatcaaggagagcacagagatccccagccccttcagccctggggtgccctgggagtaccatgacagcaaccccaacagaagcctgagcaatgtgttcagccagatccactgcaggcctgagagcagcaagggcgtcatcagcatcagcaagagcacagagcggctgagccccctgatgaaggacatcaagagcaacaagttcaagaagagccagagcattgatgaaattgatattggcacctacaaggtgtacaacatccccctggagaactatgccagcggcagtgaccacctgggcagccatgagaggccagacaagatgctgggccctgagcacggcatgagctccatgagccgcagccagagcgtgcccatgctggatgatgagatgctgacctacggcagcagcaagggcccccagcagcagaaggcctccatgaccaagaaggtgtaccagtttgaccagagcttcaacccccagggctctgtggaggtgaaggccgagaagagaattcctccacccttccagcacaacccagaatatgtgcagcaggccagcaagaacatcgccaaggacctgatcagcccccgggcctaccggggctacccacccatggagcagatgttctccttcagccagcccagcgtgaatgaagatgctgtggtgaatgcccagtttgccagccagggcgcccgggccggcttcctgcggcgggctgacagcctggtgtctgccacagagatggccatgttcagaagagtgaatgagccccatgagctgcccccaacagacagatatggccggcccccctaccggggcggcctggaccggcagagctctgtgacagtgacagagagccagttcctgaagagaaatggccgctatgaagatgagcaccccagctaccaggaggtgaaggcccaggccggcagcttccctgtgaagaacctgacccagaggcggcccctgagcgcccggagctacagcacagagagctatggagccagccagaccaggcctgtgtctgcccggcccaccatggccgccctgctggagaagatccccagcgactacaacctgggcaactacggggacaagcccagcgacaacagcgacctgaagacccggcccacccctgtgaagggggaggagagctgtgggaagatgcctgctgactggaggcagcagctgctgcggcacatcgaggcccggcggctggacagaaatgctgcctacaagcacaacacagtgaacctgggcatgctgccctatggaggcatcagcgccatgcatgctggccgctccatgaccctgaacctgcagaccaagagcaagtttgaccaccaggagctgcccctgcagaagacccccagccagcagagcaacatcctggacaatggccaggaggatgtgagccccagcggccagtggaacccctaccccctgggcagaagagatgtgcccccagacaccatcaccaagaaggccggcagccacatccagaccctgatgggcagccagagcctgcagcacaggagccgggagcagcagccctatgagggcaacatcaacaaggtgaccatccagcagttccagagccccctgcccatccagatccccagcagccaggccacccggggcccccagcccggccgctgcctgatccagaccaagggccagaggtccatggatggctacccagagcagttctgtgtgagaattgagaagaaccctggcctgggcttcagcatcagcggcggcatcagcggccagggcaaccccttcaagcccagcgacaagggcatctttgtgaccagggtgcagccagatggccctgccagcaacctgctgcagcccggggacaagatcctgcaggccaacggccacagctttgtgcacatggagcacgagaaggctgtgctgctgctgaagagcttccagaacacagtggacctggtgatccagcgggagctgactgtgtag

SEQ ID NO: 157511 - DNA, 2433 bp, Artificial Sequence
  Description of Artificial Sequence: Synthetic coding sequence
atgatccctgtgacagagctgcgctactttgctgacacccagcctgcctaccgcatcctgaagccctggtgggatgtgttcacagactacatcagcatcgtgatgctgatgattgctgtgtttggaggcaccctgcaggtgacccaggacaagatgatctgcctgccctgcaagtgggtgaccaaggacagctgcaatgacagcttccggggctgggccgcccctggccctgagcccacctaccccaacagcaccatcctgcccaccccagacaccggccccaccggcatcaagtatgacctggacagacaccagtacaactacgtggatgctgtgtgctatgaaaatcggctgcactggtttgccaagtacttcccctacctggtgctgctgcacaccctcatcttcctggcctgcagcaacttctggttcaagttccccaggaccagcagcaagctggagcactttgtgtccatcctgctgaagtgctttgacagcccctggaccacccgggccctgtctgagaccgtggtggaggagagtgaccccaagccagccttcagcaagatgaatggctccatggacaagaagagcagcacagtgtctgaagatgtggaggccaccgtgcccatgctgcagaggaccaagagcagaattgagcagggcatcgtggacagaagtgaaacaggagtgctggacaagaaggagggggagcaggccaaggccctgtttgagaaggtgaagaagttccgcacccacgtggaggagggggacatcgtgtaccgcctgtacatgaggcagaccatcatcaaggtgatcaagttcatcctgatcatctgctacacagtgtactacgtgcacaacatcaagtttgatgtggactgcaccgtggacatcgagagcctgaccggctaccgcacctaccgctgtgcccaccccctggccaccctcttcaagatcctggccagcttctacatcagcctggtgatcttctacggcctcatctgcatgtacaccctgtggtggatgctgcggcgcagcctgaagaagtacagctttgagagcatccgggaggagagcagctacagcgacatcccagatgtgaagaatgactttgccttcatgctgcacctgattgaccagtatgaccccctgtacagcaagagatttgctgtgttcctgtctgaggtgtctgagaacaagctgcggcagctgaacctgaacaatgagtggaccctggacaagctgcggcagaggctgaccaagaatgcccaggacaagctggagctgcacctgttcatgctgagcggcatcccagacacagtgtttgacctggtggagctggaggtgctgaagctggagctgatcccagatgtgaccatcccccccagcatcgcccagctgaccggcctgaaggagctgtggctgtaccacacagctgccaagattgaggccccagccctggccttcctgcgggagaacctgcgggccctgcacatcaagttcacagacatcaaggagatccccctgtggatctacagcctgaagaccctggaggagctgcacctgaccggcaacctgtctgctgagaacaaccgctacatcgtgattgatggcctgcgggagctgaagaggctgaaggtgctgcggctgaagagcaacctgagcaagctgccccaggtggtgacagatgtgggcgtgcacctgcagaagctgagcatcaacaatgaaggcaccaagctgattgtgctgaacagcctgaagaagatggccaacctgacagagctggagctgatccgctgtgacctggagcgcatcccccacagcatcttcagcctgcacaacctgcaggagattgacctgaaggacaacaacctgaagaccatcgaggagatcatctccttccagcacctgcaccggctgacctgcctgaagctgtggtacaaccacatcgcctacatccccatccagatcggcaacctgaccaacctggagcggctgtacctgaacagaaacaagattgagaagatccccacccagctgttctactgcaggaagctgcgctacctggacctgagccacaacaacctgaccttcctgcctgctgacatcggcctgctgcagaacctgcagaacctggccatcacagccaaccgcatcgagaccctgcccccagagctgttccagtgcaggaagctgcgggccctgcacctgggcaacaacgtgctgcagagcctgcccagccgggtgggggagctgaccaacctgacccagatcgagctgcggggcaaccggctggagtgcctgcctgtggagctgggagaatgtcccctgctgaagaggagcggcctggtggtggaggaggacctcttcaacaccctgcccccagaggtgaaggagcggctgtggagggctgacaaggagcaggcctag

SEQ ID NO: 157512 - DNA, 2433 bp, Artificial Sequence; identical to SEQ ID NO: 157511
  Description of Artificial Sequence: Synthetic coding sequence

SEQ ID NO: 157513 - DNA, 2433 bp, Artificial Sequence; identical to SEQ ID NO: 157511
  Description of Artificial Sequence: Synthetic coding sequence

SEQ ID NO: 157514 - DNA, 2412 bp, Artificial Sequence
  Description of Artificial Sequence: Synthetic coding sequence
atgatcaccctgacagagctgaagtgcctggctgatgcccagagcagctaccacatcctgaagccctggtgggatgtgttctggtactacatcaccctcatcatgctgctggtggccgtgctggccggggccctgcagctgacccagagccgggtgctgtgctgcctgccctgcaaggtggagtttgacaaccactgtgctgtgccctgggacatcctgaaggcctccatgaacaccagcagcaaccctggcacccccctgcccctgcccctgcgcatccagaatgacctgcaccggcagcagtacagctacattgatgctgtgtgctatgagaagcagctgcactggtttgccaagttcttcccctacctggtgctgctgcacaccctcatctttgctgcctgcagcaacttctggctgcactaccccagcaccagcagccggctggagcactttgtggccatcctgcacaagtgctttgacagcccctggaccacccgggccctgtctgagaccgtggccgagcagagcgtgcggcccctgaagctgagcaagagcaagatcctgctgagcagcagcggctgcagcgctgacattgattctgggaagcagagcctgccctacccccagcccggcctggagagcgctggcatcgagagccccaccagctctgtgctggacaagaaggagggggagcaggccaaggccatctttgagaaggtgaagcgcttcaggatgcacgtggagcagaaggacatcatctacagagtgtacctgaagcagatcatcgtgaaggtgatcctgtttgtgctgatcatcacctacgtgccctacttcctgacccacatcaccctggagattgactgcagcgtggatgtgcaggccttcaccggctacaagcgctaccagtgtgtgtacagcctggccgagatcttcaaggtgctggccagcttctacgtgatcctggtgatcctgtatggcctgaccagcagctacagcctgtggtggatgctgcggagcagcctgaagcagtacagctttgaggccctgcgggagaagagcaactacagcgacatcccagatgtgaagaatgactttgccttcatcctgcacctggccgaccagtatgaccccctgtacagcaagcgcttcagcatcttcctgtctgaggtgtctgagaacaagctgaagcagatcaacctgaacaatgagtggacagtggagaagctgaagagcaagctggtgaagaatgcccaggacaagattgagctgcacctgttcatgctgaatggcctgcctgacaacgtgtttgagctgacagagatggaggtgctgagcctggagctgatccctgaggtgaagctgcccagcgctgtgtcccagctggtgaacctgaaggagctgcgggtgtaccacagcagcctggtggtggaccacccagccctggccttcctggaggagaacctgaagatcctgcggctgaagttcacagagatgggcaagatcccccgctgggtgttccacctgaagaacctgaaggagctgtacctgagcggctgtgtgctgcctgagcagctgagcaccatgcagctggagggcttccaggacctgaagaacctgcggaccctgtacctgaagagcagcctgagccgcatcccccaggtggtgacagacctgctgcccagcctgcagaagctgagcctggacaatgaaggcagcaagctggtggtgctgaacaacctgaagaagatggtgaacctgaagagcctggagctgatcagctgtgacctggagcgcatcccccacagcatcttcagcctgaacaacctgcacgagctggacctgcgggagaacaacctgaagacagtggaggagatcatctccttccagcacctgcagaacctgagctgcctgaagctgtggcacaacaacatcgcctacatcccagcccagatcggggccctgagcaacctggagcagctgagcctggaccacaacaacatcgagaacctgcccctgcagctgttcctgtgcaccaagctgcactacctggacctgagctacaaccacctgaccttcatccctgaggagatccagtacctgagcaacctgcagtactttgctgtgaccaacaacaacatcgagatgctgcctgatggcctcttccagtgcaagaagctgcagtgcctgctgctgggcaagaacagcctgatgaacctgagcccccacgtgggggagctgagcaacctgacccacctggagctgattggcaactacctggagaccctgcccccagagctggagggctgccagagcctgaagaggaactgcctgattgtggaggagaacctgctgaacaccctgcccctgcctgtgacagagcggctgcagacctgcctggacaagtgctag

SEQ ID NO: 157515 - DNA, 2412 bp, Artificial Sequence; identical to SEQ ID NO: 157514
  Description of Artificial Sequence: Synthetic coding sequence

SEQ ID NO: 157516 - DNA, 2412 bp, Artificial Sequence; identical to SEQ ID NO: 157514
  Description of Artificial Sequence: Synthetic coding sequence

SEQ ID NO: 157517 - DNA, 312 bp, Artificial Sequence
  Description of Artificial Sequence: Synthetic coding sequence
atgatcaccctgacagagctgaagtgcctggctgatgcccagagcagctaccacatcctgaagccctggtgggatgtgttctggtactacatcaccctcatcatgctgctggtggccgtgctggccggggccctgcagctgacccagagccgggtgctgtgctgcctgccctgcaaggtggagtttgacaaccactgtgctgtgccctgggacatcctgaaggcctccatgaacaccagcagcaaccctggcacccccctgcccctgcccctgcgcatccagaatgacctgcaccggcagcagtacagctag

SEQ ID NO: 157518 - DNA, 693 bp, Artificial Sequence
  Description of Artificial Sequence: Synthetic coding sequence
atgatcaccctgacagagctgaagtgcctggctgatgcccagagcagctaccacatcctgaagccctggtgggatgtgttctggtactacatcaccctcatcatgctgctggtggccgtgctggccggggccctgcagctgacccagagccgggtgctgtgctgcctgccctgcaaggtggagtttgacaaccactgtgctgtgccctgggacatcctgaaggcctccatgaacaccagcagcaaccctggcacccccctgcccctgcccctgcgcatccagaatgacctgcaccggcagcagtacagctacattgatgctgtgtgctatgagaagcagctgcactggtttgccaagttcttcccctacctggtgctgctgcacaccctcatctttgctgcctgcagcaacttctggctgcactaccccagcaccagcagccggctggagcactttgtggccatcctgcacaagtgctttgacagcccctggaccacccgggccctgtctgagaccgtggccgagcagagcgtgcggcccctgaagctgagcaagagcaagatcctgctgagcagcagcggctgcagcgctgacattgattctgggaagcagagcctgccctacccccagcccggcctggagagcgctggcatcgagagccccaccagctctgtgctgacagaaggaggatag

SEQ ID NO: 157519 - DNA, 2412 bp, Artificial Sequence
  Description of Artificial Sequence: Synthetic coding sequence
atgatccctgtgacagagttccggcagttcagcgagcagcagcctgccttccgggtgctgaagccctggtgggatgtgttcacagactacctgtctgtggccatgctgatgattggagtgtttggctgcaccctgcaggtgatgcaggacaagatcatctgcctgcccaagagggtgcagcctgcccagaaccacagcagcctgagcaatgtgtcccaggccgtggccagcaccacccccctgcccccacccaagcccagccctgccaaccccatcaccgtggagatgaagggcctgaagacagacctggacctgcagcagtacagcttcatcaaccagatgtgctatgaaagagccctgcactggtacgccaagtacttcccctacctggtgctgatccacaccctggtgttcatgctgtgcagcaacttctggttcaagtttcctggcagcagcagcaagattgagcacttcatcagcatcctgggcaagtgctttgacagcccctggaccacccgggccctgtctgaggtgtctggagaagattctgaggagaaggacaacaggaagaacaacatgaacagaagcaacaccatccagagcggccctgaggacagcctggtgaacagccagagcctgaagagcatccctgagaagtttgtggtggacaagagcacagctggggccctggacaagaaggagggggagcaggccaaggccctgtttgagaaggtgaagaagttccggctgcacgtggaggagggggacatcctgtatgccatgtatgtgcggcagacagtgctgaaggtgatcaagttcctgatcatcatcgcctacaacagcgccctggtgtccaaggtgcagttcaccgtggactgcaatgtggacatccaggacatgacaggctacaagaacttcagctgcaaccacaccatggcccacctgttcagcaagctgtccttctgctacctgtgctttgtgtccatctacggcctgacctgcctgtacaccctgtactggctgttctaccgcagcctgcgggagtacagctttgaatatgtgcggcaggagaccggcattgatgacatcccagatgtgaagaatgactttgccttcatgctgcacatgattgaccagtatgaccccctgtacagcaagagatttgctgtgttcctgtctgaggtgtctgagaacaagctgaagcagctgaacctgaacaatgagtggaccccagacaagctgcggcagaagctgcagaccaatgcccacaaccggctggagctgcccctcatcatgctgagcggcctgcctgacacagtgtttgagatcacagagctgcagagcctgaagctggagatcatcaagaatgtgatgatcccagccaccatcgcccagctggacaacctgcaggagctgagcctgcaccagtgcagcgtgaagatccacagcgctgccctgtccttcctgaaggagaacctgaaggtgctgtctgtgaagtttgatgacatgagggagctgcccccctggatgtatggcctgaggaacctggaggagctgtacctggtgggcagcctgagccatgacatcagcagaaatgtgaccctggagagcctgcgggacctgaagagcctgaagatcctgagcatcaagagcaatgtgtccaagatcccccaggccgtggtggatgtgagcagccacctgcagaagatgtgcatccacaatgatggcaccaagctggtgatgctgaacaacctgaagaagatgaccaacctgacagagctggagctggtgcactgtgacctggagcgcatcccccatgctgtgttcagcctgctgagcctgcaggagctggacctgaaggagaacaacctgaagagcattgaggagatcgtgtccttccagcacctgaggaagctgactgtgctgaagctgtggcacaacagcatcacctacatccctgagcacatcaagaagctgaccagcctggagcggctgtccttcagccacaacaagattgaggtgctgcccagccacctgttcctgtgcaacaagatccgctacctggacctgagctacaatgacatccgcttcatccccccagaaattggagtgctgcagagcctgcagtacttcagcatcacctgcaacaaggtggagagcctgcctgatgagctgtacttctgcaagaagctgaagaccctgaagattggcaagaacagcctgtctgtgctgagccccaagattggcaacctgctcttcctgagctacctggatgtgaagggcaaccactttgagatcctgcccccagagctgggggactgccgggccctgaagagagctggcctggtggtggaggatgccctgtttgagaccctgcccagtgatgtgcgggagcagatgaagacagaatag

SEQ ID NO: 157520 - DNA, 2577 bp, Artificial Sequence
  Description of Artificial Sequence: Synthetic coding sequence
atgttcaccctggccgaggtggccagcctgaatgacatccagcccacctaccgcatcctgaagccctggtgggatgtgttcatggactacctggccgtggtgatgctgatggtggccatctttgctggcaccatgcagctgaccaaggaccaggtggtgtgcctgcctgtgctgcccagccctgtgaacagcaaggcccacaccccacctggaaatgctgaggtgaccaccaacatccccaagatggaggccgccaccaaccaggaccaggacggccgcaccaccaatgacatcagctttggcaccagcgctgtgaccccagacatccccctgcgggccacctaccccaggacagactttgccctgcccaaccaggaggccaagaaggagaagaaggaccccactggaaggaagaccaacctggacttccagcagtatgtgttcatcaaccagatgtgctaccacctggccctgccctggtacagcaagtacttcccctacctggccctgatccacaccatcatcctgatggtgagcagcaacttctggttcaagtaccccaagacctgcagcaaggtggagcactttgtgtccatcctgggcaagtgctttgagagcccctggaccaccaaggccctgtctgaaacagcctgtgaagattctgaggagaacaagcagaggatcactggagcccagaccctgcccaagcacgtgtccaccagcagtgatgagggcagccccagcgccagcacccccatgatcaacaagacaggcttcaagttctctgctgagaagcctgtgattgaggtgcccagcatgaccatcctggacaagaaggatggagagcaggccaaggccctgtttgagaaggtgaggaagttccgggcccacgtggaggacagcgacctgatctacaagctgtatgtggtgcagaccgtcatcaagacagccaagttcatcttcatcctgtgctacacagccaactttgtgaatgccatcagctttgaacatgtgtgcaagcccaaggtggagcacctgattggctatgaggtgtttgaatgtacccacaacatggcctacatgctgaagaagctgctgatctcctacatcagcatcatctgtgtgtatggcttcatctgcctgtacaccctcttctggctgttccgcatccccctgaaggagtacagctttgagaaggtgcgggaggagagcagcttcagtgacatcccagatgtgaagaatgactttgccttcctgctgcacatggtggaccagtatgaccagctgtacagcaagagatttggagtcttcctgtctgaggtgtctgagaacaagctgcgggagatcagcctgaaccacgagtggacctttgagaagctgcggcagcacatcagcagaaatgcccaggacaagcaggagctgcacctgttcatgctgagcggcgtgcctgatgctgtgtttgacctgacagacctggatgtgctgaagctggagctgatccctgaggccaagatcccagccaagatcagccagatgaccaacctgcaggagctgcacctgtgccactgcccagccaaggtggagcagacagccttctccttcctgcgggaccacctgcgctgcctgcacgtgaagttcacagatgtggccgagatcccagcctgggtgtacctgctgaagaacctgcgggagctgtacctgattggcaacctgaacagcgagaacaacaagatgattggcctggagagcctgcgggagctgcggcacctgaagatcctgcacgtgaagagcaacctgaccaaggtgcccagcaacatcacagatgtggccccccacctgaccaagctggtgatccacaatgatggcaccaagctgctggtgctgaacagcctgaagaagatgatgaatgtggccgagctggagctgcagaactgtgagctggagcgcatcccccacgccatcttcagcctgagcaacctgcaggagctggacctgaagagcaacaacatccgcaccatcgaggagatcatctccttccagcacctgaagaggctgacctgcctgaagctgtggcacaacaagatcgtgaccatccccccatccatcacccacgtgaagaacctggagagcctgtacttcagcaacaacaagctggagagcctgcctgtggccgtgttcagcctgcagaagctgcgctgcctggatgtgtcctacaacaacatctccatgatccccatcgagatcggcctgctgcagaacctgcagcacctgcacatcaccggcaacaaggtggacatcctgcccaagcagctgttcaagtgcatcaagctgcggaccctgaacctgggccagaactgcatcaccagcctgcctgagaaggtgggccagctgagccagctgacccagctggagctgaagggcaactgcctggaccggctgcctgcccagctgggccagtgcaggatgctgaagaagagcggcctggtggtggaggaccacctgtttgacaccctgcccctggaggtgaaggaggccctgaaccaggacatcaacatcccctttgccaacggcatctag

SEQ ID NO: 157521 - DNA, 2577 bp, Artificial Sequence; identical to SEQ ID NO: 157520
  Description of Artificial Sequence: Synthetic coding sequence

SEQ ID NO: 157522 - DNA, 354 bp, Artificial Sequence
  Description of Artificial Sequence: Synthetic coding sequence
atgttcaccctggccgaggtggccagcctgaatgacatccagcccacctaccgcatcctgaagccctggtgggatgtgttcatggactacctggccgtggtgatgctgatggtggccatctttgctggcaccatgcagctgaccaaggaccaggtggtgtgcctgcctgtgctgcccagccctgtgaacagcaaggcccacaccccacctggaaatgctgaggtgaccaccaacatccccaagatggaggccgccaccaaccaggaccaggacggccgcaccaccaatgacatcagctttggcaccagcgctgtgaccccagacatccccctgcgggccacctaccccaggtag

SEQ ID NO: 157523 - DNA, 825 bp, Artificial Sequence
  Description of Artificial Sequence: Synthetic coding sequence
atgttcaccctggccgaggtggccagcctgaatgacatccagcccacctaccgcatcctgaagccctggtgggatgtgttcatggactacctggccgtggtgatgctgatggtggccatctttgctggcaccatgcagctgaccaaggaccaggtggtgtgcctgcctgtgctgcccagccctgtgaacagcaaggcccacaccccacctggaaatgctgaggtgaccaccaacatccccaagatggaggccgccaccaaccaggaccaggacggccgcaccaccaatgacatcagctttggcaccagcgctgtgaccccagacatccccctgcgggccacctaccccaggacagactttgccctgcccaaccaggaggccaagaaggagaagaaggaccccactggaaggaagaccaacctggacttccagcagtatgtgttcatcaaccagatgtgctaccacctggccctgccctggtacagcaagtacttcccctacctggccctgatccacaccatcatcctgatggtgagcagcaacttctggttcaagtaccccaagacctgcagcaaggtggagcactttgtgtccatcctgggcaagtgctttgagagcccctggaccaccaaggccctgtctgaaacagcctgtgaagattctgaggagaacaagcagaggatcactggagcccagaccctgcccaagcacgtgtccaccagcagtgatgagggcagccccagcgccagcacccccatgatcaacaagacaggcttcaagttctctgctgagaagcctgtgattgaggtgcccagcatgacctag

SEQ ID NO: 157524 - DNA, 96 bp, Artificial Sequence
  Description of Artificial Sequence: Synthetic coding sequence
atgttcaccctggccgaggtggccagcctgaatgacatccagcccacctaccgcatcctgaagccctggtgggatgtgttcatggactacctgtag

SEQ ID NO: 157525 - DNA, 564 bp, Artificial Sequence
  Description of Artificial Sequence: Synthetic coding sequence
atgttcaccctggccgaggtggccagcctgaatgacatccagcccacctaccgcatcctgaagccctggtgggatgtgttcatggactacctggccgtggtgatgctgatggtggccatctttgctggcaccatgcagctgaccaaggaccaggtggtgtgcctgcctgtgctgcccagccctgtgaacagcaaggcccacaccccacctggaaatgctgaggtgaccaccaacatccccaagatggaggccgccaccaaccaggaccaggacggccgcaccaccaatgacatcagctttggcaccagcgctgtgaccccagacatccccctgcgggccacctaccccaggacagactttgccctgcccaaccaggaggccaagaaggagaagaaggaccccactggaaggaagaccaacctggacttccagcagtatgtgttcatcaaccagatgtgctaccacctggccctgccctggtacagcaagtacttcccctacctggccctgatccacaccatcatcctgatggtgagcagcaacttctggttcaagtacccctag

SEQ ID NO: 157526 - DNA, 369 bp, Artificial Sequence
  Description of Artificial Sequence: Synthetic coding sequence
atgttcaccctggccgaggtggccagcctgaatgacatccagcccacctaccgcatcctgaagccctggtgggatgtgttcatggactacctggccgtggtgatgctgatggtggccatctttgctggcaccatgcagctgaccaaggaccaggtggtgtgcctgcctgtgctgcccagccctgtgaacagcaaggcccacaccccacctggaaatgctgaggtgaccaccaacatccccaagatggaggccgccaccaaccaggaccaggacggccgcaccaccaatgacatcagctttggcaccagcgctgtgaccccagacatccccctgcgggccacctaccccaggacagactttgccctgtag

SEQ ID NO: 157527 - DNA, 2391 bp, Artificial Sequence
  Description of Artificial Sequence: Synthetic coding sequence
atgatccctgtggccgagttcaagcagttcacagagcagcagcctgccttcaaggtgctgaagccctggtgggatgtgctggccgagtacctgactgtggccatgctgatgattggagtgtttggctgcaccctgcaggtgacccaggacaagatcatctgcctgcccaaccacgagctgcaggagaacctgtctgaggccccctgccagcagctgctgccccggggcatccctgagcagattggagccctgcaggaggtgaagggcctgaagaacaacctggacctgcagcagtacagcttcatcaaccagctgtgctatgaaacagccctgcactggtacgccaagtacttcccctacctggtggtgatccacaccctcatcttcatggtgtgcaccagcttctggttcaagtttcctggcaccagcagcaagattgagcacttcatcagcatcctgggcaaatgttttgacagcccctggaccacccgggccctgtctgaggtgtctggagagaaccagaagggccctgctgccacagaaagagctgctgccaccatcgtggccatggccggcactggacctgggaaggccggggagggggagaaggagaaggtgctggccgagcctgagaaggtggtgacagagccccctgtggtgaccctgctggacaagaaggagggggagcaggccaaggccctgtttgagaaggtgaagaagttcaggatgcacgtggaggagggggacatcctgtacaccatgtacatccggcagacagtgctgaaggtgtgcaagttcctggccatcctggtgtacaacctggtgtatgtggagaagatctccttcctggtggcctgccgggtggagaccagcgaggtgacaggctacgccagcttctgctgcaaccacaccaaggcccacctgttcagcaagctggccttctgctacatcagctttgtgtgcatctacggcctgacctgcatctacaccctgtactggctgttccaccggcccctgaaggagtacagcttccgctctgtgcgggaggagaccggcatgggagacatcccagatgtgaagaatgactttgccttcatgctgcacctgattgaccagtatgacagcctgtacagcaagagatttgctgtgttcctgtctgaggtgtctgagagccggctgaagcagctgaacctgaaccacgagtggaccccagagaagctgcggcagaagctgcagagaaatgctgctggccgcctggagctggccctgtgcatgctgcccggcctgcctgacacagtgtttgagctgtctgaggtggagagcctgcggctggaggccatctgtgacatcaccttccccccaggcctgagccagctggtgcacctgcaggagctgagcctgctgcacagccctgcccggctgcccttcagcctgcaggtgttcctgcgggaccacctgaaggtgatgagggtgaagtgtgaggagctgcgggaggtgcccctgtgggtgtttggcctgcggggcctggaggagctgcacctggagggcctcttcccccaggagctggcccgggccgccaccctggagagcctgcgggagctgaagcagctgaaggtgctgagcctgcggagcaatgctgggaaggtgcctgcctctgtgacagatgtggccggccacctgcagaggctgagcctgcacaatgatggagcccggctggtggccctgaacagcctgaagaagctggccgccctgcgggagctggagctggtggcctgtggcctggagcgcatcccccatgctgtgttcagcctgggcgccctgcaggagctggacctgaaggacaaccacctgcggagcattgaggagatcctgtccttccagcactgcaggaagctggtgaccctgcggctgtggcacaaccagatcgcctacgtgcctgagcacgtgaggaagctgcggagcctggagcagctgtacctgagctacaacaagctggagaccctgcccagccagctgggcctgtgcagcggcctgcggctgctggatgtgagccacaacggcctgcacagcctgcccccagaggtgggcctgctgcagaacctgcagcacctggccctgagctacaatgccctggaggccctgcctgaggagctgttcttctgcaggaagctgcggaccctgctgctgggggacaaccagctgagccagctgagcccccacgtgggcgccctgcgggccctgagccggctggagctgaagggcaaccggctggaggccctgcctgaggagctgggcaactgtggcggcctgaagaaggccggcctgctggtggaggacaccctgtaccagggcctgcctgctgaggtgcgggacaagatggaggaggagtag

SEQ ID NO: 157528 - DNA, 1569 bp, Artificial Sequence
  Description of Artificial Sequence: Synthetic coding sequence
atggacttcctgctgctgggcctgtgcctgtactggctgctgcggcggcccagcggcgtggtgctgtgcctgctgggcgcctgcttccagatgctgcctgctgcccccagcggctgcccccagctgtgccgctgtgagggccgcctgctgtactgtgaggccctgaacctgacagaggccccccacaacctgagcggcctgctgggcctgagcctgcgctacaacagcctgtctgagctgcgggccggccagttcaccggcctgatgcagctgacctggctgtacctggaccacaaccacatctgcagcgtgcagggagatgccttccagaagctgcggcgggtgaaggagctgaccctgagcagcaaccagatcacccagctgcccaacaccaccttccggcccatgcccaacctgcggtctgtggacctgagctacaacaagctgcaggccctggccccagacctcttccacggcctgaggaagctgaccaccctgcacatgagggccaatgccatccagtttgtgcctgtgcgcatcttccaggactgccgcagcctgaagttcctggacatcggctacaaccagctgaagagcctggccaggaacagctttgctggcctcttcaagctgacagagctgcacctggagcacaatgacctggtgaaggtgaactttgcccacttccccaggctcatcagcctgcacagcctgtgcctgcggaggaacaaggtggccatcgtggtgagcagcctggactgggtgtggaacctggagaagatggacctgtctggaaatgaaattgagtacatggagccccacgtgtttgagaccgtgccccacctgcagagcctgcagctggacagcaaccggctgacctacatcgagccccgcatcctgaacagctggaagagcctgaccagcatcaccctggccggcaacctgtgggactgtggcagaaatgtgtgtgccctggcctcctggctgaacaacttccagggccgctatgatggcaacctgcagtgtgccagcccagaatatgcccagggagaagatgtgctggatgctgtgtatgccttccacctgtgtgaagatggagctgagcccaccagcggccacctgctgtctgctgtgaccaacagaagtgacctgggccccccagccagcagcgccaccaccctggctgatggaggagagggccagcatgatggcacctttgagcccgccaccgtggccctgcccggcggggagcacgccgagaatgctgtgcagatccacaaggtggtgacaggcaccatggccctgatcttctccttcctgattgtggtgctggtgctgtatgtgtcctggaagtgcttccctgccagcctgcggcagctgcggcagtgctttgtgacccagaggaggaagcagaagcagaagcagaccatgcaccagatggccgccatgtctgcccaggagtactacgtggactacaagcccaaccacattgaaggagccctggtgatcatcaatgaatatggcagctgcacctgccaccagcagcctgccagagaatgtgaggtgtag

SEQ ID NO: 157529 - DNA, 1569 bp, Artificial Sequence; identical to SEQ ID NO: 157528
  Description of Artificial Sequence: Synthetic coding sequence

SEQ ID NO: 157530 - DNA, 330 bp, Artificial Sequence
  Description of Artificial Sequence: Synthetic coding sequence
atggacttcctgctgctgggcctgtgcctgtactggctgctgcggcggcccagcggcgtggtgctgtgcctgctgggcgcctgcttccagatgctgcctgctgcccccagcggctgcccccagctgtgccgctgtgagggccgcctgctgtactgtgaggccctgaacctgacagaggccccccacaacctgagcggcctgctgggcctgagcctgcgctacaacagcctgtctgagctgcgggccggccagttcaccggcctgatgcagctgacctggctgtacctggaccacaaccacatctgcagcgtgcagggagatgccttctag

SEQ ID NO: 157531 - DNA, 672 bp, Artificial Sequence
  Description of Artificial Sequence: Synthetic coding sequence
atggacttcctgctgctgggcctgtgcctgtactggctgctgcggcggcccagcggcgtggtgctgtgcctgctgggcgcctgcttccagatgctgcctgctgcccccagcggctgcccccagctgtgccgctgtgagggccgcctgctgtactgtgaggccctgaacctgacagaggccccccacaacctgagcggcctgctgggcctgagcctgcgctacaacagcctgtctgagctgcgggccggccagttcaccggcctgatgcagctgacctggctgtacctggaccacaaccacatctgcagcgtgcagggagatgccttccagaagctgcggcgggtgaaggagctgaccctgagcagcaaccagatcacccagctgcccaacaccaccttccggcccatgcccaacctgcggtctgtggacctgagctacaacaagctgcaggccctggccccagacctcttccacggcctgaggaagctgaccaccctgcacatgagggccaatgccatccagtttgtgcctgtgcgcatcttccaggactgccgcagcctgaagttcctggacatcggctacaaccagctgaagagcctggccaggaacagctttgctggcctcttcaagctgacagagctgcacctggagcacaatgacctggtgaagtag

SEQ ID NO: 157532 - DNA, 1569 bp, Artificial Sequence; identical to SEQ ID NO: 157528
  Description of Artificial Sequence: Synthetic coding sequence

SEQ ID NO: 157533 - DNA, 1569 bp, Artificial Sequence; identical to SEQ ID NO: 157528
  Description of Artificial Sequence: Synthetic coding sequence

SEQ ID NO: 157534 - DNA, 552 bp, Artificial Sequence
  Description of Artificial Sequence: Synthetic coding sequence
atggacttcctgctgctgggcctgtgcctgtactggctgctgcggcggcccagcggcgtggtgctgtgcctgctgggcgcctgcttccagatgctgcctgctgcccccagcggctgcccccagctgtgccgctgtgagggccgcctgctgtactgtgaggccctgaacctgacagaggccccccacaacctgagcggcctgctgggcctgagcctgcgctacaacagcctgtctgagctgcgggccggccagttcaccggcctgatgcagctgacctggctgtacctggaccacaaccacatctgcagcgtgcagggagatgccttccagaagctgcggcgggtgaaggagctgaccctgagcagcaaccagatcacccagctgcccaacaccaccttccggcccatgcccaacctgcggtctgtggacctgagctacaacaagctgcaggccctggccccagacctcttccacggcctgaggaagctgaccaccctgcacatgagggccaatgccatccagtttgtgcctgtgcgcatcttccaggactag

SEQ ID NO: 157535 - DNA, 1551 bp, Artificial Sequence
  Description of Artificial Sequence: Synthetic coding sequence
atgggcctgcacttcaagtggcccctgggcgcccccatgctggccgccatctatgccatgtccatggtgctgaagatgctgcctgccctgggcatggcctgcccccccaagtgccgctgtgagaagctgctcttctactgtgacagccagggcttccacagcgtgcccaatgccacagacaagggcagcctgggcctgagcctgcggcacaaccacatcacagagctggagcgggaccagtttgccagcttcagccagctgacctggctgcacctggaccacaaccagatcagcacagtgaaggaggatgccttccagggcctgtacaagctgaaggagctgatcctgagcagcaacaagatcttctacctgcccaacaccaccttcacccagctgatcaacctgcagaacctggacctgtccttcaaccagctgagcagcctgcaccctgagctgttctacggcctgaggaagctgcagaccctgcacctgcggagcaacagcctgcggaccatccctgtgcggctcttctgggactgccgcagcctggagttcctggacctgagcaccaaccggctgcggagcctggccagaaatggatttgctggcctcatcaagctgcgggagctgcacctggagcacaaccagctgaccaagatcaactttgcccacttcctgcggctgagcagcctgcacaccctcttcctgcagtggaacaagatcagcaacctgacctgtggcatggagtggacctggggcaccctggagaagctggacctgactggaaatgagatcaaggccatcgacctgactgtgtttgagaccatgcccaacctgaagatcctgctgatggacaacaacaagctgaacagcctggacagcaagatcctgaacagcctgcggagcctgaccaccgtgggcctgagcggcaacctgtgggagtgcagcgcccgcatctgtgccctggcctcctggctgggcagcttccagggccgctgggagcacagcatcctgtgccacagcccagaccacacccagggcgaggacatcctggatgctgtgcacggcttccagctgtgctggaacctgagcaccaccgtgacagtgatggccaccacctacagagaccccaccacagagtacaccaagaggatcagcagcagcagctaccacgtgggggacaaggagatccccaccacagctggcattgctgtgaccacagaggagcacttccctgagccagacaatgccatcttcacccagagggtcatcaccggcaccatggccctgctcttctccttcttcttcatcatcttcatcgtgttcatcagcaggaagtgctgcccccccaccctgcggcgcatccggcagtgcagcatggtgcagaaccaccggcagctgcggagccagacccggctgcacatgagcaacatgtctgaccagggcccctacaatgaatatgagcccacccatgagggccccttcatcatcatcaatggctacggccagtgcaagtgccagcagctgccctacaaggaatgtgaggtgtag

SEQ ID NO: 157536 - DNA, 1746 bp, Artificial Sequence
  Description of Artificial Sequence: Synthetic coding sequence
atgggcttcaacgtcatccggctgctgagcggcagcgctgtggccctggtgattgcccccaccgtgctgctgaccatgctgagcagcgctgagcggggctgccccaagggctgccgctgtgagggcaagatggtgtactgtgagagccagaagctgcaggagatccccagcagcatctctgctggctgcctgggcctgagcctgcgctacaacagcctgcagaagctgaagtacaaccagttcaagggcctgaaccagctgacctggctgtacctggaccacaaccacatcagcaacattgatgaaaatgccttcaacggcatccggcggctgaaggagctgatcctgagcagcaaccgcatctcctacttcctgaacaacaccttccggcctgtgaccaacctgaggaacctggacctgagctacaaccagctgcacagcctgggcagcgagcagttccggggcctgaggaagctgctgagcctgcacctgcggagcaacagcctgcggaccatccctgtgcgcatcttccaggactgcaggaacctggagctgctggacctgggctacaaccgcatccgcagcctggccagaaatgtgtttgctggcatgatccggctgaaggagctgcacctggagcacaaccagttcagcaagctgaacctggccctcttcccccggctggtgtccctgcagaacctgtacctgcagtggaacaagatcagcgtcatcggccagaccatgtcctggacctggagcagcctgcagaggctggacctgtctggaaatgaaattgaggccttcagcggccccagcgtcttccagtgtgtgcccaacctgcagaggctgaacctggacagcaacaagctgaccttcatcggccaggagatcctggacagctggatcagcctgaatgacatcagcctggccggcaacatctgggagtgcagcaggaacatctgcagcctggtgaactggctgaagagcttcaagggcctgcgggagaacaccatcatctgtgccagccccaaggagctgcagggcgtgaatgtgattgatgctgtgaagaactacagcatctgtgggaagagcaccacagaaagatttgacctggcccgggccctgcccaagcccaccttcaagcccaagctgccccggcccaagcatgagagcaagccacccctgccccccaccgtgggcgccacagagcccggccctgagacagatgctgatgctgagcacatctccttccacaagatcatcgccggctctgtggccctcttcctgtctgtgctggtgatcctgctggtgatctacgtgtcctggaagcgctacccagcctccatgaagcagctgcagcagaggagcctgatgagaagacacaggaagaagaagaggcagagcctgaagcagatgacccccagcacccaggagttctacgtggactacaagcccaccaacacagagaccagcgagatgctgctgaatggcaccggcccctgcacctacaacaagagcggcagccgggagtgtgagatccccctgtccatgaatgtgtccaccttcctggcctatgaccagcccaccatctcctactgcggcgtgcaccacgagctgctgagccacaagagctttgagaccaatgcccaggaggacaccatggagacccacctggagacagagctggacctgagcaccatcaccacagctggccgcatcagtgaccacaagcagcagctggcctag

SEQ ID NO: 157537 - DNA, 1746 bp, Artificial Sequence; identical to SEQ ID NO: 157536
  Description of Artificial Sequence: Synthetic coding sequence

SEQ ID NO: 157538 - DNA, 1557 bp, Artificial Sequence
  Description of Artificial Sequence: Synthetic coding sequence
atgggcttccacctgatcacccagctgaagggcatgtctgtggtgctggtgctgctgcccaccctgctgctggtgatgctgaccggggcccagagggcctgccccaagaactgccgctgtgatggcaagatcgtgtactgtgagagccacgcctttgctgacatccctgagaacatcagcggcggcagccagggcctgagcctgcgcttcaacagcatccagaagctgaagagcaaccagtttgctggcctgaaccagctgatctggctgtacctggaccacaactacatcagctctgtggatgaagatgccttccagggcatccggcggctgaaggagctgatcctgagcagcaacaagatcacctacctgcacaacaagaccttccaccctgtgcccaacctgaggaacctggacctgagctacaacaagctgcagaccctgcagagcgagcagttcaagggcctgaggaagctgatcatcctgcacctgcggagcaacagcctgaagacagtgcccatccgggtcttccaggactgcaggaacctggacttcctggacctgggctacaaccggctgcggagcctgagcagaaatgcctttgctggcctgctgaagctgaaggagctgcacctggagcacaaccagttcagcaagatcaactttgcccacttccccaggctcttcaacctgcggagcatctacctgcagtggaaccgcatccgcagcatcagccagggcctgacctggacctggagcagcctgcacaacctggacctgtctggaaatgacatccagggcatcgagcccggcaccttcaagtgcctgcccaacctgcagaagctgaacctggacagcaacaagctgaccaacatcagccaggagaccgtgaatgcctggatcagcctcatcagcatcaccctgagcggcaacatgtgggagtgcagccgcagcatctgccccctcttctactggctgaagaacttcaagggcaacaaggagagcaccatgatctgtgccggccccaagcacatccagggcgagaaggtgtctgatgctgtggagacctacaacatctgcagcgaggtgcaggtggtgaacacagagaggagccacctggtgccccagaccccccagaagcccctcatcatcccccggcccaccatcttcaagccagatgtgacccagagcacctttgagacccccagccccagccctggcttccagatccctggagctgagcaggagtatgaacatgtgtccttccacaagatcatcgccggctctgtggccctcttcctgtctgtggccatgatcctgctggtgatctacgtgtcctggaagcgctacccagcctccatgaagcagctgcagcagcacagcctgatgaagagaagaaggaagaaggcccgggagagcgagcggcagatgaacagccccctgcaggagtactacgtggactacaagcccaccaacagcgagaccatggacatctctgtgaatggaagtggcccctgcacctacaccatcagcggcagcagagaatgtgaggtgtag

SEQ ID NO: 157539 - DNA, 1773 bp, Artificial Sequence
  Description of Artificial Sequence: Synthetic coding sequence
atgggcttccacctgatcacccagctgaagggcatgtctgtggtgctggtgctgctgcccaccctgctgctggtgatgctgaccggggcccagagggcctgccccaagaactgccgctgtgatggcaagatcgtgtactgtgagagccacgcctttgctgacatccctgagaacatcagcggcggcagccagggcctgagcctgcgcttcaacagcatccagaagctgaagagcaaccagtttgctggcctgaaccagctgatctggctgtacctggaccacaactacatcagctctgtggatgaagatgccttccagggcatccggcggctgaaggagctgatcctgagcagcaacaagatcacctacctgcacaacaagaccttccaccctgtgcccaacctgaggaacctggacctgagctacaacaagctgcagaccctgcagagcgagcagttcaagggcctgaggaagctgatcatcctgcacctgcggagcaacagcctgaagacagtgcccatccgggtcttccaggactgcaggaacctggacttcctggacctgggctacaaccggctgcggagcctgagcagaaatgcctttgctggcctgctgaagctgaaggagctgcacctggagcacaaccagttcagcaagatcaactttgcccacttccccaggctcttcaacctgcggagcatctacctgcagtggaaccgcatccgcagcatcagccagggcctgacctggacctggagcagcctgcacaacctggacctgtctggaaatgacatccagggcatcgagcccggcaccttcaagtgcctgcccaacctgcagaagctgaacctggacagcaacaagctgaccaacatcagccaggagaccgtgaatgcctggatcagcctcatcagcatcaccctgagcggcaacatgtgggagtgcagccgcagcatctgccccctcttctactggctgaagaacttcaagggcaacaaggagagcaccatgatctgtgccggccccaagcacatccagggcgagaaggtgtctgatgctgtggagacctacaacatctgcagcgaggtgcaggtggtgaacacagagaggagccacctggtgccccagaccccccagaagcccctcatcatcccccggcccaccatcttcaagccagatgtgacccagagcacctttgagacccccagccccagccctggcttccagatccctggagctgagcaggagtatgaacatgtgtccttccacaagatcatcgccggctctgtggccctcttcctgtctgtggccatgatcctgctggtgatctacgtgtcctggaagcgctacccagcctccatgaagcagctgcagcagcacagcctgatgaagagaagaaggaagaaggcccgggagagcgagcggcagatgaacagccccctgcaggagtactacgtggactacaagcccaccaacagcgagaccatggacatctctgtgaatggaagtggcccctgcacctacaccatcagcggcagcagagaatgtgagatgccccaccacatgaagcccctgccctactacagctatgaccagcctgtgattggctactgccaggcccaccagcccctgcacgtgaccaagggctatgagaccgtgtccccagagcaggatgagagccctggcctggagctgggccgggaccacagcttcatcgccaccatcgcccggtctgctgccccagccatctacctggagcgcatcgccaactag

SEQ ID NO: 157540 - DNA, 1773 bp, Artificial Sequence; identical to SEQ ID NO: 157539
  Description of Artificial Sequence: Synthetic coding sequence

SEQ ID NO: 157541 - DNA, 1776 bp, Artificial Sequence
  Description of Artificial Sequence: Synthetic coding sequence
atgcctggcttccacctgatcacccagctgaagggcatgtctgtggtgctggtgctgctgcccaccctgctgctggtgatgctgactggagcccagagggcctgccccaagaactgccgctgtgatggcaagatcgtgtactgtgagagccacgcctttgctgacatccctgagaacatcagcggcggcagccagggcctgagcctgcgcttcaacagcatccagaagctgaagagcaaccagtttgctggcctgaaccagctgatctggctgtacctggaccacaactacatcagctctgtggatgaagatgccttccagggcatccggcggctgaaggagctgatcctgagcagcaacaagatcacctacctgcacaacaagaccttccaccctgtgcccaacctgaggaacctggacctgagctacaacaagctgcagaccctgcagagcgagcagttcaagggcctgaggaagctgatcatcctgcacctgcggagcaacagcctgaagacagtgcccatccgggtcttccaggactgcaggaacctggacttcctggacctgggctacaaccggctgcggagcctgagcagaaatgcctttgctggcctgctgaagctgaaggagctgcacctggagcacaaccagttcagcaagatcaactttgcccacttccccaggctcttcaacctgcggagcatctacctgcagtggaaccgcatccgcagcatcagccagggcctgacctggacctggagcagcctgcacaacctggacctgtctggaaatgacatccagggcatcgagcccggcaccttcaagtgcctgcccaacctgcagaagctgaacctggacagcaacaagctgaccaacatcagccaggagaccgtgaatgcctggatcagcctcatcagcatcaccctgagcggcaacatgtgggagtgcagccgcagcatctgccccctcttctactggctgaagaacttcaagggcaacaaggagagcaccatgatctgtgccggccccaagcacatccagggcgagaaggtgtctgatgctgtggagacctacaacatctgcagcgaggtgcaggtggtgaacacagagaggagccacctggtgccccagaccccccagaagcccctcatcatcccccggcccaccatcttcaagccagatgtgacccagagcacctttgagacccccagccccagccctggcttccagatccctggagctgagcaggagtatgagcacgtgtccttccacaagatcatcgccggctctgtggccctcttcctgtctgtggccatgatcctgctggtgatctacgtgtcctggaagcgctacccagcctccatgaagcagctgcagcagcacagcctgatgaagagaagaaggaagaaggcccgggagagcgagcggcagatgaacagccccctgcaggagtactacgtggactacaagcccaccaacagcgagaccatggacatctctgtgaatggcagcggcccctgcacctacaccatcagcggcagccgggagtgtgagatgccccaccacatgaagcccctgccctactacagctatgaccagcccgtcatcggctactgccaggcccaccagcccctgcacgtgaccaagggctatgaaacagtgtccccagagcaggatgagagccctggcctggagctgggccgggaccacagcttcatcgccaccatcgcccggtctgctgccccagccatctacctggagagaattgccaactag

SEQ ID NO: 157542 - DNA, 579 bp, Artificial Sequence
  Description of Artificial Sequence: Synthetic coding sequence
atgaacaagagggactacatgaacacctctgtgcaggagccccccctggactacagcttccgcagcatccacgtgatccaggacctggtgaatgaggagcccaggacaggcctgcggcccctgaagaggagcaagagcggcaagagcctgacccagagcctgtggctgaacaacaacgtgctgaatgacctgcgggacttcaaccaggtggccagccagctgctggagcaccctgagaacctggcctggattgacctgtccttcaatgacctgaccagcattgatcctgtgctgaccaccttcttcaacctgtctgtgctgtacctgcacggcaacagcatccagaggctgggggaggtgaacaagctggccgtgctgccccggctgcggagcctgaccctgcacggcaaccccatggaggaggagaagggctaccggcagtatgtgctgtgcaccctgagccgcatcaccacctttgacttcagcggcgtgaccaaggctgacaggaccacagctgaggtgtggaagaggatgaacatcaagcccaagaaggcctggaccaagcagaacaccctgtag

SEQ ID NO: 157543 - DNA, 876 bp, Artificial Sequence
  Description of Artificial Sequence: Synthetic coding sequence
atgggcaccccctggaggaagaggaaaggaattgctggccctggcctgcctgacctgagctgtgccctggtgctgcagccccgggcccaggtgggcaccatgagccctgccatcgccctggccttcctgcccctggtggtgaccctgctggtgcgctaccgccactacttccggctgctggtgaggacagtgctgctgcggagcctgcgggactgcctgagcggcctgcgcatcgaggagcgggccttctcctatgtgctgacccacgccctgcccggggaccccggccacatcctgaccaccctggaccactggagcagccgctgtgagtacctgagccacatgggccctgtgaagggccagatcctgatgaggctggtggaggagaaggccccagcctgtgtgctggagctgggcacctactgcggctacagcaccctgctgattgcccgggccctgcccccaggcggccgcctgctgactgtggagcgggaccccaggacagctgctgtggccgagaagctgatccggctggccggctttgatgagcacatggtggagctgattgtgggcagcagtgaagatgtgatcccctgcctgcggacccagtaccagctgagcagagctgacctggtgctgctggcccaccggccccgctgctacctgcgggacctgcagctgctggaggcccacgccctgctgcctgctggggccaccgtgctggccgaccacgtgctcttccctggggccccccgcttcctgcagtatgccaagagctgtggccgctaccgctgccgcctgcaccacacaggcctgcctgacttccctgccatcaaggatggcatcgcccagctgacctacgccggccctggatag

SEQ ID NO: 157544 - DNA, 441 bp, Artificial Sequence
  Description of Artificial Sequence: Synthetic coding sequence
atgaacaagagggactacatgaacacctctgtgcaggagccccccctggactacagcttccgcagcatccacgtgatccaggacctggtgaatgaggagcccaggacaggcctgcggcccctgaagaggagcaagagcggcaagagcctgacccagagcctgtggctgaacaacaacgtgctgaatgacctgcgggacttcaaccaggtggccagccagctgctggagcaccctgagaacctggcctggattgacctgtccttcaatgacctgaccagcattgatcctgtgctgaccaccttcttcaacctgtctgtgctgtacctgcacggcaacagcatccagaggctgggggaggtgaacaagctggccgtgctgccccggctgcggagcctgaccctgcacggcaaccccatggaggaggagaagggctacagatag

SEQ ID NO: 157545 - DNA, 756 bp, Artificial Sequence
  Description of Artificial Sequence: Synthetic coding sequence
atgggcaccccctggaggaagaggaaaggaattgctggccctggcctgcctgacctgagctgtgccctggtgctgcagcccagcctgcgggactgcctgagcggcctgcgcatcgaggagcgggccttctcctatgtgctgacccacgccctgcccggggaccccggccacatcctgaccaccctggaccactggagcagccgctgtgagtacctgagccacatgggccctgtgaagggccagatcctgatgaggctggtggaggagaaggccccagcctgtgtgctggagctgggcacctactgcggctacagcaccctgctgattgcccgggccctgcccccaggcggccgcctgctgactgtggagcgggaccccaggacagctgctgtggccgagaagctgatccggctggccggctttgatgagcacatggtggagctgattgtgggcagcagtgaagatgtgatcccctgcctgcggacccagtaccagctgagcagagctgacctggtgctgctggcccaccggccccgctgctacctgcgggacctgcagctgctggaggcccacgccctgctgcctgctggggccaccgtgctggccgaccacgtgctcttccctggggccccccgcttcctgcagtatgccaagagctgtggccgctaccgctgccgcctgcaccacacaggcctgcctgacttccctgccatcaaggatggcatcgcccagctgacctacgccggccctggatag

SEQ ID NO: 157546 - DNA, 876 bp, Artificial Sequence; identical to SEQ ID NO: 157543
  Description of Artificial Sequence: Synthetic coding sequence

SEQ ID NO: 157547 - DNA, 477 bp, Artificial Sequence
  Description of Artificial Sequence: Synthetic coding sequence
atgaacaagagggactacatgaacacctctgtgcaggagccccccctggactacagcttccgcagcatccacgtgatccaggacctggtgaatgaggagcccaggacaggcctgcggcccctgaagaggagcaagagcggcaagagcctgacccagagcctgtggctgaacaacaacgtgctgaatgacctgcgggacttcaaccaggtggccagccagctgctggagcaccctgagaacctggcctggattgacctgtccttcaatgacctgaccagcattgatcctgtgctgaccaccttcttcaacctgtctgtgctgtacctgcacggcaacagcatccagaggctgggggaggtgaacaagctggccgtgctgccccggctgcggagcctgaccctgcacggcaaccccatggaggaggagaagggctacagagtgcccggctctgtggagatgccccacaggcctccttag

SEQ ID NO: 157548 - DNA, 279 bp, Artificial Sequence
  Description of Artificial Sequence: Synthetic coding sequence
atgaacaagagggactacatgaacacctctgtgcaggagccccccctggactacagcttccgcagcatccacgtgatccaggacctggtgaatgaggagcccaggacaggcctgcggcccctgaagaggagcaagagcggcaagagcctgacccagagcctgtggctgaacaacaacgtgctgaatgacctgcgggacttcaaccaggtggccagccagctgctggagcaccctgagaacctggcctggattgacctgtccttcaatgacctgacctag

SEQ ID NO: 157549 - DNA, 579 bp, Artificial Sequence; identical to SEQ ID NO: 157542
  Description of Artificial Sequence: Synthetic coding sequence

SEQ ID NO: 157550 - DNA, 477 bp, Artificial Sequence; identical to SEQ ID NO: 157547
  Description of Artificial Sequence: Synthetic coding sequence

SEQ ID NO: 157551 - DNA, 315 bp, Artificial Sequence
  Description of Artificial Sequence: Synthetic coding sequence
atgaacaagagggactacatgaacacctctgtgcaggagccccccctggactacagcttccgcagcatccacgtgatccaggacctggtgaatgaggagcccaggacaggcctgcggcccctgaagaggagcaagagcggcaagagcctgacccagagcctgtggctgaacaacaacgtgctgaatgacctgcgggacttcaaccaggtggccagccagctgctggagcaccctgagaacctggcctggattgacctgtccttcaatgacctgaccagcattgatcctgtgctgaccaccttcttcaacctgtag

SEQ ID NO: 157552 - DNA, 525 bp, Artificial Sequence
  Description of Artificial Sequence: Synthetic coding sequence
atggtggagttccagcccagcgtgacagacctggtgaatgaggagcccaggacaggcctgcggcccctgaagaggagcaagagcggcaagagcctgacccagagcctgtggctgaacaacaacgtgctgaatgacctgcgggacttcaaccaggtggccagccagctgctggagcaccctgagaacctggcctggattgacctgtccttcaatgacctgaccagcattgatcctgtgctgaccaccttcttcaacctgtctgtgctgtacctgcacggcaacagcatccagaggctgggggaggtgaacaagctggccgtgctgccccggctgcggagcctgaccctgcacggcaaccccatggaggaggagaagggctaccggcagtatgtgctgtgcaccctgagccgcatcaccacctttgacttcagcggcgtgaccaaggctgacaggaccacagctgaggtgtggaagaggatgaacatcaagcccaagaaggcctggaccaagcagaacaccctgtag

SEQ ID NO: 157553 - DNA, 3231 bp, Artificial Sequence
  Description of Artificial Sequence: Synthetic coding sequence
atggccgagttcaccagctacaaggagacagccagcagccgccacctgcgcttcaagctgcagagcctgagccggcggctggatgagctggaggaggccaccaagaacctgcagaaggcagaagatgagctgctggacctgcaggacaaggtgatccaggccgagggcagcaacagctccatgctggccgagattgaggtgctgcggcagagggtgctgagaattgagggcaaggatgaggagatcaagagagctgaggacctgtgccgcctgatgaaggagaagctggaggaggaggagaacctgacccgggagctgaagtcagaaattgaaaggctgcagaagaggatggccgagctggagaagctggaggaggccttcagccgcagcaagaatgactgcacccagctgtgcctgagcctgaatgaggagaggaacctgaccaagaagatcagcagcgagctggagatgctgcgggtgaaggtgaaggagctggagagcagtgaagatcggctggacaagacagagcagagcctggccagcgagctggagaagctgaagagcctgaccctgagctttgtgtctgagaggaagtacctgaatgagaaggagaaggaaaatgagaagctgatcaaggagctgacccagaagctggagcagaacaagaagatgaacagagactacaccagaaatgccagcaacctggagagaaatgacctgagaattgaagatggcatcagcagcaccctgcccagcaaggagagcaggaggaagggcggcctggactacctgaagcaggtggagaatgagaccaggaacaagtcagaaaatgagaagaacagaaaccaggaggacaacaaggtgaaggacctgaaccaggagattgagaagctgaagacccagatcaagcactttgagagcctggaggaggagctgaagaagatgaagagcaagaacaatgacctgcaggacaactacctgtctgagcagaacaagaacaagctgctggccagccagctggaggagatcaagctgcagatcaagaagcagaaggagctggagaatggagaggtggagggagaagatgccttcctgagcagcaagggcagacatgagaggaccaagttccggggccacggcagcgaggcctctgtgtccaagcacacagcccgggagctgagcccccagcacaagcgggagcggctgaggaaccgggagtttgccctgaacaatgaaaactacagcctgagcaaccggcaggtgagcagccccagcttcaccaacagaagagctgccaaggccagccacatgggcgtgtccacagattctggcacccaggagaccaagaagacagaggacagatttgtgcccggcagcagccagagcgagggcaagaagagccgggagcagcccagcgtgctgagccgctaccccccagctgcccaggagcacagcaaggcctggaagggcaccagcaagccaggcacagagagcggcctgaagggcaaggtggagaagaccaccaggaccttcagtgacaccacccacggctctgtgcccagcgaccccctgggccgggctgacaaggccagtgacaccagcagcgagaccgtgtttgggaagaggggccacgtgctgggcaatggcagccaggtgacccaggccgccaacagcggctgcagcaaggccatcggggccctggccagcagcagaagaagcagcagcgagggcctgagcaagggcaagaaggccgccaacggcctggaggccgacaacagctgccccaacagcaaggcccctgtgctgagcaagtacccctacagctgccgcagccaggagaacatcctgcagggcttcagcaccagccacaaggagggcgtgaaccagcctgctgctgtggtgatggaggacagcagcccccatgaggccctgcgctgcagggtcatcaagagcagcggccgggagaagccagacagtgatgatgacctggacatcgccagcctggtgacagccaagctggtgaacaccaccatcaccccagagcctgagcccaagccccagcccaacagccgggagaaggccaagaccaggggggcccccaggaccagcctgtttgaaaatgacaaggatgctggcatggagaatgaatctgtgaagtctgtgcgggccagcaccaacaccatggagctgcctgacaccaacggggccggcgtgaagagccagaggcccttcagcccccgggaggccctgcggagccgggccatcatcaagcctgtgattgtggacaaggatgtgaagaagatcatgggcggcagcggcacagagaccaccctggagaagcagaagcctgtgtccaagccaggccccaacaaggtgaccagcagcatcaccatctaccccagcgacagcagcagcccccgggccgcccctggagaggccctgcgggagcggcacaccagcaccagcaacatccaggtgggcctggccgagctgacctctgtgagcaaccacgtgagcagcccctttgagctgagcatccacaagcatgacatcaccctgcagctggccgaggccgagaggatggctgatggccccctgaaggacaggcctgagaccgtggtgagccgcagcagcatcatcatcaagcccagcgaccctgtggagaggaacagccacgcccccccagctgagaccatccgctggaagagccacagcgcccccagcgaggtgggcttcagtgatgcccggcacgtgacagtgagaaatgcctggaagagcagaagagacctgaagagcctggaggacccccccacccgcatcggcaagaatgtggagagcaccaacagcaatgcctacacccagaggagcagcacagacttcagcgagctggagcagcccaggagctgcctgtttgagcagggcacccggcgggtgggccccagcagtggagatgcccctgagcccagcagcaggaggacccagagcagcctgactgtgtctgaggtgctgaccaggaggaacagagtgggggacaccatcaccgtggccgcctggaaccacagcgcctccatggaggaggagggggaggactgcaccctgtctgtgtaccggcagctgcacaacagcctggaccccagcgagctgcccgggaagcagggcctgcctgagagcggccgggtgcgggcagaggagcggctgcggcccacccggccctgtgccgaggagaactag

SEQ ID NO: 157554 - DNA, 3081 bp, Artificial Sequence
  Description of Artificial Sequence: Synthetic coding sequence
atggccgagttcaccagctacaaggagacagccagcagccgccacctgcgcttcaagctgcagagcctgagccggcggctggatgagctggaggaggccaccaagaacctgcagaaggcagaagatgagctgctggacctgcaggacaaggtgatccaggccgagggcagcaacagctccatgctggccgagattgaggtgctgcggcagagggtgctgagaattgagggcaaggatgaggagatcaagagagctgaggacctgtgccgcctgatgaaggagaagctggaggaggaggagaacctgacccgggagctgaagtcagaaattgaaaggctgcagaagaggatggccgagctggagaagctggaggaggccttcagccgcagcaagaatgactgcacccagctgtgcctgagcctgaatgaggagaggaacctgaccaagaagatcagcagcgagctggagatgctgcgggtgaaggtgaaggagctggagagcagtgaagatcggctggacaagacagagcagagcctggccagcgagctggagaagctgaagagcctgaccctgagctttgtgtctgagaggaagtacctgaatgagaaggagaaggaaaatgagaagctgatcaaggagctgacccagaagctggagcagaacaagaagatgaacagagactacaccagaaatgccagcaacctggagagaaatgacctgagaattgaagatggcatcagcagcaccctgcccagcaaggagagcaggaggaagggcggcctggactacctgaagcaggtggagaatgagaccaggaacaagtcagaaaatgagaagaacagaaaccaggaggacaacaaggtgaaggacctgaaccaggagattgagaagctgaagacccagatcaagcactttgagagcctggaggaggagctgaagaagatgaagagcaagaacaatgacctgcaggacaactacctgtctgagcagaacaagaacaagctgctggccagccagctggaggagatcaagctgcagatcaagaagcagaaggagctggagaatggagaggtggagggagaagatgccttcctgagcagcaagggcagacatgagaggaccaagttccggggccacggcagcgaggcctctgtgtccaagcacacagcccgggagctgagcccccagcacaagcgggagcggctgaggaaccgggagtttgccctgaacaatgaaaactacagcctgagcaaccggcaggtgagcagccccagcttcaccaacagaagagctgccaaggccagccacatgggcgtgtccacagattctggcacccaggagaccaagaagacagaggacagatttgtgcccggcagcagccagagcgagggcaagaagagccgggagcagcccagcgtgctgagccgctaccccccagctgcccaggagcacagcaaggcctggaagggcaccagcaagccaggcacagagagcggcctgaagggcaaggtggagaagaccaccaggaccttcagtgacaccacccacggctctgtgcccagcgaccccctgggccgggctgacaaggccagtgacaccagcagcgagaccgtgtttgggaagaggggccacgtgctgggcaatggcagccaggtgacccaggccgccaacagcggctgcagcaaggccatcggggccctggccagcagcagaagaagcagcagcgagggcctgagcaagggcaagaaggccgccaacggcctggaggccgacaacagctgccccaacagcaaggcccctgtgctgagcaagtacccctacagctgccgcagccaggagaacatcctgcagggcttcagcaccagccacaaggagggcgtgaaccagcctgctgctgtggtgatggaggacagcagcccccatgaggccctgcgctgcagggtcatcaagagcagcggccgggagaagccagacagtgatgatgacctggacatcgccagcctggtgacagccaagctggtgaacaccaccatcaccccagagcctgagcccaagccccagcccaacagccgggagaaggccaagaccaggggggcccccaggaccagcctgtttgaaaatgacaaggatgctggcatggagaatgaatctgtgaagtctgtgcgggccagcaccaacaccatggagctgcctgacaccaacggggccggcgtgaagagccagaggcccttcagcccccgggaggccctgcggagccgggccatcatcaagcctgtgattgtggacaaggatgtgaagaagatcatgggcggcagcggcacagagaccaccctggagaagcagaagcctgtgtccaagccaggccccaacaaggtgaccagcagcatcaccatctaccccagcgacagcagcagcccccgggccgcccctggagaggccctgcgggagcggcacaccagcaccagcaacatccaggtgggcctggccgagctgacctctgtgagcaaccacgtgagcagcccctttgagctgagcatccacaagcatgacatcaccctgcagctggccgaggccgagaggatggctgatggccccctgaaggacaggcctgagaccgtggtgagccgcagcagcatcatcatcaagcccagcgaccctgtggagaggaacagccacgcccccccagctgagaccatccgctggaagagccacagcgcccccagcgaggtgggcttcagtgatgcccggcacgtgacagtgagaaatgcctggaagagcagaagagacctgaagagcctggaggacccccccacccgcatcggcaagaatgtggagagcaccaacagcaatgcctacacccagaggagcagcacagacttcagcgagctggagcagcccaggagctgcctgtttgagcagggcacccggcgggtgggccccagcagtggagatgcccctgagcccagcagcaggaggacccagagcagcctgactgtgtctgaggtgctgaccaggaggaacagagtgggggacaccatcaccgtggccgcctggaaccacagcgcctccatgagcagctag

SEQ ID NO: 157555 - DNA, 3231 bp, Artificial Sequence; identical to SEQ ID NO: 157553
  Description of Artificial Sequence: Synthetic coding sequence

SEQ ID NO: 157556 - DNA, 3231 bp, Artificial Sequence; identical to SEQ ID NO: 157553
  Description of Artificial Sequence: Synthetic coding sequence

SEQ ID NO: 157557 - DNA, 822 bp, Artificial Sequence
  Description of Artificial Sequence: Synthetic coding sequence
atggccgagttcaccagctacaaggagacagccagcagccgccacctgcgcttcaagctgcagagcctgagccggcggctggatgagctggaggaggccaccaagaacctgcagaaggcagaagatgagctgctggacctgcaggacaaggtgatccaggccgagggcagcaacagctccatgctggccgagattgaggtgctgcggcagagggtgctgagaattgagggcaaggatgaggagatcaagagagctgaggacctgtgccgcctgatgaaggagaagctggaggaggaggagaacctgacccgggagctgaagtcagaaattgaaaggctgcagaagaggatggccgagctggagaagctggaggaggccttcagccgcagcaagaatgactgcacccagctgtgcctgagcctgaatgaggagaggaacctgaccaagaagatcagcagcgagctggagatgctgcgggtgaaggtgaaggagctggagagcagtgaagatcggctggacaagacagagcagagcctggccagcgagctggagaagctgaagagcctgaccctgagctttgtgtctgagaggaagtacctgaatgagaaggagaaggaaaatgagaagctgatcaaggagctgacccagaagctggagcagaacaagaagatgaacagagactacaccagaaatgccagcaacctggagagaaatgacctgagaattgaagatggcatcagcagcaccctgcccagcaaggagagcaggaggaagggcggcctggactacctgaagcaggtggagaatgagaccaggaactag

SEQ ID NO: 157558 - DNA, 108 bp, Artificial Sequence
  Description of Artificial Sequence: Synthetic coding sequence
atggccgagttcaccagctacaaggagacagccagcagccgccacctgcgcttcaagctgcagagcctgagccggcggctggatgagctggaggaggccaccaagtag

SEQ ID NO: 157559 - DNA, 1041 bp, Artificial Sequence
  Description of Artificial Sequence: Synthetic coding sequence
atgaagttctccccagcccactacctgctgcccctgctgcctgccctggtgctgagcacccggcaggactatgaggagctggagaagcagctgaaggaggtgttcaaggagaggagcaccatcctgcggcagctgaccaagaccagccgggagctggatggcatcaaggtgaacctgcagagcctgaagaatgatgagcagagcgccaagacagatgtgcagaagctgctggagctgggccagaagcagcgggaggagatgaagagcctgcaggaggccctgcagaaccagctgaaggagaccagcgagaaggccgagaagcaccaggccaccatcaacttcctgaagacagaggtggagaggaagagcaagatgatccgggacctgcagaatgaaaacaagagcctgaagaacaagctgctgagcggcaacaagctgtgtggcatccatgctgaggagagcaagaagatccaggcccagctgaaggagctgcgctatggcaagaaggacctgctcttcaaggcccagcagctgacagacctggagcagaagctggccgtggccaagaatgagctggagaaggccgccctggaccgggagagccagatgaaggccatgaaggagaccgtgcagctgtgcctgaccagcgtcttccgggaccagcccccaccacccctgagcctcatcaccagcaaccccaccaggatgctgctgcccccaagaaatattgccagcaagctgcctgatgctgctgccaagagcaagccccagcagagcgccagcggcaacaatgaaagcagccaggtggagagcaccaaggagggcaaccccagcaccacagcctgtgacagccaggatgagggccggccctgcagcatgaagcacaaggagagcccccccagcaatgccacagctgagacagagcccatcccccagaagctgcagatgccaccctgcagtgaatgtgaggtgaagaaggcccctgagaagcccctgaccagctttgagggcatggccgcccgggaggagaagatcctgtag

SEQ ID NO: 157560 - DNA, 783 bp, Artificial Sequence
  Description of Artificial Sequence: Synthetic coding sequence
atgaagagcctgcaggaggccctgcagaaccagctgaaggagaccagcgagaaggccgagaagcaccaggccaccatcaacttcctgaagacagaggtggagaggaagagcaagatgatccgggacctgcagaatgaaaacaagagcctgaagaacaagctgctgagcggcaacaagctgtgtggcatccatgctgaggagagcaagaagatccaggcccagctgaaggagctgcgctatggcaagaaggacctgctcttcaaggcccagcagctgacagacctggagcagaagctggccgtggccaagaatgagctggagaaggccgccctggaccgggagagccagatgaaggccatgaaggagaccgtgcagctgtgcctgaccagcgtcttccgggaccagcccccaccacccctgagcctcatcaccagcaaccccaccaggatgctgctgcccccaagaaatattgccagcaagctgcctgatgctgctgccaagagcaagccccagcagagcgccagcggcaacaatgaaagcagccaggtggagagcaccaaggagggcaaccccagcaccacagcctgtgacagccaggatgagggccggccctgcagcatgaagcacaaggagagcccccccagcaatgccacagctgagacagagcccatcccccagaagctgcagatgccaccctgcagtgaatgtgaggtgaagaaggcccctgagaagcccctgaccagctttgagggcatggccgcccgggaggagaagatcctgtag

SEQ ID NO: 157561 - DNA, 900 bp, Artificial Sequence
  Description of Artificial Sequence: Synthetic coding sequence
atggccgagctgggcctgaatgagcaccaccagaatgaggtgatcaactacatgagatttgcccggagcaagaggggcctgcggctgaagacagtggacagctgcttccaggacctgaaggagagccggctggtggaggacaccttcaccattgatgaggtgtctgaggtgctgaatggcctgcaggccgtggtgcacagcgaggtggagagcgagctgatcaacacagcctacaccaacgtgctgctgctgcggcagctgtttgcccaggccgagaagtggtacctgaagctgcagacagacatcagcgagctggagaaccgggagctgctggagcaggtggccgagtttgagaaggccgagatcaccagcagcaacaagaagcccatcctggatgtgaccaagcccaagctggcccccctgaatgaaggaggaacagctgagctgctgaacaaggagatcctgcggctgcaggaggagaatgagaagctgaagagccggctgaagaccatcgagatccaggccaccaatgccctggatgagaagagcaagctggagaaggccctgcaggacctgcagctggaccagggcaaccagaaggacttcatcaaggcccaggacctgagcaacctggagaacacagtggccgccctgaagtctgagttccagaagaccctgaatgacaagacagagaaccagaagagcctggaggagaacctggccacagccaagcatgacctgctgcgggtgcaggagcagctgcacatggccgagaaggagctggagaagaagttccagcagacagctgcctacagaaacatgaaggagatcctgaccaagaagaatgaccagatcaaggacctgaggaagaggctggcccagtatgagcctgaggactag

SEQ ID NO: 157562 - DNA, 849 bp, Artificial Sequence
  Description of Artificial Sequence: Synthetic coding sequence
atgagatttgcccggagcaagaggggcctgcggctgaagacagtggacagctgcttccaggacctgaaggagagccggctggtggaggacaccttcaccattgatgaggtgtctgaggtgctgaatggcctgcaggccgtggtgcacagcgaggtggagagcgagctgatcaacacagcctacaccaacgtgctgctgctgcggcagctgtttgcccaggccgagaagtggtacctgaagctgcagacagacatcagcgagctggagaaccgggagctgctggagcaggtggccgagtttgagaaggccgagatcaccagcagcaacaagaagcccatcctggatgtgaccaagcccaagctggcccccctgaatgaaggaggaacagctgagctgctgaacaaggagatcctgcggctgcaggaggagaatgagaagctgaagagccggctgaagaccatcgagatccaggccaccaatgccctggatgagaagagcaagctggagaaggccctgcaggacctgcagctggaccagggcaaccagaaggacttcatcaaggcccaggacctgagcaacctggagaacacagtggccgccctgaagtctgagttccagaagaccctgaatgacaagacagagaaccagaagagcctggaggagaacctggccacagccaagcatgacctgctgcgggtgcaggagcagctgcacatggccgagaaggagctggagaagaagttccagcagacagctgcctacagaaacatgaaggagatcctgaccaagaagaatgaccagatcaaggacctgaggaagaggctggcccagtatgagccagaagattag

SEQ ID NO: 157563 - DNA, 771 bp, Artificial Sequence
  Description of Artificial Sequence: Synthetic coding sequence
atgaggaaccaggaccccgggaagatgggccggcagaggaagagcatcaagctgtaccccacccaccccctggtgaccttccccaggtcctgggccaagttccaggagaaggccctgctggtggaggacaccttcaccattgatgaggtgtctgaggtgctgaatggcctgcaggccgtggtgcacagcgaggtggagagcgagctgatcaacacagcctacaccaacgtgctgctgctgcggcagctgtttgcccaggccgagaagtggtacctgaagctgcagacagacatcagcgagctggagaaccgggagctgctggagcaggtggccgagtttgagaaggccgagatcaccagcagcaacaagaagcccatcctggatgtgaccaagcccaagctggcccccctgaatgaaggaggaacagctgagctgctgaacaaggagatcctgcggctgcaggaggagaatgagaagctgaagagccggctgaagaccatcgagatccaggccaccaatgccctggatgagaagagcaagctggagaaggccctgcaggacctgcagctggaccagggcaaccagaaggacttcatcaaggcccaggacctgagcaacctggagaacacagtggccgccctgaagtctgagttccagaagaccctgaatgacaagacagagaaccagaagagcctggaggagaacctggccacagccaagcatgacctgctgcgggtgcaggagcagctgcacatggccgagaagatctag

SEQ ID NO: 157564 - DNA, 441 bp, Artificial Sequence
  Description of Artificial Sequence: Synthetic coding sequence
atggtggatgagctggtgctgctgctgcacgccctgctgatgaggcaccgggccctgagcattgagaacagccagctgatggagcagctgcggctgctggtgtgtgagcgggccagcctgctgcggcaggtgcggccccccagctgccctgtgcccttccctgagaccttcaacggggagagcagccggctgcctgagttcatcgtgcagacagccagctacatgctggtgaatgaaaatcgcttctgcaatgatgccatgaaggtggccttcctgatcagcctgctgactggagaggccgaggagtgggtggtgccctacatcgagatggacagccccatcctgggggactaccgggccttcctggatgagatgaagcagtgcttcggctgggatgatgatgaagatgatgatgatgaggaggaggaggatgactactag

SEQ ID NO: 157565 - DNA, 2220 bp, Artificial Sequence
  Description of Artificial Sequence: Synthetic coding sequence
atggccagcatcctgctgcggagctgccggggccgggccccagcccggctgcccccaccaccccgctacacagtgccccggggcagccctggggaccctgcccacctgagctgtgccagcaccctgggcctgaggaactgcctgaatgtgcccttcggctgctgcacccccatccaccctgtgtacaccagcagcagaggagaccacctgggctgctgggccctgcggcctgagtgcctgcgcatcgtgtcccgggccccctggaccagcacctctgtgggctttgtggccgtgggcccccagtgcctgcctgtgcggggctggcacagcagcaggcctgtgagagatgacagcgtggtggagaagagcctgaagagcctgaaggacaagaacaagaagctggaggagggcggccctgtgtacagccccccagctgaggtggtggtgaagaagagcctgggccagagggtgctggatgagctgaagcactactaccacggcttccggctgctgtggattgacaccaagattgctgccaggatgctgtggaggatcctgaatggccacagcctgacccggcgggagcggcggcagttcctgcgcatctgtgccgacctcttccggctggtgcccttcctggtgtttgtggtggtgcccttcatggagttcctgctgcctgtggccgtgaagctgttccccaacatgctgcccagcacctttgagacccagagcctgaaggaggagcggctgaagaaggagctgcgggtgaagctggagctggccaagttcctgcaggacaccatcgaggagatggccctgaagaacaaggccgccaagggcagcgccaccaaggacttctctgtgttcttccagaagatccgggagaccggggagcggcccagcaatgaggagatcatgaggttcagcaagctgtttgaagatgagctgaccctggacaacctgacccggccccagctggtggccctgtgcaagctgctggagctgcagagcatcggcaccaacaacttcctgcgcttccagctgaccatgaggctgcggagcatcaaggcagatgacaagctgattgctgaggagggcgtggacagcctgaatgtgaaggagctgcaggccgcctgccgggcccggggcatgagggccctgggcgtgacagaagatcggctgcggggccagctgaagcagtggctggacctgcacctgcaccaggagatccccaccagcctgctgatcctgagccgggccatgtacctgcctgacaccctgagccctgctgaccagctgaagagcaccctgcagaccctgcctgagatcgtggccaaggaggcccaggtgaaggtggccgaggtggagggggagcaggtggacaacaaggccaagctggaggccaccctgcaggaggaggccgccatccagcaggagcaccgggagaaggagctgcagaagaggtctgaggtggccaaggactttgagcctgagcgggtggtggccgccccccagaggcctggaacagagccccagcctgagatgccagacacagtgctgcagagcgagaccctgaaggacacagcccctgtgctggagggcctgaaggaggaggagatcaccaaggaggagattgacatcctgagtgatgcctgcagcaagctgcaggagcagaagaagagcctgaccaaggagaaggaggagctggagctgctgaaggaggatgtgcaggactacagcgaggacctgcaggagatcaagaaggagctgagcaagacaggagaggagaagtatgtggaggagagcaaggccagcaagaggctgaccaagagggtgcagcagatgattggccagattgatggcctcatcagccagctggagatggaccagcaggccggcaagctggccccagccaacggcatgcccactggagaaaatgtcatctctgtggccgagctgatcaatgccatgaagcaggtgaagcacatccctgagagcaagctgaccagcctggccgccgccctggatgagaacaaggatggcaaggtgaacattgatgacctggtgaaggtgattgagctggtggacaaggaggatgtgcacatcagcaccagccaggtggccgagatcgtggccaccctggagaaggaggagaaggtggaggagaaggagaaggccaaggagaaggccgagaaggaggtggccgaggtgaagagctag

SEQ ID NO: 157566 - DNA, 759 bp, Artificial Sequence
  Description of Artificial Sequence: Synthetic coding sequence
atgaggcacacctggcccttcagaaatgtgcccttcggctgctgcacccccatccaccctgtgtacaccagcagcagaggagaccacctgggctgctgggccctgcggcctgagtgcctgcgcatcgtgtcccgggccccctggaccagcacctctgtgggctttgtggccgtgggcccccagtgcctgcctgtgcggggctggcacagcagcaggcctgtgagagatgacagcgtggtggagaagagcctgaagagcctgaaggacaagaacaagaagctggaggagggcggccctgtgtacagccccccagctgaggtggtggtgaagaagagcctgggccagagggtgctggatgagctgaagcactactaccacggcttccggctgctgtggattgacaccaagattgctgccaggatgctgtggaggatcctgaatggccacagcctgacccggcgggagcggcggcagttcctgcgcatctgtgccgacctcttccggctggtgcccttcctggtgtttgtggtggtgcccttcatggagttcctgctgcctgtggccgtgaagctgttccccaacatgctgcccagcacctttgagacccagagcctgaaggaggagcggctgaagaaggagctgcgggtgaagctggagctggccaagttcctgcaggacaccatcgaggagatggccctgaagaacaaggccgccaagggcagcgccaccaaggacttctctgtgttcttccagaagtag

SEQ ID NO: 157567 - DNA, 4185 bp, Artificial Sequence
  Description of Artificial Sequence: Synthetic coding sequence
atggccgccctgctgcggagcgcccgctggctgctgcgggccggggccgccccccggctgcccctgagcctgcggctgctgcccggcggccctggccgcctgcacgccgccagctacctgcctgctgcccgggccggccctgtggccggcggcctgctgagccctgcccggctgtatgccatcgccgccaaggagaaggacatccaggaggagagcaccttcagcagcaggaagatcagcaaccagtttgactgggccctgatgaggctggacctgtctgtgagaagaacaggccgcatccccaagaagctgctgcagaaggtgttcaatgacacctgccgcagcggcggcctgggcggcagccacgccctgctgctgctgcggagctgtggcagcctgctgcctgagctgaagctggaggagaggacagaatttgcccaccgcatctgggacaccctgcagaagctgggcgctgtgtatgatgtgagccactacaatgccctgctgaaggtgtacctgcagaatgagtacaagttcagccccacagacttcctggccaagatggaggaggccaacatccagcccaacagagtgacctaccagaggctcatcgccagctactgcaatgtgggggacattgaaggagccagcaagatcctgggcttcatgaagaccaaggacctgcctgtgacagaagctgtgttcagcgccctggtgacaggccacgcccgggccggggacatggagaatgctgagaacatcctgactgtgatgagagatgctggcatcgagcccggccctgacacctacctggccctgctgaatgcctatgcagagaagggggacatcgaccacgtgaagcagaccctggagaaggtggagaagtctgagctgcacctgatggaccgggacctgctgcagatcatcttctccttcagcaaggccggctacccccagtatgtgtctgagatcctggagaaggtgacctgtgagcggcgctacatcccagatgccatgaacctgatcctgctgctggtgacagagaagctggaggatgtggccctgcagatcctgctggcctgccctgtgtccaaggaggatggccccagcgtgtttggcagcttcttcctgcagcactgtgtgaccatgaacacccctgtggagaagctgacagactactgcaagaagctgaaggaggtgcagatgcacagcttccccctgcagttcaccctgcactgtgccctgctggccaacaagacagacctggccaaggccctgatgaaggctgtgaaggaggagggcttccccatccggccccactacttctggcccctgctggtgggccgcaggaaggagaagaatgtgcagggcatcatcgagatcctgaagggcatgcaggagctgggcgtgcacccagaccaggagacctacacagattatgtgatcccctgctttgattctgtgaacagcgcccgggccatcctgcaggagaatggctgcctgagtgacagcgacatgttcagccaggccggcctgcggtctgaggccgccaacggcaacctggactttgtgctgtccttcctgaagagcaacaccctgcccatcagcctgcagagcatccgcagcagcctgctgctgggcttcagaagatccatgaacatcaacctgtggagcgagatcacagagctgctgtacaaggatggccgctactgccaggagccccggggccccacagaggccgtgggctacttcctgtacaacctgattgacagcatgtctgattctgaggtgcaggccaaggaggagcacctgcggcagtacttccaccagctggagaagatgaatgtgaagatccctgagaacatctaccggggcatccggaacctgctggagagctaccacgtgcctgagctgatcaaggatgcccacctgctggtggagagcaagaacctggacttccagaagacagtgcagctgaccagcagcgagctggagagcaccctggagaccctgaaggccgagaaccagcccatcagagatgtgctgaagcagctgatcctggtgctgtgcagcgaggagaacatgcagaaggccctggagctgaaggccaagtatgaaagtgacatggtgactggaggctatgctgccctgatcaacctgtgctgcagacatgacaaggtggaggatgccctgaacctgaaggaggagtttgaccggctggacagcagcgctgtgctggacaccgggaagtatgtgggcctggtgcgggtgctggccaagcacggcaagctgcaggatgccatcaacatcctgaaggagatgaaggagaaggatgtgctgatcaaggacaccacagccctgtccttcttccacatgctgaatggagctgccctgcggggggagattgagaccgtgaagcagctgcacgaggccatcgtgaccctgggcctggccgagcccagcaccaacatctccttccccctggtgacagtgcacctggagaagggggacctgagcacagccctggaggtggccatcgactgctatgagaagtacaaggtgctgccccgcatccatgatgtgctgtgcaagctggtggagaagggggagacagacctgatccagaaggccatggactttgtgtcccaggagcagggcgagatggtgatgctgtatgacctcttctttgccttcctgcagacaggcaactacaaggaggccaagaagatcatcgagaccccaggcatccgggcccggagcgcccggctgcagtggttctgtgacagatgtgtggccaacaaccaggtggagaccctggagaagctggtggagctgacccagaagctgtttgaatgtgaccgggaccagatgtactacaacctgctgaagctgtacaagatcaacggggactggcagagagcagatgctgtgtggaacaagatccaggaggagaatgtcatcccccgggagaagaccctgcggctgctggccgagatcctgcgggagggcaaccaggaggtgccctttgatgtgcctgagctgtggtatgaagatgagaagcacagcctgaacagcagcagcgccagcaccacagagccagacttccagaaggacatcctgattgcctgccgcctgaaccagaagaagggggcctatgacatcttcctgaatgccaaggagcagaacatcgtgttcaatgctgagacctacagcaacctgatcaagctgctgatgtctgaggactacttcacccaggccatggaggtgaaggcctttgctgagacccacatcaagggcttcaccctgaatgatgctgccaacagccgcctcatcatcacccaggtgcggcgggactacctgaaggaggccgtgaccaccctgaagacagtgctggaccagcagcagacccccagccggctggccgtgaccagggtcatccaggccctggccatgaagggagatgtggagaacatcgaggtggtgcagaagatgctgaatggcctggaggacagcatcggcctgagcaagatggtgttcatcaacaacatcgccctggcccagatcaagaacaacaacattgatgctgccatcgagaacatcgagaacatgctgaccagcgagaacaaggtgattgagccccagtacttcggcctggcctacctgttcaggaaggtgattgaggagcagctggagcctgctgtggagaagatcagcatcatggccgagcggctggccaaccagtttgccatctacaagcctgtgacagacttcttcctgcagctggtggatgctgggaaggtggatgatgcccgggccctgctgcagagatgtggggccatcgccgagcagacccccatcctgctgctcttcctgctgaggaacagcaggaagcagggcaaggccagcacagtgaagtctgtgctggagctgatccctgagctgaatgagaaggaggaggcctacaacagcctgatgaagagctatgtgtctgagaaggatgtgaccagcgccaaggccctgtatgagcacctgacagccaagaacaccaagctggatgacctcttcctgaagagatatgccagcctgctgaagtatgctggggagcctgtgcccttcatcgagcccccagagagctttgagttctacgcccagcagctgaggaagctgcgggagaacagcagctag

SEQ ID NO: 157568 - DNA, 3264 bp, Artificial Sequence
  Description of Artificial Sequence: Synthetic coding sequence
atgcccccacccatctgcccccccctggcccctggcccctggccaggcggcctgggcggcagccacgccctgctgctgctgcggagctgtggcagcctgctgcctgagctgaagctggaggagaggacagaatttgcccaccgcatctgggacaccctgcagaagctgggcgctgtgtatgatgtgagccactacaatgccctgctgaaggtgtacctgcagaatgagtacaagttcagccccacagacttcctggccaagatggaggaggccaacatccagcccaacagagtgacctaccagaggctcatcgccagctactgcaatgtgggggacattgaaggagccagcaagatcctgggcttcatgaagaccaaggacctgcctgtgacagaagctgtgttcagcgccctggtgacaggccacgcccgggccggggacatggagaatgctgagaacatcctgactgtgatgagagatgctggcatcgagcccggccctgacacctacctggccctgctgaatgcctatgcagagaagggggacatcgaccacgtgaagcagaccctggagaaggtggagaagtctgagctgcacctgatggaccgggacctgctgcagatcatcttctccttcagcaaggccggctacccccagtatgtgtctgagatcctggagaaggtgacctgtgagcggcgctacatcccagatgccatgaacctgatcctgctgctggtgacagagaagctggaggatgtggccctgcagatcctgctggcctgccctgtgtccaaggaggatggccccagcgtgtttggcagcttcttcctgcagcactgtgtgaccatgaacacccctgtggagaagctgacagactactgcaagaagctgaaggaggtgcagatgcacagcttccccctgcagttcaccctgcactgtgccctgctggccaacaagacagacctggccaaggccctgatgaaggctgtgaaggaggagggcttccccatccggccccactacttctggcccctgctggtgggccgcaggaaggagaagaatgtgcagggcatcatcgagatcctgaagggcatgcaggagctgggcgtgcacccagaccaggagacctacacagattatgtgatcccctgctttgattctgtgaacagcgcccgggccatcctgcaggagaatggctgcctgagtgacagcgacatgttcagccaggccggcctgcggtctgaggccgccaacggcaacctggactttgtgctgtccttcctgaagagcaacaccctgcccatcagcctgcagagcatccgcagcagcctgctgctgggcttcagaagatccatgaacatcaacctgtggagcgagatcacagagctgctgtacaaggatggccgctactgccaggagccccggggccccacagaggccgtgggctacttcctgtacaacctgattgacagcatgtctgattctgaggtgcaggccaaggaggagcacctgcggcagtacttccaccagctggagaagatgaatgtgaagatccctgagaacatctaccggggcatccggaacctgctggagagctaccacgtgcctgagctgatcaaggatgcccacctgctggtggagagcaagaacctggacttccagaagacagtgcagctgaccagcagcgagctggagagcaccctggagaccctgaaggccgagaaccagcccatcagagatgtgctgaagcagctgatcctggtgctgtgcagcgaggagaacatgcagaaggccctggagctgaaggccaagtatgaaagtgacatggtgactggaggctatgctgccctgatcaacctgtgctgcagacatgacaaggtggaggatgccctgaacctgaaggaggagtttgaccggctggacagcagcgctgtgctggacaccgggaagtatgtgggcctggtgcgggtgctggccaagcacggcaagctgcaggatgccatcaacatcctgaaggagatgaaggagaaggatgtgctgatcaaggacaccacagccctgtccttcttccacatgctgaatggagctgccctgcggggggagattgagaccgtgaagcagctgcacgaggccatcgtgaccctgggcctggccgagcccagcaccaacatctccttccccctggtgacagtgcacctggagaagggggacctgagcacagccctggaggtggccatcgactgctatgagaagtacaaggtgctgccccgcatccatgatgtgctgtgcaagctggtggagaagggggagacagacctgatccagaaggccatggactttgtgtcccaggagcagggcgagatggtgatgctgtatgacctcttctttgccttcctgcagacaggcaactacaaggaggccaagaagatcatcgagaccccaggcatccgggcccggagcgcccggctgcagtggttctgtgacagatgtgtggccaacaaccaggtggagaccctggagaagctggtggagctgacccagaagctgtttgaatgtgaccgggaccagatgtactacaacctgctgaagctgtacaagatcaacggggactggcagagagcagatgctgtgtggaacaagatccaggaggagaatgtcatcccccgggagaagaccctgcggctgctggccgagatcctgcgggagggcaaccaggaggtgccctttgatgtgcctgagctgtggtatgaagatgagaagcacagcctgaacagcagcagcgccagcaccacagagccagacttccagaaggacatcctgattgcctgccgcctgaaccagaagaagggggcctatgacatcttcctgaatgccaaggagcagaacatcgtgttcaatgctgagacctacagcaacctgatcaagctgctgatgtctgaggactacttcacccaggccatggaggtgaaggcctttgctgagacccacatcaagggcttcaccctgaatgatgctgccaacagccgcctcatcatcacccaggtgcggcgggactacctgaaggaggccgtgaccaccctgaagacagtgctggaccagcagcagacccccagccggctggccgtgaccagggtcatccaggccctggccatgaagggagatgtggagaacatcgaggtggtgcagaagatgctgaatggcctggaggacagcatcggcctgagcaagatggtgttcatcaacaacatcgccctggcccagtag

SEQ ID NO: 157569 - DNA, 2856 bp, Artificial Sequence
  Description of Artificial Sequence: Synthetic coding sequence
atgcctggccccctgggcctgctgtgcttcctggccctgggcctgctgggcagcgctggccccagcggggccgccccacccctgtgtgccgccccctgcagctgtgatggagacagaagagtggactgcagcggcaagggcctgacagctgtgcctgagggcctgagcgccttcacccaggccctggacatctccatgaacaacatcacccagctgcctgaagatgccttcaagaacttccccttcctggaggagctgcagctggccggaaatgacctgtccttcatccaccccaaggccctgagcggcctgaaggagctgaaggtgctgaccctgcagaacaaccagctgaagacagtgcccagcgaggccatccggggcctgagcgccctgcagagcctgcggctggatgccaaccacatcacctctgtgcctgaggacagctttgagggcctggtgcagctgcggcacctgtggctggatgacaacagcctgacagaggtgcctgtgcaccccctgagcaacctgcccaccctgcaggccctgaccctggccctgaacaagatcagcagcatcccagactttgccttcaccaacctgagcagcctggtggtgctgcacctgcacaacaacaagatccgcagcctgagccagcactgctttgatggcctggacaacctggagaccctggacctgaactacaacaacctgggggagttcccccaggccatcaaggccctgcccagcctgaaggagctgggcttccacagcaacagcatcagcgtcatcccagatggagcctttgatggcaaccccctgctgcggaccatccacctgtatgacaaccccctgagctttgtgggcaacagcgccttccacaacctgagtgacctgcacagcctggtgatccggggggcctccatggtgcagcagttccccaacctgaccggcaccgtgcacctggagagcctgaccctgaccggcaccaagatcagcagcatccccaacaacctgtgccaggagcagaagatgctgcggaccctggacctgagctacaacaacatccgggacctgcccagcttcaacggctgccacgccctggaggagatcagcctgcagaggaaccagatctaccagatcaaggagggcaccttccagggcctcatcagcctgcgcatcctggacctgagcaggaacctgatccacgagatccacagccgggcctttgccaccctgggccccatcaccaacctggatgtgtccttcaatgagctgaccagcttccccacagagggcctgaatggcctgaaccagctgaagctggtgggcaacttcaagctgaaggaggccctggccgccaaggactttgtgaacctgcggagcctgtctgtgccctatgcctaccagtgctgtgccttctggggctgtgacagctatgccaacctgaacacagaggacaacagcctgcaggaccacagcgtggcccaggagaagggcacagcagatgctgccaacgtgaccagcaccctggagaatgaggagcacagccagatcatcatccactgcacccccagcactggagccttcaagccctgtgagtacctgctgggctcctggatgatccggctgactgtgtggttcatcttcctggtggccctcttcttcaacctgctggtgatcctgaccacctttgccagctgcaccagcctgcccagcagcaagctgttcatcggcctcatctctgtgagcaacctcttcatgggcatctacacaggcatcctgaccttcctggatgctgtgtcctggggccgctttgctgagtttggcatctggtgggagaccggcagcggctgcaaggtggccggcttcctggccgtgttcagcagcgagagcgccatcttcctgctgatgctggccaccgtggagaggagcctgagcgccaaggacatcatgaagaatggcaagagcaaccacctgaagcagttccgggtggccgccctgctggccttcctgggcgccaccgtggccggctgcttccccctcttccacagaggagagtacagcgccagccccctgtgcctgcccttccccaccggggagacccccagcctgggcttcaccgtgaccctggtgctgctgaacagcctggccttcctgctgatggccgtcatctacaccaagctgtactgcaacctggagaaggaggacctgtctgagaacagccagagctccatgatcaagcacgtggcctggctgatcttcaccaactgcatcttcttctgccctgtggccttcttctcctttgcccccctcatcacagccatcagcatcagccctgagatcatgaagtctgtgaccctcatcttcttccccctgcctgcctgcctgaaccctgtgctgtatgtgttcttcaaccccaagttcaaggaggactggaagctgctgaagagaagagtgaccaagaagagcggctctgtgtctgtgtccatcagcagccagggcggctgcctggagcaggacttctactatgactgtggcatgtacagccacctgcagggcaacctgactgtgtgtgactgctgtgagagcttcctgctgaccaagcctgtgtcctgcaagcacctgatcaagagccacagctgcccagccctggccgtggccagctgccagaggcctgagggctactggagcgactgtggcacccagagcgcccacagcgactatgcagatgaggaggacagctttgtgtctgacagcagtgaccaggtgcaggcctgtggccgggcctgcttctaccagagccggggcttccccctggtgcgctatgcctacaacctgccccgggtgaaggactag

SEQ ID NO: 157570 - DNA, 2724 bp, Artificial Sequence
  Description of Artificial Sequence: Synthetic coding sequence
atggacaccagccggctgggcgtgctgctgagcctgcctgtgctgctgcagctggccaccggcggcagcagccccaggtctggagtgctgctgcggggctgccccacccactgccactgtgagccagatggccgcatgctgctgcgggtggactgcagcgacctgggcctgtctgagctgcccagcaacctgtctgtgttcaccagctacctggacctgtccatgaacaacatcagccagctgctgcccaaccccctgcccagcctgcgcttcctggaggagctgcggctggccggaaatgccctgacctacatccccaagggggccttcaccggcctgtacagcctgaaggtgctgatgctgcagaacaaccagctgcggcacgtgcccacagaggccctgcagaacctgcggagcctgcagagcctgcggctggatgccaaccacatctcctatgtgccccccagctgcttcagcggcctgcacagcctgcggcacctgtggctggatgacaatgccctgacagagatccctgtgcaggccttccgcagcctgagcgccctgcaggccatgaccctggccctgaacaagatccaccacatcccagactatgccttcggcaacctgagcagcctggtggtgctgcacctgcacaacaaccgcatccacagcctgggcaagaagtgctttgatggcctgcacagcctggagaccctggacctgaactacaacaacctggatgagttccccacagccatccgcaccctgagcaacctgaaggagctgggcttccacagcaacaacatccgcagcatccctgagaaggcctttgtgggcaaccccagcctcatcaccatccacttctatgacaaccccatccagtttgtgggccgcagcgccttccagcacctgcctgagctgcggaccctgaccctgaatggagccagccagatcacagagttcccagacctgactggaacagccaacctggagagcctgaccctgaccggggcccagatcagcagcctgccccagacagtgtgcaaccagctgcccaacctgcaggtgctggacctgagctacaacctgctggaggacctgcccagcttctctgtgtgccagaagctgcagaagattgacctgcggcacaatgagatctatgagatcaaggtggacaccttccagcagctgctgagcctgcggagcctgaacctggcctggaacaagatcgccatcatccaccccaatgccttcagcaccctgcccagcctcatcaagctggacctgagcagcaacctgctgagcagcttccccatcaccggcctgcacggcctgacccacctgaagctgactggaaaccacgccctgcagagcctcatcagcagcgagaacttccctgagctgaaggtgattgagatgccctatgcctaccagtgctgtgccttcggcgtgtgtgaaaatgcctacaagatcagcaaccagtggaacaagggggacaacagctccatggatgacctgcacaagaaggatgctggcatgttccaggcccaggatgagcgggacctggaggacttcctgctggactttgaggaggacctgaaggccctgcacagcgtgcagtgcagccccagccctggccccttcaagccctgtgagcacctgctggatggctggctgatccgcatcggcgtgtggaccatcgctgtgctggccctgacctgcaatgccctggtgaccagcacagtgttccgcagccccctgtacatcagccccatcaagctgctgattggagtgattgctgctgtgaacatgctgactggagtgagcagcgctgtgctggccggcgtggatgccttcaccttcggcagctttgcccggcatggagcctggtgggagaatggagtgggctgccacgtgattggcttcctgagcatctttgccagcgagagctctgtgttcctgctgaccctggccgccctggagcggggcttctctgtgaagtacagcgccaagtttgagaccaaggcccccttcagcagcctgaaggtgatcatcctgctgtgtgccctgctggccctgaccatggctgctgtgcccctgctgggcggcagcaagtacggggccagccccctgtgcctgcccctgccctttggagagcccagcaccatgggctacatggtggccctgatcctgctgaacagcctgtgcttcctgatgatgaccatcgcctacaccaagctgtactgcaacctggacaagggggacctggagaacatctgggactgcagcatggtgaagcacatcgccctgctgctcttcaccaactgcatcctgaactgccctgtggccttcctgtccttcagcagcctcatcaacctgaccttcatcagccctgaggtgatcaagttcatcctgctggtggtggtgcccctgcctgcctgcctgaaccccctgctgtacatcctcttcaacccccacttcaaggaggacctggtgtccctgaggaagcagacctacgtgtggaccaggagcaagcaccccagcctgatgagcatcaacagtgatgatgtggagaagcagagctgtgacagcacccaggccctggtgaccttcaccagcagcagcatcacctatgacctgccccccagctctgtgcccagccctgcctaccctgtgacagagagctgccacctgagctctgtggcctttgtgccctgcctgtag

SEQ ID NO: 157571 - DNA, 2334 bp, Artificial Sequence
  Description of Artificial Sequence: Synthetic coding sequence
atggacaccagccggctgggcgtgctgctgagcctgcctgtgctgctgcagctggccaccggcggcagcagccccaggtctggagtgctgctgcggggctgccccacccactgccactgtgagccagatggccgcatgctgctgcgggtggactgcagcgacctgggcctgtctgagctgcccagcaacctgtctgtgttcaccagctacctggacctgtccatgaacaacatcagccagctgctgcccaaccccctgcccagcctgcgcttcctggaggagctgcggctggccggaaatgccctgacctacatccccaagggggccttcaccggcctgtacagcctgaaggtgctgatgctgcagaacaaccagctgcggcacgtgcccacagaggccctgcagaacctgcggagcctgcagagcctgcggctggatgccaaccacatctcctatgtgccccccagctgcttcagcggcctgcacagcctgcggcacctgtggctggatgacaatgccctgacagagatccctgtgcaggccttccgcagcctgagcgccctgcaggccatgaccctggccctgaacaagatccaccacatcccagactatgccttcggcaacctgagcagcctggtggtgctgcacctgcacaacaaccgcatccacagcctgggcaagaagtgctttgatggcctgcacagcctggagaccctggacctgaactacaacaacctggatgagttccccacagccatccgcaccctgagcaacctgaaggagctgggcttccacagcaacaacatccgcagcatccctgagaaggcctttgtgggcaaccccagcctcatcaccatccacttctatgacaaccccatccagtttgtgggccgcagcgccttccagcacctgcctgagctgcggaccctgaccctgaatggagccagccagatcacagagttcccagacctgactggaacagccaacctggagagcctgaccctgaccggggcccagatcagcagcctgccccagacagtgtgcaaccagctgcccaacctgcaggtgctggacctgagctacaacctgctggaggacctgcccagcttctctgtgtgccagaagctgcagaagattgacctgcggcacaatgagatctatgagatcaaggtggacaccttccagcagctgctgagcctgcggagcctgaacctggcctggaacaagatcgccatcatccaccccaatgccttcagcaccctgcccagcctcatcaagctggacctgagcagcaacctgctgagcagcttccccatcaccggcctgcacggcctgacccacctgaagctgactggaaaccacgccctgcagagcctcatcagcagcgagaacttccctgagctgaaggtgattgagatgccctatgcctaccagtgctgtgccttcggcgtgtgtgaaaatgcctacaagatcagcaaccagtggaacaagggggacaacagctccatggatgacctgcacaagaaggatgctggcatgttccaggcccaggatgagcgggacctggaggacttcctgctggactttgaggaggacctgaaggccctgcacagcgtgcagtgcagccccagccctggccccttcaagccctgtgagcacctgctggatggctggctgatccgcatcggcgtgtggaccatcgctgtgctggccctgacctgcaatgccctggtgaccagcacagtgttccgcagccccctgtacatcagccccatcaagctgctgattggagtgattgctgctgtgaacatgctgactggagtgagcagcgctgtgctggccggcgtggatgccttcaccttcggcagctttgcccggcatggagcctggtgggagaatggagtgggctgccacgtgattggcttcctgagcatctttgccagcgagagctctgtgttcctgctgaccctggccgccctggagcggggcttctctgtgaagtacagcgccaagtttgagaccaaggcccccttcagcagcctgaaggtgatcatcctgctgtgtgccctgctggccctgaccatggctgctgtgcccctgctgggcggcagcaagtacggggccagccccctgtgcctgcccctgctgccccatgatgaccactgcctgcaccaggccctgctgcagtttggccagggccggcctggagagtacctgggcctgctgtatggcaagacccactgccctgtggccctgcaccagctgcaccccaagctgccctgtggcttcctggtgctgctgctcttcaacaagccctacatctaccagagctag

SEQ ID NO: 157572 - DNA, 2508 bp, Artificial Sequence
  Description of Artificial Sequence: Synthetic coding sequence
atggacaccagccggctgggcgtgctgctgagcctgcctgtgctgctgcagctggccaccggcggcagcagccccaggtctggagtgctgctgcggggctgccccacccactgccactgtgagccagatggccgcatgctgctgcgggtggactgcagcgacctgggcctgtctgagctgcccagcaacctgtctgtgttcaccagctacctggacctgtccatgaacaacatcagccagctgctgcccaaccccctgcccagcctgcgcttcctggaggagctgcggctggccggaaatgccctgacctacatccccaagggggccttcaccggcctgtacagcctgaaggtgctgatgctgcagaacaaccagctgcggcacgtgcccacagaggccctgcagaacctgcggagcctgcagagcctgcacctgcacaacaaccgcatccacagcctgggcaagaagtgctttgatggcctgcacagcctggagaccctggacctgaactacaacaacctggatgagttccccacagccatccgcaccctgagcaacctgaaggagctgggcttccacagcaacaacatccgcagcatccctgagaaggcctttgtgggcaaccccagcctcatcaccatccacttctatgacaaccccatccagtttgtgggccgcagcgccttccagcacctgcctgagctgcggaccctgaccctgaatggagccagccagatcacagagttcccagacctgactggaacagccaacctggagagcctgaccctgaccggggcccagatcagcagcctgccccagacagtgtgcaaccagctgcccaacctgcaggtgctggacctgagctacaacctgctggaggacctgcccagcttctctgtgtgccagaagctgcagaagattgacctgcggcacaatgagatctatgagatcaaggtggacaccttccagcagctgctgagcctgcggagcctgaacctggcctggaacaagatcgccatcatccaccccaatgccttcagcaccctgcccagcctcatcaagctggacctgagcagcaacctgctgagcagcttccccatcaccggcctgcacggcctgacccacctgaagctgactggaaaccacgccctgcagagcctcatcagcagcgagaacttccctgagctgaaggtgattgagatgccctatgcctaccagtgctgtgccttcggcgtgtgtgaaaatgcctacaagatcagcaaccagtggaacaagggggacaacagctccatggatgacctgcacaagaaggatgctggcatgttccaggcccaggatgagcgggacctggaggacttcctgctggactttgaggaggacctgaaggccctgcacagcgtgcagtgcagccccagccctggccccttcaagccctgtgagcacctgctggatggctggctgatccgcatcggcgtgtggaccatcgctgtgctggccctgacctgcaatgccctggtgaccagcacagtgttccgcagccccctgtacatcagccccatcaagctgctgattggagtgattgctgctgtgaacatgctgactggagtgagcagcgctgtgctggccggcgtggatgccttcaccttcggcagctttgcccggcatggagcctggtgggagaatggagtgggctgccacgtgattggcttcctgagcatctttgccagcgagagctctgtgttcctgctgaccctggccgccctggagcggggcttctctgtgaagtacagcgccaagtttgagaccaaggcccccttcagcagcctgaaggtgatcatcctgctgtgtgccctgctggccctgaccatggctgctgtgcccctgctgggcggcagcaagtacggggccagccccctgtgcctgcccctgccctttggagagcccagcaccatgggctacatggtggccctgatcctgctgaacagcctgtgcttcctgatgatgaccatcgcctacaccaagctgtactgcaacctggacaagggggacctggagaacatctgggactgcagcatggtgaagcacatcgccctgctgctcttcaccaactgcatcctgaactgccctgtggccttcctgtccttcagcagcctcatcaacctgaccttcatcagccctgaggtgatcaagttcatcctgctggtggtggtgcccctgcctgcctgcctgaaccccctgctgtacatcctcttcaacccccacttcaaggaggacctggtgtccctgaggaagcagacctacgtgtggaccaggagcaagcaccccagcctgatgagcatcaacagtgatgatgtggagaagcagagctgtgacagcacccaggccctggtgaccttcaccagcagcagcatcacctatgacctgccccccagctctgtgcccagccctgcctaccctgtgacagagagctgccacctgagctctgtggcctttgtgccctgcctgtag

SEQ ID NO: 157573 - DNA, 2652 bp, Artificial Sequence
  Description of Artificial Sequence: Synthetic coding sequence
atggacaccagccggctgggcgtgctgctgagcctgcctgtgctgctgcagctggccaccggcggcagcagccccaggtctggagtgctgctgcggggctgccccacccactgccactgtgagccagatggccgcatgctgctgcgggtggactgcagcgacctgggcctgtctgagctgcccagcaacctgtctgtgttcaccagctacctggacctgtccatgaacaacatcagccagctgctgcccaaccccctgcccagcctgcgcttcctggaggagctgcggctggccggaaatgccctgacctacatccccaagggggccttcaccggcctgtacagcctgaaggtgctgatgctgcagaacaaccagctgcggcacgtgcccacagaggccctgcagaacctgcggagcctgcagagcctgcggctggatgccaaccacatctcctatgtgccccccagctgcttcagcggcctgcacagcctgcggcacctgtggctggatgacaatgccctgacagagatccctgtgcaggccttccgcagcctgagcgccctgcaggccatgaccctggccctgaacaagatccaccacatcccagactatgccttcggcaacctgagcagcctggtggtgctgcacctgcacaacaaccgcatccacagcctgggcaagaagtgctttgatggcctgcacagcctggagaccctggacctgaactacaacaacctggatgagttccccacagccatccgcaccctgagcaacctgaaggagctgcacttctatgacaaccccatccagtttgtgggccgcagcgccttccagcacctgcctgagctgcggaccctgaccctgaatggagccagccagatcacagagttcccagacctgactggaacagccaacctggagagcctgaccctgaccggggcccagatcagcagcctgccccagacagtgtgcaaccagctgcccaacctgcaggtgctggacctgagctacaacctgctggaggacctgcccagcttctctgtgtgccagaagctgcagaagattgacctgcggcacaatgagatctatgagatcaaggtggacaccttccagcagctgctgagcctgcggagcctgaacctggcctggaacaagatcgccatcatccaccccaatgccttcagcaccctgcccagcctcatcaagctggacctgagcagcaacctgctgagcagcttccccatcaccggcctgcacggcctgacccacctgaagctgactggaaaccacgccctgcagagcctcatcagcagcgagaacttccctgagctgaaggtgattgagatgccctatgcctaccagtgctgtgccttcggcgtgtgtgaaaatgcctacaagatcagcaaccagtggaacaagggggacaacagctccatggatgacctgcacaagaaggatgctggcatgttccaggcccaggatgagcgggacctggaggacttcctgctggactttgaggaggacctgaaggccctgcacagcgtgcagtgcagccccagccctggccccttcaagccctgtgagcacctgctggatggctggctgatccgcatcggcgtgtggaccatcgctgtgctggccctgacctgcaatgccctggtgaccagcacagtgttccgcagccccctgtacatcagccccatcaagctgctgattggagtgattgctgctgtgaacatgctgactggagtgagcagcgctgtgctggccggcgtggatgccttcaccttcggcagctttgcccggcatggagcctggtgggagaatggagtgggctgccacgtgattggcttcctgagcatctttgccagcgagagctctgtgttcctgctgaccctggccgccctggagcggggcttctctgtgaagtacagcgccaagtttgagaccaaggcccccttcagcagcctgaaggtgatcatcctgctgtgtgccctgctggccctgaccatggctgctgtgcccctgctgggcggcagcaagtacggggccagccccctgtgcctgcccctgccctttggagagcccagcaccatgggctacatggtggccctgatcctgctgaacagcctgtgcttcctgatgatgaccatcgcctacaccaagctgtactgcaacctggacaagggggacctggagaacatctgggactgcagcatggtgaagcacatcgccctgctgctcttcaccaactgcatcctgaactgccctgtggccttcctgtccttcagcagcctcatcaacctgaccttcatcagccctgaggtgatcaagttcatcctgctggtggtggtgcccctgcctgcctgcctgaaccccctgctgtacatcctcttcaacccccacttcaaggaggacctggtgtccctgaggaagcagacctacgtgtggaccaggagcaagcaccccagcctgatgagcatcaacagtgatgatgtggagaagcagagctgtgacagcacccaggccctggtgaccttcaccagcagcagcatcacctatgacctgccccccagctctgtgcccagccctgcctaccctgtgacagagagctgccacctgagctctgtggcctttgtgccctgcctgtag

SEQ ID NO: 157574 - DNA, 2748 bp, Artificial Sequence
  Description of Artificial Sequence: Synthetic coding sequence
atgggccggccccggctgaccctggtgtgccaggtgtccatcatcatcagcgcccgggacctgtccatgaacaacctgacagagctgcagcccggcctcttccaccacctgcgcttcctggaggagctgcggctgagcggcaaccacctgagccacatccctggccaggccttcagcggcctgtacagcctgaagatcctgatgctgcagaacaaccagctgggcggcatcccagctgaggccctgtgggagctgcccagcctgcagagcctgcggctggatgccaacctgatcagcctggtgcctgagaggagctttgagggcctgagcagcctgcggcacctgtggctggatgacaatgccctgacagagatccctgtgcgggccctgaacaacctgcctgccctgcaggccatgaccctggccctgaaccgcatcagccacatcccagactatgccttccagaacctgaccagcctggtggtgctgcacctgcacaacaaccgcatccagcacctgggcacccacagctttgagggcctgcacaacctggagaccctggacctgaactacaacaagctgcaggagttccctgtggccatccgcaccctgggccgcctgcaggagctgggcttccacaacaacaacatcaaggccatccctgagaaggccttcatgggcaaccccctgctgcagaccatccacttctatgacaaccccatccagtttgtgggccgcagcgccttccagtacctgcccaagctgcacaccctgagcctgaatggagccatggacatccaggagttcccagacctgaagggcaccaccagcctggagatcctgaccctgacccgggccggcatccggctgctgcccagcggcatgtgccagcagctgccccggctgcgggtgctggagctgagccacaaccagatcgaggagctgcccagcctgcaccgctgccagaagctggaggagatcggcctgcagcacaaccgcatctgggagattggagctgacaccttcagccagctgagcagcctgcaggccctggacctgtcctggaatgccatccgcagcatccaccctgaggccttcagcaccctgcacagcctggtgaagctggacctgacagacaaccagctgaccaccctgcccctggccggcctgggcggcctgatgcacctgaagctgaagggcaacctggccctgagccaggccttcagcaaggacagcttccccaagctgcgcatcctggaggtgccctatgcctaccagtgctgcccctacggcatgtgtgccagcttcttcaaggccagcggccagtgggaggccgaggacctgcacctggatgatgaggagagcagcaagaggcccctgggcctgctggcccggcaggccgagaaccactatgaccaggacctggatgagctgcagctggagatggaggacagcaagccccaccccagcgtgcagtgcagccccaccccaggccccttcaagccctgtgagtacctgtttgagagctggggcatccggctggccgtgtgggccatcgtgctgctgtctgtgctgtgcaatggcctggtgctgctgactgtgtttgctgggggccctgtgcccctgccccctgtgaagtttgtggtgggcgccatcgccggggccaacaccctgaccggcatcagctgtggcctgctggcctctgtggatgccctgaccttcggccagttctctgaatatggagcccgctgggagaccggcctgggctgccgggccaccggcttcctggccgtgctgggcagcgaggcctctgtgctgctgctgaccctggccgctgtgcagtgcagcgtgtctgtgtcctgtgtgcgggcctacggcaagagccccagcctgggctctgtgcgggccggcgtgctgggctgcctggccctggccggcctggccgccgccctgcccctggcctctgtgggggagtatggagccagccccctgtgcctgccctatgcccctcctgagggccagcctgctgccctgggcttcaccgtggccctggtgatgatgaacagcttctgcttcctggtggtggccggggcctacatcaagctgtactgtgacctgcccaggggggactttgaagctgtgtgggactgtgccatggtgcgccacgtggcctggctgatctttgctgatggcctgctgtactgccctgtggccttcctgagctttgcctccatgctgggcctcttccctgtgaccccagaggccgtgaagtctgtgctgctggtggtgctgcccctgcctgcctgcctgaaccccctgctgtacctgctcttcaacccccacttcagagatgacctgcggcggctgcggcccagggctggggacagcggccccctggcctatgctgctgctggggagctggagaagagcagctgtgacagcacccaggccctggtggccttcagtgatgtggacctgatcctggaggccagcgaggccggccggcccccaggcctggagacctacggcttccccagcgtgaccctcatcagctgccagcagcccggggccccccggctggagggcagccactgtgtggagcctgagggcaaccactttggaaacccccagcccagcatggatggagagctgctgctgcgggcagagggcagcaccccagctgggggcggcctgagcggcggcggcggcttccagcccagcggcctggcctttgccagccacgtgtag

SEQ ID NO: 157575 - DNA, 699 bp, Artificial Sequence
  Description of Artificial Sequence: Synthetic coding sequence
atgaacaacctgacagagctgcagcccggcctcttccaccacctgcgcttcctggaggagctgcggctgagcggcaaccacctgagccacatccctggccaggccttcagcggcctgtacagcctgaagatcctgatgctgcagaacaaccagctgggcggcatcccagctgaggccctgtgggagctgcccagcctgcagagcctgcggctggatgccaacctgatcagcctggtgcctgagaggagctttgagggcctgagcagcctgcggcacctgtggctggatgacaatgccctgacagagatccctgtgcgggccctgaacaacctgcctgccctgcaggccatgaccctggccctgaaccgcatcagccacatcccagactatgccttccagaacctgaccagcctggtggtgctggacctgaactacaacaagctgcaggagttccctgtggccatccgcaccctgggccgcctgcaggagctgagcctgaatggagccatggacatccaggagttcccagacctgaagggcaccaccagcctggagatcctgaccctgacccgggccggcatccggctgctgcccagcggcatgtgccagcagctgccccggctgcgggtgctggagctgagccacaaccagatcgaggagctgcccagcctgcaccgctgccagaagctggaggagtag

SEQ ID NO: 157576 - DNA, 2904 bp, Artificial Sequence
  Description of Artificial Sequence: Synthetic coding sequence
atgcccagccccccaggcctgcgggccctgtggctgtgtgccgccctgtgtgccagccggcgggccggcggggccccccagcccggccctggccccacagcctgcccagccccctgccactgccaggaggatggcatcatgctgtctgctgactgcagcgagctgggcctgtctgctgtgcctggggacctggaccccctgacagcctacctggacctgtccatgaacaacctgacagagctgcagcccggcctcttccaccacctgcgcttcctggaggagctgcggctgagcggcaaccacctgagccacatccctggccaggccttcagcggcctgtacagcctgaagatcctgatgctgcagaacaaccagctgggcggcatcccagctgaggccctgtgggagctgcccagcctgcagagcctgcggctggatgccaacctgatcagcctggtgcctgagaggagctttgagggcctgagcagcctgcggcacctgtggctggatgacaatgccctgacagagatccctgtgcgggccctgaacaacctgcctgccctgcaggccatgaccctggccctgaaccgcatcagccacatcccagactatgccttccagaacctgaccagcctggtggtgctgcacctgcacaacaaccgcatccagcacctgggcacccacagctttgagggcctgcacaacctggagaccctggacctgaactacaacaagctgcaggagttccctgtggccatccgcaccctgggccgcctgcaggagctgggcttccacaacaacaacatcaaggccatccctgagaaggccttcatgggcaaccccctgctgcagaccatccacttctatgacaaccccatccagtttgtgggccgcagcgccttccagtacctgcccaagctgcacaccctgagcctgaatggagccatggacatccaggagttcccagacctgaagggcaccaccagcctggagatcctgaccctgacccgggccggcatccggctgctgcccagcggcatgtgccagcagctgccccggctgcgggtgctggagctgagccacaaccagatcgaggagctgcccagcctgcaccgctgccagaagctggaggagatcggcctgcagcacaaccgcatctgggagattggagctgacaccttcagccagctgagcagcctgcaggccctggacctgtcctggaatgccatccgcagcatccaccctgaggccttcagcaccctgcacagcctggtgaagctggacctgacagacaaccagctgaccaccctgcccctggccggcctgggcggcctgatgcacctgaagctgaagggcaacctggccctgagccaggccttcagcaaggacagcttccccaagctgcgcatcctggaggtgccctatgcctaccagtgctgcccctacggcatgtgtgccagcttcttcaaggccagcggccagtgggaggccgaggacctgcacctggatgatgaggagagcagcaagaggcccctgggcctgctggcccggcaggccgagaaccactatgaccaggacctggatgagctgcagctggagatggaggacagcaagccccaccccagcgtgcagtgcagccccaccccaggccccttcaagccctgtgagtacctgtttgagagctggggcatccggctggccgtgtgggccatcgtgctgctgtctgtgctgtgcaatggcctggtgctgctgactgtgtttgctgggggccctgtgcccctgccccctgtgaagtttgtggtgggcgccatcgccggggccaacaccctgaccggcatcagctgtggcctgctggcctctgtggatgccctgaccttcggccagttctctgaatatggagcccgctgggagaccggcctgggctgccgggccaccggcttcctggccgtgctgggcagcgaggcctctgtgctgctgctgaccctggccgctgtgcagtgcagcgtgtctgtgtcctgtgtgcgggcctacggcaagagccccagcctgggctctgtgcgggccggcgtgctgggctgcctggccctggccggcctggccgccgccctgcccctggcctctgtgggggagtatggagccagccccctgtgcctgccctatgcccctcctgagggccagcctgctgccctgggcttcaccgtggccctggtgatgatgaacagcttctgcttcctggtggtggccggggcctacatcaagctgtactgtgacctgcccaggggggactttgaagctgtgtgggactgtgccatggtgcgccacgtggcctggctgatctttgctgatggcctgctgtactgccctgtggccttcctgagctttgcctccatgctgggcctcttccctgtgaccccagaggccgtgaagtctgtgctgctggtggtgctgcccctgcctgcctgcctgaaccccctgctgtacctgctcttcaacccccacttcagagatgacctgcggcggctgcggcccagggctggggacagcggccccctggcctatgctgctgctggggagctggagaagagcagctgtgacagcacccaggccctggtggccttcagtgatgtggacctgatcctggaggccagcgaggccggccggcccccaggcctggagacctacggcttccccagcgtgaccctcatcagctgccagcagcccggggccccccggctggagggcagccactgtgtggagcctgagggcaaccactttggaaacccccagcccagcatggatggagagctgctgctgcgggcagagggcagcaccccagctgggggcggcctgagcggcggcggcggcttccagcccagcggcctggcctttgccagccacgtgtag

SEQ ID NO: 157577 - DNA, 228 bp, Artificial Sequence
  Description of Artificial Sequence: Synthetic coding sequence
atgctgtctgctgactgcagcgagctgggcctgtctgctgtgcctggggacctggaccccctgacagcctacctggccgtgcccggcatggtggccgagggcaaggctgacagaactggaggcggcggcagcagcaggcctgagaagaccaggaggagcctggaggaggccatcgacaggaccatcggcggggcccaggagctgtgggcccctgaggtgagcagctag

SEQ ID NO: 157578 - DNA, 2487 bp, Artificial Sequence
  Description of Artificial Sequence: Synthetic coding sequence
atgaggctggagggggagggccgcagcgcccgggccggccagaacctgagcagagctggcagcgccaggagaggagccccccgggacctgtccatgaacaacctgacagagctgcagcccggcctcttccaccacctgcgcttcctggaggagctgcggctgagcggcaaccacctgagccacatccctggccaggccttcagcggcctgtacagcctgaagatcctgatgctgcagaacaaccagctgggcggcatcccagctgaggccctgtgggagctgcccagcctgcagagcctggacctgaactacaacaagctgcaggagttccctgtggccatccgcaccctgggccgcctgcaggagctgggcttccacaacaacaacatcaaggccatccctgagaaggccttcatgggcaaccccctgctgcagaccatccacttctatgacaaccccatccagtttgtgggccgcagcgccttccagtacctgcccaagctgcacaccctgagcctgaatggagccatggacatccaggagttcccagacctgaagggcaccaccagcctggagatcctgaccctgaccagggctggcatccggctgctgcccagcggcatgtgccagcagctgccccggctgcgggtgctggagctgagccacaaccagatcgaggagctgcccagcctgcaccgctgccagaagctggaggagatcggcctgcagcacaaccgcatctgggagatcggggctgacaccttcagccagctgagcagcctgcaggccctggacctgtcctggaatgccatccgcagcatccaccctgaggccttcagcaccctgcacagcctggtgaagctggacctgacagacaaccagctgaccaccctgcccctggccggcctgggcggcctgatgcacctgaagctgaagggcaacctggccctgagccaggccttcagcaaggacagcttccccaagctgcgcatcctggaggtgccctatgcctaccagtgctgcccctacggcatgtgtgccagcttcttcaaggccagcggccagtgggaggccgaggacctgcacctggatgatgaggagagcagcaagaggcccctgggcctgctggcccggcaggccgagaaccactatgaccaggacctggatgagctgcagctggagatggaggacagcaagccccaccccagcgtgcagtgcagccccaccccaggccccttcaagccctgtgagtacctgtttgagagctggggcatccggctggccgtgtgggccatcgtgctgctgtctgtgctgtgcaatggcctggtgctgctgactgtgtttgctgggggccctgtgcccctgccccctgtgaagtttgtggtgggcgccatcgccggggccaacaccctgaccggcatcagctgtggcctgctggcctctgtggatgccctgaccttcggccagttctctgaatatggagcccgctgggagaccggcctgggctgccgggccaccggcttcctggccgtgctgggcagcgaggcctctgtgctgctgctgaccctggccgctgtgcagtgcagcgtgtctgtgtcctgtgtgcgggcctacggcaagagccccagcctgggctctgtgcgggccggcgtgctgggctgcctggccctggccggcctggccgccgccctgcccctggcctctgtgggggagtatggagccagccccctgtgcctgccctatgcccctcctgagggccagcctgctgccctgggcttcaccgtggccctggtgatgatgaacagcttctgcttcctggtggtggccggggcctacatcaagctgtactgtgacctgcccaggggggactttgaggccgtgtgggactgtgccatggtgagacatgtggcctggctgatctttgctgatggcctgctgtactgccctgtggccttcctgagctttgcctccatgctgggcctcttccctgtgaccccagaggccgtgaagtctgtgctgctggtggtgctgcccctgcctgcctgcctgaaccccctgctgtacctgctcttcaacccccacttcagagatgacctgcggcggctgcggccccgggccggggacagcggccccctggcctatgctgctgctggggagctggagaagagcagctgtgacagcacccaggccctggtggccttcagtgatgtggacctgatcctggaggccagcgaggccggccggcccccaggcctggagacctacggcttccccagcgtgaccctcatcagctgccagcagcccggggccccccggctggagggcagccactgtgtggagcctgagggcaaccacttcggcaacccccagcccagcatggatggagagctgctgctgcgggcagagggcagcaccccagctgggggcggcctgagcggcggcggcggcttccagcccagcggcctggcctttgccagccacgtgtag

SEQ ID NO: 157579 - DNA, 6039 bp, Artificial Sequence
  Description of Artificial Sequence: Synthetic coding sequence
atggagaccctgaatggagctggggacaccggcggcaagcccagcacccggggcggggaccctgctgcccggagcagaagaacagagggcatccgggccgcctaccgccgcggggacagaggaggagcccgggacctgctggaggaggcctgtgaccagtgtgccagccagctggagaagggccagctgctgagcatcccagctgcctacggggacctggagatggtgcgctacctgctgagcaagaggctggtggagctgcccacagagcccacagatgacaacccagctgtggtggccgcctacttcggccacacagctgtggtgcaggagctgctggagcccctgacccccaagcagacagagtgggagcagacagcccccttcagcggcaccttccccctgagctgccacctgctgcccggcccctgcagcccccagaggctgctgaactggatgctggccctggcctgccagaggggccacctgggcgtggtgaagctgctggtgctgacccatggagctgaccctgagagctatgctgtgaggaagaatgagttccctgtgattgtgcggctgcccctgtatgctgccatcaagtctggaaatgaagacatcgccatcttcctgctgcggcatggagcctacttctgcagctacatcctgctggacagcccagaccccagcaagcacctgctgaggaagtacttcatcgaggccagccccctgcccagcagctacccaggcaagacagccctgcgggtgaagtggagccacctgcggctgccctgggtggacctggactggctgattgacatcagctgccagatcacagagctggacctgagcgccaactgcctggccaccctgcccagcgtcatcccctggggcctcatcaacctgaggaagctgaacctgagtgacaaccacctgggggagctgcccggggtgcagagcagtgatgagatcatctgcagccggctgctggagattgacatcagcagcaacaagctgagccacctgcccccaggcttcctgcacctgagcaagctgcagaagctgacagccagcaagaactgcctggagaagctgtttgaggaggagaatgccaccaactggattggcctgaggaagctgcaggagctggacatcagtgacaacaagctgacagagctgcctgccctcttcctgcacagcttcaagagcctgaacagcctgaatgtgtccaggaacaacctgaaggtgtttcctgacccctgggcctgccccctgaagtgctgcaaggccagcagaaatgccctggagtgcctgcctgacaagatggctgtgttctggaagaaccacctgaaggatgtggacttctctgaaaatgccctgaaggaggtgcccctgggcctcttccagctggatgccctgatgttcctgcggctgcagggcaaccagctggccgccctgcccccccaggagaagtggacctgccggcagctgaagaccctggacctgagcaggaaccagctgggcaagaatgaagatggcctgaagaccaagagaattgccttcttcaccacccggggccggcagaggtctggaacagaagctgcctctgtgctggagttccctgccttcctgtctgagagcctggaggtgctgtgcctgaatgacaaccacctggacacagtgcccccatctgtgtgcctgctgaagagcctgtctgagctgtacctgggcaacaaccctggcctgcgggagctgcccccagagctgggccagctgggcaacctgtggcagctggacacagaggacctgaccatcagcaatgtgcctgctgagatccagaaggagggccccaaggccatgctgagctacctgcgggcccagctgaggaaggccgagaagtgcaagctgatgaagatgatcatcgtgggccccccccggcagggcaagagcaccctgctggagatcctgcagacaggccgggccccccaggtggtgcatggagaggccaccatccgcaccaccaagtgggagctgcagaggcctgctggcagccgggccaaggtggagagcgtggagttcaacgtgtgggacattggaggccctgcctccatggccaccgtgaaccagtgcttcttcacagacaaggccctgtatgtggtggtgtggaacctggccctgggggaggaggccgtggccaacctgcagttctggctgctgaacatcgaggccaaggccccaaatgctgtggtgctggtggtgggcacccacctggacctgattgaggccaagttccgggtggagcgcatcgccaccctgcgggcctacgtgctggccctgtgccgcagccccagcggcagccgggccaccggcttcccagacatcaccttcaagcacctgcacgagatcagctgcaagagcctggagggccaggagggcctgcggcagctgatcttccacgtgacctgcagcatgaaggatgtgggcagcaccatcggctgccagaggctggccggccgcctcatccccaggagctacctgagcctgcaggaggccgtgctggccgagcagcagaggaggagcagagatgatgatgtgcagtacctgacagaccggcagctggagcagctggtggagcagaccccagacaatgacatcaaggactatgaggacctgcagagcgccatctccttcctgattgagaccggcaccctgctgcacttcccagacaccagccacggcctgaggaacctgtacttcctggaccccatctggctgtctgagtgcctgcagaggatcttcaacatcaagggcagccgctctgtggccaagaatggagtcatccgggcagaggacctgaggatgctgctggtgggcaccggcttcacccagcagacagaggagcagtacttccagttcctggccaagtttgaaattgccctgcctgtggccaatgacagctacctgctgccccacctgctgcccagcaagccaggcctggacacccacggcatgaggcaccccacagccaacaccatccagagggtcttcaagatgagctttgtgcctgtgggcttctggcagcgcttcatcgccaggatgctgatcagcctggccgagatggacctgcagctgtttgagaacaagaagaacaccaagagcaggaacaggaaggtgaccatctacagcttcaccggcaaccagaggaaccgctgcagcaccttccgggtgaagaggaaccagaccatctactggcaggagggcctgctggtgacctttgatggcggctacctgtctgtggagagcagtgatgtgaactggaagaagaagaagagcggcggcatgaagatcgtgtgccagagcgaggtgcgggacttcagcgccatggccttcatcacagaccacgtgaacagcctgattgaccagtggttccctgccctgacagccacagaaagtgatggcacccccctgatggagcagtatgtgccctgccctgtgtgtgaaacagcctgggcccagcacacagaccccagcgagaagtcagaagatgtgcagtactttgacatggaggactgtgtgctgacagccatcgagcgggacttcatcagctgccccaggcacccagacctgcctgtgcccctgcaggagctggtgcctgagctgttcatgacagacttccctgcccggctcttcctggagaacagcaagctggagcacagtgaagatgagggctctgtgctgggccagggcggcagcggcaccgtcatctaccgggcccgctaccagggccagcctgtggccgtgaagcgcttccacatcaagaagttcaagaactttgccaacgtgcctgctgacaccatgctgcggcacctgcgggccacagatgccatgaagaacttcagcgagttccggcaggaggcctccatgctgcacgccctgcagcacccctgcatcgtggccctgattggcatcagcatccaccccctgtgctttgccctggagctggcccccctgagcagcctgaacacagtgctgtctgaaaatgcccgggacagcagcttcatccccctgggccacatgctgacccagaagatcgcctaccagatcgccagcggcctggcctacctgcacaagaagaacatcatcttctgtgacctgaagagtgacaacatcctggtgtggagcctggatgtgaaggagcacatcaacatcaagctgagtgactatggcatcagccggcagagcttccatgaaggagccctgggcgtggagggcaccccaggctaccaggcccctgagatccggccccgcatcgtgtatgatgagaaggtggacatgttctcctatggcatggtgctgtatgagctgctgagcggccagaggcctgccctgggccaccaccagctgcagatcgccaagaagctgagcaagggcatccggcctgtgctgggccagcctgaggaggtgcagttccggcggctgcaggccctgatgatggagtgctgggacaccaagccagagaagaggcccctggccctgtctgtggtgtcccagatgaaggaccccacctttgccaccttcatgtatgagctgtgctgcggcaagcagacagccttcttcagcagccagggccaggagtacacagtggtgttctgggatggcaaggaggagagcaggaactacacagtggtgaacacagagaagggcctgatggaggtgcagaggatgtgctgccccggcatgaaggtgtcctgccagctgcaggtgcagaggagcctgtggacagccacagaggaccagaagatctacatctacaccctgaagggcatgtgccccctgaacaccccccagcaggccctggacaccccagctgtggtgacctgcttcctggccgtgcctgtgatcaagaagaacagctacctggtgctggccggcctggctgatggcctggtggccgtgtttcctgtggtgcggggcacccccaaggacagctgcagctacctgtgcagccacacagccaacagaagcaagttcagcattgctgatgaagatgcccggcagaacccctaccctgtgaaggccatggaggtggtgaacagcggcagcgaggtgtggtacagcaatggacctggcctgctggtgattgactgtgccagcctggagatctgccggcggctggagccctacatggcccccagcatggtgacctctgtggtgtgcagcagcgagggccgcggggaggaggtggtgtggtgcctggatgacaaggccaacagcctggtgatgtaccacagcaccacctaccagctgtgtgcccgctacttctgtggggtgcccagccccctgcgggacatgtttcctgtgcggcccctggacacagagcccccagctgccagccacacagccaaccccaaggtgcctgagggggacagcattgctgatgtgtccatcatgtacagcgaggagctgggcacccagatcctgatccaccaggagagcctgacagactactgcagcatgagcagctacagcagcagccccccccggcaggccgcccggagccccagcagcctgcccagcagccctgccagcagcagctctgtgcccttcagcacagactgtgaagattctgacatgctgcacaccccaggagctgccagtgacagaagtgaacatgacctgacccccatggatggagagaccttcagccagcacctgcaggccgtgaagatcctggccgtgcgggacctgatctgggtgcccaggagaggaggagatgtgattgtcatcggcctggagaaggacagcggggcccagaggggccgggtgattgctgtgctgaaggcccgggagctgacccctcatggagtgctggtggatgctgctgtggtggccaaggacacagtggtgtgcacctttgaaaatgaaaatacagagtggtgcctggccgtgtggaggggctggggcgcccgggagtttgacatcttctaccagagctatgaggagctgggccgcctggaggcctgcaccaggaagagaagatag

SEQ ID NO: 157580 - DNA, 6048 bp, Artificial Sequence
  Description of Artificial Sequence: Synthetic coding sequence
atggccggcatgagccagaggcctcccagcatgtactggtgtgtgggccctgaggagagcgctgtgtgcccagagcgggccatggagaccctgaatggagctggggacacaggaggcaagcccagcacccggggcggggaccctgctgcccggagcagaagaacagagggcatccgggccgcctacagaagaggagaccggggcggggcccgggacctgctggaggaggcctgtgaccagtgtgccagccagctggagaagggccagctgctgagcatcccagctgcctatggagacctggagatggtgcgctacctgctgagcaagaggctggtggagctgcccacagagcccacagatgacaacccagctgtggtggccgcctacttcggccacacagctgtggtgcaggagctgctggagagcctgcccggcccctgcagcccccagaggctgctgaactggatgctggccctggcctgccagaggggccacctgggcgtggtgaagctgctggtgctgacccacggggctgaccctgagagctatgctgtgaggaagaatgagttccctgtgattgtgcggctgcccctgtatgctgccatcaagtctggaaatgaagatattgccatcttcctgctgcggcacggggcctacttctgcagctacatcctgctggacagcccagaccccagcaagcacctgctgaggaagtacttcatcgaggccagccccctgcccagcagctacccaggcaagacagccctgcgggtgaagtggagccacctgcggctgccctgggtggacctggactggctgattgacatcagctgccagatcacagagctggacctgagcgccaactgcctggccaccctgcccagcgtcatcccctggggcctcatcaacctgaggaagctgaacctgagtgacaaccacctgggggagctgcccggggtgcagagcagtgatgagatcatctgcagccggctgctggagattgacatcagcagcaacaagctgagccacctgcccccaggcttcctgcacctgagcaagctgcagaagctgacagccagcaagaactgcctggagaagctgtttgaggaggagaatgccaccaactggattggcctgaggaagctgcaggagctggacatcagtgacaacaagctgacagagctgcctgccctcttcctgcacagcttcaagagcctgaacagcctgaatgtgtccaggaacaacctgaaggtgtttcctgacccctgggcctgccccctgaagtgctgcaaggccagcagaaatgccctggagtgcctgcctgacaagatggctgtgttctggaagaaccacctgaaggatgtggacttctctgaaaatgccctgaaggaggtgcccctgggcctcttccagctggatgccctgatgttcctgcggctgcagggcaaccagctggccgccctgcccccccaggagaagtggacctgccggcagctgaagaccctggacctgagcaggaaccagctgggcaagaatgaagatggcctgaagaccaagagaattgccttcttcaccacccggggccggcagaggagcggcacagaggccgcctctgtgctggagttccctgccttcctgtctgagagcctggaggtgctgtgcctgaatgacaaccacctggacacagtgccccccagcgtgtgcctgctgaagagcctgtctgagctgtacctgggcaacaaccctggcctgcgggagctgcccccagagctgggccagctgggcaacctgtggcagctggacacagaggacctgaccatcagcaatgtgcctgctgagatccagaaggagggccccaaggccatgctgagctacctgcgggcccagctgaggaaggccgagaagtgcaagctgatgaagatgatcatcgtgggccccccccggcagggcaagagcaccctgctggagatcctgcagacaggccgggccccccaggtggtgcacggggaggccaccatccgcaccaccaagtgggagctgcagaggcctgctggcagccgggccaaggtggagagcgtggagttcaacgtgtgggacatcggcggccctgcctccatggccaccgtgaaccagtgcttcttcacagacaaggccctgtatgtggtggtgtggaacctggccctgggggaggaggccgtggccaacctgcagttctggctgctgaacatcgaggccaaggccccaaatgctgtggtgctggtggtgggcacccacctggacctgattgaggccaagttccgggtggagagaattgccaccctgcgggcctacgtgctggccctgtgccgcagccccagcggcagccgggccaccggcttcccagacatcaccttcaagcacctgcacgagatcagctgcaagagcctggagggccaggagggcctgcggcagctgatcttccacgtgacctgcagcatgaaggatgtgggcagcaccatcggctgccagaggctggccggccgcctcatccccaggagctacctgagcctgcaggaggccgtgctggccgagcagcagaggaggagcagagatgatgatgtgcagtacctgacagaccggcagctggagcagctggtggagcagaccccagacaatgacatcaaggactatgaggacctgcagagcgccatctccttcctgattgaaacaggcaccctgctgcacttcccagacaccagccacggcctgaggaacctgtacttcctggaccccatctggctgtctgaatgtctgcagaggatcttcaacatcaagggcagccgctctgtggccaagaatggagtcatccgggcagaggacctgaggatgctgctggtgggcaccggcttcacccagcagacagaggagcagtacttccagttcctggccaagtttgagatcgccctgcctgtggccaatgacagctacctgctgccccacctgctgcccagcaagccaggcctggacacccacggcatgaggcaccccacagccaacaccatccagagggtcttcaagatgagctttgtgcctgtgggcttctggcagcgcttcatcgccaggatgctgatcagcctggccgagatggacctgcagctgtttgagaacaagaagaacaccaagagcaggaacaggaaggtgaccatctacagcttcaccggcaaccagaggaaccgctgcagcaccttccgggtgaagaggaaccagaccatctactggcaggagggcctgctggtgacctttgatggcggctacctgtctgtggagagcagtgatgtgaactggaagaagaagaagagcggcggcatgaagatcgtgtgccagagcgaggtgcgggacttcagcgccatggccttcatcacagaccacgtgaacagcctgattgaccagtggttccctgccctgacagccacagaaagtgatggcacccccctgatggagcagtatgtgccctgccctgtgtgtgaaacagcctgggcccagcacacagaccccagcgagaagtcagaagatgtgcagtactttgacatggaggactgtgtgctgacagccatcgagcgggacttcatcagctgccccaggcacccagacctgcctgtgcccctgcaggagctggtgcctgagctgttcatgacagacttccctgcccggctcttcctggagaacagcaagctggagcacagtgaagatgagggctctgtgctgggccagggcggcagcggcaccgtcatctaccgggcccgctaccagggccagcctgtggccgtgaagcgcttccacatcaagaagttcaagaactttgccaacgtgcctgctgacaccatgctgcggcacctgcgggccacagatgccatgaagaacttcagcgagttccggcaggaggcctccatgctgcacgccctgcagcacccctgcatcgtggccctgattggcatcagcatccaccccctgtgctttgccctggagctggcccccctgagcagcctgaacacagtgctgtctgaaaatgcccgggacagcagcttcatccccctgggccacatgctgacccagaagatcgcctaccagatcgccagcggcctggcctacctgcacaagaagaacatcatcttctgtgacctgaagagtgacaacatcctggtgtggagcctggatgtgaaggagcacatcaacatcaagctgagtgactatggcatcagccggcagagcttccacgagggcgccctgggcgtggagggcaccccaggctaccaggcccctgagatccggcccagaattgtgtatgatgagaaggtggacatgttctcctatggcatggtgctgtatgagctgctgagcggccagaggcctgccctgggccaccaccagctgcagatcgccaagaagctgagcaagggcatccggcctgtgctgggccagcctgaggaggtgcagttccggcggctgcaggccctgatgatggagtgctgggacaccaagccagagaagaggcccctggccctgtctgtggtgtcccagatgaaggaccccacctttgccaccttcatgtatgagctgtgctgcggcaagcagacagccttcttcagcagccagggccaggagtacacagtggtgttctgggatggcaaggaggagagcaggaactacacagtggtgaacacagagaagggcctgatggaggtgcagaggatgtgctgccccggcatgaaggtgtcctgccagctgcaggtgcagaggagcctgtggacagccacagaggaccagaagatctacatctacaccctgaagggcatgtgccccctgaacaccccccagcaggccctggacaccccagctgtggtgacctgcttcctggccgtgcctgtgatcaagaagaacagctacctggtgctggccggcctggctgatggcctggtggccgtgtttcctgtggtgcggggcacccccaaggacagctgcagctacctgtgcagccacacagccaacagaagcaagttcagcattgctgatgaagatgcccggcagaacccctaccctgtgaaggccatggaggtggtgaacagcggcagcgaggtgtggtacagcaatggacctggcctgctggtgattgactgtgccagcctggagatctgccggcggctggagccctacatggcccccagcatggtgacctctgtggtgtgcagcagcgagggccgcggggaggaggtggtgtggtgcctggatgacaaggccaacagcctggtgatgtaccacagcaccacctaccagctgtgtgcccgctacttctgtggggtgcccagccccctgcgggacatgtttcctgtgcggcccctggacacagagcccccagctgccagccacacagccaaccccaaggtgcctgagggggacagcattgctgatgtgtccatcatgtacagcgaggagctgggcacccagatcctgatccaccaggagagcctgacagactactgcagcatgagcagctacagcagcagccccccccggcaggccgcccggagccccagcagcctgcccagcagccctgccagcagcagctctgtgcccttcagcacagactgtgaggacagcgacatgctgcacacccctggggccgccagtgacagaagtgaacatgacctgacccccatggatggagagaccttcagccagcacctgcaggccgtgaagatcctggccgtgcgggacctgatctgggtgcccaggagaggaggagatgtgattgtgattggcctggagaaggacagcggggcccagaggggccgggtgattgctgtgctgaaggcccgggagctgaccccccacggcgtgctggtggatgctgctgtggtggccaaggacacagtggtgtgcacctttgaaaatgaaaatacagagtggtgcctggccgtgtggaggggctggggcgcccgggagtttgacatcttctaccagagctatgaggagctgggccgcctggaggcctgcaccaggaagagaagatag

SEQ ID NO: 157581 - DNA, 2025 bp, Artificial Sequence
  Description of Artificial Sequence: Synthetic coding sequence
atgctgcacgccctgcagcacccctgcatcgtggccctgattggcatcagcatccaccccctgtgctttgccctggagctggcccccctgagcagcctgaacacagtgctgtctgaaaatgcccgggacagcagcttcatccccctgggccacatgctgacccagaagatcgcctaccagatcgccagcggcctggcctacctgcacaagaagaacatcatcttctgtgacctgaagagtgacaacatcctggtgtggagcctggatgtgaaggagcacatcaacatcaagctgagtgactatggcatcagccggcagagcttccatgaaggagccctgggcgtggagggcaccccaggctaccaggcccctgagatccggccccgcatcgtgtatgatgagaaggtggacatgttctcctatggcatggtgctgtatgagctgctgagcggccagaggcctgccctgggccaccaccagctgcagatcgccaagaagctgagcaagggcatccggcctgtgctgggccagcctgaggaggtgcagttccggcggctgcaggccctgatgatggagtgctgggacaccaagccagagaagaggcccctggccctgtctgtggtgtcccagatgaaggaccccacctttgccaccttcatgtatgagctgtgctgcggcaagcagacagccttcttcagcagccagggccaggagtacacagtggtgttctgggatggcaaggaggagagcaggaactacacagtggtgaacacagagaagggcctgatggaggtgcagaggatgtgctgccccggcatgaaggtgtcctgccagctgcaggtgcagaggagcctgtggacagccacagaggaccagaagatctacatctacaccctgaagggcatgtgccccctgaacaccccccagcaggccctggacaccccagctgtggtgacctgcttcctggccgtgcctgtgatcaagaagaacagctacctggtgctggccggcctggctgatggcctggtggccgtgtttcctgtggtgcggggcacccccaaggacagctgcagctacctgtgcagccacacagccaacagaagcaagttcagcattgctgatgaagatgcccggcagaacccctaccctgtgaaggccatggaggtggtgaacagcggcagcgaggtgtggtacagcaatggacctggcctgctggtgattgactgtgccagcctggagatctgccggcggctggagccctacatggcccccagcatggtgacctctgtggtgtgcagcagcgagggccgcggggaggaggtggtgtggtgcctggatgacaaggccaacagcctggtgatgtaccacagcaccacctaccagctgtgtgcccgctacttctgtggggtgcccagccccctgcgggacatgtttcctgtgcggcccctggacacagagcccccagctgccagccacacagccaaccccaaggtgcctgagggggacagcattgctgatgtgtccatcatgtacagcgaggagctgggcacccagatcctgatccaccaggagagcctgacagactactgcagcatgagcagctacagcagcagccccccccggcaggccgcccggagccccagcagcctgcccagcagccctgccagcagcagctctgtgcccttcagcacagactgtgaagattctgacatgctgcacaccccaggagctgccagtgacagaagtgaacatgacctgacccccatggatggagagaccttcagccagcacctgcaggccgtgaagatcctggccgtgcgggacctgatctgggtgcccaggagaggaggagatgtgattgtcatcggcctggagaaggacagcggggcccagaggggccgggtgattgctgtgctgaaggcccgggagctgacccctcatggcatcatgcctgtgtcctctgtgaaggtgtgctgggccggctggcctgtgcgggacatggtgtacatggtggccgtgatgtag

SEQ ID NO: 157582 - DNA, 99 bp, Artificial Sequence
  Description of Artificial Sequence: Synthetic coding sequence
atggccggcatgagccagaggcctcccagcatgtactggtgtgtgggccctgaggagagcgctgtgtgcccagagcgggccatggagaccctgaactag

SEQ ID NO: 157583 - DNA, 1506 bp, Artificial Sequence
  Description of Artificial Sequence: Synthetic coding sequence
atgttctcctatggcatggtgctgtatgagctgctgagcggccagaggcctgccctgggccaccaccagctgcagatcgccaagaagctgagcaagggcatccggcctgtgctgggccagcctgaggaggtgcagttccggcggctgcaggccctgatgatggagtgctgggacaccaagccagagaagaggcccctggccctgtctgtggtgtcccagatgaaggaccccacctttgccaccttcatgtatgagctgtgctgcggcaagcagacagccttcttcagcagccagggccaggagtacacagtggtgttctgggatggcaaggaggagagcaggaactacacagtggtgaacacagagaagggcctgatggaggtgcagaggatgtgctgccccggcatgaaggtgtcctgccagctgcaggtgcagaggagcctgtggacagccacagaggaccagaagatctacatctacaccctgaagggcatgtgccccctgaacaccccccagcaggccctggacaccccagctgtggtgacctgcttcctggccgtgcctgtgatcaagaagaacagctacctggtgctggccggcctggctgatggcctggtggccgtgtttcctgtggtgcggggcacccccaaggacagctgcagctacctgtgcagccacacagccaacagaagcaagttcagcattgctgatgaagatgcccggcagaacccctaccctgtgaaggccatggaggtggtgaacagcggcagcgaggtgtggtacagcaatggacctggcctgctggtgattgactgtgccagcctggagatctgccggcggctggagccctacatggcccccagcatggtgacctctgtggtgtgcagcagcgagggccgcggggaggaggtggtgtggtgcctggatgacaaggccaacagcctggtgatgtaccacagcaccacctaccagctgtgtgcccgctacttctgtggggtgcccagccccctgcgggacatgtttcctgtgcggcccctggacacagagcccccagctgccagccacacagccaaccccaaggtgcctgagggggacagcattgctgatgtgtccatcatgtacagcgaggagctgggcacccagatcctgatccaccaggagagcctgacagactactgcagcatgagcagctacagcagcagccccccccggcaggccgcccggagccccagcagcctgcccagcagccctgccagcagcagctctgtgcccttcagcacagactgtgaggacagcgacatgctgcacacccctggggccgccagtgacagaagtgaacatgacctgacccccatggatggagagaccttcagccagcacctgcaggccgtgaagatcctggccgtgcgggacctgatctgggtgcccaggagagtggagatgctgagcagcctggcctggaggcgcatcctggcccccagcggggctgagagcctgcccagctag

SEQ ID NO: 157584 - DNA, 7584 bp, Artificial Sequence
  Description of Artificial Sequence: Synthetic coding sequence
atggccagcggcagctgccagggctgtgaagaagatgaggagaccctgaagaagctgattgtgcggctgaacaacgtgcaggagggcaagcagatcgagaccctggtgcagatcctggaggacctgctggtgttcacctacagcgagcgggccagcaagctgttccagggcaagaacatccacgtgcccctgctgattgtgctggacagctacatgagggtggcctctgtgcagcaggtgggctggagcctgctgtgcaagctgattgaggtgtgccccggcaccatgcagagcctgatgggcccccaggatgtgggcaatgactgggaggtgctgggcgtgcaccagctgatcctgaagatgctgactgtgcacaatgcctctgtgaacctgagcgtcatcggcctgaagaccctggacctgctgctgaccagcggcaagatcaccctgctgatcctggatgaggagagtgacatcttcatgctgatctttgatgccatgcacagcttccctgccaatgatgaggtgcagaagctgggctgcaaggccctgcacgtgctgtttgagcgggtgtctgaggagcagctgacagaatttgtggagaacaaggactacatgatcctgctgagcgccctgaccaacttcaaggatgaggaggagatcgtgctgcacgtgctgcactgcctgcacagcctggccatcccctgcaacaacgtggaggtgctgatgtctggaaatgtgcgctgctacaacatcgtggtggaggccatgaaggccttccccatgtctgagcgcatccaggaggtgtcctgctgcctgctgcaccggctgaccctgggcaacttcttcaacatcctggtgctgaatgaggtgcatgaatttgtggtgaaggctgtgcagcagtacccagaaaatgctgccctgcagatcagcgccctgagctgcctggccctgctgacagagaccatcttcctgaaccaggacctggaggagaagaatgaaaaccaggagaatgatgatgaaggagaggaggacaagctgttctggctggaggcctgctacaaggccctgacctggcacaggaagaacaagcacgtgcaggaggccgcctgctgggccctgaacaacctgctgatgtaccagaacagcctgcacgagaagattggagatgaagatggccacttccctgcccaccgggaggtgatgctgtccatgctgatgcacagcagcagcaaggaggtgttccaggccagcgccaatgccctgagcaccctgctggagcagaatgtgaacttcaggaagatcctgctgagcaagggcatccacctgaatgtgctggagctgatgcagaagcacatccacagccctgaggtggccgagagcggctgcaagatgctgaaccacctgtttgagggcagcaacaccagcctggacatcatggctgctgtggtgcccaagatcctgactgtgatgaagagacatgagaccagcctgcctgtgcagctggaggccctgcgggccatcctgcacttcatcgtgcccggcatgcctgaggagagccgggaggacacagagttccaccacaagctgaacatggtgaagaagcagtgcttcaagaatgacatccacaagctggtgctggccgccctgaaccgcttcatcggcaaccctggcatccagaagtgtggcctgaaggtgatcagcagcatcgtgcacttcccagatgccctggagatgctgagcctggagggcgccatggacagcgtgctgcacaccctgcagatgtacccagatgaccaggagatccagtgcctgggcctgagcctcatcggctacctgatcaccaagaagaatgtgttcatcggcaccggccacctgctggccaagatcctggtgagcagcctgtaccgcttcaaggatgtggccgagatccagaccaagggcttccagaccatcctggccatcctgaagctgagcgccagcttcagcaagctgctggtgcaccacagctttgacctggtgatcttccaccagatgagcagcaacatcatggagcagaaggaccagcagttcctgaacctgtgctgcaagtgctttgccaaggtggccatggatgactacctgaagaatgtgatgctggagcgggcctgtgaccagaacaacagcatcatggtggagtgcctgctgctgctgggcgcagatgccaaccaggccaaggagggcagcagcctcatctgccaggtgtgtgagaaggagagcagccccaagctggtggagctgctgctgaacagcggcagccgggagcaggatgtgaggaaggccctgaccatcagcattggaaaaggagacagccagatcatcagcctgctgctgcggcggctggccctggatgtggccaacaacagcatctgcctgggcggcttctgcatcggcaaggtggagcccagctggctgggccccctcttcccagacaagaccagcaacctgaggaagcagaccaacatcgccagcaccctggccaggatggtgatccgctaccagatgaagtctgctgtggaggagggcacagccagcggcagtgatggcaacttctctgaagatgtgctgagcaagtttgatgagtggaccttcatcccagacagctccatggattctgtgtttgcccagagtgatgacctggacagcgagggcagcgagggcagcttcctggtgaagaagaagagcaacagcatctctgtgggggagttctacagagatgctgtgctgcagcgctgcagccccaacctgcagaggcacagcaacagcctgggccccatctttgaccacgaggacctgctgaagaggaagaggaagatcctgagcagtgatgacagcctgcggagcagcaagctgcagagccacatgaggcacagcgacagcatcagcagcctggccagcgagcgggagtacatcaccagcctggacctgagcgccaatgagctgcgggacattgatgccctgagccagaagtgctgcatctctgtgcacctggagcacctggagaagctggagctgcaccagaatgccctgaccagcttcccccagcagctgtgtgagaccctgaagagcctgacccacctggacctgcacagcaacaagttcaccagcttccccagctacctgctgaagatgagctgcatcgccaacctggatgtgtccagaaatgacatcggccccagcgtggtgctggaccccaccgtgaagtgccccaccctgaagcagttcaacctgagctacaaccagctgagctttgtgcctgagaacctgacagatgtggtggagaagctggagcagctgatcctggagggcaacaagatcagcggcatctgcagccccctgcggctgaaggagctgaagatcctgaacctgagcaagaaccacatcagcagcctgtctgagaacttcctggaggcctgccccaaggtggagagcttcagcgccaggatgaacttcctggccgccatgcccttcctgccccccagcatgaccatcctgaagctgagccagaacaagttcagctgcatccctgaggccatcctgaacctgccccacctgcggagcctggacatgagcagcaatgacatccagtacctgcccggccctgcccactggaagagcctgaacctgcgggagctgctcttcagccacaaccagatcagcatcctggacctgtctgagaaggcctacctgtggagccgggtggagaagctgcacctgagccacaacaagctgaaggagatccccccagagatcggctgcctggagaacctgaccagcctggatgtgtcctacaacctggagctgcgctccttccccaatgagatgggcaagctgagcaagatctgggacctgcccctggatgagctgcacctgaactttgacttcaagcacatcggctgcaaggccaaggacatcatccgcttcctgcagcagaggctgaagaaggctgtgccctacaacaggatgaagctgatgattgtgggcaacacaggcagcggcaagaccaccctgctgcagcagctgatgaagaccaagaagagtgacctgggcatgcagagcgccaccgtgggcattgatgtgaaggactggcccatccagatccgggacaagaggaagagggacctggtgctgaatgtgtgggactttgctggccgggaggagttctacagcacccacccccacttcatgacccagagggccctgtacctggccgtgtatgacctgagcaagggccaggccgaggtggatgccatgaagccctggctgttcaacatcaaggcccgggccagcagcagccctgtgatcctggtgggcacccacctggatgtgtctgatgagaagcagaggaaggcctgcatgagcaagatcaccaaggagctgctgaacaagaggggcttccctgccatccgggactaccactttgtgaatgccacagaggagagtgatgccctggccaagctgaggaagaccatcatcaatgaaagcctgaacttcaagatccgggaccagctggtggtgggccagctgatcccagactgctacgtggagctggagaagatcatcctgtctgagaggaagaatgtgcccatcgagttccctgtgattgacaggaagaggctgctgcagctggtgcgggagaaccagctgcagctggatgaaaatgagctgccccatgctgtgcacttcctgaatgaaagtggagtgctgctgcacttccaggaccctgccctgcagctgagtgacctgtactttgtggagcccaagtggctgtgcaagatcatggcccagatcctgactgtgaaggtggagggctgccccaagcaccccaagggcatcatcagcagaagagatgtggagaagttcctgagcaagaagaggaagttccccaagaactacatgagccagtacttcaagctgctggagaagttccagatcgccctgcccatcggggaggagtacctgctggtgcccagcagcctgagtgaccacaggcctgtgattgagctgccccactgtgagaacagcgagatcatcatccggctgtatgagatgccctacttccccatgggcttctggagccgcctcatcaaccggctgctggagatcagcccctacatgctgagcggccgggagcgggccctgcggcccaacaggatgtactggaggcagggcatctacctgaactggagccctgaggcctactgcctggtgggcagcgaggtgctggacaaccaccctgagagcttcctgaagatcaccgtgcccagctgcaggaagggctgcatcctgctgggccaggtggtggaccacatcgacagcctgatggaggagtggttccctggcctgctggagattgacatctgtggggagggggagaccctgctgaagaagtgggccctgtacagcttcaatgatggagaggagcaccagaagatcctgctggatgacctgatgaagaaggccgaggagggggacctgctggtgaacccagaccagccccggctgaccatccccatcagccagatcgccccagacctgatcctggccgacctgcccaggaacatcatgctgaacaatgatgagctggagtttgagcaggcccctgagttcctgctgggagatggcagctttggatctgtgtaccgggccgcctatgaaggagaggaggtggccgtgaagatcttcaacaagcacaccagcctgcggctgctgcggcaggagctggtggtgctgtgccacctgcaccaccccagcctcatcagcctgctggccgccggcatccggcccaggatgctggtgatggagctggccagcaagggcagcctggaccggctgctgcagcaggacaaggccagcctgaccaggaccctgcagcaccgcatcgccctgcacgtggctgatggcctgcgctacctgcacagcgccatgatcatctacagagacctgaagccccacaacgtgctgctcttcaccctgtacccaaatgctgccatcatcgccaagattgctgactatggcatcgcccagtactgctgcaggatgggcatcaagaccagcgagggcaccccaggcttccgggcccctgaggtggcccggggaaatgtcatctacaaccagcaggctgatgtgtacagctttggcctgctgctgtatgacatcctgaccactggaggaagaattgtggagggcctgaagttccccaatgaatttgatgagctggagatccagggcaagctgcctgaccctgtgaaggagtatggctgtgccccctggcccatggtggagaagctgatcaagcagtgcctgaaggagaacccccaggagcggcccaccagcgcccaggtgtttgacatcctgaacagcgctgagctggtgtgcctgacccggcgcatcctgctgcccaagaatgtgattgtggagtgcatggtggccacccaccacaacagcagaaatgccagcatctggctgggctgcggccacacagaccggggccagctgtccttcctggacctgaacacagagggctacaccagcgaggaggtggccgacagccgcatcctgtgcctggccctggtgcacctgcctgtggagaaggagagctggatcgtgtctggcacccagagcggcaccctgctggtgatcaacacagaagatggcaagaagaggcacaccctggagaagatgacagacagcgtgacctgcctgtactgcaacagcttcagcaagcagagcaagcagaagaacttcctgctggtgggcacagcagatggcaagctggccatctttgaggacaagacagtgaagctgaagggagctgcccccctgaagatcctgaacattggaaatgtgtccacccccctgatgtgcctgtctgagagcaccaacagcacagaaagaaatgtgatgtggggcggctgcggcaccaagatcttctccttcagcaatgacttcaccatccagaagctgattgagaccaggaccagccagctgttctcctatgctgccttcagtgacagcaacatcatcaccgtggtggtggacacagccctgtacatcgccaagcagaacagccctgtggtggaggtgtgggacaagaagacagagaagctgtgtggcctgattgactgtgtgcacttcctgcgggaggtgatggtgaaggagaacaaggagagcaagcacaagatgagctacagcggccgggtgaagaccctgtgcctgcagaagaacacagccctgtggattggaactggaggcggccacatcctgctgctggacctgagcacccggcggctcatccgggtcatctacaacttctgcaacagcgtgcgggtgatgatgacagcccagctgggcagcctgaagaatgtgatgctggtgctgggctacaacaggaagaacacagagggcacccagaagcagaaggagatccagagctgcctgactgtgtgggacatcaacctgccccatgaggtgcagaacctggagaagcacatcgaggtgaggaaggagctggccgagaagatgaggaggacctctgtggagtag

SEQ ID NO: 157585 - DNA, 582 bp, Artificial Sequence
  Description of Artificial Sequence: Synthetic coding sequence
atgaccagcagctgcttccgcagcaccaccaggaggagcctgagcagccagacagcccagaggctggtgtgcccccagttcatcaatggaacagccaaggacagcatcctgaccagccgcagccaggtgcccatcatcctgcagtggaacaagagcagcaagaagtttgtgccccatggagacatccccaacatggaggatgtgctggccgtgaagagcttcaggatgcagaacaccctgtacctgagcctgacccgcttcatcggggacagccgggtgatgcgctggaacagcaagcagtttgtggagatccaggccctgcccagcagaggagccatgaccctgcagcccttctccttcaaggacaaccactacctggccctgggcagtgactacaccttcagccagatctaccagtgggacaaggagaagcagctgttcaagaagttcaaggagatctacgtgcaggcccccaggagcttcaccgctgtgtccacagaccggcgggacttcttctttgccagcagcttcaagggcaagaccaagatctttgagcacatcatcgtggacctgagcctgtag

SEQ ID NO: 157586 - DNA, 1638 bp, Artificial Sequence
  Description of Artificial Sequence: Synthetic coding sequence
atggccctgcggcggggcggctgtggggccctgggcctgctgctgctgctgctgggcgccgcctgcctgatccccaggtctgcccaggtgcggcggctggcccgctgcccagccacctgcagctgcaccaaggagagcatcatctgtgtgggcagctcctgggtgccccgcatcgtgcctggggacatcagcagcctgagcctggtgaatggcaccttcagcgagatcaaggacaggatgttcagccacctgcccagcctgcagctgctgctgctgaacagcaacagcttcaccatcatcagagatgatgcctttgctggcctcttccacctggagtacctgttcatcgagggcaacaagattgagaccatcagcagaaatgccttccggggcctgcgggacctgacccacctgagcctggccaacaaccacatcaaggccctgcccagagatgtgttcagtgacctggacagcctcatcgagctggacctgcggggcaacaagtttgaatgtgactgcaaggccaagtggctgtacctgtggctgaagatgaccaacagcacagtgtctgatgtgctgtgcatcggccccccagagtaccaggagaagaagctgaatgatgtgaccagctttgattatgagtgcaccaccacagactttgtggtgcaccagaccctgccctaccagagcgtgtctgtggacaccttcaacagcaagaatgatgtgtatgtggccatcgcccagcccagcatggagaactgcatggtgctggagtgggaccacatcgagatgaacttccgctcctatgacaacatcaccggccagagcatcgtgggctgcaaggccatcctgattgatgaccaggtgtttgtggtggtggcccagctgtttggaggcagccacatctacaagtatgatgagagctggaccaagtttgtgaagttccaggacatcgaggtgagccgcatcagcaagcccaatgacatcgagctgttccagattgatgatgagaccttctttgtgattgctgacagcagcaaggccggcctgagcacagtgtacaagtggaacagcaagggcttctacagctaccagagcctgcacgagtggttccgggacacagatgctgagtttgtggacattgatggcaagagccacctgatcctgagcagccgcagccaggtgcccatcatcctgcagtggaacaagagcagcaagaagtttgtgccccatggagacatccccaacatggaggatgtgctggccgtgaagagcttcaggatgcagaacaccctgtacctgagcctgacccgcttcatcggggacagccgggtgatgcgctggaacagcaagcagtttgtggagatccaggccctgcccagcagaggagccatgaccctgcagcccttctccttcaaggacaaccactacctggccctgggcagtgactacaccttcagccagatctaccagtgggacaaggagaagcagctgttcaagaagttcaaggagatctacgtgcaggcccccaggagcttcaccgctgtgtccacagaccggcgggacttcttctttgccagcagcttcaagggcaagaccaagatctttgagcacatcatcgtggacctgagcctgtag

SEQ ID NO: 157587 - DNA, 1647 bp, Artificial Sequence
  Description of Artificial Sequence: Synthetic coding sequence
atggccggcctgcgggcccggggcggccctggccctggcctgctggccctgagcgccctgggcttctgcctgatgctgcaggtgtctgccaagaggcctcccaagaccccaccctgcccccccagctgcagctgcacccgggacacagccttctgtgtggacagcaaggctgtgcccaggaacctgcccagcgaggtgatcagcctgaccctggtgaatgctgccttcagcgagatccaggatggagccttcagccacctgcccctgctgcagttcctgctgctgaacagcaacaagttcaccctgattggagacaatgccttcaccggcctgagccacctgcagtacctgttcatcgagaacaatgacatctgggccctgagcaagttcaccttccggggcctgaagagcctgacccacctgagcctggccaacaacaacctgcagaccctgccccgggacatcttccggcccctggacatcctgaatgacctggacctgcggggcaacagcctgaactgtgactgcaaggtgaagtggctggtggagtggctggcccacaccaacaccaccgtggcccccatctactgtgccagccccccacgcttccaggagcacaaggtgcaggacctgcccctgcgggagtttgactgcatcaccacagactttgtgctgtaccagaccctggccttccctgctgtgtctgctgagcccttcctgtacagcagtgacctgtacctggccctggcccagcccggggtgtctgcctgcaccatcctgaagtgggactatgtggagcggcagctgcgggactatgaccgcatcccagcccccagcgctgtgcactgcaagcccatggtggtggacagccagctgtatgtggtggtggcccagctgtttggaggcagctacatctaccactgggaccccaacaccacccgcttcacccggctgcaggacatcgacccccagagggtgaggaagcccaatgacctggaggccttcagaattgatggagactggtactttgctgtggccgacagcagcaaggccggggccaccagcctgtaccgctggcaccagaatggcttctacagccaccaggccctgcacccctggcaccgggacacagacctggagtttgtggatggagagggcaagccccggctgattgtgagcagcagcagccaggcccctgtgatctaccagtggagcaggacccagaagcagtttgtggcccagggcgaggtgacccaggtgcctgatgcccaggccgtgaagcacttccgggccggccgggacagctacctgtgcctgagccgctacatcggggacagcaagatcctgcgctgggagggcacccgcttcagcgaggtgcaggccctgcccagccggggcagcctggccctgcagcccttcctggtgggcggccgccgctacctggccctgggcagtgacttctccttcacccagatctaccagtgggatgagggccggcagaagtttgtgcgcttccaggagctggccgtgcaggccccccgggccttctgctacatgcctgctggagatgcccagctgctgctggcccccagcttcaagggccagaccctggtgtaccgccacatcgtggtggacctgagcgcctag

SEQ ID NO: 157588 - DNA, 1614 bp, Artificial Sequence
  Description of Artificial Sequence: Synthetic coding sequence
atgggcggggccggcatcctgctgctgctgctggccggggccggcgtggtggtggcctggaggcctcccaagggcaagtgccccctgcgctgcagctgcagcaaggacagcgccctgtgtgagggcagcccagacctgcctgtgtccttcagccccaccctgctgagcctgagcctggtgaggactggagtgacccagctgaaggccggcagcttcctgcgcatccccagcctgcacctgctgctcttcaccagcaacagcttctctgtgattgaagatgatgcctttgctggcctgagccacctgcagtacctgttcatcgaggacaatgagatcggcagcatcagcaagaatgccctgcggggcctgcggagcctgacccacctgagcctggccaacaaccacctggagaccctgccccgcttcctgttccggggcctggacaccctgacccacgtggacctgcggggcaaccccttccagtgtgactgccgggtgctgtggctgctgcagtggatgcccaccgtgaatgcctctgtgggcaccggggcctgtgccggccctgccagcctgagccacatgcagctgcaccacctggaccccaagaccttcaagtgccgggccatcgagctgtcctggttccagacagtgggggagagcgccctgtctgtggagcccttctcctaccagggcgagccccacatcgtgctggcccagccctttgctggccgctgcctgatcctgtcctgggactacagcctgcagcgcttccggcctgaggaggagctgcctgctgcctctgtggtgtcctgcaagcccctggtgctgggccccagcctgtttgtgctggccgcccggctgtggggcggcagccagctgtgggcccggcccagccctggcctgcggctggcccccacccagaccctggccccccggcggctgctgcggcccaatgatgctgagctgctgtggctggagggccagccctgctttgtggtggctgatgccagcaaggccggcagcaccaccctgctgtgcagagatggccctggcttctacccccaccagagcctgcacgcctggcaccgggacacagatgctgaggccctggagctggatggccggccccacctgctgctggccagcgccagccagaggcctgtgctcttccactggacaggaggccgctttgaaagaagaacagacatccctgaggctgaagatgtgtatgccaccaggcacttccaggccggaggagatgtgttcctgtgcctgacccgctacatcggggacagcatggtgatgcgctgggatggctccatgttccggctgctgcagcagctgcccagcagaggagcccacgtgttccagcccctgctgattgcccgggaccagctggccatcctgggcagtgactttgccttcagccaggtgctgcggctggagccagacaagggcctgctggagcccctgcaggagctgggccccccagccctggtggccccccgggcctttgcccacatcaccatggccggccgccgcttcctgtttgctgcctgcttcaagggccccacccagatctaccagcaccatgaaattgacctgagcgcctag

SEQ ID NO: 157589 - DNA, 1485 bp, Artificial Sequence
  Description of Artificial Sequence: Synthetic coding sequence
atgggcggggccggcatcctgctgctgctgctggccggggccggcgtggtggtggcctggaggcctcccaagggcaagtgccccctgcgctgcagctgcagcaaggacagcgccctgtgtgagggcagcccagacctgcctgtgtccttcagccccaccctgctgagcctgagcctggtgaggactggagtgacccagctgaaggccggcagcttcctgcgcatccccagcctgcacctgctgctcttcaccagcaacagcttctctgtgattgaagatgatgcctttgctggcctgagccacctgcagtacctgttcatcgaggacaatgagatcggcagcatcagcaagaatgccctgcggggcctgcggagcctgacccacctgagcctggccaacaaccacctggagaccctgccccgcttcctgttccggggcctggacaccctgacccacgtggacctgcggggcaaccccttccagtgtgactgccgggtgctgtggctgctgcagtggatgcccaccgtgaatgcctctgtgggcaccggggcctgtgccggccctgccagcctgagccacatgcagctgcaccacctggaccccaagaccttcaagtgccgggccatcgagctgtcctggttccagacagtgggggagagcgccctgtctgtggagcccttctcctaccagggcgagccccacatcgtgctggcccagccctttgctggccgctgcctgatcctgtcctgggactacagcctgcagcgcttccggcctgaggaggagctgcccggggagcccccaccccggcccagcgcctgcccagctgcctgcctggccggcctgacctgcctgcccaccagcccccagaggcctccctggtgcccagccagccactggtgctgggcccgggccagcagctgctggctgcctgcctgtggcggggcccacagctgtggccctggccctgtgcctgcctgtgcctggccccagaggcggccctggccccggggcggctgctgcggccccatgacccccagcagctgtggctggaagggcaacccagcctcctggtggcccatgccaccccggcgggccgccccccgctgctgtgccgccaccggccctgccttcaccaggacccgggcctgcaccccaggcaccggcaccaggaccctgcggccctggagctggacagctggccccacctgctgctggccccggctgcccagcggcccctgcagcagcactggacctgtggccgccagcagagatgcccagaccagcccccggcccaggatgtccatgccccacgccaccagccggctggtgggcacctgcagctgtgccagccacgccaccctgggcaccccctggagctgtgccggcacagccccctgctttgtgtgctgcagcaacttccccagggctgtgcccaccagcagcagccactgcagcagccctggcacctcctggcccagctag

SEQ ID NO: 157590 - DNA, 1617 bp, Artificial Sequence
  Description of Artificial Sequence: Synthetic coding sequence
atgggcggggccggcatcctgctgctgctgctggccggggccggcgtggtggtggcctggaggcctcccaagggcaagtgccccctgcgctgcagctgcagcaaggacagcgccctgtgtgagggcagcccagacctgcctgtgtccttcagccccaccctgctgagcctgagcctggtgaggactggagtgacccagctgaaggccggcagcttcctgcgcatccccagcctgcacctgctgctcttcaccagcaacagcttctctgtgattgaagatgatgcctttgctggcctgagccacctgcagtacctgttcatcgaggacaatgagatcggcagcatcagcaagaatgccctgcggggcctgcggagcctgacccacctgagcctggccaacaaccacctggagaccctgccccgcttcctgttccggggcctggacaccctgacccacgtggacctgcggggcaaccccttccagtgtgactgccgggtgctgtggctgctgcagtggatgcccaccgtgaatgcctctgtgggcaccggggcctgtgccggccctgccagcctgagccacatgcagctgcaccacctggaccccaagaccttcaagtgccgggccatcgagctgtcctggttccagacagtgggggagagcgccctgtctgtggagcccttctcctaccagggcgagccccacatcgtgctggcccagccctttgctggccgctgcctgatcctgtcctgggactacagcctgcagcgcttccggcctgaggaggagctgcctgctgcctctgtggtgtcctgcaagcccctggtgctgggccccagcctgtttgtgctggccgcccggctgtggggcggcagccagctgtgggcccggcccagccctggcctgcggctggcccccacccagaccctggccccccggcggctgctgcggcccaatgatgctgagctgctgtggctggagggccagccctgctttgtggtggctgatgccagcaaggccggcagcaccaccctgctgtgcagagatggccctggcttctacccccaccagagcctgcacgcctggcaccgggacacagatgctgaggccctggagctggatggccggccccacctgctgctggccagcgccagccagaggcctgtgctcttccactggacaggaggccgctttgaaagaagaacagacatccctgaggctgaagatgtgtatgccaccaggcacttccaggccggaggagatgtgttcctgtgcctgacccgctacatcggggacagcatggtggtgatgcgctgggatggctccatgttccggctgctgcagcagctgcccagcagaggagcccacgtgttccagcccctgctgattgcccgggaccagctggccatcctgggcagtgactttgccttcagccaggtgctgcggctggagccagacaagggcctgctggagcccctgcaggagctgggccccccagccctggtggccccccgggcctttgcccacatcaccatggccggccgccgcttcctgtttgctgcctgcttcaagggccccacccagatctaccagcaccacgagattgacctgagcgcctag

SEQ ID NO: 157591 - DNA, 2091 bp, Artificial Sequence
  Description of Artificial Sequence: Synthetic coding sequence
atggccaccccaggcagcgagccccagccctttgtgcctgccctgtctgtggccaccctgcaccccctgcaccacccccaccaccaccaccaccaccaccagcaccacggcggcactggagcccctgggggcgccggcggcggcggcggcggcagcggcggcttcaacctgcccctgaacagaggcctggagcgggccctggaggaggccgccaacagcggcggcctgaacctgagcgccaggaagctgaaggagttccccaggacagctgcccctggccatgacctgagtgacacagtgcaggccgacctgagcaagaaccggctggtggaggtgcccatggagctgtgccactttgtgtccctggagatcctgaacctgtaccacaactgcatccgggtcatccctgaggccatcgtgaacctgcagatgctgacctacctgaacctgagcaggaaccagctgagcgccctgcctgcctgcctgtgtggcctgcccctgaaggtgctgattgccagcaacaacaagctgggcagcctgcctgaggagatcggccagctgaagcagctgatggagctggatgtgtcctgcaatgagatcacagccctgccccagcagatcggccagctgaagagcctgcgggagctgaatgtgagaagaaactacctgaaggtgctgccccaggagctggtggacctgagcctggtgaagtttgacttcagctgcaacaaggtgctggtgatccccatctgcttccgggagatgaagcagctgcaggtgctgctgctggagaacaaccccctgcagagccccccagcccagatctgcaccaagggcaaggtgcacatcttcaagtacctgagcatccaggcctgccagatcaagacagctgacagcctgtacctgcacaccatggagcggccccacctgcaccagcacgtggaggatggcaagaaggacagcgacagcggcgtgggcagtgacaatggagacaagaggctgagcgccacagagcccagtgatgaggacacagtgtccctgaatgtgcccatgagcaacatcatggaggaggagcagatcatcaaggaggacagctgccaccggctgagccctgtgaagggggagttccaccaggagttccagcctgagcccagcctgctgggggacagcaccaacagcggggaggagcgggaccagttcacagacagagcagatggcctgcacagcgagttcatgaactacaaggcccgggcagaggactgtgaggagctgctgagaattgaagaagatgtgcactggcagacagagggcatcatcagcagcagcaaggaccaggacatggacatcgccatgattgagcagctgcgggaggccgtggacctgctgcaggaccccaacggcctgagcacagacatcacagagaggtctgtgctgaacctgtaccccatgggcagcgctgaggccctggagctgcaggacagcgccctgaatggccagatccagctggagaccagccctgtgtgtgaggtgcagagcgacctgaccctgcagagcaatggcagccagtacagccccaatgagatccgggagaacagccctgctgtgagccccaccaccaacagcacagcccccttcggcctgaagcccaggtctgtgttcctgcggccccagaggaacctggagagcattgacccccagttcaccatccggaggaagatggagcagatgagggaggagaaggagctggtggagcagctgcgggagagcattgagatgaggctgaaggtgtccctgcacgaggacctgggcgccgccctgatggatggagtggtgctgtgccacctggtgaaccacatccggcccaggtctgtggccagcatccacgtgcccagccctgctgtgcccaagctgtccatggccaagtgcagaagaaatgtggagaacttcctggaggcctgcaggaagctgggcgtgcctgaggagaagctgtgcctgccccaccacatcctggaggagaagggcctggtgaaggtgggcatcaccatccaggccctgctggacatcaccgtgaccaaggccctcttcacctag

SEQ ID NO: 157592 - DNA, 2187 bp, Artificial Sequence
  Description of Artificial Sequence: Synthetic coding sequence
atggccaccccaggcagcgagccccagccctttgtgcctgccctgtctgtggccaccctgcaccccctgcaccacccccaccaccaccaccaccaccaccagcaccacggcggcactggagcccctgggggcgccggcggcggcggcggcggcagcggcggcttcaacctgcccctgaacagaggcctggagcgggccctggaggaggccgccaacagcggcggcctgaacctgagcgccaggaagctgaaggagttccccaggacagctgcccctggccatgacctgagtgacacagtgcaggccgacctgagcaagaaccggctggtggaggtgcccatggagctgtgccactttgtgtccctggagatcctgaacctgtaccacaactgcatccgggtcatccctgaggccatcgtgaacctgcagatgctgacctacctgaacctgagcaggaaccagctgagcgccctgcctgcctgcctgtgtggcctgcccctgaaggtgctgattgccagcaacaacaagctgggcagcctgcctgaggagatcggccagctgaagcagctgatggagctggatgtgtcctgcaatgagatcacagccctgccccagcagatcggccagctgaagagcctgcgggagctgaatgtgagaagaaactacctgaaggtgctgccccaggagctggtggacctgagcctggtgaagtttgacttcagctgcaacaaggtgctggtgatccccatctgcttccgggagatgaagcagctgcaggtgctgctgctggagaacaaccccctgcagagccccccagcccagatctgcaccaagggcaaggtgcacatcttcaagtacctgagcatccaggcctgccagatcaagacagctgacagcctgtacctgcacaccatggagcggccccacctgcaccagcacgtggaggatggcaagaaggacagcgacagcggcgtgggcagtgacaatggagacaagaggctgagcgccacagagcccagtgatgaggacacagtgtccctgaatgtgcccatgagcaacatcatggaggaggagcagatcatcaaggaggacagctgccaccggctgagccctgtgaagggggagttccaccaggagttccagcctgagcccagcctgctgggggacagcaccaacagcggggaggagcgggaccagttcacagacagagcagatggcctgcacagcgagttcatgaactacaaggcccgggcagaggactgtgaggagctgctgagaattgaagaagatgtgcactggcagacagagggcatcatcagcagcagcaaggaccaggacatggacatcgccatgattgagcagctgcgggaggccgtggacctgctgcaggaccccaacggcctgagcacagacatcacagagaggtctgtgctgaacctgtaccccatgggcagcgctgaggccctggagctgcaggacagcgccctgaatggccagatccagctggagaccagccctgtgtgtgaggtgcagagcgacctgaccctgcagagcaatggcagccagtacagccccaatgagatccgggagaacagccctgctgtgagccccaccaccaacagcacagcccccttcggcctgaagcccaggtctgtgttcctgcggccccagaggaacctggagagcattgacccccagttcaccatccggaggaagatggagcagatgagggaggagaaggagctggtggagcagctgcgggagagcattgagatgaggctgaaggtgtccctgcacgaggacctgggcgccgccctgatggatggagtggtgctgtgccacctggtgaaccacatccggcccaggtctgtggccagcatccacgtgcccagccctgctgtgcccaagctgtccatggccaagtgcagaagaaatgtggagaacttcctggaggcctgcaggaagctgggcgtgcctgaggccgacctgtgcagcccctgtgacatcctgcagctggacttccgccacatcaggaagacagtggacaccctgctggccctgggggagaaggcccccccacccaccagcgccctgcggagccgggacctgattggcttctgcctggtgcacatcctcttcatcgtgctggtgtacatcacctaccactggaatgccctgagcgcctag

SEQ ID NO: 157593 - DNA, 2292 bp, Artificial Sequence
  Description of Artificial Sequence: Synthetic coding sequence
atggccaccccaggcagcgagccccagccctttgtgcctgccctgtctgtggccaccctgcaccccctgcaccacccccaccaccaccaccaccaccaccagcaccacggcggcactggagcccctgggggcgccggcggcggcggcggcggcagcggcggcttcaacctgcccctgaacagaggcctggagcgggccctggaggaggccgccaacagcggcggcctgaacctgagcgccaggaagctgaaggagttccccaggacagctgcccctggccatgacctgagtgacacagtgcaggccgacctgagcaagaaccggctggtggaggtgcccatggagctgtgccactttgtgtccctggagatcctgaacctgtaccacaactgcatccgggtcatccctgaggccatcgtgaacctgcagatgctgacctacctgaacctgagcaggaaccagctgagcgccctgcctgcctgcctgtgtggcctgcccctgaaggtgctgattgccagcaacaacaagctgggcagcctgcctgaggagatcggccagctgaagcagctgatggagctggatgtgtcctgcaatgagatcacagccctgccccagcagatcggccagctgaagagcctgcgggagctgaatgtgagaagaaactacctgaaggtgctgccccaggagctggtggacctgagcctggtgaagtttgacttcagctgcaacaaggtgctggtgatccccatctgcttccgggagatgaagcagctgcaggtgctgctgctggagaacaaccccctgcagagccccccagcccagatctgcaccaagggcaaggtgcacatcttcaagtacctgagcatccaggcctgccagatcaagacagctgacagcctgtacctgcacaccatggagcggccccacctgcaccagcacgtggaggatggcaagaaggacagcgacagcggcgtgggcagtgacaatggagacaagaggctgagcgccacagagcccagtgatgaggacacagtgtccctgaatgtgcccatgagcaacatcatggaggaggagcagatcatcaaggaggacagctgccaccggctgagccctgtgaagggggagttccaccaggagttccagcctgagcccagcctgctgggggacagcaccaacagcggggaggagcgggaccagttcacagacagagcagatggcctgcacagcgagttcatgaactacaaggcccgggcagaggactgtgaggagctgctgagaattgaagaagatgtgcactggcagacagagggcatcatcagcagcagcaaggaccaggacatggacatcgccatgattgagcagctgcgggaggccgtggacctgctgcaggaccccaacggcctgagcacagacatcacagagaggtctgtgctgaacctgtaccccatgggcagcgctgaggccctggagctgcaggacagcgccctgaatggccagatccagctggagaccagccctgtgtgtgaggtgcagagcgacctgaccctgcagagcaatggcagccagtacagccccaatgagatccgggagaacagccctgctgtgagccccaccaccaacagcacagcccccttcggcctgaagcccaggagtgaccctgccctgatcctgccccccatctccttcaacaccctgacccaggcccagacctgggacagcagcagctacagcgtgcccagcgagggggacagcgacaacgtgttcctgcggccccagaggaacctggagagcattgacccccagttcaccatccggaggaagatggagcagatgagggaggagaaggagctggtggagcagctgcgggagagcattgagatgaggctgaaggtgtccctgcacgaggacctgggcgccgccctgatggatggagtggtgctgtgccacctggtgaaccacatccggcccaggtctgtggccagcatccacgtgcccagccctgctgtgcccaagctgtccatggccaagtgcagaagaaatgtggagaacttcctggaggcctgcaggaagctgggcgtgcctgaggccgacctgtgcagcccctgtgacatcctgcagctggacttccgccacatcaggaagacagtggacaccctgctggccctgggggagaaggcccccccacccaccagcgccctgcggagccgggacctgattggcttctgcctggtgcacatcctcttcatcgtgctggtgtacatcacctaccactggaatgccctgagcgcctag

SEQ ID NO: 157594 - DNA, 3282 bp, Artificial Sequence
  Description of Artificial Sequence: Synthetic coding sequence
atggcccggcctgtgcggggcggcctgggcgcccccaggaggagcccctgcctgctgctgctgtggctgctgctgctgcggctggagcctgtgacagctgctgctggcccccgggccccctgtgccgccgcctgcacctgtgccggggacagcctggactgtggcggccggggcctggccgccctgcccggggacctgcccagctggaccaggagcctgaacctgagctacaacaagctgtctgaaattgatcctgctggctttgaggacctgcccaacctgcaggaggtgtacctgaacaacaatgagctgacagctgtgcccagcctgggcgccgccagcagccacgtggtgtccctcttcctgcagcacaacaagatccgctctgtggagggcagccagctgaaggcctacctgagcctggaggtgctggacctgagcctgaacaacatcacagaggtgaggaacacctgcttcccccacggcccccccatcaaggagctgaacctggccggcaacagaattggcaccctggagctgggcgcctttgatggcctgagccgcagcctgctgaccctgcggctgagcaagaaccgcatcacccagctgcctgtgcgggccttcaagctgccccggctgacccagctggacctgaacagaaaccgcatccgcctcatcgagggcctgaccttccagggcctgaacagcctggaggtgctgaagctgcagaggaacaacatcagcaagctgacagatggagccttctggggcctgagcaagatgcacgtgctgcacctggagtacaacagcctggtggaggtgaacagcggcagcctgtatggcctgacagccctgcaccagctgcacctgagcaacaacagcatcgcccgcatccacaggaagggctggagcttctgccagaagctgcacgagctggtgctgtccttcaacaacctgacccggctggatgaggagagcctggccgagctgagcagcctgtctgtgctgcggctgagccacaacagcatcagccacatcgccgagggcgccttcaagggcctgcggagcctgcgggtgctggacctggaccacaatgagatcagcggcaccatcgaggacaccagcggggccttcagcggcctggacagcctgagcaagctgaccctgtttggaaacaagatcaagtctgtggccaagagggccttcagcggcctggagggcctggagcacctgaacctgggcggcaatgccatccgctctgtgcagtttgatgcctttgtgaagatgaagaacctgaaggagctgcacatcagcagtgacagcttcctgtgtgactgccagctgaagtggctgcccccctggctgattggccgcatgctgcaggcctttgtgacagccacctgtgcccaccctgagagcctgaagggccagagcatcttctctgtgcccccagagagctttgtgtgtgatgacttcctgaagccccagatcatcacccagcctgagaccaccatggccatggtgggcaaggacatccgcttcacctgcagcgctgccagcagcagcagcagccccatgacctttgcctggaagaaggacaatgaggtgctgaccaatgctgacatggagaactttgtgcacgtgcacgcccaggatggagaggtgatggagtacaccaccatcctgcacctgcggcaggtgacctttggacatgagggccgctaccagtgtgtgatcaccaaccacttcggcagcacctacagccacaaggcccggctgactgtgaatgtgctgcccagcttcaccaagacccctcatgacatcaccatccgcaccaccaccatggcccggctggagtgtgccgccaccggccaccccaacccccagatcgcctggcagaaggatggcggcacagacttccctgctgcccgggagaggaggatgcacgtgatgccagatgatgatgtgttcttcatcacagatgtgaagattgatgatgctggggtgtacagctgcacagcccagaacagcgctggcagcatcagcgccaatgccaccctgactgtgctggagacccccagcctggtggtgcccctggaggacagagtggtgtctgtgggggagaccgtggccctgcagtgcaaggccactggaaaccccccaccccgcatcacctggttcaagggggaccggcccctgagcctgacagagcggcaccacctgaccccagacaaccagctgctggtggtgcagaatgtggtggccgaggatgctggccgctacacctgtgagatgagcaacaccctgggcacagagcgggcccacagccagctgtctgtgctgcctgctgctggctgcaggaaggatggcaccaccgtgggcatcttcaccatcgctgtggtgagcagcatcgtgctgaccagcctggtgtgggtgtgcatcatctaccagaccaggaagaagtctgaggagtacagcgtgaccaacacagatgaaacagtggtgcccccagatgtgcccagctacctgagcagccagggcaccctgagtgaccggcaggagaccgtggtgaggacagaaggaggcccccaggccaacggccacatcgagagcaatggagtgtgccccagagatgccagccacttccctgagccagacacccacagcgtggcctgccggcagcccaagctgtgtgccggcagcgcctaccacaaggagccctggaaggccatggagaaggccgagggcaccccaggcccccacaagatggagcacggcggccgggtggtgtgcagcgactgcaacacagaggtggactgctacagccggggccaggccttccacccccagcctgtgtcccgggacagcgcccagcccagcgccccaaatggacctgagcccggcggcagtgaccaggagcacagcccccaccaccagtgcagcaggacagctgctggcagctgcccagagtgccagggcagcctgtaccccagcaaccacgacaggatgctgacagctgtgaagaagaagcccatggccagcctggatggcaagggggacagctcctggaccctggcccggctgtaccacccagacagcacagagctgcagcctgccagcagcctgaccagcggcagccctgagcgggcagaggcccagtacctgctggtgtccaatggccacctgcccaaggcctgtgatgccagccctgagagcacccccctgaccggccagctgcccgggaagcagagggtgcccctgctgctggcccccaagagctag

SEQ ID NO: 157595 - DNA, 2991 bp, Artificial Sequence
  Description of Artificial Sequence: Synthetic coding sequence
aacctgagctacaacaagctgtctgaaattgatcctgctggctttgaggacctgcccaacctgcaggaggtgtacctgaacaacaatgagctgacagctgtgcccagcctgggcgccgccagcagccacgtggtgtccctcttcctgcagcacaacaagatccgctctgtggagggcagccagctgaaggcctacctgagcctggaggtgctggacctgagcctgaacaacatcacagaggtgaggaacacctgcttcccccacggcccccccatcaaggagctgaacctggccggcaaccgcatcggcaccctggagctgggcgcctttgatggcctgagccgcagcctgctgaccctgcggctgagcaagaaccgcatcacccagctgcctgtgcgggccttcaagctgccccggctgacccagctggacctgaacagaaaccgcatccggctgattgagggcctgaccttccagggcctgaacagcctggaggtgctgaagctgcagaggaacaacatcagcaagctgacagatggagccttctggggcctgagcaagatgcacgtgctgcacctggagtacaacagcctggtggaggtgaacagcggcagcctgtatggcctgacagccctgcaccagctgcacctgagcaacaacagcatcgcccgcatccacaggaagggctggagcttctgccagaagctgcacgagctggtgctgtccttcaacaacctgacccggctggatgaggagagcctggccgagctgagcagcctgtctgtgctgcggctgagccacaacagcatcagccacatcgccgagggcgccttcaagggcctgcggagcctgcgggtgctggacctggaccacaatgagatcagcggcaccatcgaggacaccagcggggccttcagcggcctggacagcctgagcaagctgaacctgggcggcaatgccatccgctctgtgcagtttgatgcctttgtgaagatgaagaacctgaaggagctgcacatcagcagtgacagcttcctgtgtgactgccagctgaagtggctgcccccctggctgattggaaggatgctgcaggcctttgtgacagccacctgtgcccaccctgagagcctgaagggccagagcatcttctctgtgcccccagagagctttgtgtgtgatgacttcctgaagccccagatcatcacccagcctgagaccaccatggccatggtgggcaaggacatccgcttcacctgcagcgctgccagcagcagcagcagccccatgacctttgcctggaagaaggacaatgaggtgctgaccaatgctgacatggagaactttgtgcacgtgcacgcccaggatggagaggtgatggagtacaccaccatcctgcacctgcggcaggtgaccttcggccacgagggccgctaccagtgtgtgatcaccaaccacttcggcagcacctacagccacaaggcccggctgactgtgaatgtgctgcccagcttcaccaagacccctcatgacatcaccatccgcaccaccaccatggcccggctggagtgtgccgccaccggccaccccaacccccagatcgcctggcagaaggatggcggcacagacttccctgctgcccgggagaggaggatgcacgtgatgccagatgatgatgtgttcttcatcacagatgtgaagattgatgatgctggggtgtacagctgcacagcccagaacagcgctggcagcatcagcgccaatgccaccctgactgtgctggagacccccagcctggtggtgcccctggaggacagagtggtgtctgtgggggagaccgtggccctgcagtgcaaggccaccggcaaccccccaccccgcatcacctggttcaagggggaccggcccctgagcctgacagagcggcaccacctgaccccagacaaccagctgctggtggtgcagaatgtggtggctgaagatgctggccgctacacctgtgagatgagcaacaccctgggcacagagcgggcccacagccagctgtctgtgctgcctgctgctggctgcaggaaggatggcaccaccgtgggcatcttcaccatcgctgtggtgagcagcatcgtgctgaccagcctggtgtgggtgtgcatcatctaccagaccaggaagaagtctgaggagtacagcgtgaccaacacagatgagaccgtggtgcccccagatgtgcccagctacctgagcagccagggcaccctgagtgaccggcaggagaccgtggtgaggacagagggcggcccccaggccaacggccacatcgagagcaatggagtgtgccccagagatgccagccacttccctgagccagacacccacagcgtggcctgccggcagcccaagctgtgtgccggcagcgcctaccacaaggagccctggaaggccatggagaaggccgagggcaccccaggcccccacaagatggagcacggcggccgggtggtgtgcagcgactgcaacacagaggtggactgctacagccggggccaggccttccacccccagcctgtgtcccgggacagcgcccagcccagcgcccccaacggccctgagcccggcggcagtgaccaggagcacagcccccaccaccagtgcagcaggacagctgctggcagctgcccagagtgccagggcagcctgtaccccagcaaccacgacaggatgctgacagctgtgaagaagaagcccatggccagcctggatggaaaaggagacagctcctggaccctggcccggctgtaccacccagacagcacagagctgcagcctgccagcagcctgaccagcggcagccctgagagagctgaggcccagtacctgctggtgtccaatggccacctgcccaaggcctgtgatgccagccctgagagcacccccctgaccggccagctgcccgggaagcagagggtgcccctgctgctggcccccaagagctag

SEQ ID NO: 157596 - DNA, 3213 bp, Artificial Sequence
  Description of Artificial Sequence: Synthetic coding sequence
atggcccggcctgtgcggggcggcctgggcgcccccaggaggagcccctgcctgctgctgctgtggctgctgctgctgcggctggagcctgtgacagctgctgctggcccccgggccccctgtgccgccgcctgcacctgtgccggggacagcctggactgtggcggccggggcctggccgccctgcccggggacctgcccagctggaccaggagcctgaacctgagctacaacaagctgtctgaaattgatcctgctggctttgaggacctgcccaacctgcaggaggtgtacctgaacaacaatgagctgacagctgtgcccagcctgggcgccgccagcagccacgtggtgtccctcttcctgcagcacaacaagatccgctctgtggagggcagccagctgaaggcctacctgagcctggaggtgctggacctgagcctgaacaacatcacagaggtgaggaacacctgcttcccccacggcccccccatcaaggagctgaacctggccggcaacagaattggcaccctggagctgggcgcctttgatggcctgagccgcagcctgctgaccctgcggctgagcaagaaccgcatcacccagctgcctgtgcgggccttcaagctgccccggctgacccagctggacctgaacagaaaccgcatccgcctcatcgagggcctgaccttccagggcctgaacagcctggaggtgctgaagctgcagaggaacaacatcagcaagctgacagatggagccttctggggcctgagcaagatgcacgtgctgcacctggagtacaacagcctggtggaggtgaacagcggcagcctgtatggcctgacagccctgcaccagctgcacctgagcaacaacagcatcgcccgcatccacaggaagggctggagcttctgccagaagctgcacgagctggtgctgtccttcaacaacctgacccggctggatgaggagagcctggccgagctgagcagcctgtctgtgctgcggctgagccacaacagcatcagccacatcgccgagggcgccttcaagggcctgcggagcctgcgggtgctggacctggaccacaatgagatcagcggcaccatcgaggacaccagcggggccttcagcggcctggacagcctgagcaagctgctgctgctggagcccagccagagcgctggctgcagcagccccagccagccccacatgtctgctgggggccgcaccctgtttggaaacaagatcaagtctgtggccaagagggccttcagcggcctggagggcctggagcacctgaacctgggcggcaatgccatccgctctgtgcagtttgatgcctttgtgaagatgaagaacctgaaggagctgcacatcagcagtgacagcttcctgtgtgactgccagctgaagtggctgcccccctggctgattggccgcatgctgcaggcctttgtgacagccacctgtgcccaccctgagagcctgaagggccagagcatcttctctgtgcccccagagagctttgtgtgtgatgacttcctgaagccccagatcatcacccagcctgagaccaccatggccatggtgggcaaggacatccgcttcacctgcagcgctgccagcagcagcagcagccccatgacctttgcctggaagaaggacaatgaggtgctgaccaatgctgacatggagaactttgtgcacgtgcacgcccaggatggagaggtgatggagtacaccaccatcctgcacctgcggcaggtgacctttggacatgagggccgctaccagtgtgtgatcaccaaccacttcggcagcacctacagccacaaggcccggctgactgtgaatgtgctgcccagcttcaccaagacccctcatgacatcaccatccgcaccaccaccatggcccggctggagtgtgccgccaccggccaccccaacccccagatcgcctggcagaaggatggcggcacagacttccctgctgcccagacccccagcctggtggtgcccctggaggacagagtggtgtctgtgggggagaccgtggccctgcagtgcaaggccaccggcaaccccccaccccgcatcacctggttcaagggggaccggcccctgagcctgacagagcggcaccacctgaccccagacaaccagctgctggtggtgcagaatgtggtggctgaagatgctggccgctacacctgtgagatgagcaacaccctgggcacagagcgggcccacagccagctgtctgtgctgcctgctgctggctgcaggaaggatggcaccaccgtgggcatcttcaccatcgctgtggtgagcagcatcgtgctgaccagcctggtgtgggtgtgcatcatctaccagaccaggaagaagtctgaggagtacagcgtgaccaacacagatgagaccgtggtgcccccagatgtgcccagctacctgagcagccagggcaccctgagtgaccggcaggagaccgtggtgaggacagagggcggcccccaggccaacggccacatcgagagcaatggagtgtgccccagagatgccagccacttccctgagccagacacccacagcgtggcctgccggcagcccaagctgtgtgccggcagcgcctaccacaaggagccctggaaggccatggagaaggccgagggcaccccaggcccccacaagatggagcacggcggccgggtggtgtgcagcgactgcaacacagaggtggactgctacagccggggccaggccttccacccccagcctgtgtcccgggacagcgcccagcccagcgcccccaacggccctgagcccggcggcagtgaccaggagcacagcccccaccaccagtgcagcaggacagctgctggcagctgcccagagtgccagggcagcctgtaccccagcaaccacgacaggatgctgacagctgtgaagaagaagcccatggccagcctggatggaaaaggagacagctcctggaccctggcccggctgtaccacccagacagcacagagctgcagcctgccagcagcctgaccagcggcagccctgagagagctgaggcccagtacctgctggtgtccaatggccacctgcccaaggcctgtgatgccagccctgagagcacccccctgaccggccagctgcccgggaagcagagggtgcccctgctgctggcccccaagagctag

SEQ ID NO: 157597 - DNA, 3198 bp, Artificial Sequence
  Description of Artificial Sequence: Synthetic coding sequence
atggccccagcccccctgggcgtgcctgaggagcagctgctgggctgccgcagccgggtgctgagccggctgctcttcatcgcccagacagccctgctgctgctgcctgctgctggggccggcctgtgcccagccccctgcagctgccgcatccccctgctggactgcagcaggaggaagctgcctgcccccagctggagggccctgagcggcctgctgcccccagacacagccatcctggacttcagccacaaccggctgagcaactggaacatcagcctggagagccagaccctgcaggaggtgaagatgaactacaatgagctgacagagatcccctactttggagagcccaccagcaacatcaccctgctgagcctggtgcacaacatcatccctgagatcaatgcccaggccctgcagttctacccagccctggagagcctggacctgagcagcaacatcatcagcgagatcaagaccagcagcttccccaggatgcagctgaagtacctgaacctgagcaacaaccgcatcaccaccctggaggccggctgctttgacaacctgagcagcagcctgctggtggtgaagctgaacagaaacaggatgtccatgatcccccccaagatcttcaagctgccccacctgcagttcctggagctgaagaggaaccgcatcaagatcgtggagggcctgaccttccagggcctggacagcctgcggagcctgaagatgcagagaaatggcatcagcaagctgaaggatggagccttcttcggcctgaacaacatggaggagctggagctggagcacaacaacctgaccagggtgaacaagggctggctgtatggcctgaggatgctgcagcagctgtatgtgtcccagaatgccatcgagcgcatcagcccagatgcctgggagttctgccagaggctgtctgagctggacctgagctacaaccagctgacccggctggatgaaagtgcctttgtgggcctgagcctgctggagcggctgaacctgggggacaacagagtgacccacatcgcagatggagtcttccgcttcctgagcaacctgcagaccctggacctgagaaataatgagatctcctgggccattgaagatgccagcgaggcctttgctggcctgaccagcctgaccaagctgatcctgcagggcaaccagatcaagagcatcaccaagaaggccttcatcggcctggagagcctggagcacctggacctgaacaacaatgccatcatgagcatccaggagaatgccttcagccagacccacctgaaggagctgatcctgaacaccagcagcctgctgtgtgactgccacctgaagtggctgctgcagtggctggtggacaacaacttccagcacagcgtgaatgtgtcctgtgcccaccctgagtggctggccggccagagcatcctgaatgtggacctgaaggactttgtgtgtgatgacttcctgaagccccagatccgcacccaccctgagaccatcatcgccctgcggggcatgaatgtgaccctgacctgcacagctgtgagcagcagtgacagccccatgagcacagtgtggaggaaggacagcgagatcctgtatgatgtggacacagagaactttgtgcgctactggcagcaggccggggaggccctggagtacaccagcatcctgcacctgttcaacgtgaacttcacagatgagggcaagtaccagtgcatcgtgaccaaccacttcggcagcaactacagccagaaggccaagctgactgtgaatgagatgcccagcttcctgaagacccccatggacctgaccatcagaactggagccatggcccggctggagtgtgccgctgagggccacccagccccccagatctcctggcagaaggatggcggcacagacttccctgctgcccgggagaggaggatgcacgtgatgccagaagatgatgtgttcttcatcgccaacgtgaagattgaggacatgggcatctacagctgcatggcccagaacacagctgggggcctgagcgccaatgccagcctgactgtgctggagacccccagcttcatccggcccctggaggacaagacagtgaccagaggagaaacagctgtgctgcagtgcatcgccggcggcagccctgccccccggctgaactggaccaaggatgatggccccctgctggtgacagagcggcacttctttgctgctgccaaccagctgctgatcatcgtggatgctggcctggaggatgctgggaagtacacctgcatcatgagcaacaccctgggcacagagcggggccacatctacctgaatgtcatcagcagccccaactgtgacagcagccagagcagcatcggccatgaagatgatggctggaccaccgtgggcatcgtcatcatcgtggtggtgtgctgcgtggtgggcaccagcctcatctgggtgattgtcatctaccacatgaggaggaagaatgaagactacagcatcaccaacacagaggagctgaacctgcctgctgacatccccagctacctgagcagccagggcaccctgtctgagccccaggagggctacagcaacagcgaggccggcagccaccagcagctgatgcccccagccaacggctacatccacaagggcacagatggcggcaccggcaccagggtcatctgcagcgactgctatgacaatgccaacatctacagcaggacccgggagtactgcccctacacctacatcgccgaggaggatgtgctggaccagaccctgagcagcctgatggtgcagatgcccaaggagacctacctggtgcaccccccccaggacaccacagccctggagagcctcatccccagcgccaaccgggagcccagcgccttccccaccaaccacgagcgcatcagcgagaagaagctgcccagcacccagatgtctggagagaccctgcagaggcctgtgtggaacatcaaccgggagctgggcctgccccacccccccttcagccagcagcctgtgcatgagagcccccagctgcaccagaatgaaggcctggccggccgggagccagactgcagcgccagctccatgagctgccaccggctgcaggaccacgcctttgacttcagcaggaccaggaacatccaggacggcagcgagggcacctag

SEQ ID NO: 157598 - DNA, 876 bp, Artificial Sequence
  Description of Artificial Sequence: Synthetic coding sequence
atggagagcgagaggagcaagaggatgggaaatgcctgcatccccctgaagagaattgcctacttcctgtgcctgctgagcgccctgctgctgacagagggcaagaagccagccaagcccaagtgcccagctgtgtgcacctgcaccaaggacaatgccctgtgtgaaaatgcccggagcatccccaggacagtgcccccagatgtgatcagcctgagctttgtgcgcagcggcttcacagagatcagcgagggcagcttcctgttcacccccagcctgcagctgctgctcttcaccagcaacagctttgatgtgatcagtgatgatgccttcatcggcctgccccacctggagtacctgttcatcgagaacaacaacatcaagagcatcagccgccacaccttccggggcctgaagagcctcatccacctgagcctggccaacaacaacctgcagaccctgcccaaggacatcttcaagggcctggacagcctgaccaacgtggacctgcggggcaacagcttcaactgtgactgcaagctgaagtggctggtggagtggctgggccacaccaatgccaccgtggaggacatctactgtgagggccccccagagtacaagaagaggaagatcaacagcctgagcagcaaggactttgactgcatcatcacagaatttgccaagagccaggacctgccctaccagagcctgagcattgacaccttctcctacctgaatgatgaatatgtggtgattgcccagcccttcaccgggaagtgcatcttcctggagtgggaccacgtggagaagaccttcagaaattatgacaacatcaccgtgctgcgggagatccaccgcttcaccaacatgtcctag

SEQ ID NO: 157599 - DNA, 1674 bp, Artificial Sequence
  Description of Artificial Sequence: Synthetic coding sequence
atggagagcgagaggagcaagaggatgggaaatgcctgcatccccctgaagagaattgcctacttcctgtgcctgctgagcgccctgctgctgacagagggcaagaagccagccaagcccaagtgcccagctgtgtgcacctgcaccaaggacaatgccctgtgtgaaaatgcccggagcatccccaggacagtgcccccagatgtgatcagcctgagctttgtgcgcagcggcttcacagagatcagcgagggcagcttcctgttcacccccagcctgcagctgctgctcttcaccagcaacagctttgatgtgatcagtgatgatgccttcatcggcctgccccacctggagtacctgttcatcgagaacaacaacatcaagagcatcagccgccacaccttccggggcctgaagagcctcatccacctgagcctggccaacaacaacctgcagaccctgcccaaggacatcttcaagggcctggacagcctgaccaacgtggacctgcggggcaacagcttcaactgtgactgcaagctgaagtggctggtggagtggctgggccacaccaatgccaccgtggaggacatctactgtgagggccccccagagtacaagaagaggaagatcaacagcctgagcagcaaggactttgactgcatcatcacagaatttgccaagagccaggacctgccctaccagagcctgagcattgacaccttctcctacctgaatgatgaatatgtggtgattgcccagcccttcaccgggaagtgcatcttcctggagtgggaccacgtggagaagaccttcagaaattatgacaacatcaccggcaccagcacagtggtgtgcaagcccatcgtgattgagacccagctgtatgtgattgtggcccagctgtttggaggcagccacatctacaagagggacagctttgccaacaagttcatcaagatccaggacatcgagatcctgaagatcaggaagcccaatgacatcgagaccttcaagattgagaacaactggtactttgtggtggccgacagcagcaaggccggcttcaccaccatctacaagtggaatggaaatggcttctacagccaccagagcctgcacgcctggtacagagacacagatgtggagtacctggagatcgtgaggaccccccagaccctgcggaccccccacctgatcctgagcagcagcagccagaggcctgtgatctaccagtggaacaaggccacccagctgttcaccaaccagacagacatccccaacatggaggatgtgtatgctgtgaagcacttctctgtgaagggagatgtgtacatctgcctgacccgcttcatcggggacagcaaggtgatgaagtggggcggcagcagcttccaggacatccagaggatgcccagccggggctccatggtgttccagcccctgcagatcaacaactaccagtatgccatcctgggcagtgactacagcttcacccaggtgtacaactgggatgctgagaaggccaagtttgtgaagttccaggagctgaatgtgcaggcccccaggagcttcacccacgtgtccatcaacaagaggaacttcctgtttgccagcagcttcaagggcaacacccagatctacaagcacgtgattgtggacctgagcgcctag

SEQ ID NO: 157600 - DNA, 1530 bp, Artificial Sequence
  Description of Artificial Sequence: Synthetic coding sequence
atggagagcgagaggagcaagaggatgggaaatgcctgcatccccctgaagagaattgcctacttcctgtgcctgctgagcgccctgctgctgacagagggcaagaagccagccaagcccaagtgcccagctgtgtgcacctgcaccaaggacaatgccctgtgtgaaaatgcccggagcatccccaggacagtgcccccagatgtgatcagcctgagctttgtgcgcagcggcttcacagagatcagcgagggcagcttcctgttcacccccagcctgcagctgctgagcctggccaacaacaacctgcagaccctgcccaaggacatcttcaagggcctggacagcctgaccaacgtggacctgcggggcaacagcttcaactgtgactgcaagctgaagtggctggtggagtggctgggccacaccaatgccaccgtggaggacatctactgtgagggccccccagagtacaagaagaggaagatcaacagcctgagcagcaaggactttgactgcatcatcacagaatttgccaagagccaggacctgccctaccagagcctgagcattgacaccttctcctacctgaatgatgaatatgtggtgattgcccagcccttcaccgggaagtgcatcttcctggagtgggaccacgtggagaagaccttcagaaattatgacaacatcaccggcaccagcacagtggtgtgcaagcccatcgtgattgagacccagctgtatgtgattgtggcccagctgtttggaggcagccacatctacaagagggacagctttgccaacaagttcatcaagatccaggacatcgagatcctgaagatcaggaagcccaatgacatcgagaccttcaagattgagaacaactggtactttgtggtggccgacagcagcaaggccggcttcaccaccatctacaagtggaatggaaatggcttctacagccaccagagcctgcacgcctggtacagagacacagatgtggagtacctggagatcgtgaggaccccccagaccctgcggaccccccacctgatcctgagcagcagcagccagaggcctgtgatctaccagtggaacaaggccacccagctgttcaccaaccagacagacatccccaacatggaggatgtgtatgctgtgaagcacttctctgtgaagggagatgtgtacatctgcctgacccgcttcatcggggacagcaaggtgatgaagtggggcggcagcagcttccaggacatccagaggatgcccagccggggctccatggtgttccagcccctgcagatcaacaactaccagtatgccatcctgggcagtgactacagcttcacccaggtgtacaactgggatgctgagaaggccaagtttgtgaagttccaggagctgaatgtgcaggcccccaggagcttcacccacgtgtccatcaacaagaggaacttcctgtttgccagcagcttcaagggcaacacccagatctacaagcacgtgattgtggacctgagcgcctag

SEQ ID NO: 157601 - DNA, 777 bp, Artificial Sequence
  Description of Artificial Sequence: Synthetic coding sequence
atgtctgcctaccccaagagctacaacccctttgatgatgatggagaagatgaaggagcccggcctgccccctggagagatgcccgggacctgcctgatggcccagatgccccagctgaccggcagcagtacctgcggcaggaggtgctgcggcgggcagaggccacagctgccagcaccagccgcagcctggccctgatgtatgagagcgagaaggtgggcgtggccagcagcgaggagctggcccggcagaggggcgtgctggagaggacagagaagatggtggacaagatggaccaggacctgaagatcagccagaagcacatcaacagcatcaagtctgtgtttggaggcctggtgaactacttcaagagcaagcctgtggagaccccacctgagcagaatggcaccctgaccagccagcccaacaaccggctgaaggaggccatcagcaccagcaaggagcaggaggccaagtaccaggccagccaccccaacctgaggaagctggatgacacagatcctgtgcccaggggggccggcagcgccatgagcacagatgcctaccccaagaacccccacctgcgggcctaccaccagaagattgacagcaacctggatgagctgtccatgggcctgggccgcctgaaggacatcgccctgggcatgcagacagaaattgaggagcaggatgacatcctggaccggctgaccaccaaggtggacaagctggatgtgaacatcaagagcacagagaggaaggtgcggcagctgtag

SEQ ID NO: 157602 - DNA, 2466 bp, Artificial Sequence
  Description of Artificial Sequence: Synthetic coding sequence
atggccggccctggcagcactggaggccagattggagctgctgccctggccggcggggcccggagcaaggtggcccccagcgtggactttgaccacagctgcagcgacagcgtggagtacctgaccctgaactttggcccctttgagaccgtgcaccgctggaggcggctgcccccctgtgatgaatttgtgggcgcccggcgcagcaagcacacagtggtggcctacaaggatgccatctacgtgtttggaggagacaatggagccttcaccaccggcaccccaccagccccccgctaccaccacagcgctgtggtgtatggcagctccatgtttgtgtttggaggctacaccggggacatctacagcaacagcaacctgaagaacaagaatgacctgtttgagtacaagtttgccaccggccagtggacagagtggaagattgagggccgcctgcctgtggcccggagcgcccatggagccaccgtgtacagcgacaagctgtggatctttgctggctatgatggaaatgcccggctgaatgacatgtggaccatcggcctgcaggaccgggagctgacctgctgggaggaggtggcccagagcggggagatcccccccagctgctgcaacttccctgtggccgtgtgccgggacaagatgtttgtgttttctggccagagcggggccaagatcaccaacaacctcttccagtttgagttcaaggacaagacctggacccgcatccccacagagcacctgctgcggggcagccccccaccaccccagaggagatatggccacaccatggtggcctttgacagacacctgtatgtgtttggaggagctgctgacaacaccctgcccaatgagctgcactgctatgatgtggacttccagacctgggaggtggtgcagcccagcagtgacagcgaggtgggcggcgctgaggtgcctgagcgggcctgtgccagcgaggaggtgcccaccctgacctatgaggagcgggtgggcttcaagaagagcagagatgtgtttggcctggactttggcaccaccagcgccaagcagcccacccagcctgccagcgagctgcccagcggccgcctcttccacgccgctgctgtgatcagtgatgccatgtacatctttggaggcaccgtggacaacaacatccgcagcggggagatgtaccgcttccagttcagctgctaccccaagtgcaccctgcacgaggactatggccgcctgtgggagagccggcagttctgtgatgtggagtttgtgctgggggagaaggaggagtgtgtgcagggccacgtggccatcgtgacagcccggagccgctggctgcggaggaagatcacccaggcccgggagcggctggcccagaagctggagcaggaggccgcccctgtgccccgggaggcccctggggtggccgccggcggggcccggccccccctgctgcacgtggccatccgggaggccgaggcccggccctttgaggtgctgatgcagttcctgtacacagacaagatcaagtaccccaggaaaggacatgtggaggatgtgctgctgatcatggatgtgtacaagctggccctgtccttccagctgtgccgcctggagcagctgtgccggcagtacatcgaggcctctgtggacctgcagaatgtgctggtggtgtgtgagagcgctgcccggctgcagctgagccagctgaaggagcactgcctgaactttgtggtgaaggagagccacttcaaccaggtgatcatgatgaaggagtttgagcggctgagcagccccctcatcgtggagatcgtgcggaggaagcagcagcccccacccaggacccccctggaccagcctgtggacatcggcaccagcctcatccaggacatgaaggcctacctggagggcgctggagctgagttctgtgacatcaccctgctgctggatggccaccccaggcctgcccacaaggccatcctggccgcccggagcagctactttgaggccatgttccgctccttcatgccagaagatggccaggtgaacatcagcattggagagatggtgcccagccggcaggcctttgagagcatgctgcgctacatctactacggggaggtgaacatgcctcctgaggacagcctgtacctgtttgctgccccctactactacggcttctacaacaaccggctgcaggcctactgcaagcagaacctggagatgaatgtgacagtgcagaatgtgctgcagatcctggaggccgctgacaagacccaggccctggacatgaagaggcactgcctgcacatcatcgtgcaccagttcaccaaggtgtccaagctgcccaccctgcggagcctgagccagcagctgctgctggacatcatcgacagcctggccagccacatcagtgacaagcagtgtgccgagctgggcgctgacatctag

SEQ ID NO: 157603 - DNA, 2400 bp, Artificial Sequence
  Description of Artificial Sequence: Synthetic coding sequence
atgaactatgaccccatcgtgtccaaggtggccgaggtgctggccagcggccgggccatcaggaagcgggaggtggagaggagcaagcacacagtggtggcctacaaggatgccatctacgtgtttggaggagacaacgggaagaccatgctgaatgacctgctgcgctttgatgtgaaggactgctcctggtgccgggccttcaccaccggcaccccaccagccccccgctaccaccacagcgctgtggtgtatggcagctccatgtttgtgtttggaggctacaccggggacatctacagcaacagcaacctgaagaacaagaatgacctgtttgagtacaagtttgccaccggccagtggacagagtggaagattgagggccgcctgcctgtggcccggagcgcccatggagccaccgtgtacagcgacaagctgtggatctttgctggctatgatggaaatgcccggctgaatgacatgtggaccatcggcctgcaggaccgggagctgacctgctgggaggaggtggcccagagcggggagatcccccccagctgctgcaacttccctgtggccgtgtgccgggacaagatgtttgtgttttctggccagagcggggccaagatcaccaacaacctcttccagtttgagttcaaggacaagacctggacccgcatccccacagagcacctgctgcggggcagccccccaccaccccagaggagatatggccacaccatggtggcctttgacagacacctgtatgtgtttggaggagctgctgacaacaccctgcccaatgagctgcactgctatgatgtggacttccagacctgggaggtggtgcagcccagcagtgacagcgaggtgggcggcgctgaggtgcctgagcgggcctgtgccagcgaggaggtgcccaccctgacctatgaggagcgggtgggcttcaagaagagcagagatgtgtttggcctggactttggcaccaccagcgccaagcagcccacccagcctgccagcgagctgcccagcggccgcctcttccacgccgctgctgtgatcagtgatgccatgtacatctttggaggcaccgtggacaacaacatccgcagcggggagatgtaccgcttccagttcagctgctaccccaagtgcaccctgcacgaggactatggccgcctgtgggagagccggcagttctgtgatgtggagtttgtgctgggggagaaggaggagtgtgtgcagggccacgtggccatcgtgacagcccggagccgctggctgcggaggaagatcacccaggcccgggagcggctggcccagaagctggagcaggaggccgcccctgtgccccgggaggcccctggggtggccgccggcggggcccggccccccctgctgcacgtggccatccgggaggccgaggcccggccctttgaggtgctgatgcagttcctgtacacagacaagatcaagtaccccaggaaaggacatgtggaggatgtgctgctgatcatggatgtgtacaagctggccctgtccttccagctgtgccgcctggagcagctgtgccggcagtacatcgaggcctctgtggacctgcagaatgtgctggtggtgtgtgagagcgctgcccggctgcagctgagccagctgaaggagcactgcctgaactttgtggtgaaggagagccacttcaaccaggtgatcatgatgaaggagtttgagcggctgagcagccccctcatcgtggagatcgtgcggaggaagcagcagcccccacccaggacccccctggaccagcctgtggacatcggcaccagcctcatccaggacatgaaggcctacctggagggcgctggagctgagttctgtgacatcaccctgctgctggatggccaccccaggcctgcccacaaggccatcctggccgcccggagcagctactttgaggccatgttccgctccttcatgccagaagatggccaggtgaacatcagcattggagagatggtgcccagccggcaggcctttgagagcatgctgcgctacatctactacggggaggtgaacatgcctcctgaggacagcctgtacctgtttgctgccccctactactacggcttctacaacaaccggctgcaggcctactgcaagcagaacctggagatgaatgtgacagtgcagaatgtgctgcagatcctggaggccgctgacaagacccaggccctggacatgaagaggcactgcctgcacatcatcgtgcaccagttcaccaaggtgtccaagctgcccaccctgcggagcctgagccagcagctgctgctggacatcatcgacagcctggccagccacatcagtgacaagcagtgtgccgagctgggcgctgacatctag

SEQ ID NO: 157604 - DNA, 1560 bp, Artificial Sequence; identical to SEQ ID NO: 156604
  Description of Artificial Sequence: Synthetic coding sequence

SEQ ID NO: 157605 - DNA, 3036 bp, Artificial Sequence
  Description of Artificial Sequence: Synthetic coding sequence
atgattgaaaattccatgtttgaggaggagccagatgtggtggacctggccaaggagccctgcctgcaccccctggagccagatgaggtggagtatgagccccggggcagccggctgctggtgcggggcctgggggagcacgagatggaggaggatgaggaggactatgagagcagcgccaagctgctgggcatgtccttcatgaacagaagcagcggcctgagaaattctgccaccggctaccggcagagcccagatggagcctgcagcgtgcccagcgcccggaccatggtggtgtgtgccttcgtcatcgtggtggccgtgtctgtcatcatggtgatctacctgctgccccgctgcaccttcaccaaggagggctgccacaagaagaaccagagcatcggcctcatccagccctttgccaccaacgggaagctgttcccctgggcccagatccggctgcccacagctgtggtgcccctgcgctatgagctgagcctgcaccccaacctgacctccatgaccttccggggctctgtgaccatctctgtgcaggccctgcaggtgacctggaacatcatcctgcacagcacaggccacaacatcagccgggtgaccttcatgtctgctgtgagcagccaggagaagcaggccgagatcctggagtatgcctaccacggccagatcgccatcgtggcccctgaggccctgctggccggccacaactacaccctgaagattgagtacagcgccaacatcagcagcagctactacggcttctacggcttctcctacacagatgagagcaatgagaagaagtactttgctgccacccagtttgagcccctggccgcccggagcgccttcccctgctttgatgagcccgccttcaaggccaccttcatcatcaagatcatcagagatgagcagtacacagccctgagcaacatgcccaagaagagctctgtggtgctggatgatggcctggtgcaggatgagttcagcgagagcgtgaagatgagcacctacctggtggccttcatcgtgggggagatgaagaacctgagccaggatgtgaatggcaccctggtgtccatctatgctgtgcctgagaagattggccaggtgcactacgccctggagaccaccgtgaagctgctggagttcttccagaactactttgagatccagtaccccctgaagaagctggacctggtggccatcccagactttgaagctggggccatggagaactggggcctgctgaccttccgggaggagaccctgctgtatgacagcaacaccagctccatggctgacaggaagctggtgaccaagatcatcgcccacgagctggcccaccagtggtttggaaacctggtgaccatgaagtggtggaatgacctgtggctgaatgaaggatttgccaccttcatggagtacttcagcctggagaagatcttcaaggagctgagcagctatgaggacttcctggatgcccgcttcaagaccatgaagaaggacagcctgaacagcagccaccccatcagcagctctgtgcagagcagcgagcagatcgaggagatgtttgacagcctgagctacttcaagggcagcagcctgctgctgatgctgaagacctacctgtctgaagatgtgttccagcacgctgtggtgctgtacctgcacaaccacagctatgccagcatccagagtgatgacctgtgggacagcttcaatgaggtgaccaaccagaccctggatgtgaagaggatgatgaagacctggaccctgcagaagggcttccccctggtgacagtgcagaagaagggcaaggagctgttcatccagcaggagcgcttcttcctgaacatgaagccagagatccagcccagcgacaccagctacctgtggcacatccccctgtcctatgtgacagagggcaggaactacagcaagtaccagagcgtgtccctgctggacaagaagagcggggtcatcaacctgacagaggaggtgctgtgggtgaaggtgaacatcaacatgaatggctactacatcgtgcactatgcagatgatgactgggaggccctgatccaccagctgaagatcaacccctacgtgctgagtgacaaggaccgggccaacctgatcaacaacatctttgagctggccggcctgggcaaggtgcccctgaagagggcctttgacctgatcaactacctgggcaatgaaaaccacacagcccccatcacagaggccctcttccagacagacctgatctacaacctgctggagaagctgggctacatggacctggccagccggctggtgaccagggtcttcaagctgctgcagaaccagatccagcagcagacctggacagatgagggcacccccagcatgagggagctgcggagcgccctgctggagtttgcctgcacccacaacctgggcaactgcagcaccacagccatgaagctgtttgatgactggatggccagcaatggcacccagagcctgcccacagatgtgatgaccaccgtcttcaaggtgggcgccaagacagacaagggctggagcttcctgctgggcaagtacatcagcatcggcagcgaggccgagaagaacaagatcctggaggccctggccagcagtgaagatgtgaggaagctgtactggctgatgaagagcagcctgaatggagacaacttccgcacccagaagctgtccttcatcatcagaacagtgggccgccacttccctggccacctgctggcctgggactttgtgaaggagaactggaacaagctggtgcagaagttccccctgggcagctacaccatccagaacatcgtggccggcagcacctacctgttcagcaccaagacccacctgtctgaggtgcaggccttctttgagaaccagagcgaggccaccttccggctgcgctgtgtgcaggaggccctggaggtgatccagctgaacatccagtggatggagaagaacctgaagagcctgacctggtggctgtag

SEQ ID NO: 157606 - DNA, 3450 bp, Artificial Sequence
  Description of Artificial Sequence: Synthetic coding sequence
atggccgagaggaaaggaacagccaaggtggacttcctgaagaagattgagaaggagatccagcagaagtgggacacagagcgggtgtttgaggtgaatgccagcaacctggagaagcagaccagcaagggcaagtactttgtgaccttcccctacccctacatgaatggccgcctgcacctgggccacaccttcagcctgagcaaatgtgaggcctgtgccgacaagctgaagcgggagattgagctgtatggctgccccccagacttcccagatgaggaggaggaggaggaggagacctctgtgaagacagaggacatcatcatcaaggacaaggccaagggcaagaagagcaaggctgctgccaaggccggcagcagcaagtaccagtggggcatcatgaagagcctgggcctgagtgatgaggagatcgtgaagttcagcgaggccgagcactggctggactacttcccccccctggccatccaggacctgaagaggatgggcctgaaggtggactggaggaggagcttcatcaccacagatgtgaacccctactatgacagctttgtgcgctggcagttcctgaccctgcgggagaggaacaagatcaagtttgggaagcgctacaccatctacagccccaaggatggccagccctgcatggaccatgaccggcagacaggagaaggagtgggcccccaggagtacaccctgctgaagctgaaggtgctggagccctaccccagcaagctgagcggcctgaagggcaagaacatcttcctggtggccgccaccctgcggcctgagaccatgtttggccagaccaactgctgggtgcggccagacatgaagtacatcggctttgaaacagtgaatggagacatcttcatctgcacccagaaggccgccaggaacatgagctaccagggcttcaccaaggacaacggggtggtgcctgtggtgaaggagctgatgggagaggagatcctgggcgccagcctgagcgcccccctgaccagctacaaggtgatctacgtgctgcccatgctgaccatcaaggaggacaagggcactggagtggtgacctctgtgcccagcgacagcccagatgacattgctgccctgcgggacctgaagaagaagcaggccctgcgggccaagtatggcatcagagatgacatggtgctgccctttgagcctgtgcctgtgattgagatccctggcttcggcaacctgtctgctgtgaccatctgtgatgagctgaagatccagagccagaatgaccgggagaagctggccgaggccaaggagaagatctacctgaagggcttctatgagggcatcatgctggtggatggcttcaagggccagaaggtgcaggatgtgaagaagaccatccagaagaagatgattgatgctggagatgccctgatctacatggagcctgagaagcaggtgatgagccgcagcagtgatgaatgtgtggtggccctgtgtgaccagtggtacctggactatggagaggagaactggaagaagcagaccagccagtgcctgaagaacctggagaccttctgtgaggagaccaggaggaactttgaggccaccctgggctggctgcaggagcacgcctgcagcaggacctacggcctgggcacccacctgccctgggatgagcagtggctgattgagagcctgagtgacagcaccatctacatggccttctacacagtggcccacctgctgcagggcggcaacctgcacggccaggccgagagccccctgggcatccggccccagcagatgaccaaggaggtgtgggactatgtgttcttcaaggaggcccccttccccaagacccagatcgccaaggagaagctggaccagctgaagcaggagtttgagttctggtaccctgtggacctgcgggtgtctgggaaggacctggtgcccaaccacctgagctactacctgtacaaccacgtggccatgtggccagagcagagcgacaagtggcccacagctgtgcgggccaacggccacctgctgctgaacagcgagaagatgagcaagagcacaggcaacttcctgaccctgacccaggccatcgacaagttcagcgcagatggcatgaggctggccctggctgatgctggggacacagtggaggatgccaactttgtggaggccatggctgatgctggcatcctgcggctgtacacctgggtggagtgggtgaaggagatggtggccaactgggacagcctgcggagcggccctgccagcaccttcaatgacagagtgtttgccagcgagctgaatgccggcatcatcaagacagaccagaactatgagaagatgatgttcaaggaggccctgaagacaggcttctttgagttccaggccgccaaggacaagtaccgggagctggccgtggagggcatgcaccgggagctggtgttccgcttcatcgaggtgcagaccctgctgctggcccccttctgcccccacctgtgtgagcacatctggaccctgctgggcaagccagacagcatcatgaatgcctcctggcctgtggccggccctgtgaatgaggtgctgatccacagcagccagtacctgatggaggtgacccatgacctgcggctgcggctgaagaactacatgatgcctgccaagggcaagaagacagacaagcagcccctgcagaagcccagccactgcaccatctacgtggccaagaactacccaccctggcagcacaccaccctgtctgtgctgaggaagcactttgaggccaacaacgggaagctgcctgacaacaaggtgattgccagcgagctgggctccatgcctgagctgaagaagtacatgaagaaggtgatgccctttgtggccatgatcaaggagaacctggagaagatgggcccccgcatcctggacctgcagctggagtttgatgagaaggctgtgctgatggagaacatcgtgtacctgaccaacagcctggagctggagcacatcgaggtgaagtttgccagcgaggccgaggacaagatccgggaggactgctgccctgggaagcccctgaatgtgttccgcatcgagcccggggtgtctgtgtccctggtgaacccccagcccagcaatggccacttcagcaccaagattgagatccggcagggcgacaactgtgacagcatcatccggcggctgatgaagatgaacagaggcatcaaggacctgagcaaggtgaagctgatgagatttgatgaccccctgctgggccccaggagagtgcctgtgctgggcaaggagtacacagagaagacccccatcagcgagcacgctgtgttcaacgtggacctgatgagcaagaagatccacctgacagaaaatggcatccgggtggacatcggggacaccatcatctacctggtgcactag

SEQ ID NO: 157607 - DNA, 480 bp, Artificial Sequence
  Description of Artificial Sequence: Synthetic coding sequence
atggccgagaggaaaggaacagccaaggtggacttcctgaagaagattgagaaggagatccagcagaagtgggacacagagcgggtgtttgaggtgaatgccagcaacctggagaagcagaccagcaagggcaagtactttgtgaccttcccctacccctacatgaatggccgcctgcacctgggccacaccttcagcctgagcaaatgtgaatttgctgtgggctaccagaggctgaagggcaagtgctgcctcttccccttcggcctgcactgcaccggcatgcccatcaaggcctgtgccgacaagctgaagcgggagattgagctgtatggctgccccccagacttcccagatgaggaggaggaggaggaggagacctctgtgaagacagaggacatcatcatcaaggacaaggccaagggcaagaagagcaaggccgccaagctggacctgctgaacaccagcggggccctgtag

SEQ ID NO: 157608 - DNA, 3531 bp, Artificial Sequence
  Description of Artificial Sequence: Synthetic coding sequence
atggccgagaggaaaggaacagccaaggtggacttcctgaagaagattgagaaggagatccagcagaagtgggacacagagcgggtgtttgaggtgaatgccagcaacctggagaagcagaccagcaagggcaagtactttgtgaccttcccctacccctacatgaatggccgcctgcacctgggccacaccttcagcctgagcaaatgtgaatttgctgtgggctaccagaggctgaagggcaagtgctgcctcttccccttcggcctgcactgcaccggcatgcccatcaaggcctgtgccgacaagctgaagcgggagattgagctgtatggctgccccccagacttcccagatgaggaggaggaggaggaggagacctctgtgaagacagaggacatcatcatcaaggacaaggccaagggcaagaagagcaaggccgccgccaaggccggcagcagcaagtaccagtggggcatcatgaagagcctgggcctgagtgatgaggagatcgtgaagttcagcgaggccgagcactggctggactacttcccccccctggccatccaggacctgaagaggatgggcctgaaggtggactggaggaggagcttcatcaccacagatgtgaacccctactatgacagctttgtgcgctggcagttcctgaccctgcgggagaggaacaagatcaagtttgggaagcgctacaccatctacagccccaaggatggccagccctgcatggaccatgaccggcagacaggagagggcgtgggcccccaggagtacaccctgctgaagctgaaggtgctggagccctaccccagcaagctgagcggcctgaagggcaagaacatcttcctggtggccgccaccctgcggcctgagaccatgtttggccagaccaactgctgggtgcggccagacatgaagtacatcggctttgagaccgtgaatggagacatcttcatctgcacccagaaggccgccaggaacatgagctaccagggcttcaccaaggacaatggagtggtgcctgtggtgaaggagctgatgggagaggagatcctgggcgccagcctgagcgcccccctgaccagctacaaggtgatctacgtgctgcccatgctgaccatcaaggaggacaagggcaccggggtggtgacctctgtgcccagcgacagcccagatgacattgctgccctgcgggacctgaagaagaagcaggccctgcgggccaagtatggcatcagagatgacatggtgctgccctttgagcctgtgcctgtgattgagatccctggctttggaaacctgtctgctgtgaccatctgtgatgagctgaagatccagagccagaatgaccgggagaagctggccgaggccaaggagaagatctacctgaagggcttctatgagggcatcatgctggtggatggcttcaagggccagaaggtgcaggatgtgaagaagaccatccagaagaagatgattgatgctggagatgccctgatctacatggagcctgagaagcaggtgatgagccgcagcagtgatgaatgtgtggtggccctgtgtgaccagtggtacctggactatggagaggagaactggaagaagcagaccagccagtgcctgaagaacctggagaccttctgtgaggagaccaggaggaactttgaggccaccctgggctggctgcaggagcacgcctgcagcaggacctacggcctgggcacccacctgccctgggatgagcagtggctgattgagagcctgagtgacagcaccatctacatggccttctacacagtggcccacctgctgcagggcggcaacctgcacggccaggccgagagccccctgggcatccggccccagcagatgaccaaggaggtgtgggactatgtgttcttcaaggaggcccccttccccaagacccagatcgccaaggagaagctggaccagctgaagcaggagtttgagttctggtaccctgtggacctgcgggtgtctgggaaggacctggtgcccaaccacctgagctactacctgtacaaccacgtggccatgtggccagagcagagcgacaagtggcccacagctgtgcgggccaacggccacctgctgctgaacagcgagaagatgagcaagagcactggaaacttcctgaccctgacccaggccatcgacaagttcagcgcagatggcatgaggctggccctggctgatgctggggacacagtggaggatgccaactttgtggaggccatggctgatgctggcatcctgcggctgtacacctgggtggagtgggtgaaggagatggtggccaactgggacagcctgcggagcggccctgccagcaccttcaatgacagagtgtttgccagcgagctgaatgccggcatcatcaagacagaccagaactatgagaagatgatgttcaaggaggccctgaagacaggcttctttgagttccaggccgccaaggacaagtaccgggagctggccgtggagggcatgcaccgggagctggtgttccgcttcatcgaggtgcagaccctgctgctggcccccttctgcccccacctgtgtgagcacatctggaccctgctgggcaagccagacagcatcatgaatgcctcctggcctgtggccggccctgtgaatgaggtgctgatccacagcagccagtacctgatggaggtgacccatgacctgcggctgcggctgaagaactacatgatgcctgccaagggcaagaagacagacaagcagcccctgcagaagcccagccactgcaccatctacgtggccaagaactacccaccctggcagcacaccaccctgtctgtgctgaggaagcactttgaggccaacaacgggaagctgcctgacaacaaggtgattgccagcgagctgggctccatgcctgagctgaagaagtacatgaagaaggtgatgccctttgtggccatgatcaaggagaacctggagaagatgggcccccgcatcctggacctgcagctggagtttgatgagaaggctgtgctgatggagaacatcgtgtacctgaccaacagcctggagctggagcacatcgaggtgaagtttgccagcgaggccgaggacaagatccgggaggactgctgccctgggaagcccctgaatgtgttcagaattgagcccggggtgtctgtgtccctggtgaacccccagcccagcaatggccacttcagcaccaagattgagatccggcagggcgacaactgtgacagcatcatccggcggctgatgaagatgaacagaggcatcaaggacctgagcaaggtgaagctgatgagatttgatgaccccctgctgggcccccggcgggtgcctgtgctgggcaaggagtacacagagaagacccccatcagcgagcacgctgtgttcaacgtggacctgatgagcaagaagatccacctgacagaaaatggcatccgggtggacattggagacaccatcatctacctggtgcactag

SEQ ID NO: 157609 - DNA, 3369 bp, Artificial Sequence
  Description of Artificial Sequence: Synthetic coding sequence
atgaatggccgcctgcacctgggccacaccttcagcctgagcaaatgtgaatttgctgtgggctaccagaggctgaagggcaagtgctgcctcttccccttcggcctgcactgcaccggcatgcccatcaaggcctgtgccgacaagctgaagcgggagattgagctgtatggctgccccccagacttcccagatgaggaggaggaggaggaggagacctctgtgaagacagaggacatcatcatcaaggacaaggccaagggcaagaagagcaaggccgccgccaaggccggcagcagcaagtaccagtggggcatcatgaagagcctgggcctgagtgatgaggagatcgtgaagttcagcgaggccgagcactggctggactacttcccccccctggccatccaggacctgaagaggatgggcctgaaggtggactggaggaggagcttcatcaccacagatgtgaacccctactatgacagctttgtgcgctggcagttcctgaccctgcgggagaggaacaagatcaagtttgggaagcgctacaccatctacagccccaaggatggccagccctgcatggaccatgaccggcagacaggagagggcgtgggcccccaggagtacaccctgctgaagctgaaggtgctggagccctaccccagcaagctgagcggcctgaagggcaagaacatcttcctggtggccgccaccctgcggcctgagaccatgtttggccagaccaactgctgggtgcggccagacatgaagtacatcggctttgagaccgtgaatggagacatcttcatctgcacccagaaggccgccaggaacatgagctaccagggcttcaccaaggacaatggagtggtgcctgtggtgaaggagctgatgggagaggagatcctgggcgccagcctgagcgcccccctgaccagctacaaggtgatctacgtgctgcccatgctgaccatcaaggaggacaagggcaccggggtggtgacctctgtgcccagcgacagcccagatgacattgctgccctgcgggacctgaagaagaagcaggccctgcgggccaagtatggcatcagagatgacatggtgctgccctttgagcctgtgcctgtgattgagatccctggctttggaaacctgtctgctgtgaccatctgtgatgagctgaagatccagagccagaatgaccgggagaagctggccgaggccaaggagaagatctacctgaagggcttctatgagggcatcatgctggtggatggcttcaagggccagaaggtgcaggatgtgaagaagaccatccagaagaagatgattgatgctggagatgccctgatctacatggagcctgagaagcaggtgatgagccgcagcagtgatgaatgtgtggtggccctgtgtgaccagtggtacctggactatggagaggagaactggaagaagcagaccagccagtgcctgaagaacctggagaccttctgtgaggagaccaggaggaactttgaggccaccctgggctggctgcaggagcacgcctgcagcaggacctacggcctgggcacccacctgccctgggatgagcagtggctgattgagagcctgagtgacagcaccatctacatggccttctacacagtggcccacctgctgcagggcggcaacctgcacggccaggccgagagccccctgggcatccggccccagcagatgaccaaggaggtgtgggactatgtgttcttcaaggaggcccccttccccaagacccagatcgccaaggagaagctggaccagctgaagcaggagtttgagttctggtaccctgtggacctgcgggtgtctgggaaggacctggtgcccaaccacctgagctactacctgtacaaccacgtggccatgtggccagagcagagcgacaagtggcccacagctgtgcgggccaacggccacctgctgctgaacagcgagaagatgagcaagagcactggaaacttcctgaccctgacccaggccatcgacaagttcagcgcagatggcatgaggctggccctggctgatgctggggacacagtggaggatgccaactttgtggaggccatggctgatgctggcatcctgcggctgtacacctgggtggagtgggtgaaggagatggtggccaactgggacagcctgcggagcggccctgccagcaccttcaatgacagagtgtttgccagcgagctgaatgccggcatcatcaagacagaccagaactatgagaagatgatgttcaaggaggccctgaagacaggcttctttgagttccaggccgccaaggacaagtaccgggagctggccgtggagggcatgcaccgggagctggtgttccgcttcatcgaggtgcagaccctgctgctggcccccttctgcccccacctgtgtgagcacatctggaccctgctgggcaagccagacagcatcatgaatgcctcctggcctgtggccggccctgtgaatgaggtgctgatccacagcagccagtacctgatggaggtgacccatgacctgcggctgcggctgaagaactacatgatgcctgccaagggcaagaagacagacaagcagcccctgcagaagcccagccactgcaccatctacgtggccaagaactacccaccctggcagcacaccaccctgtctgtgctgaggaagcactttgaggccaacaacgggaagctgcctgacaacaaggtgattgccagcgagctgggctccatgcctgagctgaagaagtacatgaagaaggtgatgccctttgtggccatgatcaaggagaacctggagaagatgggcccccgcatcctggacctgcagctggagtttgatgagaaggctgtgctgatggagaacatcgtgtacctgaccaacagcctggagctggagcacatcgaggtgaagtttgccagcgaggccgaggacaagatccgggaggactgctgccctgggaagcccctgaatgtgttcagaattgagcccggggtgtctgtgtccctggtgaacccccagcccagcaatggccacttcagcaccaagattgagatccggcagggcgacaactgtgacagcatcatccggcggctgatgaagatgaacagaggcatcaaggacctgagcaaggtgaagctgatgagatttgatgaccccctgctgggcccccggcgggtgcctgtgctgggcaaggagtacacagagaagacccccatcagcgagcacgctgtgttcaacgtggacctgatgagcaagaagatccacctgacagaaaatggcatccgggtggacattggagacaccatcatctacctggtgcactag

SEQ ID NO: 157610 - DNA, 372 bp, Artificial Sequence
  Description of Artificial Sequence: Synthetic coding sequence
atgtggccagagcagagcgacaagtggcccacagctgtgcgggccaacggccacctgctgctgaacagcgagaagatgagcaagagcacaggcaacttcctgaccctgacccaggccatcgacaagttcagcgcagatggcatgaggctggccctggctgatgctggggacacagtggaggatgccaactttgtggaggccatggctgatgctggcatcctgcggctgtacacctgggtggagtgggtgaaggagatggtggccaactgggacagcctgcggagcggccctgccagcaccttcaatgacagagtgtttgccagcgagctgaatgccggcatcatcaagacagaccagaccatgaagaggtag

SEQ ID NO: 157611 - DNA, 1458 bp, Artificial Sequence
  Description of Artificial Sequence: Synthetic coding sequence
atgtggccagagcagagcgacaagtggcccacagctgtgcgggccaacggccacctgctgctgaacagcgagaagatgagcaagagcacaggcaacttcctgaccctgacccaggccatcgacaagttcagcgcagatggcatgaggctggccctggctgatgctggggacacagtggaggatgccaactttgtggaggccatggctgatgctggcatcctgcggctgtacacctgggtggagtgggtgaaggagatggtggccaactgggacagcctgcggagcggccctgccagcaccttcaatgacagagtgtttgccagcgagctgaatgccggcatcatcaagacagaccagaactatgagaagatgatgttcaaggaggccctgaagacaggcttctttgagttccaggccgccaaggacaagtaccgggagctggccgtggagggcatgcaccgggagctggtgttccgcttcatcgaggtgcagaccctgctgctggcccccttctgcccccacctgtgtgagcacatctggaccctgctgggcaagccagacagcatcatgaatgcctcctggcctgtggccggccctgtgaatgaggtgctgatccacagcagccagtacctgatggaggtgacccatgacctgcggctgcggctgaagaactacatgatgcctgccaagggcaagaagacagacaagcagcccctgcagaagcccagccactgcaccatctacgtggccaagaactacccaccctggcagcacaccaccctgtctgtgctgaggaagcactttgaggccaacaacgggaagctgcctgacaacaaggtgattgccagcgagctgggctccatgcctgagctgaagaagtacatgaagaaggtgatgccctttgtggccatgatcaaggagaacctggagaagatgggcccccgcatcctggacctgcagctggagtttgatgagaaggctgtgctgatggagaacatcgtgtacctgaccaacagcctggagctggagcacatcgaggtgaagtttgccagcgaggccgaggacaagatccgggaggactgctgccctgggaagcccctgaatgtgttccgcatcgagcccggggtgtctgtgtccctggtgaacccccagcccagcaatggccacttcagcaccaagattgagatccggcagggcgacaactgtgacagcatcatccggcggctgatgaagatgaacagaggcatcaaggacctgagcaaggtgaagctgatgagatttgatgaccccctgctgggccccaggagagtgcctgtgctgggcaaggagtacacagagaagacccccatcagcgagcacgctgtgttcaacgtggacctgatgagcaagaagatccacctgacagaaaatggcatccgggtggacatcggggacaccatcatctacctggtgcactag

SEQ ID NO: 157612 - DNA, 3393 bp, Artificial Sequence
  Description of Artificial Sequence: Synthetic coding sequence
atggccgagaggaaaggaacagccaaggtggacttcctgaagaagattgagaaggagatccagcagaagtgggacacagagcgggtgtttgaggtgaatgccagcaacctggagaagcagaccagcaagggcaagtactttgtgaccttcccctacccctacatgaatggccgcctgcacctgggccacaccttcagcctgagcaaatgtgaatttgctgtgggctaccagaggctgaagggcaagtgctgcctcttccccttcggcctgcactgcaccggcatgcccatcaagagcaaggccgccgccaaggccggcagcagcaagtaccagtggggcatcatgaagagcctgggcctgagtgatgaggagatcgtgaagttcagcgaggccgagcactggctggactacttcccccccctggccatccaggacctgaagaggatgggcctgaaggtggactggaggaggagcttcatcaccacagatgtgaacccctactatgacagctttgtgcgctggcagttcctgaccctgcgggagaggaacaagatcaagtttgggaagcgctacaccatctacagccccaaggatggccagccctgcatggaccatgaccggcagacaggagagggcgtgggcccccaggagtacaccctgctgaagctgaaggtgctggagccctaccccagcaagctgagcggcctgaagggcaagaacatcttcctggtggccgccaccctgcggcctgagaccatgtttggccagaccaactgctgggtgcggccagacatgaagtacatcggctttgagaccgtgaatggagacatcttcatctgcacccagaaggccgccaggaacatgagctaccagggcttcaccaaggacaatggagtggtgcctgtggtgaaggagctgatgggagaggagatcctgggcgccagcctgagcgcccccctgaccagctacaaggtgatctacgtgctgcccatgctgaccatcaaggaggacaagggcaccggggtggtgacctctgtgcccagcgacagcccagatgacattgctgccctgcgggacctgaagaagaagcaggccctgcgggccaagtatggcatcagagatgacatggtgctgccctttgagcctgtgcctgtgattgagatccctggctttggaaacctgtctgctgtgaccatctgtgatgagctgaagatccagagccagaatgaccgggagaagctggccgaggccaaggagaagatctacctgaagggcttctatgagggcatcatgctggtggatggcttcaagggccagaaggtgcaggatgtgaagaagaccatccagaagaagatgattgatgctggagatgccctgatctacatggagcctgagaagcaggtgatgagccgcagcagtgatgaatgtgtggtggccctgtgtgaccagtggtacctggactatggagaggagaactggaagaagcagaccagccagtgcctgaagaacctggagaccttctgtgaggagaccaggaggaactttgaggccaccctgggctggctgcaggagcacgcctgcagcaggacctacggcctgggcacccacctgccctgggatgagcagtggctgattgagagcctgagtgacagcaccatctacatggccttctacacagtggcccacctgctgcagggcggcaacctgcacggccaggccgagagccccctgggcatccggccccagcagatgaccaaggaggtgtgggactatgtgttcttcaaggaggcccccttccccaagacccagatcgccaaggagaagctggaccagctgaagcaggagtttgagttctggtaccctgtggacctgcgggtgtctgggaaggacctggtgcccaaccacctgagctactacctgtacaaccacgtggccatgtggccagagcagagcgacaagtggcccacagctgtgcgggccaacggccacctgctgctgaacagcgagaagatgagcaagagcactggaaacttcctgaccctgacccaggccatcgacaagttcagcgcagatggcatgaggctggccctggctgatgctggggacacagtggaggatgccaactttgtggaggccatggctgatgctggcatcctgcggctgtacacctgggtggagtgggtgaaggagatggtggccaactgggacagcctgcggagcggccctgccagcaccttcaatgacagagtgtttgccagcgagctgaatgccggcatcatcaagacagaccagaactatgagaagatgatgttcaaggaggccctgaagacaggcttctttgagttccaggccgccaaggacaagtaccgggagctggccgtggagggcatgcaccgggagctggtgttccgcttcatcgaggtgcagaccctgctgctggcccccttctgcccccacctgtgtgagcacatctggaccctgctgggcaagccagacagcatcatgaatgcctcctggcctgtggccggccctgtgaatgaggtgctgatccacagcagccagtacctgatggaggtgacccatgacctgcggctgcggctgaagaactacatgatgcctgccaagggcaagaagacagacaagcagcccctgcagaagcccagccactgcaccatctacgtggccaagaactacccaccctggcagcacaccaccctgtctgtgctgaggaagcactttgaggccaacaacgggaagctgcctgacaacaaggtgattgccagcgagctgggctccatgcctgagctgaagaagtacatgaagaaggtgatgccctttgtggccatgatcaaggagaacctggagaagatgggcccccgcatcctggacctgcagctggagtttgatgagaaggctgtgctgatggagaacatcgtgtacctgaccaacagcctggagctggagcacatcgaggtgaagtttgccagcgaggccgaggacaagatccgggaggactgctgccctgggaagcccctgaatgtgttcagaattgagcccggggtgtctgtgtccctggtgaacccccagcccagcaatggccacttcagcaccaagattgagatccggcagggcgacaactgtgacagcatcatccggcggctgatgaagatgaacagaggcatcaaggacctgagcaaggtgaagctgatgagatttgatgaccccctgctgggcccccggcgggtgcctgtgctgggcaaggagtacacagagaagacccccatcagcgagcacgctgtgttcaacgtggacctgatgagcaagaagatccacctgacagaaaatggcatccgggtggacattggagacaccatcatctacctggtgcactag

SEQ ID NO: 157613 - DNA, 2712 bp, Artificial Sequence
  Description of Artificial Sequence: Synthetic coding sequence
atggcctctgtgtggcagaggctgggcttctacgccagcctgctgaagaggcagctgaatggaggcccagatgtgatcaagtgggagcggcgggtcatccctggctgcaccaggagcatctacagcgccaccgggaagtggaccaaggagtacaccctgcagaccaggaaggatgtggagaagtggtggcaccagaggatcaaggagcaggccagcaagatcagcgaggccgacaagagcaagcccaagttctacgtgctgtccatgttcccctaccccagcggcaagctgcacatgggccacgtgcgggtgtacaccatcagtgacaccatcgcccgcttccagaagatgaggggcatgcaggtgatcaaccccatgggctgggatgccttcggcctgcctgcagaaaatgctgctgtggagaggaacctgcacccccagagctggacccagagcaacatcaagcacatgaggaagcagctggaccggctgggcctgtgcttctcctgggaccgggagatcaccacctgcctgcctgactactacaagtggacccagtacctgttcatcaagctgtatgaagctggcctggcctaccagaaggaggccctggtgaactgggaccctgtggaccagacagtgctggccaatgagcaggtggatgaacatggctgctcctggaggtctggggccaaggtggagcagaagtacctgcggcagtggttcatcaagaccacagcctatgccaaggccatgcaggatgccctggccgacctgcctgagtggtacggcatcaagggcatgcaggcccactggattggagactgtgtgggctgccacctggacttcaccctgaaggtgcacggccaggccaccggggagaagctgacagcctacacagccaccccagaggccatctacggcaccagccacgtggccatcagccccagccaccggctgctgcacggccacagcagcctgaaggaggccctgaggatggccctggtgcctgggaaggactgcctgacccctgtgatggctgtgaacatgctgacccagcaggaggtgcctgtggtgatcctggccaaggctgacctggagggcagcctggacagcaagattggcatccccagcaccagcagcgaggacaccatcctggcccagaccctgggcctggcctacagcgaggtgattgagaccctgcctgatggaacagagcggctgagcagcagcgctgagttcaccggcatgacccggcaggatgccttcctggccctgacccagaaggcccggggcaagagggtgggcggagatgtgaccagtgacaagctgaaggactggctgatcagccggcagcgctactggggcacccccatccccatcgtgcactgccctgtgtgtggccccacccctgtgcccctggaggacctgcctgtgaccctgcccaacatcgccagcttcaccgggaagggcggcccccccctggccatggccagcgagtgggtgaactgcagctgcccccgctgcaagggggccgccaagcgggagacagacaccatggacacctttgtggacagcgcctggtactacttccgctacacagacccccacaacccccacagccccttcaacacagctgtggccgactactggatgcctgtggacctgtacatcggcggcaaggagcacgctgtgatgcacctgttctacgcccgcttcttcagccacttctgccacgaccagaagatggtgaagcaccgggagcccttccacaagctgctggcccagggcctcatcaagggccagaccttccggctgcccagcggccagtacctgcagcgggaggaggtggacctgaccggctctgtgcctgtgcacgccaagaccaaggagaagctggaggtgacctgggagaagatgagcaagagcaagcacaacggggtggaccctgaggaggtggtggagcagtatggaattgacaccatccggctgtacatcctgtttgctgcccctcctgagaaggacatcctgtgggatgtgaagacagatgccctgcccggggtgctgcgctggcagcagaggctgtggaccctgaccacccgcttcatcgaggcccgggccagcggcaagagcccccagccccagctgctgagcaacaaggagaaggccgaggccaggaagctgtgggagtacaagaacagcgtcatcagccaggtgaccacccacttcacagaggacttcagcctgaacagcgccatcagccagctgatgggcctgagcaatgccctgagccaggccagccagagcgtcatcctgcacagccctgagtttgaagatgccctgtgtgccctgatggtgatggccgcccccctggccccccacgtgaccagcgagatctgggccggcctggccctggtgcccaggaagctgtgtgcccactacacctgggatgcctctgtgctgctgcaggcctggccagctgtggaccctgagttcctgcagcagcctgaggtggtgcagatggctgtgctgatcaacaacaaggcctgtgggaagatccctgtgccccagcaggtggcccgggaccaggacaaggtgcatgaatttgtgctgcagagcgagctgggcgtgcggctgctgcagggccgcagcatcaagaagagcttcctgagccccaggacagccctgatcaacttcctggtgcaggactag

SEQ ID NO: 157614 - DNA, 2583 bp, Artificial Sequence
  Description of Artificial Sequence: Synthetic coding sequence
atggcctctgtgtggcagaggctgggcttctacgccagcctgctgaagaggcagctgaatggaggcccagatgtgatcaagtgggagcggcgggtcatccctggctgcaccaggagcatctacagcgccaccgggaagtggaccaaggagtacaccctgcagaccaggaaggatgtggagaagtggtggcaccagaggatcaaggagcaggccagcaagatcagcgaggctgatgtgatcaaccccatgggctgggatgccttcggcctgcctgcagaaaatgctgctgtggagaggaacctgcacccccagagctggacccagagcaacatcaagcacatgaggaagcagctggaccggctgggcctgtgcttctcctgggaccgggagatcaccacctgcctgcctgactactacaagtggacccagtacctgttcatcaagctgtatgaggccggcctggcctaccagaaggaggccctggtgaactgggaccctgtggaccagacagtgctggccaatgagcaggtggatgagcacggctgctcctggaggtctggggccaaggtggagcagaagtacctgcggcagtggttcatcaagaccacagcctatgccaaggccatgcaggatgccctggccgacctgcctgagtggtacggcatcaagggcatgcaggcccactggattggagactgtgtgggctgccacctggacttcaccctgaaggtgcacggccaggccactggagagaagctgacagcctacacagccaccccagaggccatctacggcaccagccacgtggccatcagccccagccaccggctgctgcacggccacagcagcctgaaggaggccctgaggatggccctggtgcctgggaaggactgcctgacccctgtgatggctgtgaacatgctgacccagcaggaggtgcctgtggtgatcctggccaaggctgacctggagggcagcctggacagcaagattggcatccccagcaccagcagcgaggacaccatcctggcccagaccctgggcctggcctacagcgaggtgattgagaccctgcctgatggaacagagcggctgagcagcagcgctgagttcaccggcatgacccggcaggatgccttcctggccctgacccagaaggcccggggcaagagggtgggcggagatgtgaccagtgacaagctgaaggactggctgatcagccggcagcgctactggggcacccccatccccatcgtgcactgccctgtgtgtggccccacccctgtgcccctggaggacctgcctgtgaccctgcccaacatcgccagcttcaccggaaaaggaggcccccccctggccatggccagcgagtgggtgaactgcagctgcccccgctgcaagggagctgccaagcgggagacagacaccatggacacctttgtggacagcgcctggtactacttccgctacacagacccccacaacccccacagccccttcaacacagctgtggccgactactggatgcctgtggacctgtacatcggcggcaaggagcacgctgtgatgcacctgttctacgcccgcttcttcagccacttctgccacgaccagaagatggtgaagcaccgggagcccttccacaagctgctggcccagggcctcatcaagggccagaccttccggctgcccagcggccagtacctgcagcgggaggaggtggacctgactggatctgtgcctgtgcacgccaagaccaaggagaagctggaggtgacctgggagaagatgagcaagagcaagcacaatggagtggaccctgaggaggtggtggagcagtatggcatcgacaccatccggctgtacatcctgtttgctgcccctcctgagaaggacatcctgtgggatgtgaagacagatgccctgcccggggtgctgcgctggcagcagaggctgtggaccctgaccacccgcttcatcgaggcccgggccagcggcaagagcccccagccccagctgctgagcaacaaggagaaggccgaggccaggaagctgtgggagtacaagaacagcgtcatcagccaggtgaccacccacttcacagaggacttcagcctgaacagcgccatcagccagctgatgggcctgagcaatgccctgagccaggccagccagagcgtcatcctgcacagccctgagtttgaagatgccctgtgtgccctgatggtgatggccgcccccctggcccctcatgtgaccagcgagatctgggccggcctggccctggtgcccaggaagctgtgtgcccactacacctgggatgcctctgtgctgctgcaggcctggccagctgtggaccctgagttcctgcagcagcctgaggtggtgcagatggctgtgctgatcaacaacaaggcctgtgggaagatccctgtgccccagcaggtggcccgggaccaggacaaggtgcatgaatttgtgctgcagagcgagctgggcgtgcggctgctgcagggccgcagcatcaagaagagcttcctgagccccaggacagccctgatcaacttcctggtgcaggactag

SEQ ID NO: 157615 - DNA, 2712 bp, Artificial Sequence; identical to SEQ ID NO: 157613
  Description of Artificial Sequence: Synthetic coding sequence

SEQ ID NO: 157616 - DNA, 345 bp, Artificial Sequence
  Description of Artificial Sequence: Synthetic coding sequence
atggcctctgtgtggcagaggctgggcttctacgccagcctgctgaagaggcagctgaatggaggcccagatgtgatcaagtgggagcggcgggtcatccctggctgcaccaggagcatctacagcgccaccgggaagtggaccaaggagtacaccctgcagaccaggaaggatgtggagaagtggtggcaccagaggatcaaggagcaggccagcaagatcagcgaggccgacaagagcaagcccaagttctacgtgctgtccatgttcccctaccccagcggcaagctgcacatgggccacgtgcgggtgtacaccatcagtgacaccatcgcccgcttctag

SEQ ID NO: 157617 - DNA, 609 bp, Artificial Sequence
  Description of Artificial Sequence: Synthetic coding sequence
atgaaggtgctggccgccggcgtggtgcccctgctgctggtgctgcactggaagcatggagctggcagccccctgcccatcacccctgtgaatgccacctgtgccatccgccacccctgccacaacaacctgatgaaccagatccgcagccagctggcccagctgaatggcagcgccaatgccctcttcatcctgtactacacagcccagggcgagcccttccccaacaacctggacaagctgtgtggccccaacgtgacagacttcccccccttccacgccaatggaacagagaaggccaagctggtggagctgtaccgcatcgtggtgtacctgggcaccagcctgggcaacatcacccgggaccagaagatcctgaaccccagcgccctgagcctgcacagcaagctgaatgccacagctgacatcctgcggggcctgctgagcaatgtgctgtgccgcctgtgcagcaagtaccacgtgggccacgtggatgtgacctacggccctgacaccagcggcaaggatgtgttccagaagaagaagctgggctgccagctgctgggcaagtacaagcagatcatcgctgtgctggcccaggccttctag

SEQ ID NO: 157618 - DNA, 3294 bp, Artificial Sequence
  Description of Artificial Sequence: Synthetic coding sequence
atgatggacatctacgtgtgcctgaagaggcccagctggatggtggacaacaagaggatgaggacagccagcaacttccagtggctgctgagcaccttcatcctgctgtacctgatgaaccaggtgaacagccagaagaagggggcccctcatgacctgaagtgtgtgaccaacaacctgcaggtgtggaactgctcctggaaggcccccagcggcaccggccggggcacagattatgaggtgtgcatcgagaacagaagccgcagctgctaccagctggagaagaccagcatcaagatcccagccctgagccatggagactatgagatcaccatcaacagcctgcatgactttggcagcagcaccagcaagttcaccctgaatgagcagaatgtgtccctcatcccagacaccccagagatcctgaacctgtctgctgacttcagcaccagcaccctgtacctgaagtggaatgaccggggcagcgtcttcccccacaggagcaatgtcatctgggagatcaaggtgctgaggaaggagagcatggagctggtgaagctggtgacccacaacaccaccctgaatggcaaggacaccctgcaccactggagctgggccagtgacatgcccctggagtgtgccatccactttgtggagatccgctgctacatcgacaacctgcacttcagcggcctggaggagtggagcgactggagccctgtgaagaacatctcctggatcccagacagccagaccaaggtgttcccccaggacaaggtgatcctggtgggcagtgacatcaccttctgctgcgtgtcccaggagaaggtgctgagcgccctgattggccacaccaactgccccctcatccacctggatggagaaaatgtggccatcaagatccggaacatctctgtgtctgccagcagcggcaccaacgtggtgttcaccacagaggacaacatctttggaacagtcatctttgctggctaccccccagacaccccccagcagctgaactgtgagacccatgacctgaaggagatcatctgctcctggaaccctggccgggtgacagccctggtgggcccccgggccaccagctacaccctggtggagagcttcagcggcaagtatgtgcggctgaagagagctgaggcccccaccaatgaaagctaccagctgctcttccagatgctgcccaaccaggagatctacaacttcaccctgaatgcccacaaccccctgggccgcagccagagcaccatcctggtgaacatcacagagaaggtgtacccccacacccccaccagcttcaaggtgaaggacatcaacagcacagctgtgaagctgtcctggcacctgcccggcaactttgccaagatcaacttcctgtgtgaaattgagatcaagaagagcaacagcgtgcaggagcagagaaatgtgaccatcaagggcgtggagaacagcagctacctggtggccctggacaagctgaacccctacaccctgtacaccttccgcatccgctgcagcacagagaccttctggaagtggagcaagtggagcaacaagaagcagcacctgaccacagaggccagccccagcaaaggaccagacacctggagggagtggagcagtgatggcaagaacctgatcatctactggaagcccctgcccatcaatgaggccaacgggaagatcctgagctacaacgtgtcctgcagcagtgatgaggagacccagagcctgtctgagatcccagacccccagcacaaggccgagatccggctggacaagaatgactacatcatctctgtggtggccaagaacagcgtgggcagcagcccccccagcaagatcgcctccatggagatccccaatgatgacctgaagattgagcaggtggtgggcatgggcaagggcatcctgctgacctggcactatgaccccaacatgacctgtgactatgtgatcaagtggtgcaacagcagccgctctgagccctgcctgatggactggaggaaggtgcccagcaacagcacagagaccgtcatcgagagtgatgagttccggcccggcatccgctacaacttcttcctgtatggctgcaggaaccagggctaccagctgctgcgctccatgattggctacatcgaggagctggcccccatcgtggcccccaacttcaccgtggaggacaccagcgctgacagcatcctggtgaagtgggaggacatccctgtggaggagctgcggggcttcctgcggggctacctgttctactttggaaaaggagagcgggacaccagcaagatgagggtgctggagagcggccgcagtgacatcaaggtgaagaacatcacagacatcagccagaagaccctgagaattgctgacctgcagggcaagaccagctaccacctggtgctgcgggcctacacagatggcggcgtgggccctgagaagtccatgtatgtggtgaccaaggaaaattctgtgggcctcatcatcgccatcctgatccctgtggccgtggccgtgattgtgggcgtggtgaccagcatcctgtgctacaggaagcgggagtggatcaaggagaccttctacccagacatccccaaccctgagaactgcaaggccctgcagttccagaagtctgtgtgtgagggcagcagcgccctgaagaccctggagatgaacccctgcacccccaacaacgtggaggtgctggagaccaggtctgccttccccaagattgaggacacagagatcatcagccctgtggccgagaggcctgaggacagaagtgatgctgagcctgagaaccacgtggtggtgtcctactgcccccccatcatcgaggaggagatccccaacccagctgctgatgaggccggcggcacagcccaggtgatctacattgatgtgcagagcatgtaccagccccaggccaagccagaggaggagcaggagaatgaccctgtgggcggggccggctacaagccccagatgcacctgcccatcaacagcacagtggaggacattgctgctgaggaggacctggacaagacagctggctaccggccccaggccaacgtgaacacctggaacctggtgtccccagacagccccaggagcattgacagcaacagcgagatcgtgtcctttggcagcccctgcagcatcaacagccggcagttcctgatcccccccaaggatgaggacagccccaagagcaatggaggcggctggagcttcaccaacttcttccagaacaagcccaatgactag

SEQ ID NO: 157619 - DNA, 3294 bp, Artificial Sequence; identical to SEQ ID NO: 157618
  Description of Artificial Sequence: Synthetic coding sequence

SEQ ID NO: 157620 - DNA, 381 bp, Artificial Sequence
  Description of Artificial Sequence: Synthetic coding sequence
atgatggacatctacgtgtgcctgaagaggcccagctggatggtggacaacaagaggatgaggacagccagcaacttccagtggctgctgagcaccttcatcctgctgtacctgatgaaccaggtgaacagccagaagaagggggcccctcatgacctgaagtgtgtgaccaacaacctgcaggtgtggaactgctcctggaaggcccccagcggcaccggccggggcacagattatgaggtgtgcatcgagaacagaagccgcagctgctaccagctggagaagaccagcatcaagatcccagccctgagccatggagactatgagatcaccatcaacagcctgcatgactttggcagcagcaccagcaagttcacctag

SEQ ID NO: 157621 - DNA, 228 bp, Artificial Sequence
  Description of Artificial Sequence: Synthetic coding sequence
atgatggacatctacgtgtgcctgaagaggcccagctggatggtggacaacaagaggatgaggacagccagcaacttccagtggctgctgagcaccttcatcctgctgtacctgatgaaccaggtgaacagccagaagaagggggcccctcatgacctgaagtgtgtgaccaacaacctgcaggtgtggaactgctcctggaaggcccccagcggcactggaagatag

SEQ ID NO: 157622 - DNA, 456 bp, Artificial Sequence
  Description of Artificial Sequence: Synthetic coding sequence
atgttcagcaccaaggccctgctgctggccggcctcatcagcacagccctggccggcccctgggccaacatctgtgccggcaagagcagcaatgagatccgcacctgtgacagacatggctgcggccagtacagcgcccagaggagccagaggccccaccagggcgtggacatcctgtgcagcgctggcagcacagtgtatgcccccttcaccggcatgattgtgggccaggagaagccctaccagaacaagaatgccatcaacaatggagtgcgcatcagcggccggggcttctgtgtgaagatgttctacatcaagcccatcaagtacaagggccccatcaagaagggggagaagctgggcaccctgctgcccctgcagaaggtgtacccaggcatccagagccacgtgcacatcgagaactgtgacagcagtgaccccacagcctacctgtag

SEQ ID NO: 157623 - DNA, 1128 bp, Artificial Sequence
  Description of Artificial Sequence: Synthetic coding sequence
atgacccccatcctgactgtgctgatctgcctgggcctgagcctggaccccaggacccacgtgcaggccggccccctgcccaagcccaccctgtgggccgagcccggcagcgtcatcacccagggcagccctgtgaccctgcgctgccagggcagcctggagacccaggagtaccacctgtaccgggagaagaagacagccctgtggatcacccgcatcccccaggagctggtgaagaagggccagttccccatcctgagcatcacctgggagcacgccggccgctactgctgcatctacggcagccacacagctggcctgtctgagagcagtgaccccctggagctggtggtgactggagcctacagcaagcccaccctgagcgccctgcccagccctgtggtgaccagcggcggcaatgtgaccatccagtgtgacagccaggtggcctttgatggcttcatcctgtgtgtgtccaagaagcccagcctgtctgtgcagcccggccctgtggtggcccctggagagaagctgaccttccagtgtggcagtgatgctggctatgacagatttgtgctgtacaaggagtggggccgggacttcctgcagaggcctggccggcagccccaggccggcctgagccaggccaacttcaccctgggccctgtgagccgctcctatggaggccagtacacctgcagcggggcctacaacctgagcagcgagtggagcgcccccagcgaccccctggacatcctgatcaccggccagatccgggcccggcccttcctgtctgtgcggcccggccccaccgtggccagcggggagaatgtgaccctgctgtgccagagccagggcggcatgcacaccttcctgctgaccaaggagggcgctgctgacagccccctgcggctgaagagcaagaggcagagccacaagtaccaggccgagttccccatgagccctgtgaccagcgcccacgccggcacctaccgctgctacggcagcctgagcagcaacccctacctgctgacccaccccagcgaccccctggagctggtggtgtctggagctgctgagaccctgagccccccccagaacaagagtgacagcaaggccggggagtag

SEQ ID NO: 157624 - DNA, 1956 bp, Artificial Sequence
  Description of Artificial Sequence: Synthetic coding sequence
atgacccccatcctgactgtgctgatctgcctgggcctgagcctgggccccaggacccacgtgcaggccggccacctgcccaagcccaccctgtgggccgagcccggcagcgtcatcacccagggcagccctgtgaccctgcgctgccagggcggccaggagacccaggagtaccgcctgtaccgggagaagaagacagccctgtggatcacccgcatcccccaggagctggtgaagaagggccagttccccatccccagcatcacctgggagcacgccggccgctaccgctgctactacggcagtgacacagctggccgctctgagagcagtgaccccctggagctggtggtgactggagcctacatcaagcccaccctgagcgcccagcccagccctgtggtgaacagcggcggcaatgtcatcctgcagtgtgacagccaggtggcctttgatggcttcagcctgtgcaaggagggagaagatgagcacccccagtgcctgaacagccagccccacgcccggggcagcagccgggccatcttctctgtgggccctgtgagccccagccgccgctggtggtaccgctgctacgcctatgacagcaacagcccctatgagtggagcctgcccagcgacctgctggagctgctggtgctgggcgtgtccaagaagcccagcctgtctgtgcagcccggccccatcgtggcccctgaggagaccctgaccctgcagtgtggcagtgatgctggctacaacagatttgtgctgtacaaggatggagagcgggacttcctgcagctggccggggcccagccccaggccggcctgagccaggccaacttcaccctgggccctgtgagccgctcctatggaggccagtaccgctgctacggggcccacaacctgagcagcgagtggagcgcccccagcgaccccctggacatcctgattgctggccagttctatgacagagtgtccctgtctgtgcagcccggccccaccgtggccagcggggagaatgtgaccctgctgtgccagagccagggctggatgcagaccttcctgctgaccaaggagggcgctgctgatgacccctggaggctgcggagcacctaccagagccagaagtaccaggccgagttccccatgggccctgtgaccagcgcccacgccggcacctaccgctgctacggcagccagagcagcaagccctacctgctgacccaccccagcgaccccctggagctggtggtgtctggccccagcggcggccccagcagccccaccaccggccccaccagcaccagcgctggccctgaggaccagcccctgacccccaccggcagtgacccccagagcggcctgggccgccacctgggcgtggtgattggcatcctggtggccgtcatcctgctgctgctgctgctgctgctgctcttcctgatcctgcggcaccggcggcagggcaagcactggaccagcacccagaggaaggctgacttccagcaccctgctggagctgtgggccctgagcccacagaccggggcctgcagtggaggagcagccctgctgctgatgcccaggaggagaacctgtatgctgctgtgaagcacacccagccagaagatggagtggagatggacaccaggagcccccatgatgaggacccccaggccgtgacctacgccgaggtgaagcacagccggccccggcgggagatggccagcccccccagccccctgtctggagagttcctggacaccaaggaccggcaggccgaggaggaccggcagatggacacagaggccgccgccagcgaggccccccaggatgtgacctacgcccagctgcacagcctgaccctgcggcgggaggccacagagcccccacccagccaggagggccccagccctgctgtgcccagcatctatgccaccctggccatccactag

SEQ ID NO: 157625 - DNA, 1956 bp, Artificial Sequence
  Description of Artificial Sequence: Synthetic coding sequence
atgacccccatcctgactgtgctgatctgcctgggcctgagcctgggccccaggacccacgtgcaggccggccacctgcccaagcccaccctgtgggccgagcccggcagcgtcatcacccagggcagccctgtgaccctgcgctgccagggcggccaggagacccaggagtaccgcctgtaccgggagaagaagacagccctgtggatcacccgcatcccccaggagctggtgaagaagggccagttccccatccccagcatcacctgggagcacgccggccgctaccgctgctactacggcagtgacacagctggccgctctgagagcagtgaccccctggagctggtggtgactggagcctacatcaagcccaccctgagcgcccagcccagccctgtggtgaacagcggcggcaatgtcatcctgcagtgtgacagccaggtggcctttgatggcttcagcctgtgcaaggagggagaagatgagcacccccagtgcctgaacagccagccccacgcccggggcagcagccgggccatcttctctgtgggccctgtgagccccagccgccgctggtggtaccgctgctacgcctatgacagcaacagcccctatgagtggagcctgcccagcgacctgctggagctgctggtgctgggcgtgtccaagaagcccagcctgtctgtgcagcccggccccatcgtggcccctgaggagaccctgaccctgcagtgtggcagtgatgctggctacaacagatttgtgctgtacaaggatggagagcgggacttcctgcagctggccggggcccagccccaggccggcctgagccaggccaacttcaccctgggccctgtgagccgctcctatggaggccagtaccgctgctacggggcccacaacctgagcagcgagtggagcgcccccagcgaccccctggacatcctgattgctggccagttctatgacagagtgtccctgtctgtgcagcccggccccaccgtggccagcggggagaatgtgaccctgctgtgccagagccagggctggatgcagaccttcctgctgaccaaggagggcgctgctgatgacccctggaggctgcggagcacctaccagagccagaagtaccaggccgagttccccatgggccctgtgaccagcgcccacgccggcacctaccgctgctacggcagccagagcagcaagccctacctgctgacccaccccagcgaccccctggagctggtggtgtctggccccagcggcggccccagcagccccaccaccggccccaccagcaccagcggccctgaggaccagcccctgacccccactggaagtgacccccagagcggcctgggccgccacctgggcgtggtgattggcatcctggtggccgtcatcctgctgctgctgctgctgctgctgctcttcctgatcctgcggcaccggcggcagggcaagcactggaccagcacccagaggaaggctgacttccagcaccctgctggagctgtgggccctgagcccacagaccggggcctgcagtggaggagcagccctgctgctgatgcccaggaggagaacctgtatgctgctgtgaagcacacccagccagaagatggagtggagatggacacccggcagagcccccatgatgaggacccccaggccgtgacctacgccgaggtgaagcacagccggccccggcgggagatggccagcccccccagccccctgtctggagagttcctggacaccaaggaccggcaggccgaggaggaccggcagatggacacagaggccgccgccagcgaggccccccaggatgtgacctacgcccagctgcacagcctgaccctgcggcgggaggccacagagcccccacccagccaggagggccccagccctgctgtgcccagcatctatgccaccctggccatccactag

SEQ ID NO: 157626 - DNA, 1794 bp, Artificial Sequence
  Description of Artificial Sequence: Synthetic coding sequence
atgacccccatcgtgacagtgctgatctgcctgggcctgagcctgggccccaggacccacgtgcagacaggcaccatccccaagcccaccctgtgggccgagccagattctgtcatcacccagggcagccctgtgaccctgagctgccagggcagcctggaggcccaggagtaccgcctgtaccgggagaagaagagcgcctcctggatcacccgcatccggcctgagctggtgaagaatggccagttccacatccccagcatcacctgggagcacacaggccgctatggctgccagtactacagccgggcccgctggagcgagctgagtgaccccctggtgctggtgatgaccggggcctaccccaagcccaccctgagcgcccagcccagccctgtggtgaccagcggcggccgggtgaccctgcagtgtgagagccaggtggccttcggcggcttcatcctgtgcaaggagggggaggaggagcacccccagtgcctgaacagccagccccacgcccggggcagcagccgggccatcttctctgtgggccctgtgagccccaacagacgctggagccaccgctgctacggctatgacctgaacagcccctacgtgtggagcagccccagcgacctgctggagctgctggtgcctggggtgtccaagaagcccagcctgtctgtgcagcccggccctgtggtggcccctggagagagcctgaccctgcagtgtgtgtctgatgtgggctatgacagatttgtgctgtacaaggagggggagcgggacctgcggcagctgcccggccggcagccccaggccggcctgagccaggccaacttcaccctgggccctgtgagccgctcctatggaggccagtaccgctgctatggagcccacaacctgagcagtgaatgttctgcccccagcgaccccctggacatcctgatcaccggccagatccggggcacccccttcatctctgtgcagcccggccccaccgtggccagcggagaaaatgtgaccctgctgtgccagagctggaggcagttccacaccttcctgctgaccaaggccggggctgctgatgcccccctgcggctgcggagcatccacgagtaccccaagtaccaggccgagttccccatgagccctgtgaccagcgcccatgctggcacctaccgctgctacggcagcctgaacagcgacccctacctgctgagccaccccagcgagcccctggagctggtggtgtctggccccagcatgggcagcagccccccacccaccggccccatcagcaccccaggccctgaggaccagcccctgacccccaccggcagtgacccccagagcggcctgggccgccacctgggcgtggtgattggcatcctggtggccgtggtgctgctgctgctgctgctgctgctgctcttcctgatcctgcggcaccggcggcagggcaagcactggaccagcacccagaggaaggctgacttccagcaccctgctggagctgtgggccctgagcccacagaccggggcctgcagtggaggagcagccctgctgctgatgcccaggaggagaacctgtatgctgctgtgaaggacacccagccagaagatggagtggagatggacaccagggctgctgccagcgaggccccccaggatgtgacctacgcccagctgcacagcctgaccctgcggaggaaggccacagagcccccacccagccaggagcgggagcccccagctgagcccagcatctatgccaccctggccatccactag

SEQ ID NO: 157627 - DNA, 1899 bp, Artificial Sequence
  Description of Artificial Sequence: Synthetic coding sequence
atgaccccagccctgacagccctgctgtgcctgggcctgagcctgggccccaggaccagggtgcaggccggccccttccccaagcccaccctgtgggccgagcccggcagcgtcatctcctggggcagccctgtgaccatctggtgccagggcagccaggaggcccaggagtaccgcctgcacaaggagggcagccctgagcccctggacaggaacaaccccctggagcccaagaacaaggcccgcttcagcatccccagcatgacagagcaccacgccggccgctaccgctgccactactacagcagcgctggctggagcgagcccagcgaccccctggagatggtgatgaccggggcctacagcaagcccaccctgagcgccctgcccagccctgtggtggccagcggcggcaacatgaccctgcgctgtggcagccagaagggctaccaccactttgtgctgatgaaggagggggagcaccagctgcccaggaccctggacagccagcagctgcacagccggggcttccaggccctcttccctgtgggccctgtgacccccagccaccgctggaggttcacctgctactactactacaccaacaccccctgggtgtggagccaccccagcgaccccctggagatcctgcccagcggcgtgtccaggaagcccagcctgctgaccctgcagggccctgtgctggcccctggccagagcctgaccctgcagtgtggcagtgatgtgggctacaacagatttgtgctgtacaaggagggggagcgggacttcctgcagaggcctggccagcagccccaggccggcctgagccaggccaacttcaccctgggccctgtgagccccagcaatggaggccagtaccgctgctatggagcccacaacctgagcagcgagtggagcgcccccagcgaccccctgaacatcctgatggccggccagatctatgacacagtgtccctgagcgcccagcccggccccaccgtggccagcggagaaaatgtgaccctgctgtgccagagctggtggcagtttgacaccttcctgctgaccaaggagggcgccgcccacccccccctgcggctgcgctccatgtacggggcccacaagtaccaggccgagttccccatgagccctgtgaccagcgcccatgctggcacctaccgctgctacggcagctacagcagcaacccccacctgctgagccaccccagcgagcccctggagctggtggtgtctggccacagcggcggcagcagcctgccccccaccggcccccccagcaccccaggcctgggccgctacctggaggtgctgattggagtgtctgtggcctttgtgctgctgctcttcctgctgctcttcctgctgctgcggcggcagaggcacagcaagcacaggaccagtgaccagaggaagacagacttccagaggcctgctggagctgctgagacagagcccaaggaccggggcctgctgcggcgcagcagccctgctgctgatgtgcaggaggagaacctgtatgctgctgtgaaggacacccagagtgaagatagagtggagctggacagccagcagagcccccatgatgaggacccccaggccgtgacctacgcccctgtgaagcacagcagcccccggcgggagatggccagcccccccagcagcctgagcggggagttcctggacaccaaggaccggcaggtggaggaggaccggcagatggacacagaagctgctgccagcgaggccagccaggatgtgacctacgcccagctgcacagcctgaccctgcggaggaaggccacagagcccccacccagccaggagggggagcccccagctgagcccagcatctatgccaccctggccatccactag

SEQ ID NO: 157628 - DNA, 1344 bp, Artificial Sequence
  Description of Artificial Sequence: Synthetic coding sequence
atgatccccaccttcaccgccctgctgtgcctgggcctgagcctgggccccaggacccacatgcaggccggccccctgcccaagcccaccctgtgggccgagcccggcagcgtcatctcctggggcaacagcgtgaccatctggtgccagggcaccctggaggcccgggagtaccgcctggacaaggaggagagccctgccccctgggaccggcagaaccccctggagcccaagaacaaggcccgcttcagcatccccagcatgacagaggactatgccggccgctaccgctgctactaccgcagccctgtgggctggagccagcccagcgaccccctggagctggtgatgaccggggcctacagcaagcccaccctgagcgccctgcccagccccctggtgaccagcggcaagtctgtgaccctgctgtgccagagccgcagccccatggacaccttcctgctgatcaaggagcgggccgcccaccccctgctgcacctgcggagtgaacatggagcccagcagcaccaggccgagttccccatgagccctgtgacctctgtgcatggaggcacctaccgctgcttcagcagccacggcttcagccactacctgctgagccaccccagcgaccccctggagctgattgtgtctggcagcctggaggacccccggcccagccccaccaggtctgtgtccacagctgctggccctgaggaccagcccctgatgcccaccggctctgtgccccacagcggcctgcggcggcactgggaggtgctgattggagtgctggtggtgtccatcctgctgctgagcctgctgctcttcctgctgctgcagcactggaggcagggcaagcacaggaccctggcccagaggcaggccgacttccagaggcctcctggagctgctgagcctgagcccaaggatggcggcctgcagaggaggagcagccctgctgctgatgtgcagggcgagaacttctgtgccgctgtgaagaacacccagccagaagatggagtggagatggacaccaggagcccccatgatgaggacccccaggccgtgacctacgccaaggtgaagcacagccggccccggcgggagatggccagcccccccagccccctgtctggagagttcctggacaccaaggaccggcaggccgaggaggaccggcagatggacacagaggccgccgccagcgaggccccccaggatgtgacctacgcccagctgcacagcttcaccctgcggcagaaggccacagagcccccacccagccaggagggcgccagccctgctgagcccagcgtgtatgccaccctggccatccactag

SEQ ID NO: 157629 - DNA, 1476 bp, Artificial Sequence
  Description of Artificial Sequence: Synthetic coding sequence
atgaccctgaccctgtctgtgctgatctgcctgggcctgtctgtgggccccaggacctgtgtgcaggccggcaccctgcccaagcccaccctgtgggccgagcccgcctctgtgattgcccggggcaagcctgtgaccctgtggtgccagggccccctggagacagaggagtaccgcctggacaaggagggcctgccctgggccaggaagaggcagaaccccctggagcccggggccaaggccaagttccacatccccagcacagtgtatgacagcgctggccgctaccgctgctactatgagaccccagctggctggagcgagcccagcgaccccctggagctggtggccaccggggtgtccaggaagcccagcctgctgatcccccagggctctgtggtggcccggggcggcagcctgaccctgcagtgccgcagtgatgtgggctatgacatctttgtgctgtacaaggagggggagcatgacctggtgcagggcagcggccagcagccccaggccggcctgagccaggccaacttcaccctgggccctgtgagccgcagccatggaggccagtaccgctgctacggggcccacaacctgagcccccgctggagcgcccccagcgaccccctggacatcctgattgctggcctcatcccagacatcccagccctgtctgtgcagcccggccccaaggtggccagcggggagaatgtgaccctgctgtgccagagctggcaccagattgacaccttcttcctgaccaaggagggcgccgcccacccccccctgtgcctgaagagcaagtaccagagctaccgccaccaggccgagttctccatgagccctgtgaccagcgcccagggcggcacctaccgctgctacagcgccatccgcagctacccctacctgctgagcagccccagctacccccaggagctggtggtgtctggccccagcggggaccccagcctgagccccaccggcagcacccccaccccagctggccctgaggaccagcccctgacccccaccggcctggacccccagagcggcctgggccgccacctgggcgtggtgactggagtgtctgtggcctttgtgctgctgctcttcctgctgctcttcctgctgctgcggcaccgccaccagagcaagcacaggaccagcgcccacttctacagacctgctggagctgctggccctgagcccaaggaccagggcctgcagaagagggccagccctgtggccgacatccaggaggagatcctgaatgctgctgtgaaggacacccagcccaaggatggagtggagatggatgcccgggctgctgccagcgaggccccccaggatgtgacctacgcccagctgcacagcctgaccctgcggcgggaggccacagagcccccacccagccaggagcgggagcccccagctgagcccagcatctatgcccccctggccatccactag

SEQ ID NO: 157630 - DNA, 1470 bp, Artificial Sequence
  Description of Artificial Sequence: Synthetic coding sequence
atgacccccatcgtgacagtgctgatctgcctgcggctgagcctgggccccaggacccacgtgcaggccggcaccctgcccaagcccaccctgtgggccgagcccggcagcgtcatcacccagggcagccctgtgaccctgtggtgccagggcatcctggagacccaggagtaccgcctgtaccgggagaagaagacagccccctggatcacccgcatcccccaggagatcgtgaagaagggccagttccccatccccagcatcacctgggagcacacaggccgctaccgctgcttctacggcagccacacagctggctggagcgagcccagcgaccccctggagctggtggtgactggagcctacatcaagcccaccctgagcgccctgcccagccctgtggtgaccagcggcggcaatgtgaccctgcactgtgtgtcccaggtggccttcggcagcttcatcctgtgcaaggagggagaagatgagcacccccagtgcctgaacagccagcccaggacccacggctggagccgggccatcttctctgtgggccctgtgagccccagccgccgctggagctaccgctgctacgcctatgacagcaacagcccccacgtgtggagcctgcccagcgacctgctggagctgctggtgctgggcgtgtccaagaagcccagcctgtctgtgcagcccggccccatcgtggcccctggagagagcctgaccctgcagtgtgtgtctgatgtgtcctatgacagatttgtgctgtacaaggagggggagcgggacttcctgcagctgcccggcccccagccccaggccggcctgagccaggccaacttcaccctgggccctgtgagccgctcctatggaggccagtaccgctgcagcggggcctacaacctgagcagcgagtggagcgcccccagcgaccccctggacatcctgattgctggccagttccggggccggcccttcatctctgtgcaccctggccccaccgtggccagcggggagaatgtgaccctgctgtgccagagctggggccccttccacaccttcctgctgaccaaggccggggctgctgatgcccccctgcggctgcggagcatccacgagtaccccaagtaccaggccgagttccccatgagccctgtgaccagcgcccacagcggcacctaccgctgctacggcagcctgagcagcaacccctacctgctgagccaccccagcgacagcctggagctgatggtgtctggagctgctgagaccctgagccccccccagaacaagagtgacagcaaggccggggccgccaacaccctgagccccagccagaacaagacagccagccacccccaggactacacagtggagaacctgatccgcatgggcattgctggcctggtgctggtggtgctgggcatcctgctgtttgaggcccagcacagccagaggagcctgtag

SEQ ID NO: 157631 - DNA, 1401 bp, Artificial Sequence
  Description of Artificial Sequence: Synthetic coding sequence
atgacccccatcctgactgtgctgatctgcctgggcctgagcctgggccccaggacccacgtgcaggccggccacctgcccaagcccaccctgtgggccgagcccggcagcgtcatcatccagggcagccctgtgaccctgcgctgccagggcagcctgcaggccgaggagtaccacctgtaccgggagaacaagagcgcctcctgggtgcggcgcatccaggagcccgggaagaatggccagttccccatccccagcatcacctgggagcacgccggccgctaccactgccagtactacagccacaaccacagcagcgagtacagcgaccccctggagctggtggtgactggagcctacagcaagcccaccctgagcgccctgcccagccctgtggtgaccctgggcggcaatgtgaccctgcagtgtgtgtcccaggtggcctttgatggcttcatcctgtgcaaggagggagaagatgagcacccccagaggctgaacagccacagccacgcccggggctggagctgggccatcttctctgtgggccctgtgagccccagccgccgctggagctaccgctgctacgcctatgacagcaacagcccctacgtgtggagcctgcccagcgacctgctggagctgctggtgcctggggtgtccaagaagcccagcctgtctgtgcagcccggccccatggtggcccctggagagagcctgaccctgcagtgtgtgtctgatgtgggctatgacagatttgtgctgtacaaggagggggagcgggacttcctgcagaggcctggctggcagccccaggccggcctgagccaggccaacttcaccctgggccctgtgagccccagccatggaggccagtaccgctgctacagcgcccacaacctgagcagcgagtggagcgcccccagcgaccccctggacatcctgatcaccggccagttctatgaccggcccagcctgtctgtgcagcctgtgcccaccgtggcccctgggaagaatgtgaccctgctgtgccagagccggggccagttccacaccttcctgctgaccaaggagggcgccggccacccccccctgcacctgcggtctgagcaccaggcccagcagaaccaggccgagttcaggatgggccctgtgaccagcgcccacgtgggcacctaccgctgctacagcagcctgagcagcaacccctacctgctgagcctgcccagcgaccccctggagctggtggtgtctgccagcctgggccagcacccccaggactacacagtggagaacctgatccgcatgggcgtggccggcctggtgctggtggtgctgggcatcctgctgtttgaggcccagcacagccagaggagcctgcaggatgctgctggccgctag

SEQ ID NO: 157632 - DNA, 1452 bp, Artificial Sequence
  Description of Artificial Sequence: Synthetic coding sequence
atgacccccatcctgactgtgctgatctgcctgggcctgagcctgggccccaggacccacgtgcaggccggccacctgcccaagcccaccctgtgggccgagcccggcagcgtcatcatccagggcagccctgtgaccctgcgctgccagggcagcctgcaggccgaggagtaccacctgtaccgggagaacaagagcgcctcctgggtgcggcgcatccaggagcccgggaagaatggccagttccccatccccagcatcacctgggagcacgccggccgctaccactgccagtactacagccacaaccacagcagcgagtacagcgaccccctggagctggtggtgactggagcctacagcaagcccaccctgagcgccctgcccagccctgtggtgaccctgggcggcaatgtgaccctgcagtgtgtgtcccaggtggcctttgatggcttcatcctgtgcaaggagggagaagatgagcacccccagaggctgaacagccacagccacgcccggggctggagctgggccatcttctctgtgggccctgtgagccccagccgccgctggagctaccgctgctacgcctatgacagcaacagcccctacgtgtggagcctgcccagcgacctgctggagctgctggtgcctggggtgtccaagaagcccagcctgtctgtgcagcccggccccatggtggcccctggagagagcctgaccctgcagtgtgtgtctgatgtgggctatgacagatttgtgctgtacaaggagggggagcgggacttcctgcagaggcctggctggcagccccaggccggcctgagccaggccaacttcaccctgggccctgtgagccccagccatggaggccagtaccgctgctacagcgcccacaacctgagcagcgagtggagcgcccccagcgaccccctggacatcctgatcaccggccagttctatgaccggcccagcctgtctgtgcagcctgtgcccaccgtggcccctgggaagaatgtgaccctgctgtgccagagccggggccagttccacaccttcctgctgaccaaggagggcgccggccacccccccctgcacctgcggtctgagcaccaggcccagcagaaccaggccgagttcaggatgggccctgtgaccagcgcccacgtgggcacctaccgctgctacagcagcctgagcagcaacccctacctgctgagcctgcccagcgaccccctggagctggtggtgtctgaggccgctgagaccctgagccccagccagaacaagacagacagcaccaccaccagcctgggccagcacccccaggactacacagtggagaacctgatccgcatgggcgtggccggcctggtgctggtggtgctgggcatcctgctgtttgaggcccagcacagccagaggagcctgcaggatgctgctggaagatag

SEQ ID NO: 157633 - DNA, 1452 bp, Artificial Sequence; identical to SEQ ID NO: 157632
  Description of Artificial Sequence: Synthetic coding sequence

SEQ ID NO: 157634 - DNA, 984 bp, Artificial Sequence
  Description of Artificial Sequence: Synthetic coding sequence
atgacccccatcctgactgtgctgatctgcctgggcctgagcctgggccccaggacccacgtgcaggccggccacctgcccaagcccaccctgtgggccgagcccggcagcgtcatcatccagggcagccctgtgaccctgcgctgccagggcagcctgcaggccgaggagtaccacctgtaccgggagaacaagagcgcctcctgggtgcggcgcatccaggagcccgggaagaatggccagttccccatccccagcatcacctgggagcacgccggccgctaccactgccagtactacagccacaaccacagcagcgagtacagcgaccccctggagctggtggtgactggagcctacagcaagcccaccctgagcgccctgcccagccctgtggtgaccctgggcggcaatgtgaccctgcagtgtgtgtcccaggtggcctttgatggcttcatcctgtgcaaggagggagaagatgagcacccccagaggctgaacagccacagccacgcccggggctggagctgggccatcttctctgtgggccctgtgagccccagccgccgctggagctaccgctgctacgcctatgacagcaacagcccctacgtgtggagcctgcccagcgacctgctggagctgctggtgcctggggtgtccaagaagcccagcctgtctgtgcagcccggccccatggtggcccctggagagagcctgaccctgcagtgtgtgtctgatgtgggctatgacagatttgtgctgtacaaggagggggagcgggacttcctgcagaggcctggctggcagccccaggccggcctgagccaggccaacttcaccctgggccctgtgagccccagccatggaggccagtaccgctgctacagcgcccacaacctgagcagcgagtggagcgcccccagcgaccccctggacatcctgatcaccggccagttctatgaccggcccagcctgtcctag

SEQ ID NO: 157635 - DNA, 1320 bp, Artificial Sequence
  Description of Artificial Sequence: Synthetic coding sequence
atgacccccatcctgactgtgctgatctgcctgggcctgagcctggaccccaggacccacgtgcaggccggccccctgcccaagcccaccctgtgggccgagcccggcagcgtcatcacccagggcagccctgtgaccctgcgctgccagggcagcctggagacccaggagtaccacctgtaccgggagaagaagacagccctgtggatcacccgcatcccccaggagctggtgaagaagggccagttccccatcctgagcatcacctgggagcacgccggccgctactgctgcatctacggcagccacacagctggcctgtctgagagcagtgaccccctggagctggtggtgactggagcctacagcaagcccaccctgagcgccctgcccagccctgtggtgaccagcggcggcaatgtgaccatccagtgtgacagccaggtggcctttgatggcttcatcctgtgcaaggagggagaagatgagcacccccagtgcctgaacagccacagccacgcccggggcagcagccgggccatcttctctgtgggccctgtgagccccagccgccgctggagctaccgctgctacggctatgacagccgggccccctacgtgtggagcctgcccagcgacctgctgggcctgctggtgcctggggtgtccaagaagcccagcctgtctgtgcagcccggccctgtggtggcccctggagagaagctgaccttccagtgtggcagtgatgctggctatgacagatttgtgctgtacaaggagtggggccgggacttcctgcagaggcctggccggcagccccaggccggcctgagccaggccaacttcaccctgggccctgtgagccgctcctatggaggccagtacacctgcagcggggcctacaacctgagcagcgagtggagcgcccccagcgaccccctggacatcctgatcaccggccagatccgggcccggcccttcctgtctgtgcggcccggccccaccgtggccagcggggagaatgtgaccctgctgtgccagagccagggcggcatgcacaccttcctgctgaccaaggagggcgctgctgacagccccctgcggctgaagagcaagaggcagagccacaagtaccaggccgagttccccatgagccctgtgaccagcgcccacgccggcacctaccgctgctacggcagcctgagcagcaacccctacctgctgacccaccccagcgaccccctggagctggtggtgtctggagctgctgagaccctgagccccccccagaacaagagtgacagcaaggccggggagtag

SEQ ID NO: 157636 - DNA, 1371 bp, Artificial Sequence
  Description of Artificial Sequence: Synthetic coding sequence
atgcaccggggcctcatccacccccagagcagcgctgtgggcggagatgccatgacccccatcctgactgtgctgatctgcctgggcctgagcctggaccccaggacccacgtgcaggccggccccctgcccaagcccaccctgtgggccgagcccggcagcgtcatcacccagggcagccctgtgaccctgcgctgccagggcagcctggagacccaggagtaccacctgtaccgggagaagaagacagccctgtggatcacccgcatcccccaggagctggtgaagaagggccagttccccatcctgagcatcacctgggagcacgccggccgctactgctgcatctacggcagccacacagctggcctgtctgagagcagtgaccccctggagctggtggtgactggagcctacagcaagcccaccctgagcgccctgcccagccctgtggtgaccagcggcggcaatgtgaccatccagtgtgacagccaggtggcctttgatggcttcatcctgtgcaaggagggggaggatgagcacccccagtgcctgaacagccacagccacgcccggggcagcagccgggccatcttctctgtgggccctgtgagccccagccgccgctggagctaccgctgctacggctatgacagccgggccccctacgtgtggagcctgcccagcgacctgctgggcctgctggtgcctggggtgtccaagaagcccagcctgtctgtgcagcccggccctgtggtggcccctggagagaagctgaccttccagtgtggcagtgatgctggctatgacagatttgtgctgtacaaggagtggggccgggacttcctgcagaggcctggccggcagccccaggccggcctgagccaggccaacttcaccctgggccctgtgagccgctcctatggaggccagtacacctgcagcggggcctacaacctgagcagcgagtggagcgcccccagcgaccccctggacatcctgatcaccggccagatccgggcccggcccttcctgtctgtgcggcccggccccaccgtggccagcggagaaaatgtgaccctgctgtgccagagccagggcggcatgcacaccttcctgctgaccaaggagggcgctgctgacagccccctgcggctgaagagcaagaggcagagccacaagtaccaggccgagttccccatgagccctgtgaccagcgcccatgctggcacctaccgctgctacggcagcctgagcagcaacccctacctgctgacccaccccagcgaccccctggagctggtggtgtctggagctgctgagaccctgagccccccccagaacaagagtgacagcaaggccggggagtag

SEQ ID NO: 157637 - DNA, 1959 bp, Artificial Sequence
  Description of Artificial Sequence: Synthetic coding sequence
atgacccccatcctgactgtgctgatctgcctgggcctgagcctgggccccaggacccacgtgcaggccggccacctgcccaagcccaccctgtgggccgagcccggcagcgtcatcacccagggcagccctgtgaccctgcgctgccagggcggccaggagacccaggagtaccgcctgtaccgggagaagaagacagccctgtggatcacccgcatcccccaggagctggtgaagaagggccagttccccatccccagcatcacctgggagcacgccggccgctaccgctgctactacggcagtgacacagctggccgctctgagagcagtgaccccctggagctggtggtgactggagcctacatcaagcccaccctgagcgcccagcccagccctgtggtgaacagcggcggcaatgtcatcctgcagtgtgacagccaggtggcctttgatggcttcagcctgtgcaaggagggagaagatgagcacccccagtgcctgaacagccagccccacgcccggggcagcagccgggccatcttctctgtgggccctgtgagccccagccgccgctggtggtaccgctgctacgcctatgacagcaacagcccctatgagtggagcctgcccagcgacctgctggagctgctggtgctgggcgtgtccaagaagcccagcctgtctgtgcagcccggccccatcgtggcccctgaggagaccctgaccctgcagtgtggcagtgatgctggctacaacagatttgtgctgtacaaggatggagagcgggacttcctgcagctggccggggcccagccccaggccggcctgagccaggccaacttcaccctgggccctgtgagccgctcctatggaggccagtaccgctgctacggggcccacaacctgagcagcgagtggagcgcccccagcgaccccctggacatcctgattgctggccagttctatgacagagtgtccctgtctgtgcagcccggccccaccgtggccagcggggagaatgtgaccctgctgtgccagagccagggctggatgcagaccttcctgctgaccaaggagggcgctgctgatgacccctggaggctgcggagcacctaccagagccagaagtaccaggccgagttccccatgggccctgtgaccagcgcccacgccggcacctaccgctgctacggcagccagagcagcaagccctacctgctgacccaccccagcgaccccctggagctggtggtgtctggccccagcggcggccccagcagccccaccaccggccccaccagcaccagcgctggccctgaggaccagcccctgacccccaccggcagtgacccccagagcggcctgggccgccacctgggcgtggtgattggcatcctggtggccgtcatcctgctgctgctgctgctgctgctgctcttcctgatcctgcggcaccggcggcagggcaagcactggaccagcacccagaggaaggctgacttccagcaccctgctggagctgtgggccctgagcccacagaccggggcctgcagtggaggagcagccctgctgctgatgcccaggaggagaacctgtatgctgctgtgaagcacacccagccagaagatggagtggagatggacacccggcagagcccccatgatgaggacccccaggccgtgacctatgcagaggtgaagcacagccggccccggcgggagatggccagcccccccagccccctgagcggggagttcctggacaccaaggaccggcaggccgaggaggaccggcagatggacacagaagctgctgccagcgaggccccccaggatgtgacctacgcccagctgcacagcctgaccctgcggcgggaggccacagagcccccacccagccaggagggccccagccctgctgtgcccagcatctatgccaccctggccatccactag

SEQ ID NO: 157638 - DNA, 1953 bp, Artificial Sequence
  Description of Artificial Sequence: Synthetic coding sequence
atgacccccatcctgactgtgctgatctgcctgggcctgagcctgggccccaggacccacgtgcaggccggccacctgcccaagcccaccctgtgggccgagcccggcagcgtcatcacccagggcagccctgtgaccctgcgctgccagggcggccaggagacccaggagtaccgcctgtaccgggagaagaagacagccctgtggatcacccgcatcccccaggagctggtgaagaagggccagttccccatccccagcatcacctgggagcacgccggccgctaccgctgctactacggcagtgacacagctggccgctctgagagcagtgaccccctggagctggtggtgactggagcctacatcaagcccaccctgagcgcccagcccagccctgtggtgaacagcggcggcaatgtcatcctgcagtgtgacagccaggtggcctttgatggcttcagcctgtgcaaggagggagaagatgagcacccccagtgcctgaacagccagccccacgcccggggcagcagccgggccatcttctctgtgggccctgtgagccccagccgccgctggtggtaccgctgctacgcctatgacagcaacagcccctatgagtggagcctgcccagcgacctgctggagctgctggtgctgggcgtgtccaagaagcccagcctgtctgtgcagcccggccccatcgtggcccctgaggagaccctgaccctgcagtgtggcagtgatgctggctacaacagatttgtgctgtacaaggatggagagcgggacttcctgcagctggccggggcccagccccaggccggcctgagccaggccaacttcaccctgggccctgtgagccgctcctatggaggccagtaccgctgctacggggcccacaacctgagcagcgagtggagcgcccccagcgaccccctggacatcctgattgctggccagttctatgacagagtgtccctgtctgtgcagcccggccccaccgtggccagcggggagaatgtgaccctgctgtgccagagccagggctggatgcagaccttcctgctgaccaaggagggcgctgctgatgacccctggaggctgcggagcacctaccagagccagaagtaccaggccgagttccccatgggccctgtgaccagcgcccacgccggcacctaccgctgctacggcagccagagcagcaagccctacctgctgacccaccccagcgaccccctggagctggtggtgtctggccccagcggcggccccagcagccccaccaccggccccaccagcaccagcggccctgaggaccagcccctgacccccactggaagtgacccccagagcggcctgggccgccacctgggcgtggtgattggcatcctggtggccgtcatcctgctgctgctgctgctgctgctgctcttcctgatcctgcggcaccggcggcagggcaagcactggaccagcacccagaggaaggctgacttccagcaccctgctggagctgtgggccctgagcccacagaccggggcctgcagtggaggagcagccctgctgctgatgcccaggaggagaacctgtatgctgctgtgaagcacacccagccagaagatggagtggagatggacaccaggagcccccatgatgaggacccccaggccgtgacctatgcagaggtgaagcacagccggccccggcgggagatggccagcccccccagccccctgagcggggagttcctggacaccaaggaccggcaggccgaggaggaccggcagatggacacagaagctgctgccagcgaggccccccaggatgtgacctacgcccagctgcacagcctgaccctgcggcgggaggccacagagcccccacccagccaggagggccccagccctgctgtgcccagcatctatgccaccctggccatccactag

SEQ ID NO: 157639 - DNA, 1953 bp, Artificial Sequence; identical to SEQ ID NO: 157638
  Description of Artificial Sequence: Synthetic coding sequence

SEQ ID NO: 157640 - DNA, 1905 bp, Artificial Sequence
  Description of Artificial Sequence: Synthetic coding sequence
atgacccccatcctgactgtgctgatctgcctgggcctgagcctgggccccaggacccacgtgcaggccggccacctgcccaagcccaccctgtgggccgagcccggcagcgtcatcacccagggcagccctgtgaccctgcgctgccagggcggccaggagacccaggagtaccgcctgtaccgggagaagaagacagccctgtggatcacccgcatcccccaggagctggtgaagaagggccagttccccatccccagcatcacctgggagcacgccggccgctaccgctgctactacggcagtgacacagctggccgctctgagagcagtgaccccctggagctggtggtgactggagcctacatcaagcccaccctgagcgcccagcccagccctgtggtgaacagcggcggcaatgtcatcctgcagtgtgacagccaggtggcctttgatggcttcagcctgtgcaaggagggagaagatgagcacccccagtgcctgaacagccagccccacgcccggggcagcagccgggccatcttctctgtgggccctgtgagccccagccgccgctggtggtaccgctgctacgcctatgacagcaacagcccctatgagtggagcctgcccagcgacctgctggagctgctggtgctgggcgtgtccaagaagcccagcctgtctgtgcagcccggccccatcgtggcccctgaggagaccctgaccctgcagtgtggcagtgatgctggctacaacagatttgtgctgtacaaggatggagagcgggacttcctgcagctggccggggcccagccccaggccggcctgagccaggccaacttcaccctgggccctgtgagccgctcctatggaggccagtaccgctgctacggggcccacaacctgagcagcgagtggagcgcccccagcgaccccctggacatcctgattgctggccagttctatgacagagtgtccctgtctgtgcagcccggccccaccgtggccagcggggagaatgtgaccctgctgtgccagagccagggctggatgcagaccttcctgctgaccaaggagggcgctgctgatgacccctggaggctgcggagcacctaccagagccagaagtaccaggccgagttccccatgggccctgtgaccagcgcccacgccggcacctaccgctgctacggcagccagagcagcaagccctacctgctgacccaccccagcgaccccctggagctggtggtgtctgctggccctgaggaccagcccctgacccccactggaagtgacccccagagcggcctgggccgccacctgggcgtggtgattggcatcctggtggccgtcatcctgctgctgctgctgctgctgctgctcttcctgatcctgcggcaccggcggcagggcaagcactggaccagcacccagaggaaggctgacttccagcaccctgctggagctgtgggccctgagcccacagaccggggcctgcagtggaggagcagccctgctgctgatgcccaggaggagaacctgtatgctgctgtgaagcacacccagccagaagatggagtggagatggacaccaggagcccccatgatgaggacccccaggccgtgacctatgcagaggtgaagcacagccggccccggcgggagatggccagcccccccagccccctgagcggggagttcctggacaccaaggaccggcaggccgaggaggaccggcagatggacacagaagctgctgccagcgaggccccccaggatgtgacctacgcccagctgcacagcctgaccctgcggcgggaggccacagagcccccacccagccaggagggccccagccctgctgtgcccagcatctatgccaccctggccatccactag

SEQ ID NO: 157641 - DNA, 1953 bp, Artificial Sequence; identical to SEQ ID NO: 157638
  Description of Artificial Sequence: Synthetic coding sequence

SEQ ID NO: 157642 - DNA, 1533 bp, Artificial Sequence
  Description of Artificial Sequence: Synthetic coding sequence
atgacccccatcctgactgtgctgatctgcctgggcctgagcctgggccccaggacccacgtgcaggccggccacctgcccaagcccaccctgtgggccgagcccggcagcgtcatcacccagggcagccctgtgaccctgcgctgccagggcggccaggagacccaggagtaccgcctgtaccgggagaagaagacagccctgtggatcacccgcatcccccaggagctggtgaagaagggccagttccccatccccagcatcacctgggagcacgccggccgctaccgctgctactacggcagtgacacagctggccgctctgagagcagtgaccccctggagctggtggtgactggagcctacatcaagcccaccctgagcgcccagcccagccctgtggtgaacagcggcggcaatgtcatcctgcagtgtgacagccaggtggcctttgatggcttcagcctgtgcaaggagggagaagatgagcacccccagtgcctgaacagccagccccacgcccggggcagcagccgggccatcttctctgtgggccctgtgagccccagccgccgctggtggtaccgctgctacgcctatgacagcaacagcccctatgagtggagcctgcccagcgacctgctggagctgctggtgctgggcgtgtccaagaagcccagcctgtctgtgcagcccggccccatcgtggcccctgaggagaccctgaccctgcagtgtggcagtgatgctggctacaacagatttgtgctgtacaaggatggagagcgggacttcctgcagctggccggggcccagccccaggccggcctgagccaggccaacttcaccctgggccctgtgagccgctcctatggaggccagtaccgctgctacggggcccacaacctgagcagcgagtggagcgcccccagcgaccccctggacatcctgattgctggccagttctatgacagagtgtccctgtctgtgcagcccggccccaccgtggccagcggggagaatgtgaccctgctgtgccagagccagggctggatgcagaccttcctgctgaccaaggagggcgctgctgatgacccctggaggctgcggagcacctaccagagccagaagtaccaggccgagttccccatgggccctgtgaccagcgcccacgccggcacctaccgctgctacggcagccagagcagcaagccctacctgctgacccaccccagcgaccccctggagctggtggtgtctggccccagcggcggccccagcagccccaccaccggccccaccagcaccagcggccctgaggaccagcccctgacccccactggaagtgacccccagagcggcctgggccgccacctgggcgtggtgattggcatcctggtggccgtcatcctgctgctgctgctgctgctgctgctcttcctgatcctgcggcaccggcggcagggcaagcactggaccagcagccctgcccagctgcccatgcccaggaagaagacctccatgctgccctag

SEQ ID NO: 157643 - DNA, 1797 bp, Artificial Sequence
  Description of Artificial Sequence: Synthetic coding sequence
atgacccccatcgtgacagtgctgatctgcctgggcctgagcctgggccccaggacccacgtgcagacaggcaccatccccaagcccaccctgtgggccgagccagattctgtcatcacccagggcagccctgtgaccctgagctgccagggcagcctggaggcccaggagtaccgcctgtaccgggagaagaagagcgcctcctggatcacccgcatccggcctgagctggtgaagaatggccagttccacatccccagcatcacctgggagcacacaggccgctatggctgccagtactacagccgggcccgctggagcgagctgagtgaccccctggtgctggtgatgaccggggcctaccccaagcccaccctgagcgcccagcccagccctgtggtgaccagcggcggccgggtgaccctgcagtgtgagagccaggtggccttcggcggcttcatcctgtgcaaggagggggaggaggagcacccccagtgcctgaacagccagccccacgcccggggcagcagccgggccatcttctctgtgggccctgtgagccccaacagacgctggagccaccgctgctacggctatgacctgaacagcccctacgtgtggagcagccccagcgacctgctggagctgctggtgcctggggtgtccaagaagcccagcctgtctgtgcagcccggccctgtggtggcccctggagagagcctgaccctgcagtgtgtgtctgatgtgggctatgacagatttgtgctgtacaaggagggggagcgggacctgcggcagctgcccggccggcagccccaggccggcctgagccaggccaacttcaccctgggccctgtgagccgctcctatggaggccagtaccgctgctatggagcccacaacctgagcagtgaatgttctgcccccagcgaccccctggacatcctgatcaccggccagatccggggcacccccttcatctctgtgcagcccggccccaccgtggccagcggagaaaatgtgaccctgctgtgccagagctggaggcagttccacaccttcctgctgaccaaggccggggctgctgatgcccccctgcggctgcggagcatccacgagtaccccaagtaccaggccgagttccccatgagccctgtgaccagcgcccatgctggcacctaccgctgctacggcagcctgaacagcgacccctacctgctgagccaccccagcgagcccctggagctggtggtgtctggccccagcatgggcagcagccccccacccaccggccccatcagcaccccagctggccctgaggaccagcccctgacccccactggaagtgacccccagagcggcctgggccgccacctgggcgtggtgattggcatcctggtggccgtggtgctgctgctgctgctgctgctgctgctcttcctgatcctgcggcaccggcggcagggcaagcactggaccagcacccagaggaaggctgacttccagcaccctgctggagctgtgggccctgagcccacagaccggggcctgcagtggaggagcagccctgctgctgatgcccaggaggagaacctgtatgctgctgtgaaggacacccagccagaagatggagtggagatggacaccagggctgctgccagcgaggccccccaggatgtgacctacgcccagctgcacagcctgaccctgcggaggaaggccacagagcccccacccagccaggagcgggagcccccagctgagcccagcatctatgccaccctggccatccactag

SEQ ID NO: 157644 - DNA, 1449 bp, Artificial Sequence
  Description of Artificial Sequence: Synthetic coding sequence
atgaccggggcctaccccaagcccaccctgagcgcccagcccagccctgtggtgaccagcggcggccgggtgaccctgcagtgtgagagccaggtggccttcggcggcttcatcctgtgcaaggagggggaggaggagcacccccagtgcctgaacagccagccccacgcccggggcagcagccgggccatcttctctgtgggccctgtgagccccaacagacgctggagccaccgctgctacggctatgacctgaacagcccctacgtgtggagcagccccagcgacctgctggagctgctggtgcctggggtgtccaagaagcccagcctgtctgtgcagcccggccctgtggtggcccctggagagagcctgaccctgcagtgtgtgtctgatgtgggctatgacagatttgtgctgtacaaggagggggagcgggacctgcggcagctgcccggccggcagccccaggccggcctgagccaggccaacttcaccctgggccctgtgagccgctcctatggaggccagtaccgctgctatggagcccacaacctgagcagtgaatgttctgcccccagcgaccccctggacatcctgatcaccggccagatccggggcacccccttcatctctgtgcagcccggccccaccgtggccagcggagaaaatgtgaccctgctgtgccagagctggaggcagttccacaccttcctgctgaccaaggccggggctgctgatgcccccctgcggctgcggagcatccacgagtaccccaagtaccaggccgagttccccatgagccctgtgaccagcgcccatgctggcacctaccgctgctacggcagcctgaacagcgacccctacctgctgagccaccccagcgagcccctggagctggtggtgtctggccccagcatgggcagcagccccccacccaccggccccatcagcaccccagctggccctgaggaccagcccctgacccccactggaagtgacccccagagcggcctgggccgccacctgggcgtggtgattggcatcctggtggccgtggtgctgctgctgctgctgctgctgctgctcttcctgatcctgcggcaccggcggcagggcaagcactggaccagcacccagaggaaggctgacttccagcaccctgctggagctgtgggccctgagcccacagaccggggcctgcagtggaggagcagccctgctgctgatgcccaggaggagaacctgtatgctgctgtgaaggacacccagccagaagatggagtggagatggacaccagggctgctgccagcgaggccccccaggatgtgacctacgcccagctgcacagcctgaccctgcggaggaaggccacagagcccccacccagccaggagcgggagcccccagctgagcccagcatctatgccaccctggccatccactag

SEQ ID NO: 157645 - DNA, 1932 bp, Artificial Sequence
  Description of Artificial Sequence: Synthetic coding sequence
atgaccccagccctgacagccctgctgtgcctgggcctgagcctgggccccaggaccagggtgcaggccggccccttccccaagcccaccctgtgggccgagcccggcagcgtcatctcctggggcagccctgtgaccatctggtgccagggcagccaggaggcccaggagtaccgcctgcacaaggagggcagccctgagcccctggacaggaacaaccccctggagcccaagaacaaggcccgcttcagcatccccagcatgacagagcaccacgccggccgctaccgctgccactactacagcagcgctggctggagcgagcccagcgaccccctggagatggtgatgaccggggcctacagcaagcccaccctgagcgccctgcccagccctgtggtggccagcggcggcaacatgaccctgcgctgtggcagccagaagggctaccaccactttgtgctgatgaaggagggggagcaccagctgcccaggaccctggacagccagcagctgcacagccggggcttccaggccctcttccctgtgggccctgtgacccccagccaccgctggaggttcacctgctactactactacaccaacaccccctgggtgtggagccaccccagcgaccccctggagatcctgcccagcggcgtgtccaggaagcccagcctgctgaccctgcagggccctgtgctggcccctggccagagcctgaccctgcagtgtggcagtgatgtgggctacaacagatttgtgctgtacaaggagggggagcgggacttcctgcagaggcctggccagcagccccaggccggcctgagccaggccaacttcaccctgggccctgtgagccccagcaatggaggccagtaccgctgctatggagcccacaacctgagcagcgagtggagcgcccccagcgaccccctgaacatcctgatggccggccagatctatgacacagtgtccctgagcgcccagcccggccccaccgtggccagcggagaaaatgtgaccctgctgtgccagagctggtggcagtttgacaccttcctgctgaccaaggagggcgccgcccacccccccctgcggctgcgctccatgtacggggcccacaagtaccaggccgagttccccatgagccctgtgaccagcgcccatgctggcacctaccgctgctacggcagctacagcagcaacccccacctgctgagccaccccagcgagcccctggagctggtggtgtctggccctgaggaccagcccctgaaccccccaggcagcggcccccagaaccccccaggcctgggcagcggggccggcaccagggctgctggcctgggccgctacctggaggtgctgattggagtgtctgtggcctttgtgctgctgctcttcctgctgctcttcctgctgctgcggcggcagaggcacagcaagcacaggaccagtgaccagaggaagacagacttccagaggcctgctggagctgctgagacagagcccaaggaccggggcctgctgcggcgcagcagccctgctgctgatgtgcaggaggagaacctgtatgctgctgtgaaggacacccagagtgaagatagagtggagctggacagccagagcccccatgatgaggacccccaggccgtgacctacgcccctgtgaagcacagcagcccccggcgggagatggccagcccccccagcagcctgtctggagagttcctggacaccaaggaccggcaggtggaggaggaccggcagatggacacagaggccgccgccagcgaggccagccaggatgtgacctacgcccagctgcacagcctgaccctgcggaggaaggccacagagcccccacccagccaggagggggagcccccagctgagcccagcatctatgccaccctggccatccactag

SEQ ID NO: 157646 - DNA, 1896 bp, Artificial Sequence
  Description of Artificial Sequence: Synthetic coding sequence
atgaccccagccctgacagccctgctgtgcctgggcctgagcctgggccccaggaccagggtgcaggccggccccttccccaagcccaccctgtgggccgagcccggcagcgtcatctcctggggcagccctgtgaccatctggtgccagggcagccaggaggcccaggagtaccgcctgcacaaggagggcagccctgagcccctggacaggaacaaccccctggagcccaagaacaaggcccgcttcagcatccccagcatgacagagcaccacgccggccgctaccgctgccactactacagcagcgctggctggagcgagcccagcgaccccctggagatggtgatgaccggggcctacagcaagcccaccctgagcgccctgcccagccctgtggtggccagcggcggcaacatgaccctgcgctgtggcagccagaagggctaccaccactttgtgctgatgaaggagggggagcaccagctgcccaggaccctggacagccagcagctgcacagccggggcttccaggccctcttccctgtgggccctgtgacccccagccaccgctggaggttcacctgctactactactacaccaacaccccctgggtgtggagccaccccagcgaccccctggagatcctgcccagcggcgtgtccaggaagcccagcctgctgaccctgcagggccctgtgctggcccctggccagagcctgaccctgcagtgtggcagtgatgtgggctacaacagatttgtgctgtacaaggagggggagcgggacttcctgcagaggcctggccagcagccccaggccggcctgagccaggccaacttcaccctgggccctgtgagccccagcaatggaggccagtaccgctgctatggagcccacaacctgagcagcgagtggagcgcccccagcgaccccctgaacatcctgatggccggccagatctatgacacagtgtccctgagcgcccagcccggccccaccgtggccagcggagaaaatgtgaccctgctgtgccagagctggtggcagtttgacaccttcctgctgaccaaggagggcgccgcccacccccccctgcggctgcgctccatgtacggggcccacaagtaccaggccgagttccccatgagccctgtgaccagcgcccatgctggcacctaccgctgctacggcagctacagcagcaacccccacctgctgagccaccccagcgagcccctggagctggtggtgtctggccacagcggcggcagcagcctgccccccaccggcccccccagcaccccaggcctgggccgctacctggaggtgctgattggagtgtctgtggcctttgtgctgctgctcttcctgctgctcttcctgctgctgcggcggcagaggcacagcaagcacaggaccagtgaccagaggaagacagacttccagaggcctgctggagctgctgagacagagcccaaggaccggggcctgctgcggcgcagcagccctgctgctgatgtgcaggaggagaacctgtatgctgctgtgaaggacacccagagtgaagatagagtggagctggacagccagagcccccatgatgaggacccccaggccgtgacctacgcccctgtgaagcacagcagcccccggcgggagatggccagcccccccagcagcctgtctggagagttcctggacaccaaggaccggcaggtggaggaggaccggcagatggacacagaggccgccgccagcgaggccagccaggatgtgacctacgcccagctgcacagcctgaccctgcggaggaaggccacagagcccccacccagccaggagggggagcccccagctgagcccagcatctatgccaccctggccatccactag

SEQ ID NO: 157647 - DNA, 1947 bp, Artificial Sequence
  Description of Artificial Sequence: Synthetic coding sequence
atgaccccagccctgacagccctgctgtgcctgggcctgagcctgggccccaggaccagggtgcaggccggccccttccccaagcccaccctgtgggccgagcccggcagcgtcatctcctggggcagccctgtgaccatctggtgccagggcagcctggaggcccaggagtaccagctggacaaggagggcagccctgagcccctggacaggaacaaccccctggagcccaagaacaaggcccgcttcagcatccccagcatgacccagcaccacgccggccgctaccgctgccactactacagcagcgctggctggagcgagcccagcgaccccctggagctggtgatgaccggggcctacagcaagcccaccctgagcgccctgcccagccctgtggtggccagcggcggcaacatgaccctgcgctgtggcagccagaagggctaccaccactttgtgctgatgaaggagggggagcaccagctgcccaggaccctggacagccagcagctgcacagccggggcttccaggccctcttccctgtgggccctgtgacccccagccaccgctggaggttcacctgctactactactacaccaacaccccctgggtgtggagccaccccagcgaccccctggagatcctgcccagcggcgtgtccaggaagcccagcctgctgaccctgcagggccctgtgctggcccctggccagagcctgaccctgcagtgtggcagtgatgtgggctacaacagatttgtgctgtacaaggagggggagcgggacttcctgcagaggcctggccagcagccccaggccggcctgagccaggccaacttcaccctgggccctgtgagccccagcaatggaggccagtaccgctgctatggagcccacaacctgagcagcgagtggagcgcccccagcgaccccctgaacatcctgatggccggccagatctatgacacagtgtccctgagcgcccagcccggccccaccgtggccagcggagaaaatgtgaccctgctgtgccagagctggtggcagtttgacaccttcctgctgaccaaggagggcgccgcccacccccccctgcggctgcgctccatgtacggggcccacaagtaccaggccgagttccccatgagccctgtgaccagcgcccatgctggcacctaccgctgctacggcagctacagcagcaacccccacctgctgagccaccccagcgagcccctggagctggtggtgtctggccacagcggcggcagcagcctgccccccaccggcccccccagcacccctgggggccctgaggaccagcccctgaaccccccaggcagcggcccccagaaccggctgggccgctacctggaggtgctgattggagtgtctgtggcctttgtgctgctgctcttcctgctgctcttcctgctgctgcggcggcagaggcacagcaagcacaggaccagtgaccagaggaagacagacttccagaggcctgctggagctgctgagacagagcccaaggaccggggcctgctgcggcgcagcagccctgctgctgatgtgcaggaggagaacctgtatgctgctgtgaaggacacccagagcgaggacagagtggagctggacagccagagcccccatgatgaggacccccaggccgtgacctacgcccctgtgaagcacagcagcccccggcgggagatggccagcccccccagcagcctgagcggggagttcctggacaccaaggaccggcaggtggaggaggaccggcagatggacacagaagctgctgccagcgaggccagccaggatgtgacctacgcccagctgcacagcctgaccctgcggaggaaggccacagagcccccacccagccaggagggggagcccccagctgagcccagcatctatgccaccctggccatccactag

SEQ ID NO: 157648 - DNA, 1896 bp, Artificial Sequence; identical to SEQ ID NO: 157646
  Description of Artificial Sequence: Synthetic coding sequence

SEQ ID NO: 157649 - DNA, 477 bp, Artificial Sequence
  Description of Artificial Sequence: Synthetic coding sequence
atgaccccagccctgacagccctgctgtgcctgggcctgagcctgggccccaggaccagggtgcaggccggccccttccccaagcccaccctgtgggccgagcccggcagcgtcatctcctggggcagccctgtgaccatctggtgccagggcagccaggaggcccaggagtaccgcctgcacaaggagggcagccctgagcccctggacaggaacaaccccctggagcccaagaacaaggcccgcttcagcatccccagcatgacagagcaccacgccggccgctaccgctgccactactacagcagcgctggctggagcgagcccagcgaccccctggagatggtgatgaccggggcctacagcaagcccaccctgagcgccctgcccagccctgtggtggccagcggcggcaacatgaccctgcgctgtggcagccagaagggctaccaccactttgtgctgatgaaggagtag

SEQ ID NO: 157650 - DNA, 1347 bp, Artificial Sequence
  Description of Artificial Sequence: Synthetic coding sequence
atgatccccaccttcaccgccctgctgtgcctgggcctgagcctgggccccaggacccacatgcaggccggccccctgcccaagcccaccctgtgggccgagcccggcagcgtcatctcctggggcaacagcgtgaccatctggtgccagggcaccctggaggcccgggagtaccgcctggacaaggaggagagccctgccccctgggaccggcagaaccccctggagcccaagaacaaggcccgcttcagcatccccagcatgacagaggactatgccggccgctaccgctgctactaccgcagccctgtgggctggagccagcccagcgaccccctggagctggtgatgaccggggcctacagcaagcccaccctgagcgccctgcccagccccctggtgaccagcggcaagtctgtgaccctgctgtgccagagccgcagccccatggacaccttcctgctgatcaaggagcgggccgcccaccccctgctgcacctgcggagtgaacatggagcccagcagcaccaggccgagttccccatgagccctgtgacctctgtgcatggaggcacctaccgctgcttcagcagccacggcttcagccactacctgctgagccaccccagcgaccccctggagctgattgtgtctggcagcctggaggacccccggcccagccccaccaggtctgtgtccacagctgctggccctgaggaccagcccctgatgcccaccggctctgtgccccacagcggcctgcggcggcactgggaggtgctgattggagtgctggtggtgtccatcctgctgctgagcctgctgctcttcctgctgctgcagcactggaggcagggcaagcacaggaccctggcccagaggcaggccgacttccagaggcctcctggagctgctgagcctgagcccaaggatggcggcctgcagaggaggagcagccctgctgctgatgtgcagggcgagaacttctgtgccgctgtgaagaacacccagccagaagatggagtggagatggacacccggcagagcccccatgatgaggacccccaggccgtgacctacgccaaggtgaagcacagccggccccggcgggagatggccagcccccccagccccctgagcggggagttcctggacaccaaggaccggcaggccgaggaggaccggcagatggacacagaagctgctgccagcgaggccccccaggatgtgacctacgcccagctgcacagcttcaccctgcggcagaaggccacagagcccccacccagccaggagggcgccagccctgctgagcccagcgtgtatgccaccctggccatccactag

SEQ ID NO: 157651 - DNA, 1347 bp, Artificial Sequence; identical to SEQ ID NO: 157650
  Description of Artificial Sequence: Synthetic coding sequence

SEQ ID NO: 157652 - DNA, 1773 bp, Artificial Sequence
  Description of Artificial Sequence: Synthetic coding sequence
atgaccctgaccctgtctgtgctgatctgcctgggcctgtctgtgggccccaggacctgtgtgcaggccggcaccctgcccaagcccaccctgtgggccgagcccgcctctgtgattgcccggggcaagcctgtgaccctgtggtgccagggccccctggagacagaggagtaccgcctggacaaggagggcctgccctgggccaggaagaggcagaaccccctggagcccggggccaaggccaagttccacatccccagcacagtgtatgacagcgctggccgctaccgctgctactatgagaccccagctggctggagcgagcccagcgaccccctggagctggtggccaccggcttctacgccgagcccaccctgctggccctgcccagccctgtggtggccagcggcggcaatgtgaccctgcagtgtgacaccctggatggcctgctgacctttgtgctggtggaggaggagcagaagctgcccaggaccctgtacagccagaagctgcccaagggccccagccaggccctcttccctgtgggccctgtgacccccagctgccgctggaggttccgctgctactactactacaggaagaacccccaggtgtggagcaaccccagcgacctgctggagatcctggtgcctggggtgtccaggaagcccagcctgctgatcccccagggctctgtggtggcccggggcggcagcctgaccctgcagtgccgcagtgatgtgggctatgacatctttgtgctgtacaaggagggggagcatgacctggtgcagggcagcggccagcagccccaggccggcctgagccaggccaacttcaccctgggccctgtgagccgcagccatggaggccagtaccgctgctacggggcccacaacctgagcccccgctggagcgcccccagcgaccccctggacatcctgattgctggcctcatcccagacatcccagccctgtctgtgcagcccggccccaaggtggccagcggggagaatgtgaccctgctgtgccagagctggcaccagattgacaccttcttcctgaccaaggagggcgccgcccacccccccctgtgcctgaagagcaagtaccagagctaccgccaccaggccgagttctccatgagccctgtgaccagcgcccagggcggcacctaccgctgctacagcgccatccgcagctacccctacctgctgagcagccccagctacccccaggagctggtggtgtctggccccagcggggaccccagcctgagccccaccggcagcacccccaccccaggccctgaggaccagcccctgacccccaccggcctggacccccagagcggcctgggccgccacctgggcgtggtgactggagtgtctgtggcctttgtgctgctgctcttcctgctgctcttcctgctgctgcggcaccgccaccagagcaagcacaggaccagcgcccacttctacagacctgctggagctgctggccctgagcccaaggaccagggcctgcagaagagggccagccctgtggccgacatccaggaggagatcctgaatgctgctgtgaaggacacccagcccaaggatggagtggagatggatgcccgggccgccgccagcgaggccccccaggatgtgacctacgcccagctgcacagcctgaccctgcggcgggaggccacagagcccccacccagccaggagcgggagcccccagctgagcccagcatctatgcccccctggccatccactag

SEQ ID NO: 157653 - DNA, 1776 bp, Artificial Sequence
  Description of Artificial Sequence: Synthetic coding sequence
atgaccctgaccctgtctgtgctgatctgcctgggcctgtctgtgggccccaggacctgtgtgcaggccggcaccctgcccaagcccaccctgtgggccgagcccgcctctgtgattgcccggggcaagcctgtgaccctgtggtgccagggccccctggagacagaggagtaccgcctggacaaggagggcctgccctgggccaggaagaggcagaaccccctggagcccggggccaaggccaagttccacatccccagcacagtgtatgacagcgctggccgctaccgctgctactatgagaccccagctggctggagcgagcccagcgaccccctggagctggtggccaccggcttctacgccgagcccaccctgctggccctgcccagccctgtggtggccagcggcggcaatgtgaccctgcagtgtgacaccctggatggcctgctgacctttgtgctggtggaggaggagcagaagctgcccaggaccctgtacagccagaagctgcccaagggccccagccaggccctcttccctgtgggccctgtgacccccagctgccgctggaggttccgctgctactactactacaggaagaacccccaggtgtggagcaaccccagcgacctgctggagatcctggtgcctggggtgtccaggaagcccagcctgctgatcccccagggctctgtggtggcccggggcggcagcctgaccctgcagtgccgcagtgatgtgggctatgacatctttgtgctgtacaaggagggggagcatgacctggtgcagggcagcggccagcagccccaggccggcctgagccaggccaacttcaccctgggccctgtgagccgcagccatggaggccagtaccgctgctacggggcccacaacctgagcccccgctggagcgcccccagcgaccccctggacatcctgattgctggcctcatcccagacatcccagccctgtctgtgcagcccggccccaaggtggccagcggggagaatgtgaccctgctgtgccagagctggcaccagattgacaccttcttcctgaccaaggagggcgccgcccacccccccctgtgcctgaagagcaagtaccagagctaccgccaccaggccgagttctccatgagccctgtgaccagcgcccagggcggcacctaccgctgctacagcgccatccgcagctacccctacctgctgagcagccccagctacccccaggagctggtggtgtctggccccagcggggaccccagcctgagccccaccggcagcacccccaccccagctggccctgaggaccagcccctgacccccaccggcctggacccccagagcggcctgggccgccacctgggcgtggtgactggagtgtctgtggcctttgtgctgctgctcttcctgctgctcttcctgctgctgcggcaccgccaccagagcaagcacaggaccagcgcccacttctacagacctgctggagctgctggccctgagcccaaggaccagggcctgcagaagagggccagccctgtggccgacatccaggaggagatcctgaatgctgctgtgaaggacacccagcccaaggatggagtggagatggatgcccgggctgctgccagcgaggccccccaggatgtgacctacgcccagctgcacagcctgaccctgcggcgggaggccacagagcccccacccagccaggagcgggagcccccagctgagcccagcatctatgcccccctggccatccactag

SEQ ID NO: 157654 - DNA, 1869 bp, Artificial Sequence
  Description of Artificial Sequence: Synthetic coding sequence
atgaccctgaccctgtctgtgctgatctgcctgggcctgtctgtgggccccaggacctgtgtgcaggccggcaccctgcccaagcccaccctgtgggccgagcccgcctctgtgattgcccggggcaagcctgtgaccctgtggtgccagggccccctggagacagaggagtaccgcctggacaaggagggcctgccctgggccaggaagaggcagaaccccctggagcccggggccaaggccaagttccacatccccagcacagtgtatgacagcgctggccgctaccgctgctactatgagaccccagctggctggagcgagcccagcgaccccctggagctggtggccacagccctgcccagccctgtggtggccagcggcggcaatgtgaccctgcagtgtgacaccctggatggcctgctgacctttgtgctggtggaggaggagcagaagctgcccaggaccctgtacagccagaagctgcccaagggccccagccaggccctcttccctgtgggccctgtgacccccagctgccgctggaggttccgctgctactactactacaggaagaacccccaggtgtggagcaaccccagcgacctgctggagatcctggtgcctggggtgtccaggaagcccagcctgctgatcccccagggctctgtggtggcccggggcggcagcctgaccctgcagtgccgcagtgatgtgggctatgacatctttgtgctgtacaaggagggggagcatgacctggtgcagggcagcggccagcagccccaggccggcctgagccaggccaacttcaccctgggccctgtgagccgcagccacggcggccagtaccgctgctatggagcccacaacctgagcccccgctggagcgcccccagcgaccccctggacatcctgattgctggcctcatcccagacatcccagccctgtctgtgcagcccggccccaaggtggccagcggagaaaatgtgaccctgctgtgccagagctggcaccagattgacaccttcttcctgaccaaggagggcgccgcccacccccccctgtgcctgaagagcaagtaccagagctaccgccaccaggccgagttctccatgagccctgtgaccagcgcccagggcggcacctaccgctgctacagcgccatccgcagctacccctacctgctgagcagccccagctacccccaggagctggtggtgtctggccccagcggggaccccagcctgagccccaccggcagcacccccaccccagctggccctgaggaccagcccctgacccccaccggcctggacccccagagcggcctgggccgccacctgggcgtggtgactggagtgtctgtggcctttgtgctgctgctcttcctgctgctcttcctgctgctgcggcaccgccaccagagcaagcacaggaccagcgcccacttctacagacctgctggagctgctggccctgagcccaaggaccagggcctgcagaagagggccagccctgtggccgacatccaggaggagatcctgaatgctgctgtgaaggacacccagcccaaggatggagtggagatggatgcccggcagagcccccatgatgaggacccccaggccgtgacctacgccgaggtgaagcacagccggccccggcgggagatggccagcccccccagccccctgtctggagagttcctggacaccaaggaccggcaggccgaggaggaccggcagatggacacagagcgggtgctgagcagccctggcccccaggccagccccccaccacccaggagcctgcccctgaccctgccccgctgccgcctgctgcacctgaagccacccaggatgtag

SEQ ID NO: 157655 - DNA, 2595 bp, Artificial Sequence
  Description of Artificial Sequence: Synthetic coding sequence
atgggctgctggggccagctgctggtgtggtttggagctgctggggccatcctgtgcagcagccctggcagccaggagaccttcctgcggagcagccccctgcccctggccagccccagcccccgggaccccaaggtgtctgcccctccttccatcctggagcccgccagccccctgaacagccctggaacagagggctcctggctgttcagcacctgtggggccagcggcagacatggccccacccagacccagtgtgatggagcctatgccggcacctctgtggtggtgacagtgggcgccgccggccagctgcggggcgtgcagctgtggagggtgcccggccctggccagtacctgatcagcgcctacggggctgctgggggcaagggggccaagaaccacctgagccgggcccacggcgtgtttgtgtctgccatcttcagcctgggcctgggggagagcctgtacatcctggtgggccagcagggagaagatgcctgccctgggggcagccctgagagccagctggtgtgcctgggggagagcagagctgtggaggagcacgccgccatggatggcagcgagggcgtgcccggcagccgccgctgggccggcggcggcggcggcggcggcggggccacctacgtgttccgggtgcgggccggggagctggagcccctgctggtggccgccggcggcggcggccgggcctacctgcggccccgggaccggggccgcacccaggccagccctgagaagctggagaacagaagtgaggcccctggcagcggcggccggggcggcgctgctgggggcggcggcggctggaccagccgggcccccagcccccaggccggccgcagcctgcaggagggcgctgagggcggccagggctgcagcgaggcctgggccaccctgggctgggccgccgccggcggctttggaggcggcggcggggcctgcacagctgggggcggcggcggcggctacagaggaggagatgccagcgagacagacaacctgtgggcagatggagaagatggagtgtccttcatccaccccagcagcgagctgttcctgcagcccctggccgtgacagagaaccacggggaggtggagatccgccgccacctgaactgcagccactgccccctgcgggactgccagtggcaggccgagctgcagctggctgaatgtctgtgcccagagggcatggagctggccgtggacaacgtgacctgcatggacctgcacaagcccccaggccccctggtgctgatggtggccgtggtggccaccagcaccctgagcctgctgatggtgtgtggggtgctgatcctggtgaagcagaagaagtggcagggcctgcaggagatgaggctgcccagccctgagctggagctgagcaagctgcggaccagcgccatcagaacagcccccaacccctactactgccaggtgggcctgggccctgcccagagctggcccctgcccccaggagtgacagaggtgtccccagccaacgtgaccctgctgcgggccctgggccacggggcctttggagaggtgtatgagggcctggtgattggcctgcccggggacagcagccccctgcaggtggccatcaagaccctgcctgagctgtgcagcccccaggatgagctggacttcctgatggaggccctgatcatcagcaagttccgccaccagaacatcgtgcgctgtgtgggcctgagcctgcgggccacccccaggctcatcctgctggagctgatgtctggaggagacatgaagagcttcctgcggcacagccggccccacctgggccagcccagccccctggtgatgagggacctgctgcagctggcccaggacatcgcccagggctgccactacctggaggagaaccacttcatccaccgggacattgctgccaggaactgcctgctgagctgtgccggccccagccgggtggccaagatcggggactttggcatggcccgggacatctaccgggccagctactaccgccgcggggaccgggccctgctgcctgtgaagtggatgcctcctgaggccttcctggagggcatcttcaccagcaagacagacagctggagctttggagtgctgctgtgggagatcttcagcctgggctacatgccctacccaggccgcaccaaccaggaggtgctggactttgtggtgggcggcggccgcatggaccccccccggggctgccccggccctgtgtaccgcatcatgacccagtgctggcagcacgagcctgagctgcggcccagctttgccagcatcctggagcggctgcagtactgcacccaggaccctgatgtgctgaacagcctgctgcccatggagctgggccccaccccagaggaggagggcaccagcggcctgggcaacagaagcctggagtgcctgcggcccccccagccccaggagctgagccctgagaagctgaagtcctggggcggcagccccctgggcccctggctgagcagcggcctgaagcccctgaagagccggggcctgcagccccagaacctgtggaaccccacctaccgctcctag

SEQ ID NO: 157656 - DNA, 2412 bp, Artificial Sequence
  Description of Artificial Sequence: Synthetic coding sequence
atgggctgctggggccagctgctggtgtggtttggagctgctggggccatcctgtgcagcagccctggcagccaggagaccttcctgcggagcagccccctgcccctggccagccccagcccccgggaccccaaggtgtctgcccctccttccatcctggagcccgccagccccctgaacagccctggaacagagggctcctggctgttcagcacctgtggggccagcggcagacatggccccacccagacccagtgtgatggagcctatgccggcacctctgtggtggtgacagtgggcgccgccggccagctgcggggcgtgcagctgtggagggtgcccggccctggccagtacctgatcagcgcctacggggctgctgggggcaagggggccaagaaccacctgagccgggcccacggcgtgtttgtgtctgccatcttcagcctgggcctgggggagagcctgtacatcctggtgggccagcagggagaagatgcctgccctgggggcagccctgagagccagctggtgtgcctgggggagagcagagctgtggaggagcacgccgccatggatggcagcgagggcgtgcccggcagccgccgctgggccggcggcggcggcggcggcggcggggccacctacgtgttccgggtgcgggccggggagctggagcccctgctggtggccgccggcggcggcggccgggcctacctgcggccccgggaccggggccgcacccaggccagccctgagaagctggagaacagaagtgaggcccctggcagcggcggccggggcggcgctgctggaggagatgccagcgagacagacaacctgtgggcagatggagaagatggagtgtccttcatccaccccagcagcgagctgttcctgcagcccctggccgtgacagaaaatcatggagaggtggagatcagaagacacctgaactgcagccactgccccctgcgggactgccagtggcaggccgagctgcagctggccgagtgcctgtgcccagagggcatggagctggccgtggacaacgtgacctgcatggacctgcacaagcccccaggccccctggtgctgatggtggccgtggtggccaccagcaccctgagcctgctgatggtgtgtggggtgctgatcctggtgaagcagaagaagtggcagggcctgcaggagatgaggctgcccagccctgagctggagctgagcaagctgcggaccagcgccatcagaacagcccccaacccctactactgccaggtgggcctgggccctgcccagagctggcccctgcccccaggagtgacagaggtgtccccagccaacgtgaccctgctgcgggccctgggccatggagccttcggggaggtgtatgagggcctggtgattggcctgcccggggacagcagccccctgcaggtggccatcaagaccctgcctgagctgtgcagcccccaggatgagctggacttcctgatggaggccctgatcatcagcaagttccgccaccagaacatcgtgcgctgtgtgggcctgagcctgcgggccacccccaggctcatcctgctggagctgatgtctggaggagacatgaagagcttcctgcggcacagccggccccacctgggccagcccagccccctggtgatgagggacctgctgcagctggcccaggacatcgcccagggctgccactacctggaggagaaccacttcatccaccgggacattgctgccaggaactgcctgctgagctgtgccggccccagccgggtggccaagattggagactttggcatggcccgggacatctaccgggccagctactacagaagaggagaccgggccctgctgcctgtgaagtggatgcctcctgaggccttcctggagggcatcttcaccagcaagacagacagctggagctttggagtgctgctgtgggagatcttcagcctgggctacatgccctacccaggccgcaccaaccaggaggtgctggactttgtggtgggcggcggccgcatggaccccccccggggctgccccggccctgtgtaccgcatcatgacccagtgctggcagcacgagcctgagctgcggcccagctttgccagcatcctggagcggctgcagtactgcacccaggaccctgatgtgctgaacagcctgctgcccatggagctgggccccaccccagaggaggagggcaccagcggcctgggcaacagaagcctggagtgcctgcggcccccccagccccaggagctgagccctgagaagctgaagtcctggggcggcagccccctgggcccctggctgagcagcggcctgaagcccctgaagagccggggcctgcagccccagaacctgtggaaccccacctaccgctcctag

SEQ ID NO: 157657 - DNA, 1437 bp, Artificial Sequence
  Description of Artificial Sequence: Synthetic coding sequence
atgggctgctggggccagctgctggtgtggtttggagctgctggggccatcctgtgcagcagccctggcagccaggagaccttcctgcggagcagccccctgcccctggccagccccagcccccgggaccccaaggtgtctgcccctccttccatcctggagcccgccagccccctgaacagccctggaacagagggctcctggctgttcagcacctgtggggccagcggcagacatggccccacccagacccagtgtgatggagcctatgccggcacctctgtggtggtgacagtgggcgccgccggccagctgcggggcgtgcagctgtggagggtgcccggccctggccagtacctgatcagcgcctacggggctgctgggggcaagggggccaagaaccacctgagccgggcccacggcgtgtttgtgtctgccatcttcagcctgggcctgggggagagcctgtacatcctggtgggccagcagggagaagatgcctgccctgggggcagccctgagagccagctggtgtgcctgggggagagcagagctgtggaggagcacgccgccatggatggcagcgagggcgtgcccggcagccgccgctgggccggcggcggcggcggcggcggcggggccacctacgtgttccgggtgcgggccggggagctggagcccctgctggtggccgccggcggcggcggccgggcctacctgcggccccgggaccggggccgcacccaggccagccctgagaagctggagaacagaagtgaggcccctggcagcggcggccggggcggcgctgctgggggcggcggcggctggaccagccgggcccccagcccccaggccggccgcagcctgcaggagggcgctgagggcggccagggctgcagcgaggcctgggccaccctgggctgggccgccgccggcggctttggaggcggcggcggggcctgcacagctgggggcggcggcggcggctacagaggaggagatgccagcgagacagacaacctgtgggcagatggagaagatggagtgtccttcatccaccccagcagcgagctgttcctgcagcccctggccgtgacagagaaccacggggaggtggagatccgccgccacctgaactgcagccactgccccctgcgggactgccagtggcaggccgagctgcagctggctgaatgtctgtgcccagagggcatggagctggccgtggacaacgtgacctgcatggacctgcacaagcccccaggccccctggtgctgatggtggccgtggtggccaccagcaccctgagcctgctgatggtgtgtggggtgctgatcctgggcaccaagaggctggccggcaccgtggacagccggctgctgctgagcagcgagctgggctgggtgtctgctgggggcggcagaagaagatag

SEQ ID NO: 157658 - DNA, 2205 bp, Artificial Sequence
  Description of Artificial Sequence: Synthetic coding sequence
atgggctgctggggccagctgctggtgtggtttggagctgctggggccatcctgtgcagcagccctggcagccaggagaccttcctgcggagcagccccctgcccctggccagccccagcccccgggaccccaaggtgtctgcccctccttccatcctggagcccgccagccccctgaacagccctggaacagagggctcctggctgttcagcacctgtggggccagcggcagacatggccccacccagacccagtgtgatggagcctatgccggcacctctgtggtggtgacagtgggcgccgccggccagctgcggggcgtgcagctgtggagggtgcccggccctggccagtacctgatcagcgcctacggggctgctgggggcaagggggccaagaaccacctgagccgggcccacggcgtgtttgtgtctgccatcttcagcctgggcctgggggagagcctgtacatcctggtgggccagcagggagaagatgcctgccctgggggcagccctgagagccagctggtgtgcctgggggagagcagagctgtggaggagcacgccgccatggatggcagcgagggcgtgcccggcagccgccgctgggccggcggcggcggcggcggcggcggggccacctacgtgttccgggtgcgggccggggagctggagcccctgctggtggccgccggcggcggcggccgggcctacctgcggccccgggaccggggccgcacccaggccagccctgagaagctggagaacagaagtgaggcccctggcagcggcggccggggcggcgctgctggaggagatgccagcgagacagacaacctgtgggcagatggagaagatggagtgtccttcatccaccccagcagcgagctgttcctgcagcccctggccgtgacagaaaatcatggagaggtggagatcagaagacacctgaactgcagccactgccccctgcgggactgccagtggcaggccgagctgcagctggccgagtgcctgtgcccagagggcatggagctggccgtggacaacgtgacctgcatggacctgcacaagcccccaggccccctggtgctgatggtggccgtggtggccaccagcaccctgagcctgctgatggtgtgtggggtgctgatcctgggcggggcctggccaggccctgtgctggccagcgccacccgctgccaccggggcttccccagccagtgctacagcgcccagaccctgcctgagctgtgcagcccccaggatgagctggacttcctgatggaggccctgatcatcagcaagttccgccaccagaacatcgtgcgctgtgtgggcctgagcctgcgggccacccccaggctcatcctgctggagctgatgtctggaggagacatgaagagcttcctgcggcacagccggccccacctgggccagcccagccccctggtgatgagggacctgctgcagctggcccaggacatcgcccagggctgccactacctggaggagaaccacttcatccaccgggacattgctgccaggaactgcctgctgagctgtgccggccccagccgggtggccaagatcggggactttggcatggcccgggacatctaccgggccagctactaccgccgcggggaccgggccctgctgcctgtgaagtggatgcctcctgaggccttcctggagggcatcttcaccagcaagacagacagctggagctttggagtgctgctgtgggagatcttcagcctgggctacatgccctacccaggccgcaccaaccaggaggtgctggactttgtggtgggcggcggccgcatggaccccccccggggctgccccggccctgtgtaccgcatcatgacccagtgctggcagcacgagcctgagctgcggcccagctttgccagcatcctggagcggctgcagtactgcacccaggaccctgatgtgctgaacagcctgctgcccatggagctgggccccaccccagaggaggagggcaccagcggcctgggcaacagaagcctggagtgcctgcggcccccccagccccaggagctgagccctgagaagctgaagtcctggggcggcagccccctgggcccctggctgagcagcggcctgaagcccctgaagagccggggcctgcagccccagaacctgtggaaccccacctaccgctcctag

SEQ ID NO: 157659 - DNA, 180 bp, Artificial Sequence
  Description of Artificial Sequence: Synthetic coding sequence
atgctgagcagaaatgatgacatctgcatctatggaggcctgggcctgggcggcctgctgctgctggccgtggtgctgctgagcgcctgcctgtgctggctgcaccggcggggccctggcctgctgcgggccggcacccccctgtgcatctctgctgaggccgccagcgcccagcagtag

SEQ ID NO: 157660 - DNA, 201 bp, Artificial Sequence
  Description of Artificial Sequence: Synthetic coding sequence
atgctgagcagaaatgatgacatctgcatctatggaggcctgggcctgggcggcctgctgctgctggccgtggtgctgctgagcgcctgcctgtgctggctgcaccggcgggcccccagcgtgctggtgcccggccctggcctgctgcgggccggcacccccctgtgcatctctgctgaggccgccagcgcccagcagtag

SEQ ID NO: 157661 - DNA, 222 bp, Artificial Sequence
  Description of Artificial Sequence: Synthetic coding sequence
atgctgagcagaaatgatgtgaagaggctggagaggtcctggcacctgctgtcctggagccaggcccagggcagcagcgagcaggagctgcactacgccagcctgcagaggctgcctgtgcccagcagcgagggccctgacctgcggggccgggacaagaggggcaccaaggaggaccccagggctgactatgcctgcatcgccgagaacaagcccacctag

SEQ ID NO: 157662 - DNA, 201 bp, Artificial Sequence
  Description of Artificial Sequence: Synthetic coding sequence
atgctgagcagaaatgatgtgaagaggctggagaggtcctgggcccagggcagcagcgagcaggagctgcactacgccagcctgcagaggctgcctgtgcccagcagcgagggccctgacctgcggggccgggacaagaggggcaccaaggaggaccccagggctgactatgcctgcatcgccgagaacaagcccacctag

SEQ ID NO: 157663 - DNA, 108 bp, Artificial Sequence
  Description of Artificial Sequence: Synthetic coding sequence
atgctgagcagaaatgatgcccccagcgtgctggtgcccggccctggcctgctgcgggccggcacccccctgtgcatctctgctgaggccgccagcgcccagcagtag

SEQ ID NO: 157664 - DNA, 315 bp, Artificial Sequence
  Description of Artificial Sequence: Synthetic coding sequence
atgctgagcagaaatgatgacatctgcatctatggaggcctgggcctgggcggcctgctgctgctggccgtggtgctgctgagcgcctgcctgtgctggctgcaccggcgggtgaagaggctggagaggtcctggcacctgctgtcctggagccaggcccagggcagcagcgagcaggagctgcactacgccagcctgcagaggctgcctgtgcccagcagcgagggccctgacctgcggggccgggacaagaggggcaccaaggaggaccccagggctgactatgcctgcatcgccgagaacaagcccacctag

SEQ ID NO: 157665 - DNA, 42 bp, Artificial Sequence
  Description of Artificial Sequence: Synthetic coding sequence
atgctgagcagaaatgatgaggccgccagcgcccagcagtag

SEQ ID NO: 157666 - DNA, 108 bp, Artificial Sequence; identical to SEQ ID NO: 157663
  Description of Artificial Sequence: Synthetic coding sequence

SEQ ID NO: 157667 - DNA, 276 bp, Artificial Sequence
  Description of Artificial Sequence: Synthetic coding sequence
atgatctacgtgtccactggagcctggggctgggccggcagctgcttctggcagtggagcttctgccccccagcctgtgtgggctgcatcgaggagcacctgctgtcctggagccaggcccagggcagcagcgagcaggagctgcactacgccagcctgcagaggctgcctgtgcccagcagcgagggccctgacctgcggggccgggacaagaggggcaccaaggaggaccccagggctgactatgcctgcatcgccgagaacaagcccacctag

SEQ ID NO: 157668 - DNA, 156 bp, Artificial Sequence
  Description of Artificial Sequence: Synthetic coding sequence
atgctgagcagaaatgatgtgaagaggctggagaggtcctggaggctgcctgtgcccagcagcgagggccctgacctgcggggccgggacaagaggggcaccaaggaggaccccagggctgactatgcctgcatcgccgagaacaagcccacctag

SEQ ID NO: 157669 - DNA, 192 bp, Artificial Sequence
  Description of Artificial Sequence: Synthetic coding sequence
atgcacctgtgccggggctgccagtgcccagctgtgcgggacctgaccagcggggctgagacccgggaggccccccggcgcatccaggagctgaccatgcctgccctgctgcggaccaaccccccagagcaccccaggcacctgccccagccccggcgggtggacagagtgcccctgtggagcagccagtag

SEQ ID NO: 157670 - DNA, 222 bp, Artificial Sequence; identical to SEQ ID NO: 157661
  Description of Artificial Sequence: Synthetic coding sequence

SEQ ID NO: 157671 - DNA, 108 bp, Artificial Sequence; identical to SEQ ID NO: 157663
  Description of Artificial Sequence: Synthetic coding sequence

SEQ ID NO: 157672 - DNA, 201 bp, Artificial Sequence; identical to SEQ ID NO: 157660
  Description of Artificial Sequence: Synthetic coding sequence

SEQ ID NO: 157673 - DNA, 315 bp, Artificial Sequence; identical to SEQ ID NO: 157664
  Description of Artificial Sequence: Synthetic coding sequence

SEQ ID NO: 157674 - DNA, 135 bp, Artificial Sequence
  Description of Artificial Sequence: Synthetic coding sequence
atgctgagcagaaatgatgacatctgcatctatggaggcctgggcctgggcggcctgctgctgctggccgtggtgctgctgagcgcctgcctgtgctggctgcaccggcgggaggccgccagcgcccagcagtag

SEQ ID NO: 157675 - DNA, 201 bp, Artificial Sequence
  Description of Artificial Sequence: Synthetic coding sequence
atgctgagcagaaatgatgacatctgcatctatggaggcctgggcctgggcggcctgctgctgctggccgtggtgctgctgagcgcctgcctgtgctggctgcaccggcgggtgaagaggctggagaggtcctggaggctgcctgtgcccagcagcgagggccctgacctgcggggccgggacaagaggggcaccaagtag

SEQ ID NO: 157676 - DNA, 201 bp, Artificial Sequence; identical to SEQ ID NO: 157662
  Description of Artificial Sequence: Synthetic coding sequence

SEQ ID NO: 157677 - DNA, 294 bp, Artificial Sequence
  Description of Artificial Sequence: Synthetic coding sequence
atgctgagcagaaatgatgacatctgcatctatggaggcctgggcctgggcggcctgctgctgctggccgtggtgctgctgagcgcctgcctgtgctggctgcaccggcgggtgaagaggctggagaggtcctgggcccagggcagcagcgagcaggagctgcactacgccagcctgcagaggctgcctgtgcccagcagcgagggccctgacctgcggggccgggacaagaggggcaccaaggaggaccccagggctgactatgcctgcatcgccgagaacaagcccacctag

SEQ ID NO: 157678 - DNA, 180 bp, Artificial Sequence; identical to SEQ ID NO: 157659
  Description of Artificial Sequence: Synthetic coding sequence

SEQ ID NO: 157679 - DNA, 87 bp, Artificial Sequence
  Description of Artificial Sequence: Synthetic coding sequence
atgctgagcagaaatgatggccctggcctgctgcgggccggcacccccctgtgcatctctgctgaggccgccagcgcccagcagtag

SEQ ID NO: 157680 - DNA, 87 bp, Artificial Sequence; identical to SEQ ID NO: 157679
  Description of Artificial Sequence: Synthetic coding sequence

SEQ ID NO: 157681 - DNA, 87 bp, Artificial Sequence; identical to SEQ ID NO: 157679
  Description of Artificial Sequence: Synthetic coding sequence

SEQ ID NO: 157682 - DNA, 87 bp, Artificial Sequence; identical to SEQ ID NO: 157679
  Description of Artificial Sequence: Synthetic coding sequence

SEQ ID NO: 157683 - DNA, 42 bp, Artificial Sequence; identical to SEQ ID NO: 157665
  Description of Artificial Sequence: Synthetic coding sequence

SEQ ID NO: 157684 - DNA, 249 bp, Artificial Sequence
  Description of Artificial Sequence: Synthetic coding sequence
atgctgagcagaaatgatgacatctgcatctatggaggcctgggcctgggcggcctgctgctgctggccgtggtgctgctgagcgcctgcctgtgctggctgcaccggcgggtgaagaggctggagaggtcctggaggctgcctgtgcccagcagcgagggccctgacctgcggggccgggacaagaggggcaccaaggaggaccccagggctgactatgcctgcatcgccgagaacaagcccacctag

SEQ ID NO: 157685 - DNA, 201 bp, Artificial Sequence; identical to SEQ ID NO: 157662
  Description of Artificial Sequence: Synthetic coding sequence

SEQ ID NO: 157686 - DNA, 201 bp, Artificial Sequence; identical to SEQ ID NO: 157662
  Description of Artificial Sequence: Synthetic coding sequence

SEQ ID NO: 157687 - DNA, 294 bp, Artificial Sequence; identical to SEQ ID NO: 157677
  Description of Artificial Sequence: Synthetic coding sequence

SEQ ID NO: 157688 - DNA, 156 bp, Artificial Sequence; identical to SEQ ID NO: 157668
  Description of Artificial Sequence: Synthetic coding sequence

SEQ ID NO: 157689 - DNA, 294 bp, Artificial Sequence; identical to SEQ ID NO: 157677
  Description of Artificial Sequence: Synthetic coding sequence

SEQ ID NO: 157690 - DNA, 315 bp, Artificial Sequence; identical to SEQ ID NO: 157664
  Description of Artificial Sequence: Synthetic coding sequence

SEQ ID NO: 157691 - DNA, 132 bp, Artificial Sequence
  Description of Artificial Sequence: Synthetic coding sequence
taccggggcatgatgatctacgtgtccactggagcctggggctgggccggcagctgcttctggcagtggagcttctgccccccagcctgtgtgggctgcatcgaggagcggctgcctgtgcccagcagctag

SEQ ID NO: 157692 - DNA, 111 bp, Artificial Sequence
  Description of Artificial Sequence: Synthetic coding sequence
atgctgagcagaaatgatgacatctgcatctatggaggcctgggcctgggcggcctgctgctgctggccgtggtgctgctgagcgcctgcctgtgctggctgcacaggtag

SEQ ID NO: 157693 - DNA, 315 bp, Artificial Sequence; identical to SEQ ID NO: 157664
  Description of Artificial Sequence: Synthetic coding sequence

SEQ ID NO: 157694 - DNA, 141 bp, Artificial Sequence
  Description of Artificial Sequence: Synthetic coding sequence
atgctgagcagaaatgatgacatctgcatctatggaggcctgggcctgggcggcctgctgctgctggccgtggtgctgctgagcgcctgcctgtgctggctgcaccggcgggagcactgcctggccctggagcccctgtag

SEQ ID NO: 157695 - DNA, 42 bp, Artificial Sequence; identical to SEQ ID NO: 157665
  Description of Artificial Sequence: Synthetic coding sequence

SEQ ID NO: 157696 - DNA, 87 bp, Artificial Sequence; identical to SEQ ID NO: 157679
  Description of Artificial Sequence: Synthetic coding sequence

SEQ ID NO: 157697 - DNA, 201 bp, Artificial Sequence; identical to SEQ ID NO: 157662
  Description of Artificial Sequence: Synthetic coding sequence

SEQ ID NO: 157698 - DNA, 87 bp, Artificial Sequence; identical to SEQ ID NO: 157679
  Description of Artificial Sequence: Synthetic coding sequence

SEQ ID NO: 157699 - DNA, 87 bp, Artificial Sequence; identical to SEQ ID NO: 157679
  Description of Artificial Sequence: Synthetic coding sequence

SEQ ID NO: 157700 - DNA, 132 bp, Artificial Sequence
  Description of Artificial Sequence: Synthetic coding sequence
tgaagcagaaatgatgacatctgcatctacggcggcctgggcctgggcggcctgctgctgctggccgtggtgctgctgagcgcctgcctgtgctggctgcacagaagagaggccgccagcgcccagcagtag

SEQ ID NO: 157701 - DNA, 156 bp, Artificial Sequence; identical to SEQ ID NO: 157668
  Description of Artificial Sequence: Synthetic coding sequence

SEQ ID NO: 157702 - DNA, 108 bp, Artificial Sequence; identical to SEQ ID NO: 157663
  Description of Artificial Sequence: Synthetic coding sequence

SEQ ID NO: 157703 - DNA, 42 bp, Artificial Sequence; identical to SEQ ID NO: 157665
  Description of Artificial Sequence: Synthetic coding sequence

SEQ ID NO: 157704 - DNA, 294 bp, Artificial Sequence; identical to SEQ ID NO: 157677
  Description of Artificial Sequence: Synthetic coding sequence

SEQ ID NO: 157705 - DNA, 201 bp, Artificial Sequence; identical to SEQ ID NO: 157662
  Description of Artificial Sequence: Synthetic coding sequence

SEQ ID NO: 157706 - DNA, 141 bp, Artificial Sequence; identical to SEQ ID NO: 157694
  Description of Artificial Sequence: Synthetic coding sequence

SEQ ID NO: 157707 - DNA, 132 bp, Artificial Sequence; identical to SEQ ID NO: 157700
  Description of Artificial Sequence: Synthetic coding sequence

SEQ ID NO: 157708 - DNA, 141 bp, Artificial Sequence; identical to SEQ ID NO: 157694
  Description of Artificial Sequence: Synthetic coding sequence

SEQ ID NO: 157709 - DNA, 87 bp, Artificial Sequence; identical to SEQ ID NO: 157679
  Description of Artificial Sequence: Synthetic coding sequence

SEQ ID NO: 157710 - DNA, 132 bp, Artificial Sequence; identical to SEQ ID NO: 157700
  Description of Artificial Sequence: Synthetic coding sequence

SEQ ID NO: 157711 - DNA, 201 bp, Artificial Sequence; identical to SEQ ID NO: 157662
  Description of Artificial Sequence: Synthetic coding sequence

SEQ ID NO: 157712 - DNA, 180 bp, Artificial Sequence; identical to SEQ ID NO: 157659
  Description of Artificial Sequence: Synthetic coding sequence

SEQ ID NO: 157713 - DNA, 222 bp, Artificial Sequence; identical to SEQ ID NO: 157661
  Description of Artificial Sequence: Synthetic coding sequence

SEQ ID NO: 157714 - DNA, 201 bp, Artificial Sequence; identical to SEQ ID NO: 157660
  Description of Artificial Sequence: Synthetic coding sequence

SEQ ID NO: 157715 - DNA, 201 bp, Artificial Sequence; identical to SEQ ID NO: 157662
  Description of Artificial Sequence: Synthetic coding sequence

SEQ ID NO: 157716 - DNA, 87 bp, Artificial Sequence; identical to SEQ ID NO: 157679
  Description of Artificial Sequence: Synthetic coding sequence

SEQ ID NO: 157717 - DNA, 249 bp, Artificial Sequence; identical to SEQ ID NO: 157684
  Description of Artificial Sequence: Synthetic coding sequence

SEQ ID NO: 157718 - DNA, 156 bp, Artificial Sequence; identical to SEQ ID NO: 157668
  Description of Artificial Sequence: Synthetic coding sequence

SEQ ID NO: 157719 - DNA, 180 bp, Artificial Sequence; identical to SEQ ID NO: 157659
  Description of Artificial Sequence: Synthetic coding sequence

SEQ ID NO: 157720 - DNA, 201 bp, Artificial Sequence; identical to SEQ ID NO: 157662
  Description of Artificial Sequence: Synthetic coding sequence

SEQ ID NO: 157721 - DNA, 156 bp, Artificial Sequence; identical to SEQ ID NO: 157668
  Description of Artificial Sequence: Synthetic coding sequence

SEQ ID NO: 157722 - DNA, 249 bp, Artificial Sequence; identical to SEQ ID NO: 157684
  Description of Artificial Sequence: Synthetic coding sequence

SEQ ID NO: 157723 - DNA, 141 bp, Artificial Sequence; identical to SEQ ID NO: 157694
  Description of Artificial Sequence: Synthetic coding sequence

SEQ ID NO: 157724 - DNA, 108 bp, Artificial Sequence; identical to SEQ ID NO: 157663
  Description of Artificial Sequence: Synthetic coding sequence

SEQ ID NO: 157725 - DNA, 249 bp, Artificial Sequence; identical to SEQ ID NO: 157684
  Description of Artificial Sequence: Synthetic coding sequence

SEQ ID NO: 157726 - DNA, 87 bp, Artificial Sequence; identical to SEQ ID NO: 157679
  Description of Artificial Sequence: Synthetic coding sequence

SEQ ID NO: 157727 - DNA, 294 bp, Artificial Sequence; identical to SEQ ID NO: 157677
  Description of Artificial Sequence: Synthetic coding sequence

SEQ ID NO: 157728 - DNA, 87 bp, Artificial Sequence; identical to SEQ ID NO: 157679
  Description of Artificial Sequence: Synthetic coding sequence

SEQ ID NO: 157729 - DNA, 108 bp, Artificial Sequence; identical to SEQ ID NO: 157663
  Description of Artificial Sequence: Synthetic coding sequence

SEQ ID NO: 157730 - DNA, 294 bp, Artificial Sequence; identical to SEQ ID NO: 157677
  Description of Artificial Sequence: Synthetic coding sequence

SEQ ID NO: 157731 - DNA, 201 bp, Artificial Sequence; identical to SEQ ID NO: 157662
  Description of Artificial Sequence: Synthetic coding sequence

SEQ ID NO: 157732 - DNA, 201 bp, Artificial Sequence; identical to SEQ ID NO: 157662
  Description of Artificial Sequence: Synthetic coding sequence

SEQ ID NO: 157733 - DNA, 42 bp, Artificial Sequence; identical to SEQ ID NO: 157665
  Description of Artificial Sequence: Synthetic coding sequence

SEQ ID NO: 157734 - DNA, 87 bp, Artificial Sequence; identical to SEQ ID NO: 157679
  Description of Artificial Sequence: Synthetic coding sequence

SEQ ID NO: 157735 - DNA, 111 bp, Artificial Sequence; identical to SEQ ID NO: 157692
  Description of Artificial Sequence: Synthetic coding sequence

SEQ ID NO: 157736 - DNA, 294 bp, Artificial Sequence; identical to SEQ ID NO: 157677
  Description of Artificial Sequence: Synthetic coding sequence

SEQ ID NO: 157737 - DNA, 180 bp, Artificial Sequence; identical to SEQ ID NO: 157659
  Description of Artificial Sequence: Synthetic coding sequence

SEQ ID NO: 157738 - DNA, 294 bp, Artificial Sequence; identical to SEQ ID NO: 157677
  Description of Artificial Sequence: Synthetic coding sequence

SEQ ID NO: 157739 - DNA, 201 bp, Artificial Sequence; identical to SEQ ID NO: 157660
  Description of Artificial Sequence: Synthetic coding sequence

SEQ ID NO: 157740 - DNA, 87 bp, Artificial Sequence; identical to SEQ ID NO: 157679
  Description of Artificial Sequence: Synthetic coding sequence

SEQ ID NO: 157741 - DNA, 180 bp, Artificial Sequence; identical to SEQ ID NO: 157659
  Description of Artificial Sequence: Synthetic coding sequence

SEQ ID NO: 157742 - DNA, 201 bp, Artificial Sequence; identical to SEQ ID NO: 157662
  Description of Artificial Sequence: Synthetic coding sequence

SEQ ID NO: 157743 - DNA, 108 bp, Artificial Sequence; identical to SEQ ID NO: 157663
  Description of Artificial Sequence: Synthetic coding sequence

SEQ ID NO: 157744 - DNA, 201 bp, Artificial Sequence; identical to SEQ ID NO: 157662
  Description of Artificial Sequence: Synthetic coding sequence

SEQ ID NO: 157745 - DNA, 87 bp, Artificial Sequence; identical to SEQ ID NO: 157679
  Description of Artificial Sequence: Synthetic coding sequence

SEQ ID NO: 157746 - DNA, 108 bp, Artificial Sequence; identical to SEQ ID NO: 157663
  Description of Artificial Sequence: Synthetic coding sequence

SEQ ID NO: 157747 - DNA, 132 bp, Artificial Sequence; identical to SEQ ID NO: 157700
  Description of Artificial Sequence: Synthetic coding sequence

SEQ ID NO: 157748 - DNA, 111 bp, Artificial Sequence; identical to SEQ ID NO: 157692
  Description of Artificial Sequence: Synthetic coding sequence

SEQ ID NO: 157749 - DNA, 111 bp, Artificial Sequence; identical to SEQ ID NO: 157692
  Description of Artificial Sequence: Synthetic coding sequence

SEQ ID NO: 157750 - DNA, 201 bp, Artificial Sequence; identical to SEQ ID NO: 157662
  Description of Artificial Sequence: Synthetic coding sequence

SEQ ID NO: 157751 - DNA, 294 bp, Artificial Sequence; identical to SEQ ID NO: 157677
  Description of Artificial Sequence: Synthetic coding sequence

SEQ ID NO: 157752 - DNA, 87 bp, Artificial Sequence; identical to SEQ ID NO: 157679
  Description of Artificial Sequence: Synthetic coding sequence

SEQ ID NO: 157753 - DNA, 315 bp, Artificial Sequence; identical to SEQ ID NO: 157664
  Description of Artificial Sequence: Synthetic coding sequence

SEQ ID NO: 157754 - DNA, 201 bp, Artificial Sequence; identical to SEQ ID NO: 157662
  Description of Artificial Sequence: Synthetic coding sequence

SEQ ID NO: 157755 - DNA, 111 bp, Artificial Sequence; identical to SEQ ID NO: 157692
  Description of Artificial Sequence: Synthetic coding sequence

SEQ ID NO: 157756 - DNA, 294 bp, Artificial Sequence; identical to SEQ ID NO: 157677
  Description of Artificial Sequence: Synthetic coding sequence

SEQ ID NO: 157757 - DNA, 156 bp, Artificial Sequence; identical to SEQ ID NO: 157668
  Description of Artificial Sequence: Synthetic coding sequence

SEQ ID NO: 157758 - DNA, 315 bp, Artificial Sequence; identical to SEQ ID NO: 157664
  Description of Artificial Sequence: Synthetic coding sequence

SEQ ID NO: 157759 - DNA, 294 bp, Artificial Sequence; identical to SEQ ID NO: 157677
  Description of Artificial Sequence: Synthetic coding sequence

SEQ ID NO: 157760 - DNA, 315 bp, Artificial Sequence; identical to SEQ ID NO: 157664
  Description of Artificial Sequence: Synthetic coding sequence

SEQ ID NO: 157761 - DNA, 156 bp, Artificial Sequence; identical to SEQ ID NO: 157668
  Description of Artificial Sequence: Synthetic coding sequence

SEQ ID NO: 157762 - DNA, 201 bp, Artificial Sequence; identical to SEQ ID NO: 157660
  Description of Artificial Sequence: Synthetic coding sequence

SEQ ID NO: 157763 - DNA, 111 bp, Artificial Sequence; identical to SEQ ID NO: 157692
  Description of Artificial Sequence: Synthetic coding sequence

SEQ ID NO: 157764 - DNA, 222 bp, Artificial Sequence; identical to SEQ ID NO: 157661
  Description of Artificial Sequence: Synthetic coding sequence

SEQ ID NO: 157765 - DNA, 201 bp, Artificial Sequence; identical to SEQ ID NO: 157662
  Description of Artificial Sequence: Synthetic coding sequence

SEQ ID NO: 157766 - DNA, 201 bp, Artificial Sequence; identical to SEQ ID NO: 157662
  Description of Artificial Sequence: Synthetic coding sequence

SEQ ID NO: 157767 - DNA, 108 bp, Artificial Sequence; identical to SEQ ID NO: 157663
  Description of Artificial Sequence: Synthetic coding sequence

SEQ ID NO: 157768 - DNA, 87 bp, Artificial Sequence; identical to SEQ ID NO: 157679
  Description of Artificial Sequence: Synthetic coding sequence

SEQ ID NO: 157769 - DNA, 141 bp, Artificial Sequence; identical to SEQ ID NO: 157694
  Description of Artificial Sequence: Synthetic coding sequence

SEQ ID NO: 157770 - DNA, 141 bp, Artificial Sequence; identical to SEQ ID NO: 157694
  Description of Artificial Sequence: Synthetic coding sequence

SEQ ID NO: 157771 - DNA, 201 bp, Artificial Sequence; identical to SEQ ID NO: 157660
  Description of Artificial Sequence: Synthetic coding sequence

SEQ ID NO: 157772 - DNA, 141 bp, Artificial Sequence; identical to SEQ ID NO: 157694
  Description of Artificial Sequence: Synthetic coding sequence

SEQ ID NO: 157773 - DNA, 87 bp, Artificial Sequence; identical to SEQ ID NO: 157679
  Description of Artificial Sequence: Synthetic coding sequence

SEQ ID NO: 157774 - DNA, 294 bp, Artificial Sequence; identical to SEQ ID NO: 157677
  Description of Artificial Sequence: Synthetic coding sequence

SEQ ID NO: 157775 - DNA, 180 bp, Artificial Sequence; identical to SEQ ID NO: 157659
  Description of Artificial Sequence: Synthetic coding sequence

SEQ ID NO: 157776 - DNA, 294 bp, Artificial Sequence; identical to SEQ ID NO: 157677
  Description of Artificial Sequence: Synthetic coding sequence

SEQ ID NO: 157777 - DNA, 87 bp, Artificial Sequence; identical to SEQ ID NO: 157679
  Description of Artificial Sequence: Synthetic coding sequence

SEQ ID NO: 157778 - DNA, 111 bp, Artificial Sequence; identical to SEQ ID NO: 157692
  Description of Artificial Sequence: Synthetic coding sequence

SEQ ID NO: 157779 - DNA, 156 bp, Artificial Sequence; identical to SEQ ID NO: 157668
  Description of Artificial Sequence: Synthetic coding sequence

SEQ ID NO: 157780 - DNA, 42 bp, Artificial Sequence; identical to SEQ ID NO: 157665
  Description of Artificial Sequence: Synthetic coding sequence

SEQ ID NO: 157781 - DNA, 201 bp, Artificial Sequence; identical to SEQ ID NO: 157662
  Description of Artificial Sequence: Synthetic coding sequence

SEQ ID NO: 157782 - DNA, 87 bp, Artificial Sequence; identical to SEQ ID NO: 157679
  Description of Artificial Sequence: Synthetic coding sequence

SEQ ID NO: 157783 - DNA, 315 bp, Artificial Sequence; identical to SEQ ID NO: 157664
  Description of Artificial Sequence: Synthetic coding sequence

SEQ ID NO: 157784 - DNA, 249 bp, Artificial Sequence; identical to SEQ ID NO: 157684
  Description of Artificial Sequence: Synthetic coding sequence

SEQ ID NO: 157785 - DNA, 201 bp, Artificial Sequence; identical to SEQ ID NO: 157662
  Description of Artificial Sequence: Synthetic coding sequence

SEQ ID NO: 157786 - DNA, 87 bp, Artificial Sequence; identical to SEQ ID NO: 157679
  Description of Artificial Sequence: Synthetic coding sequence

SEQ ID NO: 157787 - DNA, 132 bp, Artificial Sequence; identical to SEQ ID NO: 157700
  Description of Artificial Sequence: Synthetic coding sequence

SEQ ID NO: 157788 - DNA, 249 bp, Artificial Sequence; identical to SEQ ID NO: 157684
  Description of Artificial Sequence: Synthetic coding sequence

SEQ ID NO: 157789 - DNA, 201 bp, Artificial Sequence; identical to SEQ ID NO: 157662
  Description of Artificial Sequence: Synthetic coding sequence

SEQ ID NO: 157790 - DNA, 180 bp, Artificial Sequence; identical to SEQ ID NO: 157659
  Description of Artificial Sequence: Synthetic coding sequence

SEQ ID NO: 157791 - DNA, 87 bp, Artificial Sequence; identical to SEQ ID NO: 157679
  Description of Artificial Sequence: Synthetic coding sequence

SEQ ID NO: 157792 - DNA, 249 bp, Artificial Sequence; identical to SEQ ID NO: 157684
  Description of Artificial Sequence: Synthetic coding sequence

SEQ ID NO: 157793 - DNA, 111 bp, Artificial Sequence; identical to SEQ ID NO: 157692
  Description of Artificial Sequence: Synthetic coding sequence

SEQ ID NO: 157794 - DNA, 222 bp, Artificial Sequence; identical to SEQ ID NO: 157661
  Description of Artificial Sequence: Synthetic coding sequence

SEQ ID NO: 157795 - DNA, 201 bp, Artificial Sequence; identical to SEQ ID NO: 157662
  Description of Artificial Sequence: Synthetic coding sequence

SEQ ID NO: 157796 - DNA, 87 bp, Artificial Sequence; identical to SEQ ID NO: 157679
  Description of Artificial Sequence: Synthetic coding sequence

SEQ ID NO: 157797 - DNA, 201 bp, Artificial Sequence; identical to SEQ ID NO: 157660
  Description of Artificial Sequence: Synthetic coding sequence

SEQ ID NO: 157798 - DNA, 222 bp, Artificial Sequence; identical to SEQ ID NO: 157661
  Description of Artificial Sequence: Synthetic coding sequence

SEQ ID NO: 157799 - DNA, 201 bp, Artificial Sequence; identical to SEQ ID NO: 157660
  Description of Artificial Sequence: Synthetic coding sequence

SEQ ID NO: 157800 - DNA, 87 bp, Artificial Sequence; identical to SEQ ID NO: 157679
  Description of Artificial Sequence: Synthetic coding sequence

SEQ ID NO: 157801 - DNA, 87 bp, Artificial Sequence; identical to SEQ ID NO: 157679
  Description of Artificial Sequence: Synthetic coding sequence

SEQ ID NO: 157802 - DNA, 87 bp, Artificial Sequence; identical to SEQ ID NO: 157679
  Description of Artificial Sequence: Synthetic coding sequence

SEQ ID NO: 157803 - DNA, 87 bp, Artificial Sequence; identical to SEQ ID NO: 157679
  Description of Artificial Sequence: Synthetic coding sequence

SEQ ID NO: 157804 - DNA, 294 bp, Artificial Sequence; identical to SEQ ID NO: 157677
  Description of Artificial Sequence: Synthetic coding sequence

SEQ ID NO: 157805 - DNA, 222 bp, Artificial Sequence; identical to SEQ ID NO: 157661
  Description of Artificial Sequence: Synthetic coding sequence

SEQ ID NO: 157806 - DNA, 87 bp, Artificial Sequence; identical to SEQ ID NO: 157679
  Description of Artificial Sequence: Synthetic coding sequence

SEQ ID NO: 157807 - DNA, 294 bp, Artificial Sequence; identical to SEQ ID NO: 157677
  Description of Artificial Sequence: Synthetic coding sequence

SEQ ID NO: 157808 - DNA, 201 bp, Artificial Sequence; identical to SEQ ID NO: 157662
  Description of Artificial Sequence: Synthetic coding sequence

SEQ ID NO: 157809 - DNA, 87 bp, Artificial Sequence; identical to SEQ ID NO: 157679
  Description of Artificial Sequence: Synthetic coding sequence

SEQ ID NO: 157810 - DNA, 201 bp, Artificial Sequence; identical to SEQ ID NO: 157662
  Description of Artificial Sequence: Synthetic coding sequence

SEQ ID NO: 157811 - DNA, 42 bp, Artificial Sequence; identical to SEQ ID NO: 157665
  Description of Artificial Sequence: Synthetic coding sequence

SEQ ID NO: 157812 - DNA, 132 bp, Artificial Sequence; identical to SEQ ID NO: 157691
  Description of Artificial Sequence: Synthetic coding sequence

SEQ ID NO: 157813 - DNA, 201 bp, Artificial Sequence; identical to SEQ ID NO: 157662
  Description of Artificial Sequence: Synthetic coding sequence

SEQ ID NO: 157814 - DNA, 294 bp, Artificial Sequence; identical to SEQ ID NO: 157677
  Description of Artificial Sequence: Synthetic coding sequence

SEQ ID NO: 157815 - DNA, 222 bp, Artificial Sequence; identical to SEQ ID NO: 157661
  Description of Artificial Sequence: Synthetic coding sequence

SEQ ID NO: 157816 - DNA, 42 bp, Artificial Sequence; identical to SEQ ID NO: 157665
  Description of Artificial Sequence: Synthetic coding sequence

SEQ ID NO: 157817 - DNA, 276 bp, Artificial Sequence; identical to SEQ ID NO: 157667
  Description of Artificial Sequence: Synthetic coding sequence

SEQ ID NO: 157818 - DNA, 276 bp, Artificial Sequence; identical to SEQ ID NO: 157667
  Description of Artificial Sequence: Synthetic coding sequence

SEQ ID NO: 157819 - DNA, 276 bp, Artificial Sequence; identical to SEQ ID NO: 157667
  Description of Artificial Sequence: Synthetic coding sequence

SEQ ID NO: 157820 - DNA, 108 bp, Artificial Sequence; identical to SEQ ID NO: 157663
  Description of Artificial Sequence: Synthetic coding sequence

SEQ ID NO: 157821 - DNA, 276 bp, Artificial Sequence; identical to SEQ ID NO: 157667
  Description of Artificial Sequence: Synthetic coding sequence

SEQ ID NO: 157822 - DNA, 108 bp, Artificial Sequence; identical to SEQ ID NO: 157663
  Description of Artificial Sequence: Synthetic coding sequence

SEQ ID NO: 157823 - DNA, 108 bp, Artificial Sequence; identical to SEQ ID NO: 157663
  Description of Artificial Sequence: Synthetic coding sequence

SEQ ID NO: 157824 - DNA, 276 bp, Artificial Sequence; identical to SEQ ID NO: 157667
  Description of Artificial Sequence: Synthetic coding sequence

SEQ ID NO: 157825 - DNA, 276 bp, Artificial Sequence; identical to SEQ ID NO: 157667
  Description of Artificial Sequence: Synthetic coding sequence

SEQ ID NO: 157826 - DNA, 108 bp, Artificial Sequence; identical to SEQ ID NO: 157663
  Description of Artificial Sequence: Synthetic coding sequence

SEQ ID NO: 157827 - DNA, 108 bp, Artificial Sequence; identical to SEQ ID NO: 157663
  Description of Artificial Sequence: Synthetic coding sequence

SEQ ID NO: 157828 - DNA, 108 bp, Artificial Sequence; identical to SEQ ID NO: 157663
  Description of Artificial Sequence: Synthetic coding sequence

SEQ ID NO: 157829 - DNA, 108 bp, Artificial Sequence; identical to SEQ ID NO: 157663
  Description of Artificial Sequence: Synthetic coding sequence

SEQ ID NO: 157830 - DNA, 276 bp, Artificial Sequence; identical to SEQ ID NO: 157667
  Description of Artificial Sequence: Synthetic coding sequence

SEQ ID NO: 157831 - DNA, 843 bp, Artificial Sequence
  Description of Artificial Sequence: Synthetic coding sequence
atggagcgggagatggtgctgtgcctggcccagaccatccacacccaggaggacctgccccggcccagcatctctgctgagcccggcaccgtcatccccctgggcagccacgtgacctttgtgtgccggggccctgtgggcgtgcagaccttccggctggagcgggagagccgcagcacctacaatgacacagaagatgtgtcccaggccagccccagcgagagcgaggcccgcttcagaattgattctgtgtctgagggcaatgccggcccctaccgctgcatctactacaagccacccaagtggagcgagcagagcgactacctggagctgctggtgaaggagaccagcggcggccctgacagcccagacacagagcccggcagcagcgctggccccacccagaggcccagcgacaacagccacaatgaacatgccccagccagccagggcctgaaggccgagcacctgtacatcctgattggagtgtctgtggtgttcctgttctgcctgctgctgctggtgctcttctgcctgcaccggcagaaccagatcaagcagggccccccaagaagcaaggatgaggagcagaagccccagcagaggccagacctggccgtggatgtgctggagaggacagctgacaaggccaccgtgaatggcctgcctgagaaggaccgggagacagacaccagcgccctggccgccggcagcagccaggaggtgacctacgcccagctggaccactgggccctgacccagaggacagcccgggctgtgagcccccagagcaccaagcccatggccgagagcatcacctatgctgctgtggcccggcactag

SEQ ID NO: 157832 - DNA, 813 bp, Artificial Sequence
  Description of Artificial Sequence: Synthetic coding sequence
atgagcccccaccccacagccctgctgggcctggtgctgtgcctggcccagaccatccacacccaggaggaggacctgccccggcccagcatctctgctgagcccggcaccgtcatccccctgggcagccacgtgacctttgtgtgccggggccctgtgggcgtgcagaccttccggctggagcgggagagccgcagcacctacaatgacacagaagatgtgtcccaggccagccccagcgagagcgaggcccgcttcagaattgacagcgtgtctgagggcaatgccggcccctaccgctgcatctactacaagccacccaagtggagcgagcagagcgactacctggagctgctggtgaagggccccacccagaggcccagcgacaacagccacaatgaacatgccccagccagccagggcctgaaggccgagcacctgtacatcctgattggagtgtctgtggtgttcctgttctgcctgctgctgctggtgctcttctgcctgcaccggcagaaccagatcaagcagggccccccaagaagcaaggatgaggagcagaagccccagcagaggccagacctggccgtggatgtgctggagaggacagctgacaaggccaccgtgaatggcctgcctgagaaggaccgggagacagacaccagcgccctggccgccggcagcagccaggaggtgacctacgcccagctggaccactgggccctgacccagaggacagcccgggctgtgagcccccagagcaccaagcccatggccgagagcatcacctatgctgctgtggcccggcactag

SEQ ID NO: 157833 - DNA, 864 bp, Artificial Sequence
  Description of Artificial Sequence: Synthetic coding sequence
atgagcccccaccccacagccctgctgggcctggtgctgtgcctggcccagaccatccacacccaggaggaggacctgccccggcccagcatctctgctgagcccggcaccgtcatccccctgggcagccacgtgacctttgtgtgccggggccctgtgggcgtgcagaccttccggctggagcgggagagccgcagcacctacaatgacacagaagatgtgtcccaggccagccccagcgagagcgaggcccgcttcagaattgacagcgtgtctgagggcaatgccggcccctaccgctgcatctactacaagccacccaagtggagcgagcagagcgactacctggagctgctggtgaaggagaccagcggcggccctgacagcccagacacagagcccggcagcagcgctggccccacccagaggcccagcgacaacagccacaatgagcacgccccagccagccagggcctgaaggccgagcacctgtacatcctgattggagtgtctgtggtgttcctgttctgcctgctgctgctggtgctcttctgcctgcaccggcagaaccagatcaagcagggcccccccaggagcaaggatgaggagcagaagccccagcagaggccagacctggccgtggatgtgctggagaggacagctgacaaggccaccgtgaatggcctgcctgagaaggaccgggagacagacaccagcgccctggccgccggcagcagccaggaggtgacctacgcccagctggaccactgggccctgacccagaggacagcccgggctgtgagcccccagagcaccaagcccatggccgagagcatcacctacgccgctgtggcccggcactag

SEQ ID NO: 157834 - DNA, 1545 bp, Artificial Sequence
  Description of Artificial Sequence: Synthetic coding sequence
atgctgaccagggtgaagtctgctgtggccaacttcatgggcggcatcatggccggcagcagcggcagcgagcacggcggcggcagctgtggcggcagtgacctgcccctgcgcttcccctacggccggcctgagttcctgggcctgagccaggatgaggtggagtgcagcgctgaccacatcgcccggcccatcctgatcctgaaggagacccggcggctgccctgggccaccggctatgcagaggtgatcaatgctgggaagagcacccacaatgaagaccaggccagctgtgaggtgctgactgtgaagaagaaggccggggctgtgaccagcacccccaacagaaacagcagcaagagaagaagcagcctgcccaatggagagggcctgcagctgaaggaaaattctgagagcgagggcgtgtcctgccactactggagcctgtttgatggccacgccggcagcggggctgctgtggtggccagccggctgctgcagcaccacatcacagagcagctgcaggacatcgtggacatcctgaagaacagcgctgtgctgccccccacctgcctgggggaggagcctgagaacaccccagccaacagcaggaccctgaccagggctgccagcctgcggggcggcgtgggcgcccctggcagccccagcaccccacccacccgcttcttcacagagaagaagatcccccatgagtgcctggtgattggagccctggagagcgccttcaaggagatggacctgcagatcgagcgggagaggagcagctacaacatcagcggcggctgcacagccctgattgtcatctgcctgctgggcaagctgtatgtggccaatgctggggacagccgggccatcatcatcagaaatggagagatcatccccatgagcagcgagttcaccccagagacagagcggcagaggctgcagtacctggccttcatgcagccccacctgctgggcaatgagttcacccacctggagttccccaggagagtgcagaggaaggagctgggcaagaagatgctgtacagagacttcaacatgacaggctgggcctacaagaccattgaagatgaggacctgaagttccccctcatctacggggagggcaagaaggcccgggtgatggccaccatcggcgtgacccggggcctgggggaccatgacctgaaggtgcatgacagcaacatctacatcaagcccttcctgagcagcgcccctgaggtgcgcatctatgacctgagcaaatatgaccacggcagtgatgatgtgctgatcctggccacagatggcctgtgggatgtgctgagcaatgaggaggtggccgaggccatcacccagttcctgcccaactgtgaccctgatgacccccaccgctacaccctggccgcccaggacctggtgatgagggcccggggcgtgctgaaggaccggggctggaggatcagcaatgaccggctgggcagcggagatgacatctctgtgtatgtgatccccctcatccacggcaacaagctgtcctag

SEQ ID NO: 157835 - DNA, 1527 bp, Artificial Sequence
  Description of Artificial Sequence: Synthetic coding sequence
atgctgccccagaggaacctgagcaagaggcaggtgcccaccatgcacatccctgtgaagacccggcggctgctggccgccctgaaggtgctggacaccaaggacctgaccatcgagaaggtggtgatcaatggccaggaggtgaagtatgccctgggggagcggcagagctacaagggcagccccatggagatcagcctgcccatcgccctgagcaagaaccaggagatcgtgattgagatcagctttgagaccagccccaagagcagcgccctgcagtggctgaccccagagcagaccagcggcaaggagcacccctacctgttcagccagtgccaggccatccactgccgggccatcctgccctgccaggacacccccagcgtgaagctgacctacacagctgaggtgtctgtgcccaaggagctggtggccctgatgtctgccatcagagatggagagaccccagaccctgaggaccccagcaggaagatctacaagttcatccagaaggtgcccatcccctgctacctgattgccctggtggtgggcgccctggagagccggcagatcggccccaggaccctggtgtggagcgagaaggagcaggtggagaagagcgcctatgagttcagcgagacagagagcatgctgaagattgctgaggacctgggcggcccctacgtgtggggccagtatgacctgctggtgctgcccccatccttcccctacggcggcatggagaacccctgcctgacctttgtgacccccaccctgctggccggggacaagagcctgagcaatgtcatcgcccacgagatcagccacagctggacaggcaacctggtgaccaacaagacctgggaccacttctggctgaatgaaggccacacagtgtacctggagcggcacatctgtggccgcctgtttggagagaagttccgccacttcaatgccctgggcggctggggcgagctgcagaacagcgtgaagacctttggagagacccaccccttcaccaagctggtggtggacctgacagacattgatcctgatgtggcctacagctctgtgccctatgagaagggctttgccctgctcttctacctggagcagctgctgggcggccctgagatcttcctgggcttcctgaaggcctacgtggagaagttctcctacaagagcatcaccacagatgactggaaggacttcctgtacagctacttcaaggacaaggtggatgtgctgaaccaggtggactggaatgcctggctgtacagccctggcctgccccccatcaagcccaactatgacatgaccctgaccaatgcctgcatcgccctgagccagcgctggatcacagccaaggaggatgacctgaacagcttcaatgccacagacctgaaggacctgagcagccaccagctgaatgagttcctggcccagaccctgcagaggatggctgctgccctgcacagcatccaggtgggcggcagaaattcctttggagccaaggatggcaactag

SEQ ID NO: 157836 - DNA, 1764 bp, Artificial Sequence
  Description of Artificial Sequence: Synthetic coding sequence
atgctgccccagaggaacctgagcaagaggcaggtgcccaccatgcacatccctgtgaagacccggcggctgctggccgccctgaaggtgctggacaccaaggacctgaccatcgagaaggtggtgatcaatggccaggaggtgaagtatgccctgggggagcggcagagctacaagggcagccccatggagatcagcctgcccatcgccctgagcaagaaccaggagatcgtgattgagatcagctttgagaccagccccaagagcagcgccctgcagtggctgaccccagagcagaccagcggcaaggagcacccctacctgttcagccagtgccaggccatccactgccgggccatcctgccctgccaggacacccccagcgtgaagctgacctacacagctgaggtgtctgtgcccaaggagctggtggccctgatgtctgccatcagagatggagagaccccagaccctgaggaccccagcaggaagatctacaagttcatccagaaggtgcccatcccctgctacctgattgccctggtggtgggcgccctggagagccggcagatcggccccaggaccctggtgtggagcgagaaggagcaggtggagaagagcgcctatgagttcagcgagacagagagcatgctgaagattgctgaggacctgggcggcccctacgtgtggggccagtatgacctgctggtgctgcccccatccttcccctacggcggcatggagaacccctgcctgacctttgtgacccccaccctgctggccggggacaagagcctgagcaatgtcatcgcccacgagatcagccacagctggacaggcaacctggtgaccaacaagacctgggaccacttctggctgaatgaaggccacacagtgtacctggagcggcacatctgtggccgcctgtttggagagaagttccgccacttcaatgccctgggcggctggggcgagctgcagaacagcgtgaagacctttggagagacccaccccttcaccaagctggtggtggacctgacagacattgatcctgatgtggcctacagctctgtgccctatgagaagggctttgccctgctcttctacctggagcagctgctgggcggccctgagatcttcctgggcttcctgaaggcctacgtggagaagttctcctacaagagcatcaccacagatgactggaaggacttcctgtacagctacttcaaggacaaggtggatgtgctgaaccaggtggactggaatgcctggctgtacagccctggcctgccccccatcaagcccaactatgacatgaccctgaccaatgcctgcatcgccctgagccagcgctggatcacagccaaggaggatgacctgaacagcttcaatgccacagacctgaaggacctgagcagccaccagctgaatgagttcctggcccagaccctgcagagggcccccctgcccctgggccacatcaagaggatgcaggaggtgtacaacttcaatgccatcaacaacagcgagatccgcttccgctggctgcggctgtgcatccagagcaagtgggaggatgccatccccctggccctgaagatggccacagagcagggccgcatgaagttcacccggcccctcttcaaggacctggccgcctttgacaagagccatgaccaggccgtgaggacctaccaggagcacaaggcctccatgcaccctgtgacagccatgctggtgggcaaggacctgaaggtggactag

SEQ ID NO: 157837 - DNA, 1059 bp, Artificial Sequence
  Description of Artificial Sequence: Synthetic coding sequence
atgaacaccaccagcagcgctgccccacccagcctgggcgtggagttcatcagcctgctggccatcatcctgctgtctgtggccctggccgtgggcctgcccggcaacagctttgtggtgtggagcatcctgaagaggatgcagaagaggtctgtgacagccctgatggtgctgaacctggccctggccgacctggccgtgctgctgacagcccccttcttcctgcacttcctggcccagggcacctggagctttggcctggccggctgccgcctgtgccactacgtgtgtggggtgtccatgtatgcctctgtgctgctgatcacagccatgagcctggacaggagcctggccgtggcccggccctttgtgtcccagaagctgcggaccaaggccatggccaggagagtgctggccggcatctgggtgctgtccttcctgctggccacccctgtgctggcctacagaacagtggtgccctggaagaccaacatgagcctgtgcttcccccgctaccccagcgagggccaccgggccttccacctgatctttgaggccgtgacaggcttcctgctgcccttcctggccgtggtggccagctacagcgacatcggccggcggctgcaggcccggcgcttccgccgcagcagaagaacaggccgcctggtggtgctgatcatcctgacctttgctgccttctggctgccctaccacgtggtgaacctggccgaggccggccgggccctggccggccaggccgccggcctgggcctggtgggcaagaggctgagcctggccagaaatgtgctgattgccctggccttcctgagcagctctgtgaaccctgtgctgtatgcctgtgccggcggcggcctgctgcggtctgctggggtgggctttgtggccaagctgctggagggcaccggcagcgaggccagcagcacccggcggggcggcagcctgggccagacagcccggagcggccctgctgccctggagcccggccccagcgagagcctgacagccagcagccccctgaagctgaatgagctgaactag

SEQ ID NO: 157838 - DNA, 1059 bp, Artificial Sequence; identical to SEQ ID NO: 157837
  Description of Artificial Sequence: Synthetic coding sequence

SEQ ID NO: 157839 - DNA, 1059 bp, Artificial Sequence; identical to SEQ ID NO: 157837
  Description of Artificial Sequence: Synthetic coding sequence

SEQ ID NO: 157840 - DNA, 309 bp, Artificial Sequence
  Description of Artificial Sequence: Synthetic coding sequence
atgaacaccaccagcagcgctgccccacccagcctgggcgtggagttcatcagcctgctggccatcatcctgctgtctgtggccctggccgtgggcctgcccggcaacagctttgtggtgtggagcatcctgaagaggatgcagaagaggtctgtgacagccctgatggtgctgaacctggccctggccgacctggccgtgctgctgacagcccccttcttcctgcacttcctggcccagggcacctggagctttggcctggccggctgccgcctgtgccactacgtgtgtggggtgtccatgtactag

SEQ ID NO: 157841 - DNA, 483 bp, Artificial Sequence
  Description of Artificial Sequence: Synthetic coding sequence
atgtctgtgtgctacagacctcctggaaatgagaccctgctgtcctggaagaccagccgggccaccggcacagccttcctgctgctggccgccctgctgggcctgcctggaaatggatttgtggtgtggagcctggccggctggaggcctgcccggggccggcccctggccgccaccctggtgctgcacctggccctggctgatggagctgtgctgctgctgacccccctgtttgtggccttcctgacccggcaggcctggcccctgggccaggccggctgcaaggctgtgtactacgtgtgtgccctgtccatgtatgcctctgtgctgctgaccggcctgctgagcctgcagcgctgcctggccgtgacccggcccttcctggccccccggctgcggagccctgccctggcccggcggctgctgctggccgtgtggctggccgccctgctgctggccgtgcctgctgctgtgtacagatag

SEQ ID NO: 157842 - DNA, 1170 bp, Artificial Sequence
  Description of Artificial Sequence: Synthetic coding sequence
atggcccccagccaccgggccagccaggtgggcttctgccccaccccagagcggcccctgtggaggctgccccccacctgccggcccaggaggatgtctgtgtgctaccggcccccaggaaatgagaccctgctgtcctggaagaccagccgggccactggaacagccttcctgctgctggccgccctgctgggcctgcctggaaatggatttgtggtgtggagcctggccggctggaggcctgcccggggccggcccctggccgccaccctggtgctgcacctggccctggctgatggagctgtgctgctgctgacccccctgtttgtggccttcctgacccggcaggcctggcccctgggccaggccggctgcaaggctgtgtactacgtgtgtgccctgtccatgtatgcctctgtgctgctgaccggcctgctgagcctgcagcgctgcctggccgtgacccggcccttcctggccccccggctgcggagccctgccctggcccggcggctgctgctggccgtgtggctggccgccctgctgctggccgtgcctgctgctgtgtaccgccacctgtggagggacagagtgtgccagctgtgccaccccagccctgtgcatgctgctgcccacctgagcctggagaccctgacagcctttgtgctgcccttcggcctgatgctgggctgctacagcgtgaccctggcccggctgcggggggcccgctggggcagcggcagacatggagcccgggtgggccgcctggtgtctgccatcgtgctggccttcggcctgctgtgggccccctaccacgctgtgaacctgctgcaggccgtggccgccctggcccctcctgagggcgccctggccaagctgggcggggccggccaggccgcccgggccggcaccacagccctggccttcttcagcagctctgtgaaccctgtgctgtatgtgttcaccgctggggacctgctgccccgggccggcccccgcttcctgacccggctgtttgagggcagcggggaggcccggggcggcggccgcagccgggagggcaccatggagctgcggaccaccccccagctgaaggtggtgggccagggcagaggaaatggagaccccggcggcggcatggagaaggatggccctgagtgggacctgtag

SEQ ID NO: 157843 - DNA, 960 bp, Artificial Sequence
  Description of Artificial Sequence: Synthetic coding sequence
atgtctgtgtgctacagacctcctggaaatgagaccctgctgtcctggaagaccagccgggccaccggcacagccttcctgctgctggccgccctgctgggcctgcctggaaatggatttgtggtgtggagcctggccggctggaggcctgcccggggccggcccctggccgccaccctggtgctgcacctggccctggctgatggagctgtgctgctgctgacccccctgtttgtggccttcctgacccggcaggcctggcccctgggccaggccggctgcaaggctgtgtactacgtgtgtgccctgtccatgtatgcctctgtgctgctgaccggcctgctgagcctgcagcgctgcctggccgtgacccggcccttcctggccccccggctgcggagccctgccctggcccggcggctgctgctggccgtgtggctggccgccctgctgctggccgtgcctgctgctgtgtaccgccacctgtggagggacagagtgtgccagctgtgccaccccagccctgtgcacgccgccgcccacctgagcctggagaccctgacagcctttgtgctgcccttcggcctgatgctgggctgctacagcgtgaccctggcccggctgcggggggcccgctggggcagcggccgccacggggcccgggtgggccgcctggtgtctgccatcgtgctggccttcggcctgctgtgggccccctaccacgctgtgaacctgctgcaggccgtggccgccctggcccctcctgagggcgccctggccaagctgggcggggccggccaggccgcccgggccggcaccacagccctggccttcttcagcagctctgtgaaccctgtgctgtatgtgttcaccgctggggacctgctgcccagggctggcccccgcttcctgacccggctgtttgagggcagcggggaggcccggggcggcggccgctag

SEQ ID NO: 157844 - DNA, 1077 bp, Artificial Sequence
  Description of Artificial Sequence: Synthetic coding sequence
atgtctgtgtgctacagacctcctggaaatgagaccctgctgtcctggaagaccagccgggccaccggcacagccttcctgctgctggccgccctgctgggcctgcctggaaatggatttgtggtgtggagcctggccggctggaggcctgcccggggccggcccctggccgccaccctggtgctgcacctggccctggctgatggagctgtgctgctgctgacccccctgtttgtggccttcctgacccggcaggcctggcccctgggccaggccggctgcaaggctgtgtactacgtgtgtgccctgtccatgtatgcctctgtgctgctgaccggcctgctgagcctgcagcgctgcctggccgtgacccggcccttcctggccccccggctgcggagccctgccctggcccggcggctgctgctggccgtgtggctggccgccctgctgctggccgtgcctgctgctgtgtaccgccacctgtggagggacagagtgtgccagctgtgccaccccagccctgtgcacgccgccgcccacctgagcctggagaccctgacagcctttgtgctgcccttcggcctgatgctgggctgctacagcgtgaccctggcccggctgcggggggcccgctggggcagcggccgccacggggcccgggtgggccgcctggtgtctgccatcgtgctggccttcggcctgctgtgggccccctaccacgctgtgaacctgctgcaggccgtggccgccctggcccctcctgagggcgccctggccaagctgggcggggccggccaggccgcccgggccggcaccacagccctggccttcttcagcagctctgtgaaccctgtgctgtatgtgttcaccgctggggacctgctgcccagggctggcccccgcttcctgacccggctgtttgagggcagcggggaggcccggggcggcggccgcagccgggagggcaccatggagctgcggaccaccccccagctgaaggtggtgggccagggcagaggaaatggagaccccggcggcggcatggagaaggatggccctgagtgggacctgtag

SEQ ID NO: 157845 - DNA, 1077 bp, Artificial Sequence; identical to SEQ ID NO: 157844
  Description of Artificial Sequence: Synthetic coding sequence

SEQ ID NO: 157846 - DNA, 453 bp, Artificial Sequence
  Description of Artificial Sequence: Synthetic coding sequence
atgaaggatgaggtggccctgctggccgctgtgaccctgctgggcgtgctgctgcaggcctacttcagcctgcaggtgatcagcgcccggcgggccttccgggtgtccccacccctgaccactggacctcctgagtttgagcgggtgtaccgggcccaggtgaactgcagcgagtacttccccctcttcctggccaccctgtgggtggccggcatcttcttccatgaaggagctgctgccctgtgtggcctggtgtacctgtttgcccggctgcgctacttccagggctacgcccggagcgcccagctgcggctggcccccctgtatgccagcgcccgggccctgtggctgctggtggccctggccgccctgggcctgctggcccacttcctgcctgctgccctgcgggccgccctgctgggccgcctgcggaccctgctgccctgggcctag

SEQ ID NO: 157847 - DNA, 1161 bp, Artificial Sequence
  Description of Artificial Sequence: Synthetic coding sequence
atggaggagctggatgccctgctggaggagctggagaggagcaccctgcaggacagtgatgagtacagcaacccagcccccctgcccctggaccagcacagcaggaaggagaccaacctggatgagaccagcgagatcctgagcatccaggacaacaccagccccctgcctgcccagctggtgtacaccaccaacatccaggagctgaatgtgtacagcgaggcccaggagcccaaggagagccccccacccagcaagaccagcgctgctgcccagctggatgagctgatggcccacctgacagagatgcaggccaaggtggccgtgcgggcagatgctgggaagaagcacctgcctgacaagcaggaccacaaggccagcctggacagcatgctgggcggcctggagcaggagctgcaggacctgggcatcgccaccgtgcccaagggccactgtgccagctgccagaagcccatcgccggcaaggtgattcatgccctgggccagagctggcaccctgagcactttgtgtgcacccactgcaaggaggagatcggcagcagccccttctttgagaggagcggcctggcctactgccccaatgactaccaccagctgttcagcccccgctgtgcctactgtgccgcccccatcctggacaaggtgctgacagccatgaaccagacctggcaccctgagcacttcttctgcagccactgtggggaggtgtttggagctgagggcttccacgagaaggacaagaagccctactgcaggaaggacttcctggccatgttcagccccaagtgtggcggctgcaacagacctgtgctggagaactacctgagcgccatggacacagtgtggcaccctgagtgctttgtgtgtggggactgcttcaccagcttcagcacaggcagcttctttgagctggatggccggcccttctgtgagctgcactaccaccaccggcggggcaccctgtgccacggctgcggccagcccatcaccggccgctgcatcagcgccatgggctacaagttccaccctgagcactttgtgtgtgccttctgcctgacccagctgagcaagggcatcttccgggagcagaatgacaagacctactgccagccctgcttcaacaagctgttccccctgtag

SEQ ID NO: 157848 - DNA, 1176 bp, Artificial Sequence
  Description of Artificial Sequence: Synthetic coding sequence
atgagcaccctgctgatcagcagcagtgatgccctgctggaggagctggagaggagcaccctgcaggacagtgatgagtacagcaacccagcccccctgcccctggaccagcacagcaggaaggagaccaacctggatgagaccagcgagatcctgagcatccaggacaacaccagccccctgcctgcccagctggtgtacaccaccaacatccaggagctgaatgtgtacagcgaggcccaggagcccaaggagagccccccacccagcaagaccagcgctgctgcccagctggatgagctgatggcccacctgacagagatgcaggccaaggtggccgtgcgggcagatgctgggaagaagcacctgcctgacaagcaggaccacaaggccagcctggacagcatgctgggcggcctggagcaggagctgcaggacctgggcatcgccaccgtgcccaagggccactgtgccagctgccagaagcccatcgccggcaaggtgatccacgccctgggccagagctggcaccctgagcactttgtgtgcacccactgcaaggaggagatcggcagcagccccttctttgagaggagcggcctggcctactgccccaatgactaccaccagctgttcagcccccgctgtgcctactgtgccgcccccatcctggacaaggtgctgacagccatgaaccagacctggcaccctgagcacttcttctgcagccactgtggggaggtgtttggagctgagggcttccacgagaaggacaagaagccctactgcaggaaggacttcctggccatgttcagccccaagtgtggcggctgcaacagacctgtgctggagaactacctgagcgccatggacacagtgtggcacccagaatgttttgtgtgtggggactgcttcaccagcttcagcacaggcagcttctttgagctggatggccggcccttctgtgagctgcactaccaccacagaagaggcaccctgtgccacggctgcggccagcccatcaccggccgctgcatcagcgccatgggctacaagttccaccctgagcactttgtgtgtgccttctgcctgacccagctgagcaagggcatcttccgggagcagaatgacaagacctactgccagccctgcttcaacaagctgttccccctgtag

SEQ ID NO: 157849 - DNA, 1131 bp, Artificial Sequence
  Description of Artificial Sequence: Synthetic coding sequence
atgaactatgaatttgagcgggagatcggcttcatcaacagccagcccagcctggccgagtgcctgaccagcttcccccctgtggccgacaccttccagagcagcagcatcaagaccagcaccctgagccacagcaccctcatccccccaccatttgagcagaccatccccagcctgaaccctggcagccaccccaggcatggagctgggggccggcccaagcccagccctgctggcagccggggcagccctgtgcctgctggggccctgcagcccccagagtacccctggatgaaggagaagaaggccgccaagaagacagccctgctgcctgctgctgctgctgctgccacagctgctgccaccggccctgcctgcctgagccacaaggagagcctggagattgctgatggcagcggcggcggcagccggcggctgaggacagcctacaccaacacccagctgctggagctggagaaggagttccacttcaacaagtacctgtgccggccccggcgggtggagattgctgccctgctggacctgacagagcggcaggtgaaggtgtggttccagaacagaaggatgaagcacaagaggcagacccagtgcaaggagaaccagaacagcgagggcaagtgcaagagcctggaggacagcgagaaggtggaggaggatgaggaggagaagaccctgtttgagcaggccctgtctgtgtctggggccctgctggagcgggagggctacaccttccagcagaatgccctgagccagcagcaggccccaaatggccacaacggggacagccagagcttccctgtgagccccctgaccagcaatgagaagaacctgaagcacttccagcaccagagccccaccgtgcccaactgcctgagcaccatgggccagaactgtggggccggcctgaacaatgacagccctgaggccctggaggtgcccagcctgcaggacttcagcgtcttcagcacagacagctgcctgcagctgagtgatgctgtgagccccagcctgcccggcagcctggacagccctgtggacatctctgctgacagcctggacttcttcacagacaccctgaccaccatcgacctgcagcacctgaactactag

SEQ ID NO: 157850 - DNA, 753 bp, Artificial Sequence
  Description of Artificial Sequence: Synthetic coding sequence
atgaccccaggccgctgctgcctggccgctgacatccaggtggagaccttcatcttcacagatggagaagatgaggccctggcccggcacactggaaatgtggtgatcaccaactgcagcgctgcccacagccggcaggccctgagctgcaagatggctgtggagtatgaccgcttcatcgagagcggcaggaagtggttctgccacgtggatgatgacaactacgtgaacctgcgggccctgctgcggctgctggccagctacccccacaccagagatgtgtatgtgggcaagcccagcctggaccggcccatccaggccatggagcgggtgtctgagaacaaggtgcggcctgtgcacttctggtttgccactggaggagctggcttctgcatcagccggggcctggccctgaagatgagcccctgggccagcggcggccacttcatgaacacagctgagcgcatccggctgcctgatgactgcaccatcggctacatcgtggaggccctgctgggcgtgcccctcatccgcagcggcctcttccacagccacctggagaacctgcagcaggtgcccaccagcgagctgcacgagcaggtgaccctgtcctatggcatgtttgagaacaagagaaatgctgtgcacgtgaagggccccttctctgtggaggccgaccccagccgcttccgcagcatccactgccacctgtacccagacaccccctggtgccccaggacagccatcttctag

SEQ ID NO: 157851 - DNA, 1086 bp, Artificial Sequence
  Description of Artificial Sequence: Synthetic coding sequence
atgctgaagagatgtggccgccgcctgctgctggccctggccggggccctgctggcctgcctgctggtgctgacagctgaccccccacctccacccctgcctgctgagcggggcagaagagccctgcggagcctggccggccctgctggagctgccccagcccctggcctgggcgctgctgctgctgcccctggggccctggtgagagatgtgcacagcctgtctgagtacttcagcctgctgacccgggccaggagagatgctggccccccacctggggccgcccccaggcctgcagatggccacccccggcccctggccgagcccctggcccccagagatgtgttcatcgctgtgaagaccaccaagaagttccaccgggcccggctggacctgctgctggagacctggatcagccgccacaaggagatgaccttcatcttcacagatggagaagatgaggccctggcccggcacactggaaatgtggtgatcaccaactgcagcgctgcccacagccggcaggccctgagctgcaagatggctgtggagtatgaccgcttcattgaaagtggcaggaagtggttctgccacgtggatgatgacaactacgtgaacctgcgggccctgctgcggctgctggccagctacccccacaccagagatgtgtatgtgggcaagcccagcctggaccggcccatccaggccatggagcgggtgtctgagaacaaggtgcggcctgtgcacttctggtttgccaccggcggggccggcttctgcatcagccggggcctggccctgaagatgagcccctgggccagcggcggccacttcatgaacacagctgagcgcatccggctgcctgatgactgcaccatcggctacatcgtggaggccctgctgggcgtgcccctcatccgcagcggcctcttccacagccacctggagaacctgcagcaggtgcccaccagcgagctgcacgagcaggtgaccctgtcctatggcatgtttgagaacaagagaaatgctgtgcacgtgaagggccccttctctgtggaggccgaccccagccgctggggcaactag

SEQ ID NO: 157852 - DNA, 753 bp, Artificial Sequence; identical to SEQ ID NO: 157850
  Description of Artificial Sequence: Synthetic coding sequence

SEQ ID NO: 157853 - DNA, 927 bp, Artificial Sequence
  Description of Artificial Sequence: Synthetic coding sequence
atggatgagcagacaggccgcctgcggctggacacctactgcatgtctgccaagcagatctgggcctggagcaaatgttctggccgcctgtgggatgagcacatgaagtggatggagggctggacagaccgctggacagatggctggatggatggctggatggatgagtggagccccaccccagccctgcggagctatggaggcggcctgagccagcagaccttcatcttcacagatggagaagatgaggccctggcccggcacactggaaatgtggtgatcaccaactgcagcgctgcccacagccggcaggccctgagctgcaagatggctgtggagtatgaccgcttcatcgagagcggcaggaagtggttctgccacgtggatgatgacaactacgtgaacctgcgggccctgctgcggctgctggccagctacccccacaccagagatgtgtatgtgggcaagcccagcctggaccggcccatccaggccatggagcgggtgtctgagaacaaggtgcggcctgtgcacttctggtttgccactggaggagctggcttctgcatcagccggggcctggccctgaagatgagcccctgggccagcggcggccacttcatgaacacagctgagcgcatccggctgcctgatgactgcaccatcggctacatcgtggaggccctgctgggcgtgcccctcatccgcagcggcctcttccacagccacctggagaacctgcagcaggtgcccaccagcgagctgcacgagcaggtgaccctgtcctatggcatgtttgagaacaagagaaatgctgtgcacgtgaagggccccttctctgtggaggccgaccccagccgcttccgcagcatccactgccacctgtacccagacaccccctggtgccccaggacagccatcttctag

SEQ ID NO: 157854 - DNA, 1302 bp, Artificial Sequence
  Description of Artificial Sequence: Synthetic coding sequence
atgcagaggatgatccagcagtttgctgctgagtacaccagcaagaacagcagcacccaggaccccagccagcccaacagcaccaagaaccagagcctgcccaaggccagccctgtgaccaccagccccacagctgccaccacccagaaccctgtgctgagcaagctgctgatggctgaccaggacagccccctggacctgactgtgaggaagagccagagcgagcccagcgagcaggatggagtgctggacctgagcaccaagaagagcccctgtgccggcagcaccagcctgagccacagccctggctgcagcagcacccagggcaatggccggcccggccggcccagccagtacagaccagatggcctgcggtctggagatggagtgcccccaagaagcctgcaggacggcacccgggagggcttcggccacagcaccagcctgaaggtgcccctggcccggagcctgcagatcagcgaggagctgctgagcaggaaccagctgagcacagctgccagcctgggccccagcggcctgcagaaccacggccagcacctgatcctgagccgggaggcctcctgggccaagccccactatgagttcaacctgagcaggatgaagttcagaggaaatggagccctgagcaacatcagtgacctgcccttcctggccgagaacagcgccttccccaagatggccctgcaggccaagcaggacggcaagaaggatgtgagccacagcagccctgtggacctgaagatcccccaggtgcggggcatggacctgtcctgggagagcaggactggagaccagtacagctacagcagcctggtgatgggcagccagacagagagcgccctgagcaagaagctgcgggccatcctgcccaagcagagcaggaagtccatgctggatgctggccctgacagctggggcagtgatgctgagcagagcaccagcggccagccctaccccaccagtgaccaggagggggaccccggcagcaagcagcccaggaagaagaggggccgctaccggcagtacaacagcgagatcctggaggaggccatctctgtggtgatgtctgggaagatgtctgtgtccaaggcccagagcatctacggcatcccccacagcaccctggagtacaaggtgaaggagcggctgggcaccctgaagaacccccccaagaagaagatgaagctgatgaggtctgagggcccagatgtgtctgtgaagattgagctggacccccagggcgaggccgcccagagcgccaatgaaagcaagaatgaatag

SEQ ID NO: 157855 - DNA, 1302 bp, Artificial Sequence; identical to SEQ ID NO: 157854
  Description of Artificial Sequence: Synthetic coding sequence

SEQ ID NO: 157856 - DNA, 1302 bp, Artificial Sequence; identical to SEQ ID NO: 157854
  Description of Artificial Sequence: Synthetic coding sequence

SEQ ID NO: 157857 - DNA, 1221 bp, Artificial Sequence
  Description of Artificial Sequence: Synthetic coding sequence
atgcagaggatgatccagcagtttgctgctgagtacaccagcaagaacagcagcacccaggaccccagccagcccaacagcaccaagaaccagagcctgcccaaggccagccctgtgaccaccagccccacagctgccaccacccagaaccctgtgctgagcaagctgctgatggctgaccaggacagccccctggacctgactgtgaggaagagccagagcgagcccagcgagcaggatggagtgctggacctgagcaccaagaagagcccctgtgccggcagcaccagcctgagccacagccctggctgcagcagcacccagggcaatggccggcccggccggcccagccagtacagaccagatggcctgcggtctggagatggagtgcccccaagaagcctgcaggacggcacccgggagggcttcggccacagcaccagcctgaaggtgcccctggcccggagcctgcagatcagcgaggagctgctgagcaggaaccagctgagcacagctgccagcctgggccccagcggcctgcagaaccacggccagcacctgatcctgagccgggaggcctcctgggccaagccccactatgagttcaacctgagcaggatgaagttcagaggaaatggagccctgagcaacatcagtgacctgcccttcctggccgagaacagcgccttccccaagatggccctgcaggccaagcaggacggcaagaaggatgtgagccacagcagccctgtggacctgaagatcccccaggtgcggggcatggacctgtcctgggagagcaggactggagaccagtacagctacagcagcctggtgatgggcagccagacagagagcgccctgagcaagaagctgcgggccatcctgcccaagcagagcaggaagtccatgctggatgctggccctgacagctggggcagtgatgctgagcagagcaccagcggccagccctaccccaccagtgaccaggagggggaccccggcagcaagcagcccaggaagaagaggggccgctaccggcagtacaacagcgagatcctggaggaggccatctctgtggtgatgtctgggaagatgtctgtgtccaaggcccagagcatctacggcatcccccacagcaccctggagtacaaggtgaaggagcggctgggcaccctgaagaacccccccaagaagaagatgaagctgatgtctggatag

SEQ ID NO: 157858 - DNA, 957 bp, Artificial Sequence
  Description of Artificial Sequence: Synthetic coding sequence
atggacaagggccgggagaggatggctgctgctgctgctgctgctgctgctgctgctgctgctgcccagtgccgcagcccccgctgtgccgctgagcggcggggcttcagaagagagctggacagctggaggcaccggctgatgcactgtgtgggctttgagagcatcctggagggcctgtatggcccccggctgcggcgggacctgagcctgtttgaggactgtgagcctgaggagctgacagactggagcatggatgagaagtgcagcttctgcaacctgcagcgggaggccgtgtctgactgcatccccagcctggacagcagccagagcacccccacagaggagctgagcagccagggccagagcaacacagacaagattgagtgccaggccgagaactacctgaatgccctcttcaggaagaaggacctgccccagaactgtgaccccaacatccccctggtggcccaggagctgatgaagaagatgatccggcagtttgccatcgagtacatcagcaagagcggcaagacccaggagaacagaaatggcagcatcggccccagcatcgtgtgcaagagcatccagatgaaccaggccgagaacagcctgcaggaggagcaggagggccccctggacctgactgtgaacaggatgcaggagcagaacacccagcagggagatggagtgctggacctgagcaccaagaagaccagcatcaagtctgaggagagcagcatctgtgaccccagcagcgagaacagcgtggccggcatgctgcaggtgaagacagatgagaagctgaatgtgtctgatgagaacacagccagctgccccctgagccccatcaagatgtgcctgaaccggcccatcgagtggaacctgaacctgaccacagccagcctgaccagctgcaccgtgcacaaccagaacctgaagtctgaggagaagtag

SEQ ID NO: 157859 - DNA, 1557 bp, Artificial Sequence
  Description of Artificial Sequence: Synthetic coding sequence
atggatgagaagtgcagcttctgcaacctgcagcgggaggccgtgtctgactgcatccccagcctggacagcagccagagcacccccacagaggagctgagcagccagggccagagcaacacagacaagattgagtgccaggccgagaactacctgaatgccctcttcaggaagaaggacctgccccagaactgtgaccccaacatccccctggtggcccaggagctgatgaagaagatgatccggcagtttgccatcgagtacatcagcaagagcggcaagacccaggagaacagaaatggcagcatcggccccagcatcgtgtgcaagagcatccagatgaaccaggccgagaacagcctgcaggaggagcaggagggccccctggacctgactgtgaacaggatgcaggagcagaacacccagcagggagatggagtgctggacctgagcaccaagaagaccagcatcaagtctgaggagagcagcatctgtgaccccagcagcgagaacagcgtggccggccgcctgcacaggaaccgggaggactatgtggagaggtctgctgagtttgctgatggcctgctgagcaaggccctgaaggacatccagagcggggccctggacatcaacaaggccggcatcctgtatggcatcccccagaagaccctgctgctgcacctggaggccctgcctgctgggaagccagccagcttcaagaacaagacccgggacttccatgacagctacagctacaaggacagcaaggagacctgtgctgtgctgcagaaggtggccctgtgggcccgggcccaggccgagaggacagagaagagcaagctgaacctgctggagaccagcgagatcaagttccccacagccagcacctacctgcaccagctgaccctgcagaagatggtgacccagttcaaggagaagaatgaaagcctgcagtatgagaccagcaaccccaccgtgcagctgaagatcccccagctgcgggtgtcctctgtgtccaagagccagccagatggcagcggcctgctggatgtgatgtaccaggtgtccaagaccagctctgtgctggagggcagcgccctgcagaagctgaagaacatcctgcccaagcagaacaagattgaatgttctggccctgtgacccacagctctgtggacagctacttcctgcatggagacctgagccccctgtgcctgaacagcaagaatggaacagtggatggcaccagtgaaaatacagaagatggcctggacaggaaggacagcaagcagcccaggaagaagaggggccgctaccggcagtatgaccacgagatcatggaggaggccatcgccatggtgatgtctgggaagatgtctgtgtccaaggcccagggcatctatggagtgccccacagcaccctggagtacaaggtgaaggagaggagcggcaccctgaagaccccacccaagaagaagctgcggctgcctgacaccggcctgtacaacatgacagacagcggcaccggcagctgcaagaacagcagcaagcctgtgtag

SEQ ID NO: 157860 - DNA, 1809 bp, Artificial Sequence
  Description of Artificial Sequence: Synthetic coding sequence
atggacaagggccgggagaggatggctgctgctgctgctgctgctgctgctgctgctgctgctgcccagtgccgcagcccccgctgtgccgctgagcggcggggcttcagaagagagctggacagctggaggcaccggctgatgcactgtgtgggctttgagagcatcctggagggcctgtatggcccccggctgcggcgggacctgagcctgtttgaggactgtgagcctgaggagctgacagactggagcatggatgagaagtgcagcttctgcaacctgcagcgggaggccgtgtctgactgcatccccagcctggacagcagccagagcacccccacagaggagctgagcagccagggccagagcaacacagacaagattgagtgccaggccgagaactacctgaatgccctcttcaggaagaaggacctgccccagaactgtgaccccaacatccccctggtggcccaggagctgatgaagaagatgatccggcagtttgccatcgagtacatcagcaagagcggcaagacccaggagaacagaaatggcagcatcggccccagcatcgtgtgcaagagcatccagatgaaccaggccgagaacagcctgcaggaggagcaggagggccccctggacctgactgtgaacaggatgcaggagcagaacacccagcagggagatggagtgctggacctgagcaccaagaagaccagcatcaagtctgaggagagcagcatctgtgaccccagcagcgagaacagcgtggccggccgcctgcacaggaaccgggaggactatgtggagaggtctgctgagtttgctgatggcctgctgagcaaggccctgaaggacatccagagcggggccctggacatcaacaaggccggcatcctgtatggcatcccccagaagaccctgctgctgcacctggaggccctgcctgctgggaagccagccagcttcaagaacaagacccgggacttccatgacagctacagctacaaggacagcaaggagacctgtgctgtgctgcagaaggtggccctgtgggcccgggcccaggccgagaggacagagaagagcaagctgaacctgctggagaccagcgagatcaagttccccacagccagcacctacctgcaccagctgaccctgcagaagatggtgacccagttcaaggagaagaatgaaagcctgcagtatgagaccagcaaccccaccgtgcagctgaagatcccccagctgcgggtgtcctctgtgtccaagagccagccagatggcagcggcctgctggatgtgatgtaccaggtgtccaagaccagctctgtgctggagggcagcgccctgcagaagctgaagaacatcctgcccaagcagaacaagattgaatgttctggccctgtgacccacagctctgtggacagctacttcctgcatggagacctgagccccctgtgcctgaacagcaagaatggaacagtggatggcaccagtgaaaatacagaagatggcctggacaggaaggacagcaagcagcccaggaagaagaggggccgctaccggcagtatgaccacgagatcatggaggaggccatcgccatggtgatgtctgggaagatgtctgtgtccaaggcccagggcatctatggagtgccccacagcaccctggagtacaaggtgaaggagaggagcggcaccctgaagaccccacccaagaagaagctgcggctgcctgacaccggcctgtacaacatgacagacagcggcaccggcagctgcaagaacagcagcaagcctgtgtag

SEQ ID NO: 157861 - DNA, 435 bp, Artificial Sequence
  Description of Artificial Sequence: Synthetic coding sequence
atggaccacggctatgaggagacctctgtgtacctgaaggactgcatccccagcctggacagcagccagagcacccccacagaggagctgagcagccagggccagagcaacacagacaagattgagtgccaggccgagaactacctgaatgccctcttcaggaagaaggacctgccccagaactgtgaccccaacatccccctggtggcccaggagctgatgaagaagatgatccggcagtttgccatcgagtacatcagcaagagcggcaagacccaggagaacagaaatggcagcatcggccccagcatcgtgtgcaagagcatccagatgaaccaggccgagaacagcctgcaggaggagcaggagggccccctggacctgactgtgaacaggatgcaggagcagaacacccagcaggcctgctacaagtag

SEQ ID NO: 157862 - DNA, 2187 bp, Artificial Sequence
  Description of Artificial Sequence: Synthetic coding sequence
atgaaccagcctgagagcgccaatgaccctgagcccctgtgtgctgtgtgtggccaggcccacagcctggaggagaaccacttctacagctacccagaggaggtggatgatgacctgatctgccacatctgcctgcaggccctgctggaccccctggacaccccctgtggccacacctactgcaccctgtgcctgaccaacttcctggtggagaaggacttctgccccatggacaggaagcccctggtgctgcagcactgcaagaagagcagcatcctggtgaacaagctgctgaacaagctgctggtgacctgccccttccgggagcactgcacccaggtgctgcagagatgtgacctggagcaccacttccagaccagctgcaagggggccagccactacggcctgaccaaggacaggaagaggaggagccaggacggctgcccagatggctgtgccagcctgacagccacagcccccagccctgaggtgtctgctgctgccaccatcagcctgatgacagatgagcccggcctggacaacccagcctacgtgtcctctgcagaagatggccagcctgccatcagccctgtggacagcggccgcagcaacagaacccgggcccggccctttgagaggagcaccatccgcagccgctccttcaagaagatcaacagagccctgtctgtgctgcggaggaccaagagcggcagcgctgtggccaaccacgccgaccagggcagagaaaattctgagaacaccacagcccctgaggtgttcccccggctgtaccacctgatcccagatggagagatcaccagcatcaagatcaacagagtggaccccagcgagagcctgagcatccggctggtgggcggcagcgagacccccctggtgcacatcatcatccagcacatctacagagatggagtcatcgccagagatggccgcctgctgcccggggacatcatcctgaaggtgaatggcatggacatcagcaatgtgccccacaactatgctgtgcggctgctgcggcagccctgccaggtgctgtggctgactgtgatgagggagcagaagttccgcagcaggaacaacggccaggccccagatgcctaccggcccagagatgacagcttccacgtgatcctgaacaagagcagccctgaggagcagctgggcatcaagctggtgaggaaggtggatgagcccggggtcttcatcttcaacgtgctggatggaggagtggcctaccgccacggccagctggaggagaatgacagagtgctggccatcaatggacatgacctgcgctatggcagccctgagagcgctgcccacctgatccaggccagcgagcggcgggtgcacctggtggtgtcccggcaggtgcggcagaggagcccagacatcttccaggaggccggctggaacagcaatggctcctggagccctggccctggagagaggagcaacacccccaagcccctgcaccccaccatcacctgccacgagaaggtggtgaacatccagaaggaccccggggagagcctgggcatgacagtggccggcggggccagccaccgggagtgggacctgcccatctacgtgatctctgtggagcccggcggcgtcatcagcagagatggccgcatcaagacaggagacatcctgctgaatgtggatggagtggagctgacagaggtgagccgctctgaggccgtggccctgctgaagaggaccagcagcagcatcgtgctgaaggccctggaggtgaaggagtatgagccccaggaggactgcagcagccctgctgccctggacagcaaccacaacatggcccccccaagtgactggagccccagctgggtgatgtggctggagctgccccgctgcctgtacaactgcaaggacatcgtgctgcggaggaacacagctggcagcctgggcttctgcatcgtgggcggctatgaggagtacaatggaaacaagcccttcttcatcaagagcatcgtggagggcaccccagcctacaatgatggccgcatccgctgtggggacatcctgctggccgtgaatggccgcagcaccagcggcatgatccacgcctgcctggcccggctgctgaaggagctgaagggccgcatcaccctgaccatcgtgtcctggccaggcaccttcctgtag

SEQ ID NO: 157863 - DNA, 1899 bp, Artificial Sequence
  Description of Artificial Sequence: Synthetic coding sequence
atgaaggccctgctgctgctggtgctgccctggctgagccctgccaactacatcgacaacgtgggcaacctgcacttcctgtacagcgagctgtgcaagggggccagccactacggcctgaccaaggacaggaagaggaggagccaggacggctgcccagatggctgtgccagcctgacagccacagcccccagccctgaggtgtctgctgctgccaccatcagcctgatgacagatgagcccggcctggacaacccagcctacgtgtcctctgcagaagatggccagcctgccatcagccctgtggacagcggccgcagcaacagaacccgggcccggccctttgagaggagcaccatccgcagccgctccttcaagaagatcaacagagccctgtctgtgctgcggaggaccaagagcggcagcgctgtggccaaccacgccgaccagggcagagaaaattctgagaacaccacagcccctgaggtgttcccccggctgtaccacctgatcccagatggagagatcaccagcatcaagatcaacagagtggaccccagcgagagcctgagcatccggctggtgggcggcagcgagacccccctggtgcacatcatcatccagcacatctacagagatggagtcatcgccagagatggccgcctgctgcccggggacatcatcctgaaggtgaatggcatggacatcagcaatgtgccccacaactatgctgtgcggctgctgcggcagccctgccaggtgctgtggctgactgtgatgagggagcagaagttccgcagcaggaacaacggccaggccccagatgcctaccggcccagagatgacagcttccacgtgatcctgaacaagagcagccctgaggagcagctgggcatcaagctggtgaggaaggtggatgagcccggggtcttcatcttcaacgtgctggatggaggagtggcctaccgccacggccagctggaggagaatgacagagtgctggccatcaatggacatgacctgcgctatggcagccctgagagcgctgcccacctgatccaggccagcgagcggcgggtgcacctggtggtgtcccggcaggtgcggcagaggagcccagacatcttccaggaggccggctggaacagcaatggctcctggagccctggccctggagagaggagcaacacccccaagcccctgcaccccaccatcacctgccacgagaaggtggtgaacatccagaaggaccccggggagagcctgggcatgacagtggccggcggggccagccaccgggagtgggacctgcccatctacgtgatctctgtggagcccggcggcgtcatcagcagagatggccgcatcaagacaggagacatcctgctgaatgtggatggagtggagctgacagaggtgagccgctctgaggccgtggccctgctgaagaggaccagcagcagcatcgtgctgaaggccctggaggtgaaggagtatgagccccaggaggactgcagcagccctgctgccctggacagcaaccacaacatggcccccccaagtgactggagccccagctgggtgatgtggctggagctgccccgctgcctgtacaactgcaaggacatcgtgctgcggaggaacacagctggcagcctgggcttctgcatcgtgggcggctatgaggagtacaatggaaacaagcccttcttcatcaagagcatcgtggagggcaccccagcctacaatgatggccgcatccgctgtggggacatcctgctggccgtgaatggccgcagcaccagcggcatgatccacgcctgcctggcccggctgctgaaggagctgaagggccgcatcaccctgaccatcgtgtcctggccaggcaccttcctgtag

SEQ ID NO: 157864 - DNA, 21 bp, Artificial Sequence
  Description of Artificial Sequence: Synthetic coding sequence
atgaaccagcctgagagctag

SEQ ID NO: 157865 - DNA, 51 bp, Artificial Sequence
  Description of Artificial Sequence: Synthetic coding sequence
atgaaccagcctgagagcgccaatgaccctgagcccctgtgtgctgtgtag

SEQ ID NO: 157866 - DNA, 300 bp, Artificial Sequence
  Description of Artificial Sequence: Synthetic coding sequence
atgaaccagcctgagagcgccaatgaccctgagcccctgtgtgctgtgtgtggccaggcccacagcctggaggagaaccacttctacagctacccagaggaggtggatgatgacctgatctgccacatctgcctgcaggccctgctggaccccctggacaccccctgtggccacacctactgcaccctgtgcctgaccaacttcctggtggagaaggacttctgccccatggacaggaagcccctggtgctgcagcactgcaagaagagcagcatcctggtgaacaagctgctgaactag

SEQ ID NO: 157867 - DNA, 273 bp, Artificial Sequence
  Description of Artificial Sequence: Synthetic coding sequence
atgaaccagcctgagagcgccaatgaccctgagcccctgtgtgctgtgtgtggccaggcccacagcctggaggagaaccacttctacagctacccagaggaggtggatgatgacctgatctgccacatctgcctgcaggccctgctggaccccctggacaccccctgtggccacacctactgcaccctgtgcctgaccaacttcctggtggagaaggacttctgccccatggacaggaagcccctggtgctgcagcactgcaagaagagctag

SEQ ID NO: 157868 - DNA, 381 bp, Artificial Sequence
  Description of Artificial Sequence: Synthetic coding sequence
atgaaccagcctgagagcgccaatgaccctgagcccctgtgtgctgtgtgtggccaggcccacagcctggaggagaaccacttctacagctacccagaggaggtggatgatgacctgatctgccacatctgcctgcaggccctgctggaccccctggacaccccctgtggccacacctactgcaccctgtgcctgaccaacttcctggtggagaaggacttctgccccatggacaggaagcccctggtgctgcagcactgcaagaagagcagcatcctggtgaacaagctgctgaacaagctgctggtgacctgccccttccgggagcactgcacccaggtgctgcagagatgtgacctggagcaccacttccagacctag

SEQ ID NO: 157869 - DNA, 1701 bp, Artificial Sequence
  Description of Artificial Sequence: Synthetic coding sequence
atggctgtgcagacagctgtgcgggccagccagccccggctgccccccctggacaacccagcctacgtgtcctctgcagaagatggccagcctgccatcagccctgtggacagcggccgcagcaacagaacccgggcccggccctttgagaggagcaccatccgcagccgctccttcaagaagatcaacagagccctgtctgtgctgcggaggaccaagagcggcagcgctgtggccaaccacgccgaccagggcagagaaaattctgagaacaccacagcccctgaggtgttcccccggctgtaccacctgatcccagatggagagatcaccagcatcaagatcaacagagtggaccccagcgagagcctgagcatccggctggtgggcggcagcgagacccccctggtgcacatcatcatccagcacatctacagagatggagtcatcgccagagatggccgcctgctgcccggggacatcatcctgaaggtgaatggcatggacatcagcaatgtgccccacaactatgctgtgcggctgctgcggcagccctgccaggtgctgtggctgactgtgatgagggagcagaagttccgcagcaggaacaacggccaggccccagatgcctaccggcccagagatgacagcttccacgtgatcctgaacaagagcagccctgaggagcagctgggcatcaagctggtgaggaaggtggatgagcccggggtcttcatcttcaacgtgctggatggaggagtggcctaccgccacggccagctggaggagaatgacagagtgctggccatcaatggacatgacctgcgctatggcagccctgagagcgctgcccacctgatccaggccagcgagcggcgggtgcacctggtggtgtcccggcaggtgcggcagaggagcccagacatcttccaggaggccggctggaacagcaatggctcctggagccctggccctggagagaggagcaacacccccaagcccctgcaccccaccatcacctgccacgagaaggtggtgaacatccagaaggaccccggggagagcctgggcatgacagtggccggcggggccagccaccgggagtgggacctgcccatctacgtgatctctgtggagcccggcggcgtcatcagcagagatggccgcatcaagacaggagacatcctgctgaatgtggatggagtggagctgacagaggtgagccgctctgaggccgtggccctgctgaagaggaccagcagcagcatcgtgctgaaggccctggaggtgaaggagtatgagccccaggaggactgcagcagccctgctgccctggacagcaaccacaacatggcccccccaagtgactggagccccagctgggtgatgtggctggagctgccccgctgcctgtacaactgcaaggacatcgtgctgcggaggaacacagctggcagcctgggcttctgcatcgtgggcggctatgaggagtacaatggaaacaagcccttcttcatcaagagcatcgtggagggcaccccagcctacaatgatggccgcatccgctgtggggacatcctgctggccgtgaatggccgcagcaccagcggcatgatccacgcctgcctggcccggctgctgaaggagctgaagggccgcatcaccctgaccatcgtgtcctggccaggcaccttcctgtag

SEQ ID NO: 157870 - DNA, 2073 bp, Artificial Sequence
  Description of Artificial Sequence: Synthetic coding sequence
atgggcaccaccagtgatgagatggtgtctgtggagcagaccagcagcagcagcctgaaccccctgtgctttgaatgtggccagcagcactggacccgggagaaccacctgtacaactaccagaatgaggtggatgatgacctggtgtgccacatctgcctgcagcccctgctgcagcccctggacaccccctgtggccacaccttctgctacaagtgcctgaggaacttcctgcaggagaaggacttctgccccctggacaggaagaggctgcacttcaagctgtgcaagaagagcagcatcctggtgcacaagctgctggacaagctgctggtgctgtgccccttcagctctgtgtgcaaggatgtgatgcagagatgtgacctggaggcccacctgaagaaccgctgccctggggccagccacagaagagtggccctggagaggaggaagaccagcaggacccaggccgagattgaaaatgaaaatggccccaccctgctggaccctgctggcaccctgagccctgaggccgactgcctgggcactggagctgtgcctgtggagcggcacctgaccagcgccagcctgagcacctggagcgaggagcccggcctggacaacccagcctttgaggagagcgctggagctgacaccacccagcagcccctgagcctgcctgagggggagatcaccaccatcgagatccacaggagcaacccctacatccagctgggcatcagcatcgtgggcggcaatgagacccccctcatcaacatcgtcatccaggaggtgtacagagatggagtgattgccagagatggccgcctgctggccggggaccagatcctgcaggtgaacaactacaacatcagcaatgtgagccacaactatgcccgggctgtgctgagccagccctgcaacaccctgcacctgactgtgctgcgggagcggcgcttcggcaacagagcccacaaccacagcgacagcaacagcccccgggaggagatcttccaggtggccctgcacaagagggacagcggggagcagctgggcatcaagctggtgagaagaacagatgagcccggggtcttcatcctggacctgctggagggcggcctggccgcccaggacggccgcctgagcagcaatgacagagtgctggccatcaatggacatgacctgaagtatggcaccccagagctggccgcccagatcatccaggccagcggggagcgggtgaacctgaccatcgcccggcctgggaagccccagcccggcaacaccatccgggaggccggcaaccacagcagcagcagccagcaccacaccccaccaccctactacagccggcccagcagccacaaggacctgacccagtgtgtgacctgccaggagaagcacatcaccgtgaagaaggagccccatgagagcctgggcatgacagtggccggcggccggggcagcaagtctggagagctgcccatctttgtgacctctgtgcccccccacggctgcctggccagagatggccgcatcaagagaggagatgtgctgctgaacatcaatggaattgacctgaccaacctgagccacagcgaggccgtggccatgctgaaggccagcgctgccagccctgctgtggccctgaaggccctggaggtgcagatcgtggaggaggccacccagaatgctgaggagcagcccagcaccttctctgaaaatgaatatgatgcctcctggagccccagctgggtgatgtggctgggcctgcccagcaccctgcacagctgccacgacatcgtgctgcggcgcagctacctgggctcctggggcttcagcatcgtgggcggctatgaggagaaccacaccaaccagcccttcttcatcaagaccatcgtgctgggcaccccagcctactatgatggccgcctgaagtgtggggacatgattgtggccgtgaatggcctgagcacagtgggcatgagccacagcgccctggtgcccatgctgaaggagcagaggaacaaggtgaccctgaccgtcatctgctggccaggcagcctggtgtag

SEQ ID NO: 157871 - DNA, 2115 bp, Artificial Sequence
  Description of Artificial Sequence: Synthetic coding sequence
atgctgggcatctgccggggccgcaggaagttcctggccgccagcctgagcctgctgtgcatcccagccatcacctggatctacctgttcagcggcagctttgaagatggcaagcctgtgtccctgagccccctggagagccaggcccacagcccccgctacacagccagcagccagcgggagcgggagagcctggaggtgaggatgagggaggtggaggaggagaacagagccctgcggcggcagctgagcctggcccagggccgggcccccagccaccggcggggcaaccacagcaagacctacagcatggaggagggcaccggggacagcgagaacctgcgggccggcatcgtggccggcaacagcagtgaatgtggccagcagcctgtggtggagaagtgtgagaccatccacgtggccatcgtgtgtgccggctacaatgccagcagagatgtggtgaccctggtgaagtctgtgctcttccacagaagaaaccccctgcacttccacctgattgctgacagcattgctgagcagatcctggccaccctcttccagacctggatggtgcctgctgtgcgggtggacttctacaatgctgatgagctgaagtctgaggtgtcctggatccccaacaagcactacagcggcatctacggcctgatgaagctggtgctgaccaagaccctgcctgccaacctggagcgggtgattgtgctggacacagacatcacctttgccacagacattgctgagctgtgggccgtgttccacaagttcaagggccagcaggtgctgggcctggtggagaaccagagcgactggtacctgggcaacctgtggaagaaccaccggccctggccagccctgggccggggctacaacacaggagtcatcctgctgctgctggacaagctgaggaagatgaagtgggagcagatgtggaggctgacagctgagcgggagctgatgggcatgctgagcaccagcctggccgaccaggacatcttcaatgctgtgatcaagcagaaccccttcctggtgtaccagctgccctgcttctggaatgtgcagctgagtgaccacaccaggtctgagcagtgctacagagatgtgtctgacctgaagctgcagaagcagctgtctgagctggatgaagatgacctgtgctatgagttcagaagagagcgcttcaccgtgcacaggacccacctgtacttcctgcactatgaatatgagcctgctgctgacagcacagatgtgaccctggtggcccagctgtccatggaccggctgcagatgctggaggccatctgcaagcactgggagggccccatcagcctggccctgtacctgagtgatgctgaggcccagcagttcctgcgctatgcccagggcagcgaggtgctgatgagccgccacaacgtgggctaccacatcgtgtacaaggagggccagttctaccctgtgaacctgctgagaaatgtggccatgaagcacatcagcaccccctacatgttcctgagtgacatcgacttcctgcccatgtatggcctgtatgagtacctgaggaagagcgtcatccagctggacctggccaacaccaagaaggccatgattgtgcctgcctttgagaccctgcgctaccgcctgtccttccccaagagcaaggccgagctgctgtccatgctggacatgggcaccctcttcaccttccgctaccacgtgtggaccaagggccacgcccccaccaactttgccaagtggaggacagccaccaccccctacagagtggagtgggaggccgactttgagccctacgtggtggtgcggcgggactgcccagaatatgacagaagatttgtgggcttcggctggaacaaggtggcccacatcatggagctggatgtgcaggagtatgagttcatcgtgctgcccaatgcctacatgatccacatgccccacgcccccagctttgacatcaccaagttccgcagcaacaagcagtaccgcatctgcctgaagaccctgaaggaggagttccagcaggacatgagccgccgctatggctttgctgccctgaagtacctgacagctgagaacaacagctag

SEQ ID NO: 157872 - DNA, 2271 bp, Artificial Sequence
  Description of Artificial Sequence: Synthetic coding sequence
atgctgggcatctgccggggccgcaggaagttcctggccgccagcctgagcctgctgtgcatcccagccatcacctggatctacctgttcagcggcagctttgaagatggcaagcctgtgtccctgagccccctggagagccaggcccacagcccccgctacacagccagcagccagcgggagcgggagagcctggaggtgaggatgagggaggtggaggaggagaacagagccctgcggcggcagctgagcctggcccagggccgggcccccagccaccggcggggcaaccacagcaagacctacagcatggaggagggcaccggggacagcgagaacctgcgggccggcatcgtggccggcaacagcagtgaatgtggccagcagcctgtggtggagaagtgtgagaccatccacgtggccatcgtgtgtgccggctacaatgccagcagagatgtggtgaccctggtgaagtctgtgctcttccacagaagaaaccccctgcacttccacctgattgctgacagcattgctgagcagatcctggccaccctcttccagacctggatggtgcctgctgtgcgggtggacttctacaatgctgatgagctgaagtctgaggtgtcctggatccccaacaagcactacagcggcatctacggcctgatgaagctggtgctgaccaagaccctgcctgccaacctggagcgggtgattgtgctggacacagacatcacctttgccacagacattgctgagctgtgggccgtgttccacaagttcaagggccagcaggtgctgggcctggtggagaaccagagcgactggtacctgggcaacctgtggaagaaccaccggccctggccagccctgggccggggctacaacacaggagtcatcctgctgctgctggacaagctgaggaagatgaagtgggagcagatgtggaggctgacagctgagcgggagctgatgggcatgctgagcaccagcctggccgaccaggacatcttcaatgctgtgatcaagcagaaccccttcctggtgtaccagctgccctgcttctggaatgtgcagctgagtgaccacaccaggtctgagcagtgctacagagatgtgtctgacctgaaggtgatccactggaacagccccaagaagctgcgggtgaagaacaagcacgtggagttcttcaggaacctgtacctgaccttcctggagtatgatggcaacctgctgcggcgggagctgtttggctgccccagcgaggctgatgtgaacagcgagaacctgcagaagcagctgtctgagctggatgaagatgacctgtgctatgagttcagaagagagcgcttcaccgtgcacaggacccacctgtacttcctgcactatgaatatgagcctgctgctgacagcacagatgtgaccctggtggcccagctgtccatggaccggctgcagatgctggaggccatctgcaagcactgggagggccccatcagcctggccctgtacctgagtgatgctgaggcccagcagttcctgcgctatgcccagggcagcgaggtgctgatgagccgccacaacgtgggctaccacatcgtgtacaaggagggccagttctaccctgtgaacctgctgagaaatgtggccatgaagcacatcagcaccccctacatgttcctgagtgacatcgacttcctgcccatgtatggcctgtatgagtacctgaggaagagcgtcatccagctggacctggccaacaccaagaaggccatgattgtgcctgcctttgagaccctgcgctaccgcctgtccttccccaagagcaaggccgagctgctgtccatgctggacatgggcaccctcttcaccttccgctaccacgtgtggaccaagggccacgcccccaccaactttgccaagtggaggacagccaccaccccctacagagtggagtgggaggccgactttgagccctacgtggtggtgcggcgggactgcccagaatatgacagaagatttgtgggcttcggctggaacaaggtggcccacatcatggagctggatgtgcaggagtatgagttcatcgtgctgcccaatgcctacatgatccacatgccccacgcccccagctttgacatcaccaagttccgcagcaacaagcagtaccgcatctgcctgaagaccctgaaggaggagttccagcaggacatgagccgccgctatggctttgctgccctgaagtacctgacagctgagaacaacagctag

SEQ ID NO: 157873 - DNA, 2271 bp, Artificial Sequence; identical to SEQ ID NO: 157872
  Description of Artificial Sequence: Synthetic coding sequence

SEQ ID NO: 157874 - DNA, 2115 bp, Artificial Sequence; identical to SEQ ID NO: 157871
  Description of Artificial Sequence: Synthetic coding sequence

SEQ ID NO: 157875 - DNA, 408 bp, Artificial Sequence
  Description of Artificial Sequence: Synthetic coding sequence
atgctgggcatctgccggggccgcaggaagttcctggccgccagcctgagcctgctgtgcatcccagccatcacctggatctacctgttcagcggcagctttgaagatggcaagcctgtgtccctgagccccctggagagccaggcccacagcccccgctacacagccagcagccagcgggagcgggagagcctggaggtgaggatgagggaggtggaggaggagaacagagccctgcggcggcagctgagcctggcccagggccgggcccccagccaccggcggggcaaccacagcaagacctacagcatggaggagggcaccggggacagcgagaacctgcgggccggcatcgtggccggcaacagcagtgaatgtggccagcagcctgtggtggagaagtgctag

SEQ ID NO: 157876 - DNA, 144 bp, Artificial Sequence
  Description of Artificial Sequence: Synthetic coding sequence
atgctgggcatctgccggggccgcaggaagttcctggccgccagcctgagcctgctgtgcatcccagccatcacctggatctacctgttcagcggcagctttgaagatggcaagcctgtgtccctgagccccctggagagctag

SEQ ID NO: 157877 - DNA, 411 bp, Artificial Sequence
  Description of Artificial Sequence: Synthetic coding sequence
atgctgggcatctgccggggccgcaggaagttcctggccgccagcctgagcctgctgtgcatcccagccatcacctggatctacctgttcagcggcagctttgaagatggcaagcctgtgtccctgagccccctggagagccaggcccacagcccccgctacacagccagcagccagcgggagcgggagagcctggaggtgaggatgagggaggtggaggaggagaacagagccctgcggcggcagctgagcctggcccagggccgggcccccagccaccggcggggcaaccacagcaagacctacagcatggaggagggcaccggggacagcgagaacctgcgggccggcatcgtggccggcaacagcagtgaatgtggccagcagcctgtggtggagaagtgtgagtag

SEQ ID NO: 157878 - DNA, 183 bp, Artificial Sequence
  Description of Artificial Sequence: Synthetic coding sequence
atgctgggcatctgccggggccgcaggaagttcctggccgccagcctgagcctgctgtgcatcccagccatcacctggatctacctgttcagcggcagctttgaagatggcaagcctgtgtccctgagccccctggagagccaggcccacagcccccgctacacagccagcagccagaggtag

SEQ ID NO: 157879 - DNA, 330 bp, Artificial Sequence
  Description of Artificial Sequence: Synthetic coding sequence
atgctgggcatctgccggggccgcaggaagttcctggccgccagcctgagcctgctgtgcatcccagccatcacctggatctacctgttcagcggcagctttgaagatggcaagcctgtgtccctgagccccctggagagccaggcccacagcccccgctacacagccagcagccagcgggagcgggagagcctggaggtgaggatgagggaggtggaggaggagaacagagccctgcggcggcagctgagcctggcccagggccgggcccccagccaccggcggggcaaccacagcaagacctacagcatggaggagggcaccggctag

SEQ ID NO: 157880 - DNA, 2124 bp, Artificial Sequence
  Description of Artificial Sequence: Synthetic coding sequence
atgctgggcatctgccggggccgcaggaagttcctggccgccagcctgagcctgctgtgcatcccagccatcacctggatctacctgttcagcggcagctttgaagatggcaagcctgtgtccctgagccccctggagagccaggcccacagcccccgctacacagccagcagccagcgggagcgggagagcctggaggtgaggatgagggaggtggaggaggagaacagagccctgcggcggcagctgagcctggcccagggccgggcccccagccaccggcggggcaaccacagcaagacctacagcatggaggagggcaccggggacagcgagaacctgcgggccggcatcgtggccggcaacagcagtgaatgtggccagcagcctgtggtggagaagtgtgagaccatccacgtggccatcgtgtgtgccggctacaatgccagcagagatgtggtgaccctggtgaagtctgtgctcttccacagaagaaaccccctgcacttccacctgattgctgacagcattgctgagcagatcctggccaccctcttccagacctggatggtgcctgctgtgcgggtggacttctacaatgctgatgagctgaagtctgaggtgtcctggatccccaacaagcactacagcggcatctacggcctgatgaagctggtgctgaccaagaccctgcctgccaacctggagcgggtgattgtgctggacacagacatcacctttgccacagacattgctgagctgtgggccgtgttccacaagttcaagggccagcaggtgctgggcctggtggagaaccagagcgactggtacctgggcaacctgtggaagaaccaccggccctggccagccctgggccggggctacaacacaggagtcatcctgctgctgctggacaagctgaggaagatgaagtgggagcagatgtggaggctgacagctgagcgggagctgatgggcatgctgagcaccagcctggccgaccaggacatcttcaatgctgtgatcaagcagaaccccttcctggtgtaccagctgccctgcttctggaatgtgcagctgagtgaccacaccaggtctgagcagtgctacagagatgtgtctgacctgaaggtgatccactggaacagccccaagaagctgcgggtgaagaacaagcacgtggagttcttcaggaacctgtacctgaccttcctggagtatgatggcaacctgctgcggcgggagctgtttggctgccccagcgaggctgatgtgaacagcgagaacctgcagaagcagctgtctgagctggatgaagatgacctgtgctatgagttcagaagagagcgcttcaccgtgcacaggacccacctgtacttcctgcactatgaatatgagcctgctgctgacagcacagatgtgaccctggtggcccagctgtccatggaccggctgcagatgctggaggccatctgcaagcactgggagggccccatcagcctggccctgtacctgagtgatgctgaggcccagcagttcctgcgctatgcccagggcagcgaggtgctgatgagccgccacaacgtgggctaccacatcgtgtacaaggagggccagttctaccctgtgaacctgctgagaaatgtggccatgaagcacatcagcaccccctacatgttcctgagtgacatcgacttcctgcccatgtatggcctgtatgagtacctgcgctaccacgtgtggaccaagggccacgcccccaccaactttgccaagtggaggacagccaccaccccctacagagtggagtgggaggccgactttgagccctacgtggtggtgagaagagactgcccagaatatgacagaagatttgtgggcttcggctggaacaaggtggcccacatcatggagctggatgtgcaggagtatgagttcatcgtgctgcccaatgcctacatgatccacatgcctcatgcccccagctttgacatcaccaagttccgcagcaacaagcagtaccgcatctgcctgaagaccctgaaggaggagttccagcaggacatgagcagaagatatggctttgctgccctgaagtacctgacagctgagaacaacagctag

SEQ ID NO: 157881 - DNA, 1668 bp, Artificial Sequence
  Description of Artificial Sequence: Synthetic coding sequence
atgctgatctggagcgaggtgtcctggatccccaacaagcactacagcggcatctacggcctgatgaagctggtgctgaccaagaccctgcctgccaacctggagagggtcatcgtgctggacacagacatcacctttgccacagacattgctgagctgtgggccgtgttccacaagttcaagggccagcaggtgctgggcctggtggagaaccagagcgactggtacctgggcaacctgtggaagaaccaccggccctggccagccctgggccggggctacaacacaggagtcatcctgctgctgctggacaagctgaggaagatgaagtgggagcagatgtggaggctgacagctgagcgggagctgatgggcatgctgagcaccagcctggccgaccaggacatcttcaatgctgtgatcaagcagaaccccttcctggtgtaccagctgccctgcttctggaatgtgcagctgagtgaccacaccaggtctgagcagtgctacagagatgtgtctgacctgaaggtgatccactggaacagccccaagaagctgcgggtgaagaacaagcacgtggagttcttcaggaacctgtacctgaccttcctggagtatgatggcaacctgctgcggcgggagctgtttggctgccccagcgaggctgatgtgaacagcgagaacctgcagaagcagctgtctgagctggatgaagatgacctgtgctatgagttccggcgggagcgcttcaccgtgcacaggacccacctgtacttcctgcactatgaatatgagcctgctgctgacagcacagatgtgaccctggtggcccagctgtccatggaccggctgcagatgctggaggccatctgcaagcactgggagggccccatcagcctggccctgtacctgagtgatgctgaggcccagcagttcctgcgctatgcccagggcagcgaggtgctgatgagccgccacaacgtgggctaccacatcgtgtacaaggagggccagttctaccctgtgaacctgctgagaaatgtggccatgaagcacatcagcaccccctacatgttcctgagtgacatcgacttcctgcccatgtatggcctgtatgagtacctgaggaagagcgtcatccagctggacctggccaacaccaagaaggccatgattgtgcctgcctttgagaccctgcgctaccgcctgtccttccccaagagcaaggccgagctgctgtccatgctggacatgggcaccctcttcaccttccgctaccacgtgtggaccaagggccacgcccccaccaactttgccaagtggaggacagccaccaccccctacagagtggagtgggaggccgactttgagccctacgtggtggtgagaagagactgcccagaatatgacagaagatttgtgggcttcggctggaacaaggtggcccacatcatggagctggatgtgcaggagtatgagttcatcgtgctgcccaatgcctacatgatccacatgcctcatgcccccagctttgacatcaccaagttccgcagcaacaagcagtaccgcatctgcctgaagaccctgaaggaggagttccagcaggacatgagcagaagatatggctttgctgccctgaagtacctgacagctgagaacaacagctag

SEQ ID NO: 157882 - DNA, 1098 bp, Artificial Sequence
  Description of Artificial Sequence: Synthetic coding sequence
atggccaaggtggccaaggacctgaaccctggggtgaagaagatgagcctgggccagctgcagagcgcccggggcgtggcctgcctgggctgcaagggcacctgcagcggctttgagccccacagctggaggaagatctgcaagagctgcaagtgcagccaggaggaccactgcctgaccagtgacctggaggatgacaggaagattggccgcctgctgatggacagcaagtacagcaccctgacagcccgggtgaagggaggagatggcatccgcatctacaagaggaacaggatgatcatgaccaaccccatcgccaccgggaaggaccccacctttgacaccatcacctatgagtgggcccctcctggggtgacccagaagctgggcctgcagtacatggagctgatccccaaggagaagcagcctgtgactggaacagaaggagccttctacagaagacggcagctgatgcaccagctgcccatctatgaccaggaccccagccgctgccggggcctgctggagaatgagctgaagctgatggaggagtttgtgaagcagtacaagtctgaggccctgggcgtgggggaggtggccctgcccggccagggcggcctgcccaaggaggagggcaagcagcaggagaagccagagggcgctgagaccacagctgccaccaccaacggcagcctgagtgaccccagcaaggaggtggagtatgtgtgtgagctgtgcaagggagctgcccccccagacagccctgtggtgtacagcgaccgggccggctacaacaagcagtggcaccccacctgctttgtgtgtgccaagtgcagcgagcccctggtggacctgatctacttctggaaggatggagccccctggtgtggccgccactactgtgagagcctgcggccccgctgcagcggctgtgatgagatcatctttgctgaggactaccagagggtggaggacctggcctggcacaggaagcactttgtgtgtgagggctgtgagcagctgctgagcggccgggcctacatcgtgaccaagggccagctgctgtgccccacctgcagcaagagcaagaggagctag

SEQ ID NO: 157883 - DNA, 762 bp, Artificial Sequence
  Description of Artificial Sequence: Synthetic coding sequence
atgtttggcatgcagggagatgtgtttggcctgcgggccaccttcatggagggcctgcagtacatggagctgatccccaaggagaagcagcctgtgactggaacagaaggagccttctacagaagacggcagctgatgcaccagctgcccatctatgaccaggaccccagccgctgccggggcctgctggagaatgagctgaagctgatggaggagtttgtgaagcagtacaagtctgaggccctgggcgtgggggaggtggccctgcccggccagggcggcctgcccaaggaggagggcaagcagcaggagaagccagagggcgctgagaccacagctgccaccaccaacggcagcctgagtgaccccagcaaggaggtggagtatgtgtgtgagctgtgcaagggagctgcccccccagacagccctgtggtgtacagcgaccgggccggctacaacaagcagtggcaccccacctgctttgtgtgtgccaagtgcagcgagcccctggtggacctgatctacttctggaaggatggagccccctggtgtggccgccactactgtgagagcctgcggccccgctgcagcggctgtgatgagatcatctttgctgaggactaccagagggtggaggacctggcctggcacaggaagcactttgtgtgtgagggctgtgagcagctgctgagcggccgggcctacatcgtgaccaagggccagctgctgtgccccacctgcagcaagagcaagaggagctag

SEQ ID NO: 157884 - DNA, 879 bp, Artificial Sequence
  Description of Artificial Sequence: Synthetic coding sequence
atggacagcaagtacagcaccctgacagcccgggtgaagggaggagatggcatccgcatctacaagaggaacaggatgatcatgaccaaccccatcgccaccgggaaggaccccacctttgacaccatcacctatgagtgggcccctcctggggtgacccagaagctgggcctgcagtacatggagctgatccccaaggagaagcagcctgtgactggaacagagggcgccttctacagaagacggcagctgatgcaccagctgcccatctatgaccaggaccccagccgctgccggggcctgctggagaatgagctgaagctgatggaggagtttgtgaagcagtacaagtctgaggccctgggcgtgggggaggtggccctgcccggccagggcggcctgcccaaggaggagggcaagcagcaggagaagccagagggcgctgagaccacagctgccaccaccaacggcagcctgagtgaccccagcaaggaggtggagtatgtgtgtgagctgtgcaagggggccgcccccccagacagccctgtggtgtacagcgacagagctggctacaacaagcagtggcaccccacctgctttgtgtgtgccaagtgcagcgagcccctggtggacctgatctacttctggaaggatggagccccctggtgtggccgccactactgtgagagcctgcggccccgctgcagcggctgtgatgagatcatctttgctgaggactaccagagggtggaggacctggcctggcacaggaagcactttgtgtgtgagggctgtgagcagctgctgagcggccgggcctacatcgtgaccaagggccagctgctgtgccccacctgcagcaagagcaagaggagctag

SEQ ID NO: 157885 - DNA, 744 bp, Artificial Sequence
  Description of Artificial Sequence: Synthetic coding sequence
atggccaaggtggccaaggacctgaaccctggggtgaagaagatgagcctgggccagctgcagagcgcccggggcgtggcctgcctgggctgcaagggcacctgcagcggctttgagccccacagctggaggaagatctgcaagagctgcaagtgcagccaggaggaccactgcctgaccagtgacctggaggatgacaggaagattggccgcctgctgatggacagcaagtacagcaccctgacagcccgggtgaagggaggagatggcatccgcatctacaagaggaacaggatgatcatgaccaaccccatcgccaccgggaaggaccccacctttgacaccatcacctatgagtgggcccctcctggggtgacccagaagctgggcctgcagtacatggagctgatccccaaggagaagcagcctgtgactggaacagaaggagccttctacagaagacggcagctgatgcaccagctgcccatctatgaccaggaccccagccgctgccggggcctgctggagaatgagctgaagctgatggaggagtttgtgaagcagtacaagtctgaggccctgggcgtgggggaggtggccctgcccggccagggcggcctgcccaaggaggagggcaagcagcaggagaagccagagggcgctgagaccacagctgccaccaccaacggcagcctgagtgaccccagcaaggaggtggagtacaagcctgtgcccctggtgtag

SEQ ID NO: 157886 - DNA, 786 bp, Artificial Sequence
  Description of Artificial Sequence: Synthetic coding sequence
atgaaccccaactgtgcccgctgtgggaagatcgtgtaccccacagagaaggtgaactgcctggacaagttctggcacaaggcctgcttccactgtgagacctgcaagatgaccctgaacatgaagaactacaagggctatgagaagaagccctactgcaatgcccactaccccaagcagagcttcaccatggtggccgacaccccagagaacctgcggctgaagcagcagagcgagctgcagagccaggtgcgctacaaggaggagtttgagaagaacaagggcaagggcttctctgtggtggccgacaccccagagctgcagaggatcaagaagacccaggaccagatcagcaacatcaagtaccacgaggagtttgagaagagcaggatgggccccagcggcggggagggcatggagcctgagcggcgggacagccaggacggcagcagctacagaagacccctggagcagcagcagccccaccacatccccaccagcgcccctgtgtaccagcagccccagcagcagcctgtggcccagagctatggaggctacaaggagcctgctgcccctgtgtccatccagaggtctgcccctgggggcggcggcaagcgctacagagctgtgtatgactacagcgctgctgatgaagatgaggtgtccttccaggatggagacaccatcgtgaatgtgcagcagattgatgatggctggatgtatggaacagtggagaggactggagacaccggcatgctgcctgccaactacgtggaggccatctag

SEQ ID NO: 157887 - DNA, 501 bp, Artificial Sequence
  Description of Artificial Sequence: Synthetic coding sequence
atgaccctgaacatgaagaactacaagggctatgagaagaagccctactgcaatgcccactaccccaagcagagcttcaccatggtggccgacaccccagagaacctgcggctgaagcagcagagcgagctgcagagccaggtgcgctacaaggaggagtttgagaagaacaagggcaagggcttctctgtggtggccgacaccccagagctgcagaggatcaagaagacccaggaccagatcagcaacatcaagtaccacgaggagtttgagaagagcaggatgggccccagcggcggggagggcatggagcctgagcggcgggacagccaggacggcagcagctacagaagacccctggagcagcagcagccccaccacatccccaccagcgcccctgtgtaccagcagccccagcagcagcctgtggcccagagctatggaggctacaaggagcctgctgcccctgtgtccatccagaggtctgcccctgggggctag

SEQ ID NO: 157888 - DNA, 618 bp, Artificial Sequence
  Description of Artificial Sequence: Synthetic coding sequence
atgctgcccctgcgggacctgcaggatgacacagaacatgaggagctgcagggcctgcgggaggaggccctgctgcagagggtgcgctacaaggaggagtttgagaagaacaagggcaagggcttctctgtggtggccgacaccccagagctgcagaggatcaagaagacccaggaccagatcagcaacatcaagtaccacgaggagtttgagaagagcaggatgggccccagcggcggggagggcatggagcctgagcggcgggacagccaggacggcagcagctacagaagacccctggagcagcagcagccccaccacatccccaccagcgcccctgtgtaccagcagccccagcagcagcctgtggcccagagctatggaggctacaaggagcctgctgcccctgtgtccatccagaggtctgcccctgggggcggcggcaagcgctacagagctgtgtatgactacagcgctgctgatgaagatgaggtgtccttccaggatggagacaccatcgtgaatgtgcagcagattgatgatggctggatgtatggaacagtggagaggactggagacaccggcatgctgcctgccaactacgtggaggccatctag

SEQ ID NO: 157889 - DNA, 786 bp, Artificial Sequence; identical to SEQ ID NO: 157886
  Description of Artificial Sequence: Synthetic coding sequence

SEQ ID NO: 157890 - DNA, 378 bp, Artificial Sequence
  Description of Artificial Sequence: Synthetic coding sequence
atgaaccccaactgtgcccgctgtgggaagatcgtgtaccccacagagaaggtgaactgcctggacaagttctggcacaaggcctgcttccactgtgagacctgcaagatgaccctgaacatgaagaactacaagggctatgagaagaagccctactgcaatgcccactaccccaagcagagcttcaccatggtggccgacaccccagagaacctgcggctgaagcagcagagcgagctgcagagccaggtgcgctacaaggaggagtttgagaagaacaagggcaagggcttctctgtggtggccgacaccccagagctgcagaggagcagcctgggcttcctgtggaatgagatcccccccagcccccacctgtag

SEQ ID NO: 157891 - DNA, 4050 bp, Artificial Sequence
  Description of Artificial Sequence: Synthetic coding sequence
atgaagaagatccgcatctgccacatcttcaccttctacagctggatgtcctatgatgtgctcttccagaggacagagctgggcgccctggagatctggaggcagctgatctgtgcccacgtgtgcatctgtgtgggctggctgtacctgcgggacagagtgtgcagcaagaaggacatcatcctgaggacagagcagaacagcggccgcaccatcctgatcaaggctgtgacagagaagaactttgagaccaaggacttccgggccagcctggagaatggagtgctgctgtgtgacctgatcaacaagctgaagccaggagtcatcaagaagatcaaccggctgagcacccccatcgccggcctggacaacatcaacgtgttcctgaaggcctgtgagcagatcggcctgaaggaggcccagctgttccaccctggggacctgcaggacctgagcaacagagtgacagtgaagcaggaggagacagaccggcgggtgaagaatgtgctgatcaccctgtactggctgggcaggaaggcccagagcaacccctactacaacggcccccacctgaacctgaaggcctttgagaacctgctgggccaggccctgaccaaggccctggaggacagcagcttcctgaagaggagcggccgggacagcggctatggagacatctggtgcccagagcggggggagttcctggccccacccaggcaccacaagcgggaggacagctttgagagcctggacagcctgggcagccgcagcctgaccagctgcagcagtgacatcaccctgcggggcggccgggagggctttgaaagtgacacagacagcgagttcaccttcaagatgcaggactacaacaaggatgacatgagctaccgccgcatctctgctgtggagcccaagacagccctgcccttcaaccgcttcctgcccaacaagagccggcagcccagctatgtgcctgcccccctgaggaagaagaagccagacaagcatgaggacaacagaagatcctgggccagccctgtgtacacagaagcagatggcaccttcagccgcctcttccagaagatctatggagaaaatggcagcaagtccatgtctgatgtgtctgcagaagatgtgcagaacctgcggcagctgcgctatgaggagatgcagaagatcaagagccagctgaaggagcaggaccagaagtggcaggatgacctggccaagtggaaggacaggaggaagagctacaccagtgacctgcagaagaagaaggaggagcgggaggagattgagaagcaggccctggagaagagcaagaggagcagcaagaccttcaaggagatgctgcaggaccgggagagccagaaccagaagagcacagtgcccagcagaagaaggatgtacagctttgatgatgtgctggaggagggcaagaggcctcccaccatgacagtgtctgaggccagctaccagagcgagcgggtggaggagaagggggccacctaccccagcgagatccccaaggaggacagcaccacctttgccaagcgggaggacagagtgaccacagagatccagctgcccagccagagccctgtggaggagcagagccctgccagcctgagcagcctgcggagccgcagcacccagatggagagcaccagggtgtctgccagcctgcccaggagctacaggaagacagacacagtgcggctgacctctgtggtgaccccccggcccttcggcagccagacccggggcatcagcagcctgcccaggagctacaccatggatgatgcctggaagtacaatggagatgtggaggacatcaagaggacccccaacaacgtggtgtccaccccagcccccagcccagatgccagccagctggccagcagcctgagcagccagaaggaggtggccgccacagaagaagatgtgacccggctgcccagccccaccagccccttcagcagcctgagccaggaccaggccgccaccagcaaggccaccctgagcagcaccagcggcctggacctgatgtctgagagcggggagggggagatcagcccccagcgggaggtgagccgcagccaggaccagttcagtgacatgaggatcagcatcaaccagaccccaggcaagagcctggactttggcttcaccatcaagtgggacatccctggcatctttgtggcctctgtggaggccggcagccctgctgagttcagccagctgcaggtggatgatgagatcatcgccatcaacaacaccaagttctcctacaatgacagcaaggagtgggaggaggccatggccaaggcccaggagaccggccacctggtgatggatgtgcggcgctatggcaaggccggcagccctgagaccaagtggattgatgccaccagcggcatctacaacagcgagaagagcagcaacctgtctgtgaccacagacttcagcgagagcctgcagagcagcaacatcgagagcaaggagatcaatggcatccatgatgagagcaatgcctttgagagcaaggccagcgagagcatcagcctgaagaacctgaagagaagaagccagttctttgagcagggcagcagtgacagcgtggtgcctgacctgcctgtgcccaccatcagcgcccccagccgctgggtgtgggaccaggaggaggagaggaagaggcaggagcgctggcagaaggagcaggaccggctgctgcaggagaagtaccagcgggagcaggagaagctgcgggaggagtggcagagggccaagcaggaggccgagcgggagaacagcaagtacctggatgaggagctgatggtgctgagcagcaacagcatgagcctgaccacccgggagcccagcctggccacctgggaggccacctggagcgagggcagcaagagcagtgaccgggagggcaccagggctggggaggaggagcggcggcagccccaggaggaggtggtgcatgaggaccagggcaagaagccccaggaccagctggtgattgaaagagagaggaagtgggagcagcagctgcaggaggagcaggagcagaagaggctgcaggccgaggccgaggagcagaagaggcctgctgaggagcagaagaggcaggccgagattgagcgggagacctctgtgcgcatctaccagtacagaagacctgtggacagctatgacatccccaagacagaggaggccagcagcggcttcctgcccggggacaggaacaagagccgcagcaccacagagctggatgactacagcaccaacaagaatggaaacaacaagtacctggaccagatcggcaacatgaccagcagccagaggaggagcaagaaggagcaggtgcccagcggggctgagctggagcggcagcagatcctgcaggagatgaggaagaggacccccctgcacaatgacaacagctggatccggcagaggtctgcctctgtgaacaaggagcctgtgtccctgcccggcatcatgagaagaggagagagcctggacaacctggacagccccaggagcaacagctggaggcagcccccctggctgaaccagcccaccggcttctacgccagcagctctgtgcaggacttcagccggcccccaccccagctggtgtccaccagcaacagagcctacatgaggaaccccagcagctctgtgcccccacccagcgctggctctgtgaagaccagcaccactggagtggccaccacccagagccccacccccaggagccacagccccagcgccagccagagcggcagccagctgaggaacagatctgtgtctgggaagaggatctgcagctactgcaacaacatcctgggcaaaggagctgccatgatcatcgagagcctgggcctgtgctaccacctgcactgcttcaagtgtgtggcctgtgaatgtgacctgggcggcagcagcagtggagctgaggtgcgcatccggaaccaccagctgtactgcaatgactgctacctgcgcttcaagagcggccggcccacagccatgtag

SEQ ID NO: 157892 - DNA, 5013 bp, Artificial Sequence
  Description of Artificial Sequence: Synthetic coding sequence
atgaagaagatccgcatctgccacatcttcaccttctacagctggatgtcctatgatgtgctcttccagaggacagagctgggcgccctggagatctggaggcagctgatctgtgcccacgtgtgcatctgtgtgggctggctgtacctgcgggacagagtgtgcagcaagaaggacatcatcctgaggacagagcagaacagcggccgcaccatcctgatcaaggctgtgacagagaagaactttgagaccaaggacttccgggccagcctggagaatggagtgctgctgtgtgacctgatcaacaagctgaagccaggagtcatcaagaagatcaaccggctgagcacccccatcgccggcctggacaacatcaacgtgttcctgaaggcctgtgagcagatcggcctgaaggaggcccagctgttccaccctggggacctgcaggacctgagcaacagagtgacagtgaagcaggaggagacagaccggcgggtgaagaatgtgctgatcaccctgtactggctgggcaggaaggcccagagcaacccctactacaacggcccccacctgaacctgaaggcctttgagaacctgctgggccaggccctgaccaaggccctggaggacagcagcttcctgaagaggagcggccgggacagcggctatggagacatctggtgcccagagcggggggagttcctggccccacccaggcaccacaagcgggaggacagctttgagagcctggacagcctgggcagccgcagcctgaccagctgcagcagtgacatcaccctgcggggcggccgggagggctttgaaagtgacacagacagcgagttcaccttcaagatgcaggactacaacaaggatgacatgagctaccgccgcatctctgctgtggagcccaagacagccctgcccttcaaccgcttcctgcccaacaagagccggcagcccagctatgtgcctgcccccctgaggaagaagaagccagacaagcatgaggacaacagaagatcctgggccagccctgtgtacacagaagcagatggcaccttcagcagcaaccagaggcgcatctggggcaccaacgtggagaactggcccaccgtgcagggcaccagcaagagcagctgctacctggaggaggagaaggccaagaccaggagcatccccaacatcgtgaaggatgacctgtatgtgaggaagctgagccctgtgatgcccaaccctggaaatgcctttgaccagttcctgcccaagtgctggaccccagaagatgtgaactggaagaggatcaagcgggagacctacaagccctggtacaaggagttccagggcttcagccagttcctgctgctgcaggccctgcagacctacagtgatgacatcctgagcagcgagacccacaccaagattgaccccaccagcggccccaggctcatcaccaggaggaagaacctgtcctatgcccctggctacagaagagatgacctggagatggccgccctggaccctgacctggagaatgatgacttctttgtgaggaagacaggagccttccacgccaacccctacgtgctgcgggcctttgaggacttcaggaagttcagcgagcaggatgattctgtggagcgggacatcatcctgcagtgccgggagggggagctggtgctgcctgacctggagaaggatgacatgattgtgcggcgcatcccagcccagaagaaggaggtgcccctgagcggggccccagaccgctaccaccctgtgcccttccctgagccctggaccctgcccccagagatccaggccaagttcctgtgtgtgctggagaggacctgccccagcaaggagaagagcaacagctgccgcatcctggtgcccagctaccggcagaagaaggatgacatgctgaccaggaagatccagagctggaagctgggcaccaccgtgccccccatctccttcaccccaggcccctgcagcgaggccgacctgaagcgctgggaggccatccgggaggccagccggctgcggcacaagaagaggctgatggtggagcggctcttccagaagatctatggagaaaatggcagcaagtccatgtctgatgtgtctgcagaagatgtgcagaacctgcggcagctgcgctatgaggagatgcagaagatcaagagccagctgaaggagcaggaccagaagtggcaggatgacctggccaagtggaaggacaggaggaagagctacaccagtgacctgcagaagaagaaggaggagcgggaggagattgagaagcaggccctggagaagagcaagaggagcagcaagaccttcaaggagatgctgcaggaccgggagagccagaaccagaagagcacagtgcccagcagaagaaggatgtacagctttgatgatgtgctggaggagggcaagaggcctcccaccatgacagtgtctgaggccagctaccagagcgagcgggtggaggagaagggggccacctaccccagcgagatccccaaggaggacagcaccacctttgccaagcgggaggacagagtgaccacagagatccagctgcccagccagagccctgtggaggagcagagccctgccagcctgagcagcctgcggagccgcagcacccagatggagagcaccagggtgtctgccagcctgcccaggagctacaggaagacagacacagtgcggctgacctctgtggtgaccccccggcccttcggcagccagacccggggcatcagcagcctgcccaggagctacaccatggatgatgcctggaagtacaatggagatgtggaggacatcaagaggacccccaacaacgtggtgtccaccccagcccccagcccagatgccagccagctggccagcagcctgagcagccagaaggaggtggccgccacagaagaagatgtgacccggctgcccagccccaccagccccttcagcagcctgagccaggaccaggccgccaccagcaaggccaccctgagcagcaccagcggcctggacctgatgtctgagagcggggagggggagatcagcccccagcgggaggtgagccgcagccaggaccagttcagtgacatgaggatcagcatcaaccagaccccaggcaagagcctggactttggcttcaccatcaagtgggacatccctggcatctttgtggcctctgtggaggccggcagccctgctgagttcagccagctgcaggtggatgatgagatcatcgccatcaacaacaccaagttctcctacaatgacagcaaggagtgggaggaggccatggccaaggcccaggagaccggccacctggtgatggatgtgcggcgctatggcaaggccggcagccctgagaccaagtggattgatgccaccagcggcatctacaacagcgagaagagcagcaacctgtctgtgaccacagacttcagcgagagcctgcagagcagcaacatcgagagcaaggagatcaatggcatccatgatgagagcaatgcctttgagagcaaggccagcgagagcatcagcctgaagaacctgaagagaagaagccagttctttgagcagggcagcagtgacagcgtggtgcctgacctgcctgtgcccaccatcagcgcccccagccgctgggtgtgggaccaggaggaggagaggaagaggcaggagcgctggcagaaggagcaggaccggctgctgcaggagaagtaccagcgggagcaggagaagctgcgggaggagtggcagagggccaagcaggaggccgagcgggagaacagcaagtacctggatgaggagctgatggtgctgagcagcaacagcatgagcctgaccacccgggagcccagcctggccacctgggaggccacctggagcgagggcagcaagagcagtgaccgggagggcaccagggctggggaggaggagcggcggcagccccaggaggaggtggtgcatgaggaccagggcaagaagccccaggaccagctggtgattgaaagagagaggaagtgggagcagcagctgcaggaggagcaggagcagaagaggctgcaggccgaggccgaggagcagaagaggcctgctgaggagcagaagaggcaggccgagattgagcgggagacctctgtgcgcatctaccagtacagaagacctgtggacagctatgacatccccaagacagaggaggccagcagcggcttcctgcccggggacaggaacaagagccgcagcaccacagagctggatgactacagcaccaacaagaatggaaacaacaagtacctggaccagatcggcaacatgaccagcagccagaggaggagcaagaaggagcaggtgcccagcggggctgagctggagcggcagcagatcctgcaggagatgaggaagaggacccccctgcacaatgacaacagctggatccggcagaggtctgcctctgtgaacaaggagcctgtgtccctgcccggcatcatgagaagaggagagagcctggacaacctggacagccccaggagcaacagctggaggcagcccccctggctgaaccagcccaccggcttctacgccagcagctctgtgcaggacttcagccggcccccaccccagctggtgtccaccagcaacagagcctacatgaggaaccccagcagctctgtgcccccacccagcgctggctctgtgaagaccagcaccactggagtggccaccacccagagccccacccccaggagccacagccccagcgccagccagagcggcagccagctgaggaacagcgtgctgcctgtgtctgtgaccagcgaggccctgccccaggagctgaagagcggcagcgagaccaccaactgcacagccaccacagccatcagtgacagcaacctggatggccagcccccctgtgatgtgtccctgcacaccaaggccctgctgcagatcgaggaggaggtggtggccgcccacgtggacctgtag

SEQ ID NO: 157893 - DNA, 4845 bp, Artificial Sequence
  Description of Artificial Sequence: Synthetic coding sequence
atgaagaagatccgcatctgccacatcttcaccttctacagctggatgtcctatgatgtgctcttccagaggacagagctgggcgccctggagatctggaggcagctgatctgtgcccacgtgtgcatctgtgtgggctggctgtacctgcgggacagagtgtgcagcaagaaggacatcatcctgaggacagagcagaacagcggccgcaccatcctgatcaaggctgtgacagagaagaactttgagaccaaggacttccgggccagcctggagaatggagtgctgctgtgtgacctgatcaacaagctgaagccaggagtcatcaagaagatcaaccggctgagcacccccatcgccggcctggacaacatcaacgtgttcctgaaggcctgtgagcagatcggcctgaaggaggcccagctgttccaccctggggacctgcaggacctgagcaacagagtgacagtgaagcaggaggagacagaccggcgggtgaagaatgtgctgatcaccctgtactggctgggcaggaaggcccagagcaacccctactacaacggcccccacctgaacctgaaggcctttgagaacctgctgggccaggccctgaccaaggccctggaggacagcagcttcctgaagaggagcggccgggacagcggctatggagacatctggtgcccagagcggggggagttcctggccccacccaggcaccacaagcgggaggacagctttgagagcctggacagcctgggcagccgcagcctgaccagctgcagcagtgacatcaccctgcggggcggccgggagggctttgaaagtgacacagacagcgagttcaccttcaagatgcaggactacaacaaggatgacatgagctaccgccgcatctctgctgtggagcccaagacagccctgcccttcaaccgcttcctgcccaacaagagccggcagcccagctatgtgcctgcccccctgaggaagaagaagccagacaagcatgaggacaacagaagatcctgggccagccctgtgtacacagaagcagatggcaccttcagcagcaaccagaggcgcatctggggcaccaacgtggagaactggcccaccgtgcagggcaccagcaagagcagctgctacctggaggaggagaaggccaagaccaggagcatccccaacatcgtgaaggatgacctgtatgtgaggaagctgagccctgtgatgcccaaccctggaaatgcctttgaccagttcctgcccaagtgctggaccccagaagatgtgaactggaagaggatcaagcgggagacctacaagccctggtacaaggagttccagggcttcagccagttcctgctgctgcaggccctgcagacctacagtgatgacatcctgagcagcgagacccacaccaagattgaccccaccagcggccccaggctcatcaccaggaggaagaacctgtcctatgcccctggctacagaagagatgacctggagatggccgccctggaccctgacctggagaatgatgacttctttgtgaggaagacaggagccttccacgccaacccctacgtgctgcgggcctttgaggacttcaggaagttcagcgagcaggatgattctgtggagcgggacatcatcctgcagtgccgggagggggagctggtgctgcctgacctggagaaggatgacatgattgtgcggcgcatcccagcccagaagaaggaggtgcccctgagcggggccccagaccgctaccaccctgtgcccttccctgagccctggaccctgcccccagagatccaggccaagttcctgtgtgtgctggagaggacctgccccagcaaggagaagagcaacagctgccgcatcctggtgcccagctaccggcagaagaaggatgacatgctgaccaggaagatccagagctggaagctgggcaccaccgtgccccccatctccttcaccccaggcccctgcagcgaggccgacctgaagcgctgggaggccatccgggaggccagccggctgcggcacaagaagaggctgatggtggagcggctcttccagaagatctatggagaaaatggcagcaagtccatgtctgatgtgtctgcagaagatgtgcagaacctgcggcagctgcgctatgaggagatgcagaagatcaagagccagctgaaggagcaggaccagaagtggcaggatgacctggccaagtggaaggacaggaggaagagctacaccagtgacctgcagaagaagaaggaggagcgggaggagattgagaagcaggccctggagaagagcaagaggagcagcaagaccttcaaggagatgctgcaggaccgggagagccagaaccagaagagcacagtgcccagcagaagaaggatgtacagctttgatgatgtgctggaggagggcaagaggcctcccaccatgacagtgtctgaggccagctaccagagcgagcgggtggaggagaagggggccacctaccccagcgagatccccaaggaggacagcaccacctttgccaagcgggaggacagagtgaccacagagatccagctgcccagccagagccctgtggaggagcagagccctgccagcctgagcagcctgcggagccgcagcacccagatggagagcaccagggtgtctgccagcctgcccaggagctacaggaagacagacacagtgcggctgacctctgtggtgaccccccggcccttcggcagccagacccggggcatcagcagcctgcccaggagctacaccatggatgatgcctggaagtacaatggagatgtggaggacatcaagaggacccccaacaacgtggtgtccaccccagcccccagcccagatgccagccagctggccagcagcctgagcagccagaaggaggtggccgccacagaagaagatgtgacccggctgcccagccccaccagccccttcagcagcctgagccaggaccaggccgccaccagcaaggccaccctgagcagcaccagcggcctggacctgatgtctgagagcggggagggggagatcagcccccagcgggaggtgagccgcagccaggaccagttcagtgacatgaggatcagcatcaaccagaccccaggcaagagcctggactttggcttcaccatcaagtgggacatccctggcatctttgtggcctctgtggaggccggcagccctgctgagttcagccagctgcaggtggatgatgagatcatcgccatcaacaacaccaagttctcctacaatgacagcaaggagtgggaggaggccatggccaaggcccaggagaccggccacctggtgatggatgtgcggcgctatggcaaggccggcagccctgagaccaagtggattgatgccaccagcggcatctacaacagcgagaagagcagcaacctgtctgtgaccacagacttcagcgagagcctgcagagcagcaacatcgagagcaaggagatcaatggcatccatgatgagagcaatgcctttgagagcaaggccagcgagagcatcagcctgaagaacctgaagagaagaagccagttctttgagcagggcagcagtgacagcgtggtgcctgacctgcctgtgcccaccatcagcgcccccagccgctgggtgtgggaccaggaggaggagaggaagaggcaggagcgctggcagaaggagcaggaccggctgctgcaggagaagtaccagcgggagcaggagaagctgcgggaggagtggcagagggccaagcaggaggccgagcgggagaacagcaagtacctggatgaggagctgatggtgctgagcagcaacagcatgagcctgaccacccgggagcccagcctggccacctgggaggccacctggagcgagggcagcaagagcagtgaccgggagggcaccagggctggggaggaggagcggcggcagccccaggaggaggtggtgcatgaggaccagggcaagaagccccaggaccagctggtgattgaaagagagaggaagtgggagcagcagctgcaggaggagcaggagcagaagaggctgcaggccgaggccgaggagcagaagaggcctgctgaggagcagaagaggcaggccgagattgagcgggagacctctgtgcgcatctaccagtacagaagacctgtggacagctatgacatccccaagacagaggaggccagcagcggcttcctgcccggggacaggaacaagagccgcagcaccacagagctggatgactacagcaccaacaagaatggaaacaacaagtacctggaccagatcggcaacatgaccagcagccagaggaggagcaagaaggagcaggtgcccagcggggctgagctggagcggcagcagatcctgcaggagatgaggaagaggacccccctgcacaatgacaacagctggatccggcagaggtctgcctctgtgaacaaggagcctgtgtccctgcccggcatcatgagaagaggagagagcctggacaacctggacagccccaggagcaacagctggaggcagcccccctggctgaaccagcccaccggcttctacgccagcagctctgtgcaggacttcagccggcccccaccccagctggtgtccaccagcaacagagcctacatgaggaaccccagcagctctgtgcccccacccagcgctggctctgtgaagaccagcaccactggagtggccaccacccagagccccacccccaggagccacagccccagcgccagccagagcggcagccagctgaggaacagctggacagccaacagacatgtgatgtag

SEQ ID NO: 157894 - DNA, 4158 bp, Artificial Sequence
  Description of Artificial Sequence: Synthetic coding sequence
atgcaggactacaacaaggatgacatgagctaccgccgcatctctgctgtggagcccaagacagccctgcccttcaaccgcttcctgcccaacaagagccggcagcccagctatgtgcctgcccccctgaggaagaagaagccagacaagcatgaggacaacagaagatcctgggccagccctgtgtacacagaagcagatggcaccttcagcagcaaccagaggcgcatctggggcaccaacgtggagaactggcccaccgtgcagggcaccagcaagagcagctgctacctggaggaggagaaggccaagaccaggagcatccccaacatcgtgaaggatgacctgtatgtgaggaagctgagccctgtgatgcccaaccctggaaatgcctttgaccagttcctgcccaagtgctggaccccagaagatgtgaactggaagaggatcaagcgggagacctacaagccctggtacaaggagttccagggcttcagccagttcctgctgctgcaggccctgcagacctacagtgatgacatcctgagcagcgagacccacaccaagattgaccccaccagcggccccaggctcatcaccaggaggaagaacctgtcctatgcccctggctacagaagagatgacctggagatggccgccctggaccctgacctggagaatgatgacttctttgtgaggaagacaggagccttccacgccaacccctacgtgctgcgggcctttgaggacttcaggaagttcagcgagcaggatgacagcgtggagcgggacatcatcctgcagtgccgggagggggagctggtgctgcctgacctggagaaggatgacatgattgtgcggcgcatcccagcccagaagaaggaggtgcccctgagcggggccccagaccgctaccaccctgtgcccttccctgagccctggaccctgcccccagagatccaggccaagttcctgtgtgtgctggagaggacctgccccagcaaggagaagagcaacagctgccgcatcctggtgcccagctaccggcagaagaaggatgacatgctgaccaggaagatccagagctggaagctgggcaccaccgtgccccccatctccttcaccccaggcccctgcagcgaggccgacctgaagcgctgggaggccatccgggaggccagccggctgcggcacaagaagaggctgatggtggagcggctcttccagaagatctacggggagaatggcagcaagtccatgtctgatgtgtctgcagaagatgtgcagaacctgcggcagctgcgctatgaggagatgcagaagatcaagagccagctgaaggagcaggaccagaagtggcaggatgacctggccaagtggaaggacaggaggaagagctacaccagtgacctgcagaagaagaaggaggagcgggaggagattgagaagcaggccctggagaagagcaagaggagcagcaagaccttcaaggagatgctgcaggaccgggagagccagaaccagaagagcacagtgcccagcagaagaaggatgtacagctttgatgatgtgctggaggagggcaagaggcctcccaccatgacagtgtctgaggccagctaccagagcgagcgggtggaggagaagggggccacctaccccagcgagatccccaaggaggacagcaccacctttgccaagagagaagatagagtgaccacagagatccagctgcccagccagagccctgtggaggagcagagccctgccagcctgagcagcctgcggagccgcagcacccagatggagagcaccagggtgtctgccagcctgcccaggagctacaggaagacagacacagtgcggctgacctctgtggtgaccccccggcccttcggcagccagacccggggcatcagcagcctgcccaggagctacaccatggatgatgcctggaagtacaatggagatgtggaggacatcaagaggacccccaacaacgtggtgtccaccccagcccccagcccagatgccagccagctggccagcagcctgagcagccagaaggaggtggccgccacagaggaggatgtgacccggctgcccagccccaccagccccttcagcagcctgagccaggaccaggccgccaccagcaaggccaccctgagcagcaccagcggcctggacctgatgtctgagagcggggagggggagatcagcccccagcgggaggtgagccgcagccaggaccagttcagtgacatgaggatcagcatcaaccagacccctgggaagagcctggactttggcttcaccatcaagtgggacatccctggcatctttgtggcctctgtggaggccggcagccctgctgagttcagccagctgcaggtggatgatgagatcatcgccatcaacaacaccaagttctcctacaatgacagcaaggagtgggaggaggccatggccaaggcccaggagaccggccacctggtgatggatgtgagaagatatggcaaggccggcagccctgagaccaagtggattgatgccaccagcggcatctacaacagcgagaagagcagcaacctgtctgtgaccacagacttcagcgagagcctgcagagcagcaacatcgagagcaaggagatcaatggcatccatgatgagagcaatgcctttgagagcaaggccagcgagagcatcagcctgaagaacctgaagaggaggagccagttctttgagcagggcagcagtgacagcgtggtgcctgacctgcctgtgcccaccatcagcgcccccagccgctgggtgtgggaccaggaggaggagaggaagaggcaggagcgctggcagaaggagcaggaccggctgctgcaggagaagtaccagcgggagcaggagaagctgcgggaggagtggcagagggccaagcaggaggccgagcgggagaacagcaagtacctggatgaggagctgatggtgctgagcagcaacagcatgagcctgaccacccgggagcccagcctggccacctgggaggccacctggagcgagggcagcaagagcagtgaccgggagggcacccgggccggggaggaggagcggcggcagccccaggaggaggtggtgcatgaggaccagggcaagaagccccaggaccagctggtgattgagcgggagaggaagtgggagcagcagctgcaggaggagcaggagcagaagaggctgcaggccgaggccgaggagcagaagaggcctgctgaggagcagaagaggcaggccgagattgaaagagagacctctgtgcgcatctaccagtacagaagacctgtggacagctatgacatccccaagacagaggaggccagcagcggcttcctgcccggggacaggaacaagagccgcagcaccacagagctggatgactacagcaccaacaagaatggaaacaacaagtacctggaccagatcggcaacatgaccagcagccagaggaggagcaagaaggagcaggtgcccagcggggctgagctggagcggcagcagatcctgcaggagatgaggaagaggacccccctgcacaatgacaacagctggatccggcagaggtctgcctctgtgaacaaggagcctgtgtccctgcccggcatcatgagaagaggagagagcctggacaacctggacagccccaggagcaacagctggaggcagcccccctggctgaaccagcccaccggcttctacgccagcagctctgtgcaggacttcagccggcccccaccccagctggtgtccaccagcaacagagcctacatgaggaaccccagcagctctgtgcccccaccttctgctggctctgtgaagaccagcaccaccggggtggccaccacccagagccccacccccaggagccacagccccagcgccagccagagcggcagccagctgagaaattctgtgctgcctgtgtctgtgaccagcgaggccctgccccaggagctgaagagcggcagcgagaccaccaactgcacagccaccacagccatcagtgacagcaacctggatggccagcccccctgtgatgtgtccctgcacaccaaggccctgctgcagatcgaggaggaggtggtggccgcccacgtggacctgtag

SEQ ID NO: 157895 - DNA, 2280 bp, Artificial Sequence
  Description of Artificial Sequence: Synthetic coding sequence
atggagagcagccccttcaacagacggcagtggaccagcctgagcctgcgggtgacagccaaggagctgagcctggtgaacaagaacaagagcagcgccatcgtggagatcttcagcaagtaccagaaggctgctgaggagaccaacatggagaagaagaggagcaacacagagaacctgagccagcacttcaggaagggcaccctgactgtgctgaagaagaagtgggagaaccctggcctgggcgctgagagccacacagacagcctgaggaacagcagcacagagatccgccacagagctgaccaccccccagctgaggtgaccagccacgccgccagcggggccaaggctgaccaggaggagcagatccaccccaggagccggctgcggagccccccagaggccctggtgcagggccgctacccccacatcaaggatggagaggacctgaaggaccacagcacagagagcaagaagatggagaactgcctgggggagagcagacatgaggtggagaagtctgagatcagtgaaaatacagatgccagcggcaagattgagaagtacaacgtgcccctgaaccggctgaagatgatgtttgagaagggggagcccacccagaccaagatcctgcgggcccagagccgcagcgccagcggcaggaagatcagcgagaacagctacagcctggatgacctggagatcggccctggccagctgagcagcagcacctttgacagcgagaagaatgaaagcagaagaaacctggagctgccccggctgtctgagaccagcatcaaggacaggatggccaagtaccaggccgctgtgtccaagcagagcagcagcaccaactacaccaatgagctgaaggccagcggcggggagatcaagatccacaagatggagcagaaggaaaatgtgcccccaggccctgaggtgtgcatcacccaccaggagggggagaagatcagcgccaatgaaaacagcctggccgtgcgcagcaccccagcagaagatgacagccgggacagccaggtgaagtctgaggtgcagcagcctgtgcaccccaagcccctgagcccagacagccgggccagcagcctgtctgagagcagcccccccaaggccatgaagaagttccaggccccagcccgggagacctgtgtggagtgccagaagacagtgtaccccatggagcggctgctggccaaccagcaggtgttccacatcagctgcttccgctgcagctactgcaacaacaagctgagcctgggcacctacgccagcctgcacggccgcatctactgcaagccccacttcaaccagctgttcaagagcaaaggaaattatgatgagggcttcggccaccggccccacaaggacctgtgggccagcaagaatgaaaatgaggagatcctggagaggcctgcccagctggccaatgcccgggagaccccccacagccctggggtggaggatgcccccatcgccaaggtgggcgtgctggccgcctccatggaggccaaggccagcagccagcaggagaaggaggacaagccagctgagaccaagaagctgcgcatcgcctggcccccacccacagagctgggcagcagcggcagcgccctggaggagggcatcaagatgagcaagcccaagtggcccccagaagatgagatcagcaagccagaggtgcctgaagatgtggacctggacctgaagaagctgcggcgcagcagcagcctgaaggagaggagccggcccttcaccgtggccgccagcttccagagcacctctgtgaagagccccaagacagtgagcccccccatcaggaagggctggagcatgtctgagcagagcgaggagagcgtgggcggccgggtggccgagaggaagcaggtggagaatgccaaggccagcaagaagaatggaaatgtgggcaagaccacctggcagaacaaggagagcaaaggagagaccgggaagaggagcaaggagggccacagcctggagatggagaatgaaaacctggtggagaatggagctgacagtgatgaagatgacaacagcttcctgaagcagcagagcccccaggagcccaagagcctgaactggagcagctttgtggacaacacctttgctgaggagttcaccacccagaaccagaagagccaggatgtggagctgtgggagggggaggtggtgaaggagctgtctgtggaggagcagatcaagaggaaccgctactatgatgaagatgaagatgaggagtag

SEQ ID NO: 157896 - DNA, 2283 bp, Artificial Sequence
  Description of Artificial Sequence: Synthetic coding sequence
atggagagcagccccttcaacagacggcagtggaccagcctgagcctgcgggtgacagccaaggagctgagcctggtgaacaagaacaagagcagcgccatcgtggagatcttcagcaagtaccagaaggctgctgaggagaccaacatggagaagaagaggagcaacacagagaacctgagccagcacttcaggaagggcaccctgactgtgctgaagaagaagtgggagaaccctggcctgggcgctgagagccacacagacagcctgaggaacagcagcacagagatccgccacagagctgaccaccccccagctgaggtgaccagccacgccgccagcggggccaaggctgaccaggaggagcagatccaccccaggagccggctgcggagccccccagaggccctggtgcagggccgctacccccacatcaaggatggagaggacctgaaggaccacagcacagagagcaagaagatggagaactgcctgggggagagcagacatgaggtggagaagtctgagatcagtgaaaatacagatgccagcggcaagattgagaagtacaacgtgcccctgaaccggctgaagatgatgtttgagaagggggagcccacccagaccaagatcctgcgggcccagagccgcagcgccagcggcaggaagatcagcgagaacagctacagcctggatgacctggagatcggccctggccagctgagcagcagcacctttgacagcgagaagaatgaaagcagaagaaacctggagctgccccggctgtctgagaccagcatcaaggacaggatggccaagtaccaggccgctgtgtccaagcagagcagcagcaccaactacaccaatgagctgaaggccagcggcggggagatcaagatccacaagatggagcagaaggaaaatgtgcccccaggccctgaggtgtgcatcacccaccaggagggggagaagatcagcgccaatgaaaacagcctggccgtgcgcagcaccccagcagaagatgacagccctggggacagccaggtgaagtctgaggtgcagcagcctgtgcaccccaagcccctgagcccagacagccgggccagcagcctgtctgagagcagcccccccaaggccatgaagaagttccaggccccagcccgggagacctgtgtggagtgccagaagacagtgtaccccatggagcggctgctggccaaccagcaggtgttccacatcagctgcttccgctgcagctactgcaacaacaagctgagcctgggcacctacgccagcctgcacggccgcatctactgcaagccccacttcaaccagctgttcaagagcaagggcaactatgatgagggcttcggccaccggccccacaaggacctgtgggccagcaagaatgaaaatgaggagatcctggagaggcctgcccagctggccaatgcccgggagaccccccacagccctggggtggaggatgcccccatcgccaaggtgggcgtgctggccgcctccatggaggccaaggccagcagccagcaggagaaggaggacaagccagctgagaccaagaagctgagaattgcctggcccccacccacagagctgggcagcagcggcagcgccctggaggagggcatcaagatgagcaagcccaagtggcccccagaagatgagatcagcaagccagaggtgcctgaagatgtggacctggacctgaagaagctgcggcgcagcagcagcctgaaggagaggagccggcccttcaccgtggccgccagcttccagagcacctctgtgaagagccccaagacagtgtccccacccatcaggaagggctggagcatgtctgagcagagcgaggagagcgtgggcggccgggtggccgagaggaagcaggtggagaatgccaaggccagcaagaagaatggaaatgtgggcaagaccacctggcagaacaaggagagcaagggggagaccgggaagaggagcaaggagggccacagcctggagatggagaatgaaaacctggtggagaatggagctgacagtgatgaagatgacaacagcttcctgaagcagcagagcccccaggagcccaagagcctgaactggagcagctttgtggacaacacctttgctgaggagttcaccacccagaaccagaagagccaggatgtggagctgtgggagggggaggtggtgaaggagctgtctgtggaggagcagatcaagaggaaccgctactatgatgaagatgaagatgaggagtag

SEQ ID NO: 157897 - DNA, 2037 bp, Artificial Sequence
  Description of Artificial Sequence: Synthetic coding sequence
atgtggcagggctgcaactgcagccagctgtctgaaacagctgtggaccaggagcagctgggcgtgctgaccttcatcctgcagaggaccacctgcctgaatgtgtctgctgaccaggaggagcagatccaccccaggagccggctgcggagccccccagaggccctggtgcagggccgctacccccacatcaaggatggagaggacctgaaggaccacagcacagagagcaagaagatggagaactgcctgggggagagcagacatgaggtggagaagtctgagatcagcgagaacacagatgccagcggcaagattgagaagtacaacgtgcccctgaaccggctgaagatgatgtttgagaagggggagcccacccagaccaagatcctgcgggcccagagccgcagcgccagcggcaggaagatcagtgaaaattcctacagcctggatgacctggagatcggccctggccagctgagcagcagcacctttgattctgagaagaatgaaagcagaagaaacctggagctgccccggctgtctgagaccagcatcaaggacaggatggccaagtaccaggccgctgtgtccaagcagagcagcagcaccaactacaccaatgagctgaaggccagcggcggggagatcaagatccacaagatggagcagaaggaaaatgtgcccccaggccctgaggtgtgcatcacccaccaggagggggagaagatcagcgccaatgaaaacagcctggccgtgcgcagcaccccagcagaagatgacagccgggacagccaggtgaagtctgaggtgcagcagcctgtgcaccccaagcccctgagcccagacagccgggccagcagcctgtctgagagcagcccccccaaggccatgaagaagttccaggccccagcccgggagacctgtgtggagtgccagaagacagtgtaccccatggagcggctgctggccaaccagcaggtgttccacatcagctgcttccgctgcagctactgcaacaacaagctgagcctgggcacctacgccagcctgcacggccgcatctactgcaagccccacttcaaccagctgttcaagagcaagggcaactatgatgagggcttcggccaccggccccacaaggacctgtgggccagcaagaatgaaaatgaggagatcctggagaggcctgcccagctggccaatgcccgggagaccccccacagccctggggtggaggatgcccccatcgccaaggtgggcgtgctggccgcctccatggaggccaaggccagcagccagcaggagaaggaggacaagccagctgagaccaagaagctgagaattgcctggcccccacccacagagctgggcagcagcggcagcgccctggaggagggcatcaagatgagcaagcccaagtggcccccagaagatgagatcagcaagccagaggtgcctgaagatgtggacctggacctgaagaagctgcggcgcagcagcagcctgaaggagaggagccggcccttcaccgtggccgccagcttccagagcacctctgtgaagagccccaagacagtgtccccacccatcaggaagggctggagcatgtctgagcagagcgaggagagcgtgggcggccgggtggccgagaggaagcaggtggagaatgccaaggccagcaagaagaatggaaatgtgggcaagaccacctggcagaacaaggagagcaagggggagaccgggaagaggagcaaggagggccacagcctggagatggagaatgaaaacctggtggagaatggagctgacagtgatgaagatgacaacagcttcctgaagcagcagagcccccaggagcccaagagcctgaactggagcagctttgtggacaacacctttgctgaggagttcaccacccagaaccagaagagccaggatgtggagctgtgggagggggaggtggtgaaggagctgtctgtggaggagcagatcaagaggaaccgctactatgatgaagatgaagatgaggagtag

SEQ ID NO: 157898 - DNA, 1374 bp, Artificial Sequence
  Description of Artificial Sequence: Synthetic coding sequence
atggagcagaaggaaaatgtgcccccaggccctgaggtgtgcatcacccaccaggagggggagaagatcagcgccaatgaaaacagcctggccgtgcgcagcaccccagcagaagatgacagccgggacagccaggtgaagtctgaggtgcagcagcctgtgcaccccaagcccctgagcccagacagccgggccagcagcctgtctgagagcagcccccccaaggccatgaagaagttccaggccccagcccgggagacctgtgtggagtgccagaagacagtgtaccccatggagcggctgctggccaaccagcaggtgttccacatcagctgcttccgctgcagctactgcaacaacaagctgagcctgggcacctacgccagcctgcacggccgcatctactgcaagccccacttcaaccagctgttcaagagcaaaggaaattatgatgagggcttcggccaccggccccacaaggacctgtgggccagcaagaatgaaaatgaggagatcctggagaggcctgcccagctggccaatgcccgggagaccccccacagccctggggtggaggatgcccccatcgccaaggtgggcgtgctggccgcctccatggaggccaaggccagcagccagcaggagaaggaggacaagccagctgagaccaagaagctgcgcatcgcctggcccccacccacagagctgggcagcagcggcagcgccctggaggagggcatcaagatgagcaagcccaagtggcccccagaagatgagatcagcaagccagaggtgcctgaagatgtggacctggacctgaagaagctgcggcgcagcagcagcctgaaggagaggagccggcccttcaccgtggccgccagcttccagagcacctctgtgaagagccccaagacagtgagcccccccatcaggaagggctggagcatgtctgagcagagcgaggagagcgtgggcggccgggtggccgagaggaagcaggtggagaatgccaaggccagcaagaagaatggaaatgtgggcaagaccacctggcagaacaaggagagcaaaggagagaccgggaagaggagcaaggagggccacagcctggagatggagaatgaaaacctggtggagaatggagctgacagtgatgaagatgacaacagcttcctgaagcagcagagcccccaggagcccaagagcctgaactggagcagctttgtggacaacacctttgctgaggagttcaccacccagaaccagaagagccaggatgtggagctgtgggagggggaggtggtgaaggagctgtctgtggaggagcagatcaagaggaaccgctactatgatgaagatgaagatgaggagtag

SEQ ID NO: 157899 - DNA, 336 bp, Artificial Sequence
  Description of Artificial Sequence: Synthetic coding sequence
atggagagcagccccttcaacagacggcagtggaccagcctgagcctgcgggtgacagccaaggagctgagcctggtgaacaagaacaagagcagcgccatcgtggagatcttcagcaagtaccagaaggctgctgaggagaccaacatggagaagaagaggagcaacacagagaacctgagccagcacttcaggaagggcaccctgactgtgctgaagaagaagtgggagaaccctggcctgggcgctgagagccacacagacagcctgaggaacagcagcacagagatccgccacagagctgaccaccccccagctgaggtgaccagccactag

SEQ ID NO: 157900 - DNA, 393 bp, Artificial Sequence
  Description of Artificial Sequence: Synthetic coding sequence
atggagagcagccccttcaacagacggcagtggaccagcctgagcctgcgggtgacagccaaggagctgagcctggtgaacaagaacaagagcagcgccatcgtggagatcttcagcaagtaccagaaggctgctgaggagaccaacatggagaagaagaggagcaacacagagaacctgagccagcacttcaggaagggcaccctgactgtgctgaagaagaagtgggagaaccctggcctgggcgctgagagccacacagacagcctgaggaacagcagcacagagatccgccacagagctgaccaccccccagctgaggtgaccagccacgccgccagcggggccaaggctgaccaggaggagcagatccaccccaggagccggctgtag

SEQ ID NO: 157901 - DNA, 1371 bp, Artificial Sequence
  Description of Artificial Sequence: Synthetic coding sequence
atggagcagaaggaaaatgtgcccccaggccctgaggtgtgcatcacccaccaggagggggagaagatcagcgccaatgaaaacagcctggccgtgcgcagcaccccagcagaagatgacagccgggacagccaggtgaagtctgaggtgcagcagcctgtgcaccccaagcccctgagcccagacagccgggccagcagcctgtctgagagcagcccccccaaggccatgaagttccaggccccagcccgggagacctgtgtggagtgccagaagacagtgtaccccatggagcggctgctggccaaccagcaggtgttccacatcagctgcttccgctgcagctactgcaacaacaagctgagcctgggcacctacgccagcctgcacggccgcatctactgcaagccccacttcaaccagctgttcaagagcaagggcaactatgatgagggcttcggccaccggccccacaaggacctgtgggccagcaagaatgaaaatgaggagatcctggagaggcctgcccagctggccaatgcccgggagaccccccacagccctggggtggaggatgcccccatcgccaaggtgggcgtgctggccgcctccatggaggccaaggccagcagccagcaggagaaggaggacaagccagctgagaccaagaagctgagaattgcctggcccccacccacagagctgggcagcagcggcagcgccctggaggagggcatcaagatgagcaagcccaagtggcccccagaagatgagatcagcaagccagaggtgcctgaagatgtggacctggacctgaagaagctgcggcgcagcagcagcctgaaggagaggagccggcccttcaccgtggccgccagcttccagagcacctctgtgaagagccccaagacagtgtccccacccatcaggaagggctggagcatgtctgagcagagcgaggagagcgtgggcggccgggtggccgagaggaagcaggtggagaatgccaaggccagcaagaagaatggaaatgtgggcaagaccacctggcagaacaaggagagcaagggggagaccgggaagaggagcaaggagggccacagcctggagatggagaatgaaaacctggtggagaatggagctgacagtgatgaagatgacaacagcttcctgaagcagcagagcccccaggagcccaagagcctgaactggagcagctttgtggacaacacctttgctgaggagttcaccacccagaaccagaagagccaggatgtggagctgtgggagggggaggtggtgaaggagctgtctgtggaggagcagatcaagaggaaccgctactatgatgaagatgaagatgaggagtag

SEQ ID NO: 157902 - DNA, 1803 bp, Artificial Sequence
  Description of Artificial Sequence: Synthetic coding sequence
atggagaactgcctgggggagagcagacatgaggtggagaagtctgagatcagtgaaaatacagatgccagcggcaagattgagaagtacaacgtgcccctgaaccggctgaagatgatgtttgagaagggggagcccacccagaccaagatcctgcgggcccagagccgcagcgccagcggcaggaagatcagcgagaacagctacagcctggatgacctggagatcggccctggccagctgagcagcagcacctttgacagcgagaagaatgaaagcagaagaaacctggagctgccccggctgtctgagaccagcatcaaggacaggatggccaagtaccaggccgctgtgtccaagcagagcagcagcaccaactacaccaatgagctgaaggccagcggcggggagatcaagatccacaagatggagcagaaggaaaatgtgcccccaggccctgaggtgtgcatcacccaccaggagggggagaagatcagcgccaatgaaaacagcctggccgtgcgcagcaccccagcagaagatgacagccctggggacagccaggtgaagtctgaggtgcagcagcctgtgcaccccaagcccctgagcccagacagccgggccagcagcctgtctgagagcagcccccccaaggccatgaagaagttccaggccccagcccgggagacctgtgtggagtgccagaagacagtgtaccccatggagcggctgctggccaaccagcaggtgttccacatcagctgcttccgctgcagctactgcaacaacaagctgagcctgggcacctacgccagcctgcacggccgcatctactgcaagccccacttcaaccagctgttcaagagcaagggcaactatgatgagggcttcggccaccggccccacaaggacctgtgggccagcaagaatgaaaatgaggagatcctggagaggcctgcccagctggccaatgcccgggagaccccccacagccctggggtggaggatgcccccatcgccaaggtgggcgtgctggccgcctccatggaggccaaggccagcagccagcaggagaaggaggacaagccagctgagaccaagaagctgagaattgcctggcccccacccacagagctgggcagcagcggcagcgccctggaggagggcatcaagatgagcaagcccaagtggcccccagaagatgagatcagcaagccagaggtgcctgaagatgtggacctggacctgaagaagctgcggcgcagcagcagcctgaaggagaggagccggcccttcaccgtggccgccagcttccagagcacctctgtgaagagccccaagacagtgtccccacccatcaggaagggctggagcatgtctgagcagagcgaggagagcgtgggcggccgggtggccgagaggaagcaggtggagaatgccaaggccagcaagaagaatggaaatgtgggcaagaccacctggcagaacaaggagagcaagggggagaccgggaagaggagcaaggagggccacagcctggagatggagaatgaaaacctggtggagaatggagctgacagtgatgaagatgacaacagcttcctgaagcagcagagcccccaggagcccaagagcctgaactggagcagctttgtggacaacacctttgctgaggagttcaccacccagaaccagaagagccaggatgtggagctgtgggagggggaggtggtgaaggagctgtctgtggaggagcagatcaagaggaaccgctactatgatgaagatgaagatgaggagtag

SEQ ID NO: 157903 - DNA, 1800 bp, Artificial Sequence
  Description of Artificial Sequence: Synthetic coding sequence
atggagaactgcctgggggagagcagacatgaggtggagaagtctgagatcagtgaaaatacagatgccagcggcaagattgagaagtacaacgtgcccctgaaccggctgaagatgatgtttgagaagggggagcccacccagaccaagatcctgcgggcccagagccgcagcgccagcggcaggaagatcagcgagaacagctacagcctggatgacctggagatcggccctggccagctgagcagcagcacctttgacagcgagaagaatgaaagcagaagaaacctggagctgccccggctgtctgagaccagcatcaaggacaggatggccaagtaccaggccgctgtgtccaagcagagcagcagcaccaactacaccaatgagctgaaggccagcggcggggagatcaagatccacaagatggagcagaaggaaaatgtgcccccaggccctgaggtgtgcatcacccaccaggagggggagaagatcagcgccaatgaaaacagcctggccgtgcgcagcaccccagcagaagatgacagccgggacagccaggtgaagtctgaggtgcagcagcctgtgcaccccaagcccctgagcccagacagccgggccagcagcctgtctgagagcagcccccccaaggccatgaagaagttccaggccccagcccgggagacctgtgtggagtgccagaagacagtgtaccccatggagcggctgctggccaaccagcaggtgttccacatcagctgcttccgctgcagctactgcaacaacaagctgagcctgggcacctacgccagcctgcacggccgcatctactgcaagccccacttcaaccagctgttcaagagcaaaggaaattatgatgagggcttcggccaccggccccacaaggacctgtgggccagcaagaatgaaaatgaggagatcctggagaggcctgcccagctggccaatgcccgggagaccccccacagccctggggtggaggatgcccccatcgccaaggtgggcgtgctggccgcctccatggaggccaaggccagcagccagcaggagaaggaggacaagccagctgagaccaagaagctgcgcatcgcctggcccccacccacagagctgggcagcagcggcagcgccctggaggagggcatcaagatgagcaagcccaagtggcccccagaagatgagatcagcaagccagaggtgcctgaagatgtggacctggacctgaagaagctgcggcgcagcagcagcctgaaggagaggagccggcccttcaccgtggccgccagcttccagagcacctctgtgaagagccccaagacagtgagcccccccatcaggaagggctggagcatgtctgagcagagcgaggagagcgtgggcggccgggtggccgagaggaagcaggtggagaatgccaaggccagcaagaagaatggaaatgtgggcaagaccacctggcagaacaaggagagcaaaggagagaccgggaagaggagcaaggagggccacagcctggagatggagaatgaaaacctggtggagaatggagctgacagtgatgaagatgacaacagcttcctgaagcagcagagcccccaggagcccaagagcctgaactggagcagctttgtggacaacacctttgctgaggagttcaccacccagaaccagaagagccaggatgtggagctgtgggagggggaggtggtgaaggagctgtctgtggaggagcagatcaagaggaaccgctactatgatgaagatgaagatgaggagtag

SEQ ID NO: 157904 - DNA, 1128 bp, Artificial Sequence
  Description of Artificial Sequence: Synthetic coding sequence
atgctggacagagatgtgggccccacccccatgtacccacccacctacctggagcccggcatcggccgccacaccccctacggcaaccagacagactaccgcatctttgagctgaacaagaggctgcagaactggacagaggagtgtgacaacctgtggtgggatgccttcaccacagagttctttgaagatgatgccatgctgaccatcaccttctgcctggaggatggccccaagcgctacaccatcggccgcaccctcatcccccgctacttccgcagcatctttgagggcggggccacagagctgtactacgtgctgaagcaccccaaggaggccttccacagcaactttgtgtccctggactgtgaccagggctccatggtgacccagcacggcaagcccatgttcacccaggtgtgtgtggagggccgcctgtacctggagttcatgtttgatgacatgatgaggatcaagacctggcacttcagcatccggcagcaccgggagctgatccccaggagcatcctggccatgcacgcccaggacccccagatgctggaccagctgagcaagaacatcacccgctgtggcctgagcaacagcaccctgaactacctgcggctgtgtgtgatcctggagcccatgcaggagctgatgagccgccacaagacctacagcctgagcccccgggactgcctgaagacctgcctcttccagaagtggcagaggatggtggcccccccagctgagcccacccggcagcagcccagcaagaggaggaagaggaagatgtctgggggcagcaccatgagcagcggcggcggcaacaccaacaacagcaacagcaagaagaagagccctgccagcacctttgccctgagcagccaggtgcctgatgtgatggtggtgggggagcccaccctgatgggcggggagtttggagatgaagatgagcggctcatcacccggctggagaacacccagtttgatgctgccaacggcattgatgatgaagattccttcaacaacagccctgccctgggcgccaacagcccctggaacagcaagccacccagcagccaggagagcaagtctgagaaccccaccagccaggccagccagtag

SEQ ID NO: 157905 - DNA, 1236 bp, Artificial Sequence
  Description of Artificial Sequence: Synthetic coding sequence
atgtctgtgggctgtgcctgccccggctgcagcagcaagagcttcaagctgtacagccccaaggagcccccaaatggaaatgccttcccccccttccaccctggcaccatgctggacagagatgtgggccccacccccatgtacccacccacctacctggagcccggcatcggccgccacaccccctacggcaaccagacagactaccgcatctttgagctgaacaagaggctgcagaactggacagaggagtgtgacaacctgtggtgggatgccttcaccacagagttctttgaagatgatgccatgctgaccatcaccttctgcctggaggatggccccaagcgctacaccatcggccgcaccctcatcccccgctacttccgcagcatctttgagggcggggccacagagctgtactacgtgctgaagcaccccaaggaggccttccacagcaactttgtgtccctggactgtgaccagggctccatggtgacccagcacggcaagcccatgttcacccaggtgtgtgtggagggccgcctgtacctggagttcatgtttgatgacatgatgaggatcaagacctggcacttcagcatccggcagcaccgggagctgatccccaggagcatcctggccatgcacgcccaggacccccagatgctggaccagctgagcaagaacatcacccgctgtggcctgagcaacagcaccctgaactacctgcggctgtgtgtgatcctggagcccatgcaggagctgatgagccgccacaagacctacagcctgagcccccgggactgcctgaagacctgcctcttccagaagtggcagaggatggtggcccccccagctgagcccacccggcagcagcccagcaagaggaggaagaggaagatgtctgggggcagcaccatgagcagcggcggcggcaacaccaacaacagcaacagcaagaagaagagccctgccagcacctttgccctgagcagccaggtgcctgatgtgatggtggtgggggagcccaccctgatgggcggggagtttggagatgaagatgagcggctcatcacccggctggagaacacccagtttgatgctgccaacggcattgatgatgaagattccttcaacaacagccctgccctgggcgccaacagcccctggaacagcaagccacccagcagccaggagagcaagtctgagaaccccaccagccaggccagccagtag

SEQ ID NO: 157906 - DNA, 1122 bp, Artificial Sequence
  Description of Artificial Sequence: Synthetic coding sequence
atgagcagcacccctcatgaccccttctacagcagccccttcggccccttctacagaagacacaccccctacatggtgcagcctgagtaccgcatctatgagatgaacaagaggctgcagagcaggacagaggacagcgacaacctgtggtgggatgcctttgccacagagttctttgaagatgatgccaccctgaccctgtccttctgcctggaggatggccccaagcgctacaccatcggccgcaccctcatcccccgctacttcagcacagtgtttgaaggaggagtgacagacctgtactacatcctgaagcacagcaaggagagctaccacaacagcagcatcaccgtggactgtgaccagtgcaccatggtgacccagcacggcaagcccatgttcaccaaggtgtgcacagagggccgcctcatcctggagttcacctttgatgacctgatgaggatcaagacctggcacttcaccatccggcagtaccgggagctggtgcccaggagcatcctggccatgcacgcccaggacccccaggtgctggaccagctgagcaagaacatcaccaggatgggcctgaccaacttcaccctgaactacctgcggctgtgtgtgatcctggagcccatgcaggagctgatgagccgccacaagacctacaacctgagcccccgggactgcctgaagacctgcctcttccagaagtggcagaggatggtggcccctcctgctgagcccacccggcagcccaccaccaagaggaggaagaggaagaacagcaccagcagcaccagcaacagcagcgctggcaacaatgccaacagcacaggcagcaagaagaagaccacagctgccaacctgagcctgagcagccaggtgcctgatgtgatggtggtgggggagcccaccctgatgggcggggagtttggagatgaagatgagcggctcatcacccggctggagaacacccagtatgatgctgccaacggcatggatgatgaggaggacttcaacaacagccctgccctgggcaacaacagcccctggaacagcaagcccccagccacccaggagaccaagtcagaaaatcctccaccccaggccagccagtag

SEQ ID NO: 157907 - DNA, 996 bp, Artificial Sequence
  Description of Artificial Sequence: Synthetic coding sequence
atgagcagcacccctcatgaccccttctacagcagccccttcggccccttctacagaagacacaccccctacatggtgcagcctgagtaccgcatctatgagatgaacaagaggctgcagagcaggacagaggacagcgacaacctgtggtgggatgcctttgccacagagttctttgaagatgatgccaccctgaccctgtccttctgcctggaggatggccccaagcgctacaccatcggccgcaccctcatcccccgctacttcagcacagtgtttgaaggaggagtgacagacctgtactacatcctgaagcacagcaaggagagctaccacaacagcagcatcaccgtggactgtgaccagtgcaccatggtgacccagcacggcaagcccatgttcaccaaggtgtgcacagagggccgcctcatcctggagttcacctttgatgacctgatgaggatcaagacctggcacttcaccatccggcagtaccgggagctggtgcccaggagcatcctggccatgcacgcccaggacccccaggtgctggaccagctgagcaagaacatcaccaggatgggcctgaccaacttcaccctgaactacctgcggctgtgtgtgatcctggagcccatgcaggagctgatgagccgccacaagacctacaacctgagcccccgggactgcctgaagacctgcctcttccagaagtggcagaggatggtggcccctcctgctgagcccacccggcagcccaccaccaagaggaggaagaggaagaacagcaccagcagcaccagcaacagcagcgctggcaacaatgccaacagcacaggcagcaagaagaagaccacagctgccaacctgagcctgagcagccaggtgcccggcctgggcgccatccccaactgcagcctgaaccctggaagagatggagacctgtgccacagcacagctgtgacccccagcggccagttcaaggagaagcactag

SEQ ID NO: 157908 - DNA, 942 bp, Artificial Sequence
  Description of Artificial Sequence: Synthetic coding sequence
atgagcagcacccctcatgaccccttctacagcagccccttcggccccttctacagaagacacaccccctacatggtgcagcctgagtaccgcatctatgagatgaacaagaggctgcagagcaggacagaggacagcgacaacctgtggtgggatgcctttgccacagagttctttgaagatgatgccaccctgaccctgtccttctgcctggaggatggccccaagcgctacaccatcggccgcaccctcatcccccgctacttcagcacagtgtttgaaggaggagtgacagacctgtactacatcctgaagcacagcaaggagagctaccacaacagcagcatcaccgtggactgtgaccagtgcaccatggtgacccagcacggcaagcccatgttcaccaaggtgtgcacagagggccgcctcatcctggagttcacctttgatgacctgatgaggatcaagacctggcacttcaccatccggcagtaccgggagctggtgcccaggagcatcctggccatgcacgcccaggacccccaggtgctggaccagctgagcaagaacatcaccaggatgggcctgaccaacttcaccctgaactacctgcggctgtgtgtgatcctggagcccatgcaggagctgatgagccgccacaagacctacaacctgagcccccgggactgcctgaagacctgcctcttccagaagtggcagaggatggtggcccctcctgctgagcccacccggcagcccaccaccaagaggaggaagaggaagaacagcaccagcagcaccagcaacagcagcgctggcaacaatgccaacagcacaggcagcaagaagaagaccacagctgccaacctgagcctgagcagccaggtgcccatcgccagcatcgcccggagccctgtgtctggctgtgccctgcggacctag

SEQ ID NO: 157909 - DNA, 570 bp, Artificial Sequence
  Description of Artificial Sequence: Synthetic coding sequence
atggtgacccagcacggcaagcccatgttcaccaaggtgtgcacagagggccgcctcatcctggagttcacctttgatgacctgatgaggatcaagacctggcacttcaccatccggcagtaccgggagctggtgcccaggagcatcctggccatgcacgcccaggacccccaggtgctggaccagctgagcaagaacatcaccaggatgggcctgaccaacttcaccctgaactacctgcggctgtgtgtgatcctggagcccatgcaggagctgatgagccgccacaagacctacaacctgagcccccgggactgcctgaagacctgcctcttccagaagtggcagaggatggtggcccctcctgctgagcccacccggcagcccaccaccaagaggaggaagaggaagaacagcaccagcagcaccagcaacagcagcgctggcaacaatgccaacagcacaggcagcaagaagaagaccacagctgccaacctgagcctgagcagccaggtgcccatcgccagcatcgcccggagccctgtgtctggctgtgccctgcggacctag

SEQ ID NO: 157910 - DNA, 495 bp, Artificial Sequence
  Description of Artificial Sequence: Synthetic coding sequence
atggtgcagcctgagtaccgcatctatgagatgaacaagaggctgcagagcaggacagaggacagcgacaacctgtggtgggatgcctttgccacagagttctttgaagatgatgccaccctgaccctgtccttctgcctggaggatggccccaagcgctacaccatcggccgcaccctcatcccccgctacttcagcacagtgtttgaaggaggagtgacagacctgtactacatcctgaagcacagcaaggagagctaccacaacagcagcatcaccgtggactgtgaccagtgcaccatggtgacccagcacggcaagcccatgttcaccaaggtgtgcacagagggccgcctcatcctggagttcacctttgatgacctgatgaggatcaagacctggcacttcaccatccggcagtaccgggagctggtgcccaggagcatcctggccatgcacgcccaggacccccaggtgctggaccagctgtcctag

SEQ ID NO: 157911 - DNA, 333 bp, Artificial Sequence
  Description of Artificial Sequence: Synthetic coding sequence
atgagcagcacccctcatgaccccttctacagcagccccttcggccccttctacagaagacacaccccctacatggtgcagcctgagtaccgcatctatgagatgaacaagaggctgcagagcaggacagaggacagcgacaacctgtggtgggatgcctttgccacagagttctttgaagatgatgccaccctgaccctgtccttctgcctggaggatggccccaagcgctacatcgtgcacagcgctgctgatgcccggggcaactgcaaccagctgggggacagcgagccagatgcctgtgatggcctgctgcagttccccatcatgtag

SEQ ID NO: 157912 - DNA, 321 bp, Artificial Sequence
  Description of Artificial Sequence: Synthetic coding sequence
atgagcagcacccctcatgaccccttctacagcagccccttcggccccttctacagaagacacaccccctacatggtgcagcctgagtaccgcatctatgagatgaacaagaggctgcagagcaggacagaggacagcgacaacctgtggtgggatgcctttgccacagagttctttgaagatgatgccaccctgaccctgtccttctgcctggaggatggccccaagcgctaccgcaccaagaacctgcggcccatcggggagaagatgaacatcaatggcaagtgctaccggcaggacccccacccccccctgctgtag

SEQ ID NO: 157913 - DNA, 1116 bp, Artificial Sequence
  Description of Artificial Sequence: Synthetic coding sequence
atgagcagcacccctcatgaccccttctacagcagccccttcggccccttctacagaagacacaccccctacatggtgcagcctgagtaccgcatctatgagatgaacaagaggctgcagagcaggacagaggacagcgacaacctgtggtgggatgcctttgccacagagttctttgaagatgatgccaccctgaccctgtccttctgcctggaggatggccccaagcgctacaccatcggccgcaccctcatcccccgctacttcagcacagtgtttgaaggaggagtgacagacctgtactacatcctgaagcacagcaaggagagctaccacaacagcagcatcaccgtggactgtgaccagtgcaccatggtgacccagcacggcaagcccatgttcaccaaggtgtgcacagagggccgcctcatcctggagttcacctttgatgacctgatgaggatcaagacctggcacttcaccatccggcagtaccgggagctggtgcccaggagcatcctggccatgcacgcccaggacccccaggtgctggaccagctgagcaagaacatcaccaggatgggcctgaccaacttcaccctgaactacctgcggctgtgtgtgatcctggagcccatgcaggagctgatgagccgccacaagacctacaacctgagcccccgggactgcctgaagacctgcctcttccagaagtggcagaggatggtggcccctcctgctgagcccacccggcagcccaccaccaagaggaggaagaggaagaacagcaccagcagcaccagcaacagcagcgctggcaacaatgccaacagcacaggcagcaagaagaagaccacagctgccaacctgagcctgagcagccaggatgtgatggtggtgggggagcccaccctgatgggcggggagtttggagatgaagatgagcggctcatcacccggctggagaacacccagtatgatgctgccaacggcatggatgatgaggaggacttcaacaacagccctgccctgggcaacaacagcccctggaacagcaagcccccagccacccaggagaccaagtcagaaaatcctccaccccaggccagccagtag

SEQ ID NO: 157914 - DNA, 1854 bp, Artificial Sequence
  Description of Artificial Sequence: Synthetic coding sequence
atgagctacagcgtgaccctgaccggccctggcccctggggcttccggctgcagggcggcaaggacttcaacatgcccctgaccatcagccgcatcaccccaggcagcaaggccgcccagagccagctgagccagggcgacctggtggtggccattgatggagtgaacacagacaccatgacccacctggaggcccagaacaagatcaagagcgccagctacaacctgagcctgaccctgcagaagagcaagaggcccatccccatcagcaccacagcccctcctgtgcagacccccctgcctgtgatcccccaccagaaggtggtggtgaacagccctgccaatgctgactaccaggagcgcttcaaccccagcgccctgaaggacagcgccctgagcacccacaagcccatcgaggtgaagggcctgggcggcaaggccaccatcatccacgcccagtacaacacccccatctccatgtacagccaggatgccatcatggatgccatcgccggccaggcccaggcccagggcagtgacttcagcggcagcctgcccatcaaggacctggccgtggacagcgccagccctgtgtaccaggccgtcatcaagagccagaacaagccagaagatgaagcagatgagtgggcccggcgcagcagcaacctgcagagccgctccttccgcatcctggcccagatgactggaacagagttcatgcaggaccctgatgaggaggccctgcggcgcagccggccccaggccagcagctacagccctgctgtggccgccagcagcgccccagccacccacaccagctacagcgagggccctgctgccccagcccccaagccccgggtggtgaccacagccagcatccggcccagcgtgtaccagcctgtgcctgccagcacctacagccccagccctggggccaactacagccccaccccctacacccccagccctgccccagcctacacccccagccctgccccagcctacacccccagccctgtgcccacctacacccccagccctgccccagcctacacccccagccctgcccccaactacaacccagcccccagcgtggcctacagcggcggccctgctgagcccgccagccggcccccctgggtgacagatgacagcttcagccagaagtttgcccctgggaagagcaccaccagcatcagcaagcagaccctgccccggggcggccctgcctacaccccagctggcccccaggtgccccccctggcccggggcaccgtgcagagagctgagcgcttccctgccagcagcaggacccccctgtgtggccactgcaacaacgtcatccggggccccttcctggtggccatgggccgctcctggcaccctgaggagttcacctgtgcctactgcaagaccagcctggctgatgtgtgctttgtggaggagcagaacaacgtgtactgtgagcgctgctatgagcagttctttgcccccctgtgtgccaagtgcaacaccaagatcatgggagaggtgatgcacgccctgcggcagacctggcacaccacctgctttgtgtgtgccgcctgcaagaagccctttggaaacagcctcttccacatggaggatggagagccctactgtgagaaggactacatcaacctcttcagcaccaagtgccacggctgtgacttccctgtggaggccggggacaagttcatcgaggccctgggccacacctggcatgacacctgcttcatctgtgctgtgtgccacgtgaacctggagggccagcccttctacagcaagaaggaccggcccctgtgcaagaagcacgcccacaccatcaacctgtag

SEQ ID NO: 157915 - DNA, 993 bp, Artificial Sequence
  Description of Artificial Sequence: Synthetic coding sequence
atgagctacagcgtgaccctgaccggccctggcccctggggcttccggctgcagggcggcaaggacttcaacatgcccctgaccatcagccgcatcaccccaggcagcaaggccgcccagagccagctgagccagggcgacctggtggtggccattgatggagtgaacacagacaccatgacccacctggaggcccagaacaagatcaagagcgccagctacaacctgagcctgaccctgcagaagagcaagaggcccatccccatcagcaccacagcccctcctgtgcagacccccctgcctgtgatcccccaccagaaggaccctgccctggacaccaacggcagcctggtggcccccagccccagccctgaggcccgggccagccctggcaccccaggcaccccagagctgcggcccaccttcagccctgccttcagccggcccagcgccttcagcagcctggccgaggccagtgaccccggccccccccgggccagcctgcgggccaagaccagccctgagggcgcccgggacctgctgggccccaaggccctgcccggcagcagccagccccggcagtacaacaaccccatcggcctgtacagcgctgagaccctgcgggagatggcccagatgtaccagatgagcctgcggggcaaggccagcggcgtgggcctgcccggcggcagcctgcccatcaaggacctggccgtggacagcgccagccctgtgtaccaggccgtcatcaagagccagaacaagccagaagatgaagcagatgagtgggcccggcgcagcagcaacctgcagagccgctccttccgcatcctggcccagatgactggaacagagttcatgcaggaccctgatgaggaggccctgcggcgcagccgggagagatttgaaacagagaggaacagccccaggtttgccaagctgaggaactggcaccacggcctgagcgcccagatcctgaatgtgaagagctag

SEQ ID NO: 157916 - DNA, 1413 bp, Artificial Sequence
  Description of Artificial Sequence: Synthetic coding sequence
atgagctacagcgtgaccctgaccggccctggcccctggggcttccggctgcagggcggcaaggacttcaacatgcccctgaccatcagccgcatcaccccaggcagcaaggccgcccagagccagctgagccagggcgacctggtggtggccattgatggagtgaacacagacaccatgacccacctggaggcccagaacaagatcaagagcgccagctacaacctgagcctgaccctgcagaagagcaagaggcccatccccatcagcaccacagcccctcctgtgcagacccccctgcctgtgatcccccaccagaaggccagcagctacagccctgctgtggccgccagcagcgccccagccacccacaccagctacagcgagggccctgctgccccagcccccaagccccgggtggtgaccacagccagcatccggcccagcgtgtaccagcctgtgcctgccagcacctacagccccagccctggggccaactacagccccaccccctacacccccagccctgccccagcctacacccccagccctgccccagcctacacccccagccctgtgcccacctacacccccagccctgccccagcctacacccccagccctgcccccaactacaacccagcccccagcgtggcctacagcggcggccctgctgagcccgccagcaggcctccctgggtgacagatgacagcttcagccagaagtttgcccctgggaagagcaccaccagcatcagcaagcagaccctgccccggggcggccctgcctacaccccagctggcccccaggtgccccccctggcccggggcaccgtgcagagagctgagcgcttccctgccagcagcaggacccccctgtgtggccactgcaacaacgtcatccggggccccttcctggtggccatgggccgctcctggcaccctgaggagttcacctgtgcctactgcaagaccagcctggctgatgtgtgctttgtggaggagcagaacaacgtgtactgtgagcgctgctatgagcagttctttgcccccctgtgtgccaagtgcaacaccaagatcatgggagaggtgatgcacgccctgcggcagacctggcacaccacctgctttgtgtgtgccgcctgcaagaagcccttcggcaacagcctcttccacatggaggatggagagccctactgtgagaaggactacatcaacctcttcagcaccaagtgccacggctgtgacttccctgtggaggccggggacaagttcatcgaggccctgggccacacctggcatgacacctgcttcatctgtgctgtgtgccacgtgaacctggagggccagcccttctacagcaagaaggaccggcccctgtgcaagaagcacgcccacaccatcaacctgtag

SEQ ID NO: 157917 - DNA, 2184 bp, Artificial Sequence
  Description of Artificial Sequence: Synthetic coding sequence
atgagctacagcgtgaccctgaccggccctggcccctggggcttccggctgcagggcggcaaggacttcaacatgcccctgaccatcagccgcatcaccccaggcagcaaggccgcccagagccagctgagccagggcgacctggtggtggccattgatggagtgaacacagacaccatgacccacctggaggcccagaacaagatcaagagcgccagctacaacctgagcctgaccctgcagaagagcaagaggcccatccccatcagcaccacagcccctcctgtgcagacccccctgcctgtgatcccccaccagaaggaccctgccctggacaccaacggcagcctggtggcccccagccccagccctgaggcccgggccagccctggcaccccaggcaccccagagctgcggcccaccttcagccctgccttcagccggcccagcgccttcagcagcctggccgaggccagtgaccccggccccccccgggccagcctgcgggccaagaccagccctgagggcgcccgggacctgctgggccccaaggccctgcccggcagcagccagccccggcagtacaacaaccccatcggcctgtacagcgctgagaccctgcgggagatggcccagatgtaccagatgagcctgcggggcaaggccagcggcgtgggcctgcccggcggcagcctgcccatcaaggacctggccgtggacagcgccagccctgtgtaccaggccgtcatcaagagccagaacaagccagaagatgaagcagatgagtgggcccggcgcagcagcaacctgcagagccgctccttccgcatcctggcccagatgactggaacagagttcatgcaggaccctgatgaggaggccctgcggcgcagcagcacccccatcgagcacgcccctgtgtgcaccagccaggccaccacccccctgctgcctgccagcgcccagcccccagctgctgccagccccagcgctgccagcccccccctggccacagctgctgcccacacagccatcgccagcgccagcaccacagccccagccagcagccctgctgacagcccccggccccaggccagcagctacagccctgctgtggccgccagcagcgccccagccacccacaccagctacagcgagggccctgctgccccagcccccaagccccgggtggtgaccacagccagcatccggcccagcgtgtaccagcctgtgcctgccagcacctacagccccagccctggggccaactacagccccaccccctacacccccagccctgccccagcctacacccccagccctgccccagcctacacccccagccctgtgcccacctacacccccagccctgccccagcctacacccccagccctgcccccaactacaacccagcccccagcgtggcctacagcggcggccctgctgagcccgccagccggcccccctgggtgacagatgacagcttcagccagaagtttgcccctgggaagagcaccaccagcatcagcaagcagaccctgccccggggcggccctgcctacaccccagctggcccccaggtgccccccctggcccggggcaccgtgcagagagctgagcgcttccctgccagcagcaggacccccctgtgtggccactgcaacaacgtcatccggggccccttcctggtggccatgggccgctcctggcaccctgaggagttcacctgtgcctactgcaagaccagcctggctgatgtgtgctttgtggaggagcagaacaacgtgtactgtgagcgctgctatgagcagttctttgcccccctgtgtgccaagtgcaacaccaagatcatgggagaggtgatgcacgccctgcggcagacctggcacaccacctgctttgtgtgtgccgcctgcaagaagccctttggaaacagcctcttccacatggaggatggagagccctactgtgagaaggactacatcaacctcttcagcaccaagtgccacggctgtgacttccctgtggaggccggggacaagttcatcgaggccctgggccacacctggcatgacacctgcttcatctgtgctgtgtgccacgtgaacctggagggccagcccttctacagcaagaaggaccggcccctgtgcaagaagcacgcccacaccatcaacctgtag

SEQ ID NO: 157918 - DNA, 1197 bp, Artificial Sequence
  Description of Artificial Sequence: Synthetic coding sequence
atgagctacagcgtgaccctgaccggccctggcccctggggcttccggctgcagggcggcaaggacttcaacatgcccctgaccatcagccgcatcaccccaggcagcaaggccgcccagagccagctgagccagggcgacctggtggtggccattgatggagtgaacacagacaccatgacccacctggaggcccagaacaagatcaagagcgccagctacaacctgagcctgaccctgcagaagagcaagaggcccatccccatcagcaccacagcccctcctgtgcagacccccctgcctgtgatcccccaccagaaggaccctgccctggacaccaacggcagcctggtggcccccagccccagccctgaggcccgggccagccctggcaccccaggcaccccagagctgcggcccaccttcagccctgccttcagccggcccagcgccttcagcagcctggccgaggccagtgaccccggccccccccgggccagcctgcgggccaagaccagccctgagggcgcccgggacctgctgggccccaaggccctgcccggcagcagccagccccggcagtacaacaaccccatcggcctgtacagcgctgagaccctgcgggagatggcccagatgtaccagatgagcctgcggggcaaggccagcggcgtgggcctgcccggcggcgctgactaccaggagcgcttcaaccccagcgccctgaaggacagcgccctgagcacccacaagcccatcgaggtgaagggcctgggcggcaaggccaccatcatccacgcccagtacaacacccccatctccatgtacagccaggatgccatcatggatgccatcgccggccaggcccaggcccagggcagtgacttcagcggcagcctgcccatcaaggacctggccgtggacagcgccagccctgtgtaccaggccgtcatcaagagccagaacaagccagaagatgaagcagatgagtgggcccggcgcagcagcaacctgcagagccgctccttccgcatcctggcccagatgactggaacagagttcatgcaggaccctgatgaggaggccctgcggcgcagccgggagagatttgaaacagagaggaacagccccaggtttgccaagctgaggaactggcaccacggcctgagcgcccagatcctgaatgtgaagagctag

SEQ ID NO: 157919 - DNA, 852 bp, Artificial Sequence
  Description of Artificial Sequence: Synthetic coding sequence
atgagctacagcgtgaccctgaccggccctggcccctggggcttccggctgcagggcggcaaggacttcaacatgcccctgaccatcagccgcatcaccccaggcagcaaggccgcccagagccagctgagccagggcgacctggtggtggccattgatggagtgaacacagacaccatgacccacctggaggcccagaacaagatcaagagcgccagctacaacctgagcctgaccctgcagaagagcaagaggcccatccccatcagcaccacagcccctcctgtgcagacccccctgcctgtgatcccccaccagaaggtggtggtgaacagccctgccaatgctgactaccaggagcgcttcaaccccagcgccctgaaggacagcgccctgagcacccacaagcccatcgaggtgaagggcctgggcggcaaggccaccatcatccacgcccagtacaacacccccatctccatgtacagccaggatgccatcatggatgccatcgccggccaggcccaggcccagggcagtgacttcagcggcagcctgcccatcaaggacctggccgtggacagcgccagccctgtgtaccaggccgtcatcaagagccagaacaagccagaagatgaagcagatgagtgggcccggcgcagcagcaacctgcagagccgctccttccgcatcctggcccagatgactggaacagagttcatgcaggaccctgatgaggaggccctgcggcgcagccgggagagatttgaaacagaaagaaacagccccaggtttgccaagctgaggaactggcaccacggcctgagcgcccagatcctgaatgtgaagagctag

SEQ ID NO: 157920 - DNA, 2199 bp, Artificial Sequence
  Description of Artificial Sequence: Synthetic coding sequence
atgagctacagcgtgaccctgaccggccctggcccctggggcttccggctgcagggcggcaaggacttcaacatgcccctgaccatcagccgcatcaccccaggcagcaaggccgcccagagccagctgagccagggcgacctggtggtggccattgatggagtgaacacagacaccatgacccacctggaggcccagaacaagatcaagagcgccagctacaacctgagcctgaccctgcagaagagcaagaggcccatccccatcagcaccacagcccctcctgtgcagacccccctgcctgtgatcccccaccagaaggaccctgccctggacaccaacggcagcctggtggcccccagccccagccctgaggcccgggccagccctggcaccccaggcaccccagagctgcggcccaccttcagccctgccttcagccggcccagcgccttcagcagcctggccgaggccagtgaccccggccccccccgggccagcctgcgggccaagaccagccctgagggcgcccgggacctgctgggccccaaggccctgcccggcagcagccagccccggcagtacaacaaccccatcggcctgtacagcgctgagaccctgcgggagatggcccagatgtaccagatgagcctgcggggcaaggccagcggcgtgggcctgcccggcggcgctgactaccaggagcgcttcaaccccagcgccctgaaggacagcgccctgagcacccacaagcccatcgaggtgaagggcctgggcggcaaggccaccatcatccacgcccagtacaacacccccatctccatgtacagccaggatgccatcatggatgccatcgccggccaggcccaggcccagggcagtgacttcagcggcagcctgcccatcaaggacctggccgtggacagcgccagccctgtgtaccaggccgtcatcaagagccagaacaagccagaagatgaagcagatgagtgggcccggcgcagcagcaacctgcagagccgctccttccgcatcctggcccagatgactggaacagagttcatgcaggaccctgatgaggaggccctgcggcgcagccggccccaggccagcagctacagccctgctgtggccgccagcagcgccccagccacccacaccagctacagcgagggccctgctgccccagcccccaagccccgggtggtgaccacagccagcatccggcccagcgtgtaccagcctgtgcctgccagcacctacagccccagccctggggccaactacagccccaccccctacacccccagccctgccccagcctacacccccagccctgccccagcctacacccccagccctgtgcccacctacacccccagccctgccccagcctacacccccagccctgcccccaactacaacccagcccccagcgtggcctacagcggcggccctgctgagcccgccagcaggcctccctgggtgacagatgacagcttcagccagaagtttgcccctgggaagagcaccaccagcatcagcaagcagaccctgccccggggcggccctgcctacaccccagctggcccccaggtgccccccctggcccggggcaccgtgcagagagctgagcgcttccctgccagcagcaggacccccctgtgtggccactgcaacaacgtcatccggggccccttcctggtggccatgggccgctcctggcaccctgaggagttcacctgtgcctactgcaagaccagcctggctgatgtgtgctttgtggaggagcagaacaacgtgtactgtgagcgctgctatgagcagttctttgcccccctgtgtgccaagtgcaacaccaagatcatgggagaggtgatgcacgccctgcggcagacctggcacaccacctgctttgtgtgtgccgcctgcaagaagcccttcggcaacagcctcttccacatggaggatggagagccctactgtgagaaggactacatcaacctcttcagcaccaagtgccacggctgtgacttccctgtggaggccggggacaagttcatcgaggccctgggccacacctggcatgacacctgcttcatctgtgctgtgtgccacgtgaacctggagggccagcccttctacagcaagaaggaccggcccctgtgcaagaagcacgcccacaccatcaacctgtag

SEQ ID NO: 157921 - DNA, 1854 bp, Artificial Sequence; identical to SEQ ID NO: 157914
  Description of Artificial Sequence: Synthetic coding sequence

SEQ ID NO: 157922 - DNA, 1947 bp, Artificial Sequence
  Description of Artificial Sequence: Synthetic coding sequence
atgagctacagcgtgaccctgaccggccctggcccctggggcttccggctgcagggcggcaaggacttcaacatgcccctgaccatcagccgcatcaccccaggcagcaaggccgcccagagccagctgagccagggcgacctggtggtggccattgatggagtgaacacagacaccatgacccacctggaggcccagaacaagatcaagagcgccagctacaacctgagcctgaccctgcagaagagcaagaggcccatccccatcagcaccacagcccctcctgtgcagacccccctgcctgtgatcccccaccagaaggaccctgccctggacaccaacggcagcctggtggcccccagccccagccctgaggcccgggccagccctggcaccccaggcaccccagagctgcggcccaccttcagccctgccttcagccggcccagcgccttcagcagcctggccgaggccagtgaccccggccccccccgggccagcctgcgggccaagaccagccctgagggcgcccgggacctgctgggccccaaggccctgcccggcagcagccagccccggcagtacaacaaccccatcggcctgtacagcgctgagaccctgcgggagatggcccagatgtaccagatgagcctgcggggcaaggccagcggcgtgggcctgcccggcggcagcctgcccatcaaggacctggccgtggacagcgccagccctgtgtaccaggccgtcatcaagagccagaacaagccagaagatgaagcagatgagtgggcccggcgcagcagcaacctgcagagccgctccttccgcatcctggcccagatgactggaacagagttcatgcaggaccctgatgaggaggccctgcggcgcagccggccccaggccagcagctacagccctgctgtggccgccagcagcgccccagccacccacaccagctacagcgagggccctgctgccccagcccccaagccccgggtggtgaccacagccagcatccggcccagcgtgtaccagcctgtgcctgccagcacctacagccccagccctggggccaactacagccccaccccctacacccccagccctgtgcccacctacacccccagccctgccccagcctacacccccagccctgcccccaactacaacccagcccccagcgtggcctacagcggcggccctgctgagcccgccagcaggcctccctgggtgacagatgacagcttcagccagaagtttgcccctgggaagagcaccaccagcatcagcaagcagaccctgccccggggcggccctgcctacaccccagctggcccccaggtgccccccctggcccggggcaccgtgcagagagctgagcgcttccctgccagcagcaggacccccctgtgtggccactgcaacaacgtcatccggggccccttcctggtggccatgggccgctcctggcaccctgaggagttcacctgtgcctactgcaagaccagcctggctgatgtgtgctttgtggaggagcagaacaacgtgtactgtgagcgctgctatgagcagttctttgcccccctgtgtgccaagtgcaacaccaagatcatgggagaggtgatgcacgccctgcggcagacctggcacaccacctgctttgtgtgtgccgcctgcaagaagcccttcggcaacagcctcttccacatggaggatggagagccctactgtgagaaggactacatcaacctcttcagcaccaagtgccacggctgtgacttccctgtggaggccggggacaagttcatcgaggccctgggccacacctggcatgacacctgcttcatctgtgctgtgtgccacgtgaacctggagggccagcccttctacagcaagaaggaccggcccctgtgcaagaagcacgcccacaccatcaacctgtag

SEQ ID NO: 157923 - DNA, 696 bp, Artificial Sequence
  Description of Artificial Sequence: Synthetic coding sequence
atgagctacagcgtgaccctgaccggccctggcccctggggcttccggctgcagggcggcaaggacttcaacatgcccctgaccatcagccgcatcaccccaggcagcaaggccgcccagagccagctgagccagggcgacctggtggtggccattgatggagtgaacacagacaccatgacccacctggaggcccagaacaagatcaagagcgccagctacaacctgagcctgaccctgcagaagagcaagaggcccatccccatcagcaccacagcccctcctgtgcagacccccctgcctgtgatcccccaccagaaggaccctgccctggacaccaacggcagcctggtggcccccagccccagccctgaggcccgggccagccctggcaccccaggcaccccagagctgcggcccaccttcagccctgccttcagccggcccagcgccttcagcagcctggccgaggccagtgaccccggccccccccgggccagcctgcgggccaagaccagccctgagggcgcccgggacctgctgggccccaaggccctgcccggcagcagccagccccggcagtacaacaaccccatcggcctgtacagcgctgagaccctgcgggagatggcccagatgtaccagatgagcctgcggggcaaggccagcggcgtgggcctgcccggcggctggtag

SEQ ID NO: 157924 - DNA, 1839 bp, Artificial Sequence
  Description of Artificial Sequence: Synthetic coding sequence
atgagccaccccagctggctgccccccaagagcactggagagcccctgggccacgtgcctgccaggatggagaccacccacagctttggaaaccccagcatctctgtgtccacccagcagccccccaagaagtttgcccctgtggtggcccccaagcccaagtacaacccctacaagcagcctggaggagagggggacttcctgcccccacctcctccacccctggatgacagcagcgccctgcccagcatcagcggcaacttccccccacctccacccctggatgaggaggccttcaaggtgcagggcaaccctgggggcaagaccctggaggagaggaggagcagcctggatgctgagattgacagcctgaccagcatcctggccgacctggagtgcagcagcccctacaagcccaggcctccccagagcagcacaggcagcacagccagcccccctgtgtccacccctgtgacaggccacaagaggatggtgatccccaaccagccccccctgacagccaccaagaagagcaccctgaagccccagcctgccccccaggccggccccatccctgtggcccccatcggcaccctgaagccccagccccagcctgtgcctgccagctacaccacagccagcaccagcagccggcccaccttcaacgtgcaggtgaagagcgcccagcccagcccccactacatggccgcccccagcagcggccagatctacggcagcggcccccagggctacaacacccagcctgtgcctgtgtctggccagtgccccccacccagcacccggggcggcatggactatgcctacatccccccacctggcctgcagcctgagcccggctacggctacgcccccaaccagggccgctactatgagggctactatgctgctggccctggctatggaggaagaaatgacagcgaccccacctacggccagcagggccaccccaacacctggaagcgggagcccggctacaccccacctggagctggcaaccagaaccccccaggcatgtaccctgtgacaggccccaagaagacctacatcacagatcctgtgtctgccccctgtgccccacccctgcagcccaagggcggccacagcggccagctgggccccagctctgtggcccccagcttccggccagaagatgagctggagcacctgaccaagaagatgctgtatgacatggagaaccccccagcagatgagtacttcggccgctgtgcccgctgtggagaaaatgtggtgggggagggcaccggctgcacagccatggaccaggtgttccacgtggactgcttcacctgcatcatctgcaacaacaagctgcggggccagcccttctatgctgtggagaagaaggcctactgtgagccctgctacatcaacaccctggagcagtgcaatgtgtgcagcaagcccatcatggagcgcatcctgcgggccaccgggaaggcctaccacccccactgcttcacctgtgtgatgtgccacaggagcctggatggcatccccttcaccgtggatgctgggggcctcatccactgcatcgaggacttccacaagaagtttgccccccgctgcagcgtgtgcaaggagcccatcatgcctgcccctggccaggaggagaccgtgagaattgtggccctggaccgggacttccacgtgcactgctaccgctgtgaggactgtggcggcctgctgtctgagggggacaaccagggctgctaccccctggatggccacatcctgtgcaagacctgcaacagcgcccgcatccgggtgctgacagccaaggccagcacagacctgtag

SEQ ID NO: 157925 - DNA, 282 bp, Artificial Sequence
  Description of Artificial Sequence: Synthetic coding sequence
atgagccaccccagctggctgccccccaagagcactggagagcccctgggccacgtgcctgccaggatggagaccacccacagctttggaaaccccagcatctctgtgtccacccagcagccccccaagaagtttgcccctgtggtggcccccaagcccaagtacaacccctacaagcagcctggaggagagggggacttcctgcccccacctcctccacccctggatgacagcagcgccctgcccagcatcagcggcaacttccccccacctccaccctag

SEQ ID NO: 157926 - DNA, 456 bp, Artificial Sequence
  Description of Artificial Sequence: Synthetic coding sequence
atgagccaccccagctggctgccccccaagagcactggagagcccctgggccacgtgcctgccaggatggagaccacccacagctttggaaaccccagcatctctgtgtccacccagcagccccccaagaagtttgcccctgtggtggcccccaagcccaagtacaacccctacaagcagcctggaggagagggggacttcctgcccccacctcctccacccctggatgacagcagcgccctgcccagcatcagcggcaacttccccccacctccacccctggatgaggaggccttcaaggtgcagggcaaccctgggggcaagaccctggaggagaggaggagcagcctggatgctgagattgacagcctgaccagcatcctggccgacctggagtgcagcagcccctacaagcccaggcctccccagagcagcacaggcagcacagccagctag

SEQ ID NO: 157927 - DNA, 336 bp, Artificial Sequence
  Description of Artificial Sequence: Synthetic coding sequence
atgagccaccccagctggctgccccccaagagcactggagagcccctgggccacgtgcctgccaggatggagaccacccacagctttggaaaccccagcatctctgtgtccacccagcagccccccaagaagtttgcccctgtggtggcccccaagcccaagtacaacccctacaagcagcctggaggagagggggacttcctgcccccacctcctccacccctggatgacagcagcgccctgcccagcatcagcggcaacttccccccacctccacccctggatgaggaggccttcaaggtgcagggcaaccctgggggcaagaccctggagtag

SEQ ID NO: 157928 - DNA, 201 bp, Artificial Sequence
  Description of Artificial Sequence: Synthetic coding sequence
atgagccaccccagctggctgccccccaagagcactggagagcccctgggccacgtgcctgccaggatggagaccacccacagctttggaaaccccagcatctctgtgtccacccagcagccccccaagaagtttgcccctgtggtggcccccaagcccaagtacaacccctacaagcagcctggaggagagggggactag

SEQ ID NO: 157929 - DNA, 162 bp, Artificial Sequence
  Description of Artificial Sequence: Synthetic coding sequence
atgagccaccccagctggctgccccccaagagcactggagagcccctgggccacgtgcctgccaggatggagaccacccacagctttggaaaccccagcatctctgtgtccacccagcagccccccaagaagtttgcccctgtggtggcccccaagccctag

SEQ ID NO: 157930 - DNA, 144 bp, Artificial Sequence
  Description of Artificial Sequence: Synthetic coding sequence
atgagccaccccagctggctgccccccaagagcactggagagcccctgggccacgtgcctgccaggatggagaccacccacagctttggaaaccccagcatctctgtgtccacccagcagccccccaagaagtttgccccctag

SEQ ID NO: 157931 - DNA, 1287 bp, Artificial Sequence
  Description of Artificial Sequence: Synthetic coding sequence
atgagccaccccagctggctgccccccaagagcactggagagcccctgggccacgtgcctgccaggatggagaccacccacagctttggaaaccccagcatctctgtgtccacccagcagccccccaagaagtttgcccctgtggtggcccccaagcccaagtacaacccctacaagcagcctggaggagagggggacttcctgcccccacctcctccacccctggatgacagcagcgccctgcccagcatcagcggcaacttccccccacctccacccctggatgaggaggccttcaaggtgcagggcaaccctgggggcaagaccctggaggagaggaggagcagcctggatgctgagattgacagcctgaccagcatcctggccgacctggagtgcagcagcccctacaagcccaggcctccccagagcagcacaggcagcacagccagcccccctgtgtccacccctgtgacaggccacaagaggatggtgatccccaaccagccccccctgacagccaccaagaagagcaccctgaagccccagcctgccccccaggccggccccatccctgtggcccccatcggcaccctgaagccccagccccagcctgtgcctgccagctacaccacagccagcaccagcagccggcccaccttcaacgtgcaggtgaagagcgcccagcccagcccccactacatggccgcccccagcagcggccagatctacggcagcggcccccagggctacaacacccagcctgtgcctgtgtctggccagtgccccccacccagcacccggggcggcatggactatgcctacatccccccacctggcctgcagcctgagcccggctacggctacgcccccaaccagggccgctactatgagggctactatgctgctggccctggctatggaggaagaaatgacagcgaccccacctacggccagcagggccaccccaacacctggaagcgggagcccggctacaccccacctggagctggcaaccagaaccccccaggcatgtaccctgtgacaggccccaagaagacctacatcacagatcctgtgtctgccccctgtgccccacccctgcagcccaagggcggccacagcggccagctgggccccagctctgtggcccccagcttccggccagaagatgagctggagcacctgaccaagaagatgctgtatgacatggagaaccccccagcagatgagtactttggagagtggggcctggagctgaccagcgaggtgaccatcctgctgtag

SEQ ID NO: 157932 - DNA, 198 bp, Artificial Sequence
  Description of Artificial Sequence: Synthetic coding sequence
atgagccaccccagctggctgccccccaagagcactggagagcccctgggccacgtgcctgccaggatggagaccacccacagctttggaaaccccagcatctctgtgtccacccagcagccccccaagaagtttgcccctgtggtggcccccaagcccaagtacaacccctacaagcagcctggaggagagggctag

SEQ ID NO: 157933 - DNA, 174 bp, Artificial Sequence
  Description of Artificial Sequence: Synthetic coding sequence
atgagccaccccagctggctgccccccaagagcactggagagcccctgggccacgtgcctgccaggatggagaccacccacagctttggaaaccccagcatctctgtgtccacccagcagccccccaagaagtttgcccctgtggtggcccccaagcccaagtacaacccctag

SEQ ID NO: 157934 - DNA, 1839 bp, Artificial Sequence; identical to SEQ ID NO: 157924
  Description of Artificial Sequence: Synthetic coding sequence

SEQ ID NO: 157935 - DNA, 471 bp, Artificial Sequence
  Description of Artificial Sequence: Synthetic coding sequence
atgcagaagaaggagaagagctttggcatccagatgctgtctgtgcagcctgacaccaagcccaagggctgtgccggctgcaacaggaagatcaaggaccgctacctgctgaaggccctggacaagtactggcatgaggactgcctgaagtgtgcctgctgtgactgccgcctgggggaggtgggcagcaccctgtacaccaaggccaacctgatcctgtgcagaagagactacctgcggctgtttggagtgactggaaactgtgccgcctgcagcaagctgatcccagcctttgagatggtgatgagggccaaggacaacgtgtaccacctggactgctttgcctgccagctgtgcaaccagcgcttctgtgtgggggacaagttcttcctgaagaacaacatgatcctgtgccagacagattatgaggagggcctgatgaaggagggctacgccccccaggtgaggtag

SEQ ID NO: 157936 - DNA, 438 bp, Artificial Sequence
  Description of Artificial Sequence: Synthetic coding sequence
atgctgtctgtgcagcctgacaccaagcccaagggctgtgccggctgcaacaggaagatcaaggaccgctacctgctgaaggccctggacaagtactggcatgaggactgcctgaagtgtgcctgctgtgactgccgcctgggggaggtgggcagcaccctgtacaccaaggccaacctgatcctgtgccggcgggactacctgcggctgtttggagtgacaggcaactgtgccgcctgcagcaagctgatcccagcctttgagatggtgatgagggccaaggacaacgtgtaccacctggactgctttgcctgccagctgtgcaaccagcgcttctgtgtgggggacaagttcttcctgaagaacaacatgatcctgtgccagacagattatgaggagggcctgatgaaggagggctacgccccccaggtgaggtag

SEQ ID NO: 157937 - DNA, 438 bp, Artificial Sequence; identical to SEQ ID NO: 157936
  Description of Artificial Sequence: Synthetic coding sequence

SEQ ID NO: 157938 - DNA, 438 bp, Artificial Sequence; identical to SEQ ID NO: 157936
  Description of Artificial Sequence: Synthetic coding sequence

SEQ ID NO: 157939 - DNA, 438 bp, Artificial Sequence; identical to SEQ ID NO: 157936
  Description of Artificial Sequence: Synthetic coding sequence

SEQ ID NO: 157940 - DNA, 438 bp, Artificial Sequence; identical to SEQ ID NO: 157936
  Description of Artificial Sequence: Synthetic coding sequence

SEQ ID NO: 157941 - DNA, 438 bp, Artificial Sequence; identical to SEQ ID NO: 157936
  Description of Artificial Sequence: Synthetic coding sequence

SEQ ID NO: 157942 - DNA, 438 bp, Artificial Sequence; identical to SEQ ID NO: 157936
  Description of Artificial Sequence: Synthetic coding sequence

SEQ ID NO: 157943 - DNA, 357 bp, Artificial Sequence
  Description of Artificial Sequence: Synthetic coding sequence
atgctgtctgtgcagcctgacaccaagcccaagggctgtgccggctgcaacaggaagatcaaggaccgctacctgctgaaggccctggacaagtactggcatgaggactgcctgaagtgtgcctgctgtgactgccgcctgggggaggtgggcagcaccctgtacaccaaggccaacctgatcctgtgccggcgggactacctgcggctgtttggagtgacaggcaactgtgccgcctgcagcaagctgatcccagcctttgagatggtgatgagggccaaggacaacgtgtaccacctggactgctttgcctgccagctgtgcaaccagcgcttctgtgtgggggacaagttctag

SEQ ID NO: 157944 - DNA, 177 bp, Artificial Sequence
  Description of Artificial Sequence: Synthetic coding sequence
atgctgtctgtgcagcctgacaccaagcccaagggctgtgccggctgcaacaggaagatcaaggaccgctacctgctgaaggccctggacaagtactggcatgaggactgcctgaagtgtgcctgctgtgactgccgcctgggggaggtgggcagcaccctgtacaccaaggcctag

SEQ ID NO: 157945 - DNA, 294 bp, Artificial Sequence
  Description of Artificial Sequence: Synthetic coding sequence
atgctgtctgtgcagcctgacaccaagcccaagggctgtgccggctgcaacaggaagatcaaggaccgctacctgctgaaggccctggacaagtactggcatgaggactgcctgaagtgtgcctgctgtgactgccgcctgggggaggtgggcagcaccctgtacaccaaggccaacctgatcctgtgccggcgggactacctgcggctgtttggagtgacaggcaactgtgccgcctgcagcaagctgatcccagcctttgagatggtgatgagggccaaggacaacgtgtag

SEQ ID NO: 157946 - DNA, 357 bp, Artificial Sequence; identical to SEQ ID NO: 157943
  Description of Artificial Sequence: Synthetic coding sequence

SEQ ID NO: 157947 - DNA, 255 bp, Artificial Sequence
  Description of Artificial Sequence: Synthetic coding sequence
atgctgtctgtgcagcctgacaccaagcccaagggctgtgccggctgcaacaggaagatcaaggaccgctacctgctgaaggccctggacaagtactggcatgaggactgcctgaagtgtgcctgctgtgactgccgcctgggggaggtgggcagcaccctgtacaccaaggccaacctgatcctgtgccggcgggactacctgcggctgtttggagtgacaggcaactgtgccgcctgcagcaagctgatctag

SEQ ID NO: 157948 - DNA, 438 bp, Artificial Sequence; identical to SEQ ID NO: 157936
  Description of Artificial Sequence: Synthetic coding sequence

SEQ ID NO: 157949 - DNA, 492 bp, Artificial Sequence
  Description of Artificial Sequence: Synthetic coding sequence
atgctgatggagggcggccgggctgctgctgccagaaatgtgagcagcatccagatgctgtctgtgcagcctgacaccaagcccaagggctgtgccggctgcaacaggaagatcaaggaccgctacctgctgaaggccctggacaagtactggcatgaggactgcctgaagtgtgcctgctgtgactgccgcctgggggaggtgggcagcaccctgtacaccaaggccaacctgatcctgtgccggcgggactacctgcggctgtttggagtgacaggcaactgtgccgcctgcagcaagctgatcccagcctttgagatggtgatgagggccaaggacaacgtgtaccacctggactgctttgcctgccagctgtgcaaccagcgcttctgtgtgggggacaagttcttcctgaagaacaacatgatcctgtgccagacagattatgaggagggcctgatgaaggagggctacgccccccaggtgaggtag

SEQ ID NO: 157950 - DNA, 438 bp, Artificial Sequence; identical to SEQ ID NO: 157936
  Description of Artificial Sequence: Synthetic coding sequence

SEQ ID NO: 157951 - DNA, 378 bp, Artificial Sequence
  Description of Artificial Sequence: Synthetic coding sequence
atgctgtctgtgcagcctgacaccaagcccaagggctgtgccggctgcaacaggaagatcaaggaccgctacctgctgaaggccctggacaagtactggcatgaggactgcctgaagtgtgcctgctgtgactgccgctgggagcggctgtttggagtgacaggcaactgtgccgcctgcagcaagctgatcccagcctttgagatggtgatgagggccaaggacaacgtgtaccacctggactgctttgcctgccagctgtgcaaccagcgcttctgtgtgggggacaagttcttcctgaagaacaacatgatcctgtgccagacagattatgaggagggcctgatgaaggagggctacgccccccaggtgaggtag

SEQ ID NO: 157952 - DNA, 267 bp, Artificial Sequence
  Description of Artificial Sequence: Synthetic coding sequence
atgctgtctgtgcagcctgacaccaagcccaagggctgtgccggctgcaacaggaagatcaaggaccgctacctgctgaaggccctggacaagtactggcatgaggactgcctgaagtgtgcctgctgtgactgccgcctgggggaggtgggcagcaccctgtacaccaaggccaacctgatcctgtgccggcgggactacctgcggctgtttggagtgacaggcaactgtgccgcctgcagcaagctgatcccagcctttgaatag

SEQ ID NO: 157953 - DNA, 333 bp, Artificial Sequence
  Description of Artificial Sequence: Synthetic coding sequence
atgctgtctgtgcagcctgacaccaagcccaagggctgtgccggctgcaacaggaagatcaaggaccgctacctgctgaaggccctggacaagtactggcatgaggactgcctgaagtgtgcctgctgtgactgccgcctgggggaggtgggcagcaccctgtacaccaaggccaacctgatcctgtgccggcgggactacctgcggctgtttggagtgacaggcaactgtgccgcctgcagcaagctgatcccagcctttgagatggtgatgagggccaaggacaacgtgtaccacctggactgctttgcctgccagctgtgcaaccagtag

SEQ ID NO: 157954 - DNA, 357 bp, Artificial Sequence; identical to SEQ ID NO: 157943
  Description of Artificial Sequence: Synthetic coding sequence

SEQ ID NO: 157955 - DNA, 498 bp, Artificial Sequence
  Description of Artificial Sequence: Synthetic coding sequence
atggtgaaccctggcagcagcagccagcccccacctgtgacagctggcagcctgtcctggaagagatgtgccggctgcggcggcaagattgctgaccgcttcctgctgtatgccatggacagctactggcacagccgctgcctgaagtgcagctgctgccaggcccagctgggggacatcggcaccagctgctacaccaagagcggcatgatcctgtgcagaaatgactacatccggctgtttggaaacagcggggcctgcagcgcctgtggccagagcatcccagccagcgagctggtgatgagggcccagggcaatgtgtaccacctgaagtgcttcacctgcagcacctgcaggaaccggctggtgcctggggaccgcttccactacatcaatggcagcctcttctgtgaacatgaccggcccacagccctgatcaatggccacctgaacagcctgcagagcaaccccctgctgcctgaccagaaggtgtgctag

SEQ ID NO: 157956 - DNA, 498 bp, Artificial Sequence; identical to SEQ ID NO: 157955
  Description of Artificial Sequence: Synthetic coding sequence

SEQ ID NO: 157957 - DNA, 2031 bp, Artificial Sequence
  Description of Artificial Sequence: Synthetic coding sequence
atggacaagtatgatgacctgggcctggaggccagcaagttcatcgaggacctgaacatgtatgaggccagcaaggatggcctcttccgggtggacaagggagctggcaacaaccctgagtttgaggagaccaggagagtgtttgccaccaagatggccaagatccacctgcagcagcagcagcagcagctgctgcaggaggagaccctgccccggggcagccggggccctgtgaatggaggcggccgcctgggcccccaggcccgctgggaggtggtgggcagcaagctgactgtggatggagctgccaagccacccctggccgccagcactggagcccctggagctgtgaccaccctggccgccggccagcccccctacccaccccaggagcagaggagccggccctacctgcacggcaccaggcatggcagccaggactgtggcagccgggagagcctggccaccagcgagatgtctgccttccaccagcccggcccctgtgaggaccccagctgcctgacccacggggactactatgacaacctgagcctggccagccccaagtggggagacaagccaggagtgagccccagcatcggcctgtctgtgggcagcggctggcccagcagccctggcagtgacccccccctgcccaagccctgtggggaccaccccctgaaccaccggcagctgagcctgagcagcagccgcagcagcgagggcagcctgggcggccagaacagcggcattggaggccgcagcagcgagaagcccaccggcctgtggagcacagccagcagccagagggtgtccccaggcctgcccagccccaacctggagaatggagccccagctgtgggccctgtgcagcccaggacccccagcgtgtctgcccccctggccctgagctgcccccggcagggcggcctgcccaggagcaacagcggcctgggcggggaggtgtctggagtgatgagcaagcccaacgtggacccccagccctggttccaggacggccccaagagctacctgagcagcagcgcccccagcagcagccctgctggcctggatggcagccagcagggcgctgtgcccggcctgggccccaagccaggctgcacagacctgggcaccggccccaagctgagccccaccagcctggtgcaccctgtgatgagcaccctgcctgagctgagctgcaaggagggccccctgggctggagcagtgatggcagcctgggctctgtgctgctggacagccccagcagcccccgggtgcggctgccctgccagcccctggtgcccggccctgagctgcggcccagcgctgctgagctgaagctggaggccctgacccagaggctggagcgggagatggatgcccaccccaaggctgactactttggagcctgtgtgaagtgcagcaaaggagtgtttggagctggccaggcctgccaggccatgggcaacctgtaccatgacacctgcttcacctgtgccgcctgcagcaggaagctgcggggcaaggccttctactttgtgaatggcaaggtgttctgtgaggaggacttcctgtacagcggcttccagcagagcgctgaccgctgcttcctgtgtggccacctgatcatggacatgatcctgcaggccctgggcaagagctaccaccctggctgcttccgctgtgtgatctgcaatgaatgtctggatggagtgcccttcaccgtggacagcgagaacaagatctactgtgtgcgggactaccacaaggtgctggcccccaagtgtgccgcctgtggcctgcccatcctgcccccagagggcagtgatgagaccatccgggtggtgtccatggaccgggactaccacgtggagtgctaccactgtgaggactgtggcctggagctgaatgatgaagatggccaccgctgctaccccctggaggaccacctgttctgccacagctgccacgtgaagaggctggagaagaggcccagcagcacagccctgcaccagcaccacttctag

SEQ ID NO: 157958 - DNA, 1221 bp, Artificial Sequence
  Description of Artificial Sequence: Synthetic coding sequence
atggtgcactgtgccggctgcaagaggcccatcctggaccgcttcctgctgaatgtgctggaccgggcctggcacgtgaagtgtgtgcagtgctgtgagtgcaagtgcaacctgacagagaagtgcttcagccgggagggcaagctgtactgcaagaatgacttcttccgctgcttcggcaccaagtgtgccggctgtgcccagggcatcagccccagcgacctggtgagaagagcccggagcaaggtgttccacctgaactgcttcacctgcatgatgtgcaacaagcagctgagcactggagaggagctgtacatcattgatgagaacaagtttgtgtgcaaggaggactacctgagcaacagctctgtggccaaggagaacagcctgcacagcgccaccactggaagtgaccccagcctgagcccagacagccaggaccccagccaggatgatgccaaggacagcgagagcgccaacgtgtctgacaaggaggccggcagcaatgaaaatgatgaccagaacctgggcgccaagaggcggggccccaggaccaccatcaaggccaagcagctggagaccctgaaggccgcctttgctgccacccccaagcccaccaggcacatccgggagcagctggcccaggagaccggcctgaacatgagggtcatccaggtgtggttccagaacagaagaagcaaggagaggaggatgaagcagctgagcgccctgggcgccaggagacatgccttcttccgcagccccaggaggatgaggcccctggtggaccggctggagcctggagagctgatccccaacggccccttctccttctatggagactaccagagcgagtactacggccctgggggcaactatgacttcttcccccagggcccccccagcagccaggcccagacccctgtggacctgccctttgtgcccagcagcggccccagcggcacccccctgggcggcctggagcaccccctgcccggccaccaccccagcagcgaggcccagcgcttcacagacatcctggcccaccccccaggggacagccccagccctgagcccagcctgcccggccccctgcacagcatgtctgctgaggtgtttggccccagcccccccttcagcagcctgtctgtgaatggaggagccagctatggcaaccacctgagccaccccccagagatgaatgaagctgctgtgtggtag

SEQ ID NO: 157959 - DNA, 1221 bp, Artificial Sequence
  Description of Artificial Sequence: Synthetic coding sequence
atgctgttccacagcctgagcggccctgaggtgcacggcgtgattgatgagatggaccggcgggccaagtctgaggccccagccatcagcagcgccatcgacagaggagacacagagaccaccatgcccagcatcagcagtgaccgggccgccctgtgtgccggctgcggcggcaagatcagtgaccgctactacctgctggccgtggacaagcagtggcacatgcgctgcctgaagtgctgtgagtgcaagctgaacctggagagcgagctgacctgcttcagcaaggatggcagcatctactgcaaggaggactactaccgccgcttctctgtgcagagatgtgcccgctgccacctgggcatcagcgccagcgagatggtgatgagggcccgggacctggtgtaccacctgaactgcttcacctgcaccacctgcaacaagatgctgaccaccggggaccacttcggcatgaaggacagcctggtgtactgccgcctgcactttgaggccctgctgcagggcgagtacccagcccacttcaaccacgcagatgtggccgctgctgctgctgctgctgctgctgccaagtctgctggcctgggcgccgccggggccaaccccctgggcctgccctactacaatggagtgggcaccgtgcagaagggccggcccaggaagaggaagagccctggccctggagctgacctggccgcctacaatgctgccctgagctgcaatgaaaatgatgctgagcacctggaccgggaccagccctaccccagcagccagaagaccaagaggatgaggaccagcttcaagcaccaccagctgcggaccatgaagagctactttgccatcaaccacaacccagatgccaaggacctgaagcagctggcccagaagacaggcctgaccaagagggtgctgcaggtgtggttccagaatgcccgggccaagttcagaagaaacctgctgcggcaggagaacacaggagtggacaagagcacagatgctgccctgcagacaggcaccccatctggccctgccagcgagctgagcaatgccagcctgagccccagcagcacccccaccaccctgacagacctgaccagccccaccctgcccaccgtgacctctgtgctgacctctgtgcccggcaacctggagggccacgagccccacagccccagccagaccaccctgaccaacctcttctag

SEQ ID NO: 157960 - DNA, 1194 bp, Artificial Sequence
  Description of Artificial Sequence: Synthetic coding sequence
atggaggcccggggggagctgggccctgcccgggagagcgctggaggagacctgctgctggccctgctggccaggagagctgacctgcggcgggagatccccctgtgtgccggctgtgaccagcacatcctggaccgcttcatcctgaaggccacagccaccggcacagcctctgtgtcctctgctgccacagccacccccctggccgagcgctgcttcagcagaggagagagcgtgtactgcaaggatgacttcttcaagagatttggcaccaagtgtgccgcctgccagctgggcatcccccccacccaggtggtgagaagagcccaggactttgtgtaccacctgcactgctttgcctgtgtggtgtgcaagaggcagctggccactggagatgagttctacctgatggaggacagccggctggtgtgcaaggctgactatgaaacagccaagcagcgggaggccgaggccacagccaagaggcccaggaccaccatcacagccaagcagctggagaccctgaagagcgcctacaacaccagccccaagccagcccggcacgtgcgggagcagctgagcagcgagaccggcctggacatgagggtggtgcaggtgtggttccagaacagaagagccaaggagaagaggctgaagaaggatgctggccggcagcgctggggccagtacttcaggaacatgaagaggagcagaggaggcagcaagagtgacaaggacagcgtgcaggagggccaggacagtgatgctgaggtgtccttccctgtgtccctgccctggaggaagtgggcccggcccatggccagcactggagcctggggccaccctggcctgggccctgccctgggcagccctggccagctgctgcccggggcctggaggcctggccggcccagggctgtgccccgggccgccagccggcagcccctgcgctgcccccccatccccaggaggcctgctgagcccccctggccacccctgctgagcagcctggtgtacccagacaccagcctgggcctggtgcccagcggggcccctgggggccccccacccatgagggtgctggccggaaatggccccagcagtgacctgagcacaggcagcagcggcggctacccagacttccctgccagccctgcctcctggctggatgaggtggaccacgcccagttctag

SEQ ID NO: 157961 - DNA, 1209 bp, Artificial Sequence
  Description of Artificial Sequence: Synthetic coding sequence
atggaggcccggggggagctgggccctgcccgggagagcgctggaggagacctgctgctggccctgctggccaggagagctgacctgcggcgggagatccccctgtgtgccggctgtgaccagcacatcctggaccgcttcatcctgaaggccctggacagacactggcacagcaagtgcctgaagtgcagcgactgccacacccccctggccgagcgctgcttcagcagaggagagagcgtgtactgcaaggatgacttcttcaagagatttggcaccaagtgtgccgcctgccagctgggcatcccccccacccaggtggtgagaagagcccaggactttgtgtaccacctgcactgctttgcctgtgtggtgtgcaagaggcagctggccactggagatgagttctacctgatggaggacagccggctggtgtgcaaggctgactatgaaacagccaagcagcgggaggccgaggccacagccaagaggcccaggaccaccatcacagccaagcagctggagaccctgaagagcgcctacaacaccagccccaagccagcccggcacgtgcgggagcagctgagcagcgagaccggcctggacatgagggtggtgcaggtgtggttccagaacagaagagccaaggagaagaggctgaagaaggatgctggccggcagcgctggggccagtacttcaggaacatgaagaggagcagaggaggcagcaagagtgacaaggacagcgtgcaggagggccaggacagtgatgctgaggtgtccttcccagatgagcccagcctggccgagatgggccctgccaacggcctgtatggcagcctgggggagcccacccaggccctgggccggcccagcggggccctgggcaacttcagcctggagcacggcggcctggccggccctgagcagtaccgggagctgcggcccggcagcccctacggcgtgccccccagccctgctgccccccagagcctgcccggcccccagcccctgctgagcagcctggtgtacccagacaccagcctgggcctggtgcccagcggggcccctgggggccccccacccatgagggtgctggccggaaatggccccagcagtgacctgagcacaggcagcagcggcggctacccagacttccctgccagccctgcctcctggctggatgaggtggaccacgcccagttctag

SEQ ID NO: 157962 - DNA, 1194 bp, Artificial Sequence
  Description of Artificial Sequence: Synthetic coding sequence
atgctgctggagaccggcctggagcgggaccgggcccggcctggagctgctgctgtgtgcaccctgggcggcacccgggagatccccctgtgtgccggctgtgaccagcacatcctggaccgcttcatcctgaaggccctggacagacactggcacagcaagtgcctgaagtgcagcgactgccacacccccctggccgagcgctgcttcagcagaggagagagcgtgtactgcaaggatgacttcttcaagcgcttcggcaccaagtgtgccgcctgccagctgggcatcccccccacccaggtggtgcggcgggcccaggactttgtgtaccacctgcactgctttgcctgtgtggtgtgcaagaggcagctggccactggagatgagttctacctgatggaggacagccggctggtgtgcaaggctgactatgaaacagccaagcagcgggaggccgaggccacagccaagaggcccaggaccaccatcacagccaagcagctggagaccctgaagagcgcctacaacaccagccccaagccagcccggcacgtgcgggagcagctgagcagcgagaccggcctggacatgagggtggtgcaggtgtggttccagaacagaagagccaaggagaagaggctgaagaaggatgctggccggcagcgctggggccagtacttcaggaacatgaagaggagccggggcggcagcaagagtgacaaggacagcgtgcaggagggccaggacagtgatgctgaggtgtccttcccagatgagcccagcctggccgagatgggccctgccaacggcctgtatggcagcctgggggagcccacccaggccctgggccggcccagcggggccctgggcaacttcagcctggagcacggcggcctggccggccctgagcagtaccgggagctgcggcccggcagcccctatggagtgccccccagccctgctgccccccagagcctgcccggcccccagcccctgctgagcagcctggtgtacccagacaccagcctgggcctggtgcccagcggggcccctgggggccccccacccatgagggtgctggccggaaatggccccagcagtgacctgagcacaggcagcagcggcggctacccagacttccctgccagccctgcctcctggctggatgaggtggaccacgcccagttctag

SEQ ID NO: 157963 - DNA, 1173 bp, Artificial Sequence
  Description of Artificial Sequence: Synthetic coding sequence
atgatgcagagcgccaccgtgcctgctgagggcgctgtgaagggcctgcctgagatgctgggcgtgcccatgcagcagatcccccagtgtgccggctgcaaccagcacatcctggacaagttcatcctgaaggtgctggacagacactggcacagcagctgcctgaagtgtgccgactgccagatgcagctggccgaccgctgcttcagccgggccggctctgtgtactgcaaggaggacttcttcaagagatttggcaccaagtgcacagcctgccagcagggcatcccccccacccaggtggtgaggaaggcccaggactttgtgtaccacctgcactgctttgcctgcatcatctgcaaccggcagctggccactggagatgagttctacctgatggaggatggccgcctggtgtgcaaggaggactatgaaacagccaagcagaatgatgattctgaggccggggccaagaggcccaggaccaccatcacagccaagcagctggagaccctgaagaatgcctacaagaacagccccaagccagcccggcacgtgcgggagcagctgagcagcgagaccggcctggacatgagggtggtgcaggtgtggttccagaacagaagagccaaggagaagaggctgaagaaggatgctggccgccaccgctggggccagttctacaagtctgtgaagaggagccggggcagcagcaagcaggagaaggagagcagcgctgaggactgtggggtgtctgacagcgagctgtccttccgggaggaccagatcctgtctgagctgggccacaccaaccgcatctatggaaatgtgggagatgtgactggaggccagctgatgaatggcagcttctccatggatggcaccggccagagctaccaggacctgagagatggcagcccctacggcatcccccagagccccagcagcatcagcagcctgcccagccacgcccccctgctgaatggcctggactacacagtggacagcaacctgggcatcatcgcccacgccggccagggcgtgtcccagaccctgcgggccatggccggcggccccaccagtgacatcagcacaggcagctctgtgggctacccagacttccccaccagccctggctcctggctggatgagatggaccacccccccttctag

SEQ ID NO: 157964 - DNA, 1209 bp, Artificial Sequence
  Description of Artificial Sequence: Synthetic coding sequence
atgatggtgcactgtgccggctgtgagcggcccatcctggaccgcttcctgctgaatgtgctggaccgggcctggcacatcaagtgtgtgcagtgctgtgagtgcaagaccaacctgtctgagaagtgcttcagccgggagggcaagctgtactgcaagaatgacttcttccgccgcttcggcaccaagtgtgccggctgtgcccagggcatcagccccagcgacctggtgaggaaggcccggagcaaggtgttccacctgaactgcttcacctgcatggtgtgcaacaagcagctgagcactggagaggagctgtatgtgattgatgagaacaagtttgtgtgcaaggatgactacctgagcagcagcagcctgaaggagggcagcctgaacagcgtgagcagctgcacagacaggagcctgagcccagacctgcaggatgccctgcaggatgaccccaaggagacagacaacagcaccagcagtgacaaggagacagccaacaatgaaaatgaggagcagaacagcggcaccaagaggcggggccccaggaccaccatcaaggccaagcagctggagaccctgaaggccgcctttgctgccacccccaagcccaccaggcacatccgggagcagctggcccaggagaccggcctgaacatgagggtcatccaggtgtggttccagaacagaagaagcaaggagaggaggatgaagcagctgagcgccctgggcgccaggagacatgccttcttccgcagccccaggaggatgaggcccctgggcggccgcctggatgagagcgagatgctgggcagcaccccctacacctactatggagactaccagggcgactactatgcccctggcagcaactatgacttctttgcccacggcccccccagccaggcccagagccctgctgacagcagcttcctggccgccagcggccctggcagcacccccctgggcgccctggagccccccctggccggcccccatgctgctgacaacccccgcttcacagacatgatcagccacccagacacccccagccctgagcccggcctgcccggcaccctgcaccccatgcctggagaggtgttcagcggcggccccagcccccccttccccatgagcggcaccagcggctacagcggccccctgagccaccccaaccctgagctgaatgaagctgctgtgtggtag

SEQ ID NO: 157965 - DNA, 1071 bp, Artificial Sequence
  Description of Artificial Sequence: Synthetic coding sequence
atgcagatcctgagccgctgccagggcctgatgtctgaggagtgtggccgcaccacagccctggccgccggccgcaccaggaagggggccggggaggagggcctggtgtccccagagggcgctggagatgaggacagctgcagcagcagcgcccccctgagccccagcagcagccccaggtccatggccagcggcagcggctgccccccaggaaaatgtgtgtgcaacagctgtggcctggagatcgtggacaagtacctgctgaaggtgaatgacctgtgctggcacgtgcgctgcctgagctgcagcgtgtgcaggaccagcctgggccgccacaccagctgctacatcaaggacaaggacatcttctgcaagctggactacttccgccgctatggcacccgctgcagccgctgtggccgccacatccacagcacagactgggtgcggcgggccaagggaaatgtgtaccacctggcctgctttgcctgcttcagctgcaagaggcagctgagcactggagaggagtttgccctggtggaggagaaggtgctgtgccgggtgcactatgactgcatgctggacaacctgaagcgggaggtggagaatggaaatggcatctctgtggagggcgccctgctgacagagcaggatgtgaaccaccccaagccagccaagagggcccggaccagcttcaccgctgaccagctgcaggtgatgcaggcccagtttgcccaggacaacaacccagatgcccagaccctgcagaagctggccgagaggacaggcctgagccggcgggtcatccaggtgtggttccagaactgccgggcccggcacaagaagcacgtgagccccaaccacagcagcagcacccctgtgacagctgtgccccccagccggctgagcccccccatgctggaggagatggcctacagcgcctacgtgccccaggacggcaccatgctgacagccctgcacagctacatggatgcccacagccccaccaccctgggcctgcagcccctgctgccccacagcatgacccagctgcccatcagccacacctag

SEQ ID NO: 157966 - DNA, 1041 bp, Artificial Sequence
  Description of Artificial Sequence: Synthetic coding sequence
atgtctgaggagtgtggccgcaccacagccctggccgccggccgcaccaggaagggggccggggaggagggcctggtgtccccagagggcgctggagatgaggacagctgcagcagcagcgcccccctgagccccagcagcagccccaggtccatggccagcggcagcggctgccccccaggaaaatgtgtgtgcaacagctgtggcctggagatcgtggacaagtacctgctgaaggtgaatgacctgtgctggcacgtgcgctgcctgagctgcagcgtgtgcaggaccagcctgggccgccacaccagctgctacatcaaggacaaggacatcttctgcaagctggactacttccgccgctatggcacccgctgcagccgctgtggccgccacatccacagcacagactgggtgcggcgggccaagggaaatgtgtaccacctggcctgctttgcctgcttcagctgcaagaggcagctgagcactggagaggagtttgccctggtggaggagaaggtgctgtgccgggtgcactatgactgcatgctggacaacctgaagcgggaggtggagaatggaaatggcatctctgtggagggcgccctgctgacagagcaggatgtgaaccaccccaagccagccaagagggcccggaccagcttcaccgctgaccagctgcaggtgatgcaggcccagtttgcccaggacaacaacccagatgcccagaccctgcagaagctggccgagaggacaggcctgagccggcgggtcatccaggtgtggttccagaactgccgggcccggcacaagaagcacgtgagccccaaccacagcagcagcacccctgtgacagctgtgccccccagccggctgagcccccccatgctggaggagatggcctacagcgcctacgtgccccaggacggcaccatgctgacagccctgcacagctacatggatgcccacagccccaccaccctgggcctgcagcccctgctgccccacagcatgacccagctgcccatcagccacacctag

SEQ ID NO: 157967 - DNA, 1194 bp, Artificial Sequence
  Description of Artificial Sequence: Synthetic coding sequence
atggagatcgtgggctgcagagctgaggacaacagctgccccttccggcccccagccatgctgttccacggcatcagcggcggccacatccagggcatcatggaggagatggagaggaggagcaagacagaggcccggctggccaagggggcccagctgaatggaagagatgctggcatgccacccctgagccctgagaagccagccctgtgtgccggctgcggcggcaagatcagtgaccgctactacctgctggccgtggacaagcagtggcacctgcgctgcctgaagtgctgtgagtgcaagctggccctggagagcgagctgacctgctttgccaaggatggcagcatctactgcaaggaggactactaccgccgcttctctgtgcagagatgtgcccgctgccacctgggcatcagcgccagcgagatggtgatgagggcccgggacagcgtgtaccacctgagctgcttcacctgcagcacctgcaacaagaccctgaccaccggggaccacttcggcatgaaggacagcctggtgtactgccgggcccactttgagaccctgctgcagggcgagtacccaccccagctgagctacacagagctggccgccaagagcggcggcctggccctgccctacttcaatggaactggaacagtgcagaagggccggcccaggaagaggaagagccctgccctgggcgtggacatcgtgaactacaacagcggctgcaatgaaaatgaagctgaccacctggaccgggaccagcagccctacccacccagccagaagaccaagaggatgaggaccagcttcaagcaccaccagctgcggaccatgaagagctactttgccatcaaccacaacccagatgccaaggacctgaagcagctggcccagaagacaggcctgaccaagagggtgctgcaggtgtggttccagaatgcccgggccaagttcagaagaaacctgctgcggcaggagaatggaggagtggacaaggcagatggcaccagcctgcctgcccctccttctgctgacagcggggccctgaccccacctggaacagccaccaccctgacagacctgaccaaccccaccatcaccgtggtgacctctgtgaccagcaacatggacagccatgaaagtggcagccccagccagaccaccctgaccaacctcttctag

SEQ ID NO: 157968 - DNA, 1167 bp, Artificial Sequence
  Description of Artificial Sequence: Synthetic coding sequence
atgctgaatggcaccaccctggaggccgccatgctgttccacggcatcagcggcggccacatccagggcatcatggaggagatggagcggcgcagcaagacagaggcccggctggccaagggggcccagctgaatggaagagatgctggcatgccacccctgagccctgagaagccagccctgtgtgccggctgcggcggcaagatcagtgaccgctactacctgctggccgtggacaagcagtggcacctgcgctgcctgaagtgctgtgagtgcaagctggccctggagagcgagctgacctgctttgccaaggatggcagcatctactgcaaggaggactactaccgccgcttctctgtgcagagatgtgcccgctgccacctgggcatcagcgccagcgagatggtgatgagggcccgggacagcgtgtaccacctgagctgcttcacctgcagcacctgcaacaagaccctgaccactggagaccacttcggcatgaaggacagcctggtgtactgccgggcccactttgagaccctgctgcagggcgagtacccaccccagctgagctacacagagctggccgccaagagcggcggcctggccctgccctacttcaacggcaccggcaccgtgcagaagggccggcccaggaagaggaagagccctgccctgggcgtggacatcgtgaactacaacagcggctgcaatgaaaatgaggccgaccacctggaccgggaccagcagccctacccacccagccagaagaccaagaggatgaggaccagcttcaagcaccaccagctgcggaccatgaagagctactttgccatcaaccacaacccagatgccaaggacctgaagcagctggcccagaagacaggcctgaccaagagggtgctgcaggtgtggttccagaatgcccgggccaagttcagaagaaacctgctgcggcaggagaatggaggagtggacaaggcagatggcaccagcctgcctgccccacccagcgctgacagcggggccctgaccccacctggaacagccaccaccctgacagacctgaccaaccccaccatcaccgtggtgacctctgtgaccagcaacatggacagccatgagagcggcagccccagccagaccaccctgaccaacctcttctag

SEQ ID NO: 157969 - DNA, 1149 bp, Artificial Sequence
  Description of Artificial Sequence: Synthetic coding sequence
atgctggatggcctgaagatggaggagaacttccagagcgccatcgacaccagcgccagcttcagcagcctgctgggccgggctgtgagccccaagtctgtgtgtgagggctgccagagggtcatcctggaccgcttcctgctgcggctgaatgacagcttctggcatgagcagtgtgtgcagtgtgccagctgcaaggagcccctggagaccacctgcttctacagagacaagaagctgtactgcaagtatgactatgagaagctgtttgctgtgaagtgtggcggctgctttgaggccatcgccccaaatgaatttgtgatgagggcccagaagtctgtgtaccacctgagctgcttctgctgctgcgtgtgtgagcggcagctgcagaagggagatgaatttgtgctgaaggagggccagctgctgtgcaagggggactatgagaaggagcgggagctgctgagcctggtgtccccagctgccagtgacagcggcaagagtgatgatgaggagagcctgtgcaagagcgcccatggagctggaaaaggaacagctgaggagggcaaggaccacaagaggcccaagaggcccaggaccatcctgaccacccagcagaggcgggccttcaaggccagctttgaggtgagcagcaagccctgcaggaaggtgcgggagaccctggccgctgagaccggcctgtctgtgcgggtggtgcaggtgtggttccagaaccagagggccaagatgaagaagctggcccggcggcagcagcagcagcagcaggaccagcagaacacccagaggctgagcagcgcccagaccaacggcggcggcagcgctggcatggagggcatcatgaacccctacacagccctgcccaccccccagcagctgctggccatcgagcagagcgtgtacagcagtgaccccttccggcagggcctgaccccaccccagatgcctggggaccacatgcacccctatggagctgagcccctcttccatgacctggacagtgatgacaccagcctgagcaacctgggggactgcttcctggccaccagcgaggccggccccctgcagagccgggtgggcaaccccatcgaccacctgtacagcatgcagaacagctacttcaccagctag

SEQ ID NO: 157970 - DNA, 1149 bp, Artificial Sequence; identical to SEQ ID NO: 157969
  Description of Artificial Sequence: Synthetic coding sequence

SEQ ID NO: 157971 - DNA, 1149 bp, Artificial Sequence; identical to SEQ ID NO: 157969
  Description of Artificial Sequence: Synthetic coding sequence

SEQ ID NO: 157972 - DNA, 1221 bp, Artificial Sequence
  Description of Artificial Sequence: Synthetic coding sequence
atggacatcgccactggacctgagagcctggagcgctgcttcccccggggccagacagactgtgccaagatgctggatggcatcaagatggaggagcacgccctgcggcccggccctgccaccctgggcgtgctgctgggcagtgactgcccccaccctgctgtgtgtgagggctgccagaggcccatcagtgaccgcttcctgatgagggtgaatgaaagctcctggcatgaagaatgtctgcagtgtgccgcctgccagcaggccctgaccaccagctgctacttccgggacaggaagctgtactgcaagcaggactaccagcagctgtttgctgccaagtgcagcggctgcatggagaagatcgcccccacagaatttgtgatgagggccctggagtgtgtgtaccacctgggctgcttctgctgctgcgtgtgtgagcggcagctgaggaaaggagatgaatttgtgctgaaggagggccagctgctgtgcaagggggactatgagaaggagaaggacctgctgagctctgtgtccccagatgaaagtgacagcgtgaagtcagaagatgaagatggagacatgaagccagccaagggccagggcagccagagcaaaggaagtggagatgatggcaaggacccccggcggcccaagaggcccaggaccatcctgaccacccagcagaggcgggccttcaaggccagctttgaggtgagcagcaagccctgcaggaaggtgcgggagaccctggccgctgagaccggcctgtctgtgcgggtggtgcaggtgtggttccagaaccagagggccaagatgaagaagctggcccggcggcaccagcagcagcaggagcagcagaacagccagaggctgggccagggcgagcccggccctggccagggcctgggccaggaggtgctgagcagcaggatggagggcatgatggccagctacacccccctggccccaccccagcagcagatcgtggccatggagcagagcccctacggcagcagtgaccccttccagcagggcctgaccccaccccagatgcctggaaatgacagcatcttccatgacatcgacagcgacaccagcctgaccagcctgagtgactgcttcctgggcagcagtgatgtgggcagcctgcaggcccgggtgggcaaccccatcgaccggctgtacagcatgcagagcagctactttgccagctag

SEQ ID NO: 157973 - DNA, 1209 bp, Artificial Sequence
  Description of Artificial Sequence: Synthetic coding sequence
atggacatcgccactggacctgagagcctggagcgctgcttcccccggggccagacagactgtgccaagatgctggatggcatcaagatggaggagcacgccctgcggcccggccctgccaccctgggcgtgctgctgggcagtgactgcccccaccctgctgtgtgtgagggctgccagaggcccatcagtgaccgcttcctgatgagggtgaatgaaagctcctggcatgaagaatgtctgcagtgtgccgcctgccagcaggccctgaccaccagctgctacttccgggacaggaagctgtactgcaagcaggactaccagcagctgtttgctgccaagtgcagcggctgcatggagaagatcgcccccacagaatttgtgatgagggccctggagtgtgtgtaccacctgggctgcttctgctgctgcgtgtgtgagcggcagctgaggaaaggagatgaatttgtgctgaaggagggccagctgctgtgcaagggggactatgagaaggagaaggacctgctgagctctgtgtccccagatgaaagtgacagcgtgaagtcagaagatgaagatggagacatgaagccagccaagggccagggcagccagagcaaaggaagtggagatgatggcaaggacccccggcggcccaagaggcccaggaccatcctgaccacccagcagaggcgggccttcaaggccagctttgaggtgagcagcaagccctgcaggaaggtgcgggagaccctggccgctgagaccggcctgtctgtgcgggtggtgcaggtgtggttccagaaccagagggccaagatgaagaagctggcccggcggcaccagcagcagcaggagcagcagaacagccagaggctgggccaggaggtgctgagcagcaggatggagggcatgatggccagctacacccccctggccccaccccagcagcagatcgtggccatggagcagagcccctacggcagcagtgaccccttccagcagggcctgaccccaccccagatgcctggggaccacatgaacccctatggaaatgacagcatcttccatgacatcgacagcgacaccagcctgaccagcctgagtgactgcttcctgggcagcagtgatgtgggcagcctgcaggcccgggtgggcaaccccatcgaccggctgtacagcatgcagagcagctactttgccagctag

SEQ ID NO: 157974 - DNA, 1119 bp, Artificial Sequence
  Description of Artificial Sequence: Synthetic coding sequence
atgctggatggcatcaagatggaggagcacgccctgcggcccggccctgccaccctgggcgtgctgctgggcagtgactgcccccaccctgctgtgtgtgagggctgccagaggcccatcagtgaccgcttcctgatgagggtgaatgaaagctcctggcatgaggagtgcctgcagtgtgccgcctgccagcaggccctgaccaccagctgctacttccgggacaggaagctgtactgcaagcaggactaccagcagctgtttgctgccaagtgcagcggctgcatggagaagatcgcccccacagaatttgtgatgagggccctggagtgtgtgtaccacctgggctgcttctgctgctgcgtgtgtgagcggcagctgaggaaaggagatgaatttgtgctgaaggagggccagctgctgtgcaagggggactatgagaaggagaaggacctgctgagctctgtgtccccagatgaaagtgacagcgtgaagtcagaagatgaagatggagacatgaagccagccaagggccagggcagccagagcaagggcagcggagatgatggcaaggacccccggcggcccaagaggcccaggaccatcctgaccacccagcagaggcgggccttcaaggccagctttgaggtgagcagcaagccctgcaggaaggtgcgggagaccctggccgctgagaccggcctgtctgtgcgggtggtgcaggtgtggttccagaaccagagggccaagatgaagaagctggcccggcggcaccagcagcagcaggagcagcagaacagccagaggctgggccaggaggtgctgagcagcaggatggagggcatgatggccagctacacccccctggccccaccccagcagcagatcgtggccatggagcagagcccctacggcagcagtgaccccttccagcagggcctgaccccaccccagatgcctggaaatgacagcatcttccatgacatcgacagcgacaccagcctgaccagcctgagtgactgcttcctgggcagcagtgatgtgggcagcctgcaggcccgggtgggcaaccccatcgaccggctgtacagcatgcagagcagctactttgccagctag

SEQ ID NO: 157975 - DNA, 1188 bp, Artificial Sequence
  Description of Artificial Sequence: Synthetic coding sequence
atggacatcgccactggacctgagagcctggagcgctgcttcccccggggccagacagactgtgccaagatgctggatggcatcaagatggaggagcacgccctgcggcccggccctgccaccctgggcgtgctgctgggcagtgactgcccccaccctgctgtgtgtgagggctgccagaggcccatcagtgaccgcttcctgatgagggtgaatgaaagctcctggcatgaagaatgtctgcagtgtgccgcctgccagcaggccctgaccaccagctgctacttccgggacaggaagctgtactgcaagcaggactaccagcagctgtttgctgccaagtgcagcggctgcatggagaagatcgcccccacagaatttgtgatgagggccctggagtgtgtgtaccacctgggctgcttctgctgctgcgtgtgtgagcggcagctgaggaaaggagatgaatttgtgctgaaggagggccagctgctgtgcaagggggactatgagaaggagaaggacctgctgagctctgtgtccccagatgaaagtgacagcgtgaagtcagaagatgaagatggagacatgaagccagccaagggccagggcagccagagcaaaggaagtggagatgatggcaaggacccccggcggcccaagaggcccaggaccatcctgaccacccagcagaggcgggccttcaaggccagctttgaggtgagcagcaagccctgcaggaaggtgcgggagaccctggccgctgagaccggcctgtctgtgcgggtggtgcaggtgtggttccagaaccagagggccaagatgaagaagctggcccggcggcaccagcagcagcaggagcagcagaacagccagaggctgggccaggaggtgctgagcagcaggatggagggcatgatggccagctacacccccctggccccaccccagcagcagatcgtggccatggagcagagcccctacggcagcagtgaccccttccagcagggcctgaccccaccccagatgcctggaaatgacagcatcttccatgacatcgacagcgacaccagcctgaccagcctgagtgactgcttcctgggcagcagtgatgtgggcagcctgcaggcccgggtgggcaaccccatcgaccggctgtacagcatgcagagcagctactttgccagctag

SEQ ID NO: 157976 - DNA, 318 bp, Artificial Sequence
  Description of Artificial Sequence: Synthetic coding sequence
atgagcatctacttccccatccactgcccagactacctgcggagcgccaagatgacagaggtgatgatgaacacccagcccatggaggagatcggcctgagccccaggaaggatggcctgagctaccagatcttcccagaccccagcgactttgaccgctgctgcaagctgaaggaccggctgcccagcatcgtggtggagcccacagaaggagaggtggagagcggggagctgcgctggcccccagaggagttcctggtgcaggaggatgagcaggacaactgtgaggagacagccaaggagaacaaggagcagtag

SEQ ID NO: 157977 - DNA, 264 bp, Artificial Sequence
  Description of Artificial Sequence: Synthetic coding sequence
atggtgtcctctgtggtgggcttctacagcctgcgcttcttcggcaacttcacccccaagaaggatgacaccaccatgaccaagatcatcggcaactgtgtgtccatcctggtgctgagcagcgccctgcctgtgatgagcaggaccctgggcctgcacaagctgcacctgcccaacaccagccgggacagcgagacagcctctgtgatgaccagcagcgcccgggacaccggcttccaccacctgcaggccctgatgtgctag

SEQ ID NO: 157978 - DNA, 687 bp, Artificial Sequence
  Description of Artificial Sequence: Synthetic coding sequence
atggagggccaggatgaggtgtctgcccgggagcagcacttccacagccaggtgcgggagagcaccatctgcttcctgctgtttgccatcctgtatgtggtgtcctacttcatcatcacccgctacaagaggaagagtgatgagcaggaggatgaagatgccatcgtgaaccgcatcagcctcttcctgagcaccttcaccctggccgtgtctgctggagctgtgctgctgctgcccttcagcatcatcagcaatgagatcctgctgtccttcccccagaactactacatccagtggctgaatggcagcctcatccacggcctgtggaacctggccagcctcttcagcaacctgtgcctgtttgtgctgatgccctttgccttcttcttcctggagagcgagggctttgctggcctgaagaagggcatccgggcccgcatcctggagaccctggtgatgctgctgctgctggccctgctgatcctgggcatcgtgtgggtggccagcgccctgattgacaatgatgctgcctccatggagagcctgtatgacctgtgggagttctacctgccctacctgtacagctgcatcagcctgatgggctgcctgctgctgcacctgcccaacaccagccgggacagcgagacagccaagcccagcgtgaatggccaccagaaggccctgtag

SEQ ID NO: 157979 - DNA, 1473 bp, Artificial Sequence
  Description of Artificial Sequence: Synthetic coding sequence
atggagggccaggatgaggtgtctgcccgggagcagcacttccacagccaggtgcgggagagcaccatctgcttcctgctgtttgccatcctgtatgtggtgtcctacttcatcatcacccgctacaagaggaagagtgatgagcaggaggatgaagatgccatcgtgaaccgcatcagcctcttcctgagcaccttcaccctggccgtgtctgctggagctgtgctgctgctgcccttcagcatcatcagcaatgagatcctgctgtccttcccccagaactactacatccagtggctgaatggcagcctcatccacggcctgtggaacctggccagcctcttcagcaacctgtgcctgtttgtgctgatgccctttgccttcttcttcctggagagcgagggctttgctggcctgaagaagggcatccgggcccgcatcctggagaccctggtgatgctgctgctgctggccctgctgatcctgggcatcgtgtgggtggccagcgccctgattgacaatgatgctgcctccatggagagcctgtatgacctgtgggagttctacctgccctacctgtacagctgcatcagcctgatgggctgcctgctgctgctgctgtgcacccctgtgggcctgagcaggatgttcaccgtgatgggccagctgctggtgaagcccaccatcctggaggacctggatgagcagatctacatcatcaccctggaggaggaggccctgcagaggcggctgaatggcctgagcagctctgtggagtacaacatcatggagctggagcaggagctggagaatgtgaagaccctgaagaccaagctggagaggaggaagaaggccagcgcctgggagaggaacctggtgtacccagctgtgatggtgctgctgctgattgagaccagcatctctgtgctgctggtggcctgcaacatcctgtgcctgctggtggatgaaacagccatgcccaagggcacccggggccctggcattggaaatgccagcctgagcacctttggatttgtgggcgccgccctggagatcatcctgatcttctacctgatggtgtcctctgtggtgggcttctacagcctgcgcttcttcggcaacttcacccccaagaaggatgacaccaccatgaccaagatcatcggcaactgtgtgtccatcctggtgctgagcagcgccctgcctgtgatgagcaggaccctgggcatcaccaggtttgacctgctgggggactttggccgcttcaactggctgggcaacttctacatcgtgctgagctacaacctgctgtttgccatcgtgaccaccctgtgcctggtgaggaagttcaccagcgctgtgcgggaggagctgttcaaggccctgggcctgcacaagctgcacctgcccaacaccagccgggacagcgagacagccaagcccagcgtgaatggccaccagaaggccctgtag

SEQ ID NO: 157980 - DNA, 1596 bp, Artificial Sequence
  Description of Artificial Sequence: Synthetic coding sequence
atggagggccaggatgaggtgtctgcccgggagcagcacttccacagccaggtgcgggagagcaccatctgcttcctgctgtttgccatcctgtatgtggtgtcctacttcatcatcacccgctacaagaggaagagtgatgagcaggaggatgaagatgccatcgtgaaccgcatcagcctcttcctgagcaccttcaccctggccgtgtctgctggagctgtgctgctgctgcccttcagcatcatcagcaatgagatcctgctgtccttcccccagaactactacatccagtggctgaatggcagcctcatccacggcctgtggaacctggccagcctcttcagcaacctgtgcctgtttgtgctgatgccctttgccttcttcttcctggagagcgagggctttgctggcctgaagaagggcatccgggcccgcatcctggagaccctggtgatgctgctgctgctggccctgctgatcctgggcatcgtgtgggtggccagcgccctgattgacaatgatgctgcctccatggagagcctgtatgacctgtgggagttctacctgccctacctgtacagctgcatcagcctgatgggctgcctgctgctgctgctgtgcacccctgtgggcctgagcaggatgttcaccgtgatgggccagctgctggtgaagcccaccatcctggaggacctggatgagcagatctacatcatcaccctggaggaggaggccctgcagaggcggctgaatgtgggcatgctgtgtgccggcaaccctgaggtggccaccggccggcaggtgcctgaggagcaggccggccagctgctgctgggcaagtggatccaggagggcggggacatgattgccaacccccggctgagcagctctgtggagtacaacatcatggagctggagcaggagctggagaatgtgaagaccctgaagaccaagctggagaggaggaagaaggccagcgcctgggagaggaacctggtgtacccagctgtgatggtgctgctgctgattgagaccagcatctctgtgctgctggtggcctgcaacatcctgtgcctgctggtggatgaaacagccatgcccaagggcacccggggccctggcattggaaatgccagcctgagcaccttcggctttgtgggcgccgccctggagatcatcctgatcttctacctgatggtgtcctctgtggtgggcttctacagcctgcgcttctttggaaacttcacccccaagaaggatgacaccaccatgaccaagatcatcggcaactgtgtgtccatcctggtgctgagcagcgccctgcctgtgatgagcaggaccctgggcatcaccaggtttgacctgctgggggactttggccgcttcaactggctgggcaacttctacatcgtgctgagctacaacctgctgtttgccatcgtgaccaccctgtgcctggtgaggaagttcaccagcgctgtgcgggaggagctgttcaaggccctgggcctgcacaagctgcacctgcccaacaccagccgggacagcgagacagccaagcccagcgtgaatggccaccagaaggccctgtag

SEQ ID NO: 157981 - DNA, 855 bp, Artificial Sequence
  Description of Artificial Sequence: Synthetic coding sequence
atgctgctgctgctggccctgctgatcctgggcatcgtgtgggtggccagcgccctgattgacaatgatgctgcctccatggagagcctgtatgacctgtgggagttctacctgccctacctgtacagctgcatcagcctgatgggctgcctgctgctgctgctgtgcacccctgtgggcctgagcaggatgttcaccgtgatgggccagctgctggtgaagcccaccatcctggaggacctggatgagcagatctacatcatcaccctggaggaggaggccctgcagaggcggctgaatggcctgagcagctctgtggagtacaacatcatggagctggagcaggagctggagaatgtgaagaccctgaagaccaagctggagaggaggaagaaggccagcgcctgggagaggaacctggtgtacccagctgtgatggtgctgctgctgattgagaccagcatctctgtgctgctggtggcctgcaacatcctgtgcctgctggtggatgaaacagccatgcccaagggcacccggggccctggcattggaaatgccagcctgagcacctttggatttgtgggcgccgccctggagatcatcctgatcttctacctgatggtgtcctctgtggtgggcttctacagcctgcgcttcttcggcaacttcacccccaagaaggatgacaccaccatgaccaagatcatcggcaactgtgtgtccatcctggtgctgagcagcgccctgcctgtgatgagcaggaccctgggcctgcacaagctgcacctgcccaacaccagccgggacagcgagacagccaagcccagcgtgaatggccaccagaaggccctgtag

SEQ ID NO: 157982 - DNA, 1590 bp, Artificial Sequence
  Description of Artificial Sequence: Synthetic coding sequence
ggccaggatgaggtgtctgcccgggagcagcacttccacagccaggtgcgggagagcaccatctgcttcctgctgtttgccatcctgtatgtggtgtcctacttcatcatcacccgctacaagaggaagagtgatgagcaggaggatgaagatgccatcgtgaaccgcatcagcctcttcctgagcaccttcaccctggccgtgtctgctggagctgtgctgctgctgcccttcagcatcatcagcaatgagatcctgctgtccttcccccagaactactacatccagtggctgaatggcagcctcatccacggcctgtggaacctggccagcctcttcagcaacctgtgcctgtttgtgctgatgccctttgccttcttcttcctggagagcgagggctttgctggcctgaagaagggcatccgggcccgcatcctggagaccctggtgatgctgctgctgctggccctgctgatcctgggcatcgtgtgggtggccagcgccctgattgacaatgatgctgcctccatggagagcctgtatgacctgtgggagttctacctgccctacctgtacagctgcatcagcctgatgggctgcctgctgctgctgctgtgcacccctgtgggcctgagcaggatgttcaccgtgatgggccagctgctggtgaagcccaccatcctggaggacctggatgagcagatctacatcatcaccctggaggaggaggccctgcagaggcggctgaatgtgggcatgctgtgtgccggcaaccctgaggtggccaccggccggcaggtgcctgaggagcaggccggccagctgctgctgggcaagtggatccaggagggcggggacatgattgccaacccccggctgagcagctctgtggagtacaacatcatggagctggagcaggagctggagaatgtgaagaccctgaagaccaagctggagaggaggaagaaggccagcgcctgggagaggaacctggtgtacccagctgtgatggtgctgctgctgattgagaccagcatctctgtgctgctggtggcctgcaacatcctgtgcctgctggtggatgaaacagccatgcccaagggcacccggggccctggcattggaaatgccagcctgagcaccttcggctttgtgggcgccgccctggagatcatcctgatcttctacctgatggtgtcctctgtggtgggcttctacagcctgcgcttctttggaaacttcacccccaagaaggatgacaccaccatgaccaagatcatcggcaactgtgtgtccatcctggtgctgagcagcgccctgcctgtgatgagcaggaccctgggcatcaccaggtttgacctgctgggggactttggccgcttcaactggctgggcaacttctacatcgtgctgagctacaacctgctgtttgccatcgtgaccaccctgtgcctggtgaggaagttcaccagcgctgtgcgggaggagctgttcaaggccctgggcctgcacaagctgcacctgcccaacaccagccgggacagcgagacagccaagcccagcgtgaatggccaccagaaggccctgtag

SEQ ID NO: 157983 - DNA, 1248 bp, Artificial Sequence
  Description of Artificial Sequence: Synthetic coding sequence
atgaaggaggatggccgggccggccggggcgtgggcgctggggccgccctgccccagcccagcgctggggtgcatgatgagcaggaggatgaagatgccatcgtgaaccgcatcagcctcttcctgagcaccttcaccctggccgtgtctgctggagctgtgctgctgctgcccttcagcatcatcagcaatgagatcctgctgtccttcccccagaactactacatccagtggctgaatggcagcctcatccacggcctgtggaacctggccagcctcttcagcaacctgtgcctgtttgtgctgatgccctttgccttcttcttcctggagagcgagggctttgctggcctgaagaagggcatccgggcccgcatcctggagaccctggtgatgctgctgctgctggccctgctgatcctgggcatcgtgtgggtggccagcgccctgattgacaatgatgctgcctccatggagagcctgtatgacctgtgggagttctacctgccctacctgtacagctgcatcagcctgatgggctgcctgctgctgctgctgtgcacccctgtgggcctgagcaggatgttcaccgtgatgggccagctgctggtgaagcccaccatcctggaggacctggatgagcagatctacatcatcaccctggaggaggaggccctgcagaggcggctgaatggcctgagcagctctgtggagtacaacatcatggagctggagcaggagctggagaatgtgaagaccctgaagaccaagctggagaggaggaagaaggccagcgcctgggagaggaacctggtgtacccagctgtgatggtgctgctgctgattgagaccagcatctctgtgctgctggtggcctgcaacatcctgtgcctgctggtggatgaaacagccatgcccaagggcacccggggccctggcattggaaatgccagcctgagcaccttcggctttgtgggcgccgccctggagatcatcctgatcttctacctgatggtgtcctctgtggtgggcttctacagcctgcgcttctttggaaacttcacccccaagaaggatgacaccaccatgaccaagatcatcggcaactgtgtgtccatcctggtgctgagcagcgccctgcctgtgatgagcaggaccctgggcctgcacaagctgcacctgcccaacaccagccgggacagcgagacagccaagcccagcgtgaatggccaccagaaggccctgtag

SEQ ID NO: 157984 - DNA, 1470 bp, Artificial Sequence
  Description of Artificial Sequence: Synthetic coding sequence
atggaggccccagactatgaggtgctgtctgtgcgggagcagctgttccacgagcgcatccgggagtgcatcatcagcaccctgctgtttgccaccctgtacatcctgtgccacatcttcctgacccgcttcaagaagccagctgagttcaccaccgtggatgatgaagatgccaccgtgaacaagatcgccctggagctgtgcaccttcaccctggccatcgccctgggcgctgtgctgctgctgcccttcagcatcatcagcaatgaggtgctgctgagcctgcccaggaactactacatccagtggctgaatggcagcctcatccacggcctgtggaacctggtgttcctgttcagcaacctgagcctcatcttcctgatgccctttgcctacttcttcacagaaagtgagggctttgctggcagcaggaaaggagtgctgggccgggtgtatgagaccgtggtgatgctgatgctgctgaccctgctggtgctgggcatggtgtgggtggccagcgccatcgtggacaagaacaaggccaaccgggagagcctgtatgacttctgggagtactacctgccctacctgtacagctgcatctccttcctgggcgtgctgctgctgctggtgtgcacccccctgggcctggccaggatgttttctgtgacaggcaagctgctggtgaagccccggctgctggaggacctggaggagcagctgtactgcagcgcctttgaggaggccgccctgacccggcgcatctgcaaccccaccagctgctggctgcccctggacatggagctgctgcaccggcaggtgctggccctgcagacccagagggtgctgctggagaagaggaggaaggccagcgcctggcagaggaacctgggctaccccctggccatgctgtgcctgctggtgctgaccggcctgtctgtgctgattgtggccatccacatcctggagctgctgattgatgaagctgccatgccccggggcatgcagggcaccagcctgggccaggtgtccttcagcaagctgggcagctttggagctgtgatccaggtggtgctgatcttctacctgatggtgtcctctgtggtgggcttctacagcagccccctcttccgcagcctgcggccccgctggcatgacacagccatgacccagatcatcggcaactgtgtgtgcctgctggtgctgagcagcgccctgcctgtgttcagcaggaccctgggcctgaccaggtttgacctgctgggggactttggccgcttcaactggctgggcaacttctacatcgtgttcctgtacaatgctgcctttgctggcctgaccaccctgtgcctggtgaagaccttcaccgctgctgtgcgggcagagctgatccgggccttcggcctggaccggctgcccctgcctgtgtctggcttcccccaggccagcaggaagacccagcaccagtag

SEQ ID NO: 157985 - DNA, 1455 bp, Artificial Sequence
  Description of Artificial Sequence: Synthetic coding sequence
atggtgaatgtgaaggccctgtgtgagcctgaggtgagcaactgctggatgaatgtcatcactggaactggatctgtgagcagccccctgctggtgctgccccagcccggccctgagaccagcctgatgaccggggagcctgtggatgatgaagatgccaccgtgaacaagatcgccctggagctgtgcaccttcaccctggccatcgccctgggcgctgtgctgctgctgcccttcagcatcatcagcaatgaggtgctgctgagcctgcccaggaactactacatccagtggctgaatggcagcctcatccacggcctgtggaacctggtgttcctgttcagcaacctgagcctcatcttcctgatgccctttgcctacttcttcacagagagcgagggctttgctggcagcaggaagggcgtgctgggccgggtgtatgaaacagtggtgatgctgatgctgctgaccctgctggtgctgggcatggtgtgggtggccagcgccatcgtggacaagaacaaggccaaccgggagagcctgtatgacttctgggagtactacctgccctacctgtacagctgcatctccttcctgggcgtgctgctgctgctggtgtgcacccccctgggcctggccaggatgttttctgtgacaggcaagctgctggtgaagccccggctgctggaggacctggaggagcagctgtactgcagcgcctttgaggaggccgccctgacccggcgcatctgcaaccccaccagctgctggctgcccctggacatggagctgctgcaccggcaggtgctggccctgcagacccagagggtgctgctggagaagaggaggaaggccagcgcctggcagaggaacctgggctaccccctggccatgctgtgcctgctggtgctgaccggcctgtctgtgctgattgtggccatccacatcctggagctgctgattgatgaggccgccatgccccggggcatgcagggcaccagcctgggccaggtgtccttcagcaagctgggcagctttggagctgtgatccaggtggtgctgatcttctacctgatggtgtcctctgtggtgggcttctacagcagccccctcttccgcagcctgcggccccgctggcatgacacagccatgacccagatcatcggcaactgtgtgtgcctgctggtgctgagcagcgccctgcccgtcttcagcaggaccctgggcctgaccaggtttgacctgctgggggactttggccgcttcaactggctgggcaacttctacatcgtgttcctgtacaatgctgcctttgctggcctgaccaccctgtgcctggtgaagaccttcaccgctgctgtgcgggcagagctgatccgggccttcggcctggaccggctgcccctgcctgtgtctggcttcccccaggccagcaggaagacccagcaccagtag

SEQ ID NO: 157986 - DNA, 1410 bp, Artificial Sequence
  Description of Artificial Sequence: Synthetic coding sequence
atggaggccccagactatgaggtgctgtctgtgcgggagcagctgttccacgagcgcatccgggagtgcatcatcagcaccctgctgtttgccaccctgtacatcctgtgccacatcttcctgacccgcttcaagaagccagctgagttcaccaccgtggatgatgaagatgccaccgtgaacaagatcgccctggagctgtgcaccttcaccctggccatcgccctgggcgctgtgctgctgctgcccttcagcatcatcagcaatgaggtgctgctgagcctgcccaggaactactacatccagtggctgaatggcagcctcatccacggcctgtggaacctggtgttcctgttcagcaacctgagcctcatcttcctgatgccctttgcctacttcttcacagaaagtgagggctttgctggcagcaggaaaggagtgctgggccgggtgtatgagaccgtggtgatgctgatgctgctgaccctgctggtgctgggcatggtgtgggtggccagcgccatcgtggacaagaacaaggccaaccgggagagcctgtatgacttctgggagtactacctgccctacctgtacagctgcatctccttcctgggcgtgctgctgctgctggtgtgcacccccctgggcctggccaggatgttttctgtgacaggcaagctgctggtgaagccccggctgctggaggacctggaggagcagctgtactgcagcgcctttgaggaggccgccctgacccggcgcatctgcaaccccaccagctgctggctgcccctggacatggagctgctgcaccggcaggtgctggccctgcagacccagagggtgctgctggagaagaggaggaaggccagcgcctggcagaggaacctgggctaccccctggccatgctgtgcctgctggtgctgaccggcctgtctgtgctgattgtggccatccacatcctggagctgctgattgatgaagctgccatgccccggggcatgcaggtggtgctgatcttctacctgatggtgtcctctgtggtgggcttctacagcagccccctcttccgcagcctgcggccccgctggcatgacacagccatgacccagatcatcggcaactgtgtgtgcctgctggtgctgagcagcgccctgcctgtgttcagcaggaccctgggcctgaccaggtttgacctgctgggggactttggccgcttcaactggctgggcaacttctacatcgtgttcctgtacaatgctgcctttgctggcctgaccaccctgtgcctggtgaagaccttcaccgctgctgtgcgggcagagctgatccgggccttcggcctggaccggctgcccctgcctgtgtctggcttcccccaggccagcaggaagacccagcaccagtag

SEQ ID NO: 157987 - DNA, 384 bp, Artificial Sequence
  Description of Artificial Sequence: Synthetic coding sequence
atggaggccccagactatgaggtgctgtctgtgcgggagcagctgttccacgagcgcatccgggagtgcatcatcagcaccctgctgtttgccaccctgtacatcctgtgccacatcttcctgacccgcttcaagaagccagctgagttcaccaccgtggatgatgaagatgccaccgtgaacaagatcgccctggagctgtgcaccttcaccctggccatcgccctgggcgctgtgctgctgctgcccttcagcatcatcagcaatgaggtgctgctgagcctgcccaggaactactacatccagtggctgaatggcagcctcatccacggcctgtggaacctggtgttcctgttcagcaacctgagcctcatcttcctgtag

SEQ ID NO: 157988 - DNA, 1017 bp, Artificial Sequence
  Description of Artificial Sequence: Synthetic coding sequence
atggtgagaagagtgcagcctgacaggaagcagctgcccctggtgctgctgcggctgctgtgcctgctgcccaccggcctgcctgtgcgctctgtggacttcaacagaggaacagacaacatcaccgtgcggcagggcgacacagccatcctgcgctgtgtggtggaggacaagaacagcaaggtggcctggctgaacagaagtggcatcatctttgctggccatgacaagtggagcctggacccccgggtggagctggagaagaggcacagcctggagtacagcctgcgcatccagaaggtggatgtgtatgatgagggcagctacacctgcagcgtgcagacccagcacgagcccaagaccagccaggtgtacctgattgtgcaggtgccccccaagatcagcaacatcagcagtgatgtgacagtgaatgaaggcagcaatgtgaccctggtgtgcatggccaacggccggcctgagcctgtgatcacctggaggcacctgacccccaccggccgggagtttgaaggagaggaggagtacctggagatcctgggcatcacccgggagcagagcggcaagtatgagtgcaaggccgccaatgaggtgtcctctgcagatgtgaagcaggtgaaggtgacagtgaactacccacccaccatcacagagagcaagagcaatgaggccaccaccggccggcaggccagcctgaagtgtgaggccagcgctgtgcctgccccagactttgagtggtacagagatgacacccgcatcaacagcgccaacggcctggagatcaagagcacagagggccagagcagcctgactgtgaccaacgtgacagaggagcactacggcaactacacctgtgtggccgccaacaagctgggcgtgaccaatgccagcctggtgctcttccggcccggctctgtgcggggcatcaatggcagcatcagcctggccgtgcccctgtggctgctggccgccagcctgctgtgcctgctgagcaaatgttag

SEQ ID NO: 157989 - DNA, 1077 bp, Artificial Sequence
  Description of Artificial Sequence: Synthetic coding sequence
atgaggacctactggctgcacagcgtgtgggtgctgggcttcttcctgagcctcttcagcctgcagggcctgcctgtgcgctctgtggacttcaacagaggaacagacaacatcaccgtgcggcagggcgacacagccatcctgcgctgtgtggtggaggacaagaacagcaaggtggcctggctgaacagaagtggcatcatctttgctggccatgacaagtggagcctggacccccgggtggagctggagaagaggcacagcctggagtacagcctgcgcatccagaaggtggatgtgtatgatgagggcagctacacctgcagcgtgcagacccagcacgagcccaagaccagccaggtgtacctgattgtgcaggtgccccccaagatcagcaacatcagcagtgatgtgacagtgaatgaaggcagcaatgtgaccctggtgtgcatggccaacggccggcctgagcccgtcatcacctggaggcacctgacccccaccggccgggagtttgaaggagaggaggagtacctggagatcctgggcatcacccgggagcagagcggcaagtatgagtgcaaggccgccaatgaggtgagcagcgcagatgtgaagcaggtgaaggtgacagtgaactacccacccaccatcacagagagcaagagcaatgaggccaccaccggccggcaggccagcctgaagtgtgaggccagcgctgtgcctgccccagactttgagtggtacagagatgacacccgcatcaacagcgccaacggcctggagatcaagagcacagagggccagagcagcctgactgtgaccaacgtgacagaggagcactacggcaactacacctgtgtggccgccaacaagctgggcgtgaccaatgccagcctggtgctcttcaagagggtgctgcccaccatcccccaccccatccaggagatcggcaccaccgtgcacttcaagcagaagggccctggctctgtgcggggcatcaatggcagcatcagcctggccgtgcccctgtggctgctggccgccagcctgctgtgcctgctgagcaaatgttag

SEQ ID NO: 157990 - DNA, 753 bp, Artificial Sequence
  Description of Artificial Sequence: Synthetic coding sequence
atggccgagggcggggccagcaagggcggcggggaggagcccgggaagctgcctgagcctgctgaggaggagagccaggtgctgcggggcaccggccactgcaagtggttcaacgtgaggatgggcttcggcttcatctccatgatcaaccgggagggcagccccctggacatccctgtggatgtgtttgtgcaccagagcaagctgttcatggagggcttccgcagcctgaaggagggggagcctgtggagttcaccttcaagaagagcagcaagggcctggagagcatccgggtgacaggccctgggggcagcccctgcctgggcagcgagcggcggcccaagggcaagaccctgcagaagaggaagcccaagggggaccgctgctacaactgtggcggcctggaccaccacgccaaggaatgttccctgcccccccagcccaagaagtgccactactgccagagcatcatgcacatggtggccaactgcccccacaagaatgtggcccagcccccagccagcagccagggccggcaggaggccgagagccagccctgcaccagcaccctgccccgggaggtgggcggcggccacggctgcaccagcccccccttcccccaggaggcccgggcagagatcagcgagaggagcggccgcagcccccaggaggccagcagcaccaagagcagcatcgcccctgaggagcagagcaagaagggccccagcgtgcagaagaggaagaagacctag

SEQ ID NO: 157991 - DNA, 2250 bp, Artificial Sequence
  Description of Artificial Sequence: Synthetic coding sequence
atggaggtggtgcctgctgaggtgaacagcctgctgcctgaggagatcatggacaccggcatcaccctggtggatgatgacagcattgaagctgtgattgtgagcagccccatccccatggagacagagctggaggagatcgtgaacatcaacagcactggagacagcacagccacccccatcagcacagagcccatcaccgtgtacagcaaccacaccaaccaggtggccgtgaacaccaccatcaccaaggctgacagcaacaccaccgtgaagccagccttccccagcggcctgcagaagctgggcgcccagacccctgtgaccatcagcgccaaccagatcatcctgaacaaggtgtcccagaccagtgacctgaagctgggcaaccagaccctgaagccagatggccagaagctgatcctgaccaccctgggcaagagcggcagccccatcgtgctggccctgccccacagccagctgccccaggcccagaaggtgaccacccaggcccagagcggagatgccaagctgcccccccagcagatcaaggtggtgaccatcggcggccggcctgaggtgaagcctgtgattggagtgtctgccctgaccccaggcagccagctgatcaacaccaccacccagcccagcgtgctgcagacccagcagctgaagacagtgcagatcgccaagaagcccaggacccccaccagcggccctgtgatcaccaagctgatctttgccaagcccatcaacagcaaggctgtgacaggccagaccacccaggtgtccccacctgtgattgctggccgggtgctgagccagagcaccccaggcacccccagcaagaccatcaccatcagcgagagcggcgtgattggcagcaccctgaacagcaccacccagacccccaacaagatcgccatcagccccctgaagagccccaacaaggctgtgaagagcacagtgcagaccatcaccgtgggcggcgtgtccaccagccagttcaagaccatcatccccctggccacagccccaaatgtgcagcagatccaggtgcccggcagcaagttccactacgtgcggctggtgacagccaccagcgccagcagcagcacccagcctgtgtcccagaaccccagcaccaacacccagcccctgcagcaggccaagcctgtggtggtgaacaccacccctgtgaggatgtctgtgcccatcgtgtctgcccaggccgtgaagcaggtggtgcccaagcccatcaaccccaccagccagatcgtgaccaccagccagccccagcagaggctcatcatgcctgccacccccctgccccagatccagcccaacctgaccaacctgcccccaggcaccgtgctggccccagcccctggcactggaaatgtgggctatgctgtgctgcctgcccagtatgtgacccagctgcagcagagcagctatgtgtccatcgccagcaacagcaccttcaccggcaccagcggcatccagacccaggcccggctgcccttcaacggcatcatccccagcgagagcgccagccggcccaggaagccctgcaactgcaccaagagcctgtgcctgaagctgtactgtgactgctttgccaacggggagttctgcaacaactgcaactgcaccaactgctacaacaacctggagcatgaaaatgaaaggcagaaggccatcaaggcctgcctggacaggaaccctgaggccttcaagcccaagattggcaagggcaaggagggggagagtgacagaagacacagcaagggctgcaactgcaagaggagcggctgcctgaagaactactgtgagtgctatgaggccaagatcatgtgcagcagcatctgcaagtgcatcggctgcaagaactttgaggagagccctgagaggaagaccctgatgcacctggctgatgctgctgaggtgcgggtgcagcagcagacagctgccaagaccaagctgagcagccagatcagtgacctgctgacccggcccaccccagccctgaacagcggcggcggcaagctgcccttcacctttgtgaccaaggaggtggccgaggccacctgcaactgcctgctggcccaggccgagcaggccgacaagaagggcaagagcaaggctgctgctgagaggatgatcctggaggagtttggccgctgcctgatgtctgtcatcaacagcgctgggaaggccaagagtgacccctgtgccatgaactgctag

SEQ ID NO: 157992 - DNA, 732 bp, Artificial Sequence
  Description of Artificial Sequence: Synthetic coding sequence
atggaggtggtgcctgctgaggtgaacagcctgctgcctgaggagatcatggacaccggcatcaccctggtggatgatgacagcattgaagctgtgattgtgagcagccccatccccatggagacagagctggaggagatcgtgaacatcaacagcactggagacagcacagccacccccatcagcacagagcccatcaccgtgtacagcaaccacaccaaccaggtggccgtgaacaccaccatcaccaaggctgacagcaacaccaccgtgaagccagccttccccagcggcctgcagaagctgggcgcccagacccctgtgaccatcagcgccaaccagatcatcctgaacaaggtgtcccagaccagtgacctgaagctgggcaaccagaccctgaagccagatggccagaagctgatcctgaccaccctgggcaagagcggcagccccatcgtgctggccctgccccacagccagctgccccaggcccagaaggtgaccacccaggcccagagcggagatgccaagctgcccccccagcagatcaaggtggtgaccatcggcggccggcctgaggtgaagcctgtgattggagtgtctgccctgaccccaggcagccagctgatcaacaccaccacccagcccagcgtgctgcagacccagcagctgaagacagtgcaggtgggcttcttccacagcctgctgcctgagctgcaccagaggccctag

SEQ ID NO: 157993 - DNA, 1983 bp, Artificial Sequence
  Description of Artificial Sequence: Synthetic coding sequence
atggaggtggtgcctgctgaggtgaacagcctgctgcctgaggagatcatggacaccggcatcaccctggtggatgatgacagcattgaagctgtgattgtgagcagccccatccccatggagacagagctggaggagatcgtgaacatcaacagcactggagacagcacagccacccccatcagcacagagcccatcaccgtgtacagcaaccacaccaaccaggtggccgtgaacaccaccatcaccaaggctgacagcaacaccaccgtgaagccagccttccccagcggcctgcagaagctgggcgcccagacccctgtgaccatcagcgccaaccagatcatcctgaacaaggtgtcccagaccagtgacctgaagctgggcaaccagaccctgaagccagatggccagaagctgatcctgaccaccctgggcaagagcggcagccccatcgtgctggccctgccccacagccagctgccccaggcccagaaggtgaccacccaggcccagagcggagatgccaagctgcccccccagcagatcaaggtggtgaccatcggcggccggcctgaggtgaagcctgtgattggagtgtctgccctgaccccaggcagccagctgatcaacaccaccacccagcccagcgtgctgcagacccagcagctgaagacagtgcaggccgtgaagagcacagtgcagaccatcaccgtgggcggcgtgtccaccagccagttcaagaccatcatccccctggccacagcccccaacgtgcagcagatccaggtgcccggcagcaagttccactacgtgcggctggtgacagccaccagcgccagcagcagcacccagcctgtgtcccagaaccccagcaccaacacccagcccctgcagcaggccaagcctgtggtggtgaacaccacccctgtgaggatgtctgtgcccatcgtgtctgcccaggccgtgaagcaggtggtgcccaagcccatcaaccccaccagccagatcgtgaccaccagccagccccagcagaggctcatcatgcctgccacccccctgccccagatccagcccaacctgaccaacctgcccccaggcaccgtgctggccccagcccctggcactggaaatgtgggctatgctgtgctgcctgcccagtatgtgacccagctgcagcagagcagctatgtgtccatcgccagcaacagcaccttcaccggcaccagcggcatccagacccaggcccggctgcccttcaacggcatcatccccagcgagagcgccagccggcccaggaagccctgcaactgcaccaagagcctgtgcctgaagctgtactgtgactgctttgccaatggagagttctgcaacaactgcaactgcaccaactgctacaacaacctggagcatgaaaatgaaaggcagaaggccatcaaggcctgcctggacagaaatcctgaggccttcaagcccaagattggcaagggcaaggagggggagagtgaccggcggcacagcaagggctgcaactgcaagaggagcggctgcctgaagaactactgtgaatgttatgaggccaagatcatgtgcagcagcatctgcaagtgcatcggctgcaagaactttgaggagagccctgagaggaagaccctgatgcacctggctgatgctgctgaggtgcgggtgcagcagcagacagctgccaagaccaagctgagcagccagatcagtgacctgctgacccggcccaccccagccctgaacagcggcggcggcaagctgcccttcacctttgtgaccaaggaggtggccgaggccacctgcaactgcctgctggcccaggccgagcaggccgacaagaagggcaagagcaaggctgctgctgagaggatgatcctggaggagtttggccgctgcctgatgtctgtcatcaacagcgctgggaaggccaagagtgacccctgtgccatgaactgctag

SEQ ID NO: 157994 - DNA, 1587 bp, Artificial Sequence
  Description of Artificial Sequence: Synthetic coding sequence
atggaggtggtgcctgctgagatcgccaagaagcccaggacccccaccagcggccctgtgatcaccaagctgatctttgccaagcccatcaacagcaaggctgtgacaggccagaccacccaggtgagcccccctgtgattgctggccgggtgctgagccagagcaccccaggcacccccagcaagaccatcaccatcagcgagagcggggtcatcggcagcaccctgaacagcaccacccagacccccaacaagatcgccatcagccccctgaagagccccaacaaggctgtgaagagcacagtgcagaccatcaccgtgggcggcgtgtccaccagccagttcaagaccatcatccccctggccacagcccccaacgtgcagcagatccaggtgcccggcagcaagttccactacgtgcggctggtgacagccaccagcgccagcagcagcacccagcctgtgtcccagaaccccagcaccaacacccagcccctgcagcaggccaagcctgtggtggtgaacaccacccctgtgaggatgtctgtgcccatcgtgtctgcccaggccgtgaagcaggtggtgcccaagcccatcaaccccaccagccagatcgtgaccaccagccagccccagcagaggctcatcatgcctgccacccccctgccccagatccagcccaacctgaccaacctgcccccaggcaccgtgctggccccagcccctggcactggaaatgtgggctatgctgtgctgcctgcccagtatgtgacccagctgcagcagagcagctatgtgtccatcgccagcaacagcaccttcaccggcaccagcggcatccagacccaggcccggctgcccttcaacggcatcatccccagcgagagcgccagccggcccaggaagccctgcaactgcaccaagagcctgtgcctgaagctgtactgtgactgctttgccaatggagagttctgcaacaactgcaactgcaccaactgctacaacaacctggagcatgaaaatgaaaggcagaaggccatcaaggcctgcctggacagaaatcctgaggccttcaagcccaagattggcaagggcaaggagggggagagtgaccggcggcacagcaagggctgcaactgcaagaggagcggctgcctgaagaactactgtgaatgttatgaggccaagatcatgtgcagcagcatctgcaagtgcatcggctgcaagaactttgaggagagccctgagaggaagaccctgatgcacctggctgatgctgctgaggtgcgggtgcagcagcagacagctgccaagaccaagctgagcagccagatcagtgacctgctgacccggcccaccccagccctgaacagcggcggcggcaagctgcccttcacctttgtgaccaaggaggtggccgaggccacctgcaactgcctgctggcccaggccgagcaggccgacaagaagggcaagagcaaggctgctgctgagaggatgatcctggaggagtttggccgctgcctgatgtctgtcatcaacagcgctgggaaggccaagagtgacccctgtgccatgaactgctag

SEQ ID NO: 157995 - DNA, 1587 bp, Artificial Sequence; identical to SEQ ID NO: 157994
  Description of Artificial Sequence: Synthetic coding sequence

SEQ ID NO: 157996 - DNA, 2250 bp, Artificial Sequence; identical to SEQ ID NO: 157991
  Description of Artificial Sequence: Synthetic coding sequence

SEQ ID NO: 157997 - DNA, 1587 bp, Artificial Sequence; identical to SEQ ID NO: 157994
  Description of Artificial Sequence: Synthetic coding sequence

SEQ ID NO: 157998 - DNA, 2025 bp, Artificial Sequence
  Description of Artificial Sequence: Synthetic coding sequence
atgtggcatgaggccaggaagcatgagaggaagctgcggggcatgatggtggactacaagaagagagctgagcggcggcgggagtactatgagaagatcaagaaggaccctgcccagttcctgcaggtgcacggccgggcctgcaaggtgcacctggacagcgctgtggccctggccgctgagagccctgtgaacatgatgccctggcagggcgacaccaacaacatgattgacagatttgatgtgcgggcccacctggaccacatcccagactacaccccacccctgctgaccaccatcagccctgagcaggagagtgatgagaggaagtgcaactatgagcgctaccggggcctggtgcagaatgactttgctggcatcagcgaggagcagtgcctgtaccagatctacattgatgagctgtatggaggcctgcagaggccttctgaagatgagaagaagaagctggccgagaagaaggccagcatcggctacacctatgaggacagcacagtggccaaggtggagaaggctgctgagaagccagaggaggaggagagcgctgctgaggaggagagcaacagtgatgaagatgaggtgatcccagacattgatgtggaggtggatgtggatgagctgaaccaggagcaggtggccgacctgaacaagcaggccaccacctacggcatggctgatggagactttgtgaggatgctgaggaaggacaaggaggaggccgaggccatcaagcacgccaaggccctggaggaggagaaggccatgtacagcggcagaagaagccggcggcagaggcgggagttccgggagaagaggctgcggggcaggaagatcagcccccccagctatgcccggcgggacagccccacctatgacccctacaagaggagccccagcgagagcagcagcgagagccgcagccgcagccgcagccccaccccaggccgggaggagaagatcaccttcatcaccagctttggaggcagtgatgaggaggccgctgctgctgctgctgctgctgctgccagcggcgtgaccaccgggaagcccccagccccaccccagcccggcggccctgcccctggaagaaatgccagcgccaggagaagaagcagcagcagcagcagcagcagcagcgccagcaggaccagcagcagccgcagcagcagccgcagcagcagccgcagcagaagaggaggcggctactacagaagtggaagacatgcccggagccgcagccgctcctggagccgcagccgcagccgcagccgccgctacagccgcagccgcagccggggccgccgccacagcggcggcggcagcagagatggccaccgctacagccgcagccctgccaggagaggaggctacggccccaggagaagaagccgcagccgcagccacagcggggaccgctaccgccggggcggccggggcctgcggcaccacagcagcagccgcagccgcagctcctggagcctgagccccagccgcagccgcagcctgaccaggagccgcagccacagccccagccccagccagagccgcagccgcagccgcagccgcagccagagccccagccccagccctgcccgggagaagctgaccaggcctgctgccagccctgctgtgggggagaagctgaagaagacagagcctgctgctgggaaggagactggagctgccaagcccaagctgaccccccaggagaagctgaagctgaggatgcagaaggccctgaaccggcagttcaaggctgacaagaaggccgcccaggagaagatgatccagcaggagcacgagcggcaggagcgggaggatgagctgcgggccatggccaggaagatccgcatgaaggagcgggagcggcgggagaaggagcgggaggagtgggagcggcagtacagccggcagagccgcagccccagcccccgctacagccgggagtacagcagcagcagaagaagaagccgcagccgcagccgcagcccccactaccgccactag

SEQ ID NO: 157999 - DNA, 594 bp, Artificial Sequence
  Description of Artificial Sequence: Synthetic coding sequence
atggccgccctgggggagcctgtgcggctggagcgggacatctgccgggccatcgagctgctggagaagctgcagaggtctggagaggtgcccccccagaagctgcaggccctgcagagggtgctgcagagcgagttctgcaatgctgtgcgggaggtgtatgagcacgtgtatgagaccgtggacatcagcagcagccctgaggtgcgggccaatgccacagccaaggccaccgtggccgcctttgctgccagcgagggccacagccacccccgggtggtggagctgcccaagacagaggagggcctgggcttcaacatcatgggcggcaaggagcagaacagccccatctacatcagccgcatcatccctgggggcattgctgacagacatggaggcctgaagagaggagaccagctgctgtctgtgaatggagtgtctgtggagggggagcaccacgagaaggctgtggagctgctgaaggccgcccagggcaaggtgaagctggtggtgcgctacacccccaaggtgctggaggagatggagagcagatttgagaagatgaggtctgccaagaggcggcagcagacctag

SEQ ID NO: 158000 - DNA, 759 bp, Artificial Sequence
  Description of Artificial Sequence: Synthetic coding sequence
atggaggaggccatcctggtgccctgtgtgctgggcctgctgctgctgcccatcctggccatgctgatggccctgtgtgtgcactgccaccggctgcccggcagctatgacagcaccagcagtgacagcctgtacccccggggcatccagttcaagaggccccacacagtggccccctggcccccagcctacccacctgtgaccagctacccacccctgagccagcctgacctgctgcccatccccaggagcccccagccccggcgggacagtgatggagccaacagcgtggccagctatgaaaatgaaggagccagcggcatccggggggcccaggccggctggggcgtgtggggccccagctggacccggctgacccctgtgtccctgcccccagagcccgcctgtgaagatgctgatgaagatgaagatgactaccacaaccctggctacctggtggtgctgcctgacagcaccccagccaccagcacagctgcccccagcgccccagccctgagcaccccaggcatccgggacagcgccttctccatggagagcattgatgattatgtgaatgtgcctgagagcggggagagcgctgaggccagcctggatggcagccgggagtatgtgaatgtgtcccaggagctgcaccctggagctgccaagacagagcctgctgccctgagcagccaggaggccgaggaggtggaggaggagggcgccccagactatgagaacctgcaggagctgaactag

SEQ ID NO: 158001 - DNA, 789 bp, Artificial Sequence
  Description of Artificial Sequence: Synthetic coding sequence
atggaggaggccatcctggtgccctgtgtgctgggcctgctgctgctgcccatcctggccatgctgatggccctgtgtgtgcactgccaccggctgcccggcagctatgacagcaccagcagtgacagcctgtacccccggggcatccagttcaagaggccccacacagtggccccctggcccccagcctacccacctgtgaccagctacccacccctgagccagcctgacctgctgcccatccccaggagcccccagcccctgggcggcagccacaggacccccagcagccggcgggacagtgatggagccaacagcgtggccagctatgaaaatgaaggagccagcggcatccggggggcccaggccggctggggcgtgtggggccccagctggacccggctgacccctgtgtccctgcccccagagcccgcctgtgaagatgctgatgaagatgaagatgactaccacaaccctggctacctggtggtgctgcctgacagcaccccagccaccagcacagctgcccccagcgccccagccctgagcaccccaggcatccgggacagcgccttctccatggagagcattgatgattatgtgaatgtgcctgagagcggggagagcgctgaggccagcctggatggcagccgggagtatgtgaatgtgtcccaggagctgcaccctggagctgccaagacagagcctgctgccctgagcagccaggaggccgaggaggtggaggaggagggcgccccagactatgagaacctgcaggagctgaactag

SEQ ID NO: 158002 - DNA, 702 bp, Artificial Sequence
  Description of Artificial Sequence: Synthetic coding sequence
atggaggaggccatcctggtgccctgtgtgctgggcctgctgctgctgcccatcctggccatgctgatggccctgtgtgtgcactgccaccggctgcccggcagctatgacagcaccagcagtgacagcctgtacccccggggcatccagttcaagaggccccacacagtggccccctggcccccagcctacccacctgtgaccagctacccacccctgagccagcctgacctgctgcccatccccaggagcccccagcccctgggcggcagccacaggacccccagcagccggcgggacagtgatggagccaacagcgtggccagctatgaaaatgaggagcccgcctgtgaagatgctgatgaagatgaagatgactaccacaaccctggctacctggtggtgctgcctgacagcaccccagccaccagcacagctgcccccagcgccccagccctgagcaccccaggcatccgggacagcgccttctccatggagagcattgatgattatgtgaatgtgcctgagagcggggagagcgctgaggccagcctggatggcagccgggagtatgtgaatgtgtcccaggagctgcaccctggggccgccaagacagagcctgctgccctgagcagccaggaggccgaggaggtggaggaggagggcgccccagactatgagaacctgcaggagctgaactag

SEQ ID NO: 158003 - DNA, 810 bp, Artificial Sequence
  Description of Artificial Sequence: Synthetic coding sequence
atggaggccacagctgcctcctggcaggtggccgtgcctgtgctgggcggggccagccggcccctgggccccagaggagctgccagcctgctgcgggcccccctgcagatggaggaggccatcctggtgccctgtgtgctgggcctgctgctgctgcccatcctggccatgctgatggccctgtgtgtgcactgccaccggctgcccggcagctatgacagcaccagcagtgacagcctgtacccccggggcatccagttcaagaggccccacacagtggccccctggcccccagcctacccacctgtgaccagctacccacccctgagccagcctgacctgctgcccatccccaggagcccccagcccctgggcggcagccacaggacccccagcagccggcgggacagtgatggagccaacagcgtggccagctatgaaaatgaggagcccgcctgtgaagatgctgatgaagatgaagatgactaccacaaccctggctacctggtggtgctgcctgacagcaccccagccaccagcacagctgcccccagcgccccagccctgagcaccccaggcatccgggacagcgccttctccatggagagcattgatgattatgtgaatgtgcctgagagcggggagagcgctgaggccagcctggatggcagccgggagtatgtgaatgtgtcccaggagctgcaccctggggccgccaagacagagcctgctgccctgagcagccaggaggccgaggaggtggaggaggagggcgccccagactatgagaacctgcaggagctgaactag

SEQ ID NO: 158004 - DNA, 699 bp, Artificial Sequence
  Description of Artificial Sequence: Synthetic coding sequence
atggaggaggccatcctggtgccctgtgtgctgggcctgctgctgctgcccatcctggccatgctgatggccctgtgtgtgcactgccaccggctgcccggcagctatgacagcaccagcagtgacagcctgtacccccggggcatccagttcaagaggccccacacagtggccccctggcccccagcctacccacctgtgaccagctacccacccctgagccagcctgacctgctgcccatccccagcccccagcccctgggcggcagccacaggacccccagcagcagaagagacagtgatggagccaacagcgtggccagctatgaaaatgaggagcccgcctgtgaagatgctgatgaagatgaagatgactaccacaaccctggctacctggtggtgctgcctgacagcaccccagccaccagcacagctgcccccagcgccccagccctgagcaccccaggcatccgggacagcgccttctccatggagagcattgatgattatgtgaatgtgcctgagagcggggagagcgctgaggccagcctggatggcagccgggagtatgtgaatgtgtcccaggagctgcaccctggagctgccaagacagagcctgctgccctgagcagccaggaggccgaggaggtggaggaggagggcgccccagactatgagaacctgcaggagctgaactag

SEQ ID NO: 158005 - DNA, 732 bp, Artificial Sequence
  Description of Artificial Sequence: Synthetic coding sequence
atgagcagcggcacagagctgctgtggccaggggccgccctgctggtgctgctgggcgtggccgccagcctgtgtgtgcgctgcagcaggcctggggccaagaggtctgagaagatctaccagcagaggagcctgcgggaggaccagcagagcttcaccggcagcaggacctacagcctggtgggccaggcctggccaggccccctggccgacatggcccccaccaggaaggacaagctgctgcagttctaccccagcctggaggaccctgccagcagccgctaccagaacttcagcaagggcagccgccacggcagcgaggaggcctacatcgaccccatcgccatggagtactacaactggggccgcttcagcaagcccccagaagatgatgatgccaacagctatgaaaatgtgctgatctgcaagcagaagaccacagaaacaggagcccagcaggagggcatcggcggcctgtgccgcggggacctgagcctgagcctggccctgaagacaggccccaccagcggcctgtgccccagcgccagccctgaggaggatgaggagagcgaggactaccagaacagcgccagcatccaccagtggagggagagcaggaaggtgatgggccagctgcagcgggaggccagccctggccctgtgggcagcccagatgaagaagatggagagccagactatgtgaatggagaggtggccgccacagaggcctag

SEQ ID NO: 158006 - DNA, 732 bp, Artificial Sequence; identical to SEQ ID NO: 158005
  Description of Artificial Sequence: Synthetic coding sequence

SEQ ID NO: 158007 - DNA, 195 bp, Artificial Sequence
  Description of Artificial Sequence: Synthetic coding sequence
atgagcagcggcacagagctgctgtggccaggggccgccctgctggtgctgctgggcgtggccgccagcctgtgtgtgcgctgcagcaggcctggggccaagaggtctgagaagatctaccagcagaggagcctgcgggaggaccagcagagcttcaccggcagcaggacctacagcctggtgggccaggcctag

SEQ ID NO: 158008 - DNA, 732 bp, Artificial Sequence; identical to SEQ ID NO: 158005
  Description of Artificial Sequence: Synthetic coding sequence

SEQ ID NO: 158009 - DNA, 732 bp, Artificial Sequence; identical to SEQ ID NO: 158005
  Description of Artificial Sequence: Synthetic coding sequence

SEQ ID NO: 158010 - DNA, 177 bp, Artificial Sequence
  Description of Artificial Sequence: Synthetic coding sequence
atgagcagcggcacagagctgctgtggccaggggccgccctgctggtgctgctgggcgtggccgccagcctgtgtgtgcgctgcagcaggcctggggccaagaggtctgagaagatctaccagcagaggagcctgcgggaggaccagcagagcttcaccggcagcaggacctactag

SEQ ID NO: 158011 - DNA, 303 bp, Artificial Sequence
  Description of Artificial Sequence: Synthetic coding sequence
atgagcagcggcacagagctgctgtggccaggggccgccctgctggtgctgctgggcgtggccgccagcctgtgtgtgcgctgcagcaggcctggggccaagaggtctgagaagatctaccagcagaggagcctgcgggaggaccagcagagcttcaccggcagcaggacctacagcctggtgggccaggcctggccaggccccctggccgacatggcccccaccaggaaggacaagctgctgcagttctaccccagcctggaggaccctgccagcagccgctaccagaacttcagcaagtag

SEQ ID NO: 158012 - DNA, 1704 bp, Artificial Sequence
  Description of Artificial Sequence: Synthetic coding sequence
atgaggccagacagccccaccatggccgccccagctgagagcctgcggcggaggaagacaggctacagcgaccctgagcctgagagccccccagcccctggccggggccctgctggcagccctgcccacctgcacacaggcaccttctggctgacccgcatcgtgctgctgaaggccctggcctttgtgtactttgtggccttcctggtggccttccaccagaacaagcagctgattggagaccggggcctgctgccctgcagggtcttcctgaagaacttccagcagtacttccaggacaggacctcctgggaggtgttctcctacatgcccaccatcctgtggctgatggactggagcgacatgaacagcaacctggacctgctggccctgctgggcctgggcatcagcagctttgtgctgatcaccggctgtgccaacatgctgctgatggccgccctgtggggcctgtacatgagcctggtgaatgtgggccacgtgtggtacagctttggctgggagagccagctgctggagaccggcttcctgggcatcttcctgtgccccctgtggaccctgagccggctgccccagcacacccccaccagcagaattgtgctgtggggcttccgctggctgatcttccgcatcatgctgggcgccggcctcatcaagatccggggggaccgctgctggagggacctgacctgcatggacttccactatgagacccagcccatgcccaaccctgtggcctactacctgcaccacagcccctggtggttccacagatttgagaccctgagcaaccacttcatcgagctgctggtgcccttcttcctgttcctgggcagaagagcctgcatcatccatggagtgctgcagatcctcttccaggccgtgctgattgtgtctggcaacctgtccttcctgaactggctgaccatggtgcccagcctggcctgctttgatgatgccaccctgggcttcctgttccccagcggccctggcagcctgaaggacagagtgctgcagatgcagagggacatccggggggcccggcctgagcccaggtttggatctgtggtgcggcgggccgccaacgtgtccctgggcgtgctgctggcctggctgtctgtgcctgtggtgctgaacctgctgagcagccggcaggtgatgaacacccacttcaacagcctgcacatcgtgaacacctacggggccttcggcagcatcaccaaggagagagctgaggtgatcctgcagggcacagccagcagcaatgccagcgccccagatgccatgtgggaggactatgagttcaagtgcaagccaggggaccccagccggcggccctgcctgatcagcccctaccactaccgcctggactggctgatgtggtttgctgccttccagacctatgagcacaatgactggatcatccacctggccggcaagctgctggccagtgatgctgaggccctgagcctgctggcccacaacccctttgctggccggcccccaccccgctgggtgcggggggagcactaccgctacaagttcagcaggcctgggggcagacatgctgctgagggcaagtggtgggtgaggaagagaattggagcctacttcccccccctgagcctggaggagctgcggccctacttccgggaccggggctggcccctgcccggccccctgtag

SEQ ID NO: 158013 - DNA, 1704 bp, Artificial Sequence
  Description of Artificial Sequence: Synthetic coding sequence
atgaggccagacagccccaccatggccgccccagctgagagcctgcggcggaggaagacaggctacagcgaccctgagcctgagagccccccagcccctggccggggccctgctggcagccctgcccacctgcacacaggcaccttctggctgacccgcatcgtgctgctgaaggccctggcctttgtgtactttgtggccttcctggtggccttccaccagaacaagcagctgattggagaccggggcctgctgccctgcagggtcttcctgaagaacttccagcagtacttccaggacaggacctcctgggaggtgttctcctacatgcccaccatcctgtggctgatggactggagcgacatgaacagcaacctggacctgctggccctgctgggcctgggcatcagcagctttgtgctgatcaccggctgtgccaacatgctgctgatggccgccctgtggggcctgtacatgagcctggtgaatgtgggccacgtgtggtacagcttccgctgggagagccagctgctggagaccggcttcctgggcatcttcctgtgccccctgtggaccctgagccggctgccccagcacacccccaccagcagaattgtgctgtggggcttccgctggctgatcttccgcatcatgctgggcgccggcctcatcaagatccggggggaccgctgctggagggacctgacctgcatggacttccactatgagacccagcccatgcccaaccctgtggcctactacctgcaccacagcccctggtggttccacagatttgagaccctgagcaaccacttcatcgagctgctggtgcccttcttcctgttcctgggcagaagagcctgcatcatccatggagtgctgcagatcctcttccaggccgtgctgattgtgtctggcaacctgtccttcctgaactggctgaccatggtgcccagcctggcctgctttgatgatgccaccctgggcttcctgttccccagcggccctggcagcctgaaggacagagtgctgcagatgcagagggacatccggggggcccggcctgagcccaggtttggatctgtggtgcggcgggccgccaacgtgtccctgggcgtgctgctggcctggctgtctgtgcctgtggtgctgaacctgctgagcagccggcaggtgatgaacacccacttcaacagcctgcacatcgtgaacacctacggggccttcggcagcatcaccaaggagagagctgaggtgatcctgcagggcacagccagcagcaatgccagcgccccagatgccatgtgggaggactatgagttcaagtgcaagccaggggaccccagccggcggccctgcctgatcagcccctaccactaccgcctggactggctgatgtggtttgctgccttccagacctatgagcacaatgactggatcatccacctggccggcaagctgctggccagtgatgctgaggccctgagcctgctggcccacaacccctttgctggccggcccccaccccgctgggtgcggggggagcactaccgctacaagttcagcaggcctgggggcagacatgctgctgagggcaagtggtgggtgaggaagagaattggagcctacttcccccccctgagcctggaggagctgcggccctacttccgggaccggggctggcccctgcccggccccctgtag

SEQ ID NO: 158014 - DNA, 558 bp, Artificial Sequence
  Description of Artificial Sequence: Synthetic coding sequence
atgaggccagacagccccaccatggccgccccagctgagagcctgcggcggaggaagacaggctacagcgaccctgagcctgagagccccccagcccctggccggggccctgctggcagccctgcccacctgcacacaggcaccttctggctgacccgcatcgtgctgctgaaggccctggcctttgtgtactttgtggccttcctggtggccttccaccagaacaagcagctgattggagaccggggcctgctgccctgcagggtcttcctgaagaacttccagcagtacttccaggacaggacctcctgggaggtgttctcctacatgcccaccatcctgtggctgatggactggagcgacatgaacagcaacctggacctgctggccctgctgggcctgggcatcagcagctttgtgctgatcaccggctgtgccaacatgctgctgatggccgccctgtggggcctgtacatgagcctggtgaatgtgggccacgtgtggtgccccagcctggccagcgccatcagcctgcccagcatgcacggcggccagtag

SEQ ID NO: 158015 - DNA, 501 bp, Artificial Sequence
  Description of Artificial Sequence: Synthetic coding sequence
atggccgccccagctgagagcctgcggcggaggaagacaggctacagcgaccctgagcctgagagccccccagcccctggccggggccctgctggcagccctgcccacctgcacacaggcaccttctggctgaccagaattgtgctgctgaaggccctggcctttgtgtactttgtggccttcctggtggccttccaccagaacaagcagctgattggagaccggggcctgctgccctgcagggtcttcctgaagaacttccagcagtacttccaggacaggacctcctgggaggtgttctcctacatgcccaccatcctgtggctgatggactggagcgacatgaacagcaacctggacctgctggccctgctgggcctgggcatcagcagctttgtgctgatcaccggctgtgccaacatgctgctgatggccgccctgtggggcctgtacatgagcctggtgaatgtgggccacgtgtggtacagctttgggaagtag

SEQ ID NO: 158016 - DNA, 1053 bp, Artificial Sequence
  Description of Artificial Sequence: Synthetic coding sequence
atgagaggagctggcctcatcaagatccggggggaccgctgctggagggacctgacctgcatggacttccactatgagacccagcccatgcccaaccctgtggcctactacctgcaccacagcccctggtggttccacagatttgagaccctgagcaaccacttcatcgagctgctggtgcccttcttcctgttcctgggccggcgggcctgcatcatccacggcgtgctgcagatcctcttccaggccgtgctgattgtgtctggcaacctgtccttcctgaactggctgaccatggtgcccagcctggcctgctttgatgatgccaccctgggcttcctgttccccagcggccctggcagcctgaaggacagagtgctgcagatgcagagggacatccggggggcccggcctgagccccgcttcggctctgtggtgagaagagctgccaacgtgtccctgggcgtgctgctggcctggctgtctgtgcctgtggtgctgaacctgctgagcagccggcaggtgatgaacacccacttcaacagcctgcacatcgtgaacacctatggagccttcggcagcatcaccaaggagcgggcagaggtgatcctgcagggcacagccagcagcaatgccagcgccccagatgccatgtgggaggactatgagttcaagtgcaagccaggggaccccagcagaagaccctgcctgatcagcccctaccactaccgcctggactggctgatgtggtttgctgccttccagacctatgagcacaatgactggatcatccacctggccggcaagctgctggccagtgatgctgaggccctgagcctgctggcccacaacccctttgctggccggcccccaccccgctgggtgcggggggagcactaccgctacaagttcagcaggcctgggggcagacatgctgctgagggcaagtggtgggtgaggaagagaattggagcctacttcccccccctgagcctggaggagctgcggccctacttccgggaccggggctggcccctgcccggccccctgtag

SEQ ID NO: 158017 - DNA, 993 bp, Artificial Sequence
  Description of Artificial Sequence: Synthetic coding sequence
atggacttccactatgagacccagcccatgcccaaccctgtggcctactacctgcaccacagcccctggtggttccacagatttgagaccctgagcaaccacttcatcgagctgctggtgcccttcttcctgttcctgggccggcgggcctgcatcatccacggcgtgctgcagatcctcttccaggccgtgctgattgtgtctggcaacctgtccttcctgaactggctgaccatggtgcccagcctggcctgctttgatgatgccaccctgggcttcctgttccccagcggccctggcagcctgaaggacagagtgctgcagatgcagagggacatccggggggcccggcctgagccccgcttcggctctgtggtgagaagagctgccaacgtgtccctgggcgtgctgctggcctggctgtctgtgcctgtggtgctgaacctgctgagcagccggcaggtgatgaacacccacttcaacagcctgcacatcgtgaacacctatggagccttcggcagcatcaccaaggagcgggcagaggtgatcctgcagggcacagccagcagcaatgccagcgccccagatgccatgtgggaggactatgagttcaagtgcaagccaggggaccccagcagaagaccctgcctgatcagcccctaccactaccgcctggactggctgatgtggtttgctgccttccagacctatgagcacaatgactggatcatccacctggccggcaagctgctggccagtgatgctgaggccctgagcctgctggcccacaacccctttgctggccggcccccaccccgctgggtgcggggggagcactaccgctacaagttcagcaggcctgggggcagacatgctgctgagggcaagtggtgggtgaggaagagaattggagcctacttcccccccctgagcctggaggagctgcggccctacttccgggaccggggctggcccctgcccggccccctgtag

SEQ ID NO: 158018 - DNA, 792 bp, Artificial Sequence
  Description of Artificial Sequence: Synthetic coding sequence
atgcccaaccctgtggcctactacctgcaccacagcccctggtggttccacagatttgagaccctgagcaaccacttcatcgagctgctggtgcccttcttcctgttcctgggcagaagagcctgcatcatccatggagtgctgcagatcctcttccaggccgtgctgattgtgtctggcaacctgtccttcctgaactggctgaccatggtgcccagcctggcctgctttgatgatgccaccctgggcttcctgttccccagcggccctggcagcctgaaggacagagtgctgcagatgcagagggacatccggggggcccggcctgagcccaggtttggatctgtggtgcggcgggccgccaacgtgtccctgggcgtgctgctggcctggctgtctgtgcctgtggtgctgaacctgctgagcagccggcaggtgatgaacacccacttcaacagcctgcacatcgtgaacacctacggggccttcggcagcatcaccaaggagagagctgaggtgatcctgcagggcacagccagcagcaatgccagcgccccagatgccatgtgggaggactatgagttcaagtgcaagccaggggaccccagccggcggccctgcctgatcagcccctaccactaccgcctggactggctgatgtggtttgctgccttccagacctatgagcacaatgactggatcatccacctggccggcaagctgctggccagtgatgctgaggccctgagcctgctggcccacaacccctttgctggccggcccccaccctag

SEQ ID NO: 158019 - DNA, 1503 bp, Artificial Sequence
  Description of Artificial Sequence: Synthetic coding sequence
atgagcaacagcgtgcccctgctgtgcttctggagcctgtgctactgctttgctgctggcagccctgtgccctttggacctgagggccgcctggaggacaagctgcacaagcccaaggccacccagacagaggtgaagcccagcgtgcgcttcaacctgcggaccagcaaggaccctgagcacgagggctgctacctgtctgtgggccacagccagcccctggaggactgcagcttcaacatgacagccaagaccttcttcatcatccacggctggaccatgagcggcatctttgagaactggctgcacaagctggtgtctgccctgcacacccgggagaaggatgccaacgtggtggtggtggactggctgcccctggcccaccagctgtacacagatgctgtgaacaacaccagggtggtgggccacagcatcgccaggatgctggactggctgcaggagaaggatgacttcagcctgggcaatgtgcacctgattggctacagcctgggcgcccacgtggccggctacgccggcaactttgtgaagggcaccgtgggccgcatcaccggcctggaccctgctggccccatgtttgaaggagctgacatccacaagaggctgagcccagatgatgctgactttgtggatgtgctgcacacctacaccaggagctttggcctgagcatcggcatccagatgcctgtgggccacatcgacatctaccccaacggcggggacttccagcccggctgcggcctgaatgatgtgctgggcagcatcgcctacggcaccatcacagaggtggtgaagtgtgagcacgagagagctgtgcacctgtttgtggacagcctggtgaaccaggacaagcccagctttgccttccagtgcacagacagcaaccgcttcaagaagggcatctgcctgagctgcaggaagaaccgctgcaacagcatcggctacaatgccaagaagatgaggaacaagaggaacagcaagatgtacctgaagacccgggccggcatgcccttccgggtgtaccactaccagatgaagatccacgtgttctcctacaagaacatgggagaaattgagcccaccttctacgtgaccctgtatggcaccaatgctgacagccagaccctgcccctggagatcgtggagcgcatcgagcagaatgccaccaacaccttcctggtgtacacagaggaggacctgggggacctgctgaagatccagctgacctgggagggcgccagccagagctggtacaacctgtggaaggagttccgcagctacctgagccagcccaggaaccctggccgggagctgaacatccgccgcatccgggtgaagtctggagagacccagaggaagctgaccttctgcacagaagatcctgagaacaccagcatcagccctggccgggagctgtggttcaggaagtgcagagatggctggaggatgaagaatgagaccagccccaccgtggagctgccctag

SEQ ID NO: 158020 - DNA, 1281 bp, Artificial Sequence
  Description of Artificial Sequence: Synthetic coding sequence
atgagcaacagcgtgcccctgctgtgcttctggagcctgtgctactgctttgctgctggcagccctgtgccctttggacctgagggccgcctggaggacaagctgcacaagcccaaggccacccagacagaggtgaagcccagcgtgcgcttcaacctgcggaccagcaaggaccctgagcacgagggctgctacctgtctgtgggccacagccagcccctggaggactgcagcttcaacatgacagccaagaccttcttcatcatccacggctggaccatgagcggcatctttgagaactggctgcacaagctggtgtctgccctgcacacccgggagaaggatgccaacgtggtggtggtggactggctgcccctggcccaccagctgtacacagatgctgtgaacaacaccagggtggtgggccacagcatcgccaggatgctggactggctgcaggagaaggatgacttcagcctgggcaatgtgcacctgattggctacagcctgggcgcccacgtggccggctacgccggcaactttgtgaagggcaccgtgggccgcatcacagccatcacagaggtggtgaagtgtgagcacgagagagctgtgcacctgtttgtggacagcctggtgaaccaggacaagcccagctttgccttccagtgcacagacagcaaccgcttcaagaagggcatctgcctgagctgcaggaagaaccgctgcaacagcatcggctacaatgccaagaagatgaggaacaagaggaacagcaagatgtacctgaagacccgggccggcatgcccttccgggtgtaccactaccagatgaagatccacgtgttctcctacaagaacatgggagaaattgagcccaccttctacgtgaccctgtatggcaccaatgctgacagccagaccctgcccctggagatcgtggagcgcatcgagcagaatgccaccaacaccttcctggtgtacacagaggaggacctgggggacctgctgaagatccagctgacctgggagggcgccagccagagctggtacaacctgtggaaggagttccgcagctacctgagccagcccaggaaccctggccgggagctgaacatccgccgcatccgggtgaagtctggagagacccagaggaagctgaccttctgcacagaagatcctgagaacaccagcatcagccctggccgggagctgtggttcaggaagtgcagagatggctggaggatgaagaatgagaccagccccaccgtggagctgccctag

SEQ ID NO: 158021 - DNA, 1101 bp, Artificial Sequence
  Description of Artificial Sequence: Synthetic coding sequence
atgaacatcagccagatcatctcctactggggctacccagatgaggagtatgacatcgtgacagaagatggctacatcctgggcctgtaccgcatcccctactggaggacagacaacaacaagaacctggcccagagggtggtggtgtacctgcagcacggcctgctgaccagcgccagctcctggatcagcaacctgcccaacaacagcctgggcttcatcctggctgatgctggctatgatgtgtggatgggcaacagccggggcaacacctggagcaggaagcacctgtacctggagaccagcagcaaggagttctgggccttctcctttgatgagatggccaagtatgacctgcctgccagcattgacttcaccgtgaagcagacccggcaggaggagatcttctacgtgggccacagccagggcaccaccatcggcttcatcaccttcagcaccatcagcaagattgctgagcgcatcaagatcttctttgccctggcccctgtgttcagcaccaagtacctgaagagccccctcatccgcatgacctacaagtggaagagcatcgtgatggccttcagcggcaacaaggacttcctgcccaagaccagcttcaagaagttcatcggcagcaagctgtgccccctgcagatctttgacaagatctgcctgaacatcctcttcatgatgtttggctatgaccccaagaacctgaacatgagccggctggatgtgtacttcagccacaacccagctggcacctctgtgcagaacatgctgcactggagccagctgctgaacagcacccacctgaaggcctatgactggggcagcccagacctgaacctggtgcactacaaccagaccaccagccccctgtacaacatgaccaacatgaatgtggccacagccatctggaatggcaagagtgacctgctggccgaccctgaagatgtgaacatcctgcacagcgagatcaccaaccacatctactacaagaccatctcctactacaaccacatcgacagcctgtttggcctggatgtgtatgaccaggtgtaccacgagatcatcgacatcatccaggacaacctgtag

SEQ ID NO: 158022 - DNA, 1200 bp, Artificial Sequence
  Description of Artificial Sequence: Synthetic coding sequence
atgtggcagctgctggccgccgcctgctggatgctgctgctgggctccatgtatggctatgacaagaagggcaacaatgccaaccctgaggccaacatgaacatcagccagatcatctcctactggggctacccctatgaggagtatgatgtgaccaccaaggatggctacatcctgggcatctaccgcatcccccacggccggggctgccccggccgcacagcccccaagccagctgtgtacctgcagcacggcctgattgccagcgccagcaactggatctgcaacctgcccaacaacagcctggccttcctgctggccgacagcggctatgatgtgtggctgggcaacagccggggcaacacctggagcaggaagcacctgaagctgagccccaagagccctgagtactgggccttcagcctggatgagatggccaagtatgacctgcctgccaccatcaacttcatcatcgagaagacaggccagaagaggctgtactacgtgggccacagccagggcaccaccatcgccttcatcgccttcagcaccaaccctgagctggccaagaagatcaagatcttctttgccctggcccctgtggtgacagtgaagtacacccagagccccatgaagaagctgaccaccctgagcagaagagtggtgaaggtgctgtttggagacaagatgttccacccccacaccctgtttgaccagttcatcgccaccaaggtgtgcaacaggaagctgttccgccgcatctgcagcaacttcctgttcaccctgagcggctttgacccccagaacctgaacatgagccggctggatgtgtacctgagccacaacccagctggcacctctgtgcagaacatgctgcactgggcccaggccgtgaacagcggccagctgcaggcctttgactggggcaacagcgaccagaacatgatgcacttccaccagctgaccccacccctgtacaacatcaccaagatggaggtgcccacagccatctggaatggaggccaggacatcgtggccgaccccaaggatgtggagaacctgctgccccagatcgccaacctgatctactacaagctgatcccccactacaaccacgtggacttctacctgggagaagatgccccccaggagatctaccaggacctgatcatcctgatggaggagtacctgcagaactag

SEQ ID NO: 158023 - DNA, 1272 bp, Artificial Sequence
  Description of Artificial Sequence: Synthetic coding sequence
atgctggagaccctgagccggcagtggatcgtgagccacaggatggagatgtggctgctgatcctggtggcctacatgttccagagaaatgtgaacagcgtgcacatgcccaccaaggctgtggaccctgaggccttcatgaacatcagcgagatcatccagcaccagggctacccctgtgaggagtatgaggtggccacagaagatggctacatcctgtctgtgaaccgcatcccccggggcctggtgcagcccaagaagacaggcagcaggcctgtggtgctgctgcagcacggcctggtgggcggggccagcaactggatcagcaacctgcccaacaacagcctgggcttcatcctggctgatgctggctttgatgtgtggatgggcaacagcagaggaaatgcctggagcaggaagcacaagaccctgagcattgaccaggatgagttctgggccttctcctatgatgagatggccaggtttgacctgcctgctgtgatcaacttcatcctgcagaagacaggccaggagaagatctactacgtgggctacagccagggcaccaccatgggcttcatcgccttcagcaccatgcctgagctggcccagaagatcaagatgtactttgccctggcccccatcgccaccgtgaagcacgccaagagccctggcaccaagttcctgctgctgcctgacatgatgatcaagggcctgtttgggaagaaggagttcctgtaccagacccgcttcctgcggcagctggtgatctacctgtgtggccaggtgatcctggaccagatctgcagcaacatcatgctgctgctgggcggcttcaacaccaacaacatgaacatgagccgggcctctgtgtatgctgcccacaccctggccggcacctctgtgcagaacatcctgcactggagccaggccgtgaacagcggggagctgcgggcctttgactggggcagcgagaccaagaacctggagaagtgcaaccagcccacccctgtgcgctacagagtgcgggacatgacagtgcccacagccatgtggacaggaggccaggactggctgagcaacccagaagatgtgaagatgctgctgtctgaggtgaccaacctgatctaccacaagaacatccctgagtgggcccacgtggacttcatctggggcctggatgccccccacaggatgtacaatgagatcatccacctgatgcagcaggaggagaccaacctgagccagggccgctgtgaggccgtgctgtag

SEQ ID NO: 158024 - DNA, 1152 bp, Artificial Sequence
  Description of Artificial Sequence: Synthetic coding sequence
atgacccggcccctggacaggaagcagagcgagatcatccagcaccagggctacccctgtgaggagtatgaggtggccacagaagatggctacatcctgtctgtgaaccgcatcccccggggcctggtgcagcccaagaagacaggcagcaggcctgtggtgctgctgcagcacggcctggtgggcggggccagcaactggatcagcaacctgcccaacaacagcctgggcttcatcctggctgatgctggctttgatgtgtggatgggcaacagcagaggaaatgcctggagcaggaagcacaagaccctgagcattgaccaggatgagttctgggccttctcctatgatgagatggccaggtttgacctgcctgctgtgatcaacttcatcctgcagaagacaggccaggagaagatctactacgtgggctacagccagggcaccaccatgggcttcatcgccttcagcaccatgcctgagctggcccagaagatcaagatgtactttgccctggcccccatcgccaccgtgaagcacgccaagagccctggcaccaagttcctgctgctgcctgacatgatgatcaagggcctgtttgggaagaaggagttcctgtaccagacccgcttcctgcggcagctggtgatctacctgtgtggccaggtgatcctggaccagatctgcagcaacatcatgctgctgctgggcggcttcaacaccaacaacatgaacatgagccgggcctctgtgtatgctgcccacaccctggccggcacctctgtgcagaacatcctgcactggagccaggccgtgaacagcggggagctgcgggcctttgactggggcagcgagaccaagaacctggagaagtgcaaccagcccacccctgtgcgctacagagtgcgggacatgacagtgcccacagccatgtggacaggaggccaggactggctgagcaacccagaagatgtgaagatgctgctgtctgaggtgaccaacctgatctaccacaagaacatccctgagtgggcccacgtggacttcatctggggcctggatgccccccacaggatgtacaatgagatcatccacctgatgcagcaggaggagaccaacctgagccagggccgctgtgaggccgtgctgtag

SEQ ID NO: 158025 - DNA, 1197 bp, Artificial Sequence
  Description of Artificial Sequence: Synthetic coding sequence
atgatgtggctgctgctgaccaccacctgcctgatctgtggcaccctgaatgctgggggcttcctggacctggagaatgaggtgaaccctgaggtgtggatgaacaccagcgagatcatcatctacaacggctaccccagcgaggagtatgaggtgaccacagaagatggctacatcctgctggtgaaccgcatcccctacggccgcacccacgcccggagcacaggccccaggcctgtggtgtacatgcagcacgccctgtttgctgacaatgcctactggctggagaactatgccaacggcagcctgggcttcctgctggctgatgctggctatgatgtgtggatgggcaacagccggggcaacacctggagccgccgccacaagaccctgtctgaaacagatgagaagttctgggccttctcctttgatgagatggccaagtatgacctgcccggggtgattgacttcatcgtgaacaagacaggccaggagaagctgtacttcatcggccacagcctgggcaccaccatcggctttgtggccttcagcaccatgcctgagctggcccagaggatcaagatgaactttgccctgggccccaccatctccttcaagtaccccaccggcatcttcacccgcttcttcctgctgcccaacagcatcatcaaggctgtgtttggcaccaagggcttcttcctggaggacaagaagaccaagatcgccagcaccaagatctgcaacaacaagatcctgtggctgatctgcagcgagttcatgagcctgtgggccggcagcaacaagaagaacatgaaccagagcaggatggatgtgtacatgagccacgcccccaccggcagctctgtgcacaacatcctgcacatcaagcagctgtaccacagtgatgagttccgggcctatgactggggcaatgatgctgacaacatgaagcactacaaccagagccacccccccatctatgacctgacagccatgaaggtgcccacagccatctgggccggcggccatgatgtgctggtgaccccccaggatgtggcccgcatcctgccccagatcaagagcctgcactacttcaagctgctgcctgactggaaccactttgattttgtgtggggcctggatgccccccagaggatgtacagcgagatcatcgccctgatgaaggcctacagctag

SEQ ID NO: 158026 - DNA, 1500 bp, Artificial Sequence
  Description of Artificial Sequence: Synthetic coding sequence
atggacaccagccccctgtgcttcagcatcctgctggtgctgtgcatcttcatccagagcagcgccctgggccagagcctgaagccagagcccttcggccggcgggcccaggccgtggagaccaacaagaccctgcacgagatgaagacccgcttcctgctgtttggagagaccaaccagggctgccagatccgcatcaaccacccagacaccctgcaggagtgtggcttcaacagcagcctgcccctggtgatgatcatccacggctggagcgtggatggagtgctggagaactggatctggcagatggtggccgccctgaagagccagcctgcccagcctgtgaatgtgggcctggtggactggatcaccctggcccatgaccactacaccatcgctgtgaggaacacccggctggtgggcaaggaggtggccgccctgctgcgctggctggaggagagcgtgcagctgagccgcagccacgtgcacctgattggctacagcctgggcgcccacgtgtctggctttgctggcagcagcattggaggcacccacaagattggccgcatcaccggcctggatgctgctggccccctgtttgagggcagcgcccccagcaaccggctgagcccagatgatgccaactttgtggatgccatccacaccttcacccgggagcacatgggcctgtctgtgggcatcaagcagcccatcggccactatgacttctaccccaacggcggcagcttccagcccggctgccacttcctggagctgtaccgccacatcgcccagcacggcttcaatgccatcacccagaccatcaagtgcagccatgagaggtctgtgcacctgttcatcgacagcctgctgcatgctggcacccagagcatggcctacccctgtggggacatgaacagcttcagccagggcctgtgcctgagctgcaagaagggccgctgcaacaccctgggctaccacgtgcggcaggagcccaggagcaagagcaagaggctcttcctggtgacccgggcccagagccccttcaaggtgtaccactaccagttcaagatccagttcatcaaccagacagagacccccatccagaccaccttcaccatgagcctgctgggcaccaaggagaagatgcagaagatccccatcaccctgggcaagggcatcgccagcaacaagacctacagcttcctgatcaccctggatgtggacatcggggagctgatcatgatcaagttcaagtgggagaacagcgctgtgtgggccaacgtgtgggacacagtgcagaccatcatcccctggagcacaggccccaggcacagcggcctggtgctgaagaccatccgggtgaaggccggggagacccagcagaggatgaccttctgcagtgaaaatacagatgacctgctgctgcggcccacccaggagaagatctttgtgaagtgtgagatcaagagcaagaccagcaagaggaagatcagatag

SEQ ID NO: 158027 - DNA, 1500 bp, Artificial Sequence; identical to SEQ ID NO: 158026
  Description of Artificial Sequence: Synthetic coding sequence

SEQ ID NO: 158028 - DNA, 3231 bp, Artificial Sequence
  Description of Artificial Sequence: Synthetic coding sequence
atggagcccggcagcaagtctgtgtccagaagtgactggcagcctgagccccaccagaggcccatcacccccctggagcccggccctgagaagacccccatcgcccagcctgagagcaagaccctgcagggcagcaacacccagcagaagccagccagcaaccagaggcccctgacccagcaggagaccccagcccagcatgatgctgagagccagaaggagccccgggcccagcagaagagcgccagccaggaggagttcctggccccccagaagccagccccccagcagagcccctacatccagagggtgctgctgacccagcaggaggccgccagccagcagggccctggcctgggcaaggagagcatcacccagcaggagcccgccctgcggcagagacatgtggcccagcccggccctggccctggagagcccccaccagcccagcaggaggccgagagcaccccagctgcccaggccaagccaggggccaagcgggagcccagcgcccccacagagagcaccagccaggagaccccagagcagagcgacaagcagaccacccctgtgcagggcgccaagagcaagcagggcagcctgacagagctgggcttcctgaccaagctgcaggagctgagcatccagaggtctgccctggagtggaaggccctgtctgagtgggtgacagacagcgagagcgagagtgatgtgggcagcagcagtgacacagacagccctgccaccatgggcggcatggtggcccagggcgtgaagctgggcttcaagggcaagagcggctacaaggtgatgagcggctacagcggcaccagcccccatgagaagaccagcgccaggaaccaccgccactaccaggacacagccagccgcctcatccacaacatggacctgcggaccatgacccagagcctggtgaccctggccgaggacaacatcgccttcttcagcagccagggccctggagaaacagcccagaggctgtctggagtgtttgctggggtgcgggagcaggccctgggcctggagcccgccctgggccgcctgctgggcgtggcccacctgtttgacctggaccctgagaccccagccaacggctaccgcagcctggtgcacacagcccgctgctgcctggcccacctgctgcacaagagccgctacgtggccagcaacagaagaagcatcttcttccgcaccagccacaacctggccgagctggaggcctacctggccgccctgacccagctgcgggccctggtgtactatgcccagaggctgctggtgaccaacagacctggggtgctcttctttgaaggagatgagggcctgacagctgacttcctgcgggagtatgtgaccctgcacaagggctgcttctacggccgctgcctgggcttccagttcaccccagccatccggcccttcctgcagaccatcagcatcggcctggtgtcctttggagagcactacaagagaaatgaaacaggcctgtctgtggccgccagcagcctcttcaccagcggccgctttgccatcgaccctgagctgcggggagctgagtttgagcgcatcacccagaacctggatgtgcacttctggaaggccttctggaacatcacagagatggaggtgctgagcagcctggccaacatggccagcgccaccgtgcgggtgtcccggctgctgagcctgcccccagaggcctttgagatgcccctgacagctgaccccaccctgactgtgaccatcagcccccccctggcccacacaggccctggccctgtgctggtgcggctcatctcctatgacctgcgggagggccaggacagcgaggagctgagcagcctcatcaagagcaatggccagaggagcctggagctgtggccccggccccagcaggcccccaggagccgcagcctgattgtgcacttccatggaggcggctttgtggcccagaccagccgcagccatgagccctacctgaagtcctgggcccaggagctgggcgcccccatcatcagcattgactacagcctggcccctgaggcccccttcccccgggccctggaggagtgcttctttgcctactgctgggccatcaagcactgtgccctgctgggcagcactggagagcgcatctgcctggccggggacagcgctgggggcaacctgtgcttcaccgtggccctgcgggctgctgcctatggagtgcgggtgcctgatggcatcatggccgcctacccagccaccatgctgcagcctgctgccagccccagccggctgctgagcctgatggaccccctgctgcccctgtctgtgctgagcaaatgtgtgtctgcctatgctggggccaagacagaggaccacagcaacagcgaccagaaggccctgggcatgatgggcctggtgcggcgggacacagccctgctgctgcgggacttccggctgggcgccagctcctggctgaacagcttcctggagctgagcggcaggaagagccagaagatgtctgagcccatcgccgagcccatgagaagatctgtgtctgaggccgccctggcccagccccagggccccctgggcacagacagcctgaagaacctgaccctgcgggacctgagcctgcggggcaacagcgagaccagcagtgacaccccagagatgagcctgtctgctgagaccctgagccccagcacccccagtgatgtgaacttcctgctgcccccagaagatgctggggaggaggccgaggccaagaatgagctgagccccatggaccggggcctgggcgtgcgggccgccttccctgagggcttccacccccggcgcagcagccagggcgccacccagatgcccctgtacagcagccccatcgtgaagaaccccttcatgagccccctgctggccccagacagcatgctgaagagcctgccccctgtgcacatcgtggcctgtgccctggaccccatgctggatgacagcgtgatgctggcccggcggctgaggaacctgggccagcctgtgaccctgcgggtggtggaggacctgccccacggcttcctgaccctggccgccctgtgccgggagacccggcaggccgctgagctgtgtgtggagcgcatccggctggtgctgaccccacctgctggagctggccccagcggggagactggagctgctggggtggatggcggctgcggcggccgccactag

SEQ ID NO: 158029 - DNA, 1356 bp, Artificial Sequence
  Description of Artificial Sequence: Synthetic coding sequence
atgctgcgcttctacctgttcatcagcctgctgtgcctgagcagaagtgatgctgaggagacctgccccagcttcacccggctgtccttccacagcgctgtggtgggcaccggcctgaatgtgcggctgatgctgtacaccaggaagaacctgacctgtgcccagaccatcaacagcagcgccttcggcaacctgaatgtgaccaagaagaccaccttcatcgtgcacggcttccggcccaccggcagcccccctgtgtggatggatgacctggtgaagggcctgctgtctgtggaggacatgaatgtggtggtggtggactggaacagaggagccaccaccctcatctacacccacgccagcagcaagaccaggaaggtggccatggtgctgaaggagttcatcgaccagatgctggccgagggcgccagcctggatgacatctacatgattggagtgtccctgggcgcccacatcagcggctttgtgggggagatgtatgatggctggctgggccgcatcaccggcctggaccctgctggccccctcttcaacgggaagccccaccaggaccggctggaccccagtgatgcccagtttgtggatgtgatccacagcgacacagatgccctgggctacaaggagcccctgggcaacatcgacttctacccaaatggaggcctggaccagcccggctgccccaagaccatcctgggcggcttccagtacttcaagtgtgaccaccagaggtctgtgtacctgtacctgagcagcctgcgggagagctgcaccatcacagcctacccctgtgacagctaccaggactacagaaatggaaaatgtgtgtcctgtggcaccagccagaaggagagctgccccctgctgggctactatgctgacaactggaaggaccacctgcggggcaaggacccccccatgaccaaggccttctttgacacagctgaggagagccccttctgcatgtaccactactttgtggacatcatcacctggaacaagaatgtgagaagaggagacatcaccatcaagctgcgggacaaggccggcaacaccacagagagcaagatcaaccacgagcccaccaccttccagaagtaccaccaggtgtccctgctggcccgcttcaaccaggacctggacaaggtggccgccatcagcctgatgttcagcacaggcagcctcatcggcccccgctacaagctgcgcatcctgaggatgaagctgcggagcctggcccaccctgagcggccccagctgtgccgctatgacctggtgctgatggagaatgtggagaccgtcttccagcccatcctgtgcccagagctgcagctgtag

SEQ ID NO: 158030 - DNA, 1446 bp, Artificial Sequence
  Description of Artificial Sequence: Synthetic coding sequence
atgctgctgaagtgcctgcacaacaacctgtgccagaagtacagcgcccacgccttccagttcagccccagaaatgtgctgtggctgctggtggtgtgcctgcggagtgacaacaagaggccctgcctggagttcagccagctgtctgtgaaggacagcttccgggacctcttcatcccccgcatcgagaccatcctgatgatgtacaccaggaacaacctgaactgtgccgagcccctgtttgagcagaacaacagcctgaatgtgaacttcaacacccagaagaagacagtgtggctgatccacggctacagacctgtgggcagcatccccctgtggctgcagaactttgtgcgcatcctgctgaatgaggaggacatgaatgtcatcgtggtggactggagcagaggagccaccaccttcatctacaacagagctgtgaagaacaccaggaaggtggccgtgtccctgtctgtgcacatcaagaacctgctgaagcatggagccagcctggacaacttccacttcatcggcgtgtccctgggcgcccacatcagcggctttgtgggcaagatcttccacggccagctgggccgcatcaccggcctggaccctgctggcccccgcttcagcaggaagccaccctacagccggctggactacacagatgccaagtttgtggatgtgatccacagcgacagcaatggcctgggcatccaggagcccctgggccacatcgacttctacccaaatggaggcaacaagcagcccggctgccccaagagcatcttcagcggcatccagttcatcaagtgcaaccaccagagagctgtgcacctgttcatggccagcctggagaccaactgcaacttcatctccttcccctgccgcagctacaaggactacaagaccagcctgtgtgtggactgtgactgcttcaaggagaagagctgcccccggctgggctaccaggccaagctgttcaagggcgtgctgaaggagaggatggagggccggcccctgcggaccaccgtcttcctggacaccagcggcacctaccccttctgcacctactactttgtgctgagcatcatcgtgcctgacaagaccatgatggatggcagcttctccttcaagctgctgaaccagctgggcatgattgaggagccccggctgtatgagaagaacaagcccttctacaagctgcaggaggtgaagatcctggcccagttctacaatgactttgtgaacatcagcagcatcggcctgacctacttccagagcagcaacctgcagtgcagcacctgcacctacaagatccagaggctgatgctgaagagcctgacctacccagagcggccccccctgtgccgctacaacatcgtgctgaaggaccgggaggaggtgttcctgaaccccaacacctgcacccccaagaacacctag

SEQ ID NO: 158031 - DNA, 471 bp, Artificial Sequence
  Description of Artificial Sequence: Synthetic coding sequence
atgaatgtcatcgtggtggactggagcagaggagccaccaccttcatctacaacagagctgtgaagaacaccaggaaggtggccgtgtccctgtctgtgcacatcaagaacctgctgaagcatggagccagcctggacaacttccacttcatcggcgtgtccctgggcgcccacatcagcggctttgtgggcaagatcttccacggccagctgggccgcatcaccggcctggaccctgctggcccccgcttcagcaggaagccaccctacagccggctggactacacagatgccaagtttgtggatgtgatccacagcgacagcaatggcatccagttcatcaagtgcaaccaccagagagctgtgcacctgttcatggccagcctggagaccaactgcaacttcatctccttcccctgccgcagctacaaggactacaagaccagcctgtgtgtggactgtgactgctag

SEQ ID NO: 158032 - DNA, 426 bp, Artificial Sequence
  Description of Artificial Sequence: Synthetic coding sequence
tgatacaacagagctgtgaagaacaccaggaaggtggccgtgtccctgtctgtgcacatcaagaacctgctgaagcacggggccagcctggacaacttccacttcatcggcgtgtccctgggcgcccacatcagcggctttgtgggcaagatcttccacggccagctgggccgcatcaccggcctggaccctgctggcccccgcttcagcaggaagccaccctacagccggctggactacacagatgccaagtttgtggatgtgatccacagcgacagcaatggcatccagttcatcaagtgcaaccaccagagagctgtgcacctgttcatggccagcctggagaccaactgcaacttcatctccttcccctgccgcagctacaaggactacaagaccagcctgtgtgtggactgtgactgctag

SEQ ID NO: 158033 - DNA, 1383 bp, Artificial Sequence
  Description of Artificial Sequence: Synthetic coding sequence
atgagggtgtacatcttcctgtgcctgatgtgctgggtgcggagtgacaacaagaggccctgcctggagttcagccagctgtctgtgaaggacagcttccgggacctcttcatccccagaattgagaccatcctgatgatgtacaccaggaacaacctgaactgtgccgagcccctgtttgagcagaacaacagcctgaatgtgaacttcaacacccagaagaagacagtgtggctgattcatggctacagacctgtgggcagcatccccctgtggctgcagaactttgtgcgcatcctgctgaatgaggaggacatgaatgtgattgtggtggactggagcagaggagccaccaccttcatctacaacagagctgtgaagaacaccaggaaggtggccgtgtccctgtctgtgcacatcaagaacctgctgaagcacggggccagcctggacaacttccacttcatcggcgtgtccctgggcgcccacatcagcggctttgtgggcaagatcttccacggccagctgggccgcatcaccggcctggaccctgctggcccccgcttcagcaggaagccaccctacagccggctggactacacagatgccaagtttgtggatgtgatccacagcgacagcaatggcctgggcatccaggagcccctgggccacatcgacttctaccccaacggcggcaacaagcagcccggctgccccaagagcatcttcagcggcatccagttcatcaagtgcaaccaccagagagctgtgcacctgttcatggccagcctggagaccaactgcaacttcatctccttcccctgccgcagctacaaggactacaagaccagcctgtgtgtggactgtgactgcttcaaggagaagagctgcccccggctgggctaccaggccaagctgttcaagggcgtgctgaaggagaggatggagggccggcccctgcggaccaccgtcttcctggacaccagcggcacctaccccttctgcacctactactttgtgctgagcatcatcgtgcctgacaagaccatgatggatggcagcttctccttcaagctgctgaaccagctgggcatgattgaggagccccggctgtatgagaagaacaagcccttctacaagctgcaggaggtgaagatcctggcccagttctacaatgactttgtgaacatcagcagcatcggcctgacctacttccagagcagcaacctgcagtgcagcacctgcacctacaagatccagaggctgatgctgaagagcctgacctacccagagaggcctcccctgtgccgctacaacatcgtgctgaaggaccgggaggaggtgttcctgaaccccaacacctgcacccccaagaacacctag

SEQ ID NO: 158034 - DNA, 2673 bp, Artificial Sequence
  Description of Artificial Sequence: Synthetic coding sequence
atgaactacgtgggccagctggccggccaggtgtttgtgacagtgaaggagctgtacaagggcctgaacccagccaccctgagcggctgcatcgacatcatcgtcatccggcagcccaacggcaacctgcagtgcagccccttccacgtgcgctttgggaagatgggcgtgctgcggagccgggagaaggtggtggacatcgagatcaacggggagagcgtggacctgcacatgaagctgggggacaatggagaggccttctttgtgcaggagacagacaatgaccaggaggtgatccccatgcacctggccaccagccccatcctgtctgagggcgccagcaggatggagtgccagctgaagaggggctctgtggacaggatgaggggcctggaccccagcaccccagcccaggtgattgcccccagcgagacccccagcagcagctctgtggtgaagaagaggaggaagagaagaaggaagagccagctggacagcctgaagagagatgacaacatgaacaccagtgaagatgaggacatgttccccatcgagatgagcagtgatgaggccatggagctgctggagagcagcaggaccctgcccaatgacatcccccccttccaggatgacatccctgaggagaacctgagcctggccgtcatctacccccagagcgccagctaccccaacagcgaccgggagtggagccccacccccagccccagcggcagccggcccagcacccccaagagtgacagcgagctggtgtccaagagcacagagaggacaggccagaagaaccctgagatgctgtggctgtggggcgagctgccccaggccgccaagagcagcagcccccacaagatgaaggagagcagccccctgagcagcaggaagatctgtgacaagagccacttccaggccatccacagcgagagcagtgacaccttcagtgaccagagccccaccctggtgggcggggccctgctggaccagaacaagccccagacagagatgcagtttgtgaatgaggaggacctggagaccctgggcgccgccgcccccctgctgcccatgattgaggagctgaagccacccagcgcctctgtggtgcagacagccaacaagacagacagccccagcaggaagagggacaagaggagccgccacctgggcgcagatggagtgtacctggatgacctgacagacatggaccctgaggtggccgccctgtacttccccaagaatggagaccccagcggcctggccaagcacgccagtgacaacggggcccggagcgccaaccagagcccccagagcgtgggcagcagtggagtggacagcggcgtggagagcaccagtgatggcctgcgggacctgcccagcatcgccatcagcctgtgtggcggcctgagtgaccaccgggagatcaccaaggatgccttcctggagcaggccgtgtcctaccagcagtttgtggacaacccagccatcattgatgaccccaacctggtggtgaagattggcagcaagtactacaactggaccacagctgcccccctgctgctggccatgcaggccttccagaagcccctgcccaaggccaccgtggagagcatcatgagggacaagatgcccaagaagggcggccgctggtggttctcctggaggggcaggaacaccaccatcaaggaggagagcaagccagagcagtgcctggccggcaaggcccacagcactggagagcagcccccccagctgagcctggccaccagggtgaagcatgagagcagcagcagtgatgaggagagagctgctgccaagcccagcaatgccggccacctgcccctgctgcccaacgtgtcctacaagaagaccctgcggctgaccagcgagcagctgaagagcctgaagctgaagaatggccccaatgatgtggtgttttctgtgaccacccagtaccagggcacctgccgctgtgagggcaccatctacctgtggaactgggatgacaaggtgatcatcagtgacattgatggcaccatcaccaggagtgacaccctgggccacatcctgcccaccctgggcaaggactggacccaccagggcatcgccaagctgtaccacaaggtgtcccagaatggctacaagttcctgtactgcagcgcccgggccatcggcatggctgacatgacccggggctacctgcactgggtgaatgaaagaggaacagtgctgccccagggccccctgctgctgagccccagcagcctcttcagcgccctgcaccgggaggtgattgagaagaagccagagaagttcaaggtgcagtgcctgacagacatcaagaacctcttcttccccaacacagagcccttctacgccgccttcggcaacagaccagcagatgtgtacagctacaagcaggtgggcgtgtccctgaaccgcatcttcaccgtgaaccccaagggggagctggtgcaggagcacgccaagaccaacatcagcagctatgtgcggctgtgtgaggtggtggaccacgtgttccccctgctgaagaggagccacagcagtgacttcccctgcagcgacaccttcagcaacttcaccttctggagggagcccctgcccccatttgagaaccaggacatccacagcgccagcgcctag

SEQ ID NO: 158035 - DNA, 1863 bp, Artificial Sequence
  Description of Artificial Sequence: Synthetic coding sequence
atgctgtggctgtggggcgagctgccccaggccgccaagagcagcagcccccacaagatgaaggagagcagccccctgagcagcaggaagatctgtgacaagagccacttccaggccatccacagcgagagcagtgacaccttcagtgaccagagccccaccctggtgggcggggccctgctggaccagaacaagccccagacagagatgcagtttgtgaatgaggaggacctggagaccctgggcgccgccgcccccctgctgcccatgattgaggagctgaagccacccagcgcctctgtggtgcagacagccaacaagacagacagccccagcaggaagagggacaagaggagccgccacctgggcgcagatggagtgtacctggatgacctgacagacatggaccctgaggtggccgccctgtacttccccaagaatggagaccccagcggcctggccaagcacgccagtgacaacggggcccggagcgccaaccagagcccccagagcgtgggcagcagtggagtggacagcggcgtggagagcaccagtgatggcctgcgggacctgcccagcatcgccatcagcctgtgtggcggcctgagtgaccaccgggagatcaccaaggatgccttcctggagcaggccgtgtcctaccagcagtttgtggacaacccagccatcattgatgaccccaacctggtggtgaagattggcagcaagtactacaactggaccacagctgcccccctgctgctggccatgcaggccttccagaagcccctgcccaaggccaccgtggagagcatcatgagggacaagatgcccaagaagggcggccgctggtggttctcctggaggggcaggaacaccaccatcaaggaggagagcaagccagagcagtgcctggccggcaaggcccacagcactggagagcagcccccccagctgagcctggccaccagggtgaagcatgagagcagcagcagtgatgaggagagagctgctgccaagcccagcaatgccggccacctgcccctgctgcccaacgtgtcctacaagaagaccctgcggctgaccagcgagcagctgaagagcctgaagctgaagaatggccccaatgatgtggtgttttctgtgaccacccagtaccagggcacctgccgctgtgagggcaccatctacctgtggaactgggatgacaaggtgatcatcagtgacattgatggcaccatcaccaggagtgacaccctgggccacatcctgcccaccctgggcaaggactggacccaccagggcatcgccaagctgtaccacaaggtgtcccagaatggctacaagttcctgtactgcagcgcccgggccatcggcatggctgacatgacccggggctacctgcactgggtgaatgaaagaggaacagtgctgccccagggccccctgctgctgagccccagcagcctcttcagcgccctgcaccgggaggtgattgagaagaagccagagaagttcaaggtgcagtgcctgacagacatcaagaacctcttcttccccaacacagagcccttctacgccgccttcggcaacagaccagcagatgtgtacagctacaagcaggtgggcgtgtccctgaaccgcatcttcaccgtgaaccccaagggggagctggtgcaggagcacgccaagaccaacatcagcagctatgtgcggctgtgtgaggtggtggaccacgtgttccccctgctgaagaggagccacagcagtgacttcccctgcagcgacaccttcagcaacttcaccttctggagggagcccctgcccccatttgagaaccaggacatccacagcgccagcgcctag

SEQ ID NO: 158036 - DNA, 2799 bp, Artificial Sequence
  Description of Artificial Sequence: Synthetic coding sequence
atgagccgggtgcagaccatgaactacgtgggccagctggccggccaggtgtttgtgacagtgaaggagctgtacaagggcctgaacccagccaccctgagcggctgcatcgacatcatcgtcatccggcagcccaacggcaacctgcagtgcagccccttccacgtgcgctttgggaagatgggcgtgctgcggagccgggagaaggtggtggacatcgagatcaacggggagagcgtggacctgcacatgaagctgggggacaatggagaggccttctttgtgcaggagacagacaatgaccaggaggtgatccccatgcacctggccaccagccccatcctgtctgagggcgccagcaggatggagtgccagctgaagaggggctctgtggacaggatgaggggcctggaccccagcaccccagcccaggtgattgcccccagcgagacccccagcagcagctctgtggtgaagaagaggaggaagagaagaaggaagagccagctggacagcctgaagagagatgacaacatgaacaccagtgaagatgaggacatgttccccatcgagatgagcagtgatgaggccatggagctgctggagagcagcaggaccctgcccaatgacatcccccccttccaggatgacatccctgaggagaacctgagcctggccgtcatctacccccagagcgccagctaccccaacagcgaccgggagtggagccccacccccagcagcctggtggactgcaagaggacagccccccacctggccgtggccgctgagggcggcctgagcagcagctgccccccccagagcagcctcttccaccccagcgagagccccagcggcagccggcccagcacccccaagagtgacagcgagctggtgtccaagagcacagagaggacaggccagaagaaccctgagatgctgtggctgtggggcgagctgccccaggccgccaagagcagcagcccccacaagatgaaggagagcagccccctgagcagcaggaagatctgtgacaagagccacttccaggccatccacagcgagagcagtgacaccttcagtgaccagagccccaccctggtgggcggggccctgctggaccagaacaagccccagacagagatgcagtttgtgaatgaggaggacctggagaccctgggcgccgccgcccccctgctgcccatgattgaggagctgaagccacccagcgcctctgtggtgcagacagccaacaagacagacagccccagcaggaagagggacaagaggagccgccacctgggcgcagatggagtgtacctggatgacctgacagacatggaccctgaggtggccgccctgtacttccccaagaatggagaccccagcggcctggccaagcacgccagtgacaacggggcccggagcgccaaccagagcccccagagcgtgggcagcagtggagtggacagcggcgtggagagcaccagtgatggcctgcgggacctgcccagcatcgccatcagcctgtgtggcggcctgagtgaccaccgggagatcaccaaggatgccttcctggagcaggccgtgtcctaccagcagtttgtggacaacccagccatcattgatgaccccaacctggtggtgaagattggcagcaagtactacaactggaccacagctgcccccctgctgctggccatgcaggccttccagaagcccctgcccaaggccaccgtggagagcatcatgagggacaagatgcccaagaagggcggccgctggtggttctcctggaggggcaggaacaccaccatcaaggaggagagcaagccagagcagtgcctggccggcaaggcccacagcactggagagcagcccccccagctgagcctggccaccagggtgaagcatgagagcagcagcagtgatgaggagagagctgctgccaagcccagcaatgccggccacctgcccctgctgcccaacgtgtcctacaagaagaccctgcggctgaccagcgagcagctgaagagcctgaagctgaagaatggccccaatgatgtggtgttttctgtgaccacccagtaccagggcacctgccgctgtgagggcaccatctacctgtggaactgggatgacaaggtgatcatcagtgacattgatggcaccatcaccaggagtgacaccctgggccacatcctgcccaccctgggcaaggactggacccaccagggcatcgccaagctgtaccacaaggtgtcccagaatggctacaagttcctgtactgcagcgcccgggccatcggcatggctgacatgacccggggctacctgcactgggtgaatgaaagaggaacagtgctgccccagggccccctgctgctgagccccagcagcctcttcagcgccctgcaccgggaggtgattgagaagaagccagagaagttcaaggtgcagtgcctgacagacatcaagaacctcttcttccccaacacagagcccttctacgccgccttcggcaacagaccagcagatgtgtacagctacaagcaggtgggcgtgtccctgaaccgcatcttcaccgtgaaccccaagggggagctggtgcaggagcacgccaagaccaacatcagcagctatgtgcggctgtgtgaggtggtggaccacgtgttccccctgctgaagaggagccacagcagtgacttcccctgcagcgacaccttcagcaacttcaccttctggagggagcccctgcccccatttgagaaccaggacatccacagcgccagcgcctag

SEQ ID NO: 158037 - DNA, 1176 bp, Artificial Sequence
  Description of Artificial Sequence: Synthetic coding sequence
atgcaggccttccagaagcccctgcccaagagcagctgcctgagctacctgcacgtgatcctggatgccatccgcttctgcttcagcaagatcttcaatgcccagatcgccaccgtggagagcatcatgagggacaagatgcccaagaagggcggccgctggtggttctcctggagaggaagaaacaccaccatcaaggaggagagcaagccagagcagtgcctggccggcaaggcccacagcactggagagcagcccccccagctgagcctggccaccagggtgaagcatgagagcagcagcagtgatgaggagagagctgctgccaagcccagcaatgccggccacctgcccctgctgcccaacgtgtcctacaagaagaccctgcggctgaccagcgagcagctgaagagcctgaagctgaagaatggccccaatgatgtggtgttttctgtgaccacccagtaccagggcacctgccgctgtgagggcaccatctacctgtggaactgggatgacaaggtgatcatcagtgacattgatggcaccatcaccaggagtgacaccctgggccacatcctgcccaccctgggcaaggactggacccaccagggcatcgccaagctgtaccacaaggtgtcccagaatggctacaagttcctgtactgcagcgcccgggccatcggcatggctgacatgacccggggctacctgcactgggtgaatgaaagaggcaccgtgctgccccagggccccctgctgctgagccccagcagcctcttcagcgccctgcaccgggaggtgattgagaagaagccagagaagttcaaggtgcagtgcctgacagacatcaagaacctcttcttccccaacacagagcccttctatgctgcctttggaaacagaccagcagatgtgtacagctacaagcaggtgggcgtgtccctgaaccgcatcttcaccgtgaaccccaagggggagctggtgcaggagcacgccaagaccaacatcagcagctatgtgcggctgtgtgaggtggtggaccacgtgttccccctgctgaagaggagccacagcagtgacttcccctgcagcgacaccttcagcaacttcaccttctggagggagcccctgcccccatttgagaaccaggacatccacagcgccagcgcctag

SEQ ID NO: 158038 - DNA, 87 bp, Artificial Sequence
  Description of Artificial Sequence: Synthetic coding sequence
atgaactacgtgggccagctggccggccaggtgtttgtgacagtgaaggagctgtacaagggcctgaacccagccaccctgtcctag

SEQ ID NO: 158039 - DNA, 2691 bp, Artificial Sequence
  Description of Artificial Sequence: Synthetic coding sequence
atgagccgggtgcagaccatgaactacgtgggccagctggccggccaggtgtttgtgacagtgaaggagctgtacaagggcctgaacccagccaccctgagcggctgcatcgacatcatcgtcatccggcagcccaacggcaacctgcagtgcagccccttccacgtgcgctttgggaagatgggcgtgctgcggagccgggagaaggtggtggacatcgagatcaacggggagagcgtggacctgcacatgaagctgggggacaatggagaggccttctttgtgcaggagacagacaatgaccaggaggtgatccccatgcacctggccaccagccccatcctgtctgagggcgccagcaggatggagtgccagctgaagaggggctctgtggacaggatgaggggcctggaccccagcaccccagcccaggtgattgcccccagcgagacccccagcagcagctctgtggtgaagaagaggaggaagagaagaaggaagagccagctggacagcctgaagagagatgacaacatgaacaccagtgaagatgaggacatgttccccatcgagatgagcagtgatgaggccatggagctgctggagagcagcaggaccctgcccaatgacatcccccccttccaggatgacatccctgaggagaacctgagcctggccgtcatctacccccagagcgccagctaccccaacagcgaccgggagtggagccccacccccagccccagcggcagccggcccagcacccccaagagtgacagcgagctggtgtccaagagcacagagaggacaggccagaagaaccctgagatgctgtggctgtggggcgagctgccccaggccgccaagagcagcagcccccacaagatgaaggagagcagccccctgagcagcaggaagatctgtgacaagagccacttccaggccatccacagcgagagcagtgacaccttcagtgaccagagccccaccctggtgggcggggccctgctggaccagaacaagccccagacagagatgcagtttgtgaatgaggaggacctggagaccctgggcgccgccgcccccctgctgcccatgattgaggagctgaagccacccagcgcctctgtggtgcagacagccaacaagacagacagccccagcaggaagagggacaagaggagccgccacctgggcgcagatggagtgtacctggatgacctgacagacatggaccctgaggtggccgccctgtacttccccaagaatggagaccccagcggcctggccaagcacgccagtgacaacggggcccggagcgccaaccagagcccccagagcgtgggcagcagtggagtggacagcggcgtggagagcaccagtgatggcctgcgggacctgcccagcatcgccatcagcctgtgtggcggcctgagtgaccaccgggagatcaccaaggatgccttcctggagcaggccgtgtcctaccagcagtttgtggacaacccagccatcattgatgaccccaacctggtggtgaagattggcagcaagtactacaactggaccacagctgcccccctgctgctggccatgcaggccttccagaagcccctgcccaaggccaccgtggagagcatcatgagggacaagatgcccaagaagggcggccgctggtggttctcctggaggggcaggaacaccaccatcaaggaggagagcaagccagagcagtgcctggccggcaaggcccacagcactggagagcagcccccccagctgagcctggccaccagggtgaagcatgagagcagcagcagtgatgaggagagagctgctgccaagcccagcaatgccggccacctgcccctgctgcccaacgtgtcctacaagaagaccctgcggctgaccagcgagcagctgaagagcctgaagctgaagaatggccccaatgatgtggtgttttctgtgaccacccagtaccagggcacctgccgctgtgagggcaccatctacctgtggaactgggatgacaaggtgatcatcagtgacattgatggcaccatcaccaggagtgacaccctgggccacatcctgcccaccctgggcaaggactggacccaccagggcatcgccaagctgtaccacaaggtgtcccagaatggctacaagttcctgtactgcagcgcccgggccatcggcatggctgacatgacccggggctacctgcactgggtgaatgaaagaggaacagtgctgccccagggccccctgctgctgagccccagcagcctcttcagcgccctgcaccgggaggtgattgagaagaagccagagaagttcaaggtgcagtgcctgacagacatcaagaacctcttcttccccaacacagagcccttctacgccgccttcggcaacagaccagcagatgtgtacagctacaagcaggtgggcgtgtccctgaaccgcatcttcaccgtgaaccccaagggggagctggtgcaggagcacgccaagaccaacatcagcagctatgtgcggctgtgtgaggtggtggaccacgtgttccccctgctgaagaggagccacagcagtgacttcccctgcagcgacaccttcagcaacttcaccttctggagggagcccctgcccccatttgagaaccaggacatccacagcgccagcgcctag

SEQ ID NO: 158040 - DNA, 291 bp, Artificial Sequence
  Description of Artificial Sequence: Synthetic coding sequence
atgaactacgtgggccagctggccggccaggtgtttgtgacagtgaaggagctgtacaagggcctgaacccagccaccctgagcggctgcatcgacatcatcgtcatccggcagcccaacggcaacctgcagtgcagccccttccacgtgcgctttgggaagatgggcgtgctgcggagccgggagaaggtggtggacatcgagatcaacggggagagcgtggacctgcacatgaagctgggggacaatggagaggccttctttgtgcaggagacagacaatgaccagtag

SEQ ID NO: 158041 - DNA, 2928 bp, Artificial Sequence
  Description of Artificial Sequence: Synthetic coding sequence
atgggagagcaggacggcatccgcagcagctcctgggagaccagccagggcaagagcagcccagattctgcctggagctggatccccatcatgagggaccccggctggatcagaaatgtgtggagcagcaacatcaacgtgcagaccatgaactacgtgggccagctggccggccaggtgtttgtgacagtgaaggagctgtacaagggcctgaacccagccaccctgagcggctgcatcgacatcatcgtcatccggcagcccaatggaaacctgcagtgcagccccttccacgtgcgctttgggaagatgggcgtgctgcggagccgggagaaggtggtggacatcgagatcaatggagagagcgtggacctgcacatgaagctgggggacaacggggaggccttctttgtgcaggagacagacaatgaccaggaggtgatccccatgcacctggccaccagccccatcctgtctgagggcgccagcaggatggagtgccagctgaagaggggctctgtggacaggatgaggggcctggaccccagcaccccagcccaggtgattgcccccagcgagacccccagcagcagctctgtggtgaagaagaggaggaagagaagaaggaagagccagctggacagcctgaagagagatgacaacatgaacaccagtgaagatgaggacatgttccccatcgagatgagcagtgatgaggccatggagctgctggagagcagcaggaccctgcccaatgacatcccccccttccaggatgacatccctgaggagaacctgagcctggccgtcatctacccccagagcgccagctaccccaacagcgaccgggagtggagccccacccccagcagcctggtggactgcaagaggacagccccccacctggccgtggccgctgagggcggcctgagcagcagctgccccccccagagcagcctcttccaccccagcgagagccccagcggcagccggcccagcacccccaagagtgacagcgagctggtgtccaagagcacagagaggacaggccagaagaaccctgagatgctgtggctgtggggcgagctgccccaggccgccaagagcagcagcccccacaagatgaaggagagcagccccctgagcagcaggaagatctgtgacaagagccacttccaggccatccacagcgagagcagtgacaccttcagtgaccagagccccaccctggtgggcggggccctgctggaccagaacaagccccagacagagatgcagtttgtgaatgaggaggacctggagaccctgggcgctgctgcccccctgctgcccatgattgaggagctgaagcccccatctgcctctgtggtgcagacagccaacaagacagacagccccagcaggaagagggacaagaggagccgccacctgggcgcagatggagtgtacctggatgacctgacagacatggaccctgaggtggccgccctgtacttccccaagaatggagaccccagcggcctggccaagcacgccagtgacaatggagcccggagcgccaaccagagcccccagagcgtgggcagcagcggcgtggacagcggcgtggagagcaccagtgatggcctgcgggacctgcccagcatcgccatcagcctgtgtggcggcctgagtgaccaccgggagatcaccaaggatgccttcctggagcaggccgtgtcctaccagcagtttgtggacaacccagccatcattgatgaccccaacctggtggtgaagattggcagcaagtactacaactggaccacagctgcccccctgctgctggccatgcaggccttccagaagcccctgcccaaggccaccgtggagagcatcatgagggacaagatgcccaagaagggcggccgctggtggttctcctggagaggaagaaacaccaccatcaaggaggagagcaagccagagcagtgcctggccggcaaggcccacagcactggagagcagcccccccagctgagcctggccaccagggtgaagcatgagagcagcagcagtgatgaggagagagctgctgccaagcccagcaatgccggccacctgcccctgctgcccaacgtgtcctacaagaagaccctgcggctgaccagcgagcagctgaagagcctgaagctgaagaatggccccaatgatgtggtgttttctgtgaccacccagtaccagggcacctgccgctgtgagggcaccatctacctgtggaactgggatgacaaggtgatcatcagtgacattgatggcaccatcaccaggagtgacaccctgggccacatcctgcccaccctgggcaaggactggacccaccagggcatcgccaagctgtaccacaaggtgtcccagaatggctacaagttcctgtactgcagcgcccgggccatcggcatggctgacatgacccggggctacctgcactgggtgaatgaaagaggcaccgtgctgccccagggccccctgctgctgagccccagcagcctcttcagcgccctgcaccgggaggtgattgagaagaagccagagaagttcaaggtgcagtgcctgacagacatcaagaacctcttcttccccaacacagagcccttctatgctgcctttggaaacagaccagcagatgtgtacagctacaagcaggtgggcgtgtccctgaaccgcatcttcaccgtgaaccccaagggggagctggtgcaggagcacgccaagaccaacatcagcagctatgtgcggctgtgtgaggtggtggaccacgtgttccccctgctgaagaggagccacagcagtgacttcccctgcagcgacaccttcagcaacttcaccttctggagggagcccctgcccccatttgagaaccaggacatccacagcgccagcgcctag

SEQ ID NO: 158042 - DNA, 1380 bp, Artificial Sequence
  Description of Artificial Sequence: Synthetic coding sequence
atgagccgggtgcagaccatgaactacgtgggccagctggccggccaggtgtttgtgacagtgaaggagctgtacaagggcctgaacccagccaccctgagcggctgcatcgacatcatcgtcatccggcagcccaacggcaacctgcagtgcagccccttccacgtgcgctttgggaagatgggcgtgctgcggagccgggagaaggtggtggacatcgagatcaacggggagagcgtggacctgcacatgaagctgggggacaatggagaggccttctttgtgcaggagacagacaatgaccaggaggtgatccccatgcacctggccaccagccccatcctgtctgagggcgccagcaggatggagtgccagctgaagaggggctctgtggacaggatgaggggcctggaccccagcaccccagcccaggtgattgcccccagcgagacccccagcagcagctctgtggtgaagaagaggaggaagagaagaaggaagagccagctggacagcctgaagagagatgacaacatgaacaccagtgaagatgaggacatgttccccatcgagatgagcagtgatgaggccatggagctgctggagagcagcaggaccctgcccaatgacatcccccccttccaggatgacatccctgaggagaacctgagcctggccgtcatctacccccagagcgccagctaccccaacagcgaccgggagtggagccccacccccagcagcctggtggactgcaagaggacagccccccacctggccgtggccgctgagggcggcctgagcagcagctgccccccccagagcagcctcttccaccccagcgagagccccagcggcagccggcccagcacccccaagagtgacagcgagctggtgtccaagagcacagagaggacaggccagaagaaccctgagatgctgtggctgtggggcgagctgccccaggccgccaagagcagcagcccccacaagatgaaggagagcagccccctgagcagcaggaagatctgtgacaagagccacttccaggccatccacagcgagagcagtgacaccttcagtgaccagagccccaccctggtgggcggggccctgctggaccagaacaagccccagacagagatgcagtttgtgaatgaggaggacctggagaccctgggcgccgccgcccccctgctgcccatgattgaggagctgaagccacccagcgcctctgtggtgcagacagccaacaagacagacagccccagcaggaagagggacaagaggagccgccacctgggcgcagatggagtgtacctggatgacctgacagacatggaccctgaggtggccgccctgtacttccccaagaagtag

SEQ ID NO: 158043 - DNA, 2691 bp, Artificial Sequence
  Description of Artificial Sequence: Synthetic coding sequence
atgaactacgtgggccagctggccggccaggtgattgtgacagtgaaggagctgtacaagggcatcaaccaggccaccctgagcggctgcattgatgtgattgtggtgcagcagcaggacggcagctaccagtgcagccccttccacgtgcgctttgggaagctgggcgtgctgcggagcaaggagaaggtgattgatattgagatcaatggcagcgctgtggacctgcacatgaagctgggggacaatggagaggccttctttgtggaggagacagaggaggagtatgagaagctgcctgcctacctggccaccagccccatccccacagaggaccagttcttcaaggacatcgacacccccctggtgaagtctggaggagatgagacccccagccagagcagtgacatcagccacgtgctggagacagagaccatcttcacccccagctctgtgaagaagaagaagagaagaaggaagaagtacaagcaggacagcaagaaggaggagcaggccgccagcgctgctgctgaggacacctgtgatgtgggcgtgtccagtgatgatgacaagggggcccaggccgcccggggcagcagcaatgccagcctgaaggaggaggagtgcaaggagcccctgctcttccacagcggggaccactaccccctgagtgatggagactggagccccctggagaccacctacccccagacagcctgccccaagagtgacagcgagctggaggtgaagccagctgagagcctgctgcggtctgagagccacatggagtggacctggggcggcttccctgagagcaccaaggtgtccaagcgggagaggagtgaccaccaccccaggacagccaccatcaccccatctgagaacacccacttccgggtcatccccagcgaggacaacctgatcagcgaggtggagaaggatgcctccatggaggacacagtgtgcaccatcgtgaagcccaagccccgggccctgggcacccagatgtctgaccccacctctgtggccgagctgctggagccccccctggagagcacccagatcagctccatgctggatgctgaccacctgcccaatgctgccctggccgaggcccccagcgagagcaagccagctgccaaggtggacagccccagcaagaagaagggcgtgcacaagaggagccagcaccagggcccagatgacatctacctggatgacctgaagggcctggagcctgaggtggccgccctgtacttccccaagtctgagagcgagcccggcagccggcagtggccagagagtgacaccctgagcggcagccagagcccccagagcgtgggcagcgctgctgctgacagcggcacagaatgtctgagtgacagcgccatggacctgcctgatgtgaccctgagcctgtgtggcggcctgtctgaaaatggagagatcagcaaggagaagttcatggagcacatcatcacctaccacgagtttgctgagaaccctggcctgattgacaaccccaacctggtgatccgcatctacaaccgctactacaactgggccctggccgcccccatgatcctgagcctgcaggtgttccagaagagcctgcccaaggccaccgtggagagctgggtgaaggacaagatgcccaagaagagcggccgctggtggttctggaggaagcgggagagcatgaccaagcagctgcctgagagcaaggagggcaagtctgaggcccccccagccagtgacctgcccagcagcagcaaggagcctgctggggcccggccagcagaaaatgacagcagcagtgatgagggcagccaggagctggaggagagcatcaccgtggaccccatccccacagagcccctgagccacggcagcaccaccagctacaagaagagcctgcggctgagcagtgaccagatcgccaagctgaagctgcatgatggccccaatgatgtggtgttcagcatcaccacccagtaccagggcacctgccgctgtgccggcaccatctacctgtggaactggaatgacaagatcatcatcagtgacattgatggcaccatcaccaagagtgatgccctgggccagatcctgccccagctgggcaaggactggacccaccagggcatcgccaagctgtaccacagcatcaatgaaaatggctacaagttcctgtactgcagcgcccgggccatcggcatggctgacatgacccggggctacctgcactgggtgaatgacaagggcaccatcctgccccggggccccctgatgctgagccccagcagcctcttcagcgccttccaccgggaggtgattgagaagaagccagagaagttcaagattgaatgtctgaatgacatcaagaacctgtttgcccccagcaagcagcccttctatgctgcctttggaaaccggcccaatgatgtgtatgcctacacccaggtgggcgtgcctgactgccgcatcttcaccgtgaaccccaagggggagctgatccaggagaggaccaagggcaacaagagcagctaccaccggctgtctgagctggtggagcacgtgttccccctgctgagcaaggagcagaacagcgccttcccctgcccagagttcagcagcttctgctactggagggaccccatccctgaggtggacctggatgacctgtcctag

SEQ ID NO: 158044 - DNA, 702 bp, Artificial Sequence
  Description of Artificial Sequence: Synthetic coding sequence
atgaactacgtgggccagctggccggccaggtgattgtgacagtgaaggagctgtacaagggcatcaaccaggccaccctgagcggctgcattgatgtgattgtggtgcagcagcaggacggcagctaccagtgcagccccttccacgtgcgctttgggaagctgggcgtgctgcggagcaaggagaaggtgattgatattgagatcaatggcagcgctgtggacctgcacatgaagctgggggacaatggagaggccttctttgtggaggagacagaggaggagtatgagaagctgcctgcctacctggccaccagccccatccccacagaggaccagttcttcaaggacatcgacacccccctggtgaagtctggaggagatgagacccccagccagagcagtgacatcagccacgtgctggagacagagaccatcttcacccccagctctgtgaagaagaagaagagaagaaggaagaagtacaagcaggacagcaagaaggaggagcaggccgccagcgctgctgctgaggacacctgtgatgtgggcgtgtccagtgatgatgacaagggggcccaggccgcccggggcagcagcaatgccagcctgaaggaggaggagtgcaaggagcccctgctcttccacagcggggaccactaccccctgagtgatggagactggagccccctggagacctag

SEQ ID NO: 158045 - DNA, 2556 bp, Artificial Sequence
  Description of Artificial Sequence: Synthetic coding sequence
atgaactacgtgggccagctggccgagaccgtgtttggcaccgtgaaggagctgtaccggggcctgaacccagccaccctgagcggcggcattgatgtgctggtggtgaagcaggtggatggcagcttccgctgcagccccttccacgtgcgctttgggaagctgggcgtgctgcggagccgggagaaggtggtggacatcgagctgaatggagagcctgtggacctgcacatgaagctgggggacagcggggaggccttctttgtgcaggagctggagagtgatgatgagcacgtgcccccaggcctgtgcaccagccccatcccctggggcggcctgagcggcttccccagcgacagccagctgggcacagccagcgagcctgagggcctggtgatggccggcacagccagcactggaagaaggaagagaagaagaagaaggaagcccaagcagaaggaggatgctgtggccacagacagcagccctgaggagctggaggccggggctgagagcgagctgagcctgcctgagaagctgcggcctgagcccccaggagtgcagctggaggagaagagcagcctgcagcccaaggacatctacccctacagtgatggagagtggccaccccaggccagcctgtctgctggggagctgaccagccccaagagtgacagcgagctggaggtgaggaccccagagcccagccccctgcgggcagagagccacatgcagtgggcctggggccgcctgcccaaggtggcccgggcagagaggcctgagagctctgtggtgctggagggccgggccggggccaccagccccccccggggcggccccagcacccccagcacctctgtggccggcggcgtggaccccctgggcctgcccatccagcagacagaagctggagctgacctgcagcctgacacagaggaccccaccctggtgggcccccccctgcacaccccagagacagaggagagcaagacccagagcagcggggacatgggcctgcccccagccagcaagtcctggagctgggccaccctggaggtgcctgtgcccaccggccagcctgagcgggtgtcccggggcaagggcagccccaagaggagccagcacctgggccccagcgacatctacctggatgacctgcccagcctggacagtgaaaatgctgccctgtacttcccccagagcgacagcggcctgggcgcccggcgctggagcgagcccagcagccagaagagcctgcgggaccccaaccctgagcacgagcctgagcccaccctggacacagtggacaccatcgccctgagcctgtgtggcggcctggccgacagccgggacatcagcctggagaagttcaaccagcacagcgtgtcctaccaggacctgaccaagaaccctggcctgctggatgaccccaacctggtggtgaagatcaacgggaagcactacaactgggccgtggccgcccccatgatcctgagcctgcaggccttccagaagaacctgcccaagagcaccatggacaagctggagcgggagaagatgcccaggaaaggaggccgctggtggttctcctggaggagaagagacttcctggccgaggagaggtctgcccagaaggagaagacagctgccaaggagcagcagggcgagaagacagaggtgctgagcagtgatgatgatgccccagacagccctgtgatcctggagatccccagcctgccccccagcaccccacccagcacccccacctacaagaagagcctgcggctgagcagtgaccagatccggcggctgaacctgcaggagggcgccaatgatgtggtgttttctgtgaccacccagtaccagggcacctgccgctgcaaggccaccatctacctgtggaagtgggatgacaaggtggtgatcagtgacattgatggcaccatcaccaagagtgatgccctgggccacatcctgccccagctgggcaaggactggacccaccagggcatcaccagcctgtaccacaagatccagctgaatggctacaagttcctgtactgcagcgcccgggccatcggcatggctgacctgaccaagggctacctgcagtgggtgtctgagggcggctgcagcctgcccaagggccccatcctgctgagccccagcagcctcttcagcgccctgcaccgggaggtgattgagaagaagccagaggtgttcaaggtggcctgcctgagtgacatccagcagctgttcctgccccacggccagcccttctacgccgccttcggcaaccggcccaatgatgtgtttgcctaccggcaggtgggcctgcctgagagccgcatcttcaccgtgaaccccagaggagagctgatccaggagctgatcaagaaccacaagagcacctatgagcggctgggggaggtggtggagctgctcttcccccctgtggcccggggccccagcacagacctggccaaccctgagtacagcaacttctgctactggagggagcccctgcctgctgtggacctggacaccctggactag

SEQ ID NO: 158046 - DNA, 1242 bp, Artificial Sequence
  Description of Artificial Sequence: Synthetic coding sequence
atgggcctgcccccagccagcaagtcctggagctgggccaccctggaggtgcctgtgcccaccggccagcctgagcgggtgtcccggggcaagggcagccccaagaggagccagcacctgggccccagcgacatctacctggatgacctgcccagcctggacagtgaaaatgctgccctgtacttcccccagagcgacagcggcctgggcgcccggcgctggagcgagcccagcagccagaagagcctgcgggaccccaaccctgagcacgagcctgagcccaccctggacacagtggacaccatcgccctgagcctgtgtggcggcctggccgacagccgggacatcagcctggagaagttcaaccagcacagcgtgtcctaccaggacctgaccaagaaccctggcctgctggatgaccccaacctggtggtgaagatcaacgggaagcactacaactgggccgtggccgcccccatgatcctgagcctgcaggccttccagaagaacctgcccaagaggtctgcccagaaggagaagacagctgccaaggagcagcagggcgagaagacagaggtgctgagcagtgatgatgatgccccagacagccctgtgatcctggagatccccagcctgccccccagcaccccacccagcacccccacctacaagaagagcctgcggctgagcagtgaccagatccggcggctgaacctgcaggagggcgccaatgatgtggtgttttctgtgaccacccagtaccagggcacctgccgctgcaaggccaccatctacctgtggaagtgggatgacaaggtggtgatcagtgacattgatggcaccatcaccaagagtgatgccctgggccacatcctgccccagctgggcaaggactggacccaccagggcatcaccagcctgtaccacaagatccagctgaatggctacaagttcctgtactgcagcgcccgggccatcggcatggctgacctgaccaagggctacctgcagtgggtgtctgagggcggctgcagcctgcccaagggccccatcctgctgagccccagcagcctcttcagcgccctgcaccgggaggtgattgagaagaagccagaggtgttcaaggtggcctgcctgagtgacatccagcagctgttcctgccccacggccagcccttctatgctgcctttggaaaccggcccaatgatgtgtttgcctaccggcaggtgggcctgccctag

SEQ ID NO: 158047 - DNA, 813 bp, Artificial Sequence
  Description of Artificial Sequence: Synthetic coding sequence
tgagtgaagatcaatggcaagcactacaactgggccgtggccgcccccatgatcctgagcctgcaggccttccagaagaacctgcccaagaggtctgcccagaaggagaagacagctgccaaggagcagcagggcgagaagacagaggtgctgagcagtgatgatgatgccccagacagccctgtgatcctggagatccccagcctgccccccagcaccccacccagcacccccacctacaagaagagcctgcggctgagcagtgaccagatccggcggctgaacctgcaggagggcgccaatgatgtggtgttttctgtgaccacccagtaccagggcacctgccgctgcaaggccaccatctacctgtggaagtgggatgacaaggtggtgatcagtgacattgatggcaccatcaccaagagtgatgccctgggccacatcctgccccagctgggcaaggactggacccaccagggcatcaccagcctgtaccacaagatccagctgaatggctacaagttcctgtactgcagcgcccgggccatcggcatggctgacctgaccaagggctacctgcagtgggtgtctgagggcggctgcagcctgcccaagggccccatcctgctgagccccagcagcctcttcagcgccctgcaccgggaggtgattgagaagaagccagaggtgttcaaggtggcctgcctgagtgacatccagcagctgttcctgccccacggccagcccttctacgccgccttcggcaaccggcccaatgatgtgtttgcctaccggcaggtgggcctgccctag

SEQ ID NO: 158048 - DNA, 531 bp, Artificial Sequence
  Description of Artificial Sequence: Synthetic coding sequence
atgaagcccctgctgctggccgtgtccctgggcctgattgctgccctgcaggcccaccacctgctggccagtgatgaggagatccaggatgtgtctggcacctggtacctgaaggccatgacagtggaccgggagttccctgagatgaacctggagagcgtgacccccatgaccctgaccaccctggagggcggcaacctggaggccaaggtgaccatgctgatcagcggccgctgccaggaggtgaaggctgtgctggagaagacagatgagcccgggaagtacacagcagatggcggcaagcacgtggcctacatcatccgcagccacgtgaaggaccactacatcttctactgtgagggggagctgcacggcaagcctgtgcggggcgtgaagctggtgggccgggaccccaagaacaacctggaggccctggaggactttgagaaggccgccggggcccggggcctgagcacagagagcatcctgatcccccggcagagcgagacctgcagccctggcagtgactag

SEQ ID NO: 158049 - DNA, 531 bp, Artificial Sequence; identical to SEQ ID NO: 158048
  Description of Artificial Sequence: Synthetic coding sequence

SEQ ID NO: 158050 - DNA, 564 bp, Artificial Sequence
  Description of Artificial Sequence: Synthetic coding sequence
atgaggcagggcctgctggtgctggccctggtgctggtgctggtgctggtgctggccgccggcagccaggtgcaggagtggtacccccgggagagccacgccctgaactggaacaagttcagcggcttctggtacatcctggccacagccacagatgcccagggcttcctgcctgcccgggacaagaggaagctgggcgcctctgtggtgaaggtgaacaaggtgggccagctgcgggtgctgctggccttcagaagaggccagggctgcggccgggcccagcccaggcaccctggcaccagcggccacctgtgggccagcctgtctgtgaagggcgtgaaggccttccacgtgctgagcacagactacagctatggcctggtgtacctgcggctgggccgggccacccagaactacaagaacctgctgctcttccaccggcagaatgtgagcagcttccagagcctgaaggagttcatggatgcctgtgacatcctgggcctgagcaaggccgccgtcatcctgcccaaggatgccagcaggacccacaccatcctgccctag

SEQ ID NO: 158051 - DNA, 603 bp, Artificial Sequence
  Description of Artificial Sequence: Synthetic coding sequence
atgaggcagggcctgctggtgctggccctggtgctggtgctggtgctggtgctggccgccggcagccaggtgcaggagtggtacccccgggagagccacgccctgaactggaacaagttcagcggcttctggtacatcctggccacagccacagatgcccagggcttcctgcctgcccgggacaagaggaagctgggcgcctctgtggtgaaggtgaacaaggtgggccagctgcgggtgctgctggccttccggcggctgaagggctgccagagccaggaggtgatcctgaggaaggatggcaagaagcctgtgtttggaaatgcctgtgcctatgctgctggcccccgggagggccaggagggcgtgaagggcgtgaaggccttccacgtgctgagcacagactacagctatggcctggtgtacctgcggctgggccgggccacccagaactacaagaacctgctgctcttccaccggcagaatgtgtcctccttccagagcctgaaggagttcatggatgcctgtgacatcctgggcctgagcaaggctgctgtgatcctgcccaaggatgccagcaggacccacaccatcctgccctag

SEQ ID NO: 158052 - DNA, 273 bp, Artificial Sequence
  Description of Artificial Sequence: Synthetic coding sequence
acctttgagctgagtgatgatggccgctttgaggtgtggaatgccatgacccggggccagcactgtgacacctggagctatgtgctgatcccagctgcccagcccggccagttcaccgtggaccacggcgtggacacccgggccggctggcccagcagcggcagcgcctgctgggccggggccggctgctgcctgcccggccgctggaccagcagcagcgcctgggccgagctgcgggccagcaggatgaccaccagcagcagccagatgtag

SEQ ID NO: 158053 - DNA, 579 bp, Artificial Sequence
  Description of Artificial Sequence: Synthetic coding sequence
atgaggctgctgtgtggcctgtggctgtggctgagcctgctgaaggtgctgcaggcccagacccccacccccctgcccctgcccccacccatgcagagcttccagggcaaccagttccagggcgagtggtttgtgctgggcctggccggcaacagcttccggcctgagcaccgggccctgctgaatgccttcaccgccacctttgagctgagtgatgatggccgctttgaggtgtggaatgccatgacccggggccagcactgtgacacctggagctatgtgctgatcccagctgcccagcccggccagttcaccgtggaccacggcgtggagcccggggctgaccgggaggagaccagggtggtggacagcgactacacccagtttgccctgatgctgagcagaagacacaccagccggctggccgtgctgcgcatcagcctgctgggccgctcctggctgctgcccccaggcaccctggaccagttcatctgcctgggccgggcccagggcctgagtgatgacaacatcgtgtttcctgatgtgacaggctggagcccccaggcctctgtgtgctag

SEQ ID NO: 158054 - DNA, 597 bp, Artificial Sequence
  Description of Artificial Sequence: Synthetic coding sequence
atgcccctgggcctgctgtggctgggcctggccctgctgggcgccctgcacgcccaggcccaggacagcaccagtgacctgatcccagccccacccctgagcaaggtgcccctgcagcagaacttccaggacaaccagttccagggcaagtggtacgtggtgggcctggccggaaatgccatcctgcgggaggacaaggacccccagaagatgtatgccaccatctatgagctgaaggaggacaagagctacaacgtgacctctgtgctcttcaggaagaagaagtgtgactactggatccgcacctttgtgcccggctgccagcctggagagttcaccctgggcaacatcaagagctacccaggcctgaccagctacctggtgcgggtggtgtccaccaactacaaccagcacgccatggtgttcttcaagaaggtgtcccagaaccgggagtacttcaagatcaccctgtatggccgcaccaaggagctgaccagcgagctgaaggagaacttcatccgcttcagcaagagcctgggcctgcctgagaaccacatcgtgtttcctgtgcccatcgaccagtgcattgatggatag

SEQ ID NO: 158055 - DNA, 603 bp, Artificial Sequence
  Description of Artificial Sequence: Synthetic coding sequence
atgcccctgggcctgctgtggctgggcctggccctgctgggcgccctgcacgcccaggcccaggacagcaccagtgacctgatcccagccccacccctgagcaaggtgcccctgcagcagaacttccaggacaaccagttccagggcaagtggtacgtggtgggcctggccggaaatgccatcctgcgggaggacaaggacccccagaagatgtatgccaccatctatgagctgaaggaggacaagagctacaacgtgacctctgtgctcttccgggagaaggcccagaagtgtgactactggatccgcacctttgtgcccggctgccagcctggagagttcaccctgggcaacatcaagagctacccaggcctgaccagctacctggtgcgggtggtgtccaccaactacaaccagcacgccatggtgttcttcaagaaggtgtcccagaaccgggagtacttcaagatcaccctgtatggccgcaccaaggagctgaccagcgagctgaaggagaacttcatccgcttcagcaagagcctgggcctgcctgagaaccacatcgtgtttcctgtgcccatcgaccagtgcattgatggatag

SEQ ID NO: 158056 - DNA, 603 bp, Artificial Sequence
  Description of Artificial Sequence: Synthetic coding sequence
atgcccctgggcctgctgtggctgggcctggccctgctgggcgccctgcacgcccaggcccaggacagcaccagtgacctgatcccagccccacccctgagcaaggtgcccctgcagcagaacttccaggacaaccagttccagggcaagtggtacgtggtgggcctggccggaaatgccatcctgcgggaggacaaggacccccagaagatgtatgccaccatctatgagctgaaggaggacaagagctacaacgtgacctctgtgctcttccggcagtggaagaagaagtgtgactactggatccgcacctttgtgcccggctgccagcctggagagttcaccctgggcaacatcaagagctacccaggcctgaccagctacctggtgcgggtggtgtccaccaactacaaccagcacgccatggtgttcttcaagaaggtgtcccagaaccgggagtacttcaagatcaccctgtatggccgcaccaaggagctgaccagcgagctgaaggagaacttcatccgcttcagcaagagcctgggcctgcctgagaaccacatcgtgtttcctgtgcccatcgaccagtgcattgatggatag

SEQ ID NO: 158057 - DNA, 597 bp, Artificial Sequence; identical to SEQ ID NO: 158054
  Description of Artificial Sequence: Synthetic coding sequence

SEQ ID NO: 158058 - DNA, 597 bp, Artificial Sequence
  Description of Artificial Sequence: Synthetic coding sequence
atgcccctgggcctgctgtggctgggcctggccctgctgggcgccctgcacgcccaggcccaggacagcaccagtgacctgatcccagccccacccctgagcaaggtgcccctgcagcagaacttccaggacaaccagttccagggcaagtggtacgtggtgggcctggccggaaatgccatcctgcgggaggacaaggacccccagaagatgtatgccaccatctatgagctgaaggaggacaagagctacaacgtgacctctgtgctcttcaggaagaagaagtgtgactactggatccgcacctttgtgcccggctgccagcctggagagttcaccctgggcaacatcaagagctacccaggcctgaccagctacctggtgcgggtggtgtccaccaactacaaccagcacgccatggtgttcttcaagaaggtgtcccagaaccgggagtacttcaagatcaccctgtatggccgcaccaaggagctgaccagcgagctgaaggagaacttcatccgcttcagcaagagcctgggcctgcctgagaaccacatcgtgtttcctgtgcccatcggaaatggccagagcggctag

SEQ ID NO: 158059 - DNA, 492 bp, Artificial Sequence
  Description of Artificial Sequence: Synthetic coding sequence
atgggcggcctgctgctggccgccttcctggccctggtgtctgtgccccgggcccaggccgtgtggctgggccgcctggaccctgagcagctgctgggcccctggtacgtgctggccgtggccagccgggagaagggctttgccatggagaaggacatgaagaatgtggtgggcgtggtggtgaccctgaccccagagaacaacctgcggaccctgagcagccagcacggcctgggcggctgtgaccagagcgtgatggacctgatcaagagaaattctggctgggtgtttgagaaccccagcattggagtgctggagctgtgggtgctggccaccaacttccgggactatgccatcatcttcacccagctggagtttggagatgagcccttcaacacagtggagctgtacagcctgacagaaacagccagccaggaggccatgggcctcttcaccaagtggagccgcagcctgggcttcctgagccagtag

SEQ ID NO: 158060 - DNA, 459 bp, Artificial Sequence
  Description of Artificial Sequence: Synthetic coding sequence
atggaggagctggaccggcagaagattggaggcttctggagggaggtgggcgtggccagtgaccagagcctggtgctgacagcccccaagagggtggagggcctcttcctgaccctgagcggcagcaacctgactgtgaaggtggcctacaacagcagcggcagctgtgaaattgagaagatcgtgggcagcgagattgacagcacaggcaagtttgccttccctggccaccgggagatccacgtgctggacacagattatgagggctacgccatcctgcgggtgtccctgatgtggaggggcaggaacttccgggtgctgaagtacttcaccaggagcctggaggacaaggaccggctgggcttctggaagttccgggagctgacagctgacaccggcctgtacctggccgcccggcccggccgctgtgccgagctgctgaaggaggagctgatctag

SEQ ID NO: 158061 - DNA, 531 bp, Artificial Sequence
  Description of Artificial Sequence: Synthetic coding sequence
atggccctgctgctgctgagcctgggcctgagcctgattgctgcccaggagtttgacccccacacagtgatgcagaggaactacaacgtggcccgggtgtctggagtgtggtacagcatcttcatggccagtgatgacctgaaccgcatcaaggaaaatggagacctgcgggtgtttgtgagaaatattgagcacctgaagaatggcagcctcatctttgattttgagtacatggtgcagggagaatgtgtggccgtggtggtggtgtgtgagaagacagagaagaatggagagtacagcatcaactatgagggccagaacacagtggccgtgtctgaaacagactaccgcctcttcatcaccttccacctgcagaacttcagaaatggaacagagacccacaccctggccctgtatgagacctgtgagaagtatggcctgggcagccagaacatcatcgacctgaccaacaaggacccctgctacagcaagcactaccgcagccccccccggccccccatgcgctggtag

SEQ ID NO: 158062 - DNA, 1119 bp, Artificial Sequence
  Description of Artificial Sequence: Synthetic coding sequence
atgagcctgcgctgtggagatgctgcccggaccctgggcccccgggtgtttggccgctacttctgcagccctgtgcggcccctgagcagcctgcctgacaagaagaaggagctgctgcagaatggaccagacctgcaggactttgtgtctggggacctggccgacaggagcacctgggatgagtacaagggcaacctgaagaggcagaagggggagcggctgcggctgcccccctggctgaagacagagatccccatgggcaagaactacaacaagctgaagaacaccctgaggaacctgaacctgcacacagtgtgtgaggaggcccgctgccccaacatcggggagtgctggggcggcggggagtatgccacagccacagccaccatcatgctgatgggagacacctgcacccggggctgccgcttctgcagcgtgaagacagccaggaaccccccacccctggatgccagcgagccctacaacacagccaaggccatcgccgagtggggcctggactatgtggtgctgacctctgtggacagagatgacatgccagatggaggagctgagcacatcgccaagacagtgtcctacctgaaggagaggaaccccaagatcctggtggagtgcctgaccccagacttccggggggacctgaaggccatcgagaaggtggccctgagcggcctggatgtgtatgcccacaacgtggagaccgtgcctgagctgcagagcaaggtgcgggacccccgggccaactttgaccagagcctgcgggtgctgaagcacgccaagaaggtgcagccagatgtgatcagcaagaccagcatcatgctgggcctgggggagaatgatgagcaggtgtatgccaccatgaaggccctgcgggaggctgatgtggactgcctgaccctgggccagtacatgcagcccacccggcggcacctgaaggtggaggagtacatcaccccagagaagttcaagtactgggagaaggtgggcaatgagctgggcttccactacacagccagcggccccctggtgcgcagcagctacaaggccggggagttcttcctgaagaacctggtggccaagaggaagaccaaggacctgtag

SEQ ID NO: 158063 - DNA, 969 bp, Artificial Sequence
  Description of Artificial Sequence: Synthetic coding sequence
atgagcctgcgctgtggagatgctgcccggaccctgggcccccgggtgtttggccgctacttctgcagccctgtgcggcccctgagcagcctgcctgacaagaagaaggagctgctgcagaatggaccagacctgcaggactttgtgtctggggacctggccgacaggagcacctgggatgagtacaagggcaacctgaagaggcagaagggggagcggctgcggctgcccccctggctgaagacagagatccccatgggcaagaactacaacaagctgaagaacaccctgaggaacctgaacctgcacacagtgtgtgaggaggcccgctgccccaacatcggggagtgctggggcggcggggagtatgccacagccacagccaccatcatgctgatgggagacacctgcacccggggctgccgcttctgcagcgtgaagacagccaggaaccccccacccctggatgccagcgagccctacaacacagccaaggccatcgccgagtggggcctggactatgtggtgctgacctctgtggacagagatgacatgccagatggaggagctgagcacatcgccaagacagtgtcctacctgaaggagaggaaccccaagatcctggtggagtgcctgaccccagacttccggggggacctgaaggccatcgagaaggtggccctgagcggcctggatgtgtatgcccacaacgtggagaccgtgcctgagctgcagagcaaggtgcgggacccccgggccaactttgaccagagcctgcgggtgctgaagcacgccaagaaggtgcagccagatgtgatcagcaagaccagcatcatgctgggcctgggggagaatgatgagcaggtgtatgccaccatgaaggccctgcgggaggctgatgtggactgcctgaccctgggccagtacatgcagcccacccggcggcacctgaaggtgaacttctcctag

SEQ ID NO: 158064 - DNA, 603 bp, Artificial Sequence
  Description of Artificial Sequence: Synthetic coding sequence
atggccagcagcctgacctgcaccggggtcatctgggccctgctgtccttcctgtgtgccgccaccagctgtgtgggcttcttcatgccctactggctgtggggcagccagctgggcaagcctgtgtcctttggcaccttccgccgctgcagctaccctgtgcatgatgagagccggcagatgatggtgatggtggaggagtgtggccgctatgccagcttccagggcatccccagcgctgagtggaggatctgcaccatcgtgacaggcctgggctgcggcctgctgctgctggtggccctgacagccctgatgggctgctgcgtgtctgacctgatcagcaggacagtgggccgggtggccggcggcatccagttcctgggcggcctgctgattggagctggctgtgccctgtaccccctgggctgggacagcgaggaggtgcggcagacctgtggctacaccagcggccagtttgacctgggcaaatgtgagatcggctgggcctactactgcacaggagctggggccacagctgccatgctgctgtgcacctggctggcctgcttcagcggcaagaagcagaagcactacccctactag

SEQ ID NO: 158065 - DNA, 663 bp, Artificial Sequence
  Description of Artificial Sequence: Synthetic coding sequence
atgaggagcagcctgaccatggtgggcaccctgtgggccttcctgagcctggtgacagctgtgaccagcagcaccagctacttcctgccctactggctgtttggcagccagatgggcaagcctgtgtccttcagcaccttccgccgctgcaactaccctgtgcggggggagggccacagcctcatcatggtggaggagtgtggccgctatgccagcttcaatgccatccccagcctggcctggcagatgtgcaccgtggtgactggagctggctgtgccctgctgctgctggtggccctggccgctgtgctgggctgctgcatggaggagctgatcagcaggatgatgggccgctgcatgggcgccgcccagtttgtgggcggcctgctgatcagcagcggctgtgccctgtaccccctgggctggaacagccctgagatcatgcagacctgtggaaatgtgagcaaccagttccagctgggcacctgccgcctgggctgggcctactactgtgccggcggcggcgctgctgctgccatgctgatctgcacctggctgagctgctttgctggcaggaaccccaagcctgtgatcctggtggagagcatcatgaggaacaccaacagctatgccatggagctggaccactgcctgaagccctag

SEQ ID NO: 158066 - DNA, 564 bp, Artificial Sequence
  Description of Artificial Sequence: Synthetic coding sequence
atgaggagcagcctgaccatggtgggcaccctgtgggccttcctgagcctggtgacagctgtgaccagcagcaccagctacttcctgccctactggctgtttggcagccagatgggcaagcctgtgtccttcagcaccttccgccgctgcaactaccctgtgcggggggagggccacagcctcatcatggtggaggagtgtggccgctatgccagcttcaatgccatccccagcctggcctggcagatgtgcaccgtggtgactggagctggctgtgccctgctgctgctggtggccctggccgctgtgctgggctgctgcatggaggagctgatcagcaggatgatgggccgctgcatgggcgccgcccagtttgtgggcggcacctgccgcctgggctgggcctactactgtgccggcggcggcgctgctgctgccatgctgatctgcacctggctgagctgctttgctggaagaaaccccaagcctgtgatcctggtggagagcatcatgaggaacaccaacagctatgccatggagctggaccactgcctgaagccctag

SEQ ID NO: 158067 - DNA, 687 bp, Artificial Sequence
  Description of Artificial Sequence: Synthetic coding sequence
atgtgccacgtgattgtgacctgccgctccatgctgtggaccctgctgagcatcgtggtggcctttgctgagctgattgccttcatgtctgctgactggctgattggcaaggcccggagccggggcggcgtggagcctgctggccctgggggcggcagccctgagccctaccaccccaccctgggcatctatgcccgctgcatcagaaatcctggggtgcagcacttccagagggacaccctgtgtggcccctatgcagagagctttggagagatcgccagcggcttctggcaggccacagccatcttcctggccgtgggcatcttcatcctgtgcatggtggccctggtgtctgtgttcaccatgtgtgtgcagagcatcatgaagaagagcatcttcaacgtgtgtggcctgctgcagggcattgctggcctcttcctgatcctgggcctcatcctgtacccagctggctggggctgccagaaggccatcgactactgcggccactacgccagcgcctacaagccaggggactgcagcctgggctgggccttctacacagccatcggcggcaccgtgctgaccttcatctgtgctgtgttcagcgcccaggccgagatcgccaccagcagtgacaaggtgcaggaggagattgaggagggcaagaacctgatctgcctgctgtag

SEQ ID NO: 158068 - DNA, 687 bp, Artificial Sequence; identical to SEQ ID NO: 158067
  Description of Artificial Sequence: Synthetic coding sequence

SEQ ID NO: 158069 - DNA, 669 bp, Artificial Sequence
  Description of Artificial Sequence: Synthetic coding sequence
atgctgcctgcccaggaggccgccaagctgtaccacaccaactacgtgaggaacagccgggccatcggcgtgctgtgggccatcttcaccatctgctttgccatcgtgaatgtggtgtgcttcatccagccctactggattggagatggagtggacaccccccaggccggctacttcggcctcttccactactgcattggaaatggcttcagccgggagctgacctgccggggcagcttcacagacttcagcaccctgcccagcggggccttcaaggccgccagcttcttcatcggcctgtccatgatgctgatcatcgcctgcatcatctgcttcaccctcttcttcttctgcaacacagccaccgtgtacaagatctgtgcctggatgcagctgaccagcgctgcctgcctggtgctgggctgcatgatcttcccagatggctgggacagtgatgaggtgaagaggatgtgtggggagaagacagacaagtacaccctgggcgcctgcagcgtgcgctgggcctacatcctggccatcatcggcatcctggatgccctgatcctgtccttcctggcctttgtgctgggcaaccggcaggacagcctgatggccgaggagctgaaggccgagaacaaggtgctgctgagccagtacagcctggagtag

SEQ ID NO: 158070 - DNA, 711 bp, Artificial Sequence
  Description of Artificial Sequence: Synthetic coding sequence
atgcctggagctgctgctgctgctgctgctgctgctgctgccatgctgcctgcccaggaggccgccaagctgtaccacaccaactacgtgaggaacagccgggccatcggcgtgctgtgggccatcttcaccatctgctttgccatcgtgaatgtggtgtgcttcatccagccctactggattggagatggagtggacaccccccaggccggctacttcggcctcttccactactgcattggaaatggcttcagccgggagctgacctgccggggcagcttcacagacttcagcaccctgcccagcggggccttcaaggccgccagcttcttcatcggcctgtccatgatgctgatcatcgcctgcatcatctgcttcaccctcttcttcttctgcaacacagccaccgtgtacaagatctgtgcctggatgcagctgaccagcggggactgcctggtgctgtttgacctgcacttcccagatggctgggacagtgatgaggtgaagaggatgtgtggggagaagacagacaagtacaccctgggcgcctgcagcgtgcgctgggcctacatcctggccatcatcggcatcctggatgccctgatcctgtccttcctggcctttgtgctgggcaaccggcaggacagcctgatggccgaggagctgaaggccgagaacaaggtgctgctgagccagtacagcctggagtag

SEQ ID NO: 158071 - DNA, 699 bp, Artificial Sequence
  Description of Artificial Sequence: Synthetic coding sequence
atgcctggagctgctgctgctgctgctgctgctgctgctgccatgctgcctgcccaggaggccgccaagctgtaccacaccaactacgtgaggaacagccgggccatcggcgtgctgtgggccatcttcaccatctgctttgccatcgtgaatgtggtgtgcttcatccagccctactggattggagatggagtggacaccccccaggccggctacttcggcctcttccactactgcattggaaatggcttcagccgggagctgacctgccggggcagcttcacagacttcagcaccctgcccagcggggccttcaaggccgccagcttcttcatcggcctgtccatgatgctgatcatcgcctgcatcatctgcttcaccctcttcttcttctgcaacacagccaccgtgtacaagatctgtgcctggatgcagctgaccagcggggactgcctggtgctgtttgacctgcacttcccagatggctgggacagtgatgaggtgaagaggatgtgtggggagaagacagacaagtacaccctgggcgcctgcagcgtgcgctgggcctacatcctggccatcatcggcatcctggatgccctgatcctgtccttcctggcctttgtgctgggcaaccggcaggacagcctgatggccgaggagctgaaggccgagaacaaggatgatggaaatgcctag

SEQ ID NO: 158072 - DNA, 660 bp, Artificial Sequence
  Description of Artificial Sequence: Synthetic coding sequence
atggtgaagctgctgcctgcccaggaggccgccaagatctaccacaccaactacgtgaggaacagcagagctgtgggcgtgatgtggggcaccctgaccatctgcttctctgtgctggtgatggccctcttcatccagccctactggattggagacagcgtgaacaccccccaggccggctacttcggcctcttctcctactgtgtgggcaatgtgctgagcagcgagctgatctgcaagggcggccccctggacttcagcagcatccccagccgggccttcaagacagccatgttctttgtggccctgggcatgttcctgatcatcggcagcatcatctgcttcagcctcttcttcatctgcaacacagccaccgtgtacaagatctgtgcctggatgcagctggccgccgccaccggcctgatgattggctgcctggtgtacccagatggctgggacagcagcgaggtgcggaggatgtgtggggagcagacaggcaagtacaccctgggccactgcaccatccgctgggccttcatgctggccatcctgagcattggagatgccctgatcctgtccttcctggcctttgtgctgggctaccggcaggacaagctgctgcctgatgactacaaggcagatggaacagaggaggtgtag

SEQ ID NO: 158073 - DNA, 660 bp, Artificial Sequence; identical to SEQ ID NO: 158072
  Description of Artificial Sequence: Synthetic coding sequence

SEQ ID NO: 158074 - DNA, 675 bp, Artificial Sequence
  Description of Artificial Sequence: Synthetic coding sequence
atgtctgtgtttgggaagctgtttggagctgggggcggcaaggccgggaaaggaggccccaccccccaggaggccatccagaggctgcgggacacagaggagatgctgagcaagaagcaggagttcctggagaagaagattgagcaggagctgacagctgccaagaagcacggcaccaagaacaagagagctgccctgcaggccctgaagaggaagaagagatatgagaagcagctggcccagattgatggcaccctgagcaccatcgagttccagcgggaggccctggagaatgccaacaccaacacagaggtgctgaagaacatgggctacgccgccaaggccatgaaggccgcccatgacaacatggacatcgacaaggtggatgagctgatgcaggacattgctgaccagcaggagctggccgaggagatcagcacagccatcagcaagcctgtgggctttggagaggagtttgatgaagatgagctgatggccgagctggaggagctggagcaggaggagctggacaagaacctgctggagatcagcggccctgagaccgtgcccctgcccaacgtgcccagcatcgccctgcccagcaagccagccaagaagaaggaggaggaggatgatgacatgaaggagctggagaactgggccggctccatgtag

SEQ ID NO: 158075 - DNA, 1434 bp, Artificial Sequence
  Description of Artificial Sequence: Synthetic coding sequence
atgggcgccctggcccgggccctgcccagcatcctgctggccctgctgctgaccagcaccccagaggccctgggcgccaaccctggcctggtggcccgcatcacagacaagggcctgcagtatgctgcccaggagggcctgctggccctgcagagcgagctgctgcgcatcaccctgcctgacttcaccggggacctgcgcatcccccacgtgggccggggccgctatgagttccacagcctgaacatccacagctgtgagctgctgcacagcgccctgcggcctgtgcccggccagggcctgagcctgagcatcagtgacagcagcatccgggtgcagggccgctggaaggtgaggaagagcttcttcaagctgcagggcagctttgatgtgtctgtgaagggcatcagcatctctgtgaacctgctgctgggcagcgagagcagcggccggcccaccgtgacagccagcagctgcagcagtgacattgctgatgtggaggtggacatgtctggggacctgggctggctgctgaacctcttccacaaccagatcgagagcaagttccagaaggtgctggagagccgcatctgtgagatgatccagaagtctgtgtccagtgacctgcagccctacctgcagaccctgcctgtgaccacagaaattgacagctttgctgacatcgactacagcctggtggaggccccccgggccacagcccagatgctggaggtgatgttcaagggggagatcttccacaggaaccacaggagccctgtgaccctgctggccgctgtgatgagcctgcctgaggagcacaacaagatggtgtactttgccatcagtgactatgtgttcaacacagccagcctggtgtaccacgaggagggctacctgaacttcagcatcacagatgacatgatccccccagacagcaacatccggctgaccaccaagagcttccggccctttgtgccccggctggcccggctgtaccccaacatgaacctggagctgcagggctctgtgcccagcgcccccctgctgaacttcagccctggcaacctgtctgtggacccctacatggagattgatgcctttgtgctgctgcccagcagcagcaaggagcctgtgttccggctgtctgtggccaccaacgtgtctgccaccctgaccttcaacaccagcaagatcaccggcttcctgaagccaggcaaggtgaaggtggagctgaaggagagcaaggtgggcctcttcaatgctgagctgctggaggccctgctgaactactacatcctgaacaccttctaccccaagttcaatgacaagctggccgagggcttccccctgcccctgctgaagagggtgcagctgtatgacctgggcctgcagatccacaaggacttccccagccggcgggaccaccccccatag

SEQ ID NO: 158076 - DNA, 486 bp, Artificial Sequence
  Description of Artificial Sequence: Synthetic coding sequence
atgtctgtgcccggcccctaccaggccgccaccggccccagcagcgcccccagcgccccacccagctatgaggagaccgtggccgtgaacagctactaccccaccccaccagcccccatgcctggccccaccaccggcctggtgactggaccagatggcaagggcatgaacccccccagctactacacccagcctgcccccatccccaacaacaaccccatcaccgtgcagacagtgtatgtgcagcaccccatcaccttcctggaccggcccatccagatgtgctgccccagctgcaacaagatgattgtgtcccagctgagctacaatgctggggccctgacctggctgagctgtggcagcctgtgcctgctgggctgcatcgccggctgctgcttcatccccttctgtgtggatgccctgcaggatgtggaccactactgccccaactgccgggccctgctgggcacctacaagaggctgtag

SEQ ID NO: 158077 - DNA, 687 bp, Artificial Sequence
  Description of Artificial Sequence: Synthetic coding sequence
atgtctgtgcccggcccctaccaggccgccaccggccccagcagcgcccccagcgccccacccagctatgaggagaccgtggccgtgaacagctactaccccaccccaccagcccccatgcctggccccaccaccggcctggtgactggaccagatggcaagggcatgaacccccccagctactacacccagcctgcccccatccccaacaacaaccccatcaccgtgcagacagtgtatgtgcagcaccccatcaccttcctggaccggcccatccagatgtgctgccccagctgcaacaagatgattgtgtcccagctgagctacaatgctggggccctgacctggctgagctgtggcagcctgtgcctgctgggcgtgcacagcggcctgctgctgcaccccctgctgcggggctgcccagctggccggggccccctgctgagccagctgcagagcagccctggccacctgcaggcctttgtgggcctgagccagacctggagggagcctggagctgctggcagccccttccacctgagcagcagcttcacccctgggggcggcagcgccctggtggtgagccccctgcagggcgcccacctgcacgtgttcttctggggcgagtatgtggccaagctgaccaacctgcagaccccagaaattgctgcctggagccgggcctag

SEQ ID NO: 158078 - DNA, 459 bp, Artificial Sequence
  Description of Artificial Sequence: Synthetic coding sequence
atgtctgtgcccggcccctaccaggccgccaccggccccagcagcgcccccagcgccccacccagctatgaggagaccgtggccgtgaacagctactaccccaccccaccagcccccatgcctggccccaccaccggcctggtgactggaccagatggcaagggcatgaacccccccagctactacacccagcctgcccccatccccaacaacaaccccatcaccgtgcagacagtgtatgtgcagcaccccatcaccttcctggaccggcccatccagatgtgctgccccagctgcaacaagatgattgtgtcccagctgagctacaatgctggggccctgacctggctgagctgtggcagcctgtgcctgctgggccaggagtgcagcggcaccatcgtggccctgcggagctttgacctgctgggcagctgcaacccccccagcagcgccagctag

SEQ ID NO: 158079 - DNA, 486 bp, Artificial Sequence; identical to SEQ ID NO: 158076
  Description of Artificial Sequence: Synthetic coding sequence

SEQ ID NO: 158080 - DNA, 6123 bp, Artificial Sequence
  Description of Artificial Sequence: Synthetic coding sequence
atggagcacaaggaggtggtgctgctgctgctgctcttcctgaagtctgctgcccctgagcagagccacgtggtgcaggactgctaccatggagatggccagagctaccggggcacctacagcaccaccgtgactggaagaacctgccaggcctggagctccatgaccccccaccagcacaacagaaccacagagaactacccaaatgccggcctcatcatgaactactgcaggaacccagatgctgtggccgccccctactgctacacccgggaccccggggtgcgctgggagtactgcaacctgacccagtgcagtgatgctgagggcacagctgtggcccccccaacagtgacccctgtgcccagcctggaggcccccagcgagcaggcccccacagagcagaggcctggggtgcaggagtgctaccacggcaatggccagagctaccggggcacctacagcaccaccgtgactggaagaacctgccaggcctggagctccatgaccccccacagccacagcaggaccccagagtactacccaaatgccggcctcatcatgaactactgcaggaacccagatgctgtggccgccccctactgctacacccgggaccccggggtgcgctgggagtactgcaacctgacccagtgcagtgatgctgagggcacagctgtggcccccccaacagtgacccctgtgcccagcctggaggcccccagcgagcaggcccccacagagcagaggcctggggtgcaggagtgctaccacggcaatggccagagctaccggggcacctacagcaccaccgtgactggaagaacctgccaggcctggagctccatgaccccccacagccacagcaggaccccagagtactacccaaatgccggcctcatcatgaactactgcaggaacccagatgctgtggccgccccctactgctacacccgggaccccggggtgcgctgggagtactgcaacctgacccagtgcagtgatgctgagggcacagctgtggcccccccaacagtgacccctgtgcccagcctggaggcccccagcgagcaggcccccacagagcagaggcctggggtgcaggagtgctaccacggcaatggccagagctaccggggcacctacagcaccaccgtgactggaagaacctgccaggcctggagctccatgaccccccacagccacagcaggaccccagagtactacccaaatgccggcctcatcatgaactactgcaggaacccagatgctgtggccgccccctactgctacacccgggaccccggggtgcgctgggagtactgcaacctgacccagtgcagtgatgctgagggcacagctgtggcccccccaacagtgacccctgtgcccagcctggaggcccccagcgagcaggcccccacagagcagaggcctggggtgcaggagtgctaccacggcaatggccagagctaccggggcacctacagcaccaccgtgactggaagaacctgccaggcctggagctccatgaccccccacagccacagcaggaccccagagtactacccaaatgccggcctcatcatgaactactgcaggaacccagatgctgtggccgccccctactgctacacccgggaccccggggtgcgctgggagtactgcaacctgacccagtgcagtgatgctgagggcacagctgtggcccccccaacagtgacccctgtgcccagcctggaggcccccagcgagcaggcccccacagagcagaggcctggggtgcaggagtgctaccacggcaatggccagagctaccggggcacctacagcaccaccgtgactggaagaacctgccaggcctggagctccatgaccccccacagccacagcaggaccccagagtactacccaaatgccggcctcatcatgaactactgcaggaacccagatgctgtggccgccccctactgctacacccgggaccccggggtgcgctgggagtactgcaacctgacccagtgcagtgatgctgagggcacagctgtggcccccccaacagtgacccctgtgcccagcctggaggcccccagcgagcaggcccccacagagcagaggcctggggtgcaggagtgctaccacggcaatggccagagctaccggggcacctacagcaccaccgtgactggaagaacctgccaggcctggagctccatgaccccccacagccacagcaggaccccagagtactacccaaatgccggcctcatcatgaactactgcaggaacccagatgctgtggccgccccctactgctacacccgggaccccggggtgcgctgggagtactgcaacctgacccagtgcagtgatgctgagggcacagctgtggcccccccaacagtgacccctgtgcccagcctggaggcccccagcgagcaggcccccacagagcagaggcctggggtgcaggagtgctaccacggcaatggccagagctaccggggcacctacagcaccaccgtgactggaagaacctgccaggcctggagctccatgaccccccacagccacagcaggaccccagagtactacccaaatgccggcctcatcatgaactactgcaggaacccagaccctgtggccgccccctactgctacacccgggaccccagcgtgcgctgggagtactgcaacctgacccagtgcagtgatgctgagggcacagctgtggccccacccaccatcacccccatccccagcctggaggcccccagcgagcaggcccccacagagcagaggcctggggtgcaggagtgctaccacggcaatggccagagctaccagggcacctacttcatcaccgtgactggaagaacctgccaggcctggagctccatgaccccccacagccacagcaggaccccagcctactacccaaatgccggcctcatcaagaactactgcaggaacccagaccctgtggccgccccctggtgctacaccacagaccccagcgtgcgctgggagtactgcaacctgacccgctgcagtgatgctgagtggacagcctttgtgcccccaaatgtcatcctggcccccagcctggaggccttctttgagcaggccctgacagaggagaccccaggagtgcaggactgctactaccactacggccagagctaccggggcacctacagcaccaccgtgactggaagaacctgccaggcctggagctccatgaccccccaccagcacagcaggaccccagagaactacccaaatgccggcctgaccaggaactactgcaggaacccagatgctgagatccggccctggtgctacaccatggaccccagcgtgcgctgggagtactgcaacctgacccagtgcctggtgacagagagctctgtgctggccaccctgactgtggtgcctgaccccagcacagaggccagcagcgaggaggcccccacagagcagagccctggggtgcaggactgctaccatggagatggccagagctaccggggcagcttcagcaccaccgtgactggaagaacctgccagagctggagctccatgaccccccactggcaccagaggaccacagagtactacccaaatggaggcctgaccaggaactactgcaggaacccagatgctgagatcagcccctggtgctacaccatggaccccaacgtgcgctgggagtactgcaacctgacccagtgccctgtgacagagagctctgtgctggccaccagcacagctgtgtctgagcaggcccccacagagcagagccccaccgtgcaggactgctaccatggagatggccagagctaccggggcagcttcagcaccaccgtgactggaagaacctgccagagctggagctccatgaccccccactggcaccagaggaccacagagtactacccaaatggaggcctgaccaggaactactgcaggaacccagatgctgagatccggccctggtgctacaccatggaccccagcgtgcgctgggagtactgcaacctgacccagtgccctgtgatggagagcaccctgctgaccacccccaccgtggtgcctgtgcccagcacagagctgcccagcgaggaggcccccacagagaacagcactggagtgcaggactgctacagaggagatggccagagctaccggggcaccctgagcaccaccatcactggaagaacctgccagagctggagctccatgaccccccactggcaccggcgcatccccctgtactacccaaatgccggcctgaccaggaactactgcaggaacccagatgctgagatccggccctggtgctacaccatggaccccagcgtgcgctgggagtactgcaacctgacccgctgccctgtgacagagagctctgtgctgaccacccccaccgtggcccctgtgcccagcacagaggcccccagcgagcaggcccctcctgagaagagccctgtggtgcaggactgctaccatggagatggccgcagctaccggggcatcagcagcaccaccgtgactggaagaacctgccagagctggagctccatgatcccccactggcaccagaggaccccagagaactacccaaatgccggcctgacagagaactactgcaggaacccagacagcggcaagcagccctggtgctacaccacagacccctgtgtgcgctgggagtactgcaacctgacccagtgcagcgagacagagagcggcgtgctggagacccccaccgtggtgcctgtgcccagcatggaggcccacagcgaggccgcccccacagagcagacccctgtggtgcggcagtgctaccacggcaatggccagagctaccggggcaccttcagcaccaccgtgactggaagaacctgccagagctggagctccatgaccccccaccgccaccagaggaccccagagaactacccaaatgatggcctgaccatgaactactgcaggaacccagatgctgacaccggcccctggtgcttcaccatggaccccagcatccgctgggagtactgcaacctgacccgctgcagcgacacagagggcaccgtggtggcccccccaacagtcatccaggtgcccagcctgggcccccccagcgagcaggactgcatgtttggaaatggcaagggctaccggggcaagaaggccaccaccgtgacaggcaccccctgccaggagtgggccgcccaggagccccaccgccacagcaccttcatccctggcaccaacaagtgggccggcctggagaagaactactgcagaaatccagatggagacatcaatggcccctggtgctacaccatgaaccccaggaagctgtttgactactgtgacatccccctgtgtgccagcagcagctttgactgtgggaagccccaggtggagcccaagaagtgccccggcagcatcgtgggcggctgtgtggcccacccccacagctggccctggcaggtgtccctgcggaccaggtttgggaagcacttctgtggcggcaccctcatcagccctgagtgggtgctgacagctgcccactgcctgaagaagagcagccggcccagcagctacaaggtgatcctgggcgcccaccaggaggtgaacctggagagccacgtgcaggagattgaggtgtcccggctcttcctggagcccacccaggccgacatcgccctgctgaagctgagcaggcctgctgtgatcacagacaaggtgatgcctgcctgcctgcccagcccagactacatggtgacagccaggacagagtgctacatcaccggctggggcgagacccagggcaccttcggcaccggcctgctgaaggaggcccagctgctggtgattgaaaatgaggtgtgcaaccactacaagtacatctgtgccgagcacctggcccggggcacagacagctgccagggcgacagcggcggccccctggtgtgctttgagaaggacaagtacatcctgcagggcgtgacctcctggggcctgggctgtgcccggcccaacaagccaggagtgtatgcccgggtgtccagatttgtgacctggattgagggcatgatgaggaacaactag

SEQ ID NO: 158081 - DNA, 6123 bp, Artificial Sequence; identical to SEQ ID NO: 158080
  Description of Artificial Sequence: Synthetic coding sequence

SEQ ID NO: 158082 - DNA, 4602 bp, Artificial Sequence
  Description of Artificial Sequence: Synthetic coding sequence
atgatgcagctgaccctgaacaccctcttccctgtggtgtccaccccagccatcacctacatcgtgacagtgttcaccggagatgtgcggggggccggcaccaagagcaagatctacctggtgatgtatggagcccggggcaacaagaacagcggcaagatcttcctggagggcggcgtgtttgaccggggccgcacagacatcttccacatcgagctggccgtgctgctgagccccctgagccgggtgtctgtgggccatggaaatgtgggcgtgaacagaggctggttctgtgagaaggtggtgatcctgtgccccttcaccggcatccagcagaccttcccctgcagcaactggctggatgagaagaaggcagatggcctgattgagcggcagctgtatgagatggtgtccctgaggaagaagaggctgaagaagttcccctggagcctgtgggtgtggaccacagacctgaagaaggccggcaccaacagccccatcttcatccagatctacggccagaagggccgcacagatgagatcctgctgaaccccaacaacaagtggttcaagccaggcatcatcgagaagttccgcatcgagctgcctgacctgggccgcttctacaagatccgggtgtggcatgacaagaggagcagcggcagcggctggcacctggagaggatgaccctgatgaacaccctgaacaaggacaagtacaacttcaactgcaaccgctggctggatgccaatgaagatgacaatgaaattgtgcgggagatgacagctgagggccccaccgtgcggcgcatcatgggcatggcccgctaccacgtgacagtgtgcacaggagagctggagggcgccggcacagatgccaacgtgtacctgtgcctgtttggagatgtgggggacaccggggagcggctgctgtacaactgcaggaacaacacagacctgtttgagaagggaaatgctgatgagttcaccattgaatctgtgaccatgagaaatgtgcggcgggtgcgcatcagacatgatggaaaaggaagtggcagcggctggtacctggacagagtgctggtgcgggaggagggccagcctgagagtgacaacgtggagttcccctgcctgcgctggctggacaaggacaaggatgatggccagctggtgcgggagctgctgcccagcgacagcagcgccaccctgaagaacttccgctaccacatcagcctgaagacaggagatgtgtctggggccagcacagacagccgggtgtacatcaagctgtatggagacaagagtgacaccatcaagcaggtgctgctggtgtctgacaacaacctgaaggactactttgagcggggccgggtggatgagttcaccctggagaccctgaacatcggcaacatcaaccggctggtgattggacatgacagcacaggcatgcacgcctcctggttcctgggctctgtgcagatccgggtgccccggcagggcaagcagtacaccttccctgccaaccgctggctggacaagaaccaggctgatggccgcctggaggtggagctgtaccccagcgaggtggtggagatccagaagctggtgcactatgaggtggagatctggacaggagatgtgggcggggccggcaccagcgcccgggtgtacatgcagatctatggagagaagggcaagacagaggtgctcttcctgagcagccgcagcaaggtgtttgagcgggccagcaaggacaccttccagctggaggccgcagatgtgggggaggtgtacaagctgcggctgggccacactggagagggcttcggccccagctggtttgtggacacagtgtggctgcggcacctggtggtgcgggaggtggacctgaccccagaggaggaggccaggaagaagaaggagaaggacaagctgcggcagctgctgaagaaggagcggctgaaggccaagctgcagaggaagaagaagaagaggaagggcagtgatgaagaagatgaaggagaggaggaggagagcagcagcagcgaggagagcagcagcgaggaggaggagatggaggaggaggaggaggaggaggagtttggacctggcatgcaggaggtgattgagcagcacaagtttgaggcccaccgctggctggcccggggcaaggaggacaatgagctggtggtggagctggtgcctgctgggaagccaggccctgagaggaacacctatgaggtgcaggtggtgactggaaatgtgcccaaggccggcacagatgccaacgtgtacctgaccatctatggagaggagtatggagacaccggggagcggcccctgaagaagagtgacaagagcaacaagtttgagcagggccagacagacaccttcaccatctatgccatcgacctgggcgccctgaccaagatccgcatcagacatgacaacacaggcaacagagctggctggttcctggacagaattgacatcacagacatgaacaatgagatcacctactacttcccctgccagcgctggctggccgtggaggaggatgatggccagctgagccgggagctgctgcctgtggatgagagctatgtgctgccccagagcgaggagggccggggcggcggggacaacaaccccctggacaacctggccctggagcagaaggacaagagcaccaccttctctgtgaccatcaagacaggagtgaagaagaatgccggcacagatgccaacgtgttcatcaccctgtttggcacccaggatgacaccggcatgaccctgctgaagagcagcaagaccaacagcgacaagtttgagcgggacagcattgagatcttcaccgtggagaccctggacctgggggacctgtggaaggtgcggctgggccatgacaacacaggcaaggcccctggctggtttgtggactgggtggaggtggatgcccccagcctgggcaagtgcatgaccttcccctgtggccgctggctggccaagaatgaagatgatggcagcatcatccgggacctcttccacgccgagctgcagacccggctgtacaccccatttgtgccctatgagatcaccctgtacaccagtgatgtgtttgctgctggaacagatgccaacatcttcatcatcatctacggctgtgatgctgtgtgcacccagcagaagtacctgtgcaccaacaagcgggagcagaagcagttctttgagaggaagagcgccagccgcttcatcgtggagctggaggatgtgggggagatcatcgagaagatccgcatcggccacaacaacacaggcatgaaccctggctggcactgcagccacgtggacatccggcggctgctgcctgacaaggatggagctgagaccctgaccttcccctgtgaccgctggctggccaccagtgaagatgacaagaagaccatccgggagctggtgccctatgacatcttcacagagaagtacatgaaggatggcagcctgcggcaggtgtacaaggaggtggaggagcccctggacatcgtgctgtacagcgtgcagatcttcaccggcaacatccctggggccggcacagatgccaaggtgtacatcaccatctatggagacctgggggacacaggagagcgctacctgggcaagtctgagaacagaaccaacaagtttgagcggggcacagctgacaccttcatcatcgaggccgctgacctgggcgtcatctacaagatcaagctgcggcatgacaacagcaagtggtgtgccgactggtacgtggagaaggtggagatctggaatgacaccaatgaagatgagttcctgttcctgtgtggccgctggctgagcctgaagaaggaggatggccgcctggagcggctcttctatgagaaggagtacacaggagacaggagcagcaactgcagcagccctgctgacttctgggagatcgccctgagcagcaagatggctgatgtggacatcagcacagtgacaggccccatggctgactatgtgcaggagggccccatcatcccctactacgtgtctgtgaccaccgggaagcacaaggatgctgccacagacagccgggccttcatcttcctgattggagaagatgatgagaggagcaagaggatctggctggactacccccggggcaagaggggcttcagccggggctctgtggaggagttctacgtggccggcctggatgtgggcatcatcaagaagattgaggtgctgtatgagatgacagtgtggacaggagatgtggtgggcggcggcacagacagcaacatcttcatgaccctgtatggcatcaatggcagcacagaggagatgcagctggacaagaagaaggccaggtttgagcgggagcagaatgacaccttcatcatggagatcctggacatcgcccccttcaccaagatgaggatcagaattgatggcctgggcagcaggcctgagtggttcctggagcgggtgaagtgcctggacccccacagcagcttccagcccccacccacccccagccctggcagcagcggcctgtccatggacctggtgaaggcccagatgagcctgtag

SEQ ID NO: 158083 - DNA, 5844 bp, Artificial Sequence
  Description of Artificial Sequence: Synthetic coding sequence
atgatgcagctgaccctgaacaccctcttccctgtggtgtccaccccagccatcacctacatcgtgacagtgttcaccggagatgtgcggggggccggcaccaagagcaagatctacctggtgatgtatggagcccggggcaacaagaacagcggcaagatcttcctggagggcggcgtgtttgaccggggccgcacagacatcttccacatcgagctggccgtgctgctgagccccctgagccgggtgtctgtgggccatggaaatgtgggcgtgaacagaggctggttctgtgagaaggtggtgatcctgtgccccttcaccggcatccagcagaccttcccctgcagcaactggctggatgagaagaaggcagatggcctgattgagcggcagctgtatgagatggtgtccctgaggaagaagaggctgaagaagttcccctggagcctgtgggtgtggaccacagacctgaagaaggccggcaccaacagccccatcttcatccagatctacggccagaagggccgcacagatgagatcctgctgaaccccaacaacaagtggttcaagccaggcatcatcgagaagttccgcatcgagctgcctgacctgggccgcttctacaagatccgggtgtggcatgacaagaggagcagcggcagcggctggcacctggagaggatgaccctgatgaacaccctgaacaaggacaagtacaacttcaactgcaaccgctggctggatgccaatgaagatgacaatgaaattgtgcgggagatgacagctgagggccccaccgtgcggcgcatcatgggcatggcccgctaccacgtgacagtgtgcacaggagagctggagggcgccggcacagatgccaacgtgtacctgtgcctgtttggagatgtgggggacaccggggagcggctgctgtacaactgcaggaacaacacagacctgtttgagaagggaaatgctgatgagttcaccattgaatctgtgaccatgagaaatgtgcggcgggtgcgcatcagacatgatggaaaaggaagtggcagcggctggtacctggacagagtgctggtgcgggaggagggccagcctgagagtgacaacgtggagttcccctgcctgcgctggctggacaaggacaaggatgatggccagctggtgcgggagctgctgcccagcgacagcagcgccaccctgaagaacttccgctaccacatcagcctgaagacaggagatgtgtctggggccagcacagacagccgggtgtacatcaagctgtatggagacaagagtgacaccatcaagcaggtgctgctggtgtctgacaacaacctgaaggactactttgagcggggccgggtggatgagttcaccctggagaccctgaacatcggcaacatcaaccggctggtgattggacatgacagcacaggcatgcacgcctcctggttcctgggctctgtgcagatccgggtgccccggcagggcaagcagtacaccttccctgccaaccgctggctggacaagaaccaggctgatggccgcctggaggtggagctgtaccccagcgaggtggtggagatccagaagctggtgcactatgaggtggagatctggacaggagatgtgggcggggccggcaccagcgcccgggtgtacatgcagatctatggagagaagggcaagacagaggtgctcttcctgagcagccgcagcaaggtgtttgagcgggccagcaaggacaccttccagctggaggccgcagatgtgggggaggtgtacaagctgcggctgggccacactggagagggcttcggccccagctggtttgtggacacagtgtggctgcggcacctggtggtgcgggaggtggacctgaccccagaggaggaggccaggaagaagaaggagaaggacaagctgcggcagctgctgaagaaggagcggctgaaggccaagctgcagaggaagaagaagaagaggaagggcagtgatgaagaagatgaaggagaggaggaggagagcagcagcagcgaggagagcagcagcgaggaggaggagatggaggaggaggaggaggaggaggagtttggacctggcatgcaggaggtgattgagcagcacaagtttgaggcccaccgctggctggcccggggcaaggaggacaatgagctggtggtggagctggtgcctgctgggaagccaggccctgagaggaacacctatgaggtgcaggtggtgactggaaatgtgcccaaggccggcacagatgccaacgtgtacctgaccatctatggagaggagtatggagacaccggggagcggcccctgaagaagagtgacaagagcaacaagtttgagcagggccagacagacaccttcaccatctatgccatcgacctgggcgccctgaccaagatccgcatcagacatgacaacacaggcaacagagctggctggttcctggacagaattgacatcacagacatgaacaatgagatcacctactacttcccctgccagcgctggctggccgtggaggaggatgatggccagctgagccgggagctgctgcctgtggatgagagctatgtgctgccccagagcgaggagggccggggcggcggggacaacaaccccctggacaacctggccctggagcagaaggacaagagcaccaccttctctgtgaccatcaagacaggagtgaagaagaatgccggcacagatgccaacgtgttcatcaccctgtttggcacccaggatgacaccggcatgaccctgctgaagagcagcaagaccaacagcgacaagtttgagcgggacagcattgagatcttcaccgtggagaccctggacctgggggacctgtggaaggtgcggctgggccatgacaacacaggcaaggcccctggctggtttgtggactgggtggaggtggatgcccccagcctgggcaagtgcatgaccttcccctgtggccgctggctggccaagaatgaagatgatggcagcatcatccgggacctcttccacgccgagctgcagacccggctgtacaccccatttgtgccctatgagatcaccctgtacaccagtgatgtgtttgctgctggaacagatgccaacatcttcatcatcatctacggctgtgatgctgtgtgcacccagcagaagtacctgtgcaccaacaagcgggagcagaagcagttctttgagaggaagagcgccagccgcttcatcgtggagctggaggatgtgggggagatcatcgagaagatccgcatcggccacaacaacacaggcatgaaccctggctggcactgcagccacgtggacatccggcggctgctgcctgacaaggatggagctgagaccctgaccttcccctgtgaccgctggctggccaccagtgaagatgacaagaagaccatccgggagctggtgccctatgacatcttcacagagaagtacatgaaggatggcagcctgcggcaggtgtacaaggaggtggaggagcccctggacatcgtgctgtacagcgtgcagatcttcaccggcaacatccctggggccggcacagatgccaaggtgtacatcaccatctatggagacctgggggacacaggagagcgctacctgggcaagtctgagaacagaaccaacaagtttgagcggggcacagctgacaccttcatcatcgaggccgctgacctgggcgtcatctacaagatcaagctgcggcatgacaacagcaagtggtgtgccgactggtacgtggagaaggtggagatctggaatgacaccaatgaagatgagttcctgttcctgtgtggccgctggctgagcctgaagaaggaggatggccgcctggagcggctcttctatgagaaggagtacacaggagacaggagcagcaactgcagcagccctgctgacttctgggagatcgccctgagcagcaagatggctgatgtggacatcagcacagtgacaggccccatggctgactatgtgcaggagggccccatcatcccctactacgtgtctgtgaccaccgggaagcacaaggatgctgccacagacagccgggccttcatcttcctgattggagaagatgatgagaggagcaagaggatctggctggactacccccggggcaagaggggcttcagccggggctctgtggaggagttctacgtggccggcctggatgtgggcatcatcaagaagattgagctgggccatgatggagccagccctgagagctgctggctggtggaggagctgtgcctggccgtgcccacccagggcaccaagtacatgctgaactgcaactgctggctggccaaggacagaggagatggcatcaccagccgggtgtttgacctgctggatgccatggtggtgaacatcggcgtgaaggtgctgtatgagatgacagtgtggacaggagatgtggtgggcggcggcacagacagcaacatcttcatgaccctgtatggcatcaatggcagcacagaggagatgcagctggacaagaagaaggccaggtttgagcgggagcagaatgacaccttcatcatggagatcctggacatcgcccccttcaccaagatgaggatcagaattgatggcctgggcagcaggcctgagtggttcctggagcgcatcctgctgaagaacatgaacacaggagacctgaccatgttctactatggagactggctgagccagaggaagggcaagaagaccctggtgtgtgagatgtgtgctgtgattgatgaggaggagatgatggagtggaccagctacacagtggccgtgaagaccagtgacatcctgggcgccggcacagatgccaacgtgttcatcatcatctttggagaaaatggagacagcggcaccctggccctgaagcagagcgccaactggaacaagtttgagaggaacaacacagacaccttcaacttcccagacatgctgagcctgggccacctgtgcaagctgcgggtgtggcatgacaacaagggcatcttccctggctggcacctgtcctatgtggatgtgaaggacaacagcagagatgagaccttccacttccagtgtgactgctggctgagcaagtcagaaggagatggccagacagtgcgggactttgcctgtgccaacaacaagatctgtgatgagctggaggagaccacctatgagatcgtcatcgagactggaaatggaggagagacccgggagaatgtgtggctgatcctggagggcaggaagaacagaagcaaggagttcctgatggagaacagcagccggcagagggccttcaggaagggcaccacagacacctttgaatttgacagcatctacctgggggacatcgccagcctgtgtgtgggccacctggcccgggaggaccgcttcatccccaagcgggagctggcctggcacgtgaagaccatcaccatcacagagatggagtatggaaatgtgtacttcttcaactgtgactgcctgatccccctgaagaggaagaggaagtacttcaaggtgtttgaggtgaccaagaccacagagagctttgccagcaaggtgcagagcctggtgcctgtgaagtatgaggtgattgtgaccaccggctatgagcccggggccggcacagatgccaacgtgtttgtgaccatctttggagccaacggggacaccgggaagcgggagctgaagcagaagatgaggaacctgtttgagcggggcagcacagaccgcttcttcctggagaccctggagctggtggtgacccggctgggcctggccgcagaatgtggctag

SEQ ID NO: 158084 - DNA, 3435 bp, Artificial Sequence
  Description of Artificial Sequence: Synthetic coding sequence
atgctgcggcacctgacagacaccttcaccatctatgccatcgacctgggcgccctgaccaagatccgcatcagacatgacaacacaggcaacagagctggctggttcctggacagaattgacatcacagacatgaacaatgagatcacctactacttcccctgccagcgctggctggccgtggaggaggatgatggccagctgagccgggagctgctgcctgtggatgagagctatgtgctgccccagagcgaggagggccggggcggcggggacaacaaccccctggacaacctggccctggagcagaaggacaagagcaccaccttctctgtgaccatcaagacaggagtgaagaagaatgccggcacagatgccaacgtgttcatcaccctgtttggcacccaggatgacaccggcatgaccctgctgaagagcagcaagaccaacagcgacaagtttgagcgggacagcattgagatcttcaccgtggagaccctggacctgggggacctgtggaaggtgcggctgggccatgacaacacaggcaaggcccctggctggtttgtggactgggtggaggtggatgcccccagcctgggcaagtgcatgaccttcccctgtggccgctggctggccaagaatgaagatgatggcagcatcatccgggacctcttccacgccgagctgcagacccggctgtacaccccatttgtgccctatgagatcaccctgtacaccagtgatgtgtttgctgctggaacagatgccaacatcttcatcatcatctacggctgtgatgctgtgtgcacccagcagaagtacctgtgcaccaacaagcgggagcagaagcagttctttgagaggaagagcgccagccgcttcatcgtggagctggaggatgtgggggagatcatcgagaagatcagaattggccacaacaacacaggcatgaaccctggctggcactgcagccacgtggacatccggcggctgctgcctgacaaggatggagctgagaccctgaccttcccctgtgaccgctggctggccaccagtgaagatgacaagaagaccatccgggagctggtgccctatgacatcttcacagagaagtacatgaaggatggcagcctgcggcaggtgtacaaggaggtggaggagcccctggacatcgtgctgtacagcgtgcagatcttcaccggcaacatccctggagctggaacagatgccaaggtgtacatcaccatctacggggacctgggggacaccggggagcgctacctgggcaagtcagaaaatagaaccaacaagtttgagcggggcacagctgacaccttcatcattgaagctgctgacctgggcgtcatctacaagatcaagctgcggcatgacaacagcaagtggtgtgccgactggtacgtggagaaggtggagatctggaatgacaccaatgaagatgagttcctgttcctgtgtggccgctggctgagcctgaagaaggaggatggccgcctggagcggctcttctatgagaaggagtacaccggggacaggagcagcaactgcagcagccctgctgacttctgggagatcgccctgagcagcaagatggctgatgtggacatcagcacagtgacaggccccatggctgactatgtgcaggagggccccatcatcccctactacgtgtctgtgaccaccgggaagcacaaggatgctgccacagacagccgggccttcatcttcctgattggagaagatgatgagaggagcaagaggatctggctggactacccccggggcaagaggggcttcagccggggctctgtggaggagttctacgtggccggcctggatgtgggcatcatcaagaagattgaggtgctgtatgagatgacagtgtggacaggagatgtggtgggcggcggcacagacagcaacatcttcatgaccctgtatggcatcaatggcagcacagaggagatgcagctggacaagaagaaggccaggtttgagcgggagcagaatgacaccttcatcatggagatcctggacatcgcccccttcaccaagatgaggatcagaattgatggcctgggcagcaggcctgagtggttcctggagcgcatcctgctgaagaacatgaacacaggagacctgaccatgttctactacggggactggctgagccagaggaagggcaagaagaccctggtgtgtgagatgtgtgctgtgattgatgaggaggagatgatggagtggaccagctacacagtggccgtgaagaccagtgacatcctgggcgccggcacagatgccaacgtgttcatcatcatctttggagaaaatggagacagcggcaccctggccctgaagcagagcgccaactggaacaagtttgaaagaaacaacacagacaccttcaacttcccagacatgctgagcctgggccacctgtgcaagctgcgggtgtggcatgacaacaagggcatcttccctggctggcacctgtcctatgtggatgtgaaggacaacagcagagatgagaccttccacttccagtgtgactgctggctgagcaagtcagaaggagatggccagacagtgcgggactttgcctgtgccaacaacaagatctgtgatgagctggaggagaccacctatgaaattgtgattgaaacaggaaatggaggagagaccagagaaaatgtgtggctgatcctggagggcaggaagaacagaagcaaggagttcctgatggagaacagcagccggcagagggccttcaggaagggcaccacagacacctttgaatttgacagcatctacctgggggacatcgccagcctgtgtgtgggccacctggccagagaagatcgcttcatccccaagcgggagctggcctggcacgtgaagaccatcaccatcacagagatggagtatggaaatgtgtacttcttcaactgtgactgcctgatccccctgaagaggaagaggaagtacttcaaggtgtttgaggtgaccaagaccacagagagctttgccagcaaggtgcagagcctggtgcctgtgaagtatgaagtcatcgtgaccaccggctatgagcctggagctggaacagatgccaacgtgtttgtgaccatctttggagccaatggagacaccgggaagcgggagctgaagcagaagatgaggaacctgtttgagcggggcagcacagaccgcttcttcctggagaccctggagctgggggagctgaggaaggtgcggctggagcatgacagcagcggctactgcagcggctggctggtggagaaggtggaggtgaccaacaccagcactggagtggccaccatcttcaactgtggccgctggctggacaagaagagaggagatggcctgacctggagggacctcttccccagcgtgtag

SEQ ID NO: 158085 - DNA, 921 bp, Artificial Sequence
  Description of Artificial Sequence: Synthetic coding sequence
atgaggctgggcaccaactgtgagcacccccagctgcccctggccgcccccagcggctactacttcccctgccagcgctggctggccgtggaggaggatgatggccagctgagccgggagctgctgcctgtggatgagagctatgtgctgccccagagcgaggagggccggggcggcggggacaacaaccccctggacaacctggccctggagcagaaggacaagagcaccaccttctctgtgaccatcaagacaggagtgaagaagaatgccggcacagatgccaacgtgttcatcaccctgtttggcacccaggatgacaccggcatgaccctgctgaagagcagcaagaccaacagcgacaagtttgagcgggacagcattgagatcttcaccgtggagaccctggacctgggggacctgtggaaggtgcggctgggccatgacaacacaggcaaggcccctggctggtttgtggactgggtggaggtggatgcccccagcctgggcaagtgcatgaccttcccctgtggccgctggctggccaagaatgaagatgatggcagcatcatccgggacctcttccacgccgagctgcagacccggctgtacaccccatttgtgccctatgagatcaccctgtacaccagtgatgtgtttgctgctggaacagatgccaacatcttcatcatcatctacggctgtgatgctgtgtgcacccagcagaagtacctgtgcaccaacaagcgggagcagaagcagttctttgagaggaagagcgccagccgcttcatcgtggagctggaggatgtgggggagatcatcgagaagatccgcatcggccacaacaacacaggcatgaaccctggctggcactgcagccacgtggacatccggcggctgctgcctgacaaggactag

SEQ ID NO: 158086 - DNA, 6636 bp, Artificial Sequence
  Description of Artificial Sequence: Synthetic coding sequence
atgatgccccagaagaagagaagaaggaagaaggacatcgacttcctggccctgtatgaagctgagctgctgaactatgcctctgaagatgatgaaggagagctggagcacgagtactacaaggcccgggtgtatgaggtggtgacagccactggagatgtgagaggagctggaacagatgccaacgtgttcatcaccctgtttggagaaaatggcctgagccccaagctgcagctgaccagcaagagcaagagcgcctttgagaagggaaatgtggatgtgttccgggtgaggaccaacaacgtgggcctcatctacaaggtgcgcatcgagcatgacaacacaggcctgaatgcctcctggtacctggaccacgtgattgtgacagacatgaagaggccccacctgcgctactacttcaactgcaacaactggctgagcaaggtggagggggaccggcagtggtgccgggacctgctggccagcttcaaccccatggacatgccccggggcaacaagtatgaggtgaaggtgtacacaggagatgtgattggagctggaacagatgctgatgtgttcatcaacatctttggagaatatggagacacaggagagcggcggctggagaatgagaaggacaactttgagaagggagctgaggaccgcttcatcctggatgccccagacctgggccagctgatgaagatcaacgtgggccacaacaacaagggcggcagcgctggctggttcctgagccagatcgtgattgaagatattggcaacaagaggaaatatgacttccccctgaaccgctggctggccctggatgaagatgatggcaagatccagagggacatcctggtgggcggcgctgagaccacagccatcacctacatcgtgacagtgttcaccggagatgtgcggggggccggcaccaagagcaagatctacctggtgatgtatggagcccggggcaacaagaacagcggcaagatcttcctggagggcggcgtgtttgaccggggccgcacagacatcttccacatcgagctggccgtgctgctgagccccctgagccgggtgtctgtgggccatggaaatgtgggcgtgaacagaggctggttctgtgagaaggtggtgatcctgtgccccttcaccggcatccagcagaccttcccctgcagcaactggctggatgagaagaaggcagatggcctgattgagcggcagctgtatgagatggtgtccctgaggaagaagaggctgaagaagttcccctggagcctgtgggtgtggaccacagacctgaagaaggccggcaccaacagccccatcttcatccagatctacggccagaagggccgcacagatgagatcctgctgaaccccaacaacaagtggttcaagccaggcatcatcgagaagttccgcatcgagctgcctgacctgggccgcttctacaagatccgggtgtggcatgacaagaggagcagcggcagcggctggcacctggagaggatgaccctgatgaacaccctgaacaaggacaagtacaacttcaactgcaaccgctggctggatgccaatgaagatgacaatgaaattgtgcgggagatgacagctgagggccccaccgtgcggcgcatcatgggcatggcccgctaccacgtgacagtgtgcacaggagagctggagggcgccggcacagatgccaacgtgtacctgtgcctgtttggagatgtgggggacaccggggagcggctgctgtacaactgcaggaacaacacagacctgtttgagaagggaaatgctgatgagttcaccattgaatctgtgaccatgagaaatgtgcggcgggtgcgcatcagacatgatggaaaaggaagtggcagcggctggtacctggacagagtgctggtgcgggaggagggccagcctgagagtgacaacgtggagttcccctgcctgcgctggctggacaaggacaaggatgatggccagctggtgcgggagctgctgcccagcgacagcagcgccaccctgaagaacttccgctaccacatcagcctgaagacaggagatgtgtctggggccagcacagacagccgggtgtacatcaagctgtatggagacaagagtgacaccatcaagcaggtgctgctggtgtctgacaacaacctgaaggactactttgagcggggccgggtggatgagttcaccctggagaccctgaacatcggcaacatcaaccggctggtgattggacatgacagcacaggcatgcacgcctcctggttcctgggctctgtgcagatccgggtgccccggcagggcaagcagtacaccttccctgccaaccgctggctggacaagaaccaggctgatggccgcctggaggtggagctgtaccccagcgaggtggtggagatccagaagctggtgcactatgaggtggagatctggacaggagatgtgggcggggccggcaccagcgcccgggtgtacatgcagatctatggagagaagggcaagacagaggtgctcttcctgagcagccgcagcaaggtgtttgagcgggccagcaaggacaccttccagctggaggccgcagatgtgggggaggtgtacaagctgcggctgggccacactggagagggcttcggccccagctggtttgtggacacagtgtggctgcggcacctggtggtgcgggaggtggacctgaccccagaggaggaggccaggaagaagaaggagaaggacaagctgcggcagctgctgaagaaggagcggctgaaggccaagctgcagaggaagaagaagaagaggaagggcagtgatgaagaagatgaaggagaggaggaggagagcagcagcagcgaggagagcagcagcgaggaggaggagatggaggaggaggaggaggaggaggagtttggacctggcatgcaggaggtgattgagcagcacaagtttgaggcccaccgctggctggcccggggcaaggaggacaatgagctggtggtggagctggtgcctgctgggaagccaggccctgagaggaacacctatgaggtgcaggtggtgactggaaatgtgcccaaggccggcacagatgccaacgtgtacctgaccatctatggagaggagtatggagacaccggggagcggcccctgaagaagagtgacaagagcaacaagtttgagcagggccagacagacaccttcaccatctatgccatcgacctgggcgccctgaccaagatccgcatcagacatgacaacacaggcaacagagctggctggttcctggacagaattgacatcacagacatgaacaatgagatcacctactacttcccctgccagcgctggctggccgtggaggaggatgatggccagctgagccgggagctgctgcctgtggatgagagctatgtgctgccccagagcgaggagggccggggcggcggggacaacaaccccctggacaacctggccctggagcagaaggacaagagcaccaccttctctgtgaccatcaagacaggagtgaagaagaatgccggcacagatgccaacgtgttcatcaccctgtttggcacccaggatgacaccggcatgaccctgctgaagagcagcaagaccaacagcgacaagtttgagcgggacagcattgagatcttcaccgtggagaccctggacctgggggacctgtggaaggtgcggctgggccatgacaacacaggcaaggcccctggctggtttgtggactgggtggaggtggatgcccccagcctgggcaagtgcatgaccttcccctgtggccgctggctggccaagaatgaagatgatggcagcatcatccgggacctcttccacgccgagctgcagacccggctgtacaccccatttgtgccctatgagatcaccctgtacaccagtgatgtgtttgctgctggaacagatgccaacatcttcatcatcatctacggctgtgatgctgtgtgcacccagcagaagtacctgtgcaccaacaagcgggagcagaagcagttctttgagaggaagagcgccagccgcttcatcgtggagctggaggatgtgggggagatcatcgagaagatccgcatcggccacaacaacacaggcatgaaccctggctggcactgcagccacgtggacatccggcggctgctgcctgacaaggatggagctgagaccctgaccttcccctgtgaccgctggctggccaccagtgaagatgacaagaagaccatccgggagctggtgccctatgacatcttcacagagaagtacatgaaggatggcagcctgcggcaggtgtacaaggaggtggaggagcccctggacatcgtgctgtacagcgtgcagatcttcaccggcaacatccctggggccggcacagatgccaaggtgtacatcaccatctatggagacctgggggacacaggagagcgctacctgggcaagtctgagaacagaaccaacaagtttgagcggggcacagctgacaccttcatcatcgaggccgctgacctgggcgtcatctacaagatcaagctgcggcatgacaacagcaagtggtgtgccgactggtacgtggagaaggtggagatctggaatgacaccaatgaagatgagttcctgttcctgtgtggccgctggctgagcctgaagaaggaggatggccgcctggagcggctcttctatgagaaggagtacacaggagacaggagcagcaactgcagcagccctgctgacttctgggagatcgccctgagcagcaagatggctgatgtggacatcagcacagtgacaggccccatggctgactatgtgcaggagggccccatcatcccctactacgtgtctgtgaccaccgggaagcacaaggatgctgccacagacagccgggccttcatcttcctgattggagaagatgatgagaggagcaagaggatctggctggactacccccggggcaagaggggcttcagccggggctctgtggaggagttctacgtggccggcctggatgtgggcatcatcaagaagattgaggtgctgtatgagatgacagtgtggacaggagatgtggtgggcggcggcacagacagcaacatcttcatgaccctgtatggcatcaatggcagcacagaggagatgcagctggacaagaagaaggccaggtttgagcgggagcagaatgacaccttcatcatggagatcctggacatcgcccccttcaccaagatgaggatcagaattgatggcctgggcagcaggcctgagtggttcctggagcgcatcctgctgaagaacatgaacacaggagacctgaccatgttctactatggagactggctgagccagaggaagggcaagaagaccctggtgtgtgagatgtgtgctgtgattgatgaggaggagatgatggagtggaccagctacacagtggccgtgaagaccagtgacatcctgggcgccggcacagatgccaacgtgttcatcatcatctttggagaaaatggagacagcggcaccctggccctgaagcagagcgccaactggaacaagtttgagaggaacaacacagacaccttcaacttcccagacatgctgagcctgggccacctgtgcaagctgcgggtgtggcatgacaacaagggcatcttccctggctggcacctgtcctatgtggatgtgaaggacaacagcagagatgagaccttccacttccagtgtgactgctggctgagcaagtcagaaggagatggccagacagtgcgggactttgcctgtgccaacaacaagatctgtgatgagctggaggagaccacctatgagatcgtcatcgagactggaaatggaggagagacccgggagaatgtgtggctgatcctggagggcaggaagaacagaagcaaggagttcctgatggagaacagcagccggcagagggccttcaggaagggcaccacagacacctttgaatttgacagcatctacctgggggacatcgccagcctgtgtgtgggccacctggcccgggaggaccgcttcatccccaagcgggagctggcctggcacgtgaagaccatcaccatcacagagatggagtatggaaatgtgtacttcttcaactgtgactgcctgatccccctgaagaggaagaggaagtacttcaaggtgtttgaggtgaccaagaccacagagagctttgccagcaaggtgcagagcctggtgcctgtgaagtatgaggtgattgtgaccaccggctatgagcccggggccggcacagatgccaacgtgtttgtgaccatctttggagccaacggggacaccgggaagcgggagctgaagcagaagatgaggaacctgtttgagcggggcagcacagaccgcttcttcctggagaccctggagctgggggagctgaggaaggtgcggctggagcatgacagcagcggctactgcagcggctggctggtggagaaggtggaggtgaccaacaccagcactggagtggccaccatcttcaactgtggccgctggctggacaagaagagaggagatggcctgacctggagggacctcttccccagcgtgtag

SEQ ID NO: 158087 - DNA, 3345 bp, Artificial Sequence
  Description of Artificial Sequence: Synthetic coding sequence
atgaacaatgagatcacctactacttcccctgccagcgctggctggccgtggaggaggatgatggccagctgagccgggagctgctgcctgtggatgagagctatgtgctgccccagagcgaggagggccggggcggcggggacaacaaccccctggacaacctggccctggagcagaaggacaagagcaccaccttctctgtgaccatcaagacaggagtgaagaagaatgccggcacagatgccaacgtgttcatcaccctgtttggcacccaggatgacaccggcatgaccctgctgaagagcagcaagaccaacagcgacaagtttgagcgggacagcattgagatcttcaccgtggagaccctggacctgggggacctgtggaaggtgcggctgggccatgacaacacaggcaaggcccctggctggtttgtggactgggtggaggtggatgcccccagcctgggcaagtgcatgaccttcccctgtggccgctggctggccaagaatgaagatgatggcagcatcatccgggacctcttccacgccgagctgcagacccggctgtacaccccatttgtgccctatgagatcaccctgtacaccagtgatgtgtttgctgctggaacagatgccaacatcttcatcatcatctacggctgtgatgctgtgtgcacccagcagaagtacctgtgcaccaacaagcgggagcagaagcagttctttgagaggaagagcgccagccgcttcatcgtggagctggaggatgtgggggagatcatcgagaagatcagaattggccacaacaacacaggcatgaaccctggctggcactgcagccacgtggacatccggcggctgctgcctgacaaggatggagctgagaccctgaccttcccctgtgaccgctggctggccaccagtgaagatgacaagaagaccatccgggagctggtgccctatgacatcttcacagagaagtacatgaaggatggcagcctgcggcaggtgtacaaggaggtggaggagcccctggacatcgtgctgtacagcgtgcagatcttcaccggcaacatccctggagctggaacagatgccaaggtgtacatcaccatctacggggacctgggggacaccggggagcgctacctgggcaagtcagaaaatagaaccaacaagtttgagcggggcacagctgacaccttcatcattgaagctgctgacctgggcgtcatctacaagatcaagctgcggcatgacaacagcaagtggtgtgccgactggtacgtggagaaggtggagatctggaatgacaccaatgaagatgagttcctgttcctgtgtggccgctggctgagcctgaagaaggaggatggccgcctggagcggctcttctatgagaaggagtacaccggggacaggagcagcaactgcagcagccctgctgacttctgggagatcgccctgagcagcaagatggctgatgtggacatcagcacagtgacaggccccatggctgactatgtgcaggagggccccatcatcccctactacgtgtctgtgaccaccgggaagcacaaggatgctgccacagacagccgggccttcatcttcctgattggagaagatgatgagaggagcaagaggatctggctggactacccccggggcaagaggggcttcagccggggctctgtggaggagttctacgtggccggcctggatgtgggcatcatcaagaagattgagctgggccatgatggagccagccctgagagctgctggctggtggaggagctgtgcctggccgtgcccacccagggcaccaagtacatgctgaactgcaactgctggctggccaaggacagaggagatggcatcaccagccgggtgtttgacctgctggatgccatggtggtgaacattggagtgaaggtgctgtatgagatgacagtgtggacaggagatgtggtgggcggcggcacagacagcaacatcttcatgaccctgtatggcatcaatggcagcacagaggagatgcagctggacaagaagaaggccaggtttgagcgggagcagaatgacaccttcatcatggagatcctggacatcgcccccttcaccaagatgaggatcagaattgatggcctgggcagcaggcctgagtggttcctggagcgcatcctgctgaagaacatgaacacaggagacctgaccatgttctactacggggactggctgagccagaggaagggcaagaagaccctggtgtgtgagatgtgtgctgtgattgatgaggaggagatgatggagtggaccagctacacagtggccgtgaagaccagtgacatcctgggcgccggcacagatgccaacgtgttcatcatcatctttggagaaaatggagacagcggcaccctggccctgaagcagagcgccaactggaacaagtttgaaagaaacaacacagacaccttcaacttcccagacatgctgagcctgggccacctgtgcaagctgcgggtgtggcatgacaacaagggcatcttccctggctggcacctgtcctatgtggatgtgaaggacaacagcagagatgagaccttccacttccagtgtgactgctggctgagcaagtcagaaggagatggccagacagtgcgggactttgcctgtgccaacaacaagatctgtgatgagctggaggagaccacctatgaaattgtgattgaaacaggaaatggaggagagaccagagaaaatgtgtggctgatcctggagggcaggaagaacagaagcaaggagttcctgatggagaacagcagccggcagagggccttcaggaagggcaccacagacacctttgaatttgacagcatctacctgggggacatcgccagcctgtgtgtgggccacctggccagagaagatcgcttcatccccaagcgggagctggcctggcacgtgaagaccatcaccatcacagagatggagtatggaaatgtgtacttcttcaactgtgactgcctgatccccctgaagaggaagaggaagtacttcaaggtgtttgaggtgaccaagaccacagagagctttgccagcaaggtgcagagcctggtgcctgtgaagtatgaagtcatcgtgaccaccggctatgagcctggagctggaacagatgccaacgtgtttgtgaccatctttggagccaatggagacaccgggaagcgggagctgaagcagaagatgaggaacctgtttgagcggggcagcacagaccgcttcttcctggagaccctggagctggtggtgacccggctgggcctggccgcagaatgtggctag

SEQ ID NO: 158088 - DNA, 1539 bp, Artificial Sequence
  Description of Artificial Sequence: Synthetic coding sequence
atgacagtgtggacaggagatgtggtgggcggcggcacagacagcaacatcttcatgaccctgtatggcatcaatggcagcacagaggagatgcagctggacaagaagaaggccaggtttgagcgggagcagaatgacaccttcatcatggagatcctggacatcgcccccttcaccaagatgaggatcagaattgatggcctgggcagcaggcctgagtggttcctggagcgcatcctgctgaagaacatgaacacaggagacctgaccatgttctactacggggactggctgagccagaggaagggcaagaagaccctggtgtgtgagatgtgtgctgtgattgatgaggaggagatgatggagtggaccagctacacagtggccgtgaagaccagtgacatcctgggcgccggcacagatgccaacgtgttcatcatcatctttggagaaaatggagacagcggcaccctggccctgaagcagagcgccaactggaacaagtttgaaagaaacaacacagacaccttcaacttcccagacatgctgagcctgggccacctgtgcaagctgcgggtgtggcatgacaacaagggcatcttccctggctggcacctgtcctatgtggatgtgaaggacaacagcagagatgagaccttccacttccagtgtgactgctggctgagcaagtcagaaggagatggccagacagtgcgggactttgcctgtgccaacaacaagatctgtgatgagctggaggagaccacctatgaaattgtgattgaaacaggaaatggaggagagaccagagaaaatgtgtggctgatcctggagggcaggaagaacagaagcaaggagttcctgatggagaacagcagccggcagagggccttcaggaagggcaccacagacacctttgaatttgacagcatctacctgggggacatcgccagcctgtgtgtgggccacctggccagagaagatcgcttcatccccaagcgggagctggcctggcacgtgaagaccatcaccatcacagagatggagtatggaaatgtgtacttcttcaactgtgactgcctgatccccctgaagaggaagaggaagtacttcaaggtgtttgaggtgaccaagaccacagagagctttgccagcaaggtgcagagcctggtgcctgtgaagtatgaagtcatcgtgaccaccggctatgagcctggagctggaacagatgccaacgtgtttgtgaccatctttggagccaatggagacaccgggaagcgggagctgaagcagaagatgaggaacctgtttgagcggggcagcacagaccgcttcttcctggagaccctggagctgggggagctgaggaaggtgcggctggagcatgacagcagcggctactgcagcggctggctggtggagaaggtggaggtgaccaacaccagcactggagtggccaccatcttcaactgtggccgctggctggacaagaagagaggagatggcctgacctggagggacctcttccccagcgtgtag

SEQ ID NO: 158089 - DNA, 1374 bp, Artificial Sequence
  Description of Artificial Sequence: Synthetic coding sequence
atgacagtgtggacaggagatgtggtgggcggcggcacagacagcaacatcttcatgaccctgtatggcatcaatggcagcacagaggagatgcagctggacaagaagaaggccaggtttgagcgggagcagaatgacaccttcatcatggagatcctggacatcgcccccttcaccaagatgaggatcagaattgatggcctgggcagcaggcctgagtggttcctggagcgcatcctgctgaagaacatgaacacaggagacctgaccatgttctactacggggactggctgagccagaggaagggcaagaagaccctggtgtgtgagatgtgtgctgtgattgatgaggaggagatgatggagtggaccagctacacagtggccgtgaagaccagtgacatcctgggcgccggcacagatgccaacgtgttcatcatcatctttggagaaaatggagacagcggcaccctggccctgaagcagagcgccaactggaacaagtttgaaagaaacaacacagacaccttcaacttcccagacatgctgagcctgggccacctgtgcaagctgcgggtgtggcatgacaacaagggcatcttccctggctggcacctgtcctatgtggatgtgaaggacaacagcagagatgagaccttccacttccagtgtgactgctggctgagcaagtcagaaggagatggccagacagtgcgggactttgcctgtgccaacaacaagatctgtgatgagctggaggagaccacctatgaaattgtgattgaaacaggaaatggaggagagaccagagaaaatgtgtggctgatcctggagggcaggaagaacagaagcaaggagttcctgatggagaacagcagccggcagagggccttcaggaagggcaccacagacacctttgaatttgacagcatctacctgggggacatcgccagcctgtgtgtgggccacctggccagagaagatcgcttcatccccaagcgggagctggcctggcacgtgaagaccatcaccatcacagagatggagtatggaaatgtgtacttcttcaactgtgactgcctgatccccctgaagaggaagaggaagtacttcaaggtgtttgaggtgaccaagaccacagagagctttgccagcaaggtgcagagcctggtgcctgtgaagtatgaagtcatcgtgaccaccggctatgagcctggagctggaacagatgccaacgtgtttgtgaccatctttggagccaatggagacaccgggaagcgggagctgaagcagaagatgaggaacctgtttgagcggggcagcacagaccgcttcttcctggagaccctggagctgggggagctgaggaagtag

SEQ ID NO: 158090 - DNA, 1122 bp, Artificial Sequence
  Description of Artificial Sequence: Synthetic coding sequence
atgctgatccccttctccatgaagaactgcttccagctgctgtgcaactgccaggtgcctgctgctggcttcaagaagacagtgaagaatggcctcatcctgcagagcatcagcaatgatgtgtaccagaacctggccgtggaggactggattcatgaccacatgaacctggagggcaagcccatcctcttcttctggcagaacagccccagcgtggtgattggccgccaccagaacccctggcaggagtgcaacctgaacctgatgagggaggagggcatcaagctggccaggagaagaagtggcggcggcaccgtgtaccatgacatgggcaacatcaacctgaccttcttcaccaccaagaagaagtatgacaggatggagaacctgaagctgattgtgcgggccctgaatgctgtgcagccccagctggatgtgcaggccaccaagagatttgacctgctgctggatggccagttcaagatctctggaacagccagcaagattggaagaaccacagcctaccaccactgcaccctgctgtgcagcacagatggcaccttcctgagcagcctgctgaagagcccctaccagggcatccgcagcaatgccacagccagcatccccagcctggtgaagaacctgctggagaaggaccccaccctgacctgtgaggtgctgatgaatgctgtggccacagaatatgctgcctaccaccagattgacaaccacatccacctgatcaaccccacagatgagaccctcttccctggcatcaacagcaaggccaaggagctgcagacctgggagtggatctacggcaagacccccaagttcagcatcaacaccagcttccacgtgctgtatgagcagagccacctggagatcaaggtgttcatcgacatcaagaatggaagaattgagatctgcaacatcgaggccccagaccactggctgcccctggagatccgggacaagctgaacagcagcctcatcggcagcaagttctgccccacagagaccaccatgctgaccaacatcctgctgcggacctgcccccaggaccacaagctgaacagcaagtggaacatcctgtgtgagaagatcaagggcatcatgtag

SEQ ID NO: 158091 - DNA, 1122 bp, Artificial Sequence; identical to SEQ ID NO: 158090
  Description of Artificial Sequence: Synthetic coding sequence

SEQ ID NO: 158092 - DNA, 1122 bp, Artificial Sequence; identical to SEQ ID NO: 158090
  Description of Artificial Sequence: Synthetic coding sequence

SEQ ID NO: 158093 - DNA, 1122 bp, Artificial Sequence; identical to SEQ ID NO: 158090
  Description of Artificial Sequence: Synthetic coding sequence

SEQ ID NO: 158094 - DNA, 1122 bp, Artificial Sequence; identical to SEQ ID NO: 158090
  Description of Artificial Sequence: Synthetic coding sequence

SEQ ID NO: 158095 - DNA, 321 bp, Artificial Sequence
  Description of Artificial Sequence: Synthetic coding sequence
atgctgatccccttctccatgaagaactgcttccagctgctgtgcaactgccaggtgcctgctgctggcttcaagaagacagtgaagaatggcctcatcctgcagagcatcagcaatgatgtgtaccagaacctggccgtggaggactggattcatgaccacatgaacctggagggcaagcccatcctcttcttctggcagaacagccccagcgtggtgattggccgccaccagaacccctggcaggagtgcaacctgaacctgatgagggaggagggcatcaagctggccaggagaagaagtggcggcggcaccgtgtag

SEQ ID NO: 158096 - DNA, 756 bp, Artificial Sequence
  Description of Artificial Sequence: Synthetic coding sequence
atgctgatccccttctccatgaagaactgcttccagctgctgtgcaactgccaggtgcctgctgctggcttcaagaagacagtgaagaatggcctcatcctgcagagcatcagcaatgatgtgtaccagaacctggccgtggaggactggattcatgaccacatgaacctggagggcaagcccatcctcttcttctggcagaacagccccagcgtggtgattggccgccaccagaacccctggcaggagtgcaacctgaacctgatgagggaggagggcatcaagctggccaggagaagaagtggcggcggcaccgtgtaccatgacatgggcaacatcaacctgaccttcttcaccaccaagaagaagtatgacaggatggagaacctgaagctgattgtgcgggccctgaatgctgtgcagccccagctggatgtgcaggccaccaagagatttgacctgctgctggatggccagttcaagatctctggaacagccagcaagattggaagaaccacagcctaccaccactgcaccctgctgtgcagcacagatggcaccttcctgagcagcctgctgaagagcccctaccagggcatccgcagcaatgccacagccagcatccccagcctggtgaagaacctgctggagaaggaccccaccctgacctgtgaggtgctgatgaatgctgtggccacagaatatgctgcctaccaccagattgacaaccacatccacctgatcaaccccacctag

SEQ ID NO: 158097 - DNA, 120 bp, Artificial Sequence
  Description of Artificial Sequence: Synthetic coding sequence
atgctgatccccttctccatgaagaactgcttccagctgctgtgcaactgccaggtgcctgctgctggcttcaagaagacagtgaagaatggcctcatcctgcagagcatcagcaactag

SEQ ID NO: 158098 - DNA, 408 bp, Artificial Sequence
  Description of Artificial Sequence: Synthetic coding sequence
atgctgatccccttctccatgaagaactgcttccagctgctgtgcaactgccaggtgcctgctgctggcttcaagaagacagtgaagaatggcctcatcctgcagagcatcagcaatgatgtgtaccagaacctggccgtggaggactggattcatgaccacatgaacctggagggcaagcccatcctcttcttctggcagaacagccccagcgtggtgattggccgccaccagaacccctggcaggagtgcaacctgaacctgatgagggaggagggcatcaagctggccaggagaagaagtggcggcggcaccgtgtaccatgacatgggcaacatcaacctgaccttcttcaccaccaagaagaagtatgacaggatggagaacctgaagctgattgtgaggtag

SEQ ID NO: 158099 - DNA, 5301 bp, Artificial Sequence
  Description of Artificial Sequence: Synthetic coding sequence
atgggcggcaagaacaagcagaggaccaagggcaacctgcggcccagcaacagcggccgggctgctgagctgctggccaaggagcagggcaccgtgcccggcttcatcggcttcggcaccagccagagcgacctgggctacgtgcctgccatccagggcgctgaggagattgacagcctggtggacagcgacttcaggatggtgctgaggaagctgagcaagaaggatgtgaccaccaagctgaaggccatgcaggagtttggcaccatgtgcacagagcgggacacagagaccgtgaagggcgtgctgccctactggccccgcatcttctgcaagatcagcctggaccatgacagaagagtgcgggaggccacccagcaggcctttgagaagctgatcctgaaggtgaagaagcagctggccccctacctgaagagcctgatgggctactggctgatggcccagtgtgacacctacaccccagctgcctttgctgccaaggatgcctttgaggccgccttcccccccagcaagcagcctgaggccatcgccttctgcaaggatgagatcacctctgtgctgcaggaccacctgatcaaggagaccccagacaccctgagtgacccccagacagtgcctgaggaggagcgggaggccaagttctacagagtggtgacctgcagcctgctggccctgaagaggctgctgtgcctgctgcctgacaatgagctggacagcctggaggagaagttcaagagcctgctgagccagaacaagttctggaagtatggcaagcacagcgtgccccagatccgcagcgcctactttgagctggtgtctgccctgtgccagaggatcccccagctgatgaaggaggaggccagcaaggtgagccccagcgtgctgctgagcattgatgacagcgaccccatcgtgtgcccagccctgtgggaggccgtgctgtacaccctgaccaccatcgaggactgctggctgcacgtgaatgccaagaagtctgtgttccccaagctgagcaccgtcatccgggagggcggccggggcctggccaccgtcatctacccctacctgctgcccttcatcagcaagctgccccagagcatcaccaaccccaagctggacttcttcaagaacttcctgaccagcctggtggccggcctgagcacagagaggaccaagaccagcagcctggagagcagcgctgtgatcagcgccttctttgagtgcctgcgcttcatcatgcagcagaacctgggggaggaggagattgagcagatgctggtgaatgaccagctgatccccttcattgatgctgtgctgaaggaccccggcctgcagcacggccagctgttcaaccacctggccgagaccctgagctcctgggaggccaaggctgacacagagaaggatgagaagacagcccacaacctggagaatgtgctgatccacttctgggagcggctgtctgagatctgtgtggccaagatcagcgagcctgaggctgatgtggagagcgtgctgggcgtgagcaacctgctgcaggtgctgcagaagcccaagagcagcctgaagagcagcaagaagaagaatggcaaggtgcgctttgctgatgagatcctggagagcaacaaggaaaatgagaagtgtgtgagcagcgagggggagaagattgagggctgggagctgaccacagagcccagcctgacccacaacagcagcggcctgctgagccccctgaggaagaagcccctggaggacctggtgtgcaagctggccgacatcagcatcaactacgtgaatgaaaggaagtctgagcagcacctgcgcttcctgagcaccctgctggacagcttcagcagcagcagggtcttcaagatgctgctgggagatgagaagcagagcatcgtgcaggccaagcccctggagatcgccaagctggtgcagaagaacccagctgtgcagttcctgtaccagaagctgattggctggctgaatgaagaccagaggaaggactttggcttcctggtggacatcctgtacagcgccctgcgctgctgtgacaatgacatggagaggaagaaggtgctggatgacctgaccaaggtggacctgaagtggaacagcctgctgaagatcatcgagaaggcctgccccagcagtgacaagcacgccctggtgaccccctggctgaagggggacatcctgggggagaagctggtgaacctggccgactgcctgtgcaatgaagacctggagagccgggtgtcctctgagagccacttcagcgagcgctggaccctgctgagcctggtgctgagccagcacgtgaagaatgactacctgattggagatgtgtatgtggagcgcatcatcgtgcggctgcacgagaccctcttcaagaccaagaagctgtctgaggccgagagcagtgacagctctgtgtccttcatctgtgatgtggcctacaactacttcagcagcgccaagggctgcctgctgatgcccagcagcgaggacctgctgctgaccctcttccagctgtgtgcccagagcaaggagaagacccacctgcctgacttcctgatctgcaagctgaagaacacctggctgtctggagtgaacctgctggtgcaccagacagacagcagctacaaggagagcaccttcctgcacctgagcgccctgtggctgaagaaccaggtgcaggccagcagcctggacatcaacagcctgcaggtgctgctgtctgctgtggatgacctgctgaacaccctgctggagagtgaagattcctacctgatgggcgtgtacatcggctctgtgatgcccaatgacagcgagtgggagaagatgaggcagagcctgcccatgcagtggctgcaccggcccctgctggagggccgcctgagcctgaactatgagtgcttcaagacagacttcaaggagcaggacatcaagaccctgcccagccacctgtgcaccagcgccctgctgagcaagatggtgctgattgccctgaggaaggagaccgtgctggagaacaatgagctggagaagatcatcgccgagctgctgtacagcctgcagtggtgtgaggagctggacaacccccccatcttcctgattggcttctgtgagatcctgcagaagatgaacatcacctatgacaacctgcgggtgctgggcaacaccagcggcctgctgcagctgctcttcaacagaagccgggagcacggcaccctgtggagcctcatcatcgccaagctgatcctgagccgcagcatcagcagtgatgaggtgaagccccactacaagaggaaggagagcttcttccccctgacagagggcaacctgcacaccatccagagcctgtgccccttcctgagcaaggaggagaagaaggagttcagcgcccagtgcatcccagccctgctgggctggaccaagaaggacctgtgcagcaccaacggcggcttcggccacctggccatcttcaacagctgcctgcagaccaagagcattgatgatggagagctgctgcacggcatcctgaagatcatcatctcctggaagaaggagcacgaggacatcttcctgttcagctgcaacctgtctgaggccagccctgaggtgctgggcgtgaacatcgagatcatccgcttcctgagcctcttcctgaagtactgcagcagccccctggccgagagcgagtgggacttcatcatgtgcagcatgctggcctggctggagaccaccagcgagaaccaggccctgtacagcatccccctggtgcagctgtttgcctgtgtgtcctgtgacctggcctgtgacctgagcgccttctttgacagcaccaccctggacaccatcggcaacctgcctgtgaacctgatcagcgagtggaaggagttcttcagccagggcatccacagcctgctgctgcccatcctggtgacagtgactggagagaacaaggatgtgtctgagaccagcttccagaatgccatgctgaagcccatgtgtgagaccctgacctacatcagcaaggagcagctgctgagccacaagctgcctgcccggctggtggccgaccagaagaccaacctgcctgagtacctgcagaccctgctgaacaccctggcccccctgctgctcttccgggcccggcctgtgcagattgctgtgtaccacatgctgtacaagctgatgcctgagctgccccagtatgaccaggacaacctgaagagctatggagatgaggaggaggagcccgccctgagccccccagctgccctgatgagcctgctgagcatccaggaggacctgctggagaatgtgctgggctgcatccctgtgggccagatcgtgaccatcaagcccctgtctgaggacttctgctacgtgctgggctacctgctgacctggaagctgatcctgaccttcttcaaggccgccagcagccagctgcgggccctgtacagcatgtacctgaggaagaccaagagcctgaacaagctgctgtaccacctgttccggctgatgcctgagaaccccacctatgcagagacagctgtggaggtgcccaacaaggaccccaagaccttcttcacagaggagctgcagctgagcatccgggagaccaccatgctgccctaccacatcccccacctggcctgcagcgtgtaccacatgaccctgaaggacctgcctgccatggtgcggctgtggtggaacagcagcgagaagagggtcttcaacatcgtggaccgcttcaccagcaaatatgtgtcctctgtgctgtccttccaggagatcagctctgtgcagaccagcacccagctgttcaacggcatgacagtgaaggcccgggccaccacccgggaggtgatggccacctacaccatcgaggacatcgtcatcgagctgatcatccagctgcccagcaactaccccctgggcagcatcatcgtggagagcggcaagagggtgggcgtggccgtgcagcagtggaggaactggatgctgcagctgagcacctacctgacccaccagaatggcagcatcatggagggcctggccctgtggaagaacaacgtggacaagagatttgaaggagtggaggactgcatgatctgcttcagcgtcatccacggcttcaactacagcctgcccaagaaggcctgcaggacctgcaagaagaagttccacagcgcctgcctgtacaagtggttcaccagcagcaacaagagcacctgccccctgtgccgggagaccttcttctag

SEQ ID NO: 158100 - DNA, 1443 bp, Artificial Sequence
  Description of Artificial Sequence: Synthetic coding sequence
atgggcggcaagaacaagcagaggaccaagggcaacctgcggcccagcaacagcggccgggctgctgagctgctggccaaggagcagggcaccgtgcccggcttcatcggcttcggcaccagccagagcgacctgggctacgtgcctgccatccagggcgctgaggagattgacagcctggtggacagcgacttcaggatggtgctgaggaagctgagcaagaaggatgtgaccaccaagctgaaggccaatgccatgcaggagtttggcaccatgtgcacagagcgggacacagagaccgtgaagggcgtgctgccctactggccccgcatcttctgcaagatcagcctggaccatgacagaagagtgcgggaggccacccagcaggcctttgagaagctgatcctgaaggtgaagaagcagctggccccctacctgaagagcctgatgggctactggctgatggcccagtgtgacacctacaccccagctgcctttgctgccaaggatgcctttgaggccgccttcccccccagcaagcagcctgaggccatcgccttctgcaaggatgagatcacctctgtgctgcaggaccacctgatcaaggagaccccagacaccctgagtgacccccagacagtgcctgaggaggagcgggaggccaagttctacagagtggtgacctgcagcctgctggccctgaagaggctgctgtgcctgctgcctgacaatgagctggacagcctggaggagaagttcaagagcctgctgagccagaacaagttctggaagtatggcaagcacagcgtgccccagatccgcagcgcctactttgagctggtgtctgccctgtgccagaggatcccccagctgatgaaggaggaggccagcaaggtgagccccagcgtgctgctgagcattgatgacagcgaccccatcgtgtgcccagccctgtgggaggccgtgctgtacaccctgaccaccatcgaggactgctggctgcacgtgaatgccaagaagtctgtgttccccaagctgagcaccgtcatccgggagggcggccggggcctggccaccgtcatctacccctacctgctgcccttcatcagcaagctgccccagagcatcaccaaccccaagctggacttcttcaagaacttcctgaccagcctggtggccggcctgagcacagagaggaccaagaccagcagcctggagagcagcgctgtgatcagcgccttctttgagtgcctgcgcttcatcatgcagcagaacctgggggaggaggagattgagcagatgctggtgaatgaccagctgatccccttcattgatgctgtgctgaaggaccccggcctgcagcacggccagctgttcaaccacctggccgagaccctgagctcctgggaggccaaggctgacacagagaaggatgagaagtag

SEQ ID NO: 158101 - DNA, 5439 bp, Artificial Sequence
  Description of Artificial Sequence: Synthetic coding sequence
atggacagagtgggcggcggcaagggccctgggggcagctactacagagtgagcagcagcgctgcccggagcaggaagctgtgccccggccgggtgaacagaggcctgagcgcccagagcacagctgccacagccaccatgggcggcaagaacaagcagaggaccaagggcaacctgcggcccagcaacagcggccgggctgctgagctgctggccaaggagcagggcaccgtgcccggcttcatcggcttcggcaccagccagagcgacctgggctacgtgcctgccatccagggcgctgaggagattgacagcctggtggacagcgacttcaggatggtgctgaggaagctgagcaagaaggatgtgaccaccaagctgaaggccatgcaggagtttggcaccatgtgcacagagcgggacacagagaccgtgaagggcgtgctgccctactggccccgcatcttctgcaagatcagcctggaccatgacagaagagtgcgggaggccacccagcaggcctttgagaagctgatcctgaaggtgaagaagcagctggccccctacctgaagagcctgatgggctactggctgatggcccagtgtgacacctacaccccagctgcctttgctgccaaggatgcctttgaggccgccttcccccccagcaagcagcctgaggccatcgccttctgcaaggatgagatcacctctgtgctgcaggaccacctgatcaaggagaccccagacaccctgagtgacccccagacagtgcctgaggaggagcgggaggccaagttctacagagtggtgacctgcagcctgctggccctgaagaggctgctgtgcctgctgcctgacaatgagctggacagcctggaggagaagttcaagagcctgctgagccagaacaagttctggaagtatggcaagcacagcgtgccccagatccgcagcgcctactttgagctggtgtctgccctgtgccagaggatcccccagctgatgaaggaggaggccagcaaggtgagccccagcgtgctgctgagcattgatgacagcgaccccatcgtgtgcccagccctgtgggaggccgtgctgtacaccctgaccaccatcgaggactgctggctgcacgtgaatgccaagaagtctgtgttccccaagctgagcaccgtcatccgggagggcggccggggcctggccaccgtcatctacccctacctgctgcccttcatcagcaagctgccccagagcatcaccaaccccaagctggacttcttcaagaacttcctgaccagcctggtggccggcctgagcacagagaggaccaagaccagcagcctggagagcagcgctgtgatcagcgccttctttgagtgcctgcgcttcatcatgcagcagaacctgggggaggaggagattgagcagatgctggtgaatgaccagctgatccccttcattgatgctgtgctgaaggaccccggcctgcagcacggccagctgttcaaccacctggccgagaccctgagctcctgggaggccaaggctgacacagagaaggatgagaagacagcccacaacctggagaatgtgctgatccacttctgggagcggctgtctgagatctgtgtggccaagatcagcgagcctgaggctgatgtggagagcgtgctgggcgtgagcaacctgctgcaggtgctgcagaagcccaagagcagcctgaagagcagcaagaagaagaatggcaaggtgcgctttgctgatgagatcctggagagcaacaaggaaaatgagaagtgtgtgagcagcgagggggagaagattgagggctgggagctgaccacagagcccagcctgacccacaacagcagcggcctgctgagccccctgaggaagaagcccctggaggacctggtgtgcaagctggccgacatcagcatcaactacgtgaatgaaaggaagtctgagcagcacctgcgcttcctgagcaccctgctggacagcttcagcagcagcagggtcttcaagatgctgctgggagatgagaagcagagcatcgtgcaggccaagcccctggagatcgccaagctggtgcagaagaacccagctgtgcagttcctgtaccagaagctgattggctggctgaatgaagaccagaggaaggactttggcttcctggtggacatcctgtacagcgccctgcgctgctgtgacaatgacatggagaggaagaaggtgctggatgacctgaccaaggtggacctgaagtggaacagcctgctgaagatcatcgagaaggcctgccccagcagtgacaagcacgccctggtgaccccctggctgaagggggacatcctgggggagaagctggtgaacctggccgactgcctgtgcaatgaagacctggagagccgggtgtcctctgagagccacttcagcgagcgctggaccctgctgagcctggtgctgagccagcacgtgaagaatgactacctgattggagatgtgtatgtggagcgcatcatcgtgcggctgcacgagaccctcttcaagaccaagaagctgtctgaggccgagagcagtgacagctctgtgtccttcatctgtgatgtggcctacaactacttcagcagcgccaagggctgcctgctgatgcccagcagcgaggacctgctgctgaccctcttccagctgtgtgcccagagcaaggagaagacccacctgcctgacttcctgatctgcaagctgaagaacacctggctgtctggagtgaacctgctggtgcaccagacagacagcagctacaaggagagcaccttcctgcacctgagcgccctgtggctgaagaaccaggtgcaggccagcagcctggacatcaacagcctgcaggtgctgctgtctgctgtggatgacctgctgaacaccctgctggagagtgaagattcctacctgatgggcgtgtacatcggctctgtgatgcccaatgacagcgagtgggagaagatgaggcagagcctgcccatgcagtggctgcaccggcccctgctggagggccgcctgagcctgaactatgagtgcttcaagacagacttcaaggagcaggacatcaagaccctgcccagccacctgtgcaccagcgccctgctgagcaagatggtgctgattgccctgaggaaggagaccgtgctggagaacaatgagctggagaagatcatcgccgagctgctgtacagcctgcagtggtgtgaggagctggacaacccccccatcttcctgattggcttctgtgagatcctgcagaagatgaacatcacctatgacaacctgcgggtgctgggcaacaccagcggcctgctgcagctgctcttcaacagaagccgggagcacggcaccctgtggagcctcatcatcgccaagctgatcctgagccgcagcatcagcagtgatgaggtgaagccccactacaagaggaaggagagcttcttccccctgacagagggcaacctgcacaccatccagagcctgtgccccttcctgagcaaggaggagaagaaggagttcagcgcccagtgcatcccagccctgctgggctggaccaagaaggacctgtgcagcaccaacggcggcttcggccacctggccatcttcaacagctgcctgcagaccaagagcattgatgatggagagctgctgcacggcatcctgaagatcatcatctcctggaagaaggagcacgaggacatcttcctgttcagctgcaacctgtctgaggccagccctgaggtgctgggcgtgaacatcgagatcatccgcttcctgagcctcttcctgaagtactgcagcagccccctggccgagagcgagtgggacttcatcatgtgcagcatgctggcctggctggagaccaccagcgagaaccaggccctgtacagcatccccctggtgcagctgtttgcctgtgtgtcctgtgacctggcctgtgacctgagcgccttctttgacagcaccaccctggacaccatcggcaacctgcctgtgaacctgatcagcgagtggaaggagttcttcagccagggcatccacagcctgctgctgcccatcctggtgacagtgactggagagaacaaggatgtgtctgagaccagcttccagaatgccatgctgaagcccatgtgtgagaccctgacctacatcagcaaggagcagctgctgagccacaagctgcctgcccggctggtggccgaccagaagaccaacctgcctgagtacctgcagaccctgctgaacaccctggcccccctgctgctcttccgggcccggcctgtgcagattgctgtgtaccacatgctgtacaagctgatgcctgagctgccccagtatgaccaggacaacctgaagagctatggagatgaggaggaggagcccgccctgagccccccagctgccctgatgagcctgctgagcatccaggaggacctgctggagaatgtgctgggctgcatccctgtgggccagatcgtgaccatcaagcccctgtctgaggacttctgctacgtgctgggctacctgctgacctggaagctgatcctgaccttcttcaaggccgccagcagccagctgcgggccctgtacagcatgtacctgaggaagaccaagagcctgaacaagctgctgtaccacctgttccggctgatgcctgagaaccccacctatgcagagacagctgtggaggtgcccaacaaggaccccaagaccttcttcacagaggagctgcagctgagcatccgggagaccaccatgctgccctaccacatcccccacctggcctgcagcgtgtaccacatgaccctgaaggacctgcctgccatggtgcggctgtggtggaacagcagcgagaagagggtcttcaacatcgtggaccgcttcaccagcaaatatgtgtcctctgtgctgtccttccaggagatcagctctgtgcagaccagcacccagctgttcaacggcatgacagtgaaggcccgggccaccacccgggaggtgatggccacctacaccatcgaggacatcgtcatcgagctgatcatccagctgcccagcaactaccccctgggcagcatcatcgtggagagcggcaagagggtgggcgtggccgtgcagcagtggaggaactggatgctgcagctgagcacctacctgacccaccagaatggcagcatcatggagggcctggccctgtggaagaacaacgtggacaagagatttgaaggagtggaggactgcatgatctgcttcagcgtcatccacggcttcaactacagcctgcccaagaaggcctgcaggacctgcaagaagaagttccacagcgcctgcctgtacaagtggttcaccagcagcaacaagagcacctgccccctgtgccgggagaccttcttctag

SEQ ID NO: 158102 - DNA, 1404 bp, Artificial Sequence
  Description of Artificial Sequence: Synthetic coding sequence
atgaagaaccagaatggcaccttcaaggactgggccaatgccaacgtgtcccggcagattgaagatactgtgctgtatggctactacaccctgtacagcgtcatcctcttctgtgtgttcttctggatcccctttgtgtacttctactatgaggagaaggatgatgatgacaccagcaagtgcacccagatcaagacagccctgaagtacaccctgggctttgtggtgatctgtgccctgctgctgctggtgggcgcctttgtgcccctgaatgtgcccaacaacaagaacagcacagagtgggagaaggtgaagagcctgtttgaggagctgggcagcagccacggcctggccgccctgtccttcagcatcagcagcctgaccctcatcggcatgctggccgccatcacctacacagcctacggcatgtctgccctgcccctgaacctgatcaagggcaccaggtctgctgcctatgagcggctggagaacacagaggacatcgaggaggtggagcagcacatccagaccatcaagagcaagagcaaggatggccggcccctgcctgcccgggacaagagggccctgaagcagtttgaggagcggctgcggaccctgaagaagcgggagcggcacctggagttcattgaaaattcctggtggaccaagttctgtggggccctgcggcccctgaagatcgtgtggggcatcttcttcatcctggtggccctgctcttcgtcatcagcctcttcctgagcaacctggacaaggccctgcacagcgctggcatcgacagcggcttcatcatctttggagccaacctgagcaaccccctgaacatgctgctgcccctgctgcagaccgtcttccccctggactacatcctgatcaccatcatcatcatgtacttcatcttcacctccatggccggcatcagaaatattggcatctggttcttctggatccggctgtacaagatccggcggggccgcacccggccccaggccctgctcttcctgtgcatgatcctgctgctgattgtgctgcacaccagctacatgatctacagcctggccccccagtatgtgatgtatggcagccagaactacctgattgagaccaacatcaccagtgacaaccacaagggcaacagcaccctgtctgtgcccaagagatgtgatgctgatgcccctgaggaccagtgcaccgtgaccaggacctacctgttcctgcacaagttctggttcttctctgctgcctactactttggaaactgggccttcctgggcgtcttcctgattggcctgattgtgtcctgctgcaagggcaagaagagcgtcatcgagggcgtggatgaagattctgacatcagtgatgatgagcccagcgtgtacagcgcctag

SEQ ID NO: 158103 - DNA, 1623 bp, Artificial Sequence
  Description of Artificial Sequence: Synthetic coding sequence
atggccaccagcggggccgccagcgctgagctggtgattggctggtgcatcttcggcctgctgctgctggccatcctggccttctgctggatctacgtgaggaagtaccagagcagaagagagagcgaggtggtgtccaccatcacagccatcttcagcctggccatcgccctgatcaccagcgccctgctgcctgtggacatcttcctggtgtcctacatgaagaaccagaatggcaccttcaaggactgggccaatgccaacgtgtcccggcagatcgaggacacagtgctgtatggctactacaccctgtacagcgtcatcctcttctgtgtgttcttctggatcccctttgtgtacttctactatgaggagaaggatgatgatgacaccagcaagtgcacccagatcaagacagccctgaagtacaccctgggctttgtggtgatctgtgccctgctgctgctggtgggcgcctttgtgcccctgaatgtgcccaacaacaagaacagcacagagtgggagaaggtgaagagcctgtttgaggagctgggcagcagccacggcctggccgccctgtccttcagcatcagcagcctgaccctgattggcatgctggccgccatcacctacacagcctacggcatgtctgccctgcccctgaacctgatcaagggcaccaggtctgctgcctatgaaaggctggagaacacagaagatattgaggaggtggagcagcacatccagaccatcaagagcaagagcaaggatggccggcccctgcctgcccgggacaagagggccctgaagcagtttgaggagcggctgcggaccctgaagaagcgggagcggcacctggagttcatcgagaacagctggtggaccaagttctgtggggccctgcggcccctgaagatcgtgtggggcatcttcttcatcctggtggccctgctgtttgtgatcagcctcttcctgagcaacctggacaaggccctgcacagcgctggcattgattctggcttcatcatctttggagccaacctgagcaaccccctgaacatgctgctgcccctgctgcagacagtgttccccctggactacatcctgatcaccatcatcatcatgtacttcatcttcacctccatggccggcatccggaacatcggcatctggttcttctggatccggctgtacaagatcagaagaggccgcacccggccccaggccctgctcttcctgtgcatgatcctgctgctgattgtgctgcacaccagctacatgatctacagcctggccccccagtatgtgatgtatggcagccagaactacctgattgagaccaacatcaccagtgacaaccacaagggcaacagcaccctgtctgtgcccaagagatgtgatgctgatgcccctgaggaccagtgcaccgtgaccaggacctacctgttcctgcacaagttctggttcttctctgctgcctactacttcggcaactgggccttcctgggcgtcttcctgattggcctcatcgtgtcctgctgcaagggcaagaagtctgtgattgaaggagtggatgaggacagcgacatcagtgatgatgagcccagcgtgtacagcgcctag

SEQ ID NO: 158104 - DNA, 939 bp, Artificial Sequence
  Description of Artificial Sequence: Synthetic coding sequence
atgagctaccagaagaagcagcccaccccccagccccctgtggactgtgtgaagaccagcggcggcggcggcggcggcggcggcagcggcggcggcggctgcggcttctttggaggcggcggcagcggcggcggcagcagcggcagcggctgcggctacagcggcggcggcggctacagcggcggcggctgcggcggcggcagcagcggcggcggcggcggcggcggcattggaggctgcggcggcggcagcggcggctctgtgaagtacagcggcggcggcggcagcagcggcggcggcagcggctgcttcagcagcggcggcggcggcagcggctgcttcagcagcggcggcggcggcagcagcggcggcggcagcggctgcttcagcagcggcggcggcggcagcagcggcggcggcagcggctgcttcagcagcggcggcggcggcttcagcggccaggccgtgcagtgccagagctatggaggagtgagcagcggcggcagcagcggcggcggcagcggctgcttcagcagcggcggcggcggcggctctgtgtgtggctacagcggcggcggcagcggctgcggcggcggcagcagcggcggcagcggcagcggctacgtgagcagccagcaggtgacccagaccagctgtgccccccagcccagctatggaggcggcagcagcggcggcggcggcagcggcggcagcggctgcttcagcagcggcggcggcggcggcagcagcggctgcggcggcggcagcagcggcatcggcagcggctgcatcatcagcggcggcggctctgtgtgtggcggcggcagcagcggcggcggcggcggcggcagctctgtgggcggcagcggcagcgggaaaggagtgcccatctgccaccagacccagcagaagcaggcccccacctggcccagcaagtag

SEQ ID NO: 158105 - DNA, 1002 bp, Artificial Sequence
  Description of Artificial Sequence: Synthetic coding sequence
atgagctaccagaagaagcagcccaccccccagccccctgtggactgtgtgaagaccagcggcggcggcggcggcggcggcggcagcggcggcggcggctgcggcttctttggaggcggcggcagcggcggcggcagcagcggcagcggctgcggctacagcggcggcggcggctacagcggcggcggctgcggcggcggcagcagcggcggcggcggcggcggcggcattggaggctgcggcggcggcagcggcggctctgtgaagtacagcggcggcggcggcagcagcggcggcggcagcggctgcttcagcagcggcggcggcggcagcggctgcttcagcagcggcggcggcggcagcagcggcggcggcagcggctgcttcagcagcggcggcggcggcagcagcggcggcggcagcggctgcttcagcagcggcggcggcggcttcagcggccaggccgtgcagtgccagagctatggaggagtgagcagcggcggcagcagcggcggcggcagcggctgcttcagcagcggcggcggcggcggctctgtgtgtggctacagcggcggcggcagcggctgcggcggcggcagcagcggcggcagcggcagcggctacgtgagcagccagcaggtgacccagaccagctgtgccccccagcccagctatggaggcggcgtgagaagaagacggcagaggaggaagaggctgctgctgcagaggcggggccggcgggagctgcggctgcggcggcggctgctgcgggactggcagaggctgcaccaccagtggaggggcctgcggctgcggcgctggttcctgtggaggagaagaagaaggctgctgcggggctggctgcgggagtggcagggccgcccagacctgcccccagaccctgctgaggccggggcctacctggccgtgcagattgaccccccaggctaccacggcggggagggcgtgggcggcgtcttccagggccaccgctgggcctag

SEQ ID NO: 158106 - DNA, 927 bp, Artificial Sequence
  Description of Artificial Sequence: Synthetic coding sequence
atggatgccctgaagtctgctggccgggccctgatccgcagccccagcctggccaagcagagctggggcggcggcggccgccacaggaagctgcctgagaactggacagacacccgggagaccctgctggagggcatgctgttcagcctgaagtacctgggcatgaccctggtggagcagcccaagggggaggagctgtctgctgctgccatcaagagaattgtggccacagccaaggccagcggcaagaagctgcagaaggtgaccctgaaggtgagcccccggggcatcatcctgacagacaacctgaccaaccagctgattgaaaatgtgtccatctaccgcatctcctactgcacagctgacaagatgcatgacaaggtgtttgcctacatcgcccagagccagcacaaccagagcctggagtgccacgccttcctgtgcaccaagaggaagatggcccaggccgtgaccctgactgtggcccaggccttcaaggtggcctttgagttctggcaggtgtccaaggaggagaaggagaagagggacaaggccagccaggagggcggagatgtgctgggcgcccggcaggactgcacccccagcctgaagagcctggtggccactggaaacctgctggacctggaggagacagccaaggcccccctgagcacagtgtctgccaacaccaccaacatggatgaggtgccccggccccaggccctgagcggcagctctgtggtgtgggagctggatgatggcctggatgaggccttcagccggctggcccagagcaggaccaacccccaggtgctggacaccggcctgacagcccaggacatgcactacgcccagtgcctgagccctgtggactgggacaagccagacagcagcggcacagagcaggatgacctcttctccttctag

SEQ ID NO: 158107 - DNA, 810 bp, Artificial Sequence; identical to SEQ ID NO: 147630
  Description of Artificial Sequence: Synthetic coding sequence

SEQ ID NO: 158108 - DNA, 13635 bp, Artificial Sequence
  Description of Artificial Sequence: Synthetic coding sequence
atgctgaccccacccctgctgctgctgctgcccctgctgagcgccctggtggccgccgccattgatgcccccaagacctgcagccccaagcagtttgcctgccgggaccagatcacctgcatcagcaagggctggaggtgtgatggagagcgggactgcccagatggcagtgatgaggcccctgagatctgcccccagagcaaggcccagcgctgccagcccaatgagcacaactgcctgggcacagagctgtgtgtgcccatgagccggctgtgcaatggagtgcaggactgcatggatggcagtgatgagggcccccactgccgggagctgcagggcaactgcagccggctgggctgccagcaccactgtgtgcccaccctggatggccccacctgctactgcaacagcagcttccagctgcaggctgatggcaagacctgcaaggactttgatgaatgttctgtgtatggcacctgcagccagctgtgcaccaacacagatggcagcttcatctgtggctgtgtggagggctacctgctgcagcctgacaacagaagctgcaaggccaagaatgaacctgtggaccggccccctgtgctgctgattgccaacagccagaacatcctggccacctacctgagcggggcccaggtgtccaccatcacccccaccagcacccggcagaccacagccatggacttctcctatgccaatgaaacagtgtgctgggtgcacgtgggggacagcgctgcccagacccagctgaagtgtgccaggatgcctggcctgaagggctttgtggatgagcacaccatcaacatcagcctgagcctgcaccacgtggagcagatggccatcgactggctgactggaaacttctactttgtggatgacattgatgaccgcatctttgtgtgcaacagaaatggagacacctgtgtgaccctgctggacctggagctgtacaaccccaagggcatcgccctggaccctgccatgggcaaggtgttcttcacagattatggccagatccccaaggtggagcgctgtgacatggatggccagaacagaaccaagctggtggacagcaagatcgtgttcccccacggcatcaccctggacctggtgtcccggctggtgtactgggcagatgcctacctggactacatcgaggtggtggactatgagggcaagggccggcagaccatcatccagggcatcctgattgagcacctgtatggcctgactgtgtttgagaactacctgtatgccaccaacagcgacaatgccaatgcccagcagaagaccagcgtcatccgggtgaaccgcttcaacagcacagagtaccaggtggtgaccagggtggacaagggcggggccctgcacatctaccaccagaggcggcagccccgggtgcgcagccacgcctgtgaaaatgaccagtatggcaagccaggcggctgcagcgacatctgcctgctggccaacagccacaaggcccggacctgccgctgccgcagcggcttcagcctgggcagtgatggcaagagctgcaagaagccagagcacgagctgttcctggtgtatggcaagggccggcccggcatcatccggggcatggacatgggcgccaaggtgcctgatgagcacatgatccccatcgagaacctgatgaacccccgggccctggacttccacgccgagaccggcttcatctactttgctgacaccaccagctacctgattggccggcagaagattgatggaacagagcgggagaccatcctgaaggatggcatccacaacgtggagggcgtggccgtggactggatgggagacaacctgtactggacagatgatggccccaagaagaccatctctgtggcccggctggagaaggccgcccagaccaggaagaccctgattgagggcaagatgacccacccccgggccatcgtggtggaccccctgaatggctggatgtactggacagactgggaggaggaccccaaggacagcagaagaggccgcctggagcgggcctggatggatggcagccaccgggacatctttgtgaccagcaagacagtgctgtggcccaacggcctgagcctggacatcccagctggccgcctgtactgggtggatgccttctatgacagaattgagaccatcctgctgaatggaacagacaggaagatcgtgtatgagggccctgagctgaaccacgccttcggcctgtgccaccacggcaactacctgttctggacagagtaccgcagcggctctgtgtaccgcctggagcggggcgtgggcggggccccacccaccgtgaccctgctgcggtctgagaggcctcccatctttgagatccgcatgtatgatgcccagcagcagcaggtgggcaccaacaagtgccgggtgaacaatggaggctgcagcagcctgtgcctggccaccccaggcagccggcagtgtgcctgtgccgaggaccaggtgctggatgctgatggagtgacctgcctggccaaccccagctatgtgcccccaccccagtgccagcccggggagtttgcctgtgccaacagccgctgcatccaggagcgctggaagtgtgatggagacaatgactgcctggacaacagtgatgaggccccagccctgtgccaccagcacacctgccccagcgaccgcttcaagtgtgagaacaaccgctgcatccccaaccgctggctgtgtgatggagacaatgactgtggcaacagtgaagatgagagcaatgccacctgcagcgcccggacctgcccccccaaccagttcagctgtgccagcggccgctgcatccccatctcctggacctgtgacctggatgatgactgtggggacagaagtgatgagagcgccagctgtgcctaccccacctgcttccccctgacccagttcacctgcaacaacggccgctgcatcaacatcaactggaggtgtgacaatgacaatgactgtggggacaacagtgatgaagctggctgcagccacagctgcagcagcacccagttcaagtgcaacagcggccgctgcatccctgagcactggacctgtgatggagacaatgactgtggggactacagtgatgagacccacgccaactgcaccaaccaggccacccggcccccaggcggctgccacacagatgagttccagtgccgcctggatggcctgtgcatccccctgcgctggaggtgtgatggagacacagactgcatggacagcagtgatgagaagagctgtgaaggagtgacccacgtgtgtgaccccagcgtgaagtttggctgcaaggacagcgcccgctgcatcagcaaggcctgggtgtgtgatggagacaatgactgtgaggacaacagtgatgaggagaactgtgagagcctggcctgcaggcctcccagccacccctgtgccaacaacacctctgtgtgcctgcccccagacaagctgtgtgatggaaatgatgactgtggagatggcagtgatgaaggagagctgtgtgaccagtgcagcctgaacaatggaggctgcagccacaactgcagcgtggcccctggagagggcatcgtgtgcagctgccccctgggcatggagctgggccctgacaaccacacctgccagatccagagctactgtgccaagcacctgaagtgcagccagaagtgtgaccagaacaagttctctgtgaagtgcagctgctatgagggctgggtgctggagccagatggagagagctgccgcagcctggaccccttcaagcccttcatcatcttcagcaacagacatgagatcagaagaattgacctgcacaagggggactacagcgtgctggtgcccggcctgaggaacaccatcgccctggacttccacctgagccagagcgccctgtactggacagatgtggtggaggacaagatctaccggggcaagctgctggacaatggagccctgaccagctttgaggtggtgatccagtatggcctggccaccccagagggcctggccgtggactggattgctggcaacatctactgggtggagagcaacctggaccagatcgaggtggccaagctggatggcaccctgcggaccaccctgctggccggggacatcgagcacccccgggccatcgccctggaccccagagatggcatcctcttctggacagactgggatgccagcctgcccagaattgaagctgcctccatgtctggagctggaagaagaacagtgcaccgggagaccggcagcggcggctggcccaacggcctgactgtggactacctggagaagaggatcctgtggattgatgcccggagtgatgccatctacagcgcccgctatgatggcagcggccacatggaggtgctgcggggccacgagttcctgagccacccctttgctgtgaccctgtatggaggagaggtgtactggacagactggaggaccaacaccctggccaaggccaacaagtggacaggccacaacgtgacagtggtgcagaggaccaacacccagccctttgacctgcaggtgtaccaccccagccggcagcccatggcccccaacccctgtgaggccaatggaggccagggcccctgcagccacctgtgcctgatcaactacaacagaacagtgtcctgtgcctgcccccacctgatgaagctgcacaaggacaacaccacctgctatgagttcaagaagttcctgctgtatgcccggcagatggagatccggggcgtggacctggatgccccctactacaactacatcatctccttcaccgtgcctgacatcgacaacgtgacagtgctggactatgatgcccgggagcagagggtgtactggagcgatgtgaggacccaggccatcaagagggccttcatcaatggaactggagtggagaccgtggtgtctgctgacctgcccaatgcccacggcctggccgtggactgggtgtccaggaacctcttctggaccagctatgacaccaacaagaagcagatcaacgtggcccggctggatggcagcttcaagaatgctgtggtgcagggcctggagcagccccacggcctggtggtgcaccccctgcggggcaagctgtactggacagatggagacaacatctccatggccaacatggatggcagcaacagaaccctgctcttcagcggccagaagggccctgtgggcctggccatcgacttccctgagagcaagctgtactggatcagcagcggcaaccacaccatcaaccgctgcaacctggatggcagcggcctggaggtgattgatgccatgaggagccagctgggcaaggccacagccctggccatcatgggagacaagctgtggtgggccgaccaggtgtctgagaagatgggcacctgcagcaaggcagatggcagcggctctgtggtgctgaggaacagcaccaccctggtgatgcacatgaaggtgtatgatgagagcatccagctggaccacaagggcaccaacccctgcagcgtgaacaacggggactgcagccagctgtgcctgcccaccagcgagaccaccaggagctgcatgtgcacagctggctacagcctgcggagcggccagcaggcctgtgagggcgtgggcagcttcctgctgtacagcgtgcatgagggcatccggggcatccccctggaccccaatgacaagagtgatgccctggtgcctgtgtctggcaccagcctggccgtgggcatcgacttccacgccgagaatgacaccatctactgggtggacatgggcctgagcaccatcagccgggccaagagggaccagacctggagagaagatgtggtgaccaacggcatcggccgggtggagggcattgctgtggactggattgctggcaacatctactggacagaccagggctttgatgtgattgaggtggcccggctgaatggcagcttccgctacgtggtgatcagccagggcctggacaagccccgggccatcaccgtgcaccctgagaagggctacctgttctggacagagtggggccagtaccccagaattgaaagaagccggctggatggaacagagcgggtggtgctggtgaatgtgtccatctcctggcccaacggcatctctgtggactaccaggacggcaagctgtactggtgtgatgccaggacagacaagattgaaagaattgacctggagactggagaaaatcgggaggtggtgctgagcagcaacaacatggacatgttttctgtgtctgtgtttgaggacttcatctactggagcgacaggacccacgccaacggcagcatcaagaggggcagcaaggacaatgccacagattctgtgcccctgaggacaggcatcggcgtgcagctgaaggacatcaaggtgttcaacagagaccggcagaagggcaccaacgtgtgtgctgtggccaatggaggctgccagcagctgtgcctgtaccggggccggggccagagggcctgtgcctgtgcccacggcatgctggctgaagatggagccagctgccgggagtatgccggctacctgctgtacagcgagaggaccatcctgaagagcatccacctgagtgatgagaggaacctgaatgcccctgtgcagccctttgaggaccctgagcacatgaagaatgtgattgccctggcctttgactacagagctggcaccagccctggcacccccaaccgcatcttcttcagtgacatccacttcggcaacatccagcagatcaatgatgatggcagccgccgcatcaccatcgtggagaatgtgggctctgtggagggcctggcctaccaccggggctgggacaccctgtactggaccagctacaccaccagcaccatcaccaggcacacagtggaccagaccaggcctggggcctttgagcgggagaccgtcatcaccatgtctggagatgaccacccccgggcctttgtgctggatgagtgccagaacctgatgttctggaccaactggaatgagcagcaccccagcatcatgagagctgccctgagcggggccaacgtgctgaccctcatcgagaaggacatccgcacccccaacggcctggccatcgaccacagagctgagaagctgtacttcagtgatgccaccctggacaagattgagcgctgtgaatatgatggcagccaccgctacgtgatcctgaagtctgagcctgtgcaccccttcggcctggccgtgtatggagagcacatcttctggacagactgggtgagaagagctgtgcagagggccaacaagcacgtgggcagcaacatgaagctgctgcgggtggacatcccccagcagcccatgggcatcatcgctgtggccaatgacaccaacagctgtgagctgagcccctgccgcatcaacaacggcggctgccaggacctgtgcctgctgacccaccagggccacgtgaactgcagctgccggggcggccgcatcctgcaggatgacctgacctgcagagctgtgaacagcagctgccgggcccaggatgaatttgaatgtgccaacggggagtgcatcaacttcagcctgacctgtgatggagtgccccactgcaaggacaagagtgatgagaagcccagctactgcaacagccgccgctgcaagaagaccttccggcagtgcagcaatggccgctgtgtgagcaacatgctgtggtgcaatggagcagatgactgtggagatggcagtgatgagatcccctgcaacaagacagcctgtggggtgggggagttccgctgcagagatggcacctgcatcggcaacagcagccgctgcaaccagtttgtggactgtgaagatgccagtgatgagatgaactgcagcgccacagactgcagcagctacttccggctgggcgtgaagggcgtgctcttccagccctgtgagaggaccagcctgtgctacgcccccagctgggtgtgtgatggagccaatgactgtggggactacagtgatgagcgggactgccctggggtgaagaggccccgctgccccctgaactactttgcctgccccagcggccgctgcatccccatgtcctggacctgtgacaaggaggatgactgtgaacatggagaagatgagacccactgcaacaagttctgcagcgaggcccagtttgagtgccagaaccaccgctgcatcagcaagcagtggctgtgtgatggcagtgatgactgtggagatggcagtgatgaggccgcccactgtgagggcaagacctgtggccccagcagcttcagctgccccggcacccacgtgtgtgtgcctgagcgctggctgtgtgatggagacaaggactgtgctgatggagcagatgagagcattgctgctggctgcctgtacaacagcacctgtgatgaccgggagttcatgtgccagaaccggcagtgcatccccaagcactttgtgtgtgaccatgaccgggactgtgctgatggcagtgatgagagcccagaatgtgagtaccccacctgtggccccagcgagttccgctgtgccaacggccgctgcctgagcagccggcagtgggagtgtgatggagaaaatgactgccacgaccagagtgatgaggcccccaagaacccccactgcaccagccaggagcacaagtgcaatgccagcagccagttcctgtgcagcagcggccgctgtgtggccgaggccctgctgtgcaatggccaggatgactgtggggacagcagtgatgagcggggctgccacatcaatgaatgtctgagcaggaagctgagcggctgcagccaggactgtgaggacctgaagattggcttcaagtgccgctgcaggcctggcttccggctgaaggatgatggccgcacctgtgctgatgtggatgaatgttccaccaccttcccctgcagccagcgctgcatcaacacccacggcagctacaagtgcctgtgtgtggagggctacgccccccggggcggggacccccacagctgcaaggctgtgacagatgaggagcccttcctgatctttgccaaccgctactacctgaggaagctgaacctggatggcagcaactacaccctgctgaagcagggcctgaacaatgctgtggccctggactttgactaccgggagcagatgatctactggacagatgtgaccacccagggctccatgatccggaggatgcacctgaatggcagcaatgtgcaggtgctgcacaggacaggcctgagcaacccagatggcctggccgtggactgggtgggcggcaacctgtactggtgtgacaagggccgggacaccatcgaggtgtccaagctgaatggagcctacagaacagtgctggtgagcagcggcctgcgggagccccgggccctggtggtggatgtgcagaatggctacctgtactggacagactggggagaccacagcctcatcggcagaattggcatggatggcagcagccgctctgtgattgtggacaccaagatcacctggcccaacggcctgaccctggactatgtgacagagcgcatctactgggcagatgcccgggaggactacattgaatttgccagcctggatggcagcaacagacatgtggtgctgagccaggacatcccccacatctttgccctgaccctgtttgaagattatgtgtactggacagactgggagaccaagagcatcaacagagcccacaagaccaccggcaccaacaagaccctgctgatcagcaccctgcaccggcccatggacctgcacgtgttccacgccctgcggcagccagatgtgcccaaccacccctgcaaggtgaacaacggcggctgcagcaacctgtgcctgctgagccctgggggcggccacaagtgtgcctgccccaccaacttctacctgggcagtgatggccgcacctgtgtgagcaactgcacagccagccagtttgtgtgcaagaatgacaagtgcatccccttctggtggaagtgtgacacagaagatgactgtggggaccacagtgatgagcccccagactgcccagagttcaagtgccggcccggccagttccagtgcagcacaggcatctgcaccaacccagccttcatctgtgatggagacaatgactgccaggacaacagtgatgaggccaactgtgacatccacgtgtgcctgcccagccagttcaagtgcaccaacaccaaccgctgcatccctggcatcttccgctgcaatggccaggacaactgtggagatggagaagatgagcgggactgcccagaggtgacctgtgcccccaaccagttccagtgcagcatcaccaagcgctgcatcccccgggtgtgggtgtgtgaccgggacaatgactgtgtggatggcagtgatgagcccgccaactgcacccagatgacctgtggggtggatgagttccgctgcaaggacagcggccgctgcatcccagcccgctggaagtgtgatggagaagatgactgtggagatggcagtgatgagcccaaggaggagtgtgatgagaggacctgtgagccctaccagttccgctgcaagaacaacagatgtgtgcccggccgctggcagtgtgactatgacaatgactgtggggacaacagtgatgaggagagctgcaccccccggccctgcagcgagagcgagttcagctgtgccaacggccgctgcatcgccggccgctggaagtgtgatggagaccatgactgtgctgatggcagtgatgagaaggactgcaccccccgctgtgacatggaccagttccagtgcaagagcggccactgcatccccctgcgctggaggtgtgatgctgatgctgactgcatggatggcagtgatgaggaggcctgtggcactggagtgaggacctgccccctggatgagttccagtgcaacaacaccctgtgcaagcccctggcctggaagtgtgatggagaagatgactgtggggacaacagtgatgaaaatccagaagaatgtgccaggtttgtgtgcccccccaaccggcccttccgctgcaagaatgacagagtgtgcctgtggattggccggcagtgtgatggaacagacaactgtggagatggaacagatgaggaggactgtgagcccccaacagcccacaccacccactgcaaggacaagaaggagttcctgtgcaggaaccagcgctgcctgagcagcagcctgcgctgcaacatgtttgatgactgtggagatggcagtgatgaggaggactgcagcattgaccccaagctgaccagctgtgccaccaatgccagcatctgtggagatgaggcccgctgtgtgaggacagagaaggccgcctactgtgcctgccgcagcggcttccacacagtgcccggccagcccggctgccaggacatcaatgaatgtctgcgcttcggcacctgcagccagctgtgcaacaacaccaagggcggccacctgtgcagctgtgccaggaacttcatgaagacccacaacacctgcaaggccgagggcagcgagtaccaggtgctgtacatcgcagatgacaatgagatccgcagcctcttccctggccacccccacagcgcctatgagcaggccttccagggagatgaatctgtgagaattgatgccatggatgtgcacgtgaaggccggccgggtgtactggaccaactggcacacaggcaccatctcctaccgcagcctgcccccagctgccccacccaccaccagcaacagacaccggcggcagattgaccggggcgtgacccacctgaacatcagcggcctgaagatgccccggggcatcgccatcgactgggtggccggaaatgtgtactggacagattctggaagagatgtgattgaggtggcccagatgaagggggagaacaggaagaccctcatcagcggcatgattgatgagccccacgccatcgtggtggaccccctgcggggcaccatgtactggagcgactggggcaaccaccccaagattgaaacagctgccatggatggcaccctgcgggagaccctggtgcaggacaacatccagtggcccaccggcctggccgtggactaccacaatgaaagactctactgggcagatgccaagctgtctgtgattggcagcatccggctgaatggaacagaccccatcgtggccgctgacagcaagaggggcctgagccaccccttcagcattgatgtgtttgaggactacatctatggagtgacctacatcaacaacagagtcttcaagatccacaagtttggccacagccccctggtgaacctgactggaggcctgagccacgccagtgatgtggtgctgtaccaccagcacaagcagcctgaggtgaccaacccctgtgacaggaagaagtgtgagtggctgtgcctgctgagccccagcggccctgtgtgcacctgccccaacgggaagaggctggacaatggcacctgtgtgcctgtgcccagccccaccccacctccagatgcccccaggcctggcacctgcaacctgcagtgcttcaacggcggcagctgcttcctgaatgcccggcggcagcccaagtgccgctgccagccccgctacacaggagacaagtgtgagctggaccagtgctgggagcactgcagaaatggaggcacctgtgccgccagccccagcggcatgcccacctgccgctgccccaccggcttcaccggccccaagtgcacccagcaggtgtgtgccggctactgtgccaacaacagcacctgcaccgtgaaccagggcaaccagccccagtgccgctgcctgcccggcttcctgggggaccgctgccagtaccggcagtgcagcggctactgtgaaaattttggcacctgccagatggccgcagatggcagccggcagtgccgctgcacagcctactttgagggcagccgctgtgaggtgaacaagtgcagccgctgcctggagggcgcctgtgtggtgaacaagcagagcggagatgtgacctgcaactgcacagatggccgggtggcccccagctgcctgacctgtgtgggccactgcagcaatggaggcagctgcaccatgaacagcaagatgatgcctgagtgccagtgccccccccacatgacaggcccccgctgtgaggagcacgtgttcagccagcagcagcccggccacatcgccagcatcctgatccccctgctgctgctgctgctgctggtgctggtggccggcgtggtgttctggtacaagagaagagtgcagggcgccaagggcttccagcaccagaggatgaccaatggagccatgaatgtggagatcggcaaccccacctacaagatgtatgagggcggggagccagatgatgtgggcggcctgctggatgctgactttgccctggaccctgacaagcccaccaacttcaccaaccctgtgtatgccaccctgtacatgggcggccacggcagccgccacagcctggccagcacagatgagaagcgggagctgctgggccggggcccagaagatgaaattggagaccccctggcctag

SEQ ID NO: 158109 - DNA, 2142 bp, Artificial Sequence
  Description of Artificial Sequence: Synthetic coding sequence
atgctgctggccaccctgctgctgctgctgctgggcggggccctggcccacccagaccgcatcatcttccccaaccacgcctgtgaagatcctcctgctgtgctgctggaggtgcagggcaccctgcagaggcccctggtgcgggacagcaggaccagccctgccaactgcacctggctgatcctgggcagcaaggagcagacagtgaccatccgcttccagaagctgcacctggcctgtggcagcgagcggctgaccctgcggagccccctgcagcccctcatcagcctgtgtgaggccccacccagccccctgcagctgcccggcggcaatgtgaccatcacctacagctatgctggggcccgggcccccatgggccagggcttcctgctgagctacagccaggactggctgatgtgcctgcaggaggagttccagtgcctgaaccaccgctgtgtgtctgctgtgcagagatgtgatggagtggatgcctgtggagatggcagtgatgaggccggctgcagcagtgaccccttccctggcctgacccccaggcctgtgcccagcctgccctgcaatgtgaccctggaggacttctacggcgtcttcagcagccctggctacacccacctggcctctgtgagccacccccagagctgccactggctgctggacccccatgatggccggcggctggccgtgcgcttcaccgccctggacctgggctttggagatgctgtgcacgtgtatgatggccctggccccccagagagcagccggctgctgcggagcctgacccacttcagcaatggcaaggctgtgacagtggagaccctgagcggccaggccgtggtgtcctaccacacagtggcctggagcaatggccggggcttcaatgccacctaccacgtgcggggctactgcctgccctgggaccggccctgtggcctgggcagcggcctgggcgctggggagggcctgggggagcgctgctacagcgaggcccagagatgtgatggctcctgggactgtgctgatggaacagatgaggaggactgccccggctgccccccaggccacttcccctgtggggccgccggcaccagcggggccacagcctgctacctgcctgctgaccgctgcaactaccagaccttctgtgctgatggagcagatgagcggcgctgccgccactgccagcccggcaacttccgctgcagagatgagaagtgtgtgtatgagacctgggtgtgtgatggccagcctgactgtgctgatggcagtgatgagtgggactgcagctatgtgctgcccaggaaggtgatcacagctgctgtgattggcagcctggtgtgtggcctgctgctggtgattgccctgggctgcacctgcaagctgtatgccatccgcacccaggagtacagcatctttgcccccctgagcaggatggaggccgagatcgtgcagcagcaggcccctccttcctatggccagctgattgcccagggcgccatcccccctgtggaggacttccccacagagaaccccaatgacaacagcgtgctgggcaacctgcggagcctgctgcagatcctgcggcaggacatgacccctgggggcggccctggggcccggcggcggcagaggggccgcctgatgaggcggctggtgcggcggctgcggcgctggggcctgctgcccaggaccaacaccccagcccgggccagcgaggcccggagccaggtgaccccatctgctgcccccctggaggccctggatggcggcaccggccctgcccgggagggcggcgctgtgggcggccaggatggagagcaggccccacccctgcccatcaaggcccccctgcccagcgccagcaccagccctgcccccaccaccgtgcctgaggcccctggccccctgcccagcctgcccctggagcccagcctgctgagcggcgtggtgcaggccctgcggggccgcctgctgcccagcctgggccccccaggccccaccaggagccccccaggcccccacacagctgtgctggccctggaggatgaagatgatgtgctgctggtgcccctggccgagcccggggtgtgggtggccgaggctgaagatgagcccctgctgacctag

SEQ ID NO: 158110 - DNA, 1671 bp, Artificial Sequence
  Description of Artificial Sequence: Synthetic coding sequence
atgctgctggccaccctgctgctgctgctgctgggcggggccctggcccacccagaccgcatcatcttccccaaccacgcctgtgaagatcctcctgctgtgctgctggaggtgcagggcaccctgcagaggcccctggtgcgggacagcaggaccagccctgccaactgcacctggctgatcctgggcagcaaggagcagacagtgaccatccgcttccagaagctgcacctggcctgtggcagcgagcggctgaccctgcggagccccctgcagcccctcatcagcctgtgtgaggccccacccagccccctgcagctgcccggcggcaatgtgaccatcacctacagctatgctggggcccgggcccccatgggccagggcttcctgctgagctacagccaggactggctgatgtgcctgcaggaggagttccagtgcctgaaccaccgctgtgtgtctgctgtgcagagatgtgatggagtggatgcctgtggagatggcagtgatgaggccggctgcagcagtgaccccttccctggcctgacccccaggcctgtgcccagcctgccctgcaatgtgaccctggaggacttctacggcgtcttcagcagccctggctacacccacctggcctctgtgagccacccccagagctgccactggctgctggacccccatgatggccggcggctggccgtgcgcttcaccgccctggacctgggctttggagatgctgtgcacgtgtatgatggccctggccccccagagagcagccggctgctgcggagcctgacccacttcagcaatggcaaggctgtgacagtggagaccctgagcggccaggccgtggtgtcctaccacacagtggcctggagcaatggccggggcttcaatgccacctaccacgtgcggggctactgcctgccctgggaccggccctgtggcctgggcagcggcctgggcgctggggagggcctgggggagcgctgctacagcgaggcccagagatgtgatggctcctgggactgtgctgatggaacagatgaggaggactgccccggctgccccccaggccacttcccctgtggggccgccggcaccagcggggccacagcctgctacctgcctgctgaccgctgcaactaccagaccttctgtgctgatggagcagatgagcggcgctgccgccactgccagcccggcaacttccgctgcagagatgagaagtgtgtgtatgagacctgggtgtgtgatggccagcctgactgtgctgatggcagtgatgagtgggactgcagctatgtgctgcccaggaaggtgatcacagctgctgtgattggcagcctggtgtgtggcctgctgctggtgattgccctgggctgcacctgcaagctgtatgccatccgcacccaggagtacagcatctttgcccccctgagcaggatggaggccgagatcgtgcagcagcaggcccctccttcctatggccagctgattgcccagggcgccatcccccctgtggaggacttccccacagagaaccccaatgacaacagcgtgctgggcaacctgcggagcctgctgcagatcctgcggcaggacatgacccctgggggcggccctggggcccggcggcggcagaggggccgcctgatgaggcggctgtag

SEQ ID NO: 158111 - DNA, 13968 bp, Artificial Sequence
  Description of Artificial Sequence: Synthetic coding sequence
atggaccggggccctgctgctgtggcctgcaccctgctgctggccctggtggcctgcctggccccagccagcggccaggagtgtgacagcgcccacttccgctgtggcagcggccactgcatcccagctgactggaggtgtgatggcaccaaggactgcagtgatgatgctgatgagatcggctgtgctgtggtgacctgccagcagggctacttcaagtgccagagcgagggccagtgcatccccaacagctgggtgtgtgaccaggaccaggactgtgatgatggcagtgatgagcggcaggactgcagccagagcacctgcagcagccaccagatcacctgcagcaatggccagtgcatccccagcgagtaccgctgtgaccacgtgcgggactgcccagatggagcagatgaaaatgactgccagtaccccacctgtgagcagctgacctgtgacaacggggcctgctacaacaccagccagaagtgtgactggaaggtggactgccgggacagcagtgatgagatcaactgcacagagatctgcctgcacaatgagttcagctgtggaaatggagagtgcatcccccgggcctacgtgtgtgaccatgacaatgactgccaggacggcagtgatgaacatgcctgcaactaccccacctgtggcggctaccagttcacctgccccagcggccgctgcatctaccagaactgggtgtgtgatggagaagatgactgcaaggacaatggagatgaagatggctgtgagagcggcccccatgatgtgcacaagtgcagcccccgggagtggagctgcccagagagcggccgctgcatcagcatctacaaggtgtgtgatggcatcctggactgccccggccgggaggatgagaacaacaccagcacaggcaagtactgcagcatgaccctgtgcagcgccctgaactgccagtaccagtgccacgagaccccctacggcggggcctgcttctgccccccaggctacatcatcaaccacaatgacagcaggacctgtgtggagtttgatgactgccagatctggggcatctgtgaccagaagtgtgagagccggcccggccgccacctgtgccactgtgaggagggctacatcctggagcggggccagtactgcaaggccaatgacagctttggagaggccagcatcatcttcagcaatggccgggacctgctgattggagacatccacggccgctccttccgcatcctggtggagagccagaacagaggagtggccgtgggcgtggccttccactaccacctgcagagggtcttctggacagacacagtgcagaacaaggtgttttctgtggacatcaatggcctgaacatccaggaggtgctgaatgtgtctgtggagaccccagagaacctggccgtggactgggtgaacaacaagatctacctggtggagaccaaggtgaacagaattgacatggtgaacctggatggcagctacagagtgaccctcatcacagagaacctgggccacccccggggcattgctgtggaccccaccgtgggctacctgttcttcagtgactgggagagcctgtctggagagcccaagctggagcgggccttcatggatggcagcaacaggaaggacctggtgaagaccaagctgggctggccagctggggtgaccctggacatgatcagcaagagggtgtactgggtggacagcagatttgactacattgaaacagtgacctatgatggcatccagaggaagacagtggtgcacggcggcagcctcatcccccacccctttggagtgtccctgtttgagggccaggtgttcttcacagactggaccaagatggctgtgctgaaggccaacaagttcacagagaccaacccccaggtgtactaccaggccagcctgcggccctacggcgtgacagtgtaccacagcctgcggcagccctatgccaccaacccctgcaaggacaacaatggaggctgtgagcaggtgtgtgtgctgagccacaggacagacaatgatggcctgggcttccgctgcaagtgcaccttcggcttccagctggacacagatgagcggcactgcatcgctgtgcagaacttcctgatcttcagcagccaggtggccatccggggcatccccttcaccctgagcacccaggaggatgtgatggtgcctgtgtctggcaaccccagcttctttgtgggcatcgactttgatgcccaggacagcaccatcttcttcagtgacatgagcaagcacatgatcttcaagcagaagattgatggcaccggccgggagatcctggccgccaacagagtggagaatgtggagagcctggcctttgactggatcagcaagaacctgtactggacagacagccactacaagagcatctctgtgatgaggctggccgacaagaccaggagaacagtggtgcagtacctgaacaaccccaggtctgtggtggtgcacccctttgctggctacctgttcttcacagactggttccggcctgccaagatcatgagggcctggagcgatggcagccacctgctgcctgtgatcaacaccaccctgggctggcccaacggcctggccatcgactgggccgccagccggctgtactgggtggatgcctactttgacaagattgagcacagcacctttgatggcctggacagaagaaggctgggccacatcgagcagatgacccaccccttcggcctggccatctttggagagcacctgttcttcacagactggaggctgggcgccatcatccgggtgaggaaggcagatggaggagagatgaccgtcatccgcagcggcatcgcctacatcctgcacctgaagagctatgatgtgaacatccagacaggcagcaatgcctgcaaccagcccacccaccccaatggagactgcagccacttctgcttccctgtgcccaacttccagagggtgtgtggctgcccctacggcatgaggctggccagcaaccacctgacctgtgagggggaccccaccaatgaaccacccacagagcagtgtggcctcttctccttcccctgcaagaatggccgctgtgtgcccaactactacctgtgtgatggagtggatgactgccacgacaacagtgatgagcagctgtgtggcaccctgaacaacacctgcagcagcagcgccttcacctgtggccacggggagtgcatcccagcccactggaggtgtgacaagagaaatgactgtgtggatggcagtgatgagcacaactgccccacccacgccccagccagctgcctggacacccagtacacctgtgacaaccaccagtgcatcagcaagaactgggtgtgtgacacagacaatgactgtggagatggcagtgatgagaagaactgcaacagcacagagacctgccagcccagccagttcaactgccccaaccaccgctgcatcgacctgagctttgtgtgtgatggagacaaggactgtgtggatggcagtgatgaggtgggctgtgtgctgaactgcacagccagccagttcaagtgtgccagcggggacaagtgcattggagtgaccaacagatgtgatggagtgtttgactgcagcgacaacagtgatgaggccggctgccccacccggcccccaggcatgtgccacagtgatgagttccagtgccaggaggatggcatctgcatccccaacttctgggagtgtgatggccacccagactgcctgtatggcagtgatgagcacaatgcctgtgtgcccaagacctgccccagcagctacttccactgtgacaatggaaactgcatccaccgggcctggctgtgtgaccgggacaatgactgtggggacatgtctgatgagaaggactgccccacccagcccttccgctgccccagctggcagtggcagtgcctgggccacaacatctgtgtgaacctgtctgtggtgtgtgatggcatctttgactgccccaacggcacagatgagagccccctgtgcaatggaaacagctgcagcgacttcaatggaggctgcacccatgaatgtgtgcaggagccctttggagccaagtgcctgtgccccctgggcttcctgctggccaatgacagcaagacctgtgaagatattgatgaatgtgacatcctgggcagctgcagccagcactgctacaacatgaggggcagcttccgctgcagctgtgacaccggctacatgctggagagtgatggccgcacctgcaaggtgacagccagcgagagcctgctgctgctggtggccagccagaacaagatcatcgctgacagcgtgaccagccaggtgcacaacatctacagcctggtggagaatggcagctacatcgtggccgtggactttgacagcatcagcggccgcatcttctggagcgatgccacccagggcaagacctggagcgccttccagaatggaacagaccggcgggtggtgtttgacagcagcatcatcctgacagagaccatcgccatcgactgggtgggcaggaacctgtactggacagattatgccctggagaccatcgaggtgtccaagattgatggcagccacaggacagtgctgatcagcaagaacctgaccaacccccggggcctggccctggaccccaggatgaatgagcacctgctcttctggagcgactggggccaccaccccagaattgagcgggcctccatggatggctccatgaggacagtcatcgtgcaggacaagatcttctggccctgtggcctgaccatcgactaccccaaccggctgctgtacttcatggacagctacctggactacatggacttctgtgactacaacggccaccaccggcggcaggtgattgccagtgacctgatcatccgccacccctatgccctgaccctgtttgaggacagcgtgtactggacagaccgggccaccaggagagtgatgagggccaacaagtggcacggcggcaaccagagcgtggtgatgtacaacatccagtggcccctgggcatcgtggccgtgcaccccagcaagcagcccaacagcgtgaacccctgtgccttcagccgctgcagccacctgtgcctgctgagcagccagggcccccacttctacagctgtgtgtgccccagcggctggagcctgagcccagacctgctgaactgcctgagagatgaccagcccttcctgatcaccgtgcggcagcacatcatcttcggcatcagcctgaaccctgaggtgaagagcaatgatgccatggtgcccatcgccggcatccagaatggcctggatgtggagtttgatgatgctgagcagtacatctactgggtggagaaccctggagagatccaccgggtgaagacagatggcaccaacagaacagtgtttgccagcatctccatggtgggccccagcatgaacctggccctggactggatcagcaggaacctgtacagcaccaaccccaggacccagagcattgaggtgctgaccctgcatggagacatccgctacaggaagaccctgattgccaatgatggaacagccctgggcgtgggcttccccatcggcatcaccgtggaccctgcccggggcaagctgtactggagcgaccagggcacagacagcggcgtgcctgccaagatcgccagcgccaacatggatggcacctctgtgaagaccctcttcaccggcaacctggagcacctggagtgtgtgaccctggacatcgaggagcagaagctgtactgggccgtgacaggccggggcgtgattgaaagaggaaatgtggatggaacagacaggatgatcctggtgcaccagctgagccacccctggggcattgctgtgcatgacagcttcctgtactacacagatgagcagtatgaggtgattgagcgggtggacaaggccaccggggccaacaagatcgtgctgcgggacaacgtgcccaacctgcggggcctgcaggtgtaccacagaagaaatgctgctgagagcagcaatggctgcagcaacaacatgaatgcctgccagcagatctgcctgcctgtgcctgggggcctcttcagctgtgcctgtgccaccggcttcaagctgaacccagacaacagaagctgcagcccctacaacagcttcatcgtggtgtccatgctgagcgccatccggggcttcagcctggagctgagtgaccacagcgagaccatggtgcctgtggccggccagggcagaaatgccctgcacgtggatgtggatgtgagcagcggcttcatctactggtgtgacttcagcagctctgtggccagtgacaatgccatccgccgcatcaagccagatggcagcagcctgatgaacatcgtgacccacggcatcggggagaatggagtgcggggcattgctgtggactgggtggccggcaacctgtacttcaccaatgcctttgtgtctgagaccctgattgaggtgctgcgcatcaacaccacctacagaagagtgctgctgaaggtgacagtggacatgcccaggcacatcgtggtggaccccaagaaccgctacctgttctgggccgactatggccagaggcccaagattgaaagaagcttcctggactgcaccaacagaacagtgctggtgtctgagggcatcgtgaccccccggggcctggccgtggacagaagtgatggctacgtgtactgggtggatgacagcctggacatcatcgcccgcatccgcatcaacggggagaacagcgaggtgatccgctatggcagccgctaccccaccccctacggcatcaccgtgtttgaaaattccatcatctgggtggacaggaacctgaagaagatcttccaggccagcaaggagcctgagaacacagagccccccaccgtcatccgggacaacatcaactggctgagagatgtgaccatctttgacaagcaggtgcagcccaggagccctgctgaggtgaacaacaacccctgcctggagaacaacggcggctgcagccacctgtgctttgccctgcccggcctgcacacccccaagtgtgactgtgccttcggcaccctgcagagtgatggcaagaactgtgccatcagcacagagaacttcctgatctttgccctgagcaacagcctgcggagcctgcacctggaccctgagaaccacagcccccccttccagaccatcaacgtggagaggacagtgatgagcctggactatgacagcgtgtctgaccgcatctacttcacccagaacctggccagcggcgtgggccagatctcctatgccaccctgagcagcggcatccacacccccaccgtgattgccagcggcattggaacagcagatggcatcgcctttgactggatcacccggcgcatctactacagcgactacctgaaccagatgatcaacagcatggctgaagatggcagcaacagaacagtgattgcccgggtgcccaagccccgggccatcgtgctggacccctgccagggctacctgtactgggccgactgggacacccacgccaagattgaaagagccaccctgggcggcaacttccgggtgcccatcgtgaacagcagcctggtgatgcccagcggcctgaccctggactatgaggaggacctgctgtactgggtggatgccagcctgcagagaattgaaagaagcaccctgactggagtggaccgggaggtgattgtgaatgctgctgtgcacgccttcggcctgaccctgtatggccagtacatctactggacagacctgtacacccagaggatctaccgggccaacaagtatgatggcagcggccagatcgccatgaccaccaacctgctgagccagccccggggcatcaacacagtggtgaagaaccagaagcagcagtgcaacaacccctgtgagcagttcaatggaggctgcagccacatctgtgcccctggccccaatggagctgagtgccagtgcccccatgagggcaactggtacctggccaacaacaggaagcactgcatcgtggacaacggggagcgctgtggggccagcagcttcacctgcagcaatggccgctgcatcagcgaggagtggaagtgtgacaatgacaatgactgtggagatggcagtgatgagatggagagcgtgtgtgccctgcacacctgcagccccacagccttcacctgtgccaacggccgctgtgtgcagtacagctaccgctgtgactactacaatgactgtggagatggcagtgatgaagctggctgcctcttccgggactgcaatgccaccacagagttcatgtgcaacaacagacgctgcatcccccgggagttcatctgcaatggagtggacaactgccacgacaacaacaccagtgatgagaagaactgcccagacaggacctgccagagcggctacaccaagtgccacaacagcaacatctgcatcccccgggtgtacctgtgtgatggagacaatgactgtggggacaacagtgatgagaaccccacctactgcaccacccacacctgcagcagcagcgagttccagtgtgccagcggccgctgcatcccccagcactggtactgtgaccaggagacagactgctttgatgccagtgatgagcccgccagctgtggccacagcgagaggacctgcctggctgatgagttcaagtgtgatggcggccgctgcatccccagcgagtggatctgtgatggagacaatgactgtggggacatgtctgatgaggacaagaggcaccagtgccagaaccagaactgcagcgacagcgagttcctgtgtgtgaatgaccggcccccagaccggcgctgcatcccccagagctgggtgtgtgatggagatgtggactgcacagatggctatgatgagaaccagaactgcaccaggaggacctgcagtgaaaatgagttcacctgtggctacggcctgtgcatccccaagatcttccgctgtgacagacacaatgactgtggggactacagtgatgagcggggctgcctgtaccagacctgccagcagaaccagttcacctgccagaatggccgctgcatcagcaagacctttgtgtgtgatgaagataatgactgtggagatggcagtgatgagctgatgcacctgtgccacaccccagagcccacctgcccccctcatgagttcaagtgtgacaatggccgctgcatcgagatgatgaagctgtgcaaccacctggatgactgcctggacaacagtgatgagaagggctgcggcatcaatgaatgtcatgaccccagcatcagcggctgtgaccacaactgcacagacaccctgaccagcttctactgcagctgcaggcctggctacaagctgatgtctgacaagaggacctgtgtggacattgatgaatgtacagagatgccctttgtgtgcagccagaagtgtgaaaatgtgattggcagctacatctgcaagtgtgcccctggctacctgcgggagccagatggcaagacctgccggcagaacagcaacatcgagccctacctgatcttcagcaaccgctactacctgaggaacctgaccattgatggctacttctacagcctcatcctggagggcctggacaacgtggtggccctggactttgacagagtggagaagaggctgtactggattgacacccagaggcaggtgattgaaagaatgttcctgaacaagaccaacaaggagaccatcatcaaccaccggctgcctgctgctgagagcctggccgtggactgggtgtccaggaagctgtactggctggatgcccggctggatggcctgtttgtgtctgacctgaatggaggccacaggaggatgctggcccagcactgtgtggatgccaacaacaccttctgctttgacaacccccggggcctggccctgcacccccagtatggctacctgtactgggccgactggggccaccgggcctacatcggccgggtgggcatggatggcaccaacaagagcgtcatcatcagcaccaagctggagtggcccaacggcatcaccatcgactacaccaatgacctgctgtactgggcagatgcccacctgggctacatcgagtacagcgacctggagggccaccaccgccacacagtgtatgatggagccctgccccacccctttgccatcaccatctttgaggacaccatctactggacagactggaacaccaggacagtggagaagggcaacaagtatgatggcagcaaccggcagaccctggtgaacaccacccaccggccctttgacatccacgtgtaccacccctaccggcagcccatcgtgagcaacccctgtggcaccaacaatggaggctgcagccacctgtgcctgatcaagccaggcggcaagggcttcacctgtgagtgcccagatgacttccgcaccctgcagctgagcggcagcacctactgcatgcccatgtgcagcagcacccagttcctgtgtgccaacaatgagaagtgcatccccatctggtggaagtgtgatggccagaaggactgcagtgatggcagtgatgagctggccctgtgcccccagcgcttctgccgcctgggccagttccagtgcagtgatggcaactgcaccagcccccagaccctgtgcaatgcccaccagaactgcccagatggcagtgatgaggaccggctgctgtgtgagaaccaccactgtgacagcaatgagtggcagtgtgccaacaagcgctgcatccctgagagctggcagtgtgacaccttcaatgactgtgaggacaacagtgatgaggacagcagccactgtgccagcaggacctgcaggcctggccagttccgctgtgccaacggccgctgcatcccccaggcctggaagtgtgatgtggacaatgactgtggggaccacagtgatgagcccatcgaggagtgcatgagcagcgcccacctgtgtgacaacttcacagagttcagctgcaagaccaactaccgctgcatccccaagtgggccgtgtgcaatggagtggatgactgccgggacaacagtgatgagcagggctgtgaggagaggacctgccaccctgtgggggacttccgctgcaagaaccaccactgcatccccctgcgctggcagtgtgatggccagaatgactgtggggacaacagtgatgaggagaactgtgccccccgggagtgcacagagagcgagttccgctgtgtgaaccagcagtgcatccccagccgctggatctgtgaccactacaatgactgtggggacaacagtgatgagcgggactgtgagatgaggacctgccaccctgagtacttccagtgcaccagcggccactgtgtgcacagcgagctgaagtgtgatggcagcgctgactgcctggatgccagtgatgaggccgactgccccacccgcttcccagatggagcctactgccaggccaccatgtttgagtgcaagaaccacgtgtgcatccccccctactggaagtgtgatggagatgatgactgtggagatggcagtgatgaggagctgcacctgtgcctggatgtgccctgcaacagccccaaccgcttccgctgtgacaacaaccgctgcatctacagccatgaggtgtgcaatggagtggatgactgtggagatggaacagatgaaacagaggagcactgcaggaagcccacccccaagccctgcacagaatatgagtacaagtgtggaaatggccactgcatcccccatgacaacgtgtgtgatgatgctgatgactgtggggactggagcgatgagctgggctgcaacaagggcaaggagaggacctgtgccgagaacatctgtgagcagaactgcacccagctgaatgaaggaggcttcatctgcagctgcacagctggctttgagaccaacgtgtttgacaggaccagctgcctggacatcaatgaatgtgagcagtttggcacctgcccccagcactgcaggaacaccaagggcagctatgaatgtgtgtgtgctgatggcttcacctccatgtctgacaggcctgggaagagatgtgccgctgagggcagcagccccctgctgctgctgcctgacaacgtgcgcatcaggaagtacaacctgagcagcgagcgcttcagcgagtacctgcaggatgaggagtacatccaggccgtggactatgactgggaccccaaggacatcggcctgtctgtggtgtactacacagtgcggggggagggcagcagatttggagccatcaagagggcctacatccccaactttgaaagtggaagaaacaacctggtgcaggaggtggacctgaagctgaagtatgtgatgcagccagatggcattgctgtggactgggtgggccgccacatctactggagcgatgtgaagaacaagagaattgaggtggccaagctggatggccgctacaggaagtggctgatcagcacagacctggaccagcctgctgccatcgctgtgaaccccaagctgggcctgatgttctggacagactggggcaaggagcccaagattgagagcgcctggatgaatggagaggacaggaacatcctggtgtttgaggacctgggctggcccaccggcctgagcattgactacctgaacaatgaccgcatctactggagcgacttcaaggaggatgtgattgagaccatcaagtatgatggaacagaccggcgggtgattgccaaggaggccatgaacccctacagcctggacatctttgaggaccagctgtactggatcagcaaggagaagggggaggtgtggaagcagaacaagtttggccagggcaagaaggagaagaccctggtggtgaacccctggctgacccaggtgcgcatcttccaccagctgcgctacaacaagtctgtgcccaacctgtgcaagcagatctgcagccacctgtgcctgctgcggcctgggggctacagctgtgcctgcccccagggcagcagcttcatcgagggcagcaccacagaatgtgatgctgccatcgagctgcccatcaacctgcccccaccctgccgctgcatgcatggaggcaactgctactttgatgaaacagacctgcccaagtgcaagtgccccagcggctacaccgggaagtactgtgagatggccttcagcaagggcatcagccctggcaccacagctgtggccgtgctgctgaccatcctgctgattgtggtgattggagccctggccatcgccggcttcttccactacagaagaacaggcagcctgctgcctgccctgcccaagctgcccagcctgagcagcctggtgaagcccagtgaaaatggaaatggagtgaccttccgctctggagctgacctgaacatggacattggagtgtctggcttcggccctgagacagccatcgaccgctccatggccatgtctgaggactttgtgatggagatgggcaagcagcccatcatctttgagaaccccatgtacagcgcccgggacagcgctgtgaaggtggtgcagcccatccaggtgacagtgtctgaaaatgtggacaacaagaactacggcagccccatcaaccccagcgagatcgtgcctgagaccaaccccaccagccctgctgctgatggcacccaggtgaccaagtggaacctcttcaagaggaagagcaagcagaccaccaactttgagaaccccatctatgcccagatggagaatgagcagaaggagagcgtggccgccaccccaccacccagccccagcctgcctgccaagcccaagccacccagccggcgggaccccacccccacctacagcgccacagaggacaccttcaaggacacagccaacctggtgaaggaggacagcgaggtgtag

SEQ ID NO: 158112 - DNA, 3678 bp, Artificial Sequence
  Description of Artificial Sequence: Synthetic coding sequence
atggaccggggccctgctgctgtggcctgcaccctgctgctggccctggtggcctgcctggccccagccagcggccaggagtgtgacagcgcccacttccgctgtggcagcggccactgcatcccagctgactggaggtgtgatggcaccaaggactgcagtgatgatgctgatgagatcggctgtgctgtggtgacctgccagcagggctacttcaagtgccagagcgagggccagtgcatccccaacagctgggtgtgtgaccaggaccaggactgtgatgatggcagtgatgagcggcaggactgcagccagagcacctgcagcagccaccagatcacctgcagcaatggccagtgcatccccagcgagtaccgctgtgaccacgtgcgggactgcccagatggagcagatgaaaatgactgccagtaccccacctgtgagcagctgacctgtgacaacggggcctgctacaacaccagccagaagtgtgactggaaggtggactgccgggacagcagtgatgagatcaactgcacagagatctgcctgcacaatgagttcagctgtggaaatggagagtgcatcccccgggcctacgtgtgtgaccatgacaatgactgccaggacggcagtgatgaacatgcctgcaactaccccacctgtggcggctaccagttcacctgccccagcggccgctgcatctaccagaactgggtgtgtgatggagaagatgactgcaaggacaatggagatgaagatggctgtgagagcggcccccatgatgtgcacaagtgcagcccccgggagtggagctgcccagagagcggccgctgcatcagcatctacaaggtgtgtgatggcatcctggactgccccggccgggaggatgagaacaacaccagcacaggcaagtactgcagcatgaccctgtgcagcgccctgaactgccagtaccagtgccacgagaccccctacggcggggcctgcttctgccccccaggctacatcatcaaccacaatgacagcaggacctgtgtggagtttgatgactgccagatctggggcatctgtgaccagaagtgtgagagccggcccggccgccacctgtgccactgtgaggagggctacatcctggagcggggccagtactgcaaggccaatgacagctttggagaggccagcatcatcttcagcaatggccgggacctgctgattggagacatccacggccgctccttccgcatcctggtggagagccagaacagaggagtggccgtgggcgtggccttccactaccacctgcagagggtcttctggacagacacagtgcagaacaaggtgttttctgtggacatcaatggcctgaacatccaggaggtgctgaatgtgtctgtggagaccccagagaacctggccgtggactgggtgaacaacaagatctacctggtggagaccaaggtgaacagaattgacatggtgaacctggatggcagctacagagtgaccctcatcacagagaacctgggccacccccggggcattgctgtggaccccaccgtgggcaagacagtggtgcatggaggcagcctcatcccccaccccttcggcgtgtccctgtttgagggccaggtgttcttcacagactggaccaagatggctgtgctgaaggccaacaagttcacagagaccaacccccaggtgtactaccaggccagcctgcggccctatggagtgacagtgtaccacagcctgcggcagccctatgccaccaacccctgcaaggacaacaacggcggctgtgagcaggtgtgtgtgctgagccacaggacagacaatgatggcctgggcttccgctgcaagtgcaccttcggcttccagctggacacagatgagcggcactgcatcggccgggagatcctggccgccaacagagtggagaatgtggagagcctggcctttgactggatcagcaagaacctgtactggacagacagccactacaagagcatctctgtgatgaggctggccgacaagaccaggagaacagtggtgcagtacctgaacaaccccaggtctgtggtggtgcacccctttgctggctacctgttcttcacagactggttccggcctgccaagatcatgagggcctggagcgatggcagccacctgctgcccgtcatcaacaccaccctgggctggcccaacggcctggccatcgactgggccgccagccggctgtactgggtggatgcctactttgacaagattgagcacagcacctttgatggcctggacagaagaaggctgggccacatcgagcagatgacccaccccttcggcctggccatctttggagagcacctgttcttcacagactggaggctgggcgccatcatccgggtgaggaaggcagatggaggagagatgaccgtcatccgctctggaattgcctacatcctgcacctgaagagctatgatgtgaacatccagacaggcagcaatgcctgcaaccagcccacccaccccaacggggactgcagccacttctgcttccctgtgcccaacttccagagggtgtgtggctgcccctacggcatgaggctggccagcaaccacctgacctgtgagggggaccccaccaatgagcccccaacagagcagtgtggcctcttctccttcccctgcaagaatggccgctgtgtgcccaactactacctgtgtgatggagtggatgactgccacgacaacagtgatgagcagctgtgtggcaccctgaacaacacctgcagcagcagcgccttcacctgtggccatggagagtgcatcccagcccactggaggtgtgacaagagaaatgactgtgtggatggcagtgatgagcacaactgccccacccacgccccagccagctgcctggacacccagtacacctgtgacaaccaccagtgcatcagcaagaactgggtgtgtgacacagacaatgactgtggagatggcagtgatgagaagaactgcaacagcacagagacctgccagcccagccagttcaactgccccaaccaccgctgcatcgacctgagctttgtgtgtgatggagacaaggactgtgtggatggcagtgatgaggtgggctgtgtgctgaactgcacagccagccagttcaagtgtgccagcggggacaagtgcatcggcgtgaccaacagatgtgatggagtgtttgactgcagcgacaacagtgatgaagctggctgccccaccaggcctcctggcatgtgccacagtgatgagttccagtgccaggaggatggcatctgcatccccaacttctgggagtgtgatggccacccagactgcctgtatggcagtgatgagcacaatgcctgtgtgcccaagacctgccccagcagctacttccactgtgacaatggaaactgcatccaccgggcctggctgtgtgaccgggacaatgactgtggggacatgtctgatgagaaggactgccccacccagcccttccgctgccccagctggcagtggcagtgcctgggccacaacatctgtgtgaacctgtctgtggtgtgtgatggcatctttgactgccccaatggaacagatgagagccccctgtgcagcaagttcccagaccacagcctgctggccatcaacagcttctag

SEQ ID NO: 158113 - DNA, 1941 bp, Artificial Sequence
  Description of Artificial Sequence: Synthetic coding sequence
atgctggcccagcactgtgtggatgccaacaacaccttctgctttgacaacccccggggcctggccctgcacccccagtatggctacctgtactgggccgactggggccaccgggcctacatcggccgggtgggcatggatggcaccaacaagagcgtcatcatcagcaccaagctggagtggcccaacggcatcaccatcgactacaccaatgacctgctgtactgggcagatgcccacctgggctacatcgagtacagcgacctggagggccaccaccgccacacagtgtatgatggagccctgccccacccctttgccatcaccatctttgaggacaccatctactggacagactggaacaccaggacagtggagaagggcaacaagtatgatggcagcaaccggcagaccctggtgaacaccacccaccggccctttgacatccacgtgtaccacccctaccggcagcccatcgtgagcaacccctgtggcaccaacaacggcggctgcagccacctgtgcctgatcaagccaggcggcaagggcttcacctgtgaatgtccagatgacttccgcaccctgcagctgagcggcagcacctactgcatgcccatgtgcagcagcacccagttcctgtgtgccaacaatgagaagtgcatccccatctggtggaagtgtgatggccagaaggactgcagtgatggcagtgatgagctggccctgtgcccccagcgcttctgccgcctgggccagttccagtgcagtgatggcaactgcaccagcccccagaccctgtgcaatgcccaccagaactgcccagatggcagtgatgaagatcggctgctgtgtgagaaccaccactgtgacagcaatgagtggcagtgtgccaacaagcgctgcatccctgagagctggcagtgtgacaccttcaatgactgtgaggacaacagtgatgaggacagcagccactgtgccagcaggacctgccggcccggccagttccgctgtgccaacggccgctgcatcccccaggcctggaagtgtgatgtggacaatgactgtggggaccacagtgatgagcccatcgaggagtgcatgagcagcgcccacctgtgtgacaacttcacagagttcagctgcaagaccaactaccgctgcatccccaagtgggccgtgtgcaatggagtggatgactgccgggacaacagtgatgagcagggctgtgaggagaggacctgccaccctgtgggggacttccgctgcaagaaccaccactgcatccccctgcgctggcagtgtgatggccagaatgactgtggggacaacagtgatgaggagaactgtgcccccagagaatgtacagaaagtgagttccgctgtgtgaaccagcagtgcatccccagccgctggatctgtgaccactacaatgactgtggggacaacagtgatgagcgggactgtggcatgaggctgatgaagctgattgtgccccacgccttcctgatggtgcacacagcccggctgctgtgcagcaatgccaagaccatgtttgtgagccgccacatcggaaatgtgatggccatgatgacagtggccatggtgcagatgaagaacttcacctgtgcctggatgtttcctgtgatccaccagacagtgtctggagtgaccaccatcgccgccttcatcgtgatgagatgtgccatggtgtggatgacagtggagatggagctgatgaggcagaggagcacagtggagaaccggcccctgaacctggtgcagaacatgaacatctctgtggccatgggcatcgccttccacatgaccatgtgtgtgatgatgcccatgacagtggtgacaggccccatgaactgggtggccatcaaggagaagaaggagcacgtgctgaagatctatgccagcaagatcgtgcccaactag

SEQ ID NO: 158114 - DNA, 2313 bp, Artificial Sequence
  Description of Artificial Sequence: Synthetic coding sequence
atggagaagagagctgctgctggcctggagggcgcccctggggcccgggcccagctggccgtggtgtgcctggtgaacatcttcctgaccggccgcctgagcagcgctgtgcctgccctggccgcctgcagcggcaagctggagcagcacacagaaagaagaggagtcatctacagccctgcctggcccctgaactacccacctggcaccaactgctcctggtacatccagggcgacagaggagacatgatcaccatctccttcaggaactttgatgtggaggagagccaccagtgcagcctggactggctgctgctgggccctgctgccccaccccggcaggaggccttccggctgtgtggcagcgccatccccccagccttcatcagcgcccgggaccacgtgtggatcttcttccacagtgatgccagcagcagcggccaggcccagggcttccggctgagctacatccggggcaagctgggccaggccagctgccaggctgatgagttccgctgtgacaatggcaagtgcctgcccggcccctggcagtgcaacacagtggatgaatgtggagatggcagtgatgagggcaactgcagcgccccagccagcgagcccccaggcagcctgtgccctgggggcaccttcccctgcagcggggcccggagcacccgctgcctgcctgtggagcggcgctgtgatggcctgcaggactgtggagatggcagtgatgaagctggctgcccagacctggcctgtggccggcggctgggcagcttctacggcagctttgccagcccagacctgtttggagctgcccggggccccagcgacctgcactgcacctggctggtggacacccaggacagccggcgggtgctgctgcagctggagctgcggctgggctatgatgattatgtgcaggtgtatgagggcctgggggagcggggggaccggctgctgcagaccctgagctaccgcagcaaccacaggcctgtgtccctggaggccgcccagggccgcctgactgtggcctaccacgcccgggcccggtctgctggccacggcttcaatgccacctaccaggtgaagggctactgcctgccctgggagcagccctgtggcagcagcagtgacagtgatggcggcagcctgggggaccagggctgcttcagcgagccccagagatgtgatggctggtggcactgtgccagcggcagagatgagcagggctgcccagcctgccccccagaccagtacccctgtgagggcggcagcggcctgtgctacaccccagctgaccgctgcaacaaccagaagagctgcccagatggagcagatgagaagaactgcttcagctgccagcccggcaccttccactgcggcaccaacctgtgcatctttgagacctggaggtgtgatggccaggaggactgccaggacggcagtgatgaacatggctgcctggccgctgtgcccaggaaggtgatcacagctgccctgattggcagcctggtgtgtggcctgctgctggtgattgccctgggctgtgccttcaagctgtacagcctgcggacccaggagtaccgggcctttgagacccagatgacccggctggaggccgagtttgtgcggcgggaggccccacccagctatggccagctgattgcccagggcctcatcccccctgtggaggacttccctgtgtacagcgccagccaggcctctgtgctgcagaacctgaggacagccatgaggcggcagatgagaagacatgccagccggcggggccccagcagaagaaggctgggccgcctgtggaacagactcttccaccggccccgggccccccggggccagatccccctgctgacagctgcccggcccagccagacagtgctgggagatggcttcctgcagcctgcccctggggccgccccagaccccccagcccccctgatggacaccggcagcaccagggctgctggggacaggcctccttctgcccctggccgggcccctgaggtgggccccagcggcccccccctgcccagcggcctgcgggaccctgagtgcaggcctgtggacaaggacaggaaggtgtgccgggagcccctggtggatggccctgccccagcagatgccccccgggagccctgcagcgcccaggacccccacccccaggtgtccacagccagcagcaccctgggcccccacagccctgagcccctgggcgtgtgcagaaatcctcctccaccctgcagccccatgctggaggccagtgatgatgaggccctgctggtgtgctag

SEQ ID NO: 158115 - DNA, 858 bp, Artificial Sequence
  Description of Artificial Sequence: Synthetic coding sequence
atgggcaaccacctgcctgccttcggcccccggcccccaggaagaagagaggccctgctgagcccagactgccccctgctgcggctgcaccccaccgggaagctgggccaggccagctgccaggctgatgagttccgctgtgacaatggcaagtgcctgcccggcccctggcagtgcaacacagtggatgaatgtggagatggcagtgatgagggcaactgcagcgccccagccagcgagcccccaggcagcctgtgccctgggggcaccttcccctgcagcggggcccggagcacccgctgcctgcctgtggagcggcgctgtgatggcctgcaggactgtggagatggcagtgatgaagctggctgcccagacctggcctgtggccggcggctgggcagcttctacggcagctttgccagcccagacctgtttggagctgcccggggccccagcgacctgcactgcacctggctggtggacacccaggacagccggcgggtgctgctgcagctggagctgcggctgggctatgatgattatgtgcaggtgtatgagggcctgggggagcggggggaccggctgctgcagaccctgagctaccgcagcaaccacaggcctgtgtccctggaggccgcccagggccgcctgactgtggcctaccacgcccgggcccggtctgctggccacggcttcaatgccacctaccaggtgaagggctactgcctgccctgggagcagccctgtggcagcagcagtgacagtgatggcggcagcctgggggaccagggctgcttcagcgagccccagagatgtgatggctggtggcactgtgccagcggcagagatgagcagtag

SEQ ID NO: 158116 - DNA, 5718 bp, Artificial Sequence
  Description of Artificial Sequence: Synthetic coding sequence
atgaggcggcagtggggcgccctgctgctgggcgccctgctgtgtgcccacggcctggccagcagcccagaatgtgcctgtggccgcagccacttcacctgtgctgtgtctgccctgggagaatgtacctgcatcccagcccagtggcagtgtgatggagacaatgactgtggggaccacagtgatgaagatggctgcatcctgcccacctgcagccccctggacttccactgtgacaacgggaagtgcatcagaagatcctgggtgtgtgatggagacaatgactgtgaagatgacagtgatgagcaggactgccccccaagagaatgtgaggaggatgagttcccctgccagaatggctactgcatccgcagcctgtggcactgtgatggagacaatgactgtggggacaacagtgatgagcagtgtgacatgaggaaatgtagtgacaaggagttccgctgcagtgatggcagctgcatcgccgagcactggtactgtgatggagacacagactgcaaggatggcagtgatgaggagaactgccccagcgctgtgcctgccccaccctgcaacctggaggagttccagtgtgcctacggccgctgcatcctggacatctaccactgtgatggagatgatgactgtggggactggagcgatgaaagtgactgcagcagccaccagccctgccgctctggagagttcatgtgtgacagcggcctgtgcatcaatgccggctggaggtgtgatggagatgctgactgtgatgaccagagtgatgaaagaaactgcaccacctccatgtgcacagctgagcagttccgctgccacagcggccgctgtgtgcggctgtcctggaggtgtgatggagaagatgactgtgccgacaacagtgatgaggagaactgtgaaaatacaggcagcccccagtgtgccctggaccagttcctgtgctggaatggccgctgcatcggccagaggaagctgtgcaatggagtgaatgactgtggggacaacagtgatgagagcccccagcagaactgccggcccaggactggagaggagaactgcaatgtgaacaacggcggctgtgcccagaagtgccagatggtgagaggagctgtgcagtgcacctgccacacaggctaccgcctgacagaagatggccacacctgccaggatgtgaatgaatgtgccgaggagggctactgcagccagggctgcaccaacagcgagggcgccttccagtgctggtgtgagaccggctatgagctgcggccagaccggcgcagctgcaaggccctgggccctgagcctgtgctgctgtttgccaacagaattgacatccggcaggtgctgccccacaggtctgagtacaccctgctgctgaacaacctggagaatgccatcgccctggacttccaccaccggcgggagctggtgttctggagcgatgtgaccctggaccgcatcctgcgggccaacctgaatggcagcaatgtggaggaggtggtgtccacaggcctggagagccctgggggcctggccgtggactgggtgcatgacaagctgtactggacagacagcggcaccagcagaattgaggtggccaacctggatggagcccacaggaaggtgctgctgtggcagaacctggagaagccccgggccatcgccctgcaccccatggagggcaccatctactggacagactggggcaacaccccaagaattgaggccagctccatggatggcagcggccgccgcatcatcgctgacacccacctgttctggcccaacggcctgaccattgattatgccggccgcaggatgtactgggtggatgccaagcaccacgtgattgaaagagccaacctggatggcagccacaggaaggccgtcatcagccagggcctgccccacccctttgccatcaccgtgtttgaggacagcctgtactggacagactggcacaccaagagcatcaacagcgccaacaagttcaccgggaagaaccaggagatcatccggaacaagctgcacttccccatggacatccacaccctgcacccccagaggcagcctgctgggaagaacagatgtggggacaacaacggcggctgcacccacctgtgcctgcccagcggccagaactacacctgtgcctgccccaccggcttcaggaagatcagcagccacgcctgtgcccagagcctggacaagttcctgctgtttgcccggaggatggacatccgccgcatcagctttgacacagaggacctgagtgatgatgtgatccccctggctgatgtgcgctctgctgtggccctggactgggacagcagagatgaccacgtgtactggacagatgtgtccacagacaccatcagccgggccaagtgggatggcaccggccaggaggtggtggtggacaccagcctggagagccctgctggcctggccatcgactgggtgaccaacaagctgtactggacagatgctggaacagaccgcatcgaggtggccaacacagatggctccatgaggacagtgctgatctgggagaacctggaccggccccgggacatcgtggtggagcccatgggcggctacatgtactggacagactggggcgccagccccaagattgaaagagctggcatggatgccagcggccggcaggtgatcatcagcagcaacctgacctggcccaacggcctggccatcgactatggcagccagaggctgtactgggcagatgctggcatgaagaccattgaatttgctggcctggatggcagcaagaggaaggtgctgattggcagccagctgccccaccccttcggcctgaccctgtatggagagcgcatctactggacagactggcagaccaagagcatccagagcgctgaccggctgaccggcctggaccgggagaccctgcaggagaacctggagaacctgatggacatccacgtgttccacagaagaagacctcctgtgtccaccccctgtgccatggagaatggaggctgcagccacctgtgcctgcggagccccaaccccagcggcttcagctgcacctgccccaccggcatcaacctgctgagtgatggcaagacctgcagccctggcatgaacagcttcctgatctttgccaggagaattgacatccgcatggtgtccctggacatcccctactttgctgatgtggtggtgcccatcaacatcaccatgaagaacaccatcgccatcggcgtggacccccaggagggcaaggtgtactggagcgacagcaccctgcaccgcatcagccgggccaacctggatggcagccagcacgaggacatcatcaccaccggcctgcagaccacagatggcctggccgtggatgccatcggcaggaaggtgtactggacagacaccggcaccaaccgcatcgaggtgggcaacctggatggctccatgaggaaggtgctggtgtggcagaacctggacagcccccgggccatcgtgctgtaccacgagatgggcttcatgtactggacagactggggagaaaatgccaagctggagaggagcggcatggatggcagtgacagagctgtgctgatcaacaacaacctgggctggcccaacggcctgactgtggacaaggccagcagccagctgctgtgggcagatgcccacacagaaagaattgaagctgctgacctgaatggagccaacagacacaccctggtgtcccctgtgcagcacccctacggcctgaccctgctggacagctacatctactggacagactggcagaccaggagcatccacagagctgacaagggcaccggcagcaatgtcatcctggtgcgcagcaacctgcccggcctgatggacatgcaggccgtggaccgggcccagcccctgggcttcaacaagtgtggcagcagaaatggaggctgcagccacctgtgcctgccccggcccagcggcttcagctgtgcctgccccaccggcatccagctgaagggagatggcaagacctgtgaccccagccctgagacctacctgctcttcagcagccggggcagcatccgccgcatcagcctggacaccagtgaccacacagatgtgcacgtgcctgtgcctgagctgaacaacgtcatcagcctggactatgacagcgtggatggcaaggtgtactacacagatgtgttcctggatgtgatccggcgggctgacctgaatggcagcaacatggagaccgtgattggccggggcctgaagaccacagatggcctggccgtggactgggtggccaggaacctgtactggacagacacaggaagaaacaccatcgaggccagccggctggatggcagctgcaggaaggtgctgatcaacaacagcctggatgagccccgggccatcgctgtgttccccaggaagggctacctgttctggacagactggggccacatcgccaagattgaaagagccaacctggatggcagcgagaggaaggtgctgatcaacacagacctgggctggcccaacggcctgaccctggactatgacacccggcgcatctactgggtggatgcccacctggacagaattgaatctgctgacctgaatggcaagctgcggcaggtgctggtgagccacgtgagccacccctttgccctgacccagcaggaccgctggatctactggacagactggcagaccaagagcatccagagggtggacaagtacagcggcaggaacaaggagaccgtgctggccaacgtggagggcctgatggacatcatcgtggtgagcccccagaggcagacaggcaccaatgcctgtggggtgaacaatggaggctgcacccacctgtgctttgcccgggccagtgactttgtgtgtgcctgcccagatgagccagacagccggccctgcagcctggtgcccggcctggtgcccccagccccccgggccaccggcatgtctgagaagagccctgtgctgcccaacaccccacccaccaccctgtacagcagcaccaccaggaccaggaccagcctggaggaggtggagggccgctgcagcgagagagatgcccggctgggcctgtgtgcccggagcaatgatgctgtgcctgctgcccctggagagggcctgcacatctcctatgccatcggcggcctgctgagcatcctgctgatcctggtggtgattgctgccctgatgctgtaccgccacaagaagagcaagttcacagatcctggcatgggcaacctgacctacagcaaccccagctaccgcaccagcacccaggaggtgaagattgaggccatccccaagccagccatgtacaaccagctgtgctacaagaaggagggcggccctgaccacaactacaccaaggagaagatcaagatcgtggagggcatctgcctgctgtctggagatgatgctgagtgggatgacctgaagcagctgcggagcagccggggcggcctgctgcgggaccacgtgtgcatgaagacagacacagtgtccatccaggccagcagcggcagcctggatgacacagaaacagagcagctgctgcaggaggagcagagcgagtgcagctctgtgcacacagctgccaccccagagcggcggggcagcctgcctgacaccggctggaagcatgagaggaagctgagcagcgagagccaggtgtag

SEQ ID NO: 158117 - DNA, 4848 bp, Artificial Sequence
  Description of Artificial Sequence: Synthetic coding sequence
atggaggccgcccctcctggccccccctggcccctgctgctgctgctgctgctgctgctggccctgtgtggctgcccagccccagctgctgccagccccctgctgctgtttgccaacagaagagatgtgcggctggtggatgctgggggcgtgaagctggagagcaccatcgtggtgtctggcctggaggatgctgctgctgtggacttccagttcagcaaaggagctgtgtactggacagatgtgtctgaggaggccatcaagcagacctacctgaaccagacaggagctgctgtgcagaatgtggtgatcagcggcctggtgtccccagatggcctggcctgtgactgggtgggcaagaagctgtactggacagattctgagaccaaccgcatcgaggtggccaacctgaatggcaccagcaggaaggtgctcttctggcaggacctggaccagccccgggccatcgccctggaccctgcccacggctacatgtactggacagactggggcgagaccccccgcatcgagagagctggcatggatggcagcaccaggaagatcatcgtggacagcgacatctactggcccaacggcctgaccatcgacctggaggagcagaagctgtactgggcagatgccaagctgtccttcatccaccgggccaacctggatggcagcttccggcagaaggtggtggagggcagcctgacccacccctttgccctgaccctgagcggggacaccctgtactggacagactggcagaccaggagcatccacgcctgcaacaagaggactggaggcaagaggaaggagatcctgagcgccctgtacagccccatggacatccaggtgctgagccaggagcggcagcccttcttccacacccgctgtgaagaagataatggaggctgcagccacctgtgcctgctgagccccagcgagcccttctacacctgtgcctgccccactggagtgcagctgcaggacaatggccgcacctgcaaggccggggctgaggaggtgctgctgctggcccggaggacagacctgcggcgcatcagcctggacaccccagacttcacagacatcgtgctgcaggtggatgacatcagacatgccatcgccatcgactatgaccccctggagggctacgtgtactggacagatgatgaggtgcgggccatccggcgggcctacctggatggcagcggggcccagaccctggtgaacacagagatcaatgaccctgatggcattgctgtggactgggtggccaggaacctgtactggacagacacaggaacagaccgcatcgaggtgacccggctgaatggcaccagcaggaagatcctggtgtctgaggacctggatgagccccgggccatcgccctgcaccctgtgatgggcctgatgtactggacagactggggcgagaaccccaagattgaatgtgccaacctggatggccaggagcggcgggtgctggtgaatgccagcctgggctggcccaacggcctggccctggacctgcaggagggcaagctgtactggggagatgccaagacagacaagattgaagtcatcaacgtggatggcaccaagaggaggaccctgctggaggacaagctgccccacatcttcggcttcaccctgctgggggacttcatctactggacagactggcagaggaggagcattgaaagagtgcacaaggtgaaggccagcagagatgtgatcatcgaccagctgcctgacctgatgggcctgaaggctgtgaatgtggccaaggtggtgggcaccaacccctgtgccgacagaaatggaggctgcagccacctgtgcttcttcacccctcatgccacccgctgtggctgccccatcggcctggagctgctgagtgacatgaagacctgcatcgtgcctgaggccttcctggtgttcaccagcagagctgccatccaccgcatcagcctggagaccaacaacaatgatgtggccatccccctgactggagtgaaggaggccagcgccctggactttgatgtgagcaacaaccacatctactggacagatgtgtccctgaagaccatcagccgggccttcatgaatggcagctctgtggagcacgtggtggagtttggcctggactacccagagggcatggctgtggactggatgggcaagaacctgtactgggccgacaccggcaccaaccgcatcgaggtggcccggctggatggccagttccggcaggtgctggtgtggagggacctggacaaccccaggagcctggccctggaccccaccaagggctacatctactggacagagtggggcggcaagccccgcatcgtgcgggccttcatggatggcaccaactgcatgaccctggtggacaaggtgggccgggccaatgacctgaccattgattatgctgaccagaggctgtactggacagacctggacaccaacatgattgagagcagcaacatgctgggccaggagcgggtggtgattgctgatgacctgccccaccccttcggcctgacccagtacagcgactacatctactggacagactggaacctgcacagcattgaaagagctgacaagaccagcggcaggaacagaaccctcatccagggccacctggactttgtgatggacatcctggtgttccacagcagccggcaggacggcctgaatgactgcatgcacaacaacggccagtgtggccagctgtgcctggccatccctgggggccaccgctgtggctgtgccagccactacaccctggaccccagcagcaggaactgcagcccccccaccaccttcctgctcttcagccagaagagcgccatcagcaggatgatcccagatgaccagcacagcccagacctgatcctgcccctgcacggcctgagaaatgtgaaggccatcgactatgaccccctggacaagttcatctactgggtggatggccggcagaacatcaagagggccaaggatgatggcacccagccctttgtgctgaccagcctgagccagggccagaacccagaccggcagccccatgacctgagcattgacatctacagcaggaccctcttctggacctgtgaggccaccaacaccatcaacgtgcaccggctgagcggggaggccatgggcgtggtgctgcggggggaccgggacaagccccgggccatcgtggtgaatgctgagcggggctacctgtacttcaccaacatgcaggaccgggccgccaagattgagcgggccgccctggatggaacagagcgggaggtgctcttcaccaccggcctcatccggcctgtggccctggtggtggacaacaccctgggcaagctgttctgggtggatgctgacctgaagagaattgagagctgtgacctgagcggggccaaccggctgaccctggaggatgccaacatcgtgcagcccctgggcctgaccatcctgggcaagcacctgtactggattgaccggcagcagcagatgattgagcgggtggagaagaccaccggggacaagaggacccgcatccagggccgggtggcccacctgaccggcatccatgctgtggaggaggtgtccctggaggagttcagcgcccacccctgtgcccgggacaatggaggctgcagccacatctgcatcgccaagggagatggcaccccccgctgcagctgccctgtgcacctggtgctgctgcagaacctgctgacctgtggggagccccccacctgcagcccagaccagtttgcctgtgccaccggggagattgactgcatccctggggcctggaggtgtgatggcttcccagaatgtgatgaccagagtgatgaggagggctgccctgtgtgcagcgctgcccagttcccctgtgcccggggccagtgtgtggacctgcggctgcgctgtgatggagaggccgactgccaggacagaagtgatgaggccgactgtgatgccatctgcctgcccaaccagttccgctgtgccagcggccagtgtgtgctgatcaagcagcagtgtgacagcttcccagactgcattgatggcagtgatgagctgatgtgtgagatcaccaagcccccatctgatgacagccctgcccacagcagcgccatcggccctgtgattggcatcatcctgagcctgtttgtgatgggcggcgtgtactttgtgtgccagagggtggtgtgccagagatatgctggggccaacggccccttcccccatgaatatgtgtctggcaccccccacgtgcccctgaacttcatcgcccctgggggcagccagcacggccccttcaccggcatcgcctgtgggaagtccatgatgagctctgtgtccctgatgggcggccggggcggcgtgcccctgtatgacagaaatcatgtgactggagccagcagcagcagcagcagcagcaccaaggccaccctgtacccacccatcctgaaccccccacccagccctgccacagaccccagcctgtacaacatggacatgttctacagcagcaacatcccagccacagcccggccctaccggccctacatcatccggggcatggccccacccaccaccccctgcagcacagatgtgtgtgacagcgactacagcgccagccgctggaaggccagcaagtactacctggacctgaacagcgacagcgacccctacccacctccacccaccccccacagccagtacctgtctgctgaggacagctgcccccccagccctgccacagagaggagctacttccacctgtttcctcctccacccagcccctgcacagacagcagctag

SEQ ID NO: 158118 - DNA, 4842 bp, Artificial Sequence
  Description of Artificial Sequence: Synthetic coding sequence
atgggcgctgtgctgcggagcctgctggcctgcagcttctgtgtgctgctgcgggccgcccccctgctgctgtatgccaacagaagagacctgcggctggtggatgccaccaacgggaaggaaaatgccaccatcgtggtgggcggcctggaggatgctgctgctgtggactttgtgttcagccacggcctcatctactggagcgatgtgtctgaggaggccatcaagaggacagagttcaacaagacagaatctgtgcagaatgtggtggtgtctggcctgctgagcccagatggcctggcctgtgactggctgggggagaagctgtactggacagacagcgagaccaacagaattgaggtgagcaacctggatggcagcctgaggaaggtgctcttctggcaggagctggaccagccccgggccatcgccctggaccccagcagcggcttcatgtactggacagactggggcgaggtgcccaagattgagcgggccggcatggatggcagcagccgcttcatcatcatcaacagcgagatctactggcccaacggcctgaccctggactatgaggagcagaagctgtactgggcagatgccaagctgaacttcatccacaagagcaacctggatggcaccaaccggcaggccgtggtgaagggcagcctgccccacccctttgccctgaccctgtttgaggacatcctgtactggacagactggagcacccacagcatcctggcctgcaacaagtacaccggggagggcctgcgggagatccacagcgacatcttcagccccatggacatccacgccttcagccagcagaggcagcccaatgccaccaacccctgtggcatcgacaatggaggctgcagccacctgtgcctgatgagccctgtgaagcccttctaccagtgtgcctgccccaccggggtgaagctgctggagaatggcaagacctgcaaggatggagccacagagctgctgctgctggccaggagaacagacctgcggcgcatcagcctggacaccccagacttcacagacatcgtgctgcagctggaggacatcagacatgccatcgccattgattatgaccctgtggagggctacatctactggacagatgatgaggtgcgggccatcagaagaagcttcattgatggcagcggcagccagtttgtggtgacagcccagatcgcccacccagatggcattgctgtggactgggtggccaggaacctgtactggacagacaccggcacagacagaattgaggtgacccggctgaatggcaccatgaggaagatcctgatcagcgaggacctggaggagccccgggccatcgtgctggaccccatggtgggctacatgtactggacagactggggcgagatccccaagattgagcgggccgccctggatggcagtgacagagtggtgctggtgaacaccagcctgggctggcccaacggcctggccctggactatgatgagggcaagatctactggggagatgccaagacagacaagattgaggtgatgaacacagatggcaccggccggcgggtgctggtggaggacaagatcccccacatcttcggcttcaccctgctgggggactatgtgtactggacagactggcagaggaggagcattgagcgggtgcacaagaggtctgctgagcgggaggtgatcatcgaccagctgcctgacctgatgggcctgaaggccaccaacgtgcaccgggtgattggcagcaacccctgtgccgaggagaatggaggctgcagccacctgtgcctgtaccggccccagggcctgcgctgtgcctgccccatcggctttgagctgatcagtgacatgaagacctgcatcgtgcctgaggccttcctgctcttcagccggcgggctgacatccgccgcatcagcctggagaccaacaacaacaacgtggccatccccctgactggagtgaaggaggccagcgccctggactttgatgtgacagacaaccgcatctactggacagacatcagcctgaagaccatcagccgggccttcatgaatggcagcgccctggagcacgtggtggagtttggcctggactacccagagggcatggctgtggactggctgggcaagaacctgtactgggccgacaccggcaccaacagaattgaggtgtccaagctggatggccagcaccggcaggtgctggtgtggaaggacctggacagcccccgggccctggccctggaccctgctgagggcttcatgtactggacagagtggggcggcaagcccaagattgaccgggccgccatggatggcagcgagaggaccaccctggtgcccaacgtgggccgggccaacggcctgaccatcgactatgccaagagaagactctactggacagacctggacaccaacctgattgagagcagcaacatgctgggcctgaaccgggaggtgattgctgatgacctgccccaccccttcggcctgacccagtaccaggactacatctactggacagactggagccgccgcagcattgagcgggccaacaagaccagcggccagaacagaaccatcatccagggccacctggactatgtgatggacatcctggtgttccacagcagccggcagagcggctggaatgaatgtgccagcagcaatggccactgcagccacctgtgcctggccgtgcctgtgggcggctttgtgtgtggctgcccagcccactacagcctgaatgctgacaacagaacctgcagcgcccccaccaccttcctgctcttcagccagaagagcgccatcaacaggatggtgattgatgagcagcagagcccagacatcatcctgcccatccacagcctgagaaatgtgcgggccatcgactatgaccccctggacaagcagctgtactggattgacagccggcagaacatgatcaggaaggcccaggaggatggcagccagggcttcaccgtggtggtgtcctctgtgcccagccagaacctggagatccagccctatgacctgagcattgacatctacagccgctacatctactggacctgtgaggccaccaacgtcatcaacgtgacccggctggatggccgctctgtgggcgtggtgctgaagggggagcaggaccggcccagggctgtggtggtgaaccctgagaagggctacatgtacttcaccaacctgcaggagaggagccccaagattgagcgggccgccctggatggaacagagcgggaggtgctcttcttcagcggcctgagcaagcccatcgccctggccctggacagccggctgggcaagctgttctgggccgacagcgacctgcggcgcatcgagagcagtgacctgagcggggccaacagaattgtgctggaggacagcaacatcctgcagcctgtgggcctgactgtgtttgagaactggctgtactggattgacaagcagcagcagatgattgagaagattgacatgacaggccgggagggccgcaccaaggtgcaggccagaattgcccagctgagtgacatccatgctgtgaaggagctgaacctgcaggagtaccggcagcacccctgtgcccaggacaatggaggctgcagccacatctgcctggtgaagggagatggcaccacccgctgcagctgccccatgcacctggtgctgctgcaggatgagctgagctgtggggagccccccacctgcagcccccagcagttcacctgcttcaccggggagattgactgcatccctgtggcctggaggtgtgatggcttcacagaatgtgaggaccacagtgatgagctgaactgccctgtgtgcagcgagagccagttccagtgtgccagcggccagtgcattgatggagccctgcgctgcaatggagatgccaactgccaggacaagagtgatgagaagaactgtgaggtgctgtgcctgattgaccagttccgctgtgccaacggccagtgcatcggcaagcacaagaagtgtgaccacaacgtggactgcagcgacaagagtgatgagctggactgctaccccacagaggagcccgccccccaggccaccaacacagtgggcagcgtcatcggcgtgattgtgaccatctttgtgtctggaacagtgtacttcatctgccagaggatgctgtgccccaggatgaagggagatggagagaccatgaccaatgactatgtggtgcacggccctgcctctgtgcccctgggctacgtgccccaccccagcagcctgagcggcagcctgcccggcatgagccggggcaagtccatgatcagcagcctgagcatcatgggcggcagcagcggccccccctatgaccgggcccacgtgactggagccagcagcagcagcagcagcagcaccaagggcacctacttccctgccatcctgaaccccccacccagccctgccacagagaggagccactacaccatggagtttggctacagcagcaacagccccagcacccacaggagctacagctaccggccctacagctaccgccactttgccccacccaccaccccctgcagcacagatgtgtgtgacagcgactatgcccccagcaggaggatgacctctgtggccacagccaagggctacaccagtgacctgaactatgacagcgagcctgtgcccccaccacccacccccaggagccagtacctgtctgctgaggagaactatgagagctgcccccccagcccctacacagagaggagctacagccaccacctgtacccacctccacccagcccctgcacagacagcagctag

SEQ ID NO: 158119 - DNA, 4437 bp, Artificial Sequence
  Description of Artificial Sequence: Synthetic coding sequence
tgactggaccagccccgggccatcgccctggaccccagcagcggcttcatgtactggacagactggggcgaggtgcccaagattgaaagagctggcatggatggcagcagccgcttcatcatcatcaacagcgagatctactggcccaacggcctgaccctggactatgaggagcagaagctgtactgggcagatgccaagctgaacttcatccacaagagcaacctggatggcaccaaccggcaggccgtggtgaagggcagcctgccccacccctttgccctgaccctgtttgaggacatcctgtactggacagactggagcacccacagcatcctggcctgcaacaagtacacaggagagggcctgcgggagatccacagcgacatcttcagccccatggacatccacgccttcagccagcagaggcagcccaatgccaccaacccctgtggcatcgacaatggaggctgcagccacctgtgcctgatgagccctgtgaagcccttctaccagtgtgcctgccccactggagtgaagctgctggagaatggcaagacctgcaaggatggagccacagagctgctgctgctggcccggaggacagacctgcggcgcatcagcctggacaccccagacttcacagacatcgtgctgcagctggaggacatcagacatgccatcgccatcgactatgaccctgtggagggctacatctactggacagatgatgaggtgcgggccatccgccgctccttcattgatggcagcggcagccagtttgtggtgacagcccagatcgcccacccagatggcattgctgtggactgggtggccaggaacctgtactggacagacacaggaacagaccgcatcgaggtgacccggctgaatggcaccatgaggaagatcctgatcagcgaggacctggaggagccccgggccatcgtgctggaccccatggtgggctacatgtactggacagactggggcgagatccccaagattgaaagagctgccctggatggcagtgacagagtggtgctggtgaacaccagcctgggctggcccaacggcctggccctggactatgatgagggcaagatctactggggagatgccaagacagacaagattgaggtgatgaacacagatggcactggaagaagagtgctggtggaggacaagatcccccacatcttcggcttcaccctgctgggggactatgtgtactggacagactggcagaggaggagcattgaaagagtgcacaagaggtctgctgagcgggaggtgatcatcgaccagctgcctgacctgatgggcctgaaggccaccaacgtgcacagggtcatcggcagcaacccctgtgccgaggagaatggaggctgcagccacctgtgcctgtaccggccccagggcctgcgctgtgcctgccccatcggctttgagctgatcagtgacatgaagacctgcatcgtgcctgaggccttcctgctcttcagcagaagagctgacatccgccgcatcagcctggagaccaacaacaacaacgtggccatccccctgactggagtgaaggaggccagcgccctggactttgatgtgacagacaaccgcatctactggacagacatcagcctgaagaccatcagccgggccttcatgaatggaagtgccctggagcacgtggtggagtttggcctggactacccagagggcatggctgtggactggctgggcaagaacctgtactgggccgacaccggcaccaaccgcatcgaggtgtccaagctggatggccagcaccggcaggtgctggtgtggaaggacctggacagcccccgggccctggccctggaccctgctgagggcttcatgtactggacagagtggggcggcaagcccaagattgacagagctgccatggatggcagcgagaggaccaccctggtgcccaacgtgggccgggccaacggcctgaccattgattatgccaagaggcggctgtactggacagacctggacaccaacctgattgagagcagcaacatgctgggcctgaaccgggaggtgattgctgatgacctgccccaccccttcggcctgacccagtaccaggactacatctactggacagactggagcagaagaagcattgaaagagccaacaagaccagcggccagaacagaaccatcatccagggccacctggactatgtgatggacatcctggtgttccacagcagccggcagagcggctggaatgaatgtgccagcagcaatggccactgcagccacctgtgcctggccgtgcctgtgggcggctttgtgtgtggctgcccagcccactacagcctgaatgctgacaacagaacctgcagcgcccccaccaccttcctgctcttcagccagaagagcgccatcaacaggatggtgattgatgagcagcagagcccagacatcatcctgcccatccacagcctgagaaatgtgcgggccattgattatgaccccctggacaagcagctgtactggattgacagccggcagaacatgatcaggaaggcccaggaggatggcagccagggcttcaccgtggtggtgtcctctgtgcccagccagaacctggagatccagccctatgacctgagcattgacatctacagccgctacatctactggacctgtgaggccaccaacgtcatcaacgtgacccggctggatggccgctctgtgggcgtggtgctgaagggggagcaggaccggcccagggctgtggtggtgaaccctgagaagggctacatgtacttcaccaacctgcaggagaggagccccaagattgaaagagctgccctggatggaacagagcgggaggtgctcttcttcagcggcctgagcaagcccatcgccctggccctggacagccggctgggcaagctgttctgggccgacagcgacctgcggagaattgagagcagtgacctgagcggggccaaccgcatcgtgctggaggacagcaacatcctgcagcctgtgggcctgactgtgtttgagaactggctgtactggattgacaagcagcagcagatgattgagaagattgacatgacaggccgggagggccgcaccaaggtgcaggcccgcatcgcccagctgagtgacatccatgctgtgaaggagctgaacctgcaggagtaccggcagcacccctgtgcccaggacaatggaggctgcagccacatctgcctggtgaagggagatggcaccacccgctgcagctgccccatgcacctggtgctgctgcaggatgagctgagctgtggggagccccccacctgcagcccccagcagttcacctgcttcaccggggagattgactgcatccctgtggcctggaggtgtgatggcttcacagaatgtgaggaccacagtgatgagctgaactgccctgtgtgcagcgagagccagttccagtgtgccagcggccagtgcattgatggagccctgcgctgcaatggagatgccaactgccaggacaagagtgatgagaagaactgtgaggtgctgtgcctgattgaccagttccgctgtgccaacggccagtgcatcggcaagcacaagaagtgtgaccacaacgtggactgcagcgacaagagtgatgagctggactgctaccccacagaggagcccgccccccaggccaccaacacagtgggctctgtgattggagtcatcgtgaccatctttgtgtctggcaccgtgtacttcatctgccagaggatgctgtgccccaggatgaagggagatggagagaccatgaccaatgactatgtggtgcacggccctgcctctgtgcccctgggctacgtgccccaccccagcagcctgagcggcagcctgcccggcatgagccggggcaagtccatgatcagcagcctgagcatcatgggcggcagcagcggccccccctatgaccgggcccacgtgactggagccagcagcagcagcagcagcagcaccaagggcacctacttccctgccatcctgaaccccccacccagccctgccacagagaggagccactacaccatggagtttggctacagcagcaacagccccagcacccacaggagctacagctaccggccctacagctaccgccactttgccccacccaccaccccctgcagcacagatgtgtgtgacagcgactatgcccccagcaggaggatgacctctgtggccacagccaagggctacaccagtgacctgaactatgattctgagcctgtgcccccaccacccacccccaggagccagtacctgtctgcagaagaaaattatgagagctgcccccccagcccctacacagagaggagctacagccaccacctgtacccacctccacccagcccctgcacagacagcagctag

SEQ ID NO: 158120 - DNA, 2382 bp, Artificial Sequence
  Description of Artificial Sequence: Synthetic coding sequence
atgggcctgcctgagcccggccccctgcggctgctggccctgctgctgctgctgctgctgctgctgctgctgcagctgcagcacctggccgctgctgctgctgaccccctgctgggcggccagggccctgccaaggactgtgagaaggaccagttccagtgcagaaatgaacgctgcatccccagcgtgtggaggtgtgatgaagatgatgactgcctggaccacagtgatgaagatgactgccccaagaagacctgtgccgacagcgacttcacctgtgacaatggccactgcatccacgagcgctggaagtgtgatggagaggaggagtgcccagatggcagtgatgagagcgaggccacctgcaccaagcaggtgtgcccagctgagaagctgagctgtggccccaccagccacaagtgtgtgcctgcctcctggaggtgtgatggagagaaggactgtgagggcggcgcagatgaagctggctgtgccacctggctgaatgaatgtctgcacaacaacggcggctgcagccacatctgcacagacctgaagattggatttgaatgtacctgcccagctggcttccagctgctggaccagaagacctgtggggacattgatgagtgcaaggaccctgatgcctgcagccagatctgtgtgaactacaagggctacttcaagtgtgagtgctacccaggctatgagatggacctgctgaccaagaactgcaaggctgctgctgggaagagccccagcctcatcttcaccaacagacatgaggtgagaagaattgacctggtgaagaggaactacagccgcctcatccccatgctgaagaatgtggtggccctggatgtggaggtggccaccaaccgcatctactggtgtgacctgagctacaggaagatctacagcgcctacatggacaaggccagtgaccccaaggagcaggaggtgctgattgatgagcagctgcacagccctgagggcctggccgtggactgggtgcacaagcacatctactggacagacagcggcaacaagaccatctctgtggccaccgtggatggcggcagaagaaggaccctcttcagcaggaacctgtctgagccccgggccatcgctgtggaccccctgcggggcttcatgtactggagcgactggggagaccaggccaagattgagaagagcggcctgaatggagtggaccggcagaccctggtgtctgacaacatcgagtggcccaacggcatcaccctggacctgctgagccagaggctgtactgggtggacagcaagctgcaccagctgagcagcattgacttcagcggcggcaacaggaagaccctcatcagcagcacagacttcctgagccaccccttcggcattgctgtgtttgaggacaaggtgttctggacagacctggagaatgaggccatcttcagcgccaaccggctgaatggcctggagatcagcatcctggccgagaacctgaacaacccccatgacatcgtcatcttccacgagctgaagcagccccgggccccagatgcctgtgagctgtctgtgcagcccaatggaggctgtgagtacctgtgcctgcctgccccccagatcagcagccacagccccaagtacacctgtgcctgcccagacaccatgtggctgggccctgacatgaagcgctgctaccgggccccccagagcaccagcaccaccaccctggccagcaccatgaccaggacagtgcctgccaccacccgggcccctggcaccaccgtgcacaggagcacctaccagaaccacagcacagagacccccagcctgacagctgctgtgcccagctctgtgtctgtgccccgggcccccagcatcagccccagcaccctgagccctgccaccagcaaccacagccagcactacgccaatgaagacagcaagatgggcagcacagtgacagctgctgtgattggcatcatcgtgcccatcgtggtgattgccctgctgtgcatgagcggctacctgatctggaggaactggaagaggaagaacaccaagtccatgaactttgacaaccctgtgtacaggaagaccacagaggaggaggatgaagatgagctgcacatcggccgcacagcccagatcggccacgtgtacccagctgccatcagcagctttgaccggcccctgtgggccgagccctgcctgggggagacccgggagcctgaggaccctgccccagccctgaaggagctgtttgtgctgcctggagagcccaggagccagctgcaccagctgcccaagaaccccctgtctgagctgcctgtggtgaagagcaagagggtggccctgagcctggaggatgatggcctgccctag

SEQ ID NO: 158121 - DNA, 2892 bp, Artificial Sequence
  Description of Artificial Sequence: Synthetic coding sequence
atgggcctgcctgagcccggccccctgcggctgctggccctgctgctgctgctgctgctgctgctgctgctgcagctgcagcacctggccgctgctgctgctgaccccctgctgggcggccagggccctgccaaggactgtgagaaggaccagttccagtgcagaaatgaacgctgcatccccagcgtgtggaggtgtgatgaagatgatgactgcctggaccacagtgatgaagatgactgccccaagaagacctgtgccgacagcgacttcacctgtgacaatggccactgcatccacgagcgctggaagtgtgatggagaggaggagtgcccagatggcagtgatgagagcgaggccacctgcaccaagcaggtgtgcccagctgagaagctgagctgtggccccaccagccacaagtgtgtgcctgcctcctggaggtgtgatggagagaaggactgtgagggcggcgcagatgaagctggctgtgccaccctgtgtgcccctcatgagttccagtgtggcaacagaagctgcctggccgctgtgtttgtgtgtgatggagatgatgactgtggagatggcagtgatgagcggggctgtgccgaccctgcctgtggcccccgggagttccgctgtggaggagatggcggcggggcctgcatccctgagcgctgggtgtgtgaccggcagtttgactgtgaagatagaagtgatgaagctgctgagctgtgtggccggcccggccctggggccaccagcgccccagctgcctgtgccacagccagccagtttgcctgccgctctggagaatgtgtgcacctgggctggaggtgtgatggagaccgggactgcaaggacaagagtgatgaggccgactgccccctgggcacctgcagaggagatgagttccagtgtggagatggcacctgtgtgctggccatcaagcactgcaaccaggagcaggactgcccagatggcagtgatgaagctggctgcctgcagggcctgaatgaatgtctgcacaacaacggcggctgcagccacatctgcacagacctgaagattggatttgaatgtacctgcccagctggcttccagctgctggaccagaagacctgtggggacattgatgagtgcaaggaccctgatgcctgcagccagatctgtgtgaactacaagggctacttcaagtgtgagtgctacccaggctatgagatggacctgctgaccaagaactgcaaggctgctgctgggaagagccccagcctcatcttcaccaacagacatgaggtgagaagaattgacctggtgaagaggaactacagccgcctcatccccatgctgaagaatgtggtggccctggatgtggaggtggccaccaaccgcatctactggtgtgacctgagctacaggaagatctacagcgcctacatggacaaggccagtgaccccaaggagcaggaggtgctgattgatgagcagctgcacagccctgagggcctggccgtggactgggtgcacaagcacatctactggacagacagcggcaacaagaccatctctgtggccaccgtggatggcggcagaagaaggaccctcttcagcaggaacctgtctgagccccgggccatcgctgtggaccccctgcggggcttcatgtactggagcgactggggagaccaggccaagattgagaagagcggcctgaatggagtggaccggcagaccctggtgtctgacaacatcgagtggcccaacggcatcaccctggacctgctgagccagaggctgtactgggtggacagcaagctgcaccagctgagcagcattgacttcagcggcggcaacaggaagaccctcatcagcagcacagacttcctgagccaccccttcggcattgctgtgtttgaggacaaggtgttctggacagacctggagaatgaggccatcttcagcgccaaccggctgaatggcctggagatcagcatcctggccgagaacctgaacaacccccatgacatcgtcatcttccacgagctgaagcagccccgggccccagatgcctgtgagctgtctgtgcagcccaatggaggctgtgagtacctgtgcctgcctgccccccagatcagcagccacagccccaagtacacctgtgcctgcccagacaccatgtggctgggccctgacatgaagcgctgctaccgggccccccagagcaccagcaccaccaccctggccagcaccatgaccaggacagtgcctgccaccacccgggcccctggcaccaccgtgcacaggagcacctaccagaaccacagcacagagacccccagcctgacagctgctgtgcccagctctgtgtctgtgccccgggcccccagcatcagccccagcaccctgagccctgccaccagcaaccacagccagcactacgccaatgaagacagcaagatgggcagcacagtgacagctgctgtgattggcatcatcgtgcccatcgtggtgattgccctgctgtgcatgagcggctacctgatctggaggaactggaagaggaagaacaccaagtccatgaactttgacaaccctgtgtacaggaagaccacagaggaggaggatgaagatgagctgcacatcggccgcacagcccagatcggccacgtgtacccagctgccatcagcagctttgaccggcccctgtgggccgagccctgcctgggggagacccgggagcctgaggaccctgccccagccctgaaggagctgtttgtgctgcctggagagcccaggagccagctgcaccagctgcccaagaaccccctgtctgagctgcctgtggtgaagagcaagagggtggccctgagcctggaggatgatggcctgccctag

SEQ ID NO: 158122 - DNA, 2103 bp, Artificial Sequence
  Description of Artificial Sequence: Synthetic coding sequence
atgggcctgcctgagcccggccccctgcggctgctggccctgctgctgctgctgctgctgctgctgctgctgcagctgcagcacctggccgctgctgctgctgaccccctgctgggcggccagggccctgccaaggactgtgagaaggaccagttccagtgcagaaatgaacgctgcatccccagcgtgtggaggtgtgatgaagatgatgactgcctggaccacagtgatgaagatgactgccccaagaagacctgtgccgacagcgacttcacctgtgacaatggccactgcatccacgagcgctggaagtgtgatggagaggaggagtgcccagatggcagtgatgagagcgaggccacctgcaccaagcaggtgtgcccagctgagaagctgagctgtggccccaccagccacaagtgtgtgcctgcctcctggaggtgtgatggagagaaggactgtgagggcggcgcagatgaagctggctgtgccaccagcctgggcacctgcagaggagatgagttccagtgtggagatggcacctgtgtgctggccatcaagcactgcaaccaggagcaggactgcccagatggcagtgatgaggccggctgcctgcagggcctgaatgaatgtctgcacaacaatggaggctgcagccacatctgcacagacctgaagattggatttgagtgcacctgcccagctggcttccagctgctggaccagaagacctgtggggacattgatgagtgcaaggaccctgatgcctgcagccagatctgtgtgaactacaagggctacttcaagtgtgagtgctacccaggctatgagatggacctgctgaccaagaactgcaaggctgctgctgggaagagccccagcctcatcttcaccaacagacatgaggtgagaagaattgacctggtgaagaggaactacagccgcctcatccccatgctgaagaatgtggtggccctggatgtggaggtggccaccaaccgcatctactggtgtgacctgagctacaggaagatctacagcgcctacatggacaaggccagtgaccccaaggagcaggaggtgctgattgatgagcagctgcacagccctgagggcctggccgtggactgggtgcacaagcacatctactggacagattctggcaacaagaccatctctgtggccaccgtggatggcggcagaagaaggaccctcttcagcaggaacctgtctgagccccgggccatcgctgtggaccccctgcggggcttcatgtactggagcgactggggagaccaggccaagattgagaagagcggcctgaatggagtggaccggcagaccctggtgtctgacaacatcgagtggcccaacggcatcaccctggacctgctgagccagaggctgtactgggtggacagcaagctgcaccagctgagcagcattgacttcagcggcggcaacaggaagaccctcatcagcagcacagacttcctgagccacccctttggaattgctgtgtttgaggacaaggtgttctggacagacctggagaatgaggccatcttcagcgccaaccggctgaatggcctggagatcagcatcctggccgagaacctgaacaacccccatgacatcgtcatcttccacgagctgaagcagccccgggccccagatgcctgtgagctgtctgtgcagcccaacggcggctgtgagtacctgtgcctgcctgccccccagatcagcagccacagccccaagtacacctgtgcctgcccagacaccatgtggctgggccctgacatgaagcgctgctacagagatgccaatgaagacagcaagatgggcagcacagtgacagctgctgtgattggcatcatcgtgcccatcgtggtgattgccctgctgtgcatgagcggctacctgatctggaggaactggaagaggaagaacaccaagtccatgaactttgacaaccctgtgtacaggaagaccacagaggaggaggatgaagatgagctgcacatcggccgcacagcccagatcggccacgtgtacccagcccgggtggccctgagcctggaggatgatggcctgccctag

SEQ ID NO: 158123 - DNA, 2715 bp, Artificial Sequence
  Description of Artificial Sequence: Synthetic coding sequence
atgggcctgcctgagcccggccccctgcggctgctggccctgctgctgctgctgctgctgctgctgctgctgcagctgcagcacctggccgctgctgctgctgaccccctgctgggcggccagggccctgccaaggactgtgagaaggaccagttccagtgcagaaatgaacgctgcatccccagcgtgtggaggtgtgatgaagatgatgactgcctggaccacagtgatgaagatgactgccccaagaagacctgtgccgacagcgacttcacctgtgacaatggccactgcatccacgagcgctggaagtgtgatggagaggaggagtgcccagatggcagtgatgagagcgaggccacctgcaccaagcaggtgtgcccagctgagaagctgagctgtggccccaccagccacaagtgtgtgcctgcctcctggaggtgtgatggagagaaggactgtgagggcggcgcagatgaagctggctgtgccaccctgtgtgcccctcatgagttccagtgtggcaacagaagctgcctggccgctgtgtttgtgtgtgatggagatgatgactgtggagatggcagtgatgagcggggctgtgccgaccctgcctgtggcccccgggagttccgctgtggaggagatggcggcggggcctgcatccctgagcgctgggtgtgtgaccggcagtttgactgtgaagatagaagtgatgaagctgctgagctgtgtggccggcccggccctggggccaccagcgccccagctgcctgtgccacagccagccagtttgcctgccgctctggagaatgtgtgcacctgggctggaggtgtgatggagaccgggactgcaaggacaagagtgatgaggccgactgccccctgggcacctgcagaggagatgagttccagtgtggagatggcacctgtgtgctggccatcaagcactgcaaccaggagcaggactgcccagatggcagtgatgaagctggctgcctgcagggcctgaatgaatgtctgcacaacaacggcggctgcagccacatctgcacagacctgaagattggatttgaatgtacctgcccagctggcttccagctgctggaccagaagacctgtggggacattgatgagtgcaaggaccctgatgcctgcagccagatctgtgtgaactacaagggctacttcaagtgtgagtgctacccaggctatgagatggacctgctgaccaagaactgcaaggctgctgctgggaagagccccagcctcatcttcaccaacagacatgaggtgagaagaattgacctggtgaagaggaactacagccgcctcatccccatgctgaagaatgtggtggccctggatgtggaggtggccaccaaccgcatctactggtgtgacctgagctacaggaagatctacagcgcctacatggacaaggccagtgaccccaaggagcaggaggtgctgattgatgagcagctgcacagccctgagggcctggccgtggactgggtgcacaagcacatctactggacagacagcggcaacaagaccatctctgtggccaccgtggatggcggcagaagaaggaccctcttcagcaggaacctgtctgagccccgggccatcgctgtggaccccctgcggggcttcatgtactggagcgactggggagaccaggccaagattgagaagagcggcctgaatggagtggaccggcagaccctggtgtctgacaacatcgagtggcccaacggcatcaccctggacctgctgagccagaggctgtactgggtggacagcaagctgcaccagctgagcagcattgacttcagcggcggcaacaggaagaccctcatcagcagcacagacttcctgagccaccccttcggcattgctgtgtttgaggacaaggtgttctggacagacctggagaatgaggccatcttcagcgccaaccggctgaatggcctggagatcagcatcctggccgagaacctgaacaacccccatgacatcgtcatcttccacgagctgaagcagccccgggccccagatgcctgtgagctgtctgtgcagcccaatggaggctgtgagtacctgtgcctgcctgccccccagatcagcagccacagccccaagtacacctgtgcctgcccagacaccatgtggctgggccctgacatgaagcgctgctaccgggccccccagagcaccagcaccaccaccctggccagcaccatgaccaggacagtgcctgccaccacccgggcccctggcaccaccgtgcacaggagcacctaccagaaccacagcacagagacccccagcctgacagctgctgtgcccagctctgtgtctgtgccccgggcccccagcatcagccccagcaccctgagccctgccaccagcaaccacagccagcactacgccaatgaagacagcaagatgggcagcacagtgacagctgctgtgattggcatcatcgtgcccatcgtggtgattgccctgctgtgcatgagcggctacctgatctggaggaactggaagaggaagaacaccaagtccatgaactttgacaaccctgtgtacaggaagaccacagaggaggaggatgaagatgagctgcacatcggccgcacagcccagatcggccacgtgtacccagcccgggtggccctgagcctggaggatgatggcctgccctag

SEQ ID NO: 158124 - DNA, 1074 bp, Artificial Sequence
  Description of Artificial Sequence: Synthetic coding sequence
atggccccccggcgggtgcgctccttcctgcggggcctgcctgccctgctgctgctgctgctcttcctgggcccctggccagctgccagccatggaggcaagtacagccgggagaagaaccagcccaagcccagccccaagcgggagagcggggaggagttcaggatggagaagctgaaccagctgtgggagaaggcccagaggctgcacctgccccctgtgcggctggccgagctgcatgctgacctgaagatccaggagagagatgagctggcctggaagaagctgaagctggatggcctggatgaagatggagagaaggaggcccggctcatccggaacctgaatgtcatcctggccaagtatggcctggatggcaagaaggatgcccggcaggtgaccagcaacagcctgagcggcacccaggaggatggcctggatgacccccggctggagaagctgtggcacaaggccaagaccagcggcaagttctctggagaggagctggacaagctgtggagggagttcctgcaccacaaggagaaggtgcatgagtacaacgtgctgctggagaccctgagcaggacagaggagatccatgaaaatgtcatcagccccagcgacctgagtgacatcaagggctctgtgctgcacagccgccacacagagctgaaggagaagctgcggagcatcaaccagggcctggaccggctgcggcgggtgagccaccagggctacagcacagaggccgagtttgaggagcccagggtcatcgacctgtgggacctggcccagagcgccaacctgacagacaaggagctggaggccttccgggaggagctgaagcactttgaggccaagattgagaagcacaaccactaccagaagcagctggagatcgcccacgagaagctgcggcatgctgagagcgtgggagatggagagcgggtgagccgcagccgggagaagcacgccctgctggagggccgcaccaaggagctgggctacacagtgaagaagcacctgcaggacctgagcggccgcatcagccgggcccggcacaatgagctgtag

SEQ ID NO: 158125 - DNA, 402 bp, Artificial Sequence
  Description of Artificial Sequence: Synthetic coding sequence
atgaactacatgcctggaacagccagcctgattgaggacatcgacaagaagcacctggtgctgctgagagatggccgcaccctgattggcttcctgcggagcattgaccagtttgccaacctggtgctgcaccagacagtggagcgcatccacgtgggcaagaagtacggggacatcccccggggcatctttgtggtgagaggagaaaatgtggtgctgctgggggagattgacctggagaaggagagtgacacccccctgcagcaggtgtccattgaggagatcctggaggagcagagggtggagcagcagaccaagctggaggccgagaagctgaaggtgcaggccctgaaggaccggggcctgagcatccccagggctgacaccctggatgagtactag

SEQ ID NO: 158126 - DNA, 588 bp, Artificial Sequence
  Description of Artificial Sequence: Synthetic coding sequence
atggccgcccctcctggagagtacttctctgtgggcagccaggtgtcctgcaggacctgccaggagcagaggctgcagggcgaggtggtggcctttgactaccagagcaagatgctggccctgaagtgccccagcagcagcggcaagcccaaccacgccgacatcctgctgatcaacctgcagtatgtgtctgaggtggagatcatcaatgacagaacagagaccccaccacccctggccagcctgaatgtgtccaagctggccagcaaggccaggacagagaaggaggagaagctgagccaggcctatgccatctctgctggggtgtccctggagggccagcagctgttccagaccatccacaagaccatcaaggactgcaagtggcaggagaagaacatcgtggtgatggaggaggtggtgatcaccccaccctaccaggtggagaactgcaagggcaaggagggcagcgccctgagccacgtgaggaagatcgtggagaagcacttcagagatgtggagagccagaagatcctgcagaggagccaggcccagcagccccagaaggaggccgccctgagcagctag

SEQ ID NO: 158127 - DNA, 588 bp, Artificial Sequence; identical to SEQ ID NO: 158126
  Description of Artificial Sequence: Synthetic coding sequence

SEQ ID NO: 158128 - DNA, 288 bp, Artificial Sequence
  Description of Artificial Sequence: Synthetic coding sequence
atgctgttctacagcttcttcaagagcctggtgggcaaggatgtggtggtggagctgaagaatgacctgagcatctgtggcaccctgcacagcgtggaccagtacctgaacatcaagctgacagacatctctgtgacagatcctgagaagtacccccacatgctgtctgtgaagaactgcttcatccggggctctgtggtgcgctacgtgcagctgcctgcagatgaggtggacacccagctgctgcaggatgctgccaggaaggaggccctgcagcagaagcagtag

SEQ ID NO: 158129 - DNA, 288 bp, Artificial Sequence; identical to SEQ ID NO: 158128
  Description of Artificial Sequence: Synthetic coding sequence

SEQ ID NO: 158130 - DNA, 288 bp, Artificial Sequence; identical to SEQ ID NO: 158128
  Description of Artificial Sequence: Synthetic coding sequence

SEQ ID NO: 158131 - DNA, 288 bp, Artificial Sequence; identical to SEQ ID NO: 158128
  Description of Artificial Sequence: Synthetic coding sequence

SEQ ID NO: 158132 - DNA, 288 bp, Artificial Sequence; identical to SEQ ID NO: 158128
  Description of Artificial Sequence: Synthetic coding sequence

SEQ ID NO: 158133 - DNA, 288 bp, Artificial Sequence; identical to SEQ ID NO: 158128
  Description of Artificial Sequence: Synthetic coding sequence

SEQ ID NO: 158134 - DNA, 309 bp, Artificial Sequence
  Description of Artificial Sequence: Synthetic coding sequence
atggctgatgatgtggaccagcagcagaccaccaacacagtggaggagcccctggacctgatccggctgagcctggatgagcgcatctacgtgaagatgagaaatgaccgggagctgcggggccgcctgcacgcctatgaccagcacctgaacatgatcctgggagatgtggaggagaccgtgaccaccatcgagattgatgaggagacctatgaggagatctacaagagcaccaagaggaacatccccatgctgtttgtgagaggagatggagtggtgctggtggccccacccctgcgggtgggctag

SEQ ID NO: 158135 - DNA, 420 bp, Artificial Sequence
  Description of Artificial Sequence: Synthetic coding sequence
atgctgcccctgagcctgctgaagacagcccagaaccaccccatgctggtggagctgaagaatggagagacctacaacggccacctggtgtcctgtgacaactggatgaacatcaacctgcgggaggtgatctgcaccagcagagatggagacaagttctggaggatgcctgagtgctacatccggggcagcaccatcaagtacctgcgcatcccagatgagatcatcgacatggtgaaggaggaggtggtggccaagggccggggccggggcggcctgcagcagcagaagcagcagaagggccggggcatgggcggggccggccggggcgtgtttggaggccggggccggggcggcatccctggcaccggccggggccagcctgagaagaagccaggccggcaggccggcaagcagtag

SEQ ID NO: 158136 - DNA, 420 bp, Artificial Sequence; identical to SEQ ID NO: 158135
  Description of Artificial Sequence: Synthetic coding sequence

SEQ ID NO: 158137 - DNA, 276 bp, Artificial Sequence
  Description of Artificial Sequence: Synthetic coding sequence
atggccgccaatgccaccaccaaccccagccagctgctgcccctggagctggtggacaagtgcatcggcagccgcatccacatcgtgatgaagagtgacaaggagatcgtgggcaccctgctgggctttgatgactttgtgaacatggtgctggaggatgtgacagaatttgagatcaccccagagggccgccgcatcaccaagctggaccagatcctgctgaatggaaacaacatcaccatgctggtgcctggaggagagggccctgaggtgtag

SEQ ID NO: 158138 - DNA, 243 bp, Artificial Sequence
  Description of Artificial Sequence: Synthetic coding sequence
atgagcctgaggaagcagacccccagcgacttcctgaagcagatcatcggccggcctgtggtggtgaagctgaacagcggcgtggactaccggggcgtgctggcctgcctggatggctacatgaacatcgccctggagcagacagaggagtatgtgaatggccagctgaagaacaagtatggagatgccttcatccggggcaacaacgtgctgtacatcagcacccagaagaggaggatgtag

SEQ ID NO: 158139 - DNA, 243 bp, Artificial Sequence; identical to SEQ ID NO: 158138
  Description of Artificial Sequence: Synthetic coding sequence

SEQ ID NO: 158140 - DNA, 243 bp, Artificial Sequence; identical to SEQ ID NO: 158138
  Description of Artificial Sequence: Synthetic coding sequence

SEQ ID NO: 158141 - DNA, 243 bp, Artificial Sequence; identical to SEQ ID NO: 158138
  Description of Artificial Sequence: Synthetic coding sequence

SEQ ID NO: 158142 - DNA, 312 bp, Artificial Sequence
  Description of Artificial Sequence: Synthetic coding sequence
atggctgacaaggagaagaagaagaaggagagcatcctggacctgagcaagtacatcgacaagaccatccgggtgaagttccagggcggccgggaggccagcggcatcctgaagggctttgaccccctgctgaacctggtgctggatggcaccatcgagtacatgagggaccctgatgaccagtacaagctgacagaggacacccggcagctgggcctggtggtgtgccggggcacctctgtggtgctgatctgcccccaggacggcatggaggccatccccaaccccttcatccagcagcaggatgcctag

SEQ ID NO: 158143 - DNA, 1116 bp, Artificial Sequence
  Description of Artificial Sequence: Synthetic coding sequence
atgtctgcccaggcccagatgagggccctgctggaccagctgatgggcacagccagagatggagatgagacccggcagagggtgaagttcacagatgacagagtgtgcaagagccacctgctggactgctgcccccatgacatcctggccggcaccaggatggacctgggggagtgcaccaagatccatgacctggccctgcgggctgactatgaaattgccagcaaggagcgggacctcttctttgagctggatgccatggaccacctggagagcttcatcgccgagtgtgacagaagaacagagctggccaagaagaggctggccgagacccaggaggagatctctgctgaggtgtctgccaaggccgagaaggtgcatgagctgaatgaggagatcggcaagctgctggccaaggccgagcagctgggcgctgagggcaatgtggatgagagccagaagatcctgatggaggtggagaaggtgcgggccaagaagaaggaggccgaggaggagtacagaaacagcatgcctgccagcagcttccagcagcagaagctgcgggtgtgtgaggtgtgcagcgcctacctgggcctgcatgacaatgaccggcggctggccgaccactttggaggcaagctgcacctgggcttcatccagatccgggagaagctggaccagctgaggaagacagtggccgagaagcaggagaagaggaaccaggaccggctgcggcggcgggaggagcgggagcgggaggagcggctgagccgccgcagcggcagcaggacccgggacagaagaagaagccgcagccgggacagaagaagaagaagaagccgcagcaccagccgggagaggaggaagctgagccgcagccgcagccgggacagacaccggcggcacaggagccgcagccgcagccacagccggggccaccggcgggccagccgggacagaagtgccaagtacaagttcagccgggagcgggccagccgggaggagagctgggagagcggccgctctgagcggggccccccagactggaggctggagagcagcaatggcaagatggccagcagaagaagtgaggagaaggaggccggggagatctag

SEQ ID NO: 158144 - DNA, 978 bp, Artificial Sequence
  Description of Artificial Sequence: Synthetic coding sequence
atgtctgcccaggcccagatgagggccctgctggaccagctgatgggcacagccagagatggagatgagacccggcagagggtgaagttcacagatgacagagtgtgcaagagccacctgctggactgctgcccccatgacatcctggccggcaccaggatggacctgggggagtgcaccaagatccatgacctggccctgcgggctgactatgaaattgccagcaaggagcgggacctcttctttgagctggatgccatggaccacctggagagcttcatcgccgagtgtgacagaagaacagagctggccaagaagaggctggccgagacccaggaggagatctctgctgaggtgtctgccaaggccgagaaggtgcatgagctgaatgaggagatcggcaagctgctggccaaggccgagcagctgggcgctgagggcaatgtggatgagagccagaagatcctgatggaggtggagaaggtgcgggccaagaagaaggaggccgaggaggagtacagaaacagcatgcctgccagcagcttccagcagcagaagctgcgggtgtgtgaggtgtgcagcgcctacctgggcctgcatgacaatgaccggcggctggccgaccactttggaggcaagctgcacctgggcttcatccagatccgggagaagctggaccagctgaggaagacagtggccgagaagcaggagaagaggaaccaggaccggctgcggcggcgggaggagcgggagcgggaggagcggctgagccgccgcagcggcagcaggacccgggacagaagaagaagccgcagccgggacagaagaagaagaagaagccgcagcaccagccgggagaggaggaagctgagccgcagccgcagccgggacagacaccggcggcacaggagccgcagccgcagccacagccggggccaccggcgggccagccgggacagaagtgccaagtacaagtag

SEQ ID NO: 158145 - DNA, 819 bp, Artificial Sequence
  Description of Artificial Sequence: Synthetic coding sequence
atggacctgggagaatgtaccaagatccatgacctggccctgcgggctgactatgagatcgccagcaaggagcgggacctcttctttgagctggatgccatggaccacctggagagcttcatcgcagaatgtgacagaagaacagagctggccaagaagaggctggccgagacccaggaggagatctctgctgaggtgtctgccaaggccgagaaggtgcatgagctgaatgaggagatcggcaagctgctggccaaggccgagcagctgggcgctgagggcaatgtggatgagagccagaagatcctgatggaggtggagaaggtgcgggccaagaagaaggaggccgaggaggagtacagaaattccatgcctgccagcagcttccagcagcagaagctgcgggtgtgtgaggtgtgcagcgcctacctgggcctgcatgacaatgaccggcggctggccgaccactttggaggcaagctgcacctgggcttcatccagatccgggagaagctggaccagctgaggaagacagtggccgagaagcaggagaagaggaaccaggaccggctgcggcggcgggaggagcgggagcgggaggagcggctgagcagaagaagtggcagcaggacccgggacagaagaagaagccgcagccgggacagaagaagaagaagaagccgcagcaccagccgggagaggaggaagctgagccgcagccgcagccgggacagacacagaagacacaggagccgcagccgcagccacagccggggccacagaagagccagccgggacagaagtgccaagtacaagtag

SEQ ID NO: 158146 - DNA, 978 bp, Artificial Sequence; identical to SEQ ID NO: 158144
  Description of Artificial Sequence: Synthetic coding sequence

SEQ ID NO: 158147 - DNA, 99 bp, Artificial Sequence
  Description of Artificial Sequence: Synthetic coding sequence
atggacctgggagaatgtaccaagatccatgacctggccctgcgggctgactatgagatcgccagcaaggagcgggacctcttctttgagctggactag

SEQ ID NO: 158148 - DNA, 549 bp, Artificial Sequence
  Description of Artificial Sequence: Synthetic coding sequence
atggaccacctggagagcttcatcgccgagtgtgacagaagaacagagctggccaagaagaggctggccgagacccaggaggagatctctgctgaggtgtctgccaaggccgagaaggtgcatgagctgaatgaggagatcggcaagctgctggccaaggccgagcagctgggcgctgagggcaatgtggatgagagccagaagatcctgatggaggtggagaaggtgcgggccaagaagaaggaggccgaggaggagtacagaaacagcatgcctgccagcagcttccagcagcagaagctgcgggtgtgtgaggtgtgcagcgcctacctgggcctgcatgacaatgaccggcggctggccgaccactttggaggcaagctgcacctgggcttcatccagatccgggagaagctggaccagctgaggaagacagtggccgagaagcaggagaagaggaaccaggaccggctgcggcggcgggaggagcgggagcgggaggagcggctgagccgccgcagcggcagcaggacccgggacagaagatag

SEQ ID NO: 158149 - DNA, 183 bp, Artificial Sequence
  Description of Artificial Sequence: Synthetic coding sequence
tgaagaagaagaagccgcagccgggacagaagaagaagaagaagccgcagcaccagccgggagaggaggaagctgagccgcagccgcagccgggacagacacagaagacacaggagccgcagccgcagccacagccggggccacagaagagccagccgggacagaagtgccaagtacaagtag

SEQ ID NO: 158150 - DNA, 255 bp, Artificial Sequence
  Description of Artificial Sequence: Synthetic coding sequence
atggaccacctggagagcttcatcgccgagtgtgacagaagaacagagctggccaagaagaggctggccgagacccaggaggagatctctgctgaggtgtctgccaaggccgagaaggtgcatgagctgaatgaggagatcggcaagctgctggccaaggccgagcagctgggcgctgagggcaatgtggatgagagccagaagatcctgatggaggtggagaaggtgcgggccaagaagaaggaggccgagtag

SEQ ID NO: 158151 - DNA, 1176 bp, Artificial Sequence
  Description of Artificial Sequence: Synthetic coding sequence
atgcctgcctacctgaacctgcagggctctgtgaggaaggccccccacagccccagccgggacaccacccggcagaggatcaagttcagtgatgacagagtgtgcaagagccacctgctgaactgctgcccccatgatgtgctgagcggcaccaggatggacctgggagaatgtctgaaggtgcatgacctggccctgcgggctgactatgagatcgccagcaaggagcaggacttcttctttgagctggatgccatggaccacctgcagagcttcatcgctgactgtgacagaagaacagaggtggccaagaagaggctggccgagacccaggaggagatctctgctgaggtggccgccaaggccgagcgggtgcatgagctgaatgaggagatcggcaagctgctggccaaggtggagcagctgggcgctgagggcaatgtggaggagagccagaaggtgatggatgaggtggagaaggcccgggccaagaagcgggaggccgaggaggtgtacagaaattccatgcctgccagcagcttccagcagcagaagctgcgggtgtgtgaggtgtgcagcgcctacctgggcctgcatgacaatgaccggcggctggccgaccactttggaggcaagctgcacctgggcttcatcgagatccgggagaagctggaggagctgaagagggtggtggccgagaagcaggagaagaggaaccaggagcggctgaagagaagagaggagcgggagcgggaggagcgggagaagctgcggcgcagccgcagccacagcaagaaccccaagaggagccgcagccgggagcaccggcggcacaggagccgctccatgagccgggagaggaagaggaggaccaggagcaagagccgggagaagaggcaccgccacaggagccgcagcagcagccgcagccgcagccgcagccaccagaggagccgccacagcagccgggacaggagccgggagaggagcaagaggaggagcagcaaggagcgcttccgggaccaggacctggccagctgtgaccgggacaggagcagccgggacaggagcccccgggaccgggacaggaaggacaagaagaggagctatgagagcgccaacggccgctctgaggaccggcgcagcagcgaggagcgggaggccggggagatctag

SEQ ID NO: 158152 - DNA, 1179 bp, Artificial Sequence
  Description of Artificial Sequence: Synthetic coding sequence
atgtctgcccaggcccagatgagggccatgctggaccagctgatgggcaccagcagagatggagacaccacccggcagaggatcaagttcagtgatgacagagtgtgcaagagccacctgctgaactgctgcccccatgatgtgctgagcggcaccaggatggacctgggggagtgcctgaaggtgcatgacctggccctgcgggctgactatgaaattgccagcaaggagcaggacttcttctttgagctggatgccatggaccacctgcagagcttcatcgctgactgtgacagaagaacagaggtggccaagaagaggctggccgagacccaggaggagatctctgctgaggtggccgccaaggccgagcgggtgcatgagctgaatgaggagatcggcaagctgctggccaaggtggagcagctgggcgctgagggcaatgtggaggagagccagaaggtgatggatgaggtggagaaggcccgggccaagaagcgggaggccgaggaggtgtacagaaacagcatgcctgccagcagcttccagcagcagaagctgcgggtgtgtgaggtgtgcagcgcctacctgggcctgcatgacaatgaccggcggctggccgaccactttggaggcaagctgcacctgggcttcatcgagatccgggagaagctggaggagctgaagagggtggtggccgagaagcaggagaagaggaaccaggagcggctgaagaggcgggaggagcgggagcgggaggagcgggagaagctgcggcgcagccgcagccacagcaagaaccccaagaggagccgcagccgggagcacagaagacacaggagccgctccatgagccgggagaggaagaggaggaccaggagcaagagccgggagaagaggcaccgccacaggagccgcagcagcagccgcagccgcagccgcagccaccagaggagccgccacagcagccgggacaggagccgggagaggagcaagagaagaagcagcaaggagcgcttccgggaccaggacctggccagctgtgaccgggacaggagcagccgggacaggagcccccgggaccgggacaggaaggacaagaagaggagctatgaaagtgccaacggccgctcagaagatagaagaagcagcgaggagcgggaggccggggagatctag

SEQ ID NO: 158153 - DNA, 1170 bp, Artificial Sequence
  Description of Artificial Sequence: Synthetic coding sequence
atggtgatccacagccagctgaagaagatccagggcgccagcgagaggatgggagacaccacccggcagaggatcaagttcagtgatgacagagtgtgcaagagccacctgctgaactgctgcccccatgatgtgctgagcggcaccaggatggacctgggagaatgtctgaaggtgcatgacctggccctgcgggctgactatgagatcgccagcaaggagcaggacttcttctttgagctggatgccatggaccacctgcagagcttcatcgctgactgtgacagaagaacagaggtggccaagaagaggctggccgagacccaggaggagatctctgctgaggtggccgccaaggccgagcgggtgcatgagctgaatgaggagatcggcaagctgctggccaaggtggagcagctgggcgctgagggcaatgtggaggagagccagaaggtgatggatgaggtggagaaggcccgggccaagaagcgggaggccgaggaggtgtacagaaattccatgcctgccagcagcttccagcagcagaagctgcgggtgtgtgaggtgtgcagcgcctacctgggcctgcatgacaatgaccggcggctggccgaccactttggaggcaagctgcacctgggcttcatcgagatccgggagaagctggaggagctgaagagggtggtggccgagaagcaggagaagaggaaccaggagcggctgaagagaagagaggagcgggagcgggaggagcgggagaagctgcggcgcagccgcagccacagcaagaaccccaagaggagccgcagccgggagcaccggcggcacaggagccgctccatgagccgggagaggaagaggaggaccaggagcaagagccgggagaagaggcaccgccacaggagccgcagcagcagccgcagccgcagccgcagccaccagaggagccgccacagcagccgggacaggagccgggagaggagcaagaggaggagcagcaaggagcgcttccgggaccaggacctggccagctgtgaccgggacaggagcagccgggacaggagcccccgggaccgggacaggaaggacaagaagaggagctatgagagcgccaacggccgctctgaggaccggcgcagcagcgaggagcgggaggccggggagatctag

SEQ ID NO: 158154 - DNA, 1377 bp, Artificial Sequence
  Description of Artificial Sequence: Synthetic coding sequence
atggccgccctgggcagccccagccacaccttccggggcctgctgcgggagctgcgctacctgtctgctgccaccggccggccctacagagacacagctgcctaccgctacctggtgaaggccttccgggcccaccgggtgaccagcgagaagctgtgccgggcccagcacgagctgcacttccaggccgccacctacctgtgcctgctgcggagcatcaggaagcacgtggccctgcaccaggagttccacggcaagggggacaccacccggcagaggatcaagttcagtgatgacagagtgtgcaagagccacctgctgaactgctgcccccatgatgtgctgagcggcaccaggatggacctgggggagtgcctgaaggtgcatgacctggccctgcgggctgactatgaaattgccagcaaggagcaggacttcttctttgagctggatgccatggaccacctgcagagcttcatcgctgactgtgacagaagaacagaggtggccaagaagaggctggccgagacccaggaggagatctctgctgaggtggccgccaaggccgagcgggtgcatgagctgaatgaggagatcggcaagctgctggccaaggtggagcagctgggcgctgagggcaatgtggaggagagccagaaggtgatggatgaggtggagaaggcccgggccaagaagcgggaggccgaggaggtgtacagaaacagcatgcctgccagcagcttccagcagcagaagctgcgggtgtgtgaggtgtgcagcgcctacctgggcctgcatgacaatgaccggcggctggccgaccactttggaggcaagctgcacctgggcttcatcgagatccgggagaagctggaggagctgaagagggtggtggccgagaagcaggagaagaggaaccaggagcggctgaagaggcgggaggagcgggagcgggaggagcgggagaagctgcggcgcagccgcagccacagcaagaaccccaagaggagccgcagccgggagcacagaagacacaggagccgctccatgagccgggagaggaagaggaggaccaggagcaagagccgggagaagaggcaccgccacaggagccgcagcagcagccgcagccgcagccgcagccaccagaggagccgccacagcagccgggacaggagccgggagaggagcaagagaagaagcagcaaggagcgcttccgggaccaggacctggccagctgtgaccgggacaggagcagccgggacaggagcccccgggaccgggacaggaaggacaagaagaggagctatgaaagtgccaacggccgctcagaagatagaagaagcagcgaggagcgggaggccggggagatctag

SEQ ID NO: 158155 - DNA, 1179 bp, Artificial Sequence; identical to SEQ ID NO: 158152
  Description of Artificial Sequence: Synthetic coding sequence

SEQ ID NO: 158156 - DNA, 252 bp, Artificial Sequence
  Description of Artificial Sequence: Synthetic coding sequence
atgtctgcccaggcccagatgagggccatgctggaccagctgatgggcaccagcagagatggctccatgtacctgtgcctgcccaccagcatctgcaagggcgtgtctgagcggccccgcatccggcaggccgagatccagctggtgaatgaaagcaacagcgtgatgacagaatatgcccgggtgaccttcagcacagtggtgctgatgatgtccttcctggagctggagtggatcctggagaatgtgtag

SEQ ID NO: 158157 - DNA, 1299 bp, Artificial Sequence
  Description of Artificial Sequence: Synthetic coding sequence
atgatctctgctgcccagctgctggatgagctgatgggccgggacaggaacctggccccagatgagaagaggagcaatgtgcgctgggaccatgaatctgtgtgcaagtactacctgtgtggcttctgcccagctgagctgttcaccaacaccaggagtgacctgggcccctgtgagaagatccatgatgagaacctgaggaagcagtatgagaagagcagccgcttcatgaaggtgggctatgagcgggacttcctgcgctacctgcagagcctgctggccgaggtggagcggcgcatcagaagaggccacgcccggctggccctgagccagaaccagcagagcagcggggctgctggccccaccgggaagaatgaggagaagatccaggtgctgacagacaagattgatgtgctgctgcagcagatcgaggagctgggcagcgagggcaaggtggaggaggcccagggcatgatgaagctggtggagcagctgaaggaggagcgggagctgctgcggagcaccaccagcaccatcgagagctttgctgcccaggagaagcagatggaggtgtgtgaggtgtgtggggccttcctgattgtgggagatgcccagagccgggtggatgaccacctgatgggcaagcagcacatgggctacgccaagatcaaggccaccgtggaggagctgaaggagaagctgaggaagaggacagaggagccagacagagatgagcggctgaagaaggagaagcaggagcgggaggagcgggagaaggagcgggagcgggagcgggaggagcgggagaggaagagaagaagagaggaggaggagcgggagaaggagcgggcccgggaccgggagaggaggaagaggagccgcagccgcagccgccacagcagcaggaccagtgaccggcgctgcagccgcagccgggaccacaagaggagccgcagccgggagaggagaagaagccgcagccgggacagaagaagaagccgcagccatgacagaagtgagaggaagcacaggagccgcagccgggacagaagaagaagcaagagccgggacaggaagagctacaagcacaggagcaagagccgggaccgggagcaggacaggaagagcaaggagaaggagaagaggggcagtgatgacaagaagagctctgtgaagagcggcagccgggagaagcagagcgaggacaccaacacagagagcaaggagagtgacaccaagaatgaggtgaatggcaccagcgaggacatcaagtctgagggggacacccagagcaactag

SEQ ID NO: 158158 - DNA, 240 bp, Artificial Sequence
  Description of Artificial Sequence: Synthetic coding sequence
atgatctctgctgcccagctgctggatgagctgatgggccgggacaggaacctggccccagatgagaagaggagcaatgtgcgctgggaccatgaatctgtgtgcaagtactacctgtgtggcttctgcccagctgagctgttcaccaacaccaggagtgacctggatgtgtttggccgcggggacaacatcagagatgtgtccaagttcctggaggatgacaagtggatggaggagtag

SEQ ID NO: 158159 - DNA, 1299 bp, Artificial Sequence; identical to SEQ ID NO: 158157
  Description of Artificial Sequence: Synthetic coding sequence

SEQ ID NO: 158160 - DNA, 711 bp, Artificial Sequence
  Description of Artificial Sequence: Synthetic coding sequence
atgatctctgctgcccagctgctggatgagctgatgggccgggacaggaacctggccccagatgagaagaggagcaatgtgcgctgggaccatgaatctgtgtgcaagtactacctgtgtggcttctgcccagctgagctgttcaccaacaccaggagtgacctgggcccctgtgagaagatccatgatgagaacctgaggaagcagtatgagaagagcagccgcttcatgaaggtgggctatgagcgggacttcctgcgctacctgcagagcctgctggccgaggtggagcggcgcatcagaagaggccacgcccggctggccctgagccagaaccagcagagcagcggggctgctggccccaccgggaagaatgaggagaagatccaggtgctgacagacaagattgatgtgctgctgcagcagatcgaggagctgggcagcgagggcaaggtggaggaggcccagggcatgatgaagctggtggagcagctgaaggaggagcgggagctgctgcggagcaccaccagcaccatcgagagctttgctgcccaggagaagcagatggaggtgtgtgaggtgtgtggggccttcctgattgtgggagatgcccagagccgggtggatgaccacctgatgggcaagcagcacatgggctacgccaagatcaaggccaccgtggaggagaagaagaagaagaagaagaagtag

SEQ ID NO: 158161 - DNA, 1071 bp, Artificial Sequence
  Description of Artificial Sequence: Synthetic coding sequence
atgaaggtgggctatgagcgggacttcctgcgctacctgcagagcctgctggccgaggtggagcggcgcatcagaagaggccacgcccggctggccctgagccagaaccagcagagcagcggggctgctggccccaccgggaagaatgaggagaagatccaggtgctgacagacaagattgatgtgctgctgcagcagatcgaggagctgggcagcgagggcaaggtggaggaggcccagggcatgatgaagctggtggagcagctgaaggaggagcgggagctgctgcggagcaccaccagcaccatcgagagctttgctgcccaggagaagcagatggaggtgtgtgaggtgtgtggggccttcctgattgtgggagatgcccagagccgggtggatgaccacctgatgggcaagcagcacatgggctacgccaagatcaaggccaccgtggaggagctgaaggagaagctgaggaagaggacagaggagccagacagagatgagcggctgaagaaggagaagcaggagcgggaggagcgggagaaggagcgggagcgggagcgggaggagcgggagaggaagagaagaagagaggaggaggagcgggagaaggagcgggcccgggaccgggagaggaggaagaggagccgcagccgcagccgccacagcagcaggaccagtgaccggcgctgcagccgcagccgggaccacaagaggagccgcagccgggagaggagaagaagccgcagccgggacagaagaagaagccgcagccatgacagaagtgagaggaagcacaggagccgcagccgggacagaagaagaagcaagagccgggacaggaagagctacaagcacaggagcaagagccgggaccgggagcaggacaggaagagcaaggagaaggagaagaggggcagtgatgacaagaagagctctgtgaagagcggcagccgggagaagcagagcgaggacaccaacacagagagcaaggagagtgacaccaagaatgaggtgaatggcaccagcgaggacatcaagtctgagggcctgtttgtgacagtgtag

SEQ ID NO: 158162 - DNA, 1017 bp, Artificial Sequence
  Description of Artificial Sequence: Synthetic coding sequence
atgagcctgagcgccttcaccctcttcctggccctgattggaggcaccagcggccagtactatgactatgacttccccctgagcatctacggccagagcagccccaactgtgcccctgagtgcaactgcccagagagctaccccagcgccatgtactgtgatgagctgaagctgaagtctgtgcccatggtgcccccaggcatcaagtacctgtacctgaggaacaaccagattgaccacattgatgagaaggcctttgaaaatgtgacagacctgcagtggctgatcctggaccacaacctgctggagaacagcaagatcaagggccgggtcttcagcaagctgaagcagctgaagaagctgcacatcaaccacaacaacctgacagaatctgtgggccccctgcccaagagcctggaggacctgcagctgacccacaacaagatcaccaagctgggcagctttgagggcctggtgaacctgaccttcatccacctgcagcacaaccggctgaaggaggatgctgtgtctgctgccttcaagggcctgaagagcctggagtacctggacctgtccttcaaccagatcgcccggctgcccagcggcctgcctgtgtccctgctgaccctgtacctggacaacaacaagatcagcaacatcccagatgagtacttcaagcgcttcaatgccctgcagtacctgcggctgagccacaatgagctggccgacagcggcatccctggcaacagcttcaacgtgagcagcctggtggagctggacctgagctacaacaagctgaagaacatccccaccgtgaatgaaaacctggagaactactacctggaggtgaaccagctggagaagtttgacatcaagagcttctgcaagatcctgggccccctgagctacagcaagatcaagcacctgcggctggatggcaaccgcatcagcgagaccagcctgcccccagacatgtatgaatgtctgcgggtggccaatgaggtgaccctgaactag

SEQ ID NO: 158163 - DNA, 2100 bp, Artificial Sequence
  Description of Artificial Sequence: Synthetic coding sequence
atgaagcagcgcttcagcgccctgcagctgctgaagctgctgctgctgctgcagccccccctgccccgggccctgcgggaggccctgtgcccagagccctgcaactgtgtgcctgatggagccctgcgctgccccggccccacagctggcctgacccggctgagcctggcctacctgcctgtgaaggtgatccccagccaggccttccggggcctgaatgaagtcatcaagattgagatcagccagattgacagcctggagagaattgaggccaatgcctttgacaacctgctgaacctgtctgagatcctgatccagaacaccaagaacctgcgctacatcgagcccggggccttcatcaacctgccccggctgaagtacctgagcatctgcaacacaggcatcaggaagttcccagatgtgaccaaggtgttcagcagcgagagcaacttcatcctggagatctgtgacaacctgcacatcaccaccatccctggaaatgccttccagggcatgaacaatgaatctgtgaccctgaagctgtatggaaatggatttgaggaggtgcagagccacgccttcaacggcaccaccctgaccagcctggagctgaaggaaaatgtgcacctggagaagatgcacaatggagccttccggggggccaccggccccaagaccctggacatcagcagcaccaagctgcaggccctgcccagctatggcctggagagcatccagaggctgattgccaccagcagctacagcctgaagaagctgcccagccgggagacctttgtgaacctgctggaggccaccctgacctaccccagccactgctgtgccttcaggaacctgcccaccaaggagcagaacttcagccacagcatcagcgagaacttcagcaagcagtgtgagagcacagtgaggaaggtgaacaacaagaccctgtacagctccatgctggccgagagcgagctgagcggctgggactatgaatatggcttctgcctgcccaagaccccccgctgtgcccctgagccagatgccttcaacccctgtgaggacatcatgggctatgacttcctgcgggtgctgatctggctgatcaacatcctggccatcatgggcaacatgacagtgctgtttgtgctgctgaccagccgctacaagctgactgtgccccgcttcctgatgtgcaacctgagctttgctgacttctgcatgggcctgtacctgctgctgattgcctctgtggacagccagaccaagggccagtactacaaccacgccatcgactggcagacaggcagcggctgcagcacagctggcttcttcaccgtgtttgccagcgagctgtctgtgtacaccctgaccgtcatcaccctggagcgctggcacaccatcacctacgccatccacctggaccagaagctgcggctgcggcatgccatcctgatcatgctgggcggctggctgttcagcagcctgattgccatgctgcccctggtgggcgtgagcaactacatgaaggtgtccatctgcttccccatggatgtggagaccaccctgagccaggtgtacatcctgaccatcctgatcctgaatgtggtggccttcttcatcatctgtgcctgctacatcaagatctactttgctgtgaggaaccctgagctgatggccaccaacaaggacaccaagatcgccaagaagatggccatcctgatcttcacagacttcacctgcatggcccccatctccttctttgccatctctgctgccttcaaggtgcccctcatcaccgtgaccaacagcaaggtgctgctggtgctcttctaccccatcaacagctgtgccaaccccttcctgtatgccatcttcaccaagaccttccagagggacttcttcctgctgctgagcaagtttggctgctgcaagagaagagctgagctgtacagaaggaaggacttcagcgcctacaccagcaactgcaagaatggcttcaccggcagcaacaagcccagccagagcaccctgaagctgagcaccctgcactgccagggcacagccctgctggacaagacccgctacacagagtgctag

SEQ ID NO: 158164 - DNA, 1914 bp, Artificial Sequence
  Description of Artificial Sequence: Synthetic coding sequence
atgaagcagcgcttcagcgccctgcagctgctgaagctgctgctgctgctgcagccccccctgccccgggccctgcgggaggccctgtgcccagagccctgcaactgtgtgcctgatggagccctgcgctgccccggccccacagctggcctgacccggctgagcctggcctacctgcctgtgaaggtgatccccagccaggccttccggggcctgaatgaagtcatcaagattgagatcagccagattgacagcctggagagaattgaggccaatgcctttgacaacctgctgaacctgtctgagatcctgatccagaacaccaagaacctgcgctacatcgagcccggggccttcatcaacctgccccggctgaagtacctgagcatctgcaacacaggcatcaggaagttcccagatgtgaccaaggtgttcagcagcgagagcaacttcatcctggagatctgtgacaacctgcacatcaccaccatccctggaaatgccttccagggcatgaacaatgaatctgtgaccctgaagctgtatggaaatggatttgaggaggtgcagagccacgccttcaacggcaccaccctgaccagcctggagctgaaggaaaatgtgcacctggagaagatgcacaatggagccttccggggggccaccggccccaagaccctgcagaacttcagccacagcatcagcgagaacttcagcaagcagtgtgagagcacagtgaggaaggtgaacaacaagaccctgtacagctccatgctggccgagagcgagctgagcggctgggactatgaatatggcttctgcctgcccaagaccccccgctgtgcccctgagccagatgccttcaacccctgtgaggacatcatgggctatgacttcctgcgggtgctgatctggctgatcaacatcctggccatcatgggcaacatgacagtgctgtttgtgctgctgaccagccgctacaagctgactgtgccccgcttcctgatgtgcaacctgagctttgctgacttctgcatgggcctgtacctgctgctgattgcctctgtggacagccagaccaagggccagtactacaaccacgccatcgactggcagacaggcagcggctgcagcacagctggcttcttcaccgtgtttgccagcgagctgtctgtgtacaccctgaccgtcatcaccctggagcgctggcacaccatcacctacgccatccacctggaccagaagctgcggctgcggcatgccatcctgatcatgctgggcggctggctgttcagcagcctgattgccatgctgcccctggtgggcgtgagcaactacatgaaggtgtccatctgcttccccatggatgtggagaccaccctgagccaggtgtacatcctgaccatcctgatcctgaatgtggtggccttcttcatcatctgtgcctgctacatcaagatctactttgctgtgaggaaccctgagctgatggccaccaacaaggacaccaagatcgccaagaagatggccatcctgatcttcacagacttcacctgcatggcccccatctccttctttgccatctctgctgccttcaaggtgcccctcatcaccgtgaccaacagcaaggtgctgctggtgctcttctaccccatcaacagctgtgccaaccccttcctgtatgccatcttcaccaagaccttccagagggacttcttcctgctgctgagcaagtttggctgctgcaagagaagagctgagctgtacagaaggaaggacttcagcgcctacaccagcaactgcaagaatggcttcaccggcagcaacaagcccagccagagcaccctgaagctgagcaccctgcactgccagggcacagccctgctggacaagacccgctacacagagtgctag

SEQ ID NO: 158165 - DNA, 978 bp, Artificial Sequence
  Description of Artificial Sequence: Synthetic coding sequence
atgaagcagcgcttcagcgccctgcagctgctgaagctgctgctgctgctgcagccccccctgccccgggccctgcgggaggccctgtgcccagagccctgcaactgtgtgcctgatggagccctgcgctgccccggccccacagctggcctgacccggctgagcctggcctacctgcctgtgaaggtgatccccagccaggccttccggggcctgaatgaagtcatcaagattgagatcagccagattgacagcctggagagaattgaggccaatgcctttgacaacctgctgaacctgtctgagatcctgatccagaacaccaagaacctgcgctacatcgagcccggggccttcatcaacctgccccggctgaagtacctgagcatctgcaacacaggcatcaggaagttcccagatgtgaccaaggtgttcagcagcgagagcaacttcatcctggagatctgtgacaacctgcacatcaccaccatccctggaaatgccttccagggcatgaacaatgaatctgtgaccctgaagctgtatggaaatggatttgaggaggtgcagagccacgccttcaacggcaccaccctgaccagcctggagctgaaggaaaatgtgcacctggagaagatgcacaatggagccttccggggggccaccggccccaagaccctggacatcagcagcaccaagctgcaggccctgcccagctatggcctggagagcatccagaggctgattgccaccagcagctacagcctgaagaagctgcccagccgggagacctttgtgaacctgctggaggccaccctgacctaccccagccactgctgtgccttcaggaacctgcccaccaaggagcagaacttcagccacagcatcagcgagaacttcagcaagcagtgtgagagcacagtgaggaaggtgaacaacaagaccctgagcaagccccgcatcaatggctaccagtag

SEQ ID NO: 158166 - DNA, 990 bp, Artificial Sequence
  Description of Artificial Sequence: Synthetic coding sequence
atgaagcagcgcttcagcgccctgcagctgctgaagctgctgctgctgctgcagccccccctgccccgggccctgcgggaggccctgtgcccagagccctgcaactgtgtgcctgatggagccctgcgctgccccggccccacagctggcctgacccggctgagcctggcctacctgcctgtgaaggtgatccccagccaggccttccggggcctgaatgaagtcatcaagattgagatcagccagattgacagcctggagagaattgaggccaatgcctttgacaacctgctgaacctgtctgagatcctgatccagaacaccaagaacctgcgctacatcgagcccggggccttcatcaacctgccccggctgaagtacctgagcatctgcaacacaggcatcaggaagttcccagatgtgaccaaggtgttcagcagcgagagcaacttcatcctggagatctgtgacaacctgcacatcaccaccatccctggaaatgccttccagggcatgaacaatgaatctgtgaccctgaagctgtatggaaatggatttgaggaggtgcagagccacgccttcaacggcaccaccctgaccagcctggagctgaaggaaaatgtgcacctggagaagatgcacaatggagccttccggggggccaccggccccaagaccctggacatcagcagcaccaagctgcaggccctgcccagctatggcctggagagcatccagaggctgattgccaccagcagctacagcctgaagaagctgcccagccgggagacctttgtgaacctgctggaggccaccctgacctaccccagccactgctgtgccttcaggaacctgcccaccaaggagcagaacttcagccacagcatcagcgagaacttcagcaagcagtgtgagagcacagtgaggaaggtgaacaacaagaccctgctgctgcatggagccctgtctgctgcccacagcctgtcctag

SEQ ID NO: 158167 - DNA, 2019 bp, Artificial Sequence
  Description of Artificial Sequence: Synthetic coding sequence
atgaagcagcgcttcagcgccctgcagctgctgaagctgctgctgctgctgcagccccccctgccccgggccctgcgggaggccctgtgcccagagccctgcaactgtgtgcctgatggagccctgcgctgccccggccccacagctggcctgacccggctgagcctggcctacctgcctgtgaaggtgatccccagccaggccttccggggcctgaatgaagtcatcaagattgagatcagccagattgacagcctggagagaattgaggccaatgcctttgacaacctgctgaacctgtctgagatcctgatccagaacaccaagaacctgcgctacatcgagcccggggccttcatcaacctgccccggctgaagtacctgagcatctgcaacacaggcatcaggaagttcccagatgtgaccaaggtgttcagcagcgagagcaacttcatcctggagatctgtgacaacctgcacatcaccaccatccctggaaatgccttccagggcatgaacaatgaatctgtgaccctgaagctgtatggaaatggatttgaggaggtgcagagccacgccttcaacggcaccaccctgaccagcctggagctgaaggaaaatgtgcacctggagaagatgcacaatggagccttccggggggccaccggccccaagaccctggacatcagcagcaccaagctgcaggccctgcccagctatggcctggagagcatccagaggctgattgccaccagcagctacagcctgaagaagctgcccagccgggagacctttgtgaacctgctggaggccaccctgacctaccccagccactgctgtgccttcaggaacctgcccaccaaggactacagctccatgctggccgagagcgagctgagcggctgggactatgaatatggcttctgcctgcccaagaccccccgctgtgcccctgagccagatgccttcaacccctgtgaggacatcatgggctatgacttcctgcgggtgctgatctggctgatcaacatcctggccatcatgggcaacatgacagtgctgtttgtgctgctgaccagccgctacaagctgactgtgccccgcttcctgatgtgcaacctgagctttgctgacttctgcatgggcctgtacctgctgctgattgcctctgtggacagccagaccaagggccagtactacaaccacgccatcgactggcagacaggcagcggctgcagcacagctggcttcttcaccgtgtttgccagcgagctgtctgtgtacaccctgaccgtcatcaccctggagcgctggcacaccatcacctacgccatccacctggaccagaagctgcggctgcggcatgccatcctgatcatgctgggcggctggctgttcagcagcctcatcgccatgctgcccctggtgggcgtgagcaactacatgaaggtgtccatctgcttccccatggatgtggagaccaccctgagccaggtgtacatcctgaccatcctgatcctgaatgtggtggccttcttcatcatctgtgcctgctacatcaagatctactttgctgtgagaaatcctgagctgatggccaccaacaaggacaccaagatcgccaagaagatggccatcctgatcttcacagacttcacctgcatggcccccatctccttctttgccatctctgctgccttcaaggtgcccctcatcaccgtgaccaacagcaaggtgctgctggtgctcttctaccccatcaacagctgtgccaaccccttcctgtatgccatcttcaccaagaccttccagagggacttcttcctgctgctgagcaagtttggctgctgcaagagaagagctgagctgtacagaaggaaggacttcagcgcctacaccagcaactgcaagaatggcttcaccggcagcaacaagcccagccagagcaccctgaagctgagcaccctgcactgccagggcacagccctgctggacaagacccgctacacagaatgttag

SEQ ID NO: 158168 - DNA, 396 bp, Artificial Sequence
  Description of Artificial Sequence: Synthetic coding sequence
atgacccccctgctgaccctcatcctggtggtgctgatgggcctgcccctggcccaggccctggactgccacgtgtgtgcctacaatggagacaactgcttcaaccccatgcgctgcccagccatggtggcctactgcatgaccaccaggaccagcgctgctgaggccatctggtgccaccagtgcaccggctttggaggctgcagccacggcagccgctgcctgcgggacagcacccactgtgtgaccacagccaccagggtgctgagcaacacagaggacctgcccctggtgaccaagatgtgccacatcggctgcccagacatccccagcctgggcctgggcccctacgtgtccatcgcctgctgccagaccagcctgtgcaaccacgactag

SEQ ID NO: 158169 - DNA, 351 bp, Artificial Sequence
  Description of Artificial Sequence: Synthetic coding sequence
atgacccccctgctgaccctcatcctggtggtgctgatgggcctgcccctggcccaggccctggactgccacgtgtgtgcctacaatggagacaactgcttcaaccccatgcgctgcccagccatggtggcctactgcatgaccaccaggacctactacacccccaccaggatgaaggtgtccaagagctgtgtgccccgctgctttgaaacagtgtatgatggctacagcaagcacgccagcaccaccagctgctgccagtatgacctgtgcaatggcaccggcctggccaccccagccaccctggccctggcccccatcctgctggccaccctgtggggcctgctgtag

SEQ ID NO: 158170 - DNA, 351 bp, Artificial Sequence; identical to SEQ ID NO: 158169
  Description of Artificial Sequence: Synthetic coding sequence

SEQ ID NO: 158171 - DNA, 351 bp, Artificial Sequence; identical to SEQ ID NO: 158169
  Description of Artificial Sequence: Synthetic coding sequence

SEQ ID NO: 158172 - DNA, 249 bp, Artificial Sequence
  Description of Artificial Sequence: Synthetic coding sequence
atgacccccctgctgaccctcatcctggtggtgctgatgggcctgcccctggcccaggccctggactgccacgtgtgtgcctacaatggagacaactgcttcaaccccatgcgctgcccagccatggtggcctactgcatgaccaccaggacctactacacccccaccaggatgaaggtgtccaagagctgtgtgccccgctgctttgaaacagtgtatgatggctacagcaagcacgccagcacctag

SEQ ID NO: 158173 - DNA, 255 bp, Artificial Sequence
  Description of Artificial Sequence: Synthetic coding sequence
atgacccccctgctgaccctcatcctggtggtgctgatgggcctgcccctggcccaggccctggactgccacgtgtgtgcctacaatggagacaactgcttcaaccccatgcgctgcccagccatggtggcctactgcatgaccaccaggacctactacacccccaccaggatgaaggtgtccaagagctgtgtgccccgctgctttgaaacagtgtatgatggctacagcaagcacgccagcaccaccagctag

SEQ ID NO: 158174 - DNA, 1041 bp, Artificial Sequence
  Description of Artificial Sequence: Synthetic coding sequence
atggaccctgccaggaaggccggggcccaggccatgatctggacagctggctggctgctgctgctgctgctgcggggcggggcccaggccctggagtgctacagctgtgtgcagaaggcagatgatggctgcagccccaacaagatgaagacagtgaagtgtgcccctggggtggatgtgtgcacagaggccgtgggcgctgtggagaccatccacggccagttcagcctggccgtgcggggctgcggcagcggcctgcccgggaagaatgaccggggcctggacctgcacggcctgctggccttcatccagctgcagcagtgtgcccaggaccgctgcaatgccaagctgaacctgaccagccgggccctggaccctgctggaaatgaaagtgcctacccacccaacggggtggagtgctacagctgtgtgggcctgagccgggaggcctgccagggcaccagcccccctgtggtgtcctgctacaatgccagtgaccacgtgtacaagggctgctttgatggaaatgtgaccctgacagctgccaacgtgacagtgtccctgcctgtgcggggctgtgtgcaggatgagttctgcaccagagatggagtgactggacctggcttcaccctgagcggcagctgctgccagggcagccgctgcaacagcgacctgaggaacaagacctacttcagcccccgcatcccccccctggtgcggctgcccccacctgagcccaccaccgtggccagcaccacctctgtgaccaccagcaccagcgcccctgtgcggcccaccagcaccaccaagcccatgcctgcccccaccagccagaccccccggcagggcgtggagcacgaggccagcagagatgaggagccccggctgactggaggagctgctggccaccaggacaggagcaacagcggccagtacccagccaagggcggcccccagcagccccacaacaagggctgtgtggcccccacagctggcctggccgccctgctgctggccgtggccgccggcgtgctgctgtag

SEQ ID NO: 158175 - DNA, 885 bp, Artificial Sequence
  Description of Artificial Sequence: Synthetic coding sequence
atggaccctgccaggaaggccggggcccaggccatgatctggacagctggctggctgctgctgctgctgctgcggggcggggcccaggccctggagtgctacagctgtgtgcagaaggcagatgatggctgcagccccaacaagatgaagacagtgaagtgtgcccctggggtggatgtgtgcacagaggccgtgggcgctgtggagaccatccacggccagttcagcctggccgtgcggggctgcggcagcggcctgcccgggaagaatgaccggggcctggacctgcacggcctgctggccttcatccagctgcagcagtgtgcccaggaccgctgcaatgccaagctgaacctgaccagccgggccctggaccctgctgctgctgccaacgtgacagtgtccctgcctgtgcggggctgtgtgcaggatgagttctgcaccagagatggagtgactggacctggcttcaccctgagcggcagctgctgccagggcagccgctgcaacagcgacctgaggaacaagacctacttcagcccccgcatcccccccctggtgcggctgcccccacctgagcccaccaccgtggccagcaccacctctgtgaccaccagcaccagcgcccctgtgcggcccaccagcaccaccaagcccatgcctgcccccaccagccagaccccccggcagggcgtggagcacgaggccagcagagatgaggagccccggctgactggaggagctgctggccaccaggacaggagcaacagcggccagtacccagccaagggcggcccccagcagccccacaacaagggctgtgtggcccccacagctggcctggccgccctgctgctggccgtggccgccggcgtgctgctgtag

SEQ ID NO: 158176 - DNA, 516 bp, Artificial Sequence
  Description of Artificial Sequence: Synthetic coding sequence
atggagcccggccctgccctggcctggctgctgctgctgagcctgctggccgactgcctgaaggccgcccagagccgggacttcaccgtgaaggacatcatctacctgcaccccagcaccaccccctacccaggcggcttcaagtgcttcacctgtgagaaggctgctgacaactatgagtgcaaccgctgggccccagacatctactgcccccgggagacccgctactgctacacccagcacaccatggaggtgacaggcaacagcatctctgtgaccaagagatgtgtgcccctggaggagtgcctgagcacaggctgccgggacagcgagcacgagggccacaaggtgtgcaccagctgctgtgagggcaacatctgcaacctgcccctgcccagaaatgaaacagatgccacctttgccaccaccagccccatcaaccagaccaacggccacccccgctgcatgtctgtgattgtgtcctgcctgtggctgtggctgggcctgatgctgtag

SEQ ID NO: 158177 - DNA, 516 bp, Artificial Sequence; identical to SEQ ID NO: 158176
  Description of Artificial Sequence: Synthetic coding sequence

SEQ ID NO: 158178 - DNA, 162 bp, Artificial Sequence
  Description of Artificial Sequence: Synthetic coding sequence
atggagcccggccctgccctggcctggctgctgctgctgagcctgctggccgactgcctgaaggccgcccagagccgggacttcaccgtgaaggacatcatctacctgcaccccagcaccaccccctacccaggcggcttcaagtgcttcacctgtgagtag

SEQ ID NO: 158179 - DNA, 969 bp, Artificial Sequence
  Description of Artificial Sequence: Synthetic coding sequence
atggcccgctgcttcagcctggtgctgctgctgaccagcatctggaccacccggctgctggtgcagggcagcctgcgggcagaggagctgagcatccaggtgtcctgccgcatcatgggcatcaccctggtgtccaagaaggccaaccagcagctgaacttcacagaggccaaggaggcctgccgcctgctgggcctgagcctggccggcaaggaccaggtggagacagccctgaaggccagctttgagacctgcagctatggctgggtgggagatggctttgtggtgatcagccgcatcagccccaaccccaagtgtgggaagaatggagtgggcgtgctgatctggaaggtgcctgtgtcccggcagtttgctgcctactgctacaacagcagtgacacctggaccaacagctgcatccctgagatcatcaccaccaaggaccccatcttcaacacccagacagccacccagaccacagagttcatcgtgtctgacagcacctacagcgtggccagcccctacagcaccatcccagcccccaccaccaccccaccagccccagccagcaccagcatccccaggaggaagaagctgatctgtgtgacagaggtgttcatggagaccagcaccatgagcacagaaacagagccctttgtggagaacaaggccgccttcaagaatgaggccgccggctttggaggagtgcccacagccctgctggtgctggccctgctcttcttcggggctgctgctggcctgggcttctgctacgtgaagcgctacgtgaaggccttccccttcaccaacaagaaccagcagaaggagatgattgagaccaaggtggtgaaggaggagaaggccaatgacagcaaccccaatgaggagagcaagaagacagacaagaaccctgaggagagcaagagccccagcaagaccaccgtgcgctgcctggaggccgaggtgtag

SEQ ID NO: 158180 - DNA, 387 bp, Artificial Sequence
  Description of Artificial Sequence: Synthetic coding sequence
atgaggacagccctgctgctgctggccgccctggccgtggccactggacctgccctgaccctgcgctgccacgtgtgcaccagcagcagcaactgcaagcacagcgtggtgtgcccagccagcagccgcttctgcaagaccaccaacacagtggagcccctgcggggcaacctggtgaagaaggactgtgccgagagctgcacccccagctacaccctgcagggccaggtgagcagcggcaccagcagcacccagtgctgccaggaggacctgtgcaatgagaagctgcacaatgctgcccccaccaggacagccctggcccacagcgccctgagcctgggcctggccctgagcctgctggccgtcatcctggcccccagcctgtag

SEQ ID NO: 158181 - DNA, 396 bp, Artificial Sequence
  Description of Artificial Sequence: Synthetic coding sequence
atgaagatcttcctgcctgtgctgctggccgccctgctgggcgtggagcgggccagcagcctgatgtgcttcagctgcctgaaccagaagagcaacctgtactgcctgaagcccaccatctgcagcgaccaggacaactactgtgtgacagtgtctgccagcgctggcatcggcaacctggtgaccttcggccacagcctgagcaagacctgcagccctgcctgccccatccctgagggcgtgaatgtgggcgtggcctccatgggcatcagctgctgccagagcttcctgtgcaacttctctgctgctgatggcggcctgcgggcctctgtgaccctgctgggcgccggcctgctgctgagcctgctgcctgccctgctgcgcttcggcccctag

SEQ ID NO: 158182 - DNA, 396 bp, Artificial Sequence; identical to SEQ ID NO: 158181
  Description of Artificial Sequence: Synthetic coding sequence

SEQ ID NO: 158183 - DNA, 267 bp, Artificial Sequence
  Description of Artificial Sequence: Synthetic coding sequence
atgaagatcttcctgcctgtgctgctggccgccctgctgggcgtggagcgggccagcagcctgatgtgcttcagctgcctgaaccagaagagcaacctgtactgcctgaagcccaccatctgcagcgaccaggacaactactgtgtgacagtgtctgccagcgctggcatcggcaacctggtgaccttcggccacagcctgagcaagacctgcagccctgcctgccccatccctgagggcgtgaatgtgggcgtggcctccatgtag

SEQ ID NO: 158184 - DNA, 396 bp, Artificial Sequence; identical to SEQ ID NO: 158181
  Description of Artificial Sequence: Synthetic coding sequence

SEQ ID NO: 158185 - DNA, 396 bp, Artificial Sequence; identical to SEQ ID NO: 158181
  Description of Artificial Sequence: Synthetic coding sequence

SEQ ID NO: 158186 - DNA, 396 bp, Artificial Sequence; identical to SEQ ID NO: 158181
  Description of Artificial Sequence: Synthetic coding sequence

SEQ ID NO: 158187 - DNA, 396 bp, Artificial Sequence; identical to SEQ ID NO: 158181
  Description of Artificial Sequence: Synthetic coding sequence

SEQ ID NO: 158188 - DNA, 396 bp, Artificial Sequence; identical to SEQ ID NO: 158181
  Description of Artificial Sequence: Synthetic coding sequence

SEQ ID NO: 158189 - DNA, 402 bp, Artificial Sequence
  Description of Artificial Sequence: Synthetic coding sequence
atgaagccccagtttgtgggcatcctgctgagcagcctgctgggcgccgccctgggcaacaggatgcgctgctacaactgtggcggcagccccagcagcagctgcaaggaggccgtgaccacctgtggggagggccggccccagcccggcctggagcagatcaagctgcccggcaacccccctgtgaccctcatccaccagcacccagcctgtgtggccgcccaccactgcaaccaggtggagacagagagcgtgggagatgtgacctacccagcccaccgggactgctacctgggggacctgtgcaacagcgctgtggccagccacgtggccccagctggcatcctggccgctgctgccacagccctgacctgcctgctgcccggcctgtggagcggctag

SEQ ID NO: 158190 - DNA, 525 bp, Artificial Sequence
  Description of Artificial Sequence: Synthetic coding sequence
atgaagccccagtttgtgggcatcctgctgagcagcctgctgggcgccgccctgggcaacaggatgcgctgctacaactgtggcggcagccccagcagcagctgcaaggaggccgtgaccacctgtggggagggccggccccagcccggcctggagcagatcaagctgcccggcaacagacgctgcttcctgcggggcctgaagatccccctgggcagcctgaagagccacctgctgtgcccccggcggcaggtgctgaagccaggagtgcagcaccccagcttcatcctgagcctgagccccagcgacctggacagccccaccagcagcctgcggcgcagccccagcctgcagagcagcggggacagagtgggcggcagaagagacctgagcagcccccagggcctgctgcccggccggcctgtgcagcagaggcggggcaagccctgtggcccctgccgccacttcggctgcagcagctacagaccagacctgagcctggccaggacagtggagcgcatctag

SEQ ID NO: 158191 - DNA, 402 bp, Artificial Sequence; identical to SEQ ID NO: 158189
  Description of Artificial Sequence: Synthetic coding sequence

SEQ ID NO: 158192 - DNA, 1149 bp, Artificial Sequence
  Description of Artificial Sequence: Synthetic coding sequence
atggctgtgctcttcctgctgctcttcctgtgtggcaccccccaggccgctgacaacatgcaggccatctacgtggccctgggggaggccgtggagctgccctgccccagcccccccaccctgcatggagatgagcacctgtcctggttctgcagccctgctgctggcagcttcaccaccctggtggcccaggtgcaggtgggccggcctgccccagaccccgggaagccaggccgggagagccggctgcggctgctgggcaactacagcctgtggctggagggcagcaaggaggaggatgctggccgctactggtgcaccgtgctgggccagcaccacaactaccagaactggagggtgtatgatgtgctggtgctgaagggcagccagctgagcgcccgggcagcagatggcagcccctgcaatgtgctgctgtgcagcgtggtgcccagcaggaggatggacagcgtgacctggcaggagggcaaaggacctgtgcggggccgggtgcagagcttctggggcagcgaggccgccctgctgctggtgtgccctggagagggcctgtctgagcccaggagcagaagaccccgcatcatccgctgcctgatgacccacaacaagggcgtgtccttcagcctggccgccagcattgatgccagccctgccctgtgtgcccccagcacaggctgggacatgccctggatcctgatgctgctgctgaccatgggccagggcgtggtgatcctggccctgagcatcgtgctgtggaggcagagggtgcggggggcccctggccggggcaacaggatgcgctgctacaactgtggcggcagccccagcagcagctgcaaggaggccgtgaccacctgtggggagggccggccccagcccggcctggagcagatcaagctgcccggcaacccccctgtgaccctcatccaccagcacccagcctgtgtggccgcccaccactgcaaccaggtggagacagaatctgtgggagatgtgacctacccagcccaccgggactgctacctgggggacctgtgcaacagcgctgtggccagccacgtggccccagctggcatcctggccgccgccgccacagccctgacctgcctgctgcccggcctgtggagcggctag

SEQ ID NO: 158193 - DNA, 402 bp, Artificial Sequence; identical to SEQ ID NO: 158189
  Description of Artificial Sequence: Synthetic coding sequence

SEQ ID NO: 158194 - DNA, 402 bp, Artificial Sequence; identical to SEQ ID NO: 158189
  Description of Artificial Sequence: Synthetic coding sequence

SEQ ID NO: 158195 - DNA, 1149 bp, Artificial Sequence
  Description of Artificial Sequence: Synthetic coding sequence
atggctgtgctcttcctgctgctcttcctgtgtggcaccccccaggccgctgacaacatgcaggccatctacgtggccctgggggaggccgtggagctgccctgccccagcccccccaccctgcatggagatgagcacctgtcctggttctgcagccctgctgctggcagcttcaccaccctggtggcccaggtgcaggtgggccggcctgccccagaccccgggaagccaggccgggagagccggctgcggctgctgggcaactacagcctgtggctggagggcagcaaggaggaggatgctggccgctactggtgtgctgtgctgggccagcaccacaactaccagaactggagggtgtatgatgtgctggtgctgaagggcagccagctgagcgcccgggcagcagatggcagcccctgcaatgtgctgctgtgcagcgtggtgcccagcaggaggatggacagcgtgacctggcaggagggcaaaggacctgtgcggggccgggtgcagagcttctggggcagcgaggccgccctgctgctggtgtgccctggagagggcctgtctgagcccaggagcagaagaccccgcatcatccgctgcctgatgacccacaacaagggcgtgtccttcagcctggccgccagcattgatgccagccctgccctgtgtgcccccagcacaggctgggacatgccctggatcctgatgctgctgctgaccatgggccagggcgtggtgatcctggccctgagcatcgtgctgtggaggcagagggtgcggggggcccctggccggggcaacaggatgcgctgctacaactgtggcggcagccccagcagcagctgcaaggaggccgtgaccacctgtggggagggccggccccagcccggcctggagcagatcaagctgcccggcaacccccctgtgaccctcatccaccagcacccagcctgtgtggccgcccaccactgcaaccaggtggagacagaatctgtgggagatgtgacctacccagcccaccgggactgctacctgggggacctgtgcaacagcgctgtggccagccacgtggccccagctggcatcctggccgccgccgccacagccctgacctgcctgctgcccggcctgtggagcggctag

SEQ ID NO: 158196 - DNA, 402 bp, Artificial Sequence
  Description of Artificial Sequence: Synthetic coding sequence
atgaagccccagtttgtgggcatcctgctgagcagcctgctgggcgccgccctgggcaacaggatgcgctgctacaactgtggcggcagccccagcagcacctgcaaggaggccgtgaccacctgtggggagggccggccccagcccggcctggagcagatcaagctgcccggcaacccccctgtgaccctcatccaccagcacccagcctgtgtggccgcccaccactgcaaccaggtggagacagagagcgtgggagatgtgacctacccagcccaccgggactgctacctgggggacctgtgcaacagcgctgtggccagccacgtggccccagctggcatcctggccgctgctgccacagccctgacctgcctgctgcccggcctgtggagcggctag

SEQ ID NO: 158197 - DNA, 402 bp, Artificial Sequence; identical to SEQ ID NO: 158189
  Description of Artificial Sequence: Synthetic coding sequence

SEQ ID NO: 158198 - DNA, 402 bp, Artificial Sequence; identical to SEQ ID NO: 158189
  Description of Artificial Sequence: Synthetic coding sequence

SEQ ID NO: 158199 - DNA, 525 bp, Artificial Sequence; identical to SEQ ID NO: 158190
  Description of Artificial Sequence: Synthetic coding sequence

SEQ ID NO: 158200 - DNA, 486 bp, Artificial Sequence
  Description of Artificial Sequence: Synthetic coding sequence
atgctggccccccagaggacccgggcccccagcccccgggccgccccccggcccaccaggtccatgctgcctgctgccatgaagggcctgggcctggccctgctggccgtgctgctgtgcagcgccccagcccacggcctgtggtgccaggactgcaccctgaccaccaacagcagccactgcacccccaagcagtgccagcccagcgacacagtgtgtgcctctgtgcgcatcacagaccccagcagcagcaggaaggaccacagcgtgaacaagatgtgtgccagcagctgtgactttgtgaagaggcacttcttcagtgactacctgatgggcttcatcaacagcggcatcctgaaggtggatgtggactgctgtgagaaggacctgtgcaatggagctgctggagctggccacagcccctgggccctggccggcggcctgctgctgagcctgggccctgccctgctgtgggccggcccctag

SEQ ID NO: 158201 - DNA, 486 bp, Artificial Sequence; identical to SEQ ID NO: 158200
  Description of Artificial Sequence: Synthetic coding sequence

SEQ ID NO: 158202 - DNA, 423 bp, Artificial Sequence
  Description of Artificial Sequence: Synthetic coding sequence
atgctgcctgctgccatgaagggcctgggcctggccctgctggccgtgctgctgtgcagcgccccagcccacggcctgtggtgccaggactgcaccctgaccaccaacagcagccactgcacccccaagcagtgccagcccagcgacacagtgtgtgcctctgtgcgcatcacagaccccagcagcagcaggaaggaccacagcgtgaacaagatgtgtgccagcagctgtgactttgtgaagaggcacttcttcagtgactacctgatgggcttcatcaacagcggcatcctgaaggtggatgtggactgctgtgagaaggacctgtgcaatggagctgctggggccggccacagcccctgggccctggccggcggcctgctgctgagcctgggccctgccctgctgtgggccggcccctag

SEQ ID NO: 158203 - DNA, 1971 bp, Artificial Sequence
  Description of Artificial Sequence: Synthetic coding sequence
atggtggcccccaagagccacacagatgactgggcccctggccccttcagcagcaagccccagaggagccagctgcagatcttcagctctgtgctgcagaccagcctgctcttcctgctgatgggcctgcgggccagcggcaaggacagcgcccccaccgtggtgtctggcatcctgggcggctctgtgaccctgcccctgaacatctctgtggacacagaaattgaaaatgtcatctggattggccccaagaatgccctggcctttgcccggcccaaggaaaatgtgaccatcatggtgaagagctacctgggccgcctggacatcaccaagtggagctacagcctgtgcatcagcaacctgaccctgaatgatgctggcagctacaaggcccagatcaaccagaggaactttgaggtgaccacagaggaggagttcaccctgtttgtgtatgagcagctgcaggagccccaggtgaccatgaagtctgtgaaggtgtctgagaacttcagctgcaacatcaccctgatgtgcagcgtgaagggagctgagaagtctgtgctgtacagctggaccccccgggagccccacgccagcgagagcaatggaggcagcatcctgactgtgtccaggaccccctgtgaccctgacctgccctacatctgcacagcccagaaccctgtgtcccagaggagcagcctgcctgtgcacgtgggccagttctgcacagatcctggggccagccggggcggcaccactggagagaccgtggtgggcgtgctgggggagcctgtgaccctgcccctggccctgcctgcctgccgggacacagagaaggtggtgtggctgttcaacaccagcatcatcagcaaggagcgggaggaggccgccacagctgaccccctcatcaagagccgggacccctacaagaacagagtgtgggtgagcagccaggactgcagcctgaagatcagccagctgaagattgaagatgctggcccctaccacgcctacgtgtgcagcgaggccagctctgtgacctccatgacccacgtgaccctgctgatctaccgccgcctgaggaagcccaagatcacctggagcctgcggcacagtgaagatggcatctgccgcatcagcctgacctgcagcgtggaggatggcggcaacacagtgatgtacacctggacccccctgcagaaggaggccgtggtgtcccagggcgagagccacctgaatgtgtcctggaggagcagcgagaaccaccccaacctgacctgcacagccagcaaccctgtgagccgcagcagccaccagttcctgtctgagaacatctgcagcggccctgagaggaacaccaagctgtggattggcctcttcctgatggtgtgcctgctgtgtgtgggcatcttctcctggtgcatctggaagaggaagggccgctgcagcgtgcctgccttctgcagcagccaggccgaggccccagctgacaccccagagcccacagctggccacaccctgtacagcgtgctgagccagggctatgagaagctggacacccccctgcggcctgcccggcagcagcccacccccaccagtgacagcagcagtgacagcaacctgaccacagaagaagatgaagatagacctgaggtgcacaagcccatcagcggccgctatgaggtgtttgaccaggtgacccaggagggcgccggccatgaccctgcccctgagggccaggccgactatgaccctgtgaccccctacgtgacagaggtggagagcgtggtgggggagaacaccatgtatgcccaggtgttcaacctgcagggcaagacccctgtgtcccagaaggaggagagcagcgccaccatctactgcagcatcaggaagccccaggtggtggtgcccccaccccagcagaatgacctggagatccctgagagccccacctatgagaacttcacctag

SEQ ID NO: 158204 - DNA, 1566 bp, Artificial Sequence
  Description of Artificial Sequence: Synthetic coding sequence
atggtggcccccaagagccacacagatgactgggcccctggccccttcagcagcaagccccagaggagccagctgcagatcttcagctctgtgctgcagaccagcctgctcttcctgctgatgggcctgcgggccagcggcaaggacagcgcccccaccgtggtgtctggcatcctgggcggctctgtgaccctgcccctgaacatctctgtggacacagaaattgaaaatgtcatctggattggccccaagaatgccctggcctttgcccggcccaaggaaaatgtgaccatcatggtgaagagctacctgggccgcctggacatcaccaagtggagctacagcctgtgcatcagcaacctgaccctgaatgatgctggcagctacaaggcccagatcaaccagaggaactttgaggtgaccacagaggaggagttcaccctgtttgtgtatgagcagctgcaggagccccaggtgaccatgaagtctgtgaaggtgtctgagaacttcagctgcaacatcaccctgatgtgcagcgtgaagggagctgagaagtctgtgctgtacagctggaccccccgggagccccacgccagcgagagcaatggaggcagcatcctgactgtgtccaggaccccctgtgaccctgacctgccctacatctgcacagcccagaaccctgtgtcccagaggagcagcctgcctgtgcacgtgggccagttctgcacagatcctggggccagccggggcggcaccactggagagaccgtggtgggcgtgctgggggagcctgtgaccctgcccctggccctgcctgcctgccgggacacagagaaggtggtgtggctgttcaacaccagcatcatcagcaaggagcgggaggaggccgccacagctgaccccctcatcaagagccgggacccctacaagaacagagtgtgggtgagcagccaggactgcagcctgaagatcagccagctgaagattgaagatgctggcccctaccacgcctacgtgtgcagcgaggccagctctgtgacctccatgacccacgtgaccctgctgatctacagacctgagaggaacaccaagctgtggattggcctcttcctgatggtgtgcctgctgtgtgtgggcatcttctcctggtgcatctggaagaggaagggccgctgcagcgtgcctgccttctgcagcagccaggccgaggccccagctgacaccccaggctatgagaagctggacacccccctgaggaagcccatcagcggccgctatgaggtgtttgaccaggtgacccaggagggcgccggccatgaccctgcccctgagggccaggccgactatgaccctgtgaccccctacgtgacagaggtggagagcgtggtgggggagaacaccatgtatgcccaggtgttcaacctgcagggcaagacccctgtgtcccagaaggaggagagcagcgccaccatctactgcagcatcaggaagccccaggtggtgcccccaccccagcagaatgacctggagatccctgagagccccacctatgagaacttcacctag

SEQ ID NO: 158205 - DNA, 813 bp, Artificial Sequence
  Description of Artificial Sequence: Synthetic coding sequence
atgacccacgtgaccctgctgatctaccgccgcctgaggaagcccaagatcacctggagcctgcggcacagtgaagatggcatctgccgcatcagcctgacctgcagcgtggaggatggcggcaacacagtgatgtacacctggacccccctgcagaaggaggccgtggtgtcccagggcgagagccacctgaatgtgtcctggaggagcagcgagaaccaccccaacctgacctgcacagccagcaaccctgtgagccgcagcagccaccagttcctgtctgagaacatctgcagcggccctgagaggaacaccaagctgtggattggcctcttcctgatggtgtgcctgctgtgtgtgggcatcttctcctggtgcatctggaagaggaagggccgctgcagcgtgcctgccttctgcagcagccaggccgaggccccagctgacaccccaggctatgagaagctggacacccccctgcggcctgcccggcagcagcccacccccaccagtgacagcagcagtgacagcaacctgaccacagaagaagatgaagatagacctgaggtgcacaagcccatcagcggccgctatgaggtgtttgaccaggtgacccaggagggcgccggccatgaccctgcccctgagggccaggccgactatgaccctgtgaccccctacgtgacagaggtggagagcgtggtgggggagaacaccatgtatgcccaggtgttcaacctgcaggtggtgcccccaccccagcagaatgacctggagatccctgagagccccacctatgagaacttcacctag

SEQ ID NO: 158206 - DNA, 813 bp, Artificial Sequence; identical to SEQ ID NO: 158205
  Description of Artificial Sequence: Synthetic coding sequence

SEQ ID NO: 158207 - DNA, 1968 bp, Artificial Sequence
  Description of Artificial Sequence: Synthetic coding sequence
atggtggcccccaagagccacacagatgactgggcccctggccccttcagcagcaagccccagaggagccagctgcagatcttcagctctgtgctgcagaccagcctgctcttcctgctgatgggcctgcgggccagcggcaaggacagcgcccccaccgtggtgtctggcatcctgggcggctctgtgaccctgcccctgaacatctctgtggacacagaaattgaaaatgtcatctggattggccccaagaatgccctggcctttgcccggcccaaggaaaatgtgaccatcatggtgaagagctacctgggccgcctggacatcaccaagtggagctacagcctgtgcatcagcaacctgaccctgaatgatgctggcagctacaaggcccagatcaaccagaggaactttgaggtgaccacagaggaggagttcaccctgtttgtgtatgagcagctgcaggagccccaggtgaccatgaagtctgtgaaggtgtctgagaacttcagctgcaacatcaccctgatgtgcagcgtgaagggagctgagaagtctgtgctgtacagctggaccccccgggagccccacgccagcgagagcaatggaggcagcatcctgactgtgtccaggaccccctgtgaccctgacctgccctacatctgcacagcccagaaccctgtgtcccagaggagcagcctgcctgtgcacgtgggccagttctgcacagatcctggggccagccggggcggcaccactggagagaccgtggtgggcgtgctgggggagcctgtgaccctgcccctggccctgcctgcctgccgggacacagagaaggtggtgtggctgttcaacaccagcatcatcagcaaggagcgggaggaggccgccacagctgaccccctcatcaagagccgggacccctacaagaacagagtgtgggtgagcagccaggactgcagcctgaagatcagccagctgaagattgaagatgctggcccctaccacgcctacgtgtgcagcgaggccagctctgtgacctccatgacccacgtgaccctgctgatctaccgccgcctgaggaagcccaagatcacctggagcctgcggcacagtgaagatggcatctgccgcatcagcctgacctgcagcgtggaggatggcggcaacacagtgatgtacacctggacccccctgcagaaggaggccgtggtgtcccagggcgagagccacctgaatgtgtcctggaggagcagcgagaaccaccccaacctgacctgcacagccagcaaccctgtgagccgcagcagccaccagttcctgtctgagaacatctgcagcggccctgagaggaacaccaagctgtggattggcctcttcctgatggtgtgcctgctgtgtgtgggcatcttctcctggtgcatctggaagaggaagggccgctgcagcgtgcctgccttctgcagcagccaggccgaggccccagctgacaccccagagcccacagctggccacaccctgtacagcgtgctgagccagggctatgagaagctggacacccccctgcggcctgcccggcagcagcccacccccaccagtgacagcagcagtgacagcaacctgaccacagaagaagatgaagatagacctgaggtgcacaagcccatcagcggccgctatgaggtgtttgaccaggtgacccaggagggcgccggccatgaccctgcccctgagggccaggccgactatgaccctgtgaccccctacgtgacagaggtggagagcgtggtgggggagaacaccatgtatgcccaggtgttcaacctgcagggcaagacccctgtgtcccagaaggaggagagcagcgccaccatctactgcagcatcaggaagccccaggtggtgcccccaccccagcagaatgacctggagatccctgagagccccacctatgagaacttcacctag

SEQ ID NO: 158208 - DNA, 1116 bp, Artificial Sequence
  Description of Artificial Sequence: Synthetic coding sequence
atggtggcccccaagagccacacagatgactgggcccctggccccttcagcagcaagccccagaggagccagctgcagatcttcagctctgtgctgcagaccagcctgctcttcctgctgatgggcctgcgggccagcggcaaggacagcgcccccaccgtggtgtctggcatcctgggcggctctgtgaccctgcccctgaacatctctgtggacacagaaattgaaaatgtcatctggattggccccaagaatgccctggcctttgcccggcccaaggaaaatgtgaccatcatggtgaagagctacctgggccgcctggacatcaccaagtggagctacagcctgtgcatcagcaacctgaccctgaatgatgctggcagctacaaggcccagatcaaccagaggaactttgaggtgaccacagaggaggagttcaccctgtttgtgtatgagcagctgcaggagccccaggtgaccatgaagtctgtgaaggtgtctgagaacttcagctgcaacatcaccctgatgtgcagcgtgaagggagctgagaagtctgtgctgtacagctggaccccccgggagccccacgccagcgagagcaatggaggcagcatcctgactgtgtccaggaccccctgtgaccctgacctgccctacatctgcacagcccagaaccctgtgtcccagaggagcagcctgcctgtgcacgtgggccagttctgcacagatcctggggccagccggggcggcaccactggagagaccgtggtgggcgtgctgggggagcctgtgaccctgcccctggccctgcctgcctgccgggacacagagaaggtggtgtggctgttcaacaccagcatcatcagcaaggagcgggaggaggccgccacagctgaccccctcatcaagagccgggacccctacaagaacagagtgtgggtgagcagccaggactgcagcctgaagatcagccagctgaagattgaagatgctggcccctaccacgcctacgtgtgcagcgaggccagctctgtgacctccatgacccacgtgaccctgctgatctaccgggagagcctgggccgggcccccatcacccgcttcctgctgtag

SEQ ID NO: 158209 - DNA, 1809 bp, Artificial Sequence
  Description of Artificial Sequence: Synthetic coding sequence
atgggcctgcgggccagcggcaaggacagcgcccccaccgtggtgtctggcatcctgggcggctctgtgaccctgcccctgaacatctctgtggacacagaaattgaaaatgtcatctggattggccccaagaatgccctggcctttgcccggcccaaggaaaatgtgaccatcatggtgaagagctacctgggccgcctggacatcaccaagtggagctacagcctgtgcatcagcaacctgaccctgaatgatgctggcagctacaaggcccagatcaaccagaggaactttgaggtgaccacagaggaggagttcaccctgtttgtgtatgagcagctgcaggagccccaggtgaccatgaagtctgtgaaggtgtctgagaacttcagctgcaacatcaccctgatgtgcagcgtgaagggagctgagaagtctgtgctgtacagctggaccccccgggagccccacgccagcgagagcaatggaggcagcatcctgactgtgtccaggaccccctgtgaccctgacctgccctacatctgcacagcccagaaccctgtgtcccagaggagcagcctgcctgtgcacgtgggccagttctgcacagatcctggggccagccggggcggcaccactggagagaccgtggtgggcgtgctgggggagcctgtgaccctgcccctggccctgcctgcctgccgggacacagagaaggtggtgtggctgttcaacaccagcatcatcagcaaggagcgggaggaggccgccacagctgaccccctcatcaagagccgggacccctacaagaacagagtgtgggtgagcagccaggactgcagcctgaagatcagccagctgaagattgaagatgctggcccctaccacgcctacgtgtgcagcgaggccagctctgtgacctccatgacccacgtgaccctgctgatctaccgccgcctgaggaagcccaagatcacctggagcctgcggcacagtgaagatggcatctgccgcatcagcctgacctgcagcgtggaggatggcggcaacacagtgatgtacacctggacccccctgcagaaggaggccgtggtgtcccagggcgagagccacctgaatgtgtcctggaggagcagcgagaaccaccccaacctgacctgcacagccagcaaccctgtgagccgcagcagccaccagttcctgtctgagaacatctgcagcggccctgagaggaacaccaagctgtggattggcctcttcctgatggtgtgcctgctgtgtgtgggcatcttctcctggtgcatctggaagaggaagggccgctgcagcgtgcctgccttctgcagcagccaggccgaggccccagctgacaccccaggctatgagaagctggacacccccctgcggcctgcccggcagcagcccacccccaccagtgacagcagcagtgacagcaacctgaccacagaagaagatgaagatagacctgaggtgcacaagcccatcagcggccgctatgaggtgtttgaccaggtgacccaggagggcgccggccatgaccctgcccctgagggccaggccgactatgaccctgtgaccccctacgtgacagaggtggagagcgtggtgggggagaacaccatgtatgcccaggtgttcaacctgcagggcaagacccctgtgtcccagaaggaggagagcagcgccaccatctactgcagcatcaggaagccccaggtggtggtgcccccaccccagcagaatgacctggagatccctgagagccccacctatgagaacttcacctag

SEQ ID NO: 158210 - DNA, 582 bp, Artificial Sequence
  Description of Artificial Sequence: Synthetic coding sequence
atggtggcccccaagagccacacagatgactgggcccctggccccttcagcagcaagccccagaggagccagctgcagatcttcagctctgtgctgcagaccagcctgctcttcctgctgatgggcctgcgggccagcggcaaggacagcgcccccaccgtggtgtctggcatcctgggcggctctgtgaccctgcccctgaacatctctgtggacacagaaattgaaaatgtcatctggattggccccaagaatgccctggcctttgcccggcccaaggaaaatgtgaccatcatggtgaagagctacctgggccgcctggacatcaccaagtggagctacagcctgtgcatcagcaacctgaccctgaatgatgctggcagctacaaggcccagatcaaccagaggaactttgaggtgaccacagaggaggagttcaccctgtttgtgtatgcccccttcatcgagaagctgtctgtgcacgtgattgaaggagaccacaggaccctgctggagggcagcggcctggagagcatcatcagcaccctggccgagccccgggtgtctgtgcgggagggctag

SEQ ID NO: 158211 - DNA, 1581 bp, Artificial Sequence
  Description of Artificial Sequence: Synthetic coding sequence
atgggcctgcgggccagcggcaaggacagcgcccccaccgtggtgtctggcatcctgggcggctctgtgaccctgcccctgaacatctctgtggacacagaaattgaaaatgtcatctggattggccccaagaatgccctggcctttgcccggcccaaggaaaatgtgaccatcatggtgaagagctacctgggccgcctggacatcaccaagtggagctacagcctgtgcatcagcaacctgaccctgaatgatgctggcagctacaaggcccagatcaaccagaggaactttgaggtgaccacagaggaggagttcaccctgtttgtgtatgagcagctgcaggagccccaggtgaccatgaagtctgtgaaggtgtctgagaacttcagctgcaacatcaccctgatgtgcagcgtgaagggagctgagaagtctgtgctgtacagctggaccccccgggagccccacgccagcgagagcaatggaggcagcatcctgactgtgtccaggaccccctgtgaccctgacctgccctacatctgcacagcccagaaccctgtgtcccagaggagcagcctgcctgtgcacgtgggccagttctgcacagatcctggggccagccggggcggcaccactggagagaccgtggtgggcgtgctgggggagcctgtgaccctgcccctggccctgcctgcctgccgggacacagagaaggtggtgtggctgttcaacaccagcatcatcagcaaggagcgggaggaggccgccacagctgaccccctcatcaagagccgggacccctacaagaacagagtgtgggtgagcagccaggactgcagcctgaagatcagccagctgaagattgaagatgctggcccctaccacgcctacgtgtgcagcgaggccagctctgtgacctccatgacccacgtgaccctgctgatctacagacctgagaggaacaccaagctgtggattggcctcttcctgatggtgtgcctgctgtgtgtgggcatcttctcctggtgcatctggaagaggaagggccgctgcagcgtgcctgccttctgcagcagccaggccgaggccccagctgacaccccagagcccacagctggccacaccctgtacagcgtgctgagccagggctatgagaagctggacacccccctgcggcctgcccggcagcagcccacccccaccagtgacagcagcagtgacagcaacctgaccacagaagaagatgaagatagacctgaggtgcacaagcccatcagcggccgctatgaggtgtttgaccaggtgacccaggagggcgccggccatgaccctgcccctgagggccaggccgactatgaccctgtgaccccctacgtgacagaggtggagagcgtggtgggggagaacaccatgtatgcccaggtgttcaacctgcagggcaagacccctgtgtcccagaaggaggagagcagcgccaccatctactgcagcatcaggaagccccaggtggtggtgcccccaccccagcagaatgacctggagatccctgagagccccacctatgagaacttcacctag

SEQ ID NO: 158212 - DNA, 1884 bp, Artificial Sequence
  Description of Artificial Sequence: Synthetic coding sequence
atggcccggggctctgtgtctgatgaggagatgatggagctgcgggaggcctttgccaaggtggacacagatggaaatggctacatctccttcaatgagctgaatgacctcttcaaggccgcctgcctgcccctgcccggctacagagtgcgggagatcacagagaacctgatggccaccggggacctggaccaggacggccgcatcagctttgatgagttcatcaagatcttccacggcctgaagagcacagatgtggccaagaccttcaggaaggccatcaacaagaaggagggcatctgtgccatcggcggcaccagcgagcagagctctgtgggcacccagcacagctacagcgaggaggagaagtatgcctttgtgaactggatcaacaaggccctggagaatgaccctgactgccgccacgtgatccccatgaaccccaacaccaatgacctcttcaatgctgtgggagatggcatcgtgctgtgcaagatgatcaacctgtctgtgcctgacaccattgatgagaggaccatcaacaagaagaagctgacccccttcaccatccaggagaacctgaacctggccctgaacagcgccagcgccatcggctgccacgtggtgaacattggagctgaggacctgaaggagggcaagccctacctggtgctgggcctgctgtggcaggtgatcaagattggcctgtttgctgacatcgagctgagcagaaatgaggccctgattgccctgctgcgggagggggagagcctggaggacctgatgaagctgagccctgaggagctgctgctgcgctgggccaactaccacctggagaatgccggctgcaacaagattggcaacttcagcacagacatcaaggacagcaaggcctactaccacctgctggagcaggtggcccccaagggagatgaggagggcgtgcctgctgtggtgattgacatgagcggcctgcgggagaaggatgacatccagagagctgagtgcatgctgcagcaggccgagcggctgggctgccggcagtttgtgacagccacagatgtggtgcggggcaaccccaagctgaacctggccttcatcgccaacctcttcaaccgctacccagccctgcacaagccagagaaccaggacatcgactggggcgccctggagggggagacccgggaggagaggaccttcaggaactggatgaacagcctgggcgtgaacccccgggtgaaccacctgtacagcgacctgagtgatgccctggtgatcttccagctgtatgagaagatcaaggtgcctgtggactggaacagagtgaacaagccaccctaccccaagctgggcggcaacatgaagaagctggagaactgcaactatgctgtggagctgggcaagaaccaggccaagttcagcctggtgggcatcggcggccaggacctgaatgaaggcaacagaaccctgaccctggccctgatctggcagctgatgaggcgctacaccctgaacatcctggaggagatcggcggcggccagaaggtgaatgatgacatcatcgtgaactgggtgaatgagaccctgcgggaggccaagaagagcagcagcatcagcagcttcaaggaccccaagatcagcaccagcctgcctgtgctggacctgattgatgccatccagcccggcagcatcaactatgacctgctgaagacagagaacctgaatgatgatgagaagctgaacaatgccaagtatgccatctccatggccaggaagattggagcccgggtgtatgccctgcctgaggacctggtggaggtgaaccccaagatggtgatgacagtgtttgcctgcctgatgggcaagggcatgaagagggtgtag

SEQ ID NO: 158213 - DNA, 1884 bp, Artificial Sequence; identical to SEQ ID NO: 158212
  Description of Artificial Sequence: Synthetic coding sequence

SEQ ID NO: 158214 - DNA, 741 bp, Artificial Sequence
  Description of Artificial Sequence: Synthetic coding sequence
atggcccggggctctgtgtctgatgaggagatgatggagctgcgggaggcctttgccaaggtggacacagatggaaatggctacatctccttcaatgagctgaatgacctcttcaaggccgcctgcctgcccctgcccggctacagagtgcgggagatcacagagaacctgatggccaccggggacctggaccaggacggccgcatcagctttgatgagttcatcaagatcttccacggcctgaagagcacagatgtggccaagaccttcaggaaggccatcaacaagaaggagggcatctgtgccatcggcggcaccagcgagcagagctctgtgggcacccagcacagctacagcgaggaggagaagtatgcctttgtgaactggatcaacaaggccctggagaatgaccctgactgccgccacgtgatccccatgaaccccaacaccaatgacctcttcaatgctgtgggagatggcatcgtgctgtgcaagatgatcaacctgtctgtgcctgacaccattgatgagaggaccatcaacaagaagaagctgacccccttcaccatccaggagaacctgaacctggccctgaacagcgccagcgccatcggctgccacgtggtgaacattggagctgaggacctgaaggagggcaagccctacctggtgctgggcctgctgtggcaggtgatcaagattggcctgtttgctgacatcgagctgagcagaaatgaatag

SEQ ID NO: 158215 - DNA, 591 bp, Artificial Sequence
  Description of Artificial Sequence: Synthetic coding sequence
atgtgtgccgaggatggagacagcaagttctccatgagcatctccatgaacagccccttcctggagatcctgcacctggagaactgcaactatgctgtggagctgggcaagaaccaggccaagttcagcctggtgggcattggaggccaggacctgaatgaaggcaacagaaccctgaccctggccctgatctggcagctgatgaggcgctacaccctgaacatcctggaggagattggaggcggccagaaggtgaatgatgacatcatcgtgaactgggtgaatgagaccctgcgggaggccaagaagagcagcagcatcagcagcttcaaggaccccaagatcagcaccagcctgcctgtgctggacctgattgatgccatccagcccggcagcatcaactatgacctgctgaagacagagaacctgaatgatgatgagaagctgaacaatgccaagtatgccatctccatggccaggaagatcggggcccgggtgtatgccctgcctgaggacctggtggaggtgaaccccaagatggtgatgacagtgtttgcctgcctgatgggcaagggcatgaagagggtgtag

SEQ ID NO: 158216 - DNA, 201 bp, Artificial Sequence
  Description of Artificial Sequence: Synthetic coding sequence
atggcccggggctctgtgtctgatgaggagatgatggagctgcgggaggcctttgccaaggtggacacagatggaaatggctacatctccttcaatgagctgaatgacctcttcaaggccgcctgcctgcccctgcccggctacagagtgcgggagatcacagagaacctgatggccaccggggacctggaccaggactag

SEQ ID NO: 158217 - DNA, 1602 bp, Artificial Sequence
  Description of Artificial Sequence: Synthetic coding sequence
atggccctgagaaatgtgcccttccgctctgaggtgctgggctgggaccctgacagcctggccgactacttcaagaagctgaactacaaggactgtgagaaggctgtgaagaagtaccacattgatggagcccgcttcctgaacctgacagaaaatgacatccagaagttccccaagctgcgggtgcccatcctgagcaagctgagccaggagatcaacaagaatgaggagcggcgcagcatcttcaccaggaagccccaggtgccccgcttccctgaggagacagagagccatgaggaggacaatggaggctggagcagctttgaggaggatgattatgagagccccaatgatgaccaggatggagaagatgatggagactatgagagccccaatgaggaggaggaggcccctgtggaggatgatgctgactatgagcccccacccagcaatgatgaggaggccctgcagaacagcatcctgcctgccaagcccttccccaacagcaacagcatgtacatcgacaggcctccttctgggaagaccccccagcagccccctgtgcccccccagaggcccatggccgccctgcccccacctcctgctggcaggaaccacagccccctgcccccaccccagaccaaccacgaggagcccagccgcagcaggaaccacaagacagccaagctgcctgcccccagcattgacaggagcaccaagccacccctggacaggagcctggccccctttgaccgggagcccttcaccctgggcaagaagccacccttcagtgacaagcccagcatcccagctggccgcagcctgggggagcacctgcccaagatccagaagccacccctgccccccaccacagaaagacatgagaggagcagccccctgcccgggaagaagccccctgtgcccaagcacggctggggccctgaccggcgggagaatgatgaagatgatgtgcaccagaggcccctgccccagcctgccctgctgcccatgagcagcaacaccttccccagccgcagcaccaagcccagccccatgaaccccctgcccagcagccacatgcctggggccttcagcgagagcaacagcagcttcccccagagcgccagcctgcccccctacttcagccagggccccagcaacagaccacccatccgggcagagggcaggaacttccccctgcccctgcccaacaagccccggccccccagccctgctgaggaggagaacagcctgaatgaggagtggtacgtgtcctacatcaccaggcctgaggccgaggccgccctgaggaagatcaaccaggacggcaccttcctggtgcgggacagcagcaagaagaccaccaccaacccctacgtgctgatggtgctgtacaaggacaaggtgtacaacatccagatccgctaccagaaggagagccaggtgtacctgctgggcaccggcctgcggggcaaggaggacttcctgtctgtgtctgacatcatcgactacttcaggaagatgcccctgctgctgattgatggcaagaacagaggcagccgctaccagtgcaccctgacccatgctgctggctacccctag

SEQ ID NO: 158218 - DNA, 1578 bp, Artificial Sequence
  Description of Artificial Sequence: Synthetic coding sequence
atgtgggaggcccagttcctgggcctgctcttcctgcagcccctgtgggtggcccctgtgaagcccctgcagcctggagctgaggtgcctgtggtgtgggcccaggagggcgccccagcccagctgccctgcagccccaccatccccctgcaggacctgagcctgctgcggcgggccggcgtgacctggcagcaccagccagattctggccccccagctgctgcccctggccaccccctggcccctggcccccaccctgctgcccccagctcctggggcccccggccccggcgctacacagtgctgtctgtgggccctgggggcctgcggagcggccgcctgcccctgcagccccgggtgcagctggatgagcggggccggcagagaggagacttcagcctgtggctgcggcctgcccggcgggcagatgctggggagtacagagctgctgtgcacctgcgggaccgggccctgagctgccgcctgcggctgcggctgggccaggcctccatgacagccagccccccaggcagcctgcgggccagtgactgggtgatcctgaactgcagcttcagcaggccagacaggcctgcctctgtgcactggttcaggaacagaggccagggccgggtgcctgtgcgggagagcccccaccaccacctggccgagagcttcctgttcctgccccaggtgagccccatggacagcggcccctggggctgcatcctgacctacagagatggcttcaacgtgtccatcatgtacaacctgactgtgctgggcctggagccccccacccccctgactgtgtatgctggggccggcagccgggtgggcctgccctgccgcctgcctgctggggtgggcaccaggagcttcctgacagccaagtggaccccacctgggggcggccctgacctgctggtgactggagacaatggagacttcaccctgcggctggaggatgtgtcccaggcccaggccggcacctacacctgccacatccacctgcaggagcagcagctgaatgccaccgtgaccctggccatcatcaccgtgacccccaagagctttggcagccctggcagcctgggcaagctgctgtgtgaggtgacccctgtgtctggccaggagagatttgtgtggagcagcctggacacccccagccagaggagcttcagcggcccctggctggaggcccaggaggcccagctgctgagccagccctggcagtgccagctgtaccagggcgagcggctgctgggcgctgctgtgtacttcacagagctgagcagccctggggcccagaggagcggccgggcccctggggccctgcctgctggccacctgctgctcttcctgatcctgggcgtgctgagcctgctgctgctggtgactggagccttcggcttccacctgtggaggcggcagtggaggccccggcgcttcagcgccctggagcagggcatccaccccccccaggcccagagcaagattgaggagctggagcaggagcctgagcctgagcctgagcctgagcctgagcctgagcctgagcctgagcctgagcagctgtag

SEQ ID NO: 158219 - DNA, 1020 bp, Artificial Sequence
  Description of Artificial Sequence: Synthetic coding sequence
atggccgaggccagcagtgaccccggggctgaggagcgggaggagctgctgggccccacagcccagtggagcgtggaggatgaggaggaggccgtgcatgagcagtgccagcacgagcgggaccggcagctgcaggcccaggatgaggagggcggcggccacgtgcctgagcggcccaagcaggagatgctgctgagcctgaagcccagcgaggcccctgagctggatgaagatgagggctttggagactggagccagaggcctgagcagaggcagcagcacgagggcgcccagggcgccctggacagcggggagcccccccagtgccgcagccctgagggggagcaggaggaccggcccggcctgcacgcctatgagaaggaggacagtgatgaggtgcacctggaggagctgagcctgagcaaggagggccctggccctgaggacacagtgcaggacaacctgggcgccgccggggctgaggaggagcaggaggagcaccagaagtgccagcagcccaggacccccagccccctggtgctggagggcaccatcgagcagagcagcccccccctgagccccaccaccaagctgattgacagaacagagagcctgaacagaagcattgagaagagcaacagcgtgaagaagagccagcctgacctgcccatcagcaagattgaccagtggctggagcagtacacccaggccatcgagacagctggccgcacccccaagctggcccggcaggccagcattgagctgcccagcatggctgtggccagcaccaagagccgctgggagactggagaggtgcaggcccagagcgctgccaagacccccagctgcaaggacatcgtggccggggacatgagcaagaagagcctgtgggagcagaagggcggcagcaagaccagcagcaccatcaagagcacccccagcggcaagcgctacaagtttgtggccactggacatggcaagtatgagaaggtgctggtggagggcggccctgccccctag

SEQ ID NO: 158220 - DNA, 834 bp, Artificial Sequence
  Description of Artificial Sequence: Synthetic coding sequence
atgctgctgagcctgaagcccagcgaggcccctgagctggatgaagatgagggctttggagactggagccagaggcctgagcagaggcagcagcacgagggcgcccagggcgccctggacagcggggagcccccccagtgccgcagccctgagggggagcaggaggaccggcccggcctgcacgcctatgagaaggaggacagtgatgaggtgcacctggaggagctgagcctgagcaaggagggccctggccctgaggacacagtgcaggacaacctgggcgccgccggggctgaggaggagcaggaggagcaccagaagtgccagcagcccaggacccccagccccctggtgctggagggcaccatcgagcagagcagcccccccctgagccccaccaccaagctgattgacagaacagagagcctgaacagaagcattgagaagagcaacagcgtgaagaagagccagcctgacctgcccatcagcaagattgaccagtggctggagcagtacacccaggccatcgagacagctggccgcacccccaagctggcccggcaggccagcattgagctgcccagcatggctgtggccagcaccaagagccgctgggagactggagaggtgcaggcccagagcgctgccaagacccccagctgcaaggacatcgtggccggggacatgagcaagaagagcctgtgggagcagaagggcggcagcaagaccagcagcaccatcaagagcacccccagcggcaagcgctacaagtttgtggccactggacatggcaagtatgagaaggtgctggtggagggcggccctgccccctag

SEQ ID NO: 158221 - DNA, 834 bp, Artificial Sequence; identical to SEQ ID NO: 158220
  Description of Artificial Sequence: Synthetic coding sequence

SEQ ID NO: 158222 - DNA, 669 bp, Artificial Sequence
  Description of Artificial Sequence: Synthetic coding sequence
atgctgctgagcctgaagcccagcgaggcccctgagctggatgaagatgagggctttggagactggagccagaggcctgagcagaggcagcagcacgagggcgcccagggcgccctggacagcggggagcccccccagtgccgcagccctgagggggagcaggaggaccggcccggcctgcacgcctatgagaaggaggacagtgatgaggtgcacctggaggagctgagcctgagcaaggagggccctggccctgaggacacagtgcaggacaacctgggcgccgccggggctgaggaggagcaggaggagcaccagaagtgccagcagcccaggacccccagccccctggtgctggagggcaccatcgagcagagcagcccccccctgagccccaccaccaagctgattgacagaacagagagcctgaacagaagcattgagaagagcaacagcgtgaagaagagccagcctgacctgcccatcagcaagattgaccagtggctggagcagtacacccaggccatcgagacagctggccgcacccccaagctggcccggcaggccagcattgagctgcccagcatggctgtggccagcaccaagagccgctgggagactggagaggtgcaggcccagagcgctgccaagacccccagctgcaagtag

SEQ ID NO: 158223 - DNA, 183 bp, Artificial Sequence
  Description of Artificial Sequence: Synthetic coding sequence
atgctgctgagcctgaagcccagcgaggcccctgagctggatgaagatgagggctttggagactggagccagaggcctgagcagaggcagcagcacgagggcgcccagggcgccctggacagcggggagcccccccagtgccgcagccctgagggggagcaggaggaccggcccggcctgtag

SEQ ID NO: 158224 - DNA, 669 bp, Artificial Sequence; identical to SEQ ID NO: 158222
  Description of Artificial Sequence: Synthetic coding sequence

SEQ ID NO: 158225 - DNA, 381 bp, Artificial Sequence
  Description of Artificial Sequence: Synthetic coding sequence
atgctgctgagcctgaagcccagcgaggcccctgagctggatgaagatgagggctttggagactggagccagaggcctgagcagaggcagcagcacgagggcgcccagggcgccctggacagcggggagcccccccagtgccgcagccctgagggggagcaggaggaccggcccggcctgcacgcctatgagaaggaggacagtgatgaggtgcacctggaggagctgagcctgagcaaggagggccctggccctgaggacacagtgcaggacaacctgggcgccgccggggctgaggaggagcaggaggagcaccagaagtgccagcagcccaggacccccagccccctggtgctggagggcaccatcgagcagagctag

SEQ ID NO: 158226 - DNA, 195 bp, Artificial Sequence
  Description of Artificial Sequence: Synthetic coding sequence
atgctgctgagcctgaagcccagcgaggcccctgagctggatgaagatgagggctttggagactggagccagaggcctgagcagaggcagcagcacgagggcgcccagggcgccctggacagcggggagcccccccagtgccgcagccctgagggggagcaggaggaccggcccggcctgcacgcctatgaatag

SEQ ID NO: 158227 - DNA, 1404 bp, Artificial Sequence
  Description of Artificial Sequence: Synthetic coding sequence
atggcccccatctggagccccccaggccgggtgtctggctgccacctgagcagcggccctgcccctggcagcgctgtgggcccctggctgggcaccccccaccccagcctgcccctgcccctggccccccacaagcccccacctcctggcctgcccggcagcgctggccagaccagcctgcctgcccagagagaatgtgtgtttcctggagatgctgctgtgcaccaggagctgtgtggcctgggctttgaagaatgtctgggcagcatcccccaggcccaccagtgctacctgaccaacggccccaagaggaggaagtgcagccccaggagaagaggccgggccccagcctggctgtgtggcggcagccccccctgccaccagggcctgggccacgagcaccccagcagcggccccagcaccaactgcagcccccggcccacagcccagtggagcgtggaggatgaggaggaggccgtgcatgagcagtgccagcacgagcgggaccggcagctgcaggcccaggatgaggagggcggcggccacgtgcctgagcggcccaagcaggagatgctgctgagcctgaagcccagcgaggcccctgagctggatgaagatgagggctttggagactggagccagaggcctgagcagaggcagcagcacgagggcgcccagggcgccctggacagcggggagcccccccagtgccgcagccctgagggggagcaggaggaccggcccggcctgcacgcctatgagaaggaggacagtgatgaggtgcacctggaggagctgagcctgagcaaggagggccctggccctgaggacacagtgcaggacaacctgggcgccgccggggctgaggaggagcaggaggagcaccagaagtgccagcagcccaggacccccagccccctggtgctggagggcaccatcgagcagagcagcccccccctgagccccaccaccaagctgattgacagaacagagagcctgaacagaagcattgagaagagcaacagcgtgaagaagagccagcctgacctgcccatcagcaagattgaccagtggctggagcagtacacccaggccatcgagacagctggccgcacccccaagctggcccggcaggccagcattgagctgcccagcatggctgtggccagcaccaagagccgctgggagactggagaggtgcaggcccagagcgctgccaagacccccagctgcaaggacatcgtggccggggacatgagcaagaagagcctgtgggagcagaagggcggcagcaagaccagcagcaccatcaagagcacccccagcggcaagcgctacaagtttgtggccactggacatggcaagtatgagaaggtgctggtggagggcggccctgccccctag

SEQ ID NO: 158228 - DNA, 618 bp, Artificial Sequence
  Description of Artificial Sequence: Synthetic coding sequence
atgaccccacctgagcggctcttcctgccccgggtgtgtggcaccaccctgcacctgctgctgctgggcctgctgctggtgctgctgcccggggcccagggcctgcccggggtgggcctgaccccatctgctgcccagacagcccggcagcaccccaagatgcacctggcccacagcaacctgaagccagctgcccacctgattggagaccccagcaagcagaacagcctgctgtggagggccaacacagaccgggccttcctgcaggacggcttcagcctgagcaacaacagcctgctggtgcccaccagcggcatctactttgtgtacagccaggtggtgttcagcggcaaggcctacagccccaaggccaccagcagccccctgtacctggcccacgaggtgcagctgttcagcagccagtaccccttccacgtgcccctgctgagcagccagaagatggtgtacccaggcctgcaggagccctggctgcacagcatgtaccatggagctgccttccagctgacccagggcgaccagctgagcacccacacagatggcatcccccacctggtgctgagccccagcacagtgttcttcggggcctttgccctgtag

SEQ ID NO: 158229 - DNA, 618 bp, Artificial Sequence; identical to SEQ ID NO: 158228
  Description of Artificial Sequence: Synthetic coding sequence

SEQ ID NO: 158230 - DNA, 618 bp, Artificial Sequence
  Description of Artificial Sequence: Synthetic coding sequence
atgaccccacctgagcggctcttcctgccccgggtgtgtggcaccaccctgcacctgctgctgctgggcctgctgctggtgctgctgcccggggcccagggcctgcccggggtgggcctgaccccatctgctgcccagacagcccggcagcaccccaagatgcacctggcccacagcaccctgaagccagctgcccacctgattggagaccccagcaagcagaacagcctgctgtggagggccaacacagaccgggccttcctgcaggacggcttcagcctgagcaacaacagcctgctggtgcccaccagcggcatctactttgtgtacagccaggtggtgttcagcggcaaggcctacagccccaaggccaccagcagccccctgtacctggcccacgaggtgcagctgttcagcagccagtaccccttccacgtgcccctgctgagcagccagaagatggtgtacccaggcctgcaggagccctggctgcacagcatgtaccatggagctgccttccagctgacccagggcgaccagctgagcacccacacagatggcatcccccacctggtgctgagccccagcacagtgttcttcggggcctttgccctgtag

SEQ ID NO: 158231 - DNA, 618 bp, Artificial Sequence; identical to SEQ ID NO: 158230
  Description of Artificial Sequence: Synthetic coding sequence

SEQ ID NO: 158232 - DNA, 618 bp, Artificial Sequence; identical to SEQ ID NO: 158230
  Description of Artificial Sequence: Synthetic coding sequence

SEQ ID NO: 158233 - DNA, 618 bp, Artificial Sequence
  Description of Artificial Sequence: Synthetic coding sequence
atgaccccacctgagcggctcttcctgccccgggtgcggggcaccaccctgcacctgctgctgctgggcctgctgctggtgctgctgcccggggcccagggcctgcccggggtgggcctgaccccatctgctgcccagacagcccggcagcaccccaagatgcacctggcccacagcaccctgaagccagctgcccacctgattggagaccccagcaagcagaacagcctgctgtggagggccaacacagaccgggccttcctgcaggacggcttcagcctgagcaacaacagcctgctggtgcccaccagcggcatctactttgtgtacagccaggtggtgttcagcggcaaggcctacagccccaaggccaccagcagccccctgtacctggcccacgaggtgcagctgttcagcagccagtaccccttccacgtgcccctgctgagcagccagaagatggtgtacccaggcctgcaggagccctggctgcacagcatgtaccatggagctgccttccagctgacccagggcgaccagctgagcacccacacagatggcatcccccacctggtgctgagccccagcacagtgttcttcggggcctttgccctgtag

SEQ ID NO: 158234 - DNA, 618 bp, Artificial Sequence; identical to SEQ ID NO: 158230
  Description of Artificial Sequence: Synthetic coding sequence

SEQ ID NO: 158235 - DNA, 417 bp, Artificial Sequence
  Description of Artificial Sequence: Synthetic coding sequence
atgaccccacctgagcggctcttcctgccccgggtgtgtggcaccaccctgcacctgctgctgctgggcctgctgctggtgctgctgcccggggcccagggcctgcccggggtgggcctgaccccatctgctgcccagacagcccggcagcaccccaagatgcacctggcccacagcaccctgaagccagctgcccacctgattggagaccccagcaagcagaacagcctgctgtggagggccaacacagaccgggccttcctgcaggacggcttcagcctgagcaacaacagcctgctggtgcccaccagcggcatctactttgtgtacagccagggcagcagcccccccctgctgtggcccttccagcagctgaagagcagcctcatcaagagccctgagctgagcaagaagtag

SEQ ID NO: 158236 - DNA, 618 bp, Artificial Sequence; identical to SEQ ID NO: 158233
  Description of Artificial Sequence: Synthetic coding sequence

SEQ ID NO: 158237 - DNA, 618 bp, Artificial Sequence; identical to SEQ ID NO: 158233
  Description of Artificial Sequence: Synthetic coding sequence

SEQ ID NO: 158238 - DNA, 618 bp, Artificial Sequence; identical to SEQ ID NO: 158230
  Description of Artificial Sequence: Synthetic coding sequence

SEQ ID NO: 158239 - DNA, 618 bp, Artificial Sequence; identical to SEQ ID NO: 158230
  Description of Artificial Sequence: Synthetic coding sequence

SEQ ID NO: 158240 - DNA, 618 bp, Artificial Sequence; identical to SEQ ID NO: 158233
  Description of Artificial Sequence: Synthetic coding sequence

SEQ ID NO: 158241 - DNA, 417 bp, Artificial Sequence
  Description of Artificial Sequence: Synthetic coding sequence
atgaccccacctgagcggctcttcctgccccgggtgcggggcaccaccctgcacctgctgctgctgggcctgctgctggtgctgctgcccggggcccagggcctgcccggggtgggcctgaccccatctgctgcccagacagcccggcagcaccccaagatgcacctggcccacagcaccctgaagccagctgcccacctgattggagaccccagcaagcagaacagcctgctgtggagggccaacacagaccgggccttcctgcaggacggcttcagcctgagcaacaacagcctgctggtgcccaccagcggcatctactttgtgtacagccagggcagcagcccccccctgctgtggcccttccagcagctgaagagcagcctcatcaagagccctgagctgagcaagaagtag

SEQ ID NO: 158242 - DNA, 474 bp, Artificial Sequence
  Description of Artificial Sequence: Synthetic coding sequence
atgaccccacctgagcggctcttcctgccccgggtgtgtggcaccaccctgcacctgctgctgctgggcctgctgctggtgctgctgcccggggcccagggcctgcccggggtgggcctgaccccatctgctgcccagacagcccggcagcaccccaagatgcacctggcccacagcaacctgaagccagctgcccacctgattggagaccccagcaagcagaacagcctgctgtggagggccaacacagaccgggccttcctgcaggacggcttcagcctgagcaacaacagcctgctggtgcccaccagcggcatctactttgtgtacagccagctgcctgaagatggagtgtccagagctgctggcaccctggccgccctggatgtgccccggggctgtgtgcctgcccaccctggccggcctgccatccacccccaccgctggcaccccccacccagcccccagccctag

SEQ ID NO: 158243 - DNA, 417 bp, Artificial Sequence; identical to SEQ ID NO: 158235
  Description of Artificial Sequence: Synthetic coding sequence

SEQ ID NO: 158244 - DNA, 417 bp, Artificial Sequence; identical to SEQ ID NO: 158235
  Description of Artificial Sequence: Synthetic coding sequence

SEQ ID NO: 158245 - DNA, 417 bp, Artificial Sequence; identical to SEQ ID NO: 158241
  Description of Artificial Sequence: Synthetic coding sequence

SEQ ID NO: 158246 - DNA, 735 bp, Artificial Sequence
  Description of Artificial Sequence: Synthetic coding sequence
atgggcgccctgggcctggagggccggggcggccgcctgcagggccggggcagcctgctgctggccgtggccggggccaccagcctggtgaccctgctgctggccgtgcccatcaccgtgctggccgtgctggccctggtgccccaggaccagggcggcctggtgacagaaacagctgaccccggggcccaggcccagcagggcctgggcttccagaagctgcctgaggaggagcctgagacagacctgagccctggcctgcctgctgcccacctgattggagcccccctgaagggccagggcctgggctgggagaccaccaaggagcaggccttcctgaccagcggcacccagttcagtgatgctgagggcctggccctgccccaggacggcctgtactacctgtactgcctggtgggctaccggggccgggcccctcctgggggcggggacccccagggccgctctgtgaccctgcggagcagcctgtaccgggccggcggggcctacggccctggcaccccagagctgctgctggagggcgctgagaccgtgacccctgtgctggaccctgcccggcggcagggctacggccccctgtggtacacctctgtgggctttggaggcctggtgcagctgcggcggggggagcgggtgtatgtgaacatcagccacccagacatggtggactttgcccggggcaagaccttcttcggggctgtgatggtgggctag

SEQ ID NO: 158247 - DNA, 735 bp, Artificial Sequence; identical to SEQ ID NO: 158246
  Description of Artificial Sequence: Synthetic coding sequence

SEQ ID NO: 158248 - DNA, 735 bp, Artificial Sequence; identical to SEQ ID NO: 158246
  Description of Artificial Sequence: Synthetic coding sequence

SEQ ID NO: 158249 - DNA, 735 bp, Artificial Sequence; identical to SEQ ID NO: 158246
  Description of Artificial Sequence: Synthetic coding sequence

SEQ ID NO: 158250 - DNA, 735 bp, Artificial Sequence; identical to SEQ ID NO: 158246
  Description of Artificial Sequence: Synthetic coding sequence

SEQ ID NO: 158251 - DNA, 735 bp, Artificial Sequence; identical to SEQ ID NO: 158246
  Description of Artificial Sequence: Synthetic coding sequence

SEQ ID NO: 158252 - DNA, 234 bp, Artificial Sequence
  Description of Artificial Sequence: Synthetic coding sequence
atgggcgccctgggcctggagggccggggcggccgcctgcagggccggggcagcctgctgctggccgtggccggggccaccagcctggtgaccctgctgctggccgtgcccatcaccgtgctggccgtgctggccctggtgccccaggaccagggcggcctgggcttccgcagctgccagaggaggagccagaagcagatcagcgcccctggcagccagctgcccaccagctag

SEQ ID NO: 158253 - DNA, 735 bp, Artificial Sequence; identical to SEQ ID NO: 158246
  Description of Artificial Sequence: Synthetic coding sequence

SEQ ID NO: 158254 - DNA, 735 bp, Artificial Sequence; identical to SEQ ID NO: 158246
  Description of Artificial Sequence: Synthetic coding sequence

SEQ ID NO: 158255 - DNA, 276 bp, Artificial Sequence
  Description of Artificial Sequence: Synthetic coding sequence
atggccgccagcagccgggcccaggtgctgagcctgtaccgggccatgctgcgggagagcaagcgcttcagcgcctacaactaccgcacctatgctgtgcggcgcatcagagatgccttccgggagaacaagaatgtgaaggaccctgtggagatccagaccctggtgaacaaggccaagagggacctgggcgtcatccggcggcaggtgcacatcggccagctgtacagcacagacaagctgatcatcgagaacagagacatgcccaggacatag

SEQ ID NO: 158256 - DNA, 393 bp, Artificial Sequence
  Description of Artificial Sequence: Synthetic coding sequence
atggccgccagcagccgggcccaggtgctgagcctgtaccgggccatgctgcgggagagcaagcgcttcagcgcctacaactaccgcacctatgctgtgcggcgcatcagagatgccttccgggagaacaagaatgtgaaggaccctgtggagatccagaccctggtgaacaaggccaagagggacctgggcgtcatccggcggcagatggacagccacagcgtggcccaggccggcgtgcactggaatgacctgagcagcctgcagcccctgcccccctggttcaagcagttcagctgcctgagcctgcccagctcctgggactacagaaggaccccaccccggctggccaacttctgcatcctgagcagagatgtgatcagcctgtactag

SEQ ID NO: 158257 - DNA, 291 bp, Artificial Sequence
  Description of Artificial Sequence: Synthetic coding sequence
atggccgccagcagccgggcccaggtgctgagcctgtaccgggccatgctgcgggagagcaagcgcttcagcgcctacaactaccgcacctatgctgtgcggcgcatcagagatgccttccgggagaacaagaatgtgaaggaccctgtggagatccagaccctggtgaacaaggccaagagggacctgggcgtcatccggcggcaggtggccgagcagggcacagctgcccggaggaagagcggcaacagcagccgcagcctgggcaagccctgcacctcctggccctag

SEQ ID NO: 158258 - DNA, 2559 bp, Artificial Sequence
  Description of Artificial Sequence: Synthetic coding sequence
atgctgagcggcaagaaggctgctgctgctgctgctgctgctgctgctgctgccactggaacagaagctggccctggaacagctgggggctctgaaaatggaagtgaggtggccgcccagcctgctggcctgagcggccctgctgaggtgggccctggagctgtgggggagaggacccccaggaagaaggagcccccccgggccagccccccaggcggcctggccgagcccccaggcagcgctggcccccaggccggccccaccgtggtgcccggcagcgccacccccatggagactggaattgctgagaccccagagggccgccgcaccagcaggaggaagagggccaaggtggagtaccgggagatggatgagagcctggccaacctgtctgaagatgagtactacagcgaggaggagagaaatgccaaggccgagaaggagaagaagctgcccccacctccaccccaggcccctcctgaggaggagaatgaaagtgagcctgaggagcccagcggcgtggagggcgccgccttccagagccggctgccccatgacaggatgaccagccaggaggccgcctgcttcccagacatcatcagcggcccccagcagacccagaaggtgttcctgttcatccggaacagaaccctgcagctgtggctggacaaccccaagatccagctgacctttgaggccaccctgcagcagctggaggccccctacaacagcgacacagtgctggtgcaccgggtgcacagctacctggagagacatggcctcatcaactttggcatctacaagaggatcaagcccctgcccaccaagaagacaggcaaggtgatcatcatcggcagcggcgtgtctggcctggccgccgcccggcagctgcagagctttggcatggatgtgaccctgctggaggcccgggacagagtgggcggccgggtggccaccttcaggaagggcaactacgtggccgacctgggcgccatggtggtgacaggcctgggcggcaaccccatggctgtggtgtccaagcaggtgaacatggagctggccaagatcaagcagaagtgccccctgtatgaggccaacggccaggccgtgcccaaggagaaggatgagatggtggagcaggagttcaaccggctgctggaggccaccagctacctgagccaccagctggacttcaacgtgctgaacaacaagcctgtgtccctgggccaggccctggaggtggtgatccagctgcaggagaagcacgtgaaggatgagcagatcgagcactggaagaagatcgtgaagacccaggaggagctgaaggagctgctgaacaagatggtgaacctgaaggagaagatcaaggagctgcaccagcagtacaaggaggccagcgaggtgaagccaccccgggacatcacagctgagttcctggtgaagagcaagcaccgggacctgacagccctgtgcaaggagtatgatgagctggccgagacccagggcaagctggaggagaagctgcaggagctggaggccaaccccccatctgatgtgtacctgagcagccgggaccggcagatcctggactggcactttgccaacctggagtttgccaatgccacccccctgagcaccctgagcctgaagcactgggaccaggatgatgactttgagttcaccggcagccacctgactgtgagaaatggctacagctgtgtgcctgtggccctggccgagggcctggacatcaagctgaacacagctgtgcggcaggtgcgctacacagccagcggctgtgaggtgattgctgtgaacaccaggagcaccagccagaccttcatctacaagtgtgatgctgtgctgtgcaccctgcccctgggcgtgctgaagcagcagcccccagctgtgcagtttgtgccccccctgcctgagtggaagaccagcgctgtgcagaggatgggcttcggcaacctgaacaaggtggtgctgtgctttgacagagtcttctgggaccccagcgtgaacctgtttggccacgtgggcagcaccacagccagcagaggagagctgttcctgttctggaacctgtacaaggcccccatcctgctggccctggtggccggggaggccgccggcatcatggagaacatcagtgatgatgtgattgtgggccgctgcctggccatcctgaagggcatcttcggcagcagcgctgtgccccagcccaaggagaccgtggtgagccgctggagggctgacccctgggcccggggcagctacagctatgtggccgccggcagcagtggaaatgactatgacctgatggcccagcccatcaccccaggccccagcatccctggggccccccagcccatccccaggctcttctttgctggggagcacaccatccggaactacccagccaccgtgcacggggccctgctgagcggcctgcgggaggccggcagaattgctgaccagttcctgggcgccatgtacaccctgccccggcaggccaccccaggagtgcctgcccagcagagccccagcatgtag

SEQ ID NO: 158259 - DNA, 2631 bp, Artificial Sequence
  Description of Artificial Sequence: Synthetic coding sequence
atgctgagcggcaagaaggctgctgctgctgctgctgctgctgctgctgctgccactggaacagaagctggccctggaacagctgggggctctgaaaatggaagtgaggtggccgcccagcctgctggcctgagcggccctgctgaggtgggccctggagctgtgggggagaggacccccaggaagaaggagcccccccgggccagccccccaggcggcctggccgagcccccaggcagcgctggcccccaggccggccccaccgtggtgcccggcagcgccacccccatggagactggaattgctgagaccccagagggccgccgcaccagcaggaggaagagggccaaggtggagtaccgggagatggatgagagcctggccaacctgtctgaagatgagtactacagcgaggaggagagaaatgccaaggccgagaaggagaagaagctgcccccacctccaccccaggcccctcctgaggaggagaatgaaagtgagcctgaggagcccagcggccaggccggcggcctgcaggatgacagcagcggcggctatggagatggccaggccagcggcgtggagggcgccgccttccagagccggctgccccatgacaggatgaccagccaggaggccgcctgcttcccagacatcatcagcggcccccagcagacccagaaggtgttcctgttcatccggaacagaaccctgcagctgtggctggacaaccccaagatccagctgacctttgaggccaccctgcagcagctggaggccccctacaacagcgacacagtgctggtgcaccgggtgcacagctacctggagagacatggcctcatcaactttggcatctacaagaggatcaagcccctgcccaccaagaagacaggcaaggtgatcatcatcggcagcggcgtgtctggcctggccgccgcccggcagctgcagagctttggcatggatgtgaccctgctggaggcccgggacagagtgggcggccgggtggccaccttcaggaagggcaactacgtggccgacctgggcgccatggtggtgacaggcctgggcggcaaccccatggctgtggtgtccaagcaggtgaacatggagctggccaagatcaagcagaagtgccccctgtatgaggccaacggccaggccgagcgcatcatcgtgcccaaggagaaggatgagatggtggagcaggagttcaaccggctgctggaggccaccagctacctgagccaccagctggacttcaacgtgctgaacaacaagcctgtgtccctgggccaggccctggaggtggtgatccagctgcaggagaagcacgtgaaggatgagcagatcgagcactggaagaagatcgtgaagacccaggaggagctgaaggagctgctgaacaagatggtgaacctgaaggagaagatcaaggagctgcaccagcagtacaaggaggccagcgaggtgaagccaccccgggacatcacagctgagttcctggtgaagagcaagcaccgggacctgacagccctgtgcaaggagtatgatgagctggccgagacccagggcaagctggaggagaagctgcaggagctggaggccaaccccccatctgatgtgtacctgagcagccgggaccggcagatcctggactggcactttgccaacctggagtttgccaatgccacccccctgagcaccctgagcctgaagcactgggaccaggatgatgactttgagttcaccggcagccacctgactgtgagaaatggctacagctgtgtgcctgtggccctggccgagggcctggacatcaagctgaacacagctgtgcggcaggtgcgctacacagccagcggctgtgaggtgattgctgtgaacaccaggagcaccagccagaccttcatctacaagtgtgatgctgtgctgtgcaccctgcccctgggcgtgctgaagcagcagcccccagctgtgcagtttgtgccccccctgcctgagtggaagaccagcgctgtgcagaggatgggcttcggcaacctgaacaaggtggtgctgtgctttgacagagtcttctgggaccccagcgtgaacctgtttggccacgtgggcagcaccacagccagcagaggagagctgttcctgttctggaacctgtacaaggcccccatcctgctggccctggtggccggggaggccgccggcatcatggagaacatcagtgatgatgtgattgtgggccgctgcctggccatcctgaagggcatcttcggcagcagcgctgtgccccagcccaaggagaccgtggtgagccgctggagggctgacccctgggcccggggcagctacagctatgtggccgccggcagcagtggaaatgactatgacctgatggcccagcccatcaccccaggccccagcatccctggggccccccagcccatccccaggctcttctttgctggggagcacaccatccggaactacccagccaccgtgcacggggccctgctgagcggcctgcgggaggccggcagaattgctgaccagttcctgggcgccatgtacaccctgccccggcaggccaccccaggagtgcctgcccagcagagccccagcatgtag

SEQ ID NO: 158260 - DNA, 2631 bp, Artificial Sequence
  Description of Artificial Sequence: Synthetic coding sequence
atgctgagcggcaagaaggctgctgctgctgctgctgctgctgctgctgctgccactggaacagaagctggccctggaacagctgggggctctgaaaatggaagtgaggtggccgcccagcctgctggcctgagcggccctgctgaggtgggccctggagctgtgggggagaggacccccaggaagaaggagcccccccgggccagccccccaggcggcctggccgagcccccaggcagcgctggcccccaggccggccccaccgtggtgcccggcagcgccacccccatggagactggaattgctgagaccccagagggccgccgcaccagcaggaggaagagggccaaggtggagtaccgggagatggatgagagcctggccaacctgtctgaagatgagtactacagcgaggaggagagaaatgccaaggccgagaaggagaagaagctgcccccacctccaccccaggcccctcctgaggaggagaatgaaagtgagcctgaggagcccagcggccaggccggcggcctgcaggatgacagcagcggcggctatggagatggccaggccagcggcgtggagggcgccgccttccagagccggctgccccatgacaggatgaccagccaggaggccgcctgcttcccagacatcatcagcggcccccagcagacccagaaggtgttcctgttcatccggaacagaaccctgcagctgtggctggacaaccccaagatccagctgacctttgaggccaccctgcagcagctggaggccccctacaacagcgacacagtgctggtgcaccgggtgcacagctacctggagagacatggcctcatcaactttggcatctacaagaggatcaagcccctgcccaccaagaagacaggcaaggtgatcatcatcggcagcggcgtgtctggcctggccgccgcccggcagctgcagagctttggcatggatgtgaccctgctggaggcccgggacagagtgggcggccgggtggccaccttcaggaagggcaactacgtggccgacctgggcgccatggtggtgacaggcctgggcggcaaccccatggctgtggtgtccaagcaggtgaacatggagctggccaagatcaagcagaagtgccccctgtatgaggccaacggccaggccgacacagtgaaggtgcccaaggagaaggatgagatggtggagcaggagttcaaccggctgctggaggccaccagctacctgagccaccagctggacttcaacgtgctgaacaacaagcctgtgtccctgggccaggccctggaggtggtgatccagctgcaggagaagcacgtgaaggatgagcagatcgagcactggaagaagatcgtgaagacccaggaggagctgaaggagctgctgaacaagatggtgaacctgaaggagaagatcaaggagctgcaccagcagtacaaggaggccagcgaggtgaagccaccccgggacatcacagctgagttcctggtgaagagcaagcaccgggacctgacagccctgtgcaaggagtatgatgagctggccgagacccagggcaagctggaggagaagctgcaggagctggaggccaaccccccatctgatgtgtacctgagcagccgggaccggcagatcctggactggcactttgccaacctggagtttgccaatgccacccccctgagcaccctgagcctgaagcactgggaccaggatgatgactttgagttcaccggcagccacctgactgtgagaaatggctacagctgtgtgcctgtggccctggccgagggcctggacatcaagctgaacacagctgtgcggcaggtgcgctacacagccagcggctgtgaggtgattgctgtgaacaccaggagcaccagccagaccttcatctacaagtgtgatgctgtgctgtgcaccctgcccctgggcgtgctgaagcagcagcccccagctgtgcagtttgtgccccccctgcctgagtggaagaccagcgctgtgcagaggatgggcttcggcaacctgaacaaggtggtgctgtgctttgacagagtcttctgggaccccagcgtgaacctgtttggccacgtgggcagcaccacagccagcagaggagagctgttcctgttctggaacctgtacaaggcccccatcctgctggccctggtggccggggaggccgccggcatcatggagaacatcagtgatgatgtgattgtgggccgctgcctggccatcctgaagggcatcttcggcagcagcgctgtgccccagcccaaggagaccgtggtgagccgctggagggctgacccctgggcccggggcagctacagctatgtggccgccggcagcagtggaaatgactatgacctgatggcccagcccatcaccccaggccccagcatccctggggccccccagcccatccccaggctcttctttgctggggagcacaccatccggaactacccagccaccgtgcacggggccctgctgagcggcctgcgggaggccggcagaattgctgaccagttcctgggcgccatgtacaccctgccccggcaggccaccccaggagtgcctgcccagcagagccccagcatgtag

SEQ ID NO: 158261 - DNA, 1773 bp, Artificial Sequence
  Description of Artificial Sequence: Synthetic coding sequence
atggccaccccccggggccgcaccaagaagaaggccagctttgaccacagcccagacagcctgcccctgcggagcagcggccggcaggccaagaagaaggccacagagaccacagatgaagatgaagatggcggcagcgagaagaagtacagaaaatgtgagaaggccggctgcacagccacctgccctgtgtgctttgccagcgccagcgagcgctgtgccaagaatggctacaccagccgctggtaccacctgagctgtggggagcacttctgcaatgaatgttttgaccactactaccgcagccacaaggatggctatgacaagtacaccacctggaagaagatctggaccagcaatggcaagacagagcccagccccaaggccttcatggctgaccagcagctgccctactgggtgcagtgcaccaagccagagtgcaggaagtggaggcagctgaccaaggagatccagctgaccccccagatcgccaagacctaccgctgtggcatgaagcccaacacagccatcaagccagagaccagtgaccactgcagcctgcctgaggacctggaggccctgaccccccagaagtgcatcccccacatcatcgtgcggggcctggtgcgcatccgctgtgtgcaggaggtggagcgcatcctgtacttcatgaccaggaagggcctcatcaacacaggagtgctgtctgtgggcgctgaccagtacctgctgcccaaggactaccacaacaagagcgtcatcatcatcggggccggccctgctggcctggccgccgcccggcagctgcacaactttggcatcaaggtgacagtgctggaggccaaggacagaattggaggccgggtgtgggatgacaagagcttcaagggcgtgacagtgggccgcggggcccagatcgtgaatggctgcatcaacaaccctgtggccctgatgtgtgagcaggtgtctgcccgctcctgggaccacaatgagttctttgcccagtttgctggggaccacaccctgctgaccccaggctacagcgtcatcatcgagaagctggccgagggcctggacatccagctgaagagccctgtgcagtgcatcgactacagcggagatgaggtgcaggtgaccaccacagatggcaccggctacagcgcccagaaggtgctggtgacagtgcccctggccctgctgcagaagggggccatccagttcaacccccccctgtctgagaagaagatgaaggccatcaacagcctgggcgccggcatcatcgagaagatcgccctgcagttcccctaccgcttctgggacagcaaggtgcagggcgctgacttctttggacatgtgcccccatctgccagcaagaggggcctgtttgctgtgttctatgacatggacccccagaagaagcacagcgtgctgatgtctgtgattgctggggaggccgtggcctctgtgaggaccctggatgacaagcaggtgctgcagcagtgcatggccaccctgcgggagctgttcaaggagcaggaggtgcctgaccccaccaagtactttgtgacccgctggagcacagacccctggatccagatggcctacagctttgtgaagacaggaggcagcggggaggcctatgacatcatcgccgaggacatccagggcaccgtcttctttgctggggaggccaccaacagacacttcccccagacagtgactggagcctacctgtctggagtgcgggaggccagcaagattgctgccttctag

SEQ ID NO: 158262 - DNA, 2463 bp, Artificial Sequence
  Description of Artificial Sequence: Synthetic coding sequence
atggccaccccccggggccgcaccaagaagaaggccagctttgaccacagcccagacagcctgcccctgcggagcagcggccggcaggccaagaagaaggccacagagaccacagatgaagatgaagatggcggcagcgagaagaagtacagaaaatgtgagaaggccggctgcacagccacctgccctgtgtgctttgccagcgccagcgagcgctgtgccaagaatggctacaccagccgctggtaccacctgagctgtggggagcacttctgcaatgaatgttttgaccactactaccgcagccacaaggatggctatgacaagtacaccacctggaagaagatctggaccagcaatggcaagacagagcccagccccaaggccttcatggctgaccagcagctgccctactgggtgcagtgcaccaagccagagtgcaggaagtggaggcagctgaccaaggagatccagctgaccccccagatcgccaagacctaccgctgtggcatgaagcccaacacagccatcaagccagagaccagtgaccactgcagcctgcctgaggacctgcgggtgctggaggtgagcaaccactggtggtacagcatgctgatcctgccccccctgctgaaggacagcgtggccgcccccctgctgagcgcctactacccagactgtgtgggcatgagccccagctgcaccagcaccaacagagctgctgccactggaaatgccagccctgggaagctggagcacagcaaggccgccctgtctgtgcacgtgcccggcatgaaccgctacttccagcccttctaccagcccaatgaatgtgggaaggccctgtgtgtgcggccagatgtgatggagctggatgagctgtatgagttccctgagtacagccgggaccccaccatgtacctggccctgaggaacctgatcctggccctgtggtacaccaactgcaaggaggccctgaccccccagaagtgcatcccccacatcatcgtgcggggcctggtgcgcatccgctgtgtgcaggaggtggagcgcatcctgtacttcatgaccaggaagggcctcatcaacacaggagtgctgtctgtgggcgctgaccagtacctgctgcccaaggactaccacaacaagagcgtcatcatcatcggggccggccctgctggcctggccgccgcccggcagctgcacaactttggcatcaaggtgacagtgctggaggccaaggacagaattggaggccgggtgtgggatgacaagagcttcaagggcgtgacagtgggccgcggggcccagatcgtgaatggctgcatcaacaaccctgtggccctgatgtgtgagcagctgggcatctccatgcacaagtttggagagcgctgtgacctgatccaggagggcggccgcatcacagaccccaccatcgacaagaggatggacttccacttcaatgccctgctggatgtggtgtctgagtggaggaaggacaagacccagctgcaggatgtgcccctgggggagaagattgaggagatctacaaggccttcatcaaggagagcggcatccagttcagcgagctggagggccaggtgctgcagttccacctgagcaacctggagtatgcctgtggcagcaacctgcaccaggtgtctgcccgctcctgggaccacaatgagttctttgcccagtttgctggggaccacaccctgctgaccccaggctacagcgtcatcatcgagaagctggccgagggcctggacatccagctgaagagccctgtgcagtgcatcgactacagcggagatgaggtgcaggtgaccaccacagatggcaccggctacagcgcccagaaggtgctggtgacagtgcccctggccctgctgcagaagggggccatccagttcaacccccccctgtctgagaagaagatgaaggccatcaacagcctgggcgccggcatcatcgagaagatcgccctgcagttcccctaccgcttctgggacagcaaggtgcagggcgctgacttctttggacatgtgcccccatctgccagcaagaggggcctgtttgctgtgttctatgacatggacccccagcacagcgtgctgatgtctgtgattgctggggaggccgtggcctctgtgaggaccctggatgacaagcaggtgctgcagcagtgcatggccaccctgcgggagctgttcaaggagcaggaggtgcctgaccccaccaagtactttgtgacccgctggagcacagacccctggatccagatggcctacagctttgtgaagacaggaggcagcggggaggcctatgacatcatcgccgaggacatccagggcaccgtcttctttgctggggaggccaccaacagacacttcccccagacagtgactggagcctacctgtctggagtgcgggaggccagcaagattgctgccttctag

SEQ ID NO: 158263 - DNA, 2472 bp, Artificial Sequence
  Description of Artificial Sequence: Synthetic coding sequence
atggccaccccccggggccgcaccaagaagaaggccagctttgaccacagcccagacagcctgcccctgcggagcagcggccggcaggccaagaagaaggccacagagaccacagatgaagatgaagatggcggcagcgagaagaagtacagaaaatgtgagaaggccggctgcacagccacctgccctgtgtgctttgccagcgccagcgagcgctgtgccaagaatggctacaccagccgctggtaccacctgagctgtggggagcacttctgcaatgaatgttttgaccactactaccgcagccacaaggatggctatgacaagtacaccacctggaagaagatctggaccagcaatggcaagacagagcccagccccaaggccttcatggctgaccagcagctgccctactgggtgcagtgcaccaagccagagtgcaggaagtggaggcagctgaccaaggagatccagctgaccccccagatcgccaagacctaccgctgtggcatgaagcccaacacagccatcaagccagagaccagtgaccactgcagcctgcctgaggacctgcgggtgctggaggtgagcaaccactggtggtacagcatgctgatcctgccccccctgctgaaggacagcgtggccgcccccctgctgagcgcctactacccagactgtgtgggcatgagccccagctgcaccagcaccaacagagctgctgccactggaaatgccagccctgggaagctggagcacagcaaggccgccctgtctgtgcacgtgcccggcatgaaccgctacttccagcccttctaccagcccaatgaatgtgggaaggccctgtgtgtgcggccagatgtgatggagctggatgagctgtatgagttccctgagtacagccgggaccccaccatgtacctggccctgaggaacctgatcctggccctgtggtacaccaactgcaaggaggccctgaccccccagaagtgcatcccccacatcatcgtgcggggcctggtgcgcatccgctgtgtgcaggaggtggagcgcatcctgtacttcatgaccaggaagggcctcatcaacacaggagtgctgtctgtgggcgctgaccagtacctgctgcccaaggactaccacaacaagagcgtcatcatcatcggggccggccctgctggcctggccgccgcccggcagctgcacaactttggcatcaaggtgacagtgctggaggccaaggacagaattggaggccgggtgtgggatgacaagagcttcaagggcgtgacagtgggccgcggggcccagatcgtgaatggctgcatcaacaaccctgtggccctgatgtgtgagcagctgggcatctccatgcacaagtttggagagcgctgtgacctgatccaggagggcggccgcatcacagaccccaccatcgacaagaggatggacttccacttcaatgccctgctggatgtggtgtctgagtggaggaaggacaagacccagctgcaggatgtgcccctgggggagaagattgaggagatctacaaggccttcatcaaggagagcggcatccagttcagcgagctggagggccaggtgctgcagttccacctgagcaacctggagtatgcctgtggcagcaacctgcaccaggtgtctgcccgctcctgggaccacaatgagttctttgcccagtttgctggggaccacaccctgctgaccccaggctacagcgtcatcatcgagaagctggccgagggcctggacatccagctgaagagcccccaggtgcagtgcatcgactacagcggagatgaggtgcaggtgaccaccacagatggcaccggctacagcgcccagaaggtgctggtgacagtgcccctggccctgctgcagaagggggccatccagttcaacccccccctgtctgagaagaagatgaaggccatcaacagcctgggcgccggcatcatcgagaagatcgccctgcagttcccctaccgcttctgggacagcaaggtgcagggcgctgacttcttcggccacgtgccccccagcgccagcaagaggggcctgtttgctgtgttctatgacatggacccccagaagaagcacagcgtgctgatgtctgtgattgctggggaggccgtggcctctgtgaggaccctggatgacaagcaggtgctgcagcagtgcatggccaccctgcgggagctgttcaaggagcaggaggtgcctgaccccaccaagtactttgtgacccgctggagcacagacccctggatccagatggcctacagctttgtgaagacaggaggcagcggggaggcctatgacatcatcgccgaggacatccagggcaccgtcttctttgctggggaggccaccaacagacacttcccccagacagtgactggagcctacctgagcggcgtgcgggaggccagcaagattgctgccttctag

SEQ ID NO: 158264 - DNA, 1776 bp, Artificial Sequence
  Description of Artificial Sequence: Synthetic coding sequence
atggccaccccccggggccgcaccaagaagaaggccagctttgaccacagcccagacagcctgcccctgcggagcagcggccggcaggccaagaagaaggccacagagaccacagatgaagatgaagatggcggcagcgagaagaagtacagaaaatgtgagaaggccggctgcacagccacctgccctgtgtgctttgccagcgccagcgagcgctgtgccaagaatggctacaccagccgctggtaccacctgagctgtggggagcacttctgcaatgaatgttttgaccactactaccgcagccacaaggatggctatgacaagtacaccacctggaagaagatctggaccagcaatggcaagacagagcccagccccaaggccttcatggctgaccagcagctgccctactgggtgcagtgcaccaagccagagtgcaggaagtggaggcagctgaccaaggagatccagctgaccccccagatcgccaagacctaccgctgtggcatgaagcccaacacagccatcaagccagagaccagtgaccactgcagcctgcctgaggacctggaggccctgaccccccagaagtgcatcccccacatcatcgtgcggggcctggtgcgcatccgctgtgtgcaggaggtggagcgcatcctgtacttcatgaccaggaagggcctcatcaacacaggagtgctgtctgtgggcgctgaccagtacctgctgcccaaggactaccacaacaagagcgtcatcatcatcggggccggccctgctggcctggccgccgcccggcagctgcacaactttggcatcaaggtgacagtgctggaggccaaggacagaattggaggccgggtgtgggatgacaagagcttcaagggcgtgacagtgggccgcggggcccagatcgtgaatggctgcatcaacaaccctgtggccctgatgtgtgagcaggtgtctgcccgctcctgggaccacaatgagttctttgcccagtttgctggggaccacaccctgctgaccccaggctacagcgtcatcatcgagaagctggccgagggcctggacatccagctgaagagcccccaggtgcagtgcatcgactacagcggagatgaggtgcaggtgaccaccacagatggcaccggctacagcgcccagaaggtgctggtgacagtgcccctggccctgctgcagaagggggccatccagttcaacccccccctgtctgagaagaagatgaaggccatcaacagcctgggcgccggcatcatcgagaagatcgccctgcagttcccctaccgcttctgggacagcaaggtgcagggcgctgacttcttcggccacgtgccccccagcgccagcaagaggggcctgtttgctgtgttctatgacatggacccccagaagaagcacagcgtgctgatgtctgtgattgctggggaggccgtggcctctgtgaggaccctggatgacaagcaggtgctgcagcagtgcatggccaccctgcgggagctgttcaaggagcaggaggtgcctgaccccaccaagtactttgtgacccgctggagcacagacccctggatccagatggcctacagctttgtgaagacaggaggcagcggggaggcctatgacatcatcgccgaggacatccagggcaccgtcttctttgctggggaggccaccaacagacacttcccccagacagtgactggagcctacctgagcggcgtgcgggaggccagcaagattgctgccttctag

SEQ ID NO: 158265 - DNA, 1923 bp, Artificial Sequence
  Description of Artificial Sequence: Synthetic coding sequence
tgatgcagcctgcctgaggacctgcgggtgctggaggtgagcaaccactggtggtacagcatgctgatcctgccccccctgctgaaggacagcgtggccgcccccctgctgagcgcctactacccagactgtgtgggcatgagccccagctgcaccagcaccaacagagctgctgccactggaaatgccagccctgggaagctggagcacagcaaggccgccctgtctgtgcacgtgcccggcatgaaccgctacttccagcccttctaccagcccaatgaatgtgggaaggccctgtgtgtgcggccagatgtgatggagctggatgagctgtatgagttccctgagtacagccgggaccccaccatgtacctggccctgaggaacctgatcctggccctgtggtacaccaactgcaaggaggccctgaccccccagaagtgcatcccccacatcatcgtgcggggcctggtgcgcatccgctgtgtgcaggaggtggagcgcatcctgtacttcatgaccaggaagggcctcatcaacacaggagtgctgtctgtgggcgctgaccagtacctgctgcccaaggactaccacaacaagagcgtcatcatcattggagctggccctgctggcctggccgccgcccggcagctgcacaactttggcatcaaggtgacagtgctggaggccaaggaccgcatcggcggccgggtgtgggatgacaagagcttcaagggcgtgacagtgggccgcggggcccagatcgtgaatggctgcatcaacaaccctgtggccctgatgtgtgagcagctgggcatctccatgcacaagtttggagagcgctgtgacctgatccaggagggcggccgcatcacagaccccaccatcgacaagaggatggacttccacttcaatgccctgctggatgtggtgtctgagtggaggaaggacaagacccagctgcaggatgtgcccctgggggagaagattgaggagatctacaaggccttcatcaaggagagcggcatccagttcagcgagctggagggccaggtgctgcagttccacctgagcaacctggagtatgcctgtggcagcaacctgcaccaggtgtctgcccgctcctgggaccacaatgagttctttgcccagtttgctggggaccacaccctgctgaccccaggctacagcgtcatcatcgagaagctggccgagggcctggacatccagctgaagagcccccaggtgcagtgcatcgactacagcggagatgaggtgcaggtgaccaccacagatggcaccggctacagcgcccagaaggtgctggtgacagtgcccctggccctgctgcagaagggggccatccagttcaacccccccctgtctgagaagaagatgaaggccatcaacagcctgggcgccggcatcatcgagaagatcgccctgcagttcccctaccgcttctgggacagcaaggtgcagggcgctgacttctttggacatgtgcccccatctgccagcaagaggggcctgtttgctgtgttctatgacatggacccccagaagaagcacagcgtgctgatgtctgtgattgctggggaggccgtggcctctgtgaggaccctggatgacaagcaggtgctgcagcagtgcatggccaccctgcgggagctgttcaaggagcaggaggtgcctgaccccaccaagtactttgtgacccgctggagcacagacccctggatccagatggcctacagctttgtgaagacaggaggcagcggggaggcctatgacatcatcgccgaggacatccagggcaccgtcttctttgctggggaggccaccaacagacacttcccccagacagtgactggagcctacctgtctggagtgcgggaggccagcaagattgctgccttctag

SEQ ID NO: 158266 - DNA, 342 bp, Artificial Sequence
  Description of Artificial Sequence: Synthetic coding sequence
atgtctgtgattgctggggaggccgtggcctctgtgaggaccctggatgacaagcaggtgctgcagcagtgcatggccaccctgcgggagctgttcaaggagcaggaggtgcctgaccccaccaagtactttgtgacccgctggagcacagacccctggatccagatggcctacagctttgtgaagacaggaggcagcggggaggcctatgacatcatcgccgaggacatccagggcaccgtcttctttgctggggaggccaccaacagacacttcccccagacagtgactggagcctacctgagcggcgtgcgggaggccagcaagattgctgccttctag

SEQ ID NO: 158267 - DNA, 3966 bp, Artificial Sequence
  Description of Artificial Sequence: Synthetic coding sequence
atggtgctgaccctgggggagagctggcctgtgctggtgggccgccgcttcctgagcctgtctgctgctgatggcagtgatggcagccatgacagctgggatgtggagcgggtggccgagtggccctggctgagcggcaccatccgggctgtgagccacacagatgtgaccaagaaggacctgaaggtgtgtgtggagtttgatggagagagctggaggaagaggcgctggattgaggtgtacagcctgctgcggcgggccttcctggtggagcacaacctggtgctggccgagaggaagagccctgagatcagcgagcgcatcgtgcagtggccagccatcacctacaagcccctgctggacaaggccggcctgggcagcatcacctctgtgcgcttcctgggggaccagcagagggtcttcctgagcaaggacctgctgaagcccatccaggatgtgaacagcctgcggctgagcctgacagacaaccagatcgtgtccaaggagttccaggccctgattgtgaagcacctggatgagagccacctgctgaagggggacaagaacctggtgggcagcgaggtgaagatctacagcctggaccccagcacccagtggttcagcgccaccgtcatcaatggaaatcctgccagcaagaccctgcaggtgaactgtgaggagatcccagccctgaagatcgtggaccccagcctcatccacgtggaggtggtgcatgacaacctggtgacctgtggcaacagcgccagaattggagctgtgaagaggaagagcagcgagaacaacggcaccctggtgtccaagcaggccaagagctgcagcgaggccagccccagcatgtgccctgtgcagagcgtgcccaccaccgtcttcaaggagatcctgctgggctgcacagctgccaccccacccagcaaggacccccggcagcagagcaccccccaggccgccaacagcccccccaacctgggcgccaagatcccccagggctgccacaagcagagcctgcctgaggagatcagcagctgcctgaacaccaagtctgaggccctgcggaccaagccagatgtgtgcaaggccggcctgctgagcaagagcagccagattggaactggagacctgaagatcctgacagagcccaagggcagctgcacccagcccaagaccaacacagaccaggagaaccggctggagagcgtgccccaggccctgaccggcctgcccaaggagtgcctgcccaccaaggccagcagcaaggccgagctggagatcgccaaccccccagagctgcagaagcacctggagcacgcccccagccccagtgatgtgtccaatgcccctgaggtgaaggccggcgtgaacagcgacagccccaacaactgcagcggcaagaaggtggagcccagcgccctggcctgccgcagccagaacctgaaggagagctctgtgaaggtggacaatgaaagctgctgcagccgcagcaacaacaagatccagaatgcccccagcaggaagtctgtgctgacagatcctgccaagctgaagaagctgcagcagagcggggaggcctttgtgcaggatgacagctgtgtgaacatcgtggcccagctgcccaagtgccgggagtgccgcctggacagcctgaggaaggacaaggagcagcagaaggacagccctgtgttctgccgcttcttccacttccggcggctgcagttcaacaagcatggagtgctgcgggtggagggcttcctgacccccaacaagtatgacaatgaggccatcggcctgtggctgcccctgaccaagaatgtggtgggcatcgacctggacacagccaagtacatcctggccaacattggagaccacttctgccagatggtgatcagcgagaaggaggccatgagcaccatcgagccccaccggcaggtggcctggaagagagctgtgaagggcgtgcgggagatgtgtgatgtgtgtgacaccaccatcttcaacctgcactgggtgtgcccccgctgtggctttggagtgtgtgtggactgctacaggatgaagaggaagaactgccagcagggcgccgcctacaagaccttctcctggctgaagtgtgtgaagagccagatccacgagcctgagaacctgatgcccacccagatcatccctgggaaggccctgtatgatgtgggggacatcgtgcacagcgtgcgggccaagtggggcatcaaggccaactgcccctgcagcaaccggcagttcaagctgttcagcaagccagccagcaaggaggacctgaagcagaccagcctggccggggagaagcccaccctgggcgctgtgctgcagcagaaccccagcgtgctggagcctgctgctgtgggcggggaggccgccagcaagccagctggctccatgaagccagcctgcccagccagcaccagccccctgaactggctggccgacctgaccagcggaaatgtgaacaaggagaacaaggagaagcagcccaccatgcccatcctgaagaatgagatcaagtgcctgccccccctgccccccctgagcaagagcagcacagtgctgcacaccttcaacagcaccatcctgacccctgtgagcaacaacaacagcggcttcctgaggaacctgctgaacagcagcacaggcaagacagaaaatggcctgaagaacacccccaagatcctggatgacatctttgccagcctggtgcagaacaagaccaccagtgacctgagcaagaggccccagggcctgaccatcaagcccagcatcctgggctttgacaccccccactactggctgtgtgacaaccggctgctgtgcctgcaggaccccaacaacaagagcaactggaatgtgttccgggagtgctggaagcagggccagcctgtgatggtgtctggagtgcaccacaagctgaacagcgagctgtggaagccagagagcttcaggaaggagtttggagagcaggaggtggacctggtgaactgcaggaccaatgagatcatcaccggggccaccgtgggggacttctgggatggctttgaagatgtgcccaaccggctgaagaatgagaaggagcccatggtgctgaagctgaaggactggcccccaggagaggacttccgggacatgatgcccagcagatttgatgacctgatggccaacatccccctgcctgagtacaccaggagagatggcaagctgaacctggccagccggctgcccaactactttgtgcggccagacctgggccccaagatgtacaatgcctacggcctcatcaccccagaggacagaaaatatggcaccaccaacctgcacctggatgtgtctgatgctgccaacgtgatggtgtatgtgggcatccccaagggccagtgtgagcaggaggaggaggtgctgaagaccatccaggatggagacagtgatgagctgaccatcaagcgcttcatcgagggcaaggagaagccaggggccctgtggcacatctatgctgccaaggacacagagaagatccgggagttcctgaagaaggtgtctgaggagcagggccaggagaacccagctgaccatgaccccatccatgaccagagctggtacctggacaggagcctgaggaagaggctgcaccaggagtatggagtgcagggctgggccatcgtgcagttcctgggagatgtggtgttcatcccagctggggccccccaccaggtgcacaacctgtacagctgcatcaaggtggccgaggactttgtgtccccagagcacgtgaagcactgcttctggctgacccaggagttccgctacctgagccagacccacaccaaccacgaggacaagctgcaggtgaagaatgtcatctaccacgctgtgaaggatgctgtggccatgctgaaggccagcgagagcagctttgggaagccctag

SEQ ID NO: 158268 - DNA, 3966 bp, Artificial Sequence; identical to SEQ ID NO: 158267
  Description of Artificial Sequence: Synthetic coding sequence

SEQ ID NO: 158269 - DNA, 3966 bp, Artificial Sequence; identical to SEQ ID NO: 158267
  Description of Artificial Sequence: Synthetic coding sequence

SEQ ID NO: 158270 - DNA, 513 bp, Artificial Sequence
  Description of Artificial Sequence: Synthetic coding sequence
atggtgctgaccctgggggagagctggcctgtgctggtgggccgccgcttcctgagcctgtctgctgctgatggcagtgatggcagccatgacagctgggatgtggagcgggtggccgagtggccctggctgagcggcaccatccgggctgtgagccacacagatgtgaccaagaaggacctgaaggtgtgtgtggagtttgatggagagagctggaggaagaggcgctggattgaggtgtacagcctgctgcggcgggccttcctggtggagcacaacctggtgctggccgagaggaagagccctgagatcagcgagcgcatcgtgcagtggccagccatcacctacaagcccctgctggacaaggccggcctgggcagcatcacctctgtgcgcttcctgggggaccagcagagggtcttcctgagcaaggacctgctgaagcccatccaggatgtgaacagcctgcggctgagcctgacagacaaccagatcgtgtccaaggagttctag

SEQ ID NO: 158271 - DNA, 2136 bp, Artificial Sequence
  Description of Artificial Sequence: Synthetic coding sequence
atggtgctgaccctgggggagagctggcctgtgctggtgggccgccgcttcctgagcctgtctgctgctgatggcagtgatggcagccatgacagctgggatgtggagcgggtggccgagtggccctggctgagcggcaccatccgggctgtgagccacacagatgtgaccaagaaggacctgaaggtgtgtgtggagtttgatggagagagctggaggaagaggcgctggattgaggtgtacagcctgctgcggcgggccttcctggtggagcacaacctggtgctggccgagaggaagagccctgagatcagcgagcgcatcgtgcagtggccagccatcacctacaagcccctgctggacaaggccggcctgggcagcatcacctctgtgcgcttcctgggggaccagcagagggtcttcctgagcaaggacctgctgaagcccatccaggatgtgaacagcctgcggctgagcctgacagacaaccagatcgtgtccaaggagttccaggccctgattgtgaagcacctggatgagagccacctgctgaagggggacaagaacctggtgggcagcgaggtgaagatctacagcctggaccccagcacccagtggttcagcgccaccgtcatcaatggaaatcctgccagcaagaccctgcaggtgaactgtgaggagatcccagccctgaagatcgtggaccccagcctcatccacgtggaggtggtgcatgacaacctggtgacctgtggcaacagcgccagaattggagctgtgaagaggaagagcagcgagaacaacggcaccctggtgtccaagcaggccaagagctgcagcgaggccagccccagcatgtgccctgtgcagagcgtgcccaccaccgtcttcaaggagatcctgctgggctgcacagctgccaccccacccagcaaggacccccggcagcagagcaccccccaggccgccaacagcccccccaacctgggcgccaagatcccccagggctgccacaagcagagcctgcctgaggagatcagcagctgcctgaacaccaagtctgaggccctgcggaccaagccagatgtgtgcaaggccggcctgctgagcaagagcagccagattggaactggagacctgaagatcctgacagagcccaagggcagctgcacccagcccaagaccaacacagaccaggagaaccggctggagagcgtgccccaggccctgaccggcctgcccaaggagtgcctgcccaccaaggccagcagcaaggccgagctggagatcgccaaccccccagagctgcagaagcacctggagcacgcccccagccccagtgatgtgtccaatgcccctgaggtgaaggccggcgtgaacagcgacagccccaacaactgcagcggcaagaaggtggagcccagcgccctggcctgccgcagccagaacctgaaggagagctctgtgaaggtggacaatgaaagctgctgcagccgcagcaacaacaagatccagaatgcccccagcaggaagtctgtgctgacagatcctgccaagctgaagaagctgcagcagagcggggaggcctttgtgcaggatgacagctgtgtgaacatcgtggcccagctgcccaagtgccgggagtgccgcctggacagcctgaggaaggacaaggagcagcagaaggacagccctgtgttctgccgcttcttccacttccggcggctgcagttcaacaagcatggagtgctgcgggtggagggcttcctgacccccaacaagtatgacaatgaggccatcggcctgtggctgcccctgaccaagaatgtggtgggcatcgacctggacacagccaagtacatcctggccaacattggagaccacttctgccagatggtgatcagcgagaaggaggccatgagcaccatcgagccccaccggcaggtggcctggaagagagctgtgaagggcgtgcgggagatgtgtgatgtgtgtgacaccaccatcttcaacctgcactgggtgtgcccccgctgtggctttggagtgtgtgtggactgctacaggatgaagaggaagaactgccagcagggagaaaatagatttgacagccccccagcccccctgcacagctag

SEQ ID NO: 158272 - DNA, 366 bp, Artificial Sequence
  Description of Artificial Sequence: Synthetic coding sequence
atggtgctgaccctgggggagagctggcctgtgctggtgggccgccgcttcctgagcctgtctgctgctgatggcagtgatggcagccatgacagctgggatgtggagcgggtggccgagtggccctggctgagcggcaccatccgggctgtgagccacacagatgtgaccaagaaggacctgaaggtgtgtgtggagtttgatggagagagctggaggaagaggcgctggattgaggtgtacagcctgctgcggcgggccttcctggtggagcacaacctggtgctggccgagaggaagagccctgagatcagcgagcgcatcgtgcagtggccagccatcacctacaagcccctgctggactag

SEQ ID NO: 158273 - DNA, 3984 bp, Artificial Sequence
  Description of Artificial Sequence: Synthetic coding sequence
atggtgctgaccctgggggagagctggcctgtgctggtgggccgccgcttcctgagcctgtctgctgctgatggcagtgatggcagccatgacagctgggatgtggagcgggtggccgagtggccctggctgagcggcaccatccgggctgtgagccacacagatgtgaccaagaaggacctgaaggtgtgtgtggagtttgatggagagagctggaggaagaggcgctggattgaggtgtacagcctgctgcggcgggccttcctggtggagcacaacctggtgctggccgagaggaagagccctgagatcagcgagcgcatcgtgcagtggccagccatcacctacaagcccctgctggacaaggccggcctgggcagcatcacctctgtgcgcttcctgggggaccagcagagggtcttcctgagcaaggacctgctgaagcccatccaggatgtgaacagcctgcggctgagcctgacagacaaccagatcgtgtccaaggagttccaggccctgattgtgaagcacctggatgagagccacctgctgaagggggacaagaacctggtgggcagcgaggtgaagatctacagcctggaccccagcacccagtggttcagcgccaccgtcatcaatggaaatcctgccagcaagaccctgcaggtgaactgtgaggagatcccagccctgaagatcgtggaccccagcctcatccacgtggaggtggtgcatgacaacctggtgacctgtggcaacagcgccagaattggagctgtgaagaggaagagcagcgagaacaacggcaccctggtgtccaagcaggccaagagctgcagcgaggccagccccagcatgtgccctgtgcagagcgtgcccaccaccgtcttcaaggagatcctgctgggctgcacagctgccaccccacccagcaaggacccccggcagcagagcaccccccaggccgccaacagcccccccaacctgggcgccaagatcccccagggctgccacaagcagagcctgcctgaggagatcagcagctgcctgaacaccaagtctgaggccctgcggaccaagccagatgtgtgcaaggccggcctgctgagcaagagcagccagattggaactggagacctgaagatcctgacagagcccaagggcagctgcacccagcccaagaccaacacagaccaggagaaccggctggagagcgtgccccaggccctgaccggcctgcccaaggagtgcctgcccaccaaggccagcagcaaggccgagctggagatcgccaaccccccagagctgcagaagcacctggagcacgcccccagccccagtgatgtgtccaatgcccctgaggtgaaggccggcgtgaacagcgacagccccaacaactgcagcggcaagaaggtggagcccagcgccctggcctgccgcagccagaacctgaaggagagctctgtgaaggtggacaatgaaagctgctgcagccgcagcaacaacaagatccagaatgcccccagcaggaagtctgtgctgacagatcctgccaagctgaagaagctgcagcagagcggggaggcctttgtgcaggatgacagctgtgtgaacatcgtggcccagctgcccaagtgccgggagtgccgcctggacagcctgaggaaggacaaggagcagcagaaggacagccctgtgttctgccgcttcttccacttccggcggctgcagttcaacaagcatggagtgctgcgggtggagggcttcctgacccccaacaagtatgacaatgaggccatcggcctgtggctgcccctgaccaagaatgtggtgggcatcgacctggacacagccaagtacatcctggccaacattggagaccacttctgccagatggtgatcagcgagaaggaggccatgagcaccatcgagccccaccggcaggtggcctggaagagagctgtgaagggcgtgcgggagatgtgtgatgtgtgtgacaccaccatcttcaacctgcactgggtgtgcccccgctgtggctttggagtgtgtgtggactgctacaggatgaagaggaagaactgccagcagggcgccgcctacaagaccttctcctggctgaagtgtgtgaagagccagatccacgagcctgagaacctgatgcccacccagatcatccctgggaaggccctgtatgatgtgggggacatcgtgcacagcgtgcgggccaagtggggcatcaaggccaactgcccctgcagcaaccggcagttcaagctgttcagcaagccagccagcaaggaggacctgaagcagaccagcctggccggggagaagcccaccctgggcgctgtgctgcagcagaaccccagcgtgctggagcctgctgctgtgggcggggaggccgccagcaagccagctggctccatgaagccagcctgcccagccagcaccagccccctgaactggctggccgacctgaccagcggaaatgtgaacaaggagaacaaggagaagcagcccaccatgcccatcctgaagaatgagatcaagtgcctgccccccctgccccccctgagcaagagcagcacagtgctgcacaccttcaacagcaccatcctgacccctgtgagcaacaacaacagcggcttcctgaggaacctgctgaacagcagcacaggcaagacagaaaatggcctgaagaacacccccaagatcctggatgacatctttgccagcctggtgcagaacaagaccaccagtgacctgagcaagaggccccagggcctgaccatcaagcccagcatcctgggctttgacaccccccactactggctgtgtgacaaccggctgctgtgcctgcaggaccccaacaacaagagcaactggaatgtgttccgggagtgctggaagcagggccagcctgtgatggtgtctggagtgcaccacaagctgaacagcgagctgtggaagccagagagcttcaggaaggagtttggagagcaggaggtggacctggtgaactgcaggaccaatgagatcatcaccggggccaccgtgggggacttctgggatggctttgaagatgtgcccaaccggctgaagaatgagaaggagcccatggtgctgaagctgaaggactggcccccaggagaggacttccgggacatgatgcccagcagatttgatgacctgatggccaacatccccctgcctgagtacaccaggagagatggcaagctgaacctggccagccggctgcccaactactttgtgcggccagacctgggccccaagatgtacaatgcctacggcctcatcaccccagaggacagaaaatatggcaccaccaacctgcacctggatgtgtctgatgctgccaacgtgatggtgtatgtgggcatccccaagggccagtgtgagcaggaggaggaggtgctgaagaccatccaggatggagacagtgatgagctgaccatcaagcgcttcatcgagggcaaggagaagccaggggccctgtggcacatctatgctgccaaggacacagagaagatccgggagttcctgaagaaggtgtctgaggagcagggccaggagaacccagctgaccatgaccccatccatgaccagagctggtacctggacaggagcctgaggaagaggctgcaccaggagtatggagtgcagggctgggccatcgtgcagttcctgggagatgtggtgttcatcccagctggggccccccaccaggtgcacaacctgtacagctgcatcaaggtggccgaggactttgtgtccccagagcacgtgaagcactgcttctggctgacccaggagttccgctacctgagccagacccacaccaaccacgaggacaagctgcaggtgaagaatgtcatctaccacgctgtgaaggatgctgtggccatgctgaaggtgaaccctgtgctggccaacctgaacctgcctgcccactggaagtag

SEQ ID NO: 158274 - DNA, 3810 bp, Artificial Sequence
  Description of Artificial Sequence: Synthetic coding sequence
atggtgctgaccctgggggagagctggcctgtgctggtgggccgccgcttcctgagcctgtctgctgctgatggcagtgatggcagccatgacagctgggatgtggagcgggtggccgagtggccctggctgagcggcaccatccgggctgtgagccacacagatgtgaccaagaaggacctgaagacctacaagcccctgctggacaaggccggcctgggcagcatcacctctgtgcgcttcctgggggaccagcagagggtcttcctgagcaaggacctgctgaagcccatccaggatgtgaacagcctgcggctgagcctgacagacaaccagatcgtgtccaaggagttccaggccctgattgtgaagcacctggatgagagccacctgctgaagggggacaagaacctggtgggcagcgaggtgaagatctacagcctggaccccagcacccagtggttcagcgccaccgtcatcaatggaaatcctgccagcaagaccctgcaggtgaactgtgaggagatcccagccctgaagatcgtggaccccagcctcatccacgtggaggtggtgcatgacaacctggtgacctgtggcaacagcgccagaattggagctgtgaagaggaagagcagcgagaacaacggcaccctggtgtccaagcaggccaagagctgcagcgaggccagccccagcatgtgccctgtgcagagcgtgcccaccaccgtcttcaaggagatcctgctgggctgcacagctgccaccccacccagcaaggacccccggcagcagagcaccccccaggccgccaacagcccccccaacctgggcgccaagatcccccagggctgccacaagcagagcctgcctgaggagatcagcagctgcctgaacaccaagtctgaggccctgcggaccaagccagatgtgtgcaaggccggcctgctgagcaagagcagccagattggaactggagacctgaagatcctgacagagcccaagggcagctgcacccagcccaagaccaacacagaccaggagaaccggctggagagcgtgccccaggccctgaccggcctgcccaaggagtgcctgcccaccaaggccagcagcaaggccgagctggagatcgccaaccccccagagctgcagaagcacctggagcacgcccccagccccagtgatgtgtccaatgcccctgaggtgaaggccggcgtgaacagcgacagccccaacaactgcagcggcaagaaggtggagcccagcgccctggcctgccgcagccagaacctgaaggagagctctgtgaaggtggacaatgaaagctgctgcagccgcagcaacaacaagatccagaatgcccccagcaggaagtctgtgctgacagatcctgccaagctgaagaagctgcagcagagcggggaggcctttgtgcaggatgacagctgtgtgaacatcgtggcccagctgcccaagtgccgggagtgccgcctggacagcctgaggaaggacaaggagcagcagaaggacagccctgtgttctgccgcttcttccacttccggcggctgcagttcaacaagcatggagtgctgcgggtggagggcttcctgacccccaacaagtatgacaatgaggccatcggcctgtggctgcccctgaccaagaatgtggtgggcatcgacctggacacagccaagtacatcctggccaacattggagaccacttctgccagatggtgatcagcgagaaggaggccatgagcaccatcgagccccaccggcaggtggcctggaagagagctgtgaagggcgtgcgggagatgtgtgatgtgtgtgacaccaccatcttcaacctgcactgggtgtgcccccgctgtggctttggagtgtgtgtggactgctacaggatgaagaggaagaactgccagcagggcgccgcctacaagaccttctcctggctgaagtgtgtgaagagccagatccacgagcctgagaacctgatgcccacccagatcatccctgggaaggccctgtatgatgtgggggacatcgtgcacagcgtgcgggccaagtggggcatcaaggccaactgcccctgcagcaaccggcagttcaagctgttcagcaagccagccagcaaggaggacctgaagcagaccagcctggccggggagaagcccaccctgggcgctgtgctgcagcagaaccccagcgtgctggagcctgctgctgtgggcggggaggccgccagcaagccagctggctccatgaagccagcctgcccagccagcaccagccccctgaactggctggccgacctgaccagcggaaatgtgaacaaggagaacaaggagaagcagcccaccatgcccatcctgaagaatgagatcaagtgcctgccccccctgccccccctgagcaagagcagcacagtgctgcacaccttcaacagcaccatcctgacccctgtgagcaacaacaacagcggcttcctgaggaacctgctgaacagcagcacaggcaagacagaaaatggcctgaagaacacccccaagatcctggatgacatctttgccagcctggtgcagaacaagaccaccagtgacctgagcaagaggccccagggcctgaccatcaagcccagcatcctgggctttgacaccccccactactggctgtgtgacaaccggctgctgtgcctgcaggaccccaacaacaagagcaactggaatgtgttccgggagtgctggaagcagggccagcctgtgatggtgtctggagtgcaccacaagctgaacagcgagctgtggaagccagagagcttcaggaaggagtttggagagcaggaggtggacctggtgaactgcaggaccaatgagatcatcaccggggccaccgtgggggacttctgggatggctttgaagatgtgcccaaccggctgaagaatgagaaggagcccatggtgctgaagctgaaggactggcccccaggagaggacttccgggacatgatgcccagcagatttgatgacctgatggccaacatccccctgcctgagtacaccaggagagatggcaagctgaacctggccagccggctgcccaactactttgtgcggccagacctgggccccaagatgtacaatgcctacggcctcatcaccccagaggacagaaaatatggcaccaccaacctgcacctggatgtgtctgatgctgccaacgtgatggtgtatgtgggcatccccaagggccagtgtgagcaggaggaggaggtgctgaagaccatccaggatggagacagtgatgagctgaccatcaagcgcttcatcgagggcaaggagaagccaggggccctgtggcacatctatgctgccaaggacacagagaagatccgggagttcctgaagaaggtgtctgaggagcagggccaggagaacccagctgaccatgaccccatccatgaccagagctggtacctggacaggagcctgaggaagaggctgcaccaggagtatggagtgcagggctgggccatcgtgcagttcctgggagatgtggtgttcatcccagctggggccccccaccaggtgcacaacctgtacagctgcatcaaggtggccgaggactttgtgtccccagagcacgtgaagcactgcttctggctgacccaggagttccgctacctgagccagacccacaccaaccacgaggacaagctgcaggtgaagaatgtcatctaccacgctgtgaaggatgctgtggccatgctgaaggccagcgagagcagctttgggaagccctag

SEQ ID NO: 158275 - DNA, 5286 bp, Artificial Sequence
  Description of Artificial Sequence: Synthetic coding sequence
atggctgatgctgctgccagccctgtgggcaagaggctgctgctgctgtttgctgacacagctgccagcgccagcgccagcgccccagctgctgctgctgccagcggggaccccggccctgccctgcggacccgggcctggagggctggcaccgtgcgggccatgtctggagctgtgccccaggacctggccatctttgtggagtttgatggctgcaactggaagcagcacagctgggtgaaggtgcacgccgaggaggtgattgtgctgctgctggagggcagcctggtgtgggccccccgggaggaccctgtgctgctgcagggcatccgggtgtccatcgcccagtggccagccctgaccttcacccccctggtggacaagctgggcctgggctctgtggtgcctgtggagtacctgctggaccgggagctgcgcttcctgagtgatgccaacggcctgcacctgttccagatgggcacagacagccagaaccagatcctgctggagcacgccgccctgcgggagaccgtgaatgccctgatcagtgaccagaagctgcaggagatcttcagccggggcccctacagcgtgcagggccaccgggtgaagatctaccagcctgagggggaggagggctggctgtatggagtggtgagccaccaggacagcatcacccggctgatggaggtgtctgtgacagagagcggggagatcaagtctgtggaccccaggctcatccacgtgatgctgatggacaacagcgccccccagagcgagggcggcaccctgaaggctgtgaagagcagcaagggcaagaagaagcgggagagcattgagggcaaggatggaagaagaaggaagagcgccagtgacagcggctgtgaccctgccagcaagaagctgaagggggacagaggagaggtggacagcaatggaagtgatggaggagaggccagccggggcccctggaagggcggcaatgccagcggggagcccggcctggaccagagggccaagcagccccccagcacctttgtgccccagatcaacagaaacatccgctttgccacctacaccaaggaaaatggaagaaccctggtggtgcaggatgagcctgtgggcggggacaccccagccagcttcaccccctacagcacagccaccggccagacccccctggcccctgaggtgggcggcgctgagaacaaggaggccggcaagaccctggagcaggtgggccagggcatcgtggccagcgctgctgtggtgaccacagccagcagcacccccaacacagtgcgcatcagtgacaccggcctggccgccggcaccgtgcctgagaagcagaagggcagccgcagccaggccagcggggagaacagcagaaattccatcctggccagcagcggctttggagcccccctgcccagcagcagccagcccctgacctttggaagtggccgcagccagagcaatggagtgctggccacagagaacaagcccctgggcttctcctttggctgcagcagcgcccaggaggcccagaaggacacagacctgagcaagaacctcttcttccagtgcatgagccagaccctgcccaccagcaactacttcaccaccgtgtctgagagcctggctgatgacagcagcagccgggacagcttcaagcagagcctggagagcctgagcagcggcctgtgcaagggccgctctgtgctgggcacagacaccaagccaggcagcaaggccggcagctctgtggacaggaaggtgcctgctgagagcatgcccaccctgaccccagccttccccaggagcctgctgaatgcccggaccccagagaaccatgaaaatctcttcctgcagccccccaagctgagccgggaggagcccagcaaccccttcctggcctttgtggagaaggtggagcacagccccttcagcagctttgccagccaggccagcggcagcagcagcagcgccaccaccgtgaccagcaaggtggcccccagctggccagagagccacagcagcgctgacagcgccagcctggccaagaagaagcccctcttcatcaccacagacagcagcaagctggtgtctggagtgctgggcagcgccctgaccagcggcggccccagcctgagcgccatgggaaatggccgcagcagcagccccaccagcagcctgacccagcccatcgagatgcccaccctgagcagcagccccacagaggagcggcccaccgtgggccctggccagcaggacaaccccctgctgaagaccttcagcaatgtgtttggccgccacagcggcggcttcctgagcagccctgctgacttcagccaggagaacaaggccccctttgaagctgtgaagcgcttcagcctggatgagaggagcctggcctgccggcaggacagcgacagcagcaccaacagcgacctgagtgacctgagtgacagcgaggagcagctgcaggccaagacaggcctgaagggcatccctgagcacctgatgggcaagctgggccccaacggggagaggtctgctgagctgctgctgggcaagagcaagggcaagcaggcccccaagggccggcccaggacagcccccctgaaggtgggccagagcgtgctgaaggatgtgtccaaggtgaagaagctgaagcagagcggggagcccttcctgcaggacggcagctgcatcaacgtggccccccacctgcacaagtgccgggagtgccgcctggagcgctacaggaagttcaaggagcaggagcaggatgacagcacagtggcctgccgcttcttccacttcagaagactcatcttcaccaggaagggcgtgctgcgggtggagggcttcctgagcccccagcagagcgaccctgatgccatgaacctgtggatccccagcagcagcctggccgagggcatcgacctggagaccagcaagtacatcctggccaacgtgggggaccagttctgccagctggtgatgtctgagaaggaggccatgatgatggtggagccccaccagaaggtggcctggaagagagctgtgcggggcgtgcgggagatgtgtgatgtgtgtgagaccaccctcttcaacatccactgggtgtgcaggaaatgtggcttcggcgtgtgcctggactgctaccgcctgaggaagagccggcccaggagtgaaacagaggagatgggagatgaggaggtgttctcctggctgaagtgtgccaagggccagagccatgagcctgagaacctgatgcccacccagatcatccctggaacagccctgtacaacattggagacatggtgcatgctgcccggggcaagtggggcatcaaggccaactgcccctgcatcagccggcagaacaagtctgtgctgcggcctgctgtgaccaacggcatgagccagctgcccagcatcaaccccagcgccagcagtggaaatgagaccaccttcagcggcggcggcggccctgcccctgtgaccaccccagagccagaccacgtgcccaaggctgacagcacagacatccgctctgaggagcccctgaagacagacagcagcgccagcaacagcaacagcgagctgaaggccatccggcccccctgcccagacacagccccacccagcagcgccctgcactggctggccgacctggccacccagaaggccaaggaggagaccaaggaggccggcagcctgcggtctgtgctgaacaaggagagccacagccccttcggcctggacagcttcaacagcacagccaaggtgagccccctgacccccaagctgttcaacagcctgctgctgggccccacagccagcaacaacaagacagagggcagcagcctgcgggacctgctgcacagcggccctgggaagctgccccagacccccctggacaccggcatccccttcccccctgtgttcagcaccagcagcgctggggtgaagagcaaggccagcctgcccaacttcctggaccacatcatcgcctctgtggtggagaacaagaagaccagtgatgccagcaagagggcctgcaacctgacagacacccagaaggaggtgaaggagatggtgatgggcctgaatgtgctggacccccacaccagccacagctggctgtgtgatggccgcctgctgtgcctgcatgaccccagcaacaagaacaactggaagatcttccgggagtgctggaagcagggccagcctgtgctggtgtctggagtgcacaagaagctgaagtctgagctgtggaagccagaggccttcagccaggagtttggagaccaggatgtggacctggtgaactgcaggaactgtgccatcatcagtgatgtgaaggtgcgggacttctgggatggctttgagatcatctgcaagaggctgcggagtgaagatggccagcccatggtgctgaagctgaaggactggcccccaggagaggacttccgggacatgatgcccaccaggtttgaggacctgatggagaacctgcccctgcctgagtacaccaagagagatggccgcctgaacctggccagccggctgcccagctactttgtgcggccagacctgggccccaagatgtacaatgcctacggcctcatcacagctgaggaccggcgggtgggcaccaccaacctgcacctggatgtgtctgatgctgtgaatgtgatggtgtatgtgggcatccccatcggggagggcgcccatgatgaggaggtgctgaagaccattgatgaaggagatgctgatgaggtgaccaagcagagaattcatgatggcaaggagaagccaggggccctgtggcacatctatgctgccaaggatgctgagaagatccgggagctgctgaggaaggtgggggaggagcagggccaggagaaccccccagaccatgaccccatccatgaccagagctggtacctggaccagaccctgaggaagaggctgtatgaggagtatggagtgcagggctgggccatcgtgcagttcctgggagatgctgtgttcatcccagctggggccccccaccaggtgcacaacctgtacagctgcatcaaggtggccgaggactttgtgtccccagagcacgtgaagcactgcttccggctgacccaggagttccgccacctgagcaacacccacaccaaccacgaggacaagctgcaggtgaagaacatcatctaccacgctgtgaaggatgctgtgggcaccctgaaggcccacgagagcaagctggcccggagctag

SEQ ID NO: 158276 - DNA, 4254 bp, Artificial Sequence
  Description of Artificial Sequence: Synthetic coding sequence
atgggcgccatggagatcaacagaaacatccgctttgccacctacaccaaggaaaatggaagaaccctggtggtgcaggatgagcctgtgggcggggacaccccagccagcttcaccccctacagcacagccaccggccagacccccctggcccctgaggtgggcggcgctgagaacaaggaggccggcaagaccctggagcaggtgggccagggcatcgtggccagcgctgctgtggtgaccacagccagcagcacccccaacacagtgcgcatcagtgacaccggcctggccgccggcaccgtgcctgagaagcagaagggcagccgcagccaggccagcggggagaacagcagaaattccatcctggccagcagcggctttggagcccccctgcccagcagcagccagcccctgacctttggaagtggccgcagccagagcaatggagtgctggccacagagaacaagcccctgggcttctcctttggctgcagcagcgcccaggaggcccagaaggacacagacctgagcaagaacctcttcttccagtgcatgagccagaccctgcccaccagcaactacttcaccaccgtgtctgagagcctggctgatgacagcagcagccgggacagcttcaagcagagcctggagagcctgagcagcggcctgtgcaagggccgctctgtgctgggcacagacaccaagccaggcagcaaggccggcagctctgtggacaggaaggtgcctgctgagagcatgcccaccctgaccccagccttccccaggagcctgctgaatgcccggaccccagagaaccatgaaaatctcttcctgcagccccccaagctgagccgggaggagcccagcaaccccttcctggcctttgtggagaaggtggagcacagccccttcagcagctttgccagccaggccagcggcagcagcagcagcgccaccaccgtgaccagcaaggtggcccccagctggccagagagccacagcagcgctgacagcgccagcctggccaagaagaagcccctcttcatcaccacagacagcagcaagctggtgtctggagtgctgggcagcgccctgaccagcggcggccccagcctgagcgccatgggaaatggccgcagcagcagccccaccagcagcctgacccagcccatcgagatgcccaccctgagcagcagccccacagaggagcggcccaccgtgggccctggccagcaggacaaccccctgctgaagaccttcagcaatgtgtttggccgccacagcggcggcttcctgagcagccctgctgacttcagccaggagaacaaggccccctttgaagctgtgaagcgcttcagcctggatgagaggagcctggcctgccggcaggacagcgacagcagcaccaacagcgacctgagtgacctgagtgacagcgaggagcagctgcaggccaagacaggcctgaagggcatccctgagcacctgatgggcaagctgggccccaacggggagaggtctgctgagctgctgctgggcaagagcaagggcaagcaggcccccaagggccggcccaggacagcccccctgaaggtgggccagagcgtgctgaaggatgtgtccaaggtgaagaagctgaagcagagcggggagcccttcctgcaggacggcagctgcatcaacgtggccccccacctgcacaagtgccgggagtgccgcctggagcgctacaggaagttcaaggagcaggagcaggatgacagcacagtggcctgccgcttcttccacttcagaagactcatcttcaccaggaagggcgtgctgcgggtggagggcttcctgagcccccagcagagcgaccctgatgccatgaacctgtggatccccagcagcagcctggccgagggcatcgacctggagaccagcaagtacatcctggccaacgtgggggaccagttctgccagctggtgatgtctgagaaggaggccatgatgatggtggagccccaccagaaggtggcctggaagagagctgtgcggggcgtgcgggagatgtgtgatgtgtgtgagaccaccctcttcaacatccactgggtgtgcaggaaatgtggcttcggcgtgtgcctggactgctaccgcctgaggaagagccggcccaggagtgaaacagaggagatgggagatgaggaggtgttctcctggctgaagtgtgccaagggccagagccatgagcctgagaacctgatgcccacccagatcatccctggaacagccctgtacaacattggagacatggtgcatgctgcccggggcaagtggggcatcaaggccaactgcccctgcatcagccggcagaacaagtctgtgctgcggcctgctgtgaccaacggcatgagccagctgcccagcatcaaccccagcgccagcagtggaaatgagaccaccttcagcggcggcggcggccctgcccctgtgaccaccccagagccagaccacgtgcccaaggctgacagcacagacatccgctctgaggagcccctgaagacagacagcagcgccagcaacagcaacagcgagctgaaggccatccggcccccctgcccagacacagccccacccagcagcgccctgcactggctggccgacctggccacccagaaggccaaggaggagaccaaggaggccggcagcctgcggtctgtgctgaacaaggagagccacagccccttcggcctggacagcttcaacagcacagccaaggtgagccccctgacccccaagctgttcaacagcctgctgctgggccccacagccagcaacaacaagacagagggcagcagcctgcgggacctgctgcacagcggccctgggaagctgccccagacccccctggacaccggcatccccttcccccctgtgttcagcaccagcagcgctggggtgaagagcaaggccagcctgcccaacttcctggaccacatcatcgcctctgtggtggagaacaagaagaccagtgatgccagcaagagggcctgcaacctgacagacacccagaaggaggtgaaggagatggtgatgggcctgaatgtgctggacccccacaccagccacagctggctgtgtgatggccgcctgctgtgcctgcatgaccccagcaacaagaacaactggaagatcttccgggagtgctggaagcagggccagcctgtgctggtgtctggagtgcacaagaagctgaagtctgagctgtggaagccagaggccttcagccaggagtttggagaccaggatgtggacctggtgaactgcaggaactgtgccatcatcagtgatgtgaaggtgcgggacttctgggatggctttgagatcatctgcaagaggctgcggagtgaagatggccagcccatggtgctgaagctgaaggactggcccccaggagaggacttccgggacatgatgcccaccaggtttgaggacctgatggagaacctgcccctgcctgagtacaccaagagagatggccgcctgaacctggccagccggctgcccagctactttgtgcggccagacctgggccccaagatgtacaatgcctacggcctcatcacagctgaggaccggcgggtgggcaccaccaacctgcacctggatgtgtctgatgctgtgaatgtgatggtgtatgtgggcatccccatcggggagggcgcccatgatgaggaggtgctgaagaccattgatgaaggagatgctgatgaggtgaccaagcagagaattcatgatggcaaggagaagccaggggccctgtggcacatctatgctgccaaggatgctgagaagatccgggagctgctgaggaaggtgggggaggagcagggccaggagaaccccccagaccatgaccccatccatgaccagagctggtacctggaccagaccctgaggaagaggctgtatgaggagtatggagtgcagggctgggccatcgtgcagttcctgggagatgctgtgttcatcccagctggggccccccaccaggtgcacaacctgtacagctgcatcaaggtggccgaggactttgtgtccccagagcacgtgaagcactgcttccggctgacccaggagttccgccacctgagcaacacccacaccaaccacgaggacaagctgcaggtgaagaacatcatctaccacgctgtgaaggatgctgtgggcaccctgaaggcccacgagagcaagctggcccggagctag

SEQ ID NO: 158277 - DNA, 2382 bp, Artificial Sequence
  Description of Artificial Sequence: Synthetic coding sequence
atgaacctgtggatccccagcagcagcctggccgagggcatcgacctggagaccagcaagtacatcctggccaacgtgggggaccagttctgccagctggtgatgtctgagaaggaggccatgatgatggtggagccccaccagaaggtggcctggaagagagctgtgcggggcgtgcgggagatgtgtgatgtgtgtgagaccaccctcttcaacatccactgggtgtgcaggaaatgtggcttcggcgtgtgcctggactgctaccgcctgaggaagagccggcccaggagtgaaacagaggagatgggagatgaggaggtgttctcctggctgaagtgtgccaagggccagagccatgagcctgagaacctgatgcccacccagatcatccctggaacagccctgtacaacattggagacatggtgcatgctgcccggggcaagtggggcatcaaggccaactgcccctgcatcagccggcagaacaagtctgtgctgcggcctgctgtgaccaacggcatgagccagctgcccagcatcaaccccagcgccagcagtggaaatgagaccaccttcagcggcggcggcggccctgcccctgtgaccaccccagagccagaccacgtgcccaaggctgacagcacagacatccgctctgaggagcccctgaagacagacagcagcgccagcaacagcaacagcgagctgaaggccatccggcccccctgcccagacacagccccacccagcagcgccctgcactggctggccgacctggccacccagaaggccaaggaggagaccaaggaggccggcagcctgcggtctgtgctgaacaaggagagccacagccccttcggcctggacagcttcaacagcacagccaaggtgagccccctgacccccaagctgttcaacagcctgctgctgggccccacagccagcaacaacaagacagagggcagcagcctgcgggacctgctgcacagcggccctgggaagctgccccagacccccctggacaccggcatccccttcccccctgtgttcagcaccagcagcgctggggtgaagagcaaggccagcctgcccaacttcctggaccacatcatcgcctctgtggtggagaacaagaagaccagtgatgccagcaagagggcctgcaacctgacagacacccagaaggaggtgaaggagatggtgatgggcctgaatgtgctggacccccacaccagccacagctggctgtgtgatggccgcctgctgtgcctgcatgaccccagcaacaagaacaactggaagatcttccgggagtgctggaagcagggccagcctgtgctggtgtctggagtgcacaagaagctgaagtctgagctgtggaagccagaggccttcagccaggagtttggagaccaggatgtggacctggtgaactgcaggaactgtgccatcatcagtgatgtgaaggtgcgggacttctgggatggctttgagatcatctgcaagaggctgcggagtgaagatggccagcccatggtgctgaagctgaaggactggcccccaggagaggacttccgggacatgatgcccaccaggtttgaggacctgatggagaacctgcccctgcctgagtacaccaagagagatggccgcctgaacctggccagccggctgcccagctactttgtgcggccagacctgggccccaagatgtacaatgcctacggcctcatcacagctgaggaccggcgggtgggcaccaccaacctgcacctggatgtgtctgatgctgtgaatgtgatggtgtatgtgggcatccccatcggggagggcgcccatgatgaggaggtgctgaagaccattgatgaaggagatgctgatgaggtgaccaagcagagaattcatgatggcaaggagaagccaggggccctgtggcacatctatgctgccaaggatgctgagaagatccgggagctgctgaggaaggtgggggaggagcagggccaggagaaccccccagaccatgaccccatccatgaccagagctggtacctggaccagaccctgaggaagaggctgtatgaggagtatggagtgcagggctgggccatcgtgcagttcctgggagatgctgtgttcatcccagctggggccccccaccaggtgcacaacctgtacagctgcatcaaggtggccgaggactttgtgtccccagagcacgtgaagcactgcttccggctgacccaggagttccgccacctgagcaacacccacaccaaccacgaggacaagctgcaggtgaagaacatcatctaccacgctgtgaaggatgctgtgggcaccctgaaggcccacgagagcaagctggcccggagctag

SEQ ID NO: 158278 - DNA, 4656 bp, Artificial Sequence
  Description of Artificial Sequence: Synthetic coding sequence
ggctggcgctggctgtatggagtggtgagccaccaggacagcatcacccggctgatggaggtgtctgtgacagagagcggggagatcaagtctgtggaccccaggctcatccacgtgatgctgatggacaacagcgccccccagagcgagggcggcaccctgaaggctgtgaagagcagcaagggcaagaagaagcgggagagcattgagggcaaggatggaagaagaaggaagagcgccagtgacagcggctgtgaccctgccagcaagaagctgaagggggacagaggagaggtggacagcaatggaagtgatggaggagaggccagccggggcccctggaagggcggcaatgccagcggggagcccggcctggaccagagggccaagcagccccccagcacctttgtgccccagatcaacagaaacatccgctttgccacctacaccaaggaaaatggaagaaccctggtggtgcaggatgagcctgtgggcggggacaccccagccagcttcaccccctacagcacagccaccggccagacccccctggcccctgaggtgggcggcgctgagaacaaggaggccggcaagaccctggagcaggtgggccagggcatcgtggccagcgctgctgtggtgaccacagccagcagcacccccaacacagtgcgcatcagtgacaccggcctggccgccggcaccgtgcctgagaagcagaagggcagccgcagccaggccagcggggagaacagcagaaattccatcctggccagcagcggctttggagcccccctgcccagcagcagccagcccctgacctttggaagtggccgcagccagagcaatggagtgctggccacagagaacaagcccctgggcttctcctttggctgcagcagcgcccaggaggcccagaaggacacagacctgagcaagaacctcttcttccagtgcatgagccagaccctgcccaccagcaactacttcaccaccgtgtctgagagcctggctgatgacagcagcagccgggacagcttcaagcagagcctggagagcctgagcagcggcctgtgcaagggccgctctgtgctgggcacagacaccaagccaggcagcaaggccggcagctctgtggacaggaaggtgcctgctgagagcatgcccaccctgaccccagccttccccaggagcctgctgaatgcccggaccccagagaaccatgaaaatctcttcctgcagccccccaagctgagccgggaggagcccagcaaccccttcctggcctttgtggagaaggtggagcacagccccttcagcagctttgccagccaggccagcggcagcagcagcagcgccaccaccgtgaccagcaaggtggcccccagctggccagagagccacagcagcgctgacagcgccagcctggccaagaagaagcccctcttcatcaccacagacagcagcaagctggtgtctggagtgctgggcagcgccctgaccagcggcggccccagcctgagcgccatgggaaatggccgcagcagcagccccaccagcagcctgacccagcccatcgagatgcccaccctgagcagcagccccacagaggagcggcccaccgtgggccctggccagcaggacaaccccctgctgaagaccttcagcaatgtgtttggccgccacagcggcggcttcctgagcagccctgctgacttcagccaggagaacaaggccccctttgaagctgtgaagcgcttcagcctggatgagaggagcctggcctgccggcaggacagcgacagcagcaccaacagcgacctgagtgacctgagtgacagcgaggagcagctgcaggccaagacaggcctgaagggcatccctgagcacctgatgggcaagctgggccccaacggggagaggtctgctgagctgctgctgggcaagagcaagggcaagcaggcccccaagggccggcccaggacagcccccctgaaggtgggccagagcgtgctgaaggatgtgtccaaggtgaagaagctgaagcagagcggggagcccttcctgcaggacggcagctgcatcaacgtggccccccacctgcacaagtgccgggagtgccgcctggagcgctacaggaagttcaaggagcaggagcaggatgacagcacagtggcctgccgcttcttccacttcagaagactcatcttcaccaggaagggcgtgctgcgggtggagggcttcctgagcccccagcagagcgaccctgatgccatgaacctgtggatccccagcagcagcctggccgagggcatcgacctggagaccagcaagtacatcctggccaacgtgggggaccagttctgccagctggtgatgtctgagaaggaggccatgatgatggtggagccccaccagaaggtggcctggaagagagctgtgcggggcgtgcgggagatgtgtgatgtgtgtgagaccaccctcttcaacatccactgggtgtgcaggaaatgtggcttcggcgtgtgcctggactgctaccgcctgaggaagagccggcccaggagtgaaacagaggagatgggagatgaggaggtgttctcctggctgaagtgtgccaagggccagagccatgagcctgagaacctgatgcccacccagatcatccctggaacagccctgtacaacattggagacatggtgcatgctgcccggggcaagtggggcatcaaggccaactgcccctgcatcagccggcagaacaagtctgtgctgcggcctgctgtgaccaacggcatgagccagctgcccagcatcaaccccagcgccagcagtggaaatgagaccaccttcagcggcggcggcggccctgcccctgtgaccaccccagagccagaccacgtgcccaaggctgacagcacagacatccgctctgaggagcccctgaagacagacagcagcgccagcaacagcaacagcgagctgaaggccatccggcccccctgcccagacacagccccacccagcagcgccctgcactggctggccgacctggccacccagaaggccaaggaggagaccaaggaggccggcagcctgcggtctgtgctgaacaaggagagccacagccccttcggcctggacagcttcaacagcacagccaaggtgagccccctgacccccaagctgttcaacagcctgctgctgggccccacagccagcaacaacaagacagagggcagcagcctgcgggacctgctgcacagcggccctgggaagctgccccagacccccctggacaccggcatccccttcccccctgtgttcagcaccagcagcgctggggtgaagagcaaggccagcctgcccaacttcctggaccacatcatcgcctctgtggtggagaacaagaagaccagtgatgccagcaagagggcctgcaacctgacagacacccagaaggaggtgaaggagatggtgatgggcctgaatgtgctggacccccacaccagccacagctggctgtgtgatggccgcctgctgtgcctgcatgaccccagcaacaagaacaactggaagatcttccgggagtgctggaagcagggccagcctgtgctggtgtctggagtgcacaagaagctgaagtctgagctgtggaagccagaggccttcagccaggagtttggagaccaggatgtggacctggtgaactgcaggaactgtgccatcatcagtgatgtgaaggtgcgggacttctgggatggctttgagatcatctgcaagaggctgcggagtgaagatggccagcccatggtgctgaagctgaaggactggcccccaggagaggacttccgggacatgatgcccaccaggtttgaggacctgatggagaacctgcccctgcctgagtacaccaagagagatggccgcctgaacctggccagccggctgcccagctactttgtgcggccagacctgggccccaagatgtacaatgcctacggcctcatcacagctgaggaccggcgggtgggcaccaccaacctgcacctggatgtgtctgatgctgtgaatgtgatggtgtatgtgggcatccccatcggggagggcgcccatgatgaggaggtgctgaagaccattgatgaaggagatgctgatgaggtgaccaagcagagaattcatgatggcaaggagaagccaggggccctgtggcacatctatgctgccaaggatgctgagaagatccgggagctgctgaggaaggtgggggaggagcagggccaggagaaccccccagaccatgaccccatccatgaccagagctggtacctggaccagaccctgaggaagaggctgtatgaggagtatggagtgcagggctgggccatcgtgcagttcctgggagatgctgtgttcatcccagctggggccccccaccaggtgcacaacctgtacagctgcatcaaggtggccgaggactttgtgtccccagagcacgtgaagcactgcttccggctgacccaggagttccgccacctgagcaacacccacaccaaccacgaggacaagctgcaggtgaagaacatcatctaccacgctgtgaaggatgctgtgggcaccctgaaggcccacgagagcaagctggcccggagctag

SEQ ID NO: 158279 - DNA, 2148 bp, Artificial Sequence
  Description of Artificial Sequence: Synthetic coding sequence
atggccggcgtgggccctgggggctacgccgctgagtttgtgcccccacctgagtgccctgtgtttgagcccagctgggaggagttcacagaccccctgtccttcatcggccgcatccggcccctggccgagaagacaggcatctgcaagatccggccccccaaggagtatgccctgagcggctggaacctgaacaacatgcctgtgctggagcagagcgtgctggcccacatcaacgtggacatcagcggcatgaaggtgccctggctgtatgtgggcatgtgcttcagcagcttctgctggcacatcgaggaccactggagctacagcatcaactacctgcactggggcgagcccaagacctggtatggagtgcccagccatgctgctgagcagctggaggaggtgatgagggagctggcccctgagctgtttgagagccagcctgacctgctgcaccagctggtgaccatcatgaaccccaacgtgctgatggagcacggcgtgcctgtgtaccgcaccaaccagtgtgccggggagtttgtggtgaccttcccccgggcctaccacagcggcttcaaccagggctacaactttgctgaggccgtgaacttctgcacagctgactggctgcccatcggccggcagtgtgtgaaccactaccgccgcctgcggcggcactgtgtgttcagccatgaggagctgatcttcaagatggctgctgaccctgagtgcctggatgtgggcctggccgccatggtgtgcaaggagctgaccctgatgacagaggaggagacccggctgcgggagagcgtggtgcagatgggcgtgctgatgtctgaggaggaggtgtttgagctggtgcctgatgatgagcggcagtgcagcgcctgcaggaccacctgcttcctgagcgccctgacctgcagctgcaaccctgagcggctggtgtgcctgtaccaccccacagacctgtgcccctgccccatgcagaagaagtgcctgcgctaccgctaccccctggaggacctgcccagcctgctgtatggagtgaaggtgcgggcccagagctatgacacctgggtgtcccgggtgacagaggccctgagcgccaacttcaaccacaagaaggacctgattgagctgcgggtgatgctggaggatgctgaggacaggaagtacccagaaaatgacctcttcaggaagctgagagatgctgtgaaggaggccgagacctgtgcctctgtggcccagctgctgctgagcaagaagcagaagcaccggcagagcccagattctggccgcaccaggaccaagctgactgtggaggagctgaaggcctttgtgcagcagctgttcagcctgccctgtgtgatcagccaggcccggcaggtgaagaacctgctggatgatgtggaggagttccacgagcgggcccaggaggccatgatggatgagaccccagacagcagcaagctgcagatgctgattgacatgggcagcagcctgtatgtggagctgcctgagctgccccggctgaagcaggagctgcagcaggcccgctggctggatgaggtgcggctgaccctgagtgacccccagcaggtgaccctggatgtgatgaagaagctgattgattctggagtgggcctggccccccaccacgctgtggagaaggccatggccgagctgcaggagctgctgactgtgtctgagcgctgggaggagaaggccaaggtgtgcctgcaggcccggcccaggcacagcgtggccagcctggagagcatcgtgaatgaggccaagaacatcccagccttcctgcccaacgtgctgagcctgaaggaggccctgcagaaggcccgggagtggacagccaaggtggaggccatccagagcggcagcaactatgcctacctggagcagctggagagcctgagcgccaagggccggcccatccctgtgcggctggaggccctgccccaggtggagagccaggtggccgccgcccgggcctggagggagaggacaggccgcaccttcctgaagaagaacagcagccacaccctgctgcaggtgctgagccccaggacagacattggagtgtatggcagcggcaagaacagaaggaagaaggtgaaggagctgtag

SEQ ID NO: 158280 - DNA, 4911 bp, Artificial Sequence
  Description of Artificial Sequence: Synthetic coding sequence
atggccggcgtgggccctgggggctacgccgctgagtttgtgcccccacctgagtgccctgtgtttgagcccagctgggaggagttcacagaccccctgtccttcatcggccgcatccggcccctggccgagaagacaggcatctgcaagatccggccccccaaggactggcagcccccatttgcctgtgaggtgaagagcttccgcttcaccccccgggtgcagaggctgaatgagctggaggccatgaccagggtgcggctggacttcctggaccagctggccaagttctgggagctgcagggcagcaccctgaagatccctgtggtggagaggaagatcctggacctgtatgccctgagcaagatcgtggccagcaaaggaggctttgagatggtgaccaaggagaagaagtggagcaaggtgggcagccggctgggctacctgcccgggaagggcaccggcagcctgctgaagagccactatgaaagaatcctgtacccctatgagctgttccagagcggcgtgtccctgatgggcgtgcagatgcccaacctggacctgaaggagaaggtggagcctgaggtgctgagcacagacacccagaccagccctgagcccggcaccaggatgaacatcctgcccaagaggaccaggagagtgaagacccagagcgagagcggagatgtgtccaggaacacagagctgaagaagctgcagatctttggagctggccccaaggtggtgggcctggccatgggcaccaaggacaaggaggatgaggtgaccaggaggaggaaggtgaccaacagaagtgatgccttcaacatgcagatgaggcagaggaagggcaccctgtctgtgaactttgtggacctgtatgtgtgcatgttctgtggccggggcaacaatgaagacaagctgctgctgtgtgatggctgtgatgacagctaccacaccttctgcctgatcccccccctgcctgatgtgcccaagggggactggcgctgccccaagtgtgtggccgaggagtgcagcaagccccgggaggccttcggctttgagcaggccgtgcgggagtacaccctgcagagctttggagagatggctgacaacttcaagagtgactacttcaacatgcctgtgcacatggtgcccacagagctggtggagaaggagttctggaggctggtgagcagcattgaagaagatgtgattgtggagtatggagctgacatcagcagcaaggactttggcagcggcttccctgtgaaggatggccgcaggaagatcctgcctgaggaggaggagtatgccctgagcggctggaacctgaacaacatgcctgtgctggagcagagcgtgctggcccacatcaacgtggacatcagcggcatgaaggtgccctggctgtatgtgggcatgtgcttcagcagcttctgctggcacatcgaggaccactggagctacagcatcaactacctgcactggggcgagcccaagacctggtacggcgtgcccagccacgccgctgagcagctggaggaggtgatgagggagctggcccctgagctgtttgagagccagcctgacctgctgcaccagctggtgaccatcatgaaccccaacgtgctgatggagcacggcgtgcctgtgtaccgcaccaaccagtgtgccggggagtttgtggtgaccttcccccgggcctaccacagcggcttcaaccagggctacaactttgctgaggccgtgaacttctgcacagctgactggctgcccatcggccggcagtgtgtgaaccactacagaaggctgcggcggcactgtgtgttcagccatgaggagctgatcttcaagatggctgctgaccctgaatgtctggatgtgggcctggccgccatggtgtgcaaggagctgaccctgatgacagaggaggagacccggctgcgggagagcgtggtgcagatgggcgtgctgatgtctgaggaggaggtgtttgagctggtgcctgatgatgagcggcagtgcagcgcctgcaggaccacctgcttcctgagcgccctgacctgcagctgcaaccctgagcggctggtgtgcctgtaccaccccacagacctgtgcccctgccccatgcagaagaagtgcctgcgctaccgctaccccctggaggacctgcccagcctgctgtatggagtgaaggtgcgggcccagagctatgacacctgggtgtcccgggtgacagaggccctgagcgccaacttcaaccacaagaaggacctgattgagctgcgggtgatgctggaggatgctgaggacaggaagtacccagaaaatgacctcttcaggaagctgagagatgctgtgaaggaggccgagacctgtgcctctgtggcccagctgctgctgagcaagaagcagaagcaccggcagagcccagacagcggccgcaccaggaccaagctgactgtggaggagctgaaggcctttgtgcagcagctgttcagcctgccctgcgtcatcagccaggcccggcaggtgaagaacctgctggatgatgtggaggagttccacgagcgggcccaggaggccatgatggatgagaccccagacagcagcaagctgcagatgctgattgacatgggcagcagcctgtatgtggagctgcctgagctgccccggctgaagcaggagctgcagcaggcccgctggctggatgaggtgcggctgaccctgagtgacccccagcaggtgaccctggatgtgatgaagaagctgattgacagcggcgtgggcctggccccccaccacgctgtggagaaggccatggccgagctgcaggagctgctgactgtgtctgagcgctgggaggagaaggccaaggtgtgcctgcaggcccggcccaggcacagcgtggccagcctggagagcatcgtgaatgaggccaagaacatcccagccttcctgcccaacgtgctgagcctgaaggaggccctgcagaaggcccgggagtggacagccaaggtggaggccatccagagcggcagcaactatgcctacctggagcagctggagagcctgagcgccaagggccggcccatccctgtgcggctggaggccctgccccaggtggagagccaggtggccgccgcccgggcctggagggagaggactggaagaaccttcctgaagaagaacagcagccacaccctgctgcaggtgctgagccccaggacagacatcggcgtgtatggcagcggcaagaacagaaggaagaaggtgaaggagctgattgagaaggagaaggagaaggacctggacctggagcccctgagtgacctggaggagggcctggaggagacccgggacacagccatggtggtggccgtgttcaaggagcgggagcagaaggagattgaggccatgcacagcctgcgggccgccaacctggccaagatgaccatggtggaccgcatcgaggaggtgaagttctgcatctgcaggaagacagccagcggcttcatgctgcagtgtgagctgtgcaaggactggttccacaacagctgtgtgcccctgcccaagagcagcagccagaagaagggcagctcctggcaggccaaggaggtgaagttcctgtgccccctgtgcatgaggagcagaagaccccggctggagaccatcctgagcctgctggtgtccctgcagaagctgcctgtgcggctgcctgagggggaggccctgcagtgcctgacagagcgggccatgtcctggcaggaccgggcccggcaggccctggccacagatgagctgagcagcgccctggccaagctgtctgtgctgagccagaggatggtggagcaggccgcccgggagaagacagagaagatcatctctgctgagctgcagaaggccgccgccaacccagacctgcagggccacctgcccagcttccagcagagcgccttcaacagagtggtgtcctctgtgagcagcagcccccggcagaccatggactatgatgatgaggagacagacagtgatgaggacatccgggagacctacggctatgacatgaaggacacagcctctgtgaagagcagcagcagcctggagcccaacctcttctgtgatgaggagatccccatcaagtctgaggaggtggtgacccacatgtggacagcccccagcttctgtgccgagcacgcctacagcagcgccagcaagagctgcagccagggcagcagcacccccaggaagcagcccaggaagagccccctggtgcccaggagcctggagccccctgtgctggagctgagccctggggccaaggcccagctggaggagctgatgatggtgggggacctgctggaggtgtccctggatgagacccagcacatctggaggatcctgcaggccacccaccccccatctgaagatcgcttcctgcacatcatggaggatgacagcatggaggagaagcccctgaaggtgaagggcaaggacagcagcgagaagaagaggaagaggaagctggagaaggtggagcagctgtttggagagggcaagcagaagagcaaggagctgaagaagatggacaagcccaggaagaagaagctgaagctgggcgctgacaagagcaaggagctgaacaagctggccaagaagctggccaaggaggaggagaggaagaagaagaaggagaaggctgctgctgccaaggtggagctggtgaaggagagcacagagaagaagcgggagaagaaggtgctggacatccccagcaaatatgactggagcggggctgaggagagtgatgatgaaaatgctgtgtgtgccgcccagaactgccagaggccctgcaaggacaagggcgtggtgtttgtgacagaggaggagaagaacaagaagtactag

SEQ ID NO: 158281 - DNA, 3150 bp, Artificial Sequence
  Description of Artificial Sequence: Synthetic coding sequence
atggccggcgtgggccctgggggctacgccgctgagtttgtgcccccacctgagtgccctgtgtttgagcccagctgggaggagttcacagaccccctgtccttcatcggccgcatccggcccctggccgagaagacaggcatctgcaagatccggccccccaaggactggcagcccccatttgcctgtgaggtgaagagcttccgcttcaccccccgggtgcagaggctgaatgagctggagatcgtggccagcaagggcggctttgagatggtgaccaaggagaagaagtggagcaaggtgggcagccggctgggctacctgcctggaaaaggaacaggcagcctgctgaagagccactatgagcgcatcctgtacccctatgagctgttccagagcggcgtgtccctgatgggcgtgcagatgcccaacctggacctgaaggagaaggtggagcctgaggtgctgagcacagacacccagaccagccctgagcccggcaccaggatgaacatcctgcccaagaggacccggcgggtgaagacccagagcgagagcggagatgtgtccaggaacacagagctgaagaagctgcagatctttggagctggccccaaggtggtgggcctggccatgggcaccaaggacaaggaggatgaggtgaccaggaggaggaaggtgaccaacagaagtgatgccttcaacatgcagatgaggcagaggaagggcaccctgtctgtgaactttgtggacctgtatgtgtgcatgttctgtggccggggcaacaatgaagacaagctgctgctgtgtgatggctgtgatgacagctaccacaccttctgcctgatcccccccctgcctgatgtgcccaagggggactggcgctgccccaagtgtgtggccgaggagtgcagcaagccccgggaggcctttggatttgagcaggccgtgcgggagtacaccctgcagagctttggagagatggctgacaacttcaagagtgactacttcaacatgcctgtgcacatggtgcccacagagctggtggagaaggagttctggaggctggtgagcagcattgaggaggatgtgattgtggagtatggagctgacatcagcagcaaggactttggaagtggcttccctgtgaaggatggaagaaggaagatcctgcctgaggaggaggagtatgccctgagcggctggaacctgaacaacatgcctgtgctggagcagagcgtgctggcccacatcaacgtggacatcagcggcatgaaggtgccctggctgtatgtgggcatgtgcttcagcagcttctgctggcacatcgaggaccactggagctacagcatcaactacctgcactggggcgagcccaagacctggtatggagtgcccagccatgctgctgagcagctggaggaggtgatgagggagctggcccctgagctgtttgagagccagcctgacctgctgcaccagctggtgaccatcatgaaccccaacgtgctgatggagcacggcgtgcctgtgtaccgcaccaaccagtgtgccggggagtttgtggtgaccttcccccgggcctaccacagcggcttcaaccagggctacaactttgctgaggccgtgaacttctgcacagctgactggctgcccatcggccggcagtgtgtgaaccactaccgccgcctgcggcggcactgtgtgttcagccatgaggagctgatcttcaagatggctgctgaccctgagtgcctggatgtgggcctggccgccatggtgtgcaaggagctgaccctgatgacagaggaggagacccggctgcgggagagcgtggtgcagatgggcgtgctgatgtctgaggaggaggtgtttgagctggtgcctgatgatgagcggcagtgcagcgcctgcaggaccacctgcttcctgagcgccctgacctgcagctgcaaccctgagcggctggtgtgcctgtaccaccccacagacctgtgcccctgccccatgcagaagaagtgcctgcgctaccgctaccccctggaggacctgcccagcctgctgtatggagtgaaggtgcgggcccagagctatgacacctgggtgtcccgggtgacagaggccctgagcgccaacttcaaccacaagaaggacctgattgagctgcgggtgatgctggaggatgctgaggacaggaagtacccagaaaatgacctcttcaggaagctgagagatgctgtgaaggaggccgagacctgtgcctctgtggcccagctgctgctgagcaagaagcagaagcaccggcagagcccagattctggccgcaccaggaccaagctgactgtggaggagctgaaggcctttgtgcagcagctgttcagcctgccctgtgtgatcagccaggcccggcaggtgaagaacctgctggatgatgtggaggagttccacgagcgggcccaggaggccatgatggatgagaccccagacagcagcaagctgcagatgctgattgacatgggcagcagcctgtatgtggagctgcctgagctgccccggctgaagcaggagctgcagcaggcccgctggctggatgaggtgcggctgaccctgagtgacccccagcaggtgaccctggatgtgatgaagaagctgattgattctggagtgggcctggccccccaccacgctgtggagaaggccatggccgagctgcaggagctgctgactgtgtctgagcgctgggaggagaaggccaaggtgtgcctgcaggcccggcccaggcacagcgtggccagcctggagagcatcgtgaatgaggccaagaacatcccagccttcctgcccaacgtgctgagcctgaaggaggccctgcagaaggcccgggagtggacagccaaggtggaggccatccagagcggcagcaactatgcctacctggagcagctggagagcctgagcgccaagggccggcccatccctgtgcggctggaggccctgccccaggtggagagccaggtggccgccgcccgggcctggagggagaggacaggccgcaccttcctgaagaagaacagcagccacaccctgctgcaggtgctgagccccaggacagacattggagtgtatggcagcggcaagaacagaagatag

SEQ ID NO: 158282 - DNA, 5073 bp, Artificial Sequence
  Description of Artificial Sequence: Synthetic coding sequence
atggccggcgtgggccctgggggctacgccgctgagtttgtgcccccacctgagtgccctgtgtttgagcccagctgggaggagttcacagaccccctgtccttcatcggccgcatccggcccctggccgagaagacaggcatctgcaagatccggccccccaaggactggcagcccccatttgcctgtgaggtgaagagcttccgcttcaccccccgggtgcagaggctgaatgagctggaggccatgaccagggtgcggctggacttcctggaccagctggccaagttctgggagctgcagggcagcaccctgaagatccctgtggtggagaggaagatcctggacctgtatgccctgagcaagatcgtggccagcaaaggaggctttgagatggtgaccaaggagaagaagtggagcaaggtgggcagccggctgggctacctgcccgggaagggcaccggcagcctgctgaagagccactatgaaagaatcctgtacccctatgagctgttccagagcggcgtgtccctgatgggcgtgcagatgcccaacctggacctgaaggagaaggtggagcctgaggtgctgagcacagacacccagaccagccctgagcccggcaccaggatgaacatcctgcccaagaggaccaggagagtgaagacccagagcgagagcggagatgtgtccaggaacacagagctgaagaagctgcagatctttggagctggccccaaggtggtgggcctggccatgggcaccaaggacaaggaggatgaggtgaccaggaggaggaaggtgaccaacagaagtgatgccttcaacatgcagatgaggcagaggaagggcaccctgtctgtgaactttgtggacctgtatgtgtgcatgttctgtggccggggcaacaatgaagacaagctgctgctgtgtgatggctgtgatgacagctaccacaccttctgcctgatcccccccctgcctgatgtgcccaagggggactggcgctgccccaagtgtgtggccgaggagtgcagcaagccccgggaggccttcggctttgagcaggccgtgcgggagtacaccctgcagagctttggagagatggctgacaacttcaagagtgactacttcaacatgcctgtgcacatggtgcccacagagctggtggagaaggagttctggaggctggtgagcagcattgaagaagatgtgattgtggagtatggagctgacatcagcagcaaggactttggcagcggcttccctgtgaaggatggccgcaggaagatcctgcctgaggaggaggagtatgccctgagcggctggaacctgaacaacatgcctgtgctggagcagagcgtgctggcccacatcaacgtggacatcagcggcatgaaggtgccctggctgtatgtgggcatgtgcttcagcagcttctgctggcacatcgaggaccactggagctacagcatcaactacctgcactggggcgagcccaagacctggtacggcgtgcccagccacgccgctgagcagctggaggaggtgatgagggagctggcccctgagctgtttgagagccagcctgacctgctgcaccagctggtgaccatcatgaaccccaacgtgctgatggagcacggcgtgcctgtgtaccgcaccaaccagtgtgccggggagtttgtggtgaccttcccccgggcctaccacagcggcttcaaccagggctacaactttgctgaggccgtgaacttctgcacagctgactggctgcccatcggccggcagtgtgtgaaccactacagaaggctgcggcggcactgtgtgttcagccatgaggagctgatcttcaagatggctgctgaccctgaatgtctggatgtgggcctggccgccatggtgtgcaaggagctgaccctgatgacagaggaggagacccggctgcgggagagcgtggtgcagatgggcgtgctgatgtctgaggaggaggtgtttgagctggtgcctgatgatgagcggcagtgcagcgcctgcaggaccacctgcttcctgagcgccctgacctgcagctgcaaccctgagcggctggtgtgcctgtaccaccccacagacctgtgcccctgccccatgcagaagaagtgcctgcgctaccgctaccccctggaggacctgcccagcctgctgtatggagtgaaggtgcgggcccagagctatgacacctgggtgtcccgggtgacagaggccctgagcgccaacttcaaccacaagaaggacctgattgagctgcgggtgatgctggaggatgctgaggacaggaagtacccagaaaatgacctcttcaggaagctgagagatgctgtgaaggaggccgagacctgtgcctctgtggcccagctgctgctgagcaagaagcagaagcaccggcagagcccagacagcggccgcaccaggaccaagctgactgtggaggagctgaaggcctttgtgcagcagctgttcagcctgccctgcgtcatcagccaggcccggcaggtgaagaacctgctggatgatgtggaggagttccacgagcgggcccaggaggccatgatggatgagaccccagacagcagcaagctgcagatgctgattgacatgggcagcagcctgtatgtggagctgcctgagctgccccggctgaagcaggagctgcagcaggcccgctggctggatgaggtgcggctgaccctgagtgacccccagcaggtgaccctggatgtgatgaagaagctgattgacagcggcgtgggcctggccccccaccacgctgtggagaaggccatggccgagctgcaggagctgctgactgtgtctgagcgctgggaggagaaggccaaggtgtgcctgcaggcccggcccaggcacagcgtggccagcctggagagcatcgtgaatgaggccaagaacatcccagccttcctgcccaacgtgctgagcctgaaggaggccctgcagaaggcccgggagtggacagccaaggtggaggccatccagagcggcagcaactatgcctacctggagcagctggagagcctgagcgccaagggccggcccatccctgtgcggctggaggccctgccccaggtggagagccaggtggccgccgcccgggcctggagggagaggactggaagaaccttcctgaagaagaacagcagccacaccctgctgcaggtgctgagccccaggacagacatcggcgtgtatggcagcggcaagaacagaaggaagaaggtgaaggagctgattgagaaggagaaggagaaggacctggacctggagcccctgagtgacctggaggagggcctggaggagacccgggacacagccatggtggtggccgtgttcaaggagcgggagcagaaggagattgaggccatgcacagcctgcgggccgccaacctggccaagatgaccatggtggaccgcatcgaggaggtgaagttctgcatctgcaggaagacagccagcggcttcatgctgcagtgtgagctgtgcaaggactggttccacaacagctgtgtgcccctgcccaagagcagcagccagaagaagggcagctcctggcaggccaaggaggtgaagttcctgtgccccctgtgcatgaggagcagaagaccccggctggagaccatcctgagcctgctggtgtccctgcagaagctgcctgtgcggctgcctgagggggaggccctgcagtgcctgacagagcgggccatgtcctggcaggaccgggcccggcaggccctggccacagatgagctgagcagcgccctggccaagctgtctgtgctgagccagaggatggtggagcaggccgcccgggagaagacagagaagatcatctctgctgagctgcagaaggccgccgccaacccagacctgcagggccacctgcccagcttccagcagagcgccttcaacagagtggtgtcctctgtgagcagcagcccccggcagaccatggactatgatgatgaggagacagacagtgatgaggacatccgggagacctacggctatgacatgaaggacacagcctctgtgaagagcagcagcagcctggagcccaacctcttctgtgatgaggagatccccatcaagtctgaggaggtggtgacccacatgtggacagcccccagcttctgtgccgagcacgcctacagcagcgccagcaagagctgcagccagggcagcagcacccccaggaagcagcccaggaagagccccctggtgcccaggagcctggagccccctgtgctggagctgagccctggggccaaggcccagctggaggagctgatgatggtgggggacctgctggaggtgtccctggatgagacccagcacatctggaggatcctgcaggccacccaccccccatctgaagatcgcttcctgcacatcatggaggatgacagcatggaggagaagcccctgaaggtgaagggcaaggacagcagcgagaagaagaggaagaggaagctggagaaggtggagcagctgtttggagagggcaagcagaagagcaaggagctgaagaagatggacaagcccaggaagaagaagctgaagctgggcgctgacaagagcaaggagctgaacaagctggccaagaagctggccaaggaggaggagaggaagaagaagaaggagaaggctgctgctgccaaggtggagctggtgaaggagagcacagagaagaagcgggagaagaaggtgctggacatccccagcaaatatgactggagcggggctgaggagagtgatgatgaaaatgctgtgtgtgccgcccagaactgccagaggccctgcaaggacaaggtggactgggtgcagtgtgatggcggctgtgatgagtggttccaccaggtgtgtgtgggcgtgtccccagagatggctgaaaatgaagactacatctgcatcaactgtgccaagaagcagggccctgtgtccccaggccctgcccccccacccagcttcatcatgagctacaagctgcccatggaggacctgaaggagaccagctag

SEQ ID NO: 158283 - DNA, 3828 bp, Artificial Sequence
  Description of Artificial Sequence: Synthetic coding sequence
atgggctttgcccctgggaaggctgtgggcagccacatccggggccactatgagcgcatcctgaacccctacaacctcttcctgagcggggacagcctgcgctgcctgcagaagcccaacctgaccacagacaccaaggacaaggagtacaagccccatgacatcccccagaggcagagcgtgcagcccagcgagacctgccccccagcccggcgggccaagaggatgagagctgaggccatgaacatcaagattgagcctgaggagaccacagaggcccggacccacaacctgcggcggaggatgggctgccccacccccaagtgtgaaaatgagaaggagatgaagagcagcatcaagcaggagcccatcgagaggaaggactacatcgtggagaatgagaaggagaagcccaagagccgcagcaagaaggccaccaatgctgtggacctgtatgtgtgcctgctgtgtggcagcggaaatgatgaagatcggctgctgctgtgtgatggctgtgatgacagctaccacaccttctgcctgatcccccccctgcatgatgtgcccaagggggactggcgctgccccaagtgcctggcccaggagtgcagcaagccccaggaggccttcggctttgagcaggccgcccgggactacaccctgcggaccttcggggagatggctgatgccttcaagagtgactacttcaacatgcctgtgcacatggtgcccacagagctggtggagaaggagttctggaggctggtgtccaccattgaagaagatgtgacagtggagtatggagctgacatcgccagcaaggagtttggcagcggcttccctgtgagagatggcaagatcaagctgagccctgaggaggaggagtacctggacagcggctggaacctgaacaacatgcctgtgatggagcagagcgtgctggcccacatcacagctgacatctgtggcatgaagctgccctggctgtatgtgggcatgtgcttcagcagcttctgctggcacatcgaggaccactggagctacagcatcaactacctgcactggggcgagcccaagacctggtacggcgtgcccggctacgccgctgagcagctggagaatgtgatgaagaagctggcccctgagctgtttgtgtcccagcctgacctgctgcaccagctggtgaccatcatgaaccccaacaccctgatgacccatgaggtgcctgtgtaccgcaccaaccagtgtgccggggagtttgtgatcaccttcccccgggcctaccacagcggcttcaaccagggcttcaactttgctgaggccgtgaacttctgcaccgtggactggctgcccctgggccggcagtgtgtggagcactaccgcctgctgcaccgctactgtgtgttcagccatgatgagatgatctgcaagatggccagcaaggcagatgtgctggatgtggtggtggccagcacagtgcagaaggacatggccatcatgattgaagatgagaaggccctgcgggagaccgtgaggaagctgggcgtgattgattctgagaggatggactttgagctgctgcctgatgatgagcggcagtgtgtgaagtgcaagaccacctgcttcatgtctgccatcagctgcagctgcaagccaggcctgctggtgtgcctgcaccacgtgaaggagctgtgcagctgccccccctacaagtacaagctgcgctaccgctacaccctggatgacctgtaccccatgatgaatgccctgaagctgcgggcagagagctacaatgagtgggccctgaatgtgaatgaggccctggaggccaagatcaacaagaagaagagcctggtgtccttcaaggccctgattgaggagagcgagatgaagaagttcccagacaatgacctgctgcggcacctgcggctggtgacccaggatgctgagaagtgtgcctctgtggcccagcagctgctgaatggcaagaggcagacccgctaccgcagcggcggcggcaagagccagaaccagctgactgtgaatgagctgcggcagtttgtgacccagctgtatgccctgccctgtgtgctgagccagacccccctgctgaaggacctgctgaacagagtggaggacttccagcagcacagccagaagctgctgtctgaggagacccccagcgctgctgagctgcaggacctgctggatgtgtcctttgaatttgatgtggagctgccccagctggccgagatgaggatccggctggagcaggcccgctggctggaggaggtgcagcaggcctgcctggaccccagcagcctgaccctggatgacatgaggcggctgattgacctgggcgtgggcctggccccctacagcgctgtggagaaggccatggcccggctgcaggagctgctgactgtgtctgagcactgggatgacaaggccaagagcctgctgaaggcccggcccaggcacagcctgaacagcctggccacagctgtgaaggagattgaggagatcccagcctacctgcccaacggggccgccctgaaggacagcgtgcagagggcccgggactggctgcaggatgtggagggcctgcaggccggcggccgggtgcctgtgctggacaccctcatcgagctggtgacccggggccgcagcatccctgtgcacctgaacagcctgccccggctggagaccctggtggccgaggtgcaggcctggaaggaatgtgctgtgaacaccttcctgacagagaacagcccctacagcctgctggaggtgctgtgcccccgctgtgacatcggcctgctgggcctgaagaggaagcagaggaagctgaaggagcccctgcccaacgggaagaagaagagcaccaagctggagagcctgagtgacctggagcgggccctgacagagagcaaggagacagccagcgccatggccaccctgggggaggcccggctgcgggagatggaggccctgcagagcctgcggctggccaatgaaggcaagctgctgagccccctgcaggatgtggacatcaagatctgcctgtgccagaaggccccagctgcccccatgatccagtgtgagctgtgcagagatgccttccacaccagctgtgtggccgtgcccagcatcagccagggcctgcgcatctggctgtgcccccactgccgccgctctgagaagccacccctggagaagatcctgcccctgctggccagcctgcagaggatccgggtgcggctgcctgaaggagatgccctgcgctacatgattgaaagaacagtgaactggcagcaccgggcccagcagctgctgagcagcggcaacctgaagtttgtgcaggacagagtgggcagcggcctgctgtacagccgctggcaggccagcgctggccaggtgtctgacaccaacaaggtgtcccagcccccaggcaccaccagcttcagcctgcctgatgactgggacaacagaaccagctacctgcacagccccttcagcacaggccgcagctgcatccccctgcacggcgtgtccccagaggtgaatgagctgctgatggaggcccagctgctgcaggtgtccctgcctgagatccaggagctgtaccagaccctgctggccaagcccagccctgcccagcagacagacaggagcagccctgtgcggcccagcagcgagaagaatgactgctgccggggcaagagagatggcatcaacagcctggagaggaagctgaagaggcggctggagcgggagggcctgagcagcgagcgctgggagcgggtgaagaagatgaggaccccctag

SEQ ID NO: 158284 - DNA, 4743 bp, Artificial Sequence
  Description of Artificial Sequence: Synthetic coding sequence
atggaggccgccaccaccctgcaccctggccccaggcctgccctgcccctgggcggccctggccccctgggggagttcctgcccccaccagaatgtcctgtgtttgagcccagctgggaggagtttgctgacccctttgccttcatccacaagatccggcccatcgccgagcagacaggcatctgcaaggtgcggcccccaccagactggcagcccccatttgcctgtgatgtggacaagctgcacttcaccccccgcatccagaggctgaatgagctggaggcccagaccagggtgaagctgaacttcctggaccagatcgccaagtactgggagctgcagggcagcaccctgaagatcccccacgtggagaggaagatcctggacctcttccagctgaacaagctggtggccgaggagggcggctttgctgtggtgtgcaaggacaggaagtggaccaagatcgccaccaagatgggctttgcccctgggaaggctgtgggcagccacatccggggccactatgagcgcatcctgaacccctacaacctcttcctgagcggggacagcctgcgctgcctgcagaagcccaacctgaccacagacaccaaggacaaggagtacaagccccatgacatcccccagaggcagagcgtgcagcccagcgagacctgccccccagcccggcgggccaagaggatgagagctgagcggcagagcctggccgtgctgccccggctggagtgcagcggggccatcctggcccactgcaacctgcggctgctggacagcagcaacagcagcgccagcgccagccaggccatgaacatcaagattgagcctgaggagaccacagaggcccggacccacaacctgcggcggaggatgggctgccccacccccaagtgtgaaaatgagaaggagatgaagagcagcatcaagcaggagcccatcgagaggaaggactacatcgtggagaatgagaaggagaagcccaagagccgcagcaagaaggccaccaatgctgtggacctgtatgtgtgcctgctgtgtggcagcggaaatgatgaagatcggctgctgctgtgtgatggctgtgatgacagctaccacaccttctgcctgatcccccccctgcatgatgtgcccaagggggactggcgctgccccaagtgcctggcccaggagtgcagcaagccccaggaggccttcggctttgagcaggccgcccgggactacaccctgcggaccttcggggagatggctgatgccttcaagagtgactacttcaacatgcctgtgcacatggtgcccacagagctggtggagaaggagttctggaggctggtgtccaccattgaagaagatgtgacagtggagtatggagctgacatcgccagcaaggagtttggcagcggcttccctgtgagagatggcaagatcaagctgagccctgaggaggaggagtacctggacagcggctggaacctgaacaacatgcctgtgatggagcagagcgtgctggcccacatcacagctgacatctgtggcatgaagctgccctggctgtatgtgggcatgtgcttcagcagcttctgctggcacatcgaggaccactggagctacagcatcaactacctgcactggggcgagcccaagacctggtacggcgtgcccggctacgccgctgagcagctggagaatgtgatgaagaagctggcccctgagctgtttgtgtcccagcctgacctgctgcaccagctggtgaccatcatgaaccccaacaccctgatgacccatgaggtgcctgtgtaccgcaccaaccagtgtgccggggagtttgtgatcaccttcccccgggcctaccacagcggcttcaaccagggcttcaactttgctgaggccgtgaacttctgcaccgtggactggctgcccctgggccggcagtgtgtggagcactaccgcctgctgcaccgctactgtgtgttcagccatgatgagatgatctgcaagatggccagcaaggcagatgtgctggatgtggtggtggccagcacagtgcagaaggacatggccatcatgattgaagatgagaaggccctgcgggagaccgtgaggaagctgggcgtgattgattctgagaggatggactttgagctgctgcctgatgatgagcggcagtgtgtgaagtgcaagaccacctgcttcatgtctgccatcagctgcagctgcaagccaggcctgctggtgtgcctgcaccacgtgaaggagctgtgcagctgccccccctacaagtacaagctgcgctaccgctacaccctggatgacctgtaccccatgatgaatgccctgaagctgcgggcagagagctacaatgagtgggccctgaatgtgaatgaggccctggaggccaagatcaacaagaagaagagcctggtgtccttcaaggccctgattgaggagagcgagatgaagaagttcccagacaatgacctgctgcggcacctgcggctggtgacccaggatgctgagaagtgtgcctctgtggcccagcagctgctgaatggcaagaggcagacccgctaccgcagcggcggcggcaagagccagaaccagctgactgtgaatgagctgcggcagtttgtgacccagctgtatgccctgccctgtgtgctgagccagacccccctgctgaaggacctgctgaacagagtggaggacttccagcagcacagccagaagctgctgtctgaggagacccccagcgctgctgagctgcaggacctgctggatgtgtcctttgaatttgatgtggagctgccccagctggccgagatgaggatccggctggagcaggcccgctggctggaggaggtgcagcaggcctgcctggaccccagcagcctgaccctggatgacatgaggcggctgattgacctgggcgtgggcctggccccctacagcgctgtggagaaggccatggcccggctgcaggagctgctgactgtgtctgagcactgggatgacaaggccaagagcctgctgaaggcccggcccaggcacagcctgaacagcctggccacagctgtgaaggagattgaggagatcccagcctacctgcccaacggggccgccctgaaggacagcgtgcagagggcccgggactggctgcaggatgtggagggcctgcaggccggcggccgggtgcctgtgctggacaccctcatcgagctggtgacccggggccgcagcatccctgtgcacctgaacagcctgccccggctggagaccctggtggccgaggtgcaggcctggaaggaatgtgctgtgaacaccttcctgacagagaacagcccctacagcctgctggaggtgctgtgcccccgctgtgacatcggcctgctgggcctgaagaggaagcagaggaagctgaaggagcccctgcccaacgggaagaagaagagcaccaagctggagagcctgagtgacctggagcgggccctgacagagagcaaggagacagccagcgccatggccaccctgggggaggcccggctgcgggagatggaggccctgcagagcctgcggctggccaatgaaggcaagctgctgagccccctgcaggatgtggacatcaagatctgcctgtgccagaaggccccagctgcccccatgatccagtgtgagctgtgcagagatgccttccacaccagctgtgtggccgtgcccagcatcagccagggcctgcgcatctggctgtgcccccactgccgccgctctgagaagccacccctggagaagatcctgcccctgctggccagcctgcagaggatccgggtgcggctgcctgaaggagatgccctgcgctacatgattgaaagaacagtgaactggcagcaccgggcccagcagctgctgagcagcggcaacctgaagtttgtgcaggacagagtgggcagcggcctgctgtacagccgctggcaggccagcgctggccaggtgtctgacaccaacaaggtgtcccagcccccaggcaccaccagcttcagcctgcctgatgactgggacaacagaaccagctacctgcacagccccttcagcacaggccgcagctgcatccccctgcacggcgtgtccccagaggtgaatgagctgctgatggaggcccagctgctgcaggtgtccctgcctgagatccaggagctgtaccagaccctgctggccaagcccagccctgcccagcagacagacaggagcagccctgtgcggcccagcagcgagaagaatgactgctgccggggcaagagagatggcatcaacagcctggagaggaagctgaagaggcggctggagcgggagggcctgagcagcgagcgctgggagcgggtgaagaagatgaggacccccaagaagaagaagatcaagctgagccaccccaaggacatgaacaacttcaagctggagcgggagaggagctatgagctggtgcgctctgctgagacccacagcctgcccagcgacaccagctacagcgagcaggaggacagtgaagatgaagatgccatctgcccagctgtgtcctgcctgcagccagaaggagatgaggtggactgggtgcagtgtgatggcagctgcaaccagtggttccaccaggtgtgtgtgggcgtgtccccagagatggccgagaaggaggactacatctgtgtgcgctgcaccgtgaaggatgcccccagcaggaagtag

SEQ ID NO: 158285 - DNA, 4635 bp, Artificial Sequence
  Description of Artificial Sequence: Synthetic coding sequence
atggaggccgccaccaccctgcaccctggccccaggcctgccctgcccctgggcggccctggccccctgggggagttcctgcccccaccagaatgtcctgtgtttgagcccagctgggaggagtttgctgacccctttgccttcatccacaagatccggcccatcgccgagcagacaggcatctgcaaggtgcggcccccaccagactggcagcccccatttgcctgtgatgtggacaagctgcacttcaccccccgcatccagaggctgaatgagctggaggcccagaccagggtgaagctgaacttcctggaccagatcgccaagtactgggagctgcagggcagcaccctgaagatcccccacgtggagaggaagatcctggacctcttccagctgaacaagctggtggccgaggagggcggctttgctgtggtgtgcaaggacaggaagtggaccaagatcgccaccaagatgggctttgcccctgggaaggctgtgggcagccacatccggggccactatgagcgcatcctgaacccctacaacctcttcctgagcggggacagcctgcgctgcctgcagaagcccaacctgaccacagacaccaaggacaaggagtacaagccccatgacatcccccagaggcagagcgtgcagcccagcgagacctgccccccagcccggcgggccaagaggatgagagctgaggccatgaacatcaagattgagcctgaggagaccacagaggcccggacccacaacctgcggcggaggatgggctgccccacccccaagtgtgaaaatgagaaggagatgaagagcagcatcaagcaggagcccatcgagaggaaggactacatcgtggagaatgagaaggagaagcccaagagccgcagcaagaaggccaccaatgctgtggacctgtatgtgtgcctgctgtgtggcagcggaaatgatgaagatcggctgctgctgtgtgatggctgtgatgacagctaccacaccttctgcctgatcccccccctgcatgatgtgcccaagggggactggcgctgccccaagtgcctggcccaggagtgcagcaagccccaggaggccttcggctttgagcaggccgcccgggactacaccctgcggaccttcggggagatggctgatgccttcaagagtgactacttcaacatgcctgtgcacatggtgcccacagagctggtggagaaggagttctggaggctggtgtccaccattgaagaagatgtgacagtggagtatggagctgacatcgccagcaaggagtttggcagcggcttccctgtgagagatggcaagatcaagctgagccctgaggaggaggagtacctggacagcggctggaacctgaacaacatgcctgtgatggagcagagcgtgctggcccacatcacagctgacatctgtggcatgaagctgccctggctgtatgtgggcatgtgcttcagcagcttctgctggcacatcgaggaccactggagctacagcatcaactacctgcactggggcgagcccaagacctggtacggcgtgcccggctacgccgctgagcagctggagaatgtgatgaagaagctggcccctgagctgtttgtgtcccagcctgacctgctgcaccagctggtgaccatcatgaaccccaacaccctgatgacccatgaggtgcctgtgtaccgcaccaaccagtgtgccggggagtttgtgatcaccttcccccgggcctaccacagcggcttcaaccagggcttcaactttgctgaggccgtgaacttctgcaccgtggactggctgcccctgggccggcagtgtgtggagcactaccgcctgctgcaccgctactgtgtgttcagccatgatgagatgatctgcaagatggccagcaaggcagatgtgctggatgtggtggtggccagcacagtgcagaaggacatggccatcatgattgaagatgagaaggccctgcgggagaccgtgaggaagctgggcgtgattgattctgagaggatggactttgagctgctgcctgatgatgagcggcagtgtgtgaagtgcaagaccacctgcttcatgtctgccatcagctgcagctgcaagccaggcctgctggtgtgcctgcaccacgtgaaggagctgtgcagctgccccccctacaagtacaagctgcgctaccgctacaccctggatgacctgtaccccatgatgaatgccctgaagctgcgggcagagagctacaatgagtgggccctgaatgtgaatgaggccctggaggccaagatcaacaagaagaagagcctggtgtccttcaaggccctgattgaggagagcgagatgaagaagttcccagacaatgacctgctgcggcacctgcggctggtgacccaggatgctgagaagtgtgcctctgtggcccagcagctgctgaatggcaagaggcagacccgctaccgcagcggcggcggcaagagccagaaccagctgactgtgaatgagctgcggcagtttgtgacccagctgtatgccctgccctgtgtgctgagccagacccccctgctgaaggacctgctgaacagagtggaggacttccagcagcacagccagaagctgctgtctgaggagacccccagcgctgctgagctgcaggacctgctggatgtgtcctttgaatttgatgtggagctgccccagctggccgagatgaggatccggctggagcaggcccgctggctggaggaggtgcagcaggcctgcctggaccccagcagcctgaccctggatgacatgaggcggctgattgacctgggcgtgggcctggccccctacagcgctgtggagaaggccatggcccggctgcaggagctgctgactgtgtctgagcactgggatgacaaggccaagagcctgctgaaggcccggcccaggcacagcctgaacagcctggccacagctgtgaaggagattgaggagatcccagcctacctgcccaacggggccgccctgaaggacagcgtgcagagggcccgggactggctgcaggatgtggagggcctgcaggccggcggccgggtgcctgtgctggacaccctcatcgagctggtgacccggggccgcagcatccctgtgcacctgaacagcctgccccggctggagaccctggtggccgaggtgcaggcctggaaggaatgtgctgtgaacaccttcctgacagagaacagcccctacagcctgctggaggtgctgtgcccccgctgtgacatcggcctgctgggcctgaagaggaagcagaggaagctgaaggagcccctgcccaacgggaagaagaagagcaccaagctggagagcctgagtgacctggagcgggccctgacagagagcaaggagacagccagcgccatggccaccctgggggaggcccggctgcgggagatggaggccctgcagagcctgcggctggccaatgaaggcaagctgctgagccccctgcaggatgtggacatcaagatctgcctgtgccagaaggccccagctgcccccatgatccagtgtgagctgtgcagagatgccttccacaccagctgtgtggccgtgcccagcatcagccagggcctgcgcatctggctgtgcccccactgccgccgctctgagaagccacccctggagaagatcctgcccctgctggccagcctgcagaggatccgggtgcggctgcctgaaggagatgccctgcgctacatgattgaaagaacagtgaactggcagcaccgggcccagcagctgctgagcagcggcaacctgaagtttgtgcaggacagagtgggcagcggcctgctgtacagccgctggcaggccagcgctggccaggtgtctgacaccaacaaggtgtcccagcccccaggcaccaccagcttcagcctgcctgatgactgggacaacagaaccagctacctgcacagccccttcagcacaggccgcagctgcatccccctgcacggcgtgtccccagaggtgaatgagctgctgatggaggcccagctgctgcaggtgtccctgcctgagatccaggagctgtaccagaccctgctggccaagcccagccctgcccagcagacagacaggagcagccctgtgcggcccagcagcgagaagaatgactgctgccggggcaagagagatggcatcaacagcctggagaggaagctgaagaggcggctggagcgggagggcctgagcagcgagcgctgggagcgggtgaagaagatgaggacccccaagaagaagaagatcaagctgagccaccccaaggacatgaacaacttcaagctggagcgggagaggagctatgagctggtgcgctctgctgagacccacagcctgcccagcgacaccagctacagcgagcaggaggacagtgaagatgaagatgccatctgcccagctgtgtcctgcctgcagccagaaggagatgaggtggactgggtgcagtgtgatggcagctgcaaccagtggttccaccaggtgtgtgtgggcgtgtccccagagatggccgagaaggaggactacatctgtgtgcgctgcaccgtgaaggatgcccccagcaggaagtag

SEQ ID NO: 158286 - DNA, 4161 bp, Artificial Sequence
  Description of Artificial Sequence: Synthetic coding sequence
atgggctttgcccctgggaaggctgtgggcagccacatccggggccactatgagcgcatcctgaacccctacaacctcttcctgagcggggacagcctgcgctgcctgcagaagcccaacctgaccacagacaccaaggacaaggagtacaagccccatgacatcccccagaggcagagcgtgcagcccagcgagacctgccccccagcccggcgggccaagaggatgagagctgaggccatgaacatcaagattgagcctgaggagaccacagaggcccggacccacaacctgcggcggaggatgggctgccccacccccaagtgtgaaaatgagaaggagatgaagagcagcatcaagcaggagcccatcgagaggaaggactacatcgtggagaatgagaaggagaagcccaagagccgcagcaagaaggccaccaatgctgtggacctgtatgtgtgcctgctgtgtggcagcggaaatgatgaagatcggctgctgctgtgtgatggctgtgatgacagctaccacaccttctgcctgatcccccccctgcatgatgtgcccaagggggactggcgctgccccaagtgcctggcccaggagtgcagcaagccccaggaggccttcggctttgagcaggccgcccgggactacaccctgcggaccttcggggagatggctgatgccttcaagagtgactacttcaacatgcctgtgcacatggtgcccacagagctggtggagaaggagttctggaggctggtgtccaccattgaagaagatgtgacagtggagtatggagctgacatcgccagcaaggagtttggcagcggcttccctgtgagagatggcaagatcaagctgagccctgaggaggaggagtacctggacagcggctggaacctgaacaacatgcctgtgatggagcagagcgtgctggcccacatcacagctgacatctgtggcatgaagctgccctggctgtatgtgggcatgtgcttcagcagcttctgctggcacatcgaggaccactggagctacagcatcaactacctgcactggggcgagcccaagacctggtacggcgtgcccggctacgccgctgagcagctggagaatgtgatgaagaagctggcccctgagctgtttgtgtcccagcctgacctgctgcaccagctggtgaccatcatgaaccccaacaccctgatgacccatgaggtgcctgtgtaccgcaccaaccagtgtgccggggagtttgtgatcaccttcccccgggcctaccacagcggcttcaaccagggcttcaactttgctgaggccgtgaacttctgcaccgtggactggctgcccctgggccggcagtgtgtggagcactaccgcctgctgcaccgctactgtgtgttcagccatgatgagatgatctgcaagatggccagcaaggcagatgtgctggatgtggtggtggccagcacagtgcagaaggacatggccatcatgattgaagatgagaaggccctgcgggagaccgtgaggaagctgggcgtgattgattctgagaggatggactttgagctgctgcctgatgatgagcggcagtgtgtgaagtgcaagaccacctgcttcatgtctgccatcagctgcagctgcaagccaggcctgctggtgtgcctgcaccacgtgaaggagctgtgcagctgccccccctacaagtacaagctgcgctaccgctacaccctggatgacctgtaccccatgatgaatgccctgaagctgcgggcagagagctacaatgagtgggccctgaatgtgaatgaggccctggaggccaagatcaacaagaagaagagcctggtgtccttcaaggccctgattgaggagagcgagatgaagaagttcccagacaatgacctgctgcggcacctgcggctggtgacccaggatgctgagaagtgtgcctctgtggcccagcagctgctgaatggcaagaggcagacccgctaccgcagcggcggcggcaagagccagaaccagctgactgtgaatgagctgcggcagtttgtgacccagctgtatgccctgccctgtgtgctgagccagacccccctgctgaaggacctgctgaacagagtggaggacttccagcagcacagccagaagctgctgtctgaggagacccccagcgctgctgagctgcaggacctgctggatgtgtcctttgaatttgatgtggagctgccccagctggccgagatgaggatccggctggagcaggcccgctggctggaggaggtgcagcaggcctgcctggaccccagcagcctgaccctggatgacatgaggcggctgattgacctgggcgtgggcctggccccctacagcgctgtggagaaggccatggcccggctgcaggagctgctgactgtgtctgagcactgggatgacaaggccaagagcctgctgaaggcccggcccaggcacagcctgaacagcctggccacagctgtgaaggagattgaggagatcccagcctacctgcccaacggggccgccctgaaggacagcgtgcagagggcccgggactggctgcaggatgtggagggcctgcaggccggcggccgggtgcctgtgctggacaccctcatcgagctggtgacccggggccgcagcatccctgtgcacctgaacagcctgccccggctggagaccctggtggccgaggtgcaggcctggaaggaatgtgctgtgaacaccttcctgacagagaacagcccctacagcctgctggaggtgctgtgcccccgctgtgacatcggcctgctgggcctgaagaggaagcagaggaagctgaaggagcccctgcccaacgggaagaagaagagcaccaagctggagagcctgagtgacctggagcgggccctgacagagagcaaggagacagccagcgccatggccaccctgggggaggcccggctgcgggagatggaggccctgcagagcctgcggctggccaatgaaggcaagctgctgagccccctgcaggatgtggacatcaagatctgcctgtgccagaaggccccagctgcccccatgatccagtgtgagctgtgcagagatgccttccacaccagctgtgtggccgtgcccagcatcagccagggcctgcgcatctggctgtgcccccactgccgccgctctgagaagccacccctggagaagatcctgcccctgctggccagcctgcagaggatccgggtgcggctgcctgaaggagatgccctgcgctacatgattgaaagaacagtgaactggcagcaccgggcccagcagctgctgagcagcggcaacctgaagtttgtgcaggacagagtgggcagcggcctgctgtacagccgctggcaggccagcgctggccaggtgtctgacaccaacaaggtgtcccagcccccaggcaccaccagcttcagcctgcctgatgactgggacaacagaaccagctacctgcacagccccttcagcacaggccgcagctgcatccccctgcacggcgtgtccccagaggtgaatgagctgctgatggaggcccagctgctgcaggtgtccctgcctgagatccaggagctgtaccagaccctgctggccaagcccagccctgcccagcagacagacaggagcagccctgtgcggcccagcagcgagaagaatgactgctgccggggcaagagagatggcatcaacagcctggagaggaagctgaagaggcggctggagcgggagggcctgagcagcgagcgctgggagcgggtgaagaagatgaggacccccaagaagaagaagatcaagctgagccaccccaaggacatgaacaacttcaagctggagcgggagaggagctatgagctggtgcgctctgctgagacccacagcctgcccagcgacaccagctacagcgagcaggaggacagtgaagatgaagatgccatctgcccagctgtgtcctgcctgcagccagaaggagatgaggtggactgggtgcagtgtgatggcagctgcaaccagtggttccaccaggtgtgtgtgggcgtgtccccagagatggccgagaaggaggactacatctgtgtgcgctgcaccgtgaaggatgcccccagcaggaagtag

SEQ ID NO: 158287 - DNA, 933 bp, Artificial Sequence
  Description of Artificial Sequence: Synthetic coding sequence
atgatctgcaagatggccagcaaggcagatgtgctggatgtggtggtggccagcacagtgcagaaggacatggccatcatgattgaagatgagaaggccctgcgggagaccgtgaggaagctgggcgtcatcgacagcgagaggatggactttgagctgctgcctgatgatgagcggcagtgtgtgaagtgcaagaccacctgcttcatgtctgccatcagctgcagctgcaagccaggcctgctggtgtgcctgcaccacgtgaaggagctgtgcagctgccccccctacaagtacaagctgcgctaccgctacaccctggatgacctgtaccccatgatgaatgccctgaagctgcgggcagagagctacaatgagtgggccctgaatgtgaatgaggccctggaggccaagatcaacaagaagaagagcctggtgtccttcaaggccctgattgaggagagcgagatgaagaagttcccagacaatgacctgctgcggcacctgcggctggtgacccaggatgctgagaagtgtgcctctgtggcccagcagctgctgaatggcaagaggcagacccgctacagaagtggcggcggcaagagccagaaccagctgactgtgaatgagctgcggcagtttgtgacccagctgtatgccctgccctgtgtgctgagccagacccccctgctgaaggacctgctgaacagagtggaggacttccagcagcacagccagaagctgctgtctgaggagaccccatctgctgctgagctgcaggacctgctggatgtgtcctttgaatttgatgtggagctgccccagctggccgagatgaggatccggctggagcaggcccgctggctggaggaggtgcagcaggcctgcctggaccccagcagcctgaccctggatgacatgagggtgtcctag

SEQ ID NO: 158288 - DNA, 4674 bp, Artificial Sequence
  Description of Artificial Sequence: Synthetic coding sequence
atggagcccggcagtgatgacttcctgcccccaccagaatgtcctgtgtttgagcccagctgggccgagttccgggaccccctgggctacatcgccaagatccggcccatcgccgagaagagcggcatctgcaagatccggcccccagctgactggcagcccccatttgctgtggaggtggacaacttccgcttcaccccccgcatccagaggctgaatgagctggaggcccagaccagggtgaagctgaactacctggaccagatcgccaagttctgggagatccagggcagcagcctgaagatccccaacgtggagcggcgcatcctggacctgtacagcctgagcaagatcgtggtggaggagggcggctatgaggccatctgcaaggaccggcgctgggcccgggtggcccagaggctgaactacccacctgggaagaacatcggcagcctgctgcggagccactatgagcgcatcgtgtacccctatgagatgtaccagagcggggccaacctggtgcagtgcaacacccggccctttgacaatgaggagaaggacaaggagtacaagccccacagcatccccctgcggcagagcgtgcagcccagcaagttcaacagctatggaagaagagccaagaggctgcagcctgaccctgagcccacagaagaagatattgagaagaaccctgagctgaagaagctgcagatctatggagctggccccaagatgatgggcctgggcctgatggccaaggacaagaccctgaggaagaaggacaaggagggccctgagtgcccccccaccgtggtggtgaaggaggagctgggcggagatgtgaaggtggagagcaccagccccaagaccttcctggagagcaaggaggagctgagccacagccctgagccctgcaccaagatgaccatgaggctgcggaggaaccacagcaatgcccagttcatcgagagctatgtgtgcaggatgtgcagcagaggagatgaagatgacaagctgctgctgtgtgatggctgtgatgacaactaccacatcttctgcctgctgccccccctgcctgagatccccaagggcgtgtggcgctgccccaagtgtgtgatggccgagtgcaagaggcctcctgaggcctttggatttgagcaggccacccgggagtacaccctgcagagctttggagagatggctgacagcttcaaggctgactacttcaacatgcctgtgcacatggtgcccacagagctggtggagaaggagttctggaggctggtgaacagcattgaggaggatgtgacagtggagtatggagctgacatccacagcaaggagtttggaagtggcttccctgtgtctgacagcaagaggcacctgaccccagaggaggaggagtatgccaccagcggctggaacctgaatgtgatgcctgtgctggagcagagcgtgctgtgccacatcaatgctgacatcagcggcatgaaggtgccctggctgtatgtgggcatggtgttttctgccttctgctggcacatcgaggaccactggagctacagcatcaactacctgcactggggcgagcccaagacctggtatggagtgcccagcctggccgctgagcacctggaggaggtgatgaagaagctgaccccagagctgtttgacagccagcctgacctgctgcaccagctggtgaccctgatgaaccccaacaccctgatgagccatggagtgcctgtggtgaggaccaaccagtgtgccggggagtttgtgatcaccttcccccgggcctaccacagcggcttcaaccagggctacaactttgctgaggccgtgaacttctgcacagctgactggctgcctgctggccggcagtgcatcgagcactaccgccgcctgcggcgctactgtgtgttcagccatgaggagctgatctgcaagatggccgcctgcccagagaagctggacctgaacctggccgctgctgtgcacaaggagatgttcatcatggtgcaggaggagcggcggctgaggaaggccctgctggagaagggcatcacagaggccgagcgggaggcctttgagctgctgcctgatgatgagcggcagtgcatcaagtgcaagaccacctgcttcctgagcgccctggcctgctatgactgcccagatggcctggtgtgcctgagccacatcaatgacctgtgcaagtgcagcagcagccggcagtacctgcgctaccgctacaccctggatgagctgcctgccatgctgcacaagctgaaggtgcgggcagagagctttgacacctgggccaacaaggtgcgggtggccctggaggtggaggatggcaggaagaggagcctggaggagctgcgggccctggagagcgaggcccgggagcggcgcttccccaacagcgagctgctgcagcagctgaagaactgcctgtctgaggccgaggcctgtgtgtcccgggccctgggcctggtgtctggccaggaggccggcccccaccgggtggccggcctgcagatgaccctgacagagctgcgggccttcctggaccagatgaacaacctgccctgtgccatgcaccagattggagatgtgaagggcgtgctggagcaggtggaggcctaccaggccgaggcccgggaggccctggccagcctgcccagcagccctggcctgctgcagagcctgctggagcggggccggcagctgggcgtggaggtgcctgaggcccagcagctgcagaggcaggtggagcaggcccgctggctggatgaggtgaagaggaccctggcccccagcgcccggcggggcaccctggccgtgatgaggggcctgctggtggccggggcctctgtggcccccagccctgctgtggacaaggcccaggccgagctgcaggagctgctgaccatcgccgagcgctgggaggagaaggcccacctgtgcctggaggcccggcagaagcaccccccagccaccctggaggccatcatccgggaggccgagaacatccctgtgcacctgcccaacatccaggccctgaaggaggccctggccaaggcccgggcctggattgctgatgtggatgagatccagaatggagaccactacccctgcctggatgacctggagggcctggtggccgtgggccgggacctgcctgtgggcctggaggagctgcggcagctggagctgcaggtgctgacagcccacagctggagggagaaggccagcaagaccttcctgaagaagaacagctgctacaccctgctggaggtgctgtgcccctgtgctgatgctggcagtgacagcaccaagaggagccgctggatggagaaggagctgggcctgtacaagagtgacacagagctgctgggcctgagcgcccaggacctgcgggaccccggctctgtgattgtggccttcaaggagggggagcagaaggagaaggagggcatcctgcagctgcggaggaccaacagcgccaagcccagccccctggccagcagcagcacagccagcagcaccaccagcatctgtgtgtgtggccaggtgctggccggggccggggccctgcagtgtgacctgtgccaggactggttccacggccgctgtgtgtctgtgccccggctgctgagcagcccccggcccaaccccaccagcagccccctgctggcctggtgggagtgggacaccaagttcctgtgccccctgtgcatgaggagcagaagaccccggctggagaccatcctggccctgctggtggccctgcagaggctgcctgtgcggctgcctgagggggaggccctgcagtgcctgacagagcgggccatctcctggcagggccgggcccggcaggccctggcctctgaagatgtgacagccctgctgggccgcctggccgagctgcggcagaggctgcaggccgagcccaggcctgaggagccccccaactacccagctgccccagccagtgaccccctgcgggagggcagcggcaaggacatgcccaaggtgcagggcctgctggagaatggagacagcgtgaccagccctgagaaggtggcccctgaggagggcagtgacctggagctgctgagcagcctgctgccccagctgaccggccctgtgctggagctgcctgaggccacccgggcccccctggaggagctgatgatggagggggacctgctggaggtgaccctggatgagaaccacagcatctggcagctgctgcaggccggccagcccccagacctggagcgcatccgcaccctgctggagctggagaaggccgagagacatggcagccgggcccggggccgggccctggagaggagaagaagaaggaaggtggacagaggaggagaaggagatgatcctgcccgggaggagctggagcccaagagggtgcgcagcagcggccctgaggccgaggaggtgcaggaggaggaggagctggaggaggagactggaggagagggccccccagcccccatccccaccaccggcagccccagcacccaggagaaccagaatggcctggagcctgctgagggcaccaccagcggccccagcgcccccttcagcaccctgaccccccggctgcacctgccctgcccccagcagcccccccagcagcagctgtag

SEQ ID NO: 158289 - DNA, 4551 bp, Artificial Sequence
  Description of Artificial Sequence: Synthetic coding sequence
atggagcccggcagtgatgacttcctgcccccaccagaatgtcctgtgtttgagcccagctgggccgagttccgggaccccctgggctacatcgccaagatccggcccatcgccgagaagagcggcatctgcaagatccggcccccagctgactggcagcccccatttgctgtggaggtggacaacttccgcttcaccccccgcatccagaggctgaatgagctggagatcgtggtggaggagggcggctatgaggccatctgcaaggaccggcgctgggcccgggtggcccagaggctgaactacccacctgggaagaacatcggcagcctgctgcggagccactatgaaagaattgtgtacccctatgagatgtaccagagcggggccaacctggtgcagtgcaacacccggccctttgacaatgaggagaaggacaaggagtacaagccccacagcatccccctgcggcagagcgtgcagcccagcaagttcaacagctatggccggcgggccaagaggctgcagcctgaccctgagcccacagaggaggacatcgagaagaaccctgagctgaagaagctgcagatctacggggccggccccaagatgatgggcctgggcctgatggccaaggacaagaccctgaggaagaaggacaaggagggcccagaatgtcctcccaccgtggtggtgaaggaggagctgggcggagatgtgaaggtggagagcaccagccccaagaccttcctggagagcaaggaggagctgagccacagccctgagccctgcaccaagatgaccatgaggctgcggaggaaccacagcaatgcccagttcatcgagagctatgtgtgcaggatgtgcagcagaggagatgaagatgacaagctgctgctgtgtgatggctgtgatgacaactaccacatcttctgcctgctgccccccctgcctgagatccccaagggcgtgtggcgctgccccaagtgtgtgatggccgagtgcaagaggcctcctgaggccttcggctttgagcaggccacccgggagtacaccctgcagagctttggagagatggctgacagcttcaaggctgactacttcaacatgcctgtgcacatggtgcccacagagctggtggagaaggagttctggaggctggtgaacagcattgaagaagatgtgacagtggagtatggagctgacatccacagcaaggagtttggcagcggcttccctgtgtctgacagcaagaggcacctgaccccagaggaggaggagtatgccaccagcggctggaacctgaatgtgatgcctgtgctggagcagagcgtgctgtgccacatcaatgctgacatcagcggcatgaaggtgccctggctgtatgtgggcatggtgttcagcgccttctgctggcacatcgaggaccactggagctacagcatcaactacctgcactggggcgagcccaagacctggtacggcgtgcccagcctggccgctgagcacctggaggaggtgatgaagaagctgaccccagagctgtttgacagccagcctgacctgctgcaccagctggtgaccctgatgaaccccaacaccctgatgagccacggcgtgcctgtggtgaggaccaaccagtgtgccggggagtttgtgatcaccttcccccgggcctaccacagcggcttcaaccagggctacaactttgctgaggccgtgaacttctgcacagctgactggctgcctgctggccggcagtgcatcgagcactacagaaggctgcggcgctactgtgtgttcagccatgaggagctgatctgcaagatggccgcctgcccagagaagctggacctgaacctggccgctgctgtgcacaaggagatgttcatcatggtgcaggaggagcggcggctgaggaaggccctgctggagaagggcatcacagaagctgagcgggaggcctttgagctgctgcctgatgatgagcggcagtgcatcaagtgcaagaccacctgcttcctgagcgccctggcctgctatgactgcccagatggcctggtgtgcctgagccacatcaatgacctgtgcaagtgcagcagcagccggcagtacctgcgctaccgctacaccctggatgagctgcctgccatgctgcacaagctgaaggtgcgggcagagagctttgacacctgggccaacaaggtgcgggtggccctggaggtggaggatggcaggaagaggagcctggaggagctgcgggccctggagagcgaggcccgggagcggcgcttccccaacagcgagctgctgcagcagctgaagaactgcctgtctgaggccgaggcctgtgtgtcccgggccctgggcctggtgtctggccaggaggccggcccccaccgggtggccggcctgcagatgaccctgacagagctgcgggccttcctggaccagatgaacaacctgccctgtgccatgcaccagattggagatgtgaagggcgtgctggagcaggtggaggcctaccaggccgaggcccgggaggccctggccagcctgcccagcagccctggcctgctgcagagcctgctggagcggggccggcagctgggcgtggaggtgcctgaggcccagcagctgcagaggcaggtggagcaggcccgctggctggatgaggtgaagaggaccctggcccccagcgcccggcggggcaccctggccgtgatgaggggcctgctggtggccggggcctctgtggcccccagccctgctgtggacaaggcccaggccgagctgcaggagctgctgaccatcgccgagcgctgggaggagaaggcccacctgtgcctggaggcccggcagaagcaccccccagccaccctggaggccatcatccgggaggccgagaacatccctgtgcacctgcccaacatccaggccctgaaggaggccctggccaaggcccgggcctggattgctgatgtggatgagatccagaatggagaccactacccctgcctggatgacctggagggcctggtggccgtgggccgggacctgcctgtgggcctggaggagctgcggcagctggagctgcaggtgctgacagcccacagctggagggagaaggccagcaagaccttcctgaagaagaacagctgctacaccctgctggaggtgctgtgcccctgtgctgatgctggcagtgacagcaccaagaggagccgctggatggagaaggagctgggcctgtacaagagtgacacagagctgctgggcctgagcgcccaggacctgcgggaccccggcagcgtcatcgtggccttcaaggagggggagcagaaggagaaggagggcatcctgcagctgcggaggaccaacagcgccaagcccagccccctggccagcagcagcacagccagcagcaccaccagcatctgtgtgtgtggccaggtgctggccggggccggggccctgcagtgtgacctgtgccaggactggttccacggccgctgtgtgtctgtgccccggctgctgagcagcccccggcccaaccccaccagcagccccctgctggcctggtgggagtgggacaccaagttcctgtgccccctgtgcatgaggagccggcggccccggctggagaccatcctggccctgctggtggccctgcagaggctgcctgtgcggctgcctgagggggaggccctgcagtgcctgacagagcgggccatctcctggcagggccgggcccggcaggccctggcctctgaagatgtgacagccctgctgggccgcctggccgagctgcggcagaggctgcaggccgagcccaggcctgaggagccccccaactacccagctgccccagccagtgaccccctgcgggagggcagcggcaaggacatgcccaaggtgcagggcctgctggagaatggagacagcgtgaccagccctgagaaggtggcccctgaggagggcagtgacctggagctgctgagcagcctgctgccccagctgactggacctgtgctggagctgcctgaggccacccgggcccccctggaggagctgatgatggagggggacctgctggaggtgaccctggatgagaaccacagcatctggcagctgctgcaggccggccagcccccagacctggagcgcatccgcaccctgctggagctggagaaggccgagcggcacggcagccgggcccggggccgggccctggagaggagaagaagaaggaaggtggaccggggcggggagggagatgatcctgcccgggaggagctggagcccaagagggtgcgcagcagcggccctgaggccgaggaggtgcaggaggaggaggagctggaggaggagaccggcggggagggccccccagcccccatccccaccaccggcagccccagcacccaggagaaccagaatggcctggagcctgctgagggcaccaccagcggccccagcgcccccttcagcaccctgaccccccggctgcacctgccctgcccccagcagcccccccagcagcagctgtag

SEQ ID NO: 158290 - DNA, 4683 bp, Artificial Sequence
  Description of Artificial Sequence: Synthetic coding sequence
atggagcccggcagtgatgacttcctgcccccaccagaatgtcctgtgtttgagcccagctgggccgagttccgggaccccctgggctacatcgccaagatccggcccatcgccgagaagagcggcatctgcaagatccggcccccagctgactggcagcccccatttgctgtggaggtggacaacttccgcttcaccccccgcatccagaggctgaatgagctggaggcccagaccagggtgaagctgaactacctggaccagatcgccaagttctgggagatccagggcagcagcctgaagatccccaacgtggagcggcgcatcctggacctgtacagcctgagcaagatcgtggtggaggagggcggctatgaggccatctgcaaggaccggcgctgggcccgggtggcccagaggctgaactacccacctgggaagaacatcggcagcctgctgcggagccactatgagcgcatcgtgtacccctatgagatgtaccagagcggggccaacctggtgcagtgcaacacccggccctttgacaatgaggagaaggacaaggagtacaagccccacagcatccccctgcggcagagcgtgcagcccagcaagttcaacagctatggaagaagagccaagaggctgcagcctgaccctgagcccacagaagaagatattgagaagaaccctgagctgaagaagctgcagatctatggagctggccccaagatgatgggcctgggcctgatggccaaggacaagaccctgaggaagaaggacaaggagggccctgagtgcccccccaccgtggtggtgaaggaggagctgggcggagatgtgaaggtggagagcaccagccccaagaccttcctggagagcaaggaggagctgagccacagccctgagccctgcaccaagatgaccatgaggctgcggaggaaccacagcaatgcccagttcatcgagagctatgtgtgcaggatgtgcagcagaggagatgaagatgacaagctgctgctgtgtgatggctgtgatgacaactaccacatcttctgcctgctgccccccctgcctgagatccccaagggcgtgtggcgctgccccaagtgtgtgatggccgagtgcaagaggcctcctgaggcctttggatttgagcaggccacccgggagtacaccctgcagagctttggagagatggctgacagcttcaaggctgactacttcaacatgcctgtgcacatggtgcccacagagctggtggagaaggagttctggaggctggtgaacagcattgaggaggatgtgacagtggagtatggagctgacatccacagcaaggagtttggaagtggcttccctgtgtctgacagcaagaggcacctgaccccagaggaggaggagtatgccaccagcggctggaacctgaatgtgatgcctgtgctggagcagagcgtgctgtgccacatcaatgctgacatcagcggcatgaaggtgccctggctgtatgtgggcatggtgttttctgccttctgctggcacatcgaggaccactggagctacagcatcaactacctgcactggggcgagcccaagacctggtatggagtgcccagcctggccgctgagcacctggaggaggtgatgaagaagctgaccccagagctgtttgacagccagcctgacctgctgcaccagctggtgaccctgatgaaccccaacaccctgatgagccatggagtgcctgtggtgaggaccaaccagtgtgccggggagtttgtgatcaccttcccccgggcctaccacagcggcttcaaccagggctacaactttgctgaggccgtgaacttctgcacagctgactggctgcctgctggccggcagtgcatcgagcactaccgccgcctgcggcgctactgtgtgttcagccatgaggagctgatctgcaagatggccgcctgcccagagaagctggacctgaacctggccgctgctgtgcacaaggagatgttcatcatggtgcaggaggagcggcggctgaggaaggccctgctggagaagggcatcacagaggccgagcgggaggcctttgagctgctgcctgatgatgagcggcagtgcatcaagtgcaagaccacctgcttcctgagcgccctggcctgctatgactgcccagatggcctggtgtgcctgagccacatcaatgacctgtgcaagtgcagcagcagccggcagtacctgcgctaccgctacaccctggatgagctgcctgccatgctgcacaagctgaaggtgcgggcagagagctttgacacctgggccaacaaggtgcgggtggccctggaggtggaggatggcaggaagaggagcctggaggagctgcgggccctggagagcgaggcccgggagcggcgcttccccaacagcgagctgctgcagcagctgaagaactgcctgtctgaggccgaggcctgtgtgtcccgggccctgggcctggtgtctggccaggaggccggcccccaccgggtggccggcctgcagatgaccctgacagagctgcgggccttcctggaccagatgaacaacctgccctgtgccatgcaccagattggagatgtgaagggcgtgctggagcaggtggaggcctaccaggccgaggcccgggaggccctggccagcctgcccagcagccctggcctgctgcagagcctgctggagcggggccggcagctgggcgtggaggtgcctgaggcccagcagctgcagaggcaggtggagcaggcccgctggctggatgaggtgaagaggaccctggcccccagcgcccggcggggcaccctggccgtgatgaggggcctgctggtggccggggcctctgtggcccccagccctgctgtggacaaggcccaggccgagctgcaggagctgctgaccatcgccgagcgctgggaggagaaggcccacctgtgcctggaggcccggcagaagcaccccccagccaccctggaggccatcatccgggaggccgagaacatccctgtgcacctgcccaacatccaggccctgaaggaggccctggccaaggcccgggcctggattgctgatgtggatgagatccagaatggagaccactacccctgcctggatgacctggagggcctggtggccgtgggccgggacctgcctgtgggcctggaggagctgcggcagctggagctgcaggtgctgacagcccacagctggagggagaaggccagcaagaccttcctgaagaagaacagctgctacaccctgctggaggtgctgtgcccctgtgctgatgctggcagtgacagcaccaagaggagccgctggatggagaaggagctgggcctgtacaagagtgacacagagctgctgggcctgagcgcccaggacctgcgggaccccggctctgtgattgtggccttcaaggagggggagcagaaggagaaggagggcatcctgcagctgcggaggaccaacagcgccaagcccagccccctggccagcagcagcacagccagcagcaccaccagcatctgtgtgtgtggccaggtgctggccggggccggggccctgcagtgtgacctgtgccaggactggttccacggccgctgtgtgtctgtgccccggctgctgagcagcccccggcccaaccccaccagcagccccctgctggcctggtgggagtgggacaccaagttcctgtgccccctgtgcatgaggagcagaagaccccggctggagaccatcctggccctgctggtggccctgcagaggctgcctgtgcggctgcctgagggggaggccctgcagtgcctgacagagcgggccatctcctggcagggccgggcccggcaggccctggcctctgaagatgtgacagccctgctgggccgcctggccgagctgcggcagaggctgcaggccgagcccaggcctgaggagccccccaactacccagctgccccagccagtgaccccctgcgggagggcagcggcaaggacatgcccaaggtgcagggcctgctggagaatggagacagcgtgaccagccctgagaaggtggcccctgaggagggcagcggcaagagggacctggagctgctgagcagcctgctgccccagctgactggacctgtgctggagctgcctgaggccacccgggcccccctggaggagctgatgatggagggggacctgctggaggtgaccctggatgagaaccacagcatctggcagctgctgcaggccggccagcccccagacctggagcgcatccgcaccctgctggagctggagaaggccgagcggcacggcagccgggcccggggccgggccctggagaggagaagaagaaggaaggtggaccggggcggggagggagatgatcctgcccgggaggagctggagcccaagagggtgcgcagcagcggccctgaggccgaggaggtgcaggaggaggaggagctggaggaggagaccggcggggagggccccccagcccccatccccaccaccggcagccccagcacccaggagaaccagaatggcctggagcctgctgagggcaccaccagcggccccagcgcccccttcagcaccctgaccccccggctgcacctgccctgcccccagcagcccccccagcagcagctgtag

SEQ ID NO: 158291 - DNA, 4680 bp, Artificial Sequence
  Description of Artificial Sequence: Synthetic coding sequence
atggagcccggcagtgatgacttcctgcccccaccagaatgtcctgtgtttgagcccagctgggccgagttccgggaccccctgggctacatcgccaagatccggcccatcgccgagaagagcggcatctgcaagatccggcccccagctgactggcagcccccatttgctgtggaggtggacaacttccgcttcaccccccgcatccagaggctgaatgagctggaggcccagaccagggtgaagctgaactacctggaccagatcgccaagttctgggagatccagggcagcagcctgaagatccccaacgtggagcggcgcatcctggacctgtacagcctgagcaagatcgtggtggaggagggcggctatgaggccatctgcaaggaccggcgctgggcccgggtggcccagaggctgaactacccacctgggaagaacatcggcagcctgctgcggagccactatgagcgcatcgtgtacccctatgagatgtaccagagcggggccaacctggtgtgcaacacccggccctttgacaatgaggagaaggacaaggagtacaagccccacagcatccccctgcggcagagcgtgcagcccagcaagttcaacagctatggccggcgggccaagaggctgcagcctgaccctgagcccacagaggaggacatcgagaagaaccctgagctgaagaagctgcagatctacggggccggccccaagatgatgggcctgggcctgatggccaaggacaagaccctgaggaagaaggacaaggagggcccagaatgtcctcccaccgtggtggtgaaggaggagctgggcggagatgtgaaggtggagagcaccagccccaagaccttcctggagagcaaggaggagctgagccacagccctgagccctgcaccaagatgaccatgaggctgcggaggaaccacagcaatgcccagttcatcgagagctatgtgtgcaggatgtgcagcagaggagatgaagatgacaagctgctgctgtgtgatggctgtgatgacaactaccacatcttctgcctgctgccccccctgcctgagatccccaagggcgtgtggcgctgccccaagtgtgtgatggccgagtgcaagaggcctcctgaggccttcggctttgagcaggccacccgggagtacaccctgcagagctttggagagatggctgacagcttcaaggctgactacttcaacatgcctgtgcacatggtgcccacagagctggtggagaaggagttctggaggctggtgaacagcattgaagaagatgtgacagtggagtatggagctgacatccacagcaaggagtttggcagcggcttccctgtgtctgacagcaagaggcacctgaccccagaggaggaggagtatgccaccagcggctggaacctgaatgtgatgcctgtgctggagcagagcgtgctgtgccacatcaatgctgacatcagcggcatgaaggtgccctggctgtatgtgggcatggtgttcagcgccttctgctggcacatcgaggaccactggagctacagcatcaactacctgcactggggcgagcccaagacctggtacggcgtgcccagcctggccgctgagcacctggaggaggtgatgaagaagctgaccccagagctgtttgacagccagcctgacctgctgcaccagctggtgaccctgatgaaccccaacaccctgatgagccacggcgtgcctgtggtgaggaccaaccagtgtgccggggagtttgtgatcaccttcccccgggcctaccacagcggcttcaaccagggctacaactttgctgaggccgtgaacttctgcacagctgactggctgcctgctggccggcagtgcatcgagcactacagaaggctgcggcgctactgtgtgttcagccatgaggagctgatctgcaagatggccgcctgcccagagaagctggacctgaacctggccgctgctgtgcacaaggagatgttcatcatggtgcaggaggagcggcggctgaggaaggccctgctggagaagggcatcacagaagctgagcgggaggcctttgagctgctgcctgatgatgagcggcagtgcatcaagtgcaagaccacctgcttcctgagcgccctggcctgctatgactgcccagatggcctggtgtgcctgagccacatcaatgacctgtgcaagtgcagcagcagccggcagtacctgcgctaccgctacaccctggatgagctgcctgccatgctgcacaagctgaaggtgcgggcagagagctttgacacctgggccaacaaggtgcgggtggccctggaggtggaggatggcaggaagaggagcctggaggagctgcgggccctggagagcgaggcccgggagcggcgcttccccaacagcgagctgctgcagcagctgaagaactgcctgtctgaggccgaggcctgtgtgtcccgggccctgggcctggtgtctggccaggaggccggcccccaccgggtggccggcctgcagatgaccctgacagagctgcgggccttcctggaccagatgaacaacctgccctgtgccatgcaccagattggagatgtgaagggcgtgctggagcaggtggaggcctaccaggccgaggcccgggaggccctggccagcctgcccagcagccctggcctgctgcagagcctgctggagcggggccggcagctgggcgtggaggtgcctgaggcccagcagctgcagaggcaggtggagcaggcccgctggctggatgaggtgaagaggaccctggcccccagcgcccggcggggcaccctggccgtgatgaggggcctgctggtggccggggcctctgtggcccccagccctgctgtggacaaggcccaggccgagctgcaggagctgctgaccatcgccgagcgctgggaggagaaggcccacctgtgcctggaggcccggcagaagcaccccccagccaccctggaggccatcatccgggaggccgagaacatccctgtgcacctgcccaacatccaggccctgaaggaggccctggccaaggcccgggcctggattgctgatgtggatgagatccagaatggagaccactacccctgcctggatgacctggagggcctggtggccgtgggccgggacctgcctgtgggcctggaggagctgcggcagctggagctgcaggtgctgacagcccacagctggagggagaaggccagcaagaccttcctgaagaagaacagctgctacaccctgctggaggtgctgtgcccctgtgctgatgctggcagtgacagcaccaagaggagccgctggatggagaaggagctgggcctgtacaagagtgacacagagctgctgggcctgagcgcccaggacctgcgggaccccggcagcgtcatcgtggccttcaaggagggggagcagaaggagaaggagggcatcctgcagctgcggaggaccaacagcgccaagcccagccccctggccagcagcagcacagccagcagcaccaccagcatctgtgtgtgtggccaggtgctggccggggccggggccctgcagtgtgacctgtgccaggactggttccacggccgctgtgtgtctgtgccccggctgctgagcagcccccggcccaaccccaccagcagccccctgctggcctggtgggagtgggacaccaagttcctgtgccccctgtgcatgaggagccggcggccccggctggagaccatcctggccctgctggtggccctgcagaggctgcctgtgcggctgcctgagggggaggccctgcagtgcctgacagagcgggccatctcctggcagggccgggcccggcaggccctggcctctgaagatgtgacagccctgctgggccgcctggccgagctgcggcagaggctgcaggccgagcccaggcctgaggagccccccaactacccagctgccccagccagtgaccccctgcgggagggcagcggcaaggacatgcccaaggtgcagggcctgctggagaatggagacagcgtgaccagccctgagaaggtggcccctgaggagggcagcggcaagagggacctggagctgctgagcagcctgctgccccagctgaccggccctgtgctggagctgcctgaggccacccgggcccccctggaggagctgatgatggagggggacctgctggaggtgaccctggatgagaaccacagcatctggcagctgctgcaggccggccagcccccagacctggagcgcatccgcaccctgctggagctggagaaggccgagagacatggcagccgggcccggggccgggccctggagaggagaagaagaaggaaggtggacagaggaggagaaggagatgatcctgcccgggaggagctggagcccaagagggtgcgcagcagcggccctgaggccgaggaggtgcaggaggaggaggagctggaggaggagactggaggagagggccccccagcccccatccccaccaccggcagccccagcacccaggagaaccagaatggcctggagcctgctgagggcaccaccagcggccccagcgcccccttcagcaccctgaccccccggctgcacctgccctgcccccagcagcccccccagcagcagctgtag

SEQ ID NO: 158292 - DNA, 4140 bp, Artificial Sequence
  Description of Artificial Sequence: Synthetic coding sequence
atggagcccggcagtgatgacttcctgcccccaccagaatgtcctgtgtttgagcccagctgggccgagttccgggaccccctgggctacatcgccaagatccggcccatcgccgagaagagcggcatctgcaagatccggcccccagccatcgtggtggaggagggcggctatgaggccatctgcaaggaccggcgctgggcccgggtggcccagaggctgaactacccacctgggaagaacatcggcagcctgctgcggagccactatgaaagaattgtgtacccctatgagatgtaccagagcggggccaacctggtgcagtgcaacacccggccctttgacaatgaggagaaggacaaggagtacaagccccacagcatccccctgcggcagagcgtgcagcccagcaagttcaacagctatggccggcgggccaagaggctgcagcctgaccctgagcccacagaggaggacatcgagaagaaccctgagctgaagaagctgcagatctacggggccggccccaagatgatgggcctgggcctgatggccaaggacaagaccctgaggaagaaggacaaggagggcccagaatgtcctcccaccgtggtggtgaaggaggagctgggcggagatgtgaaggtggagagcaccagccccaagaccttcctggagagcaaggaggagctgagccacagccctgagccctgcaccaagatgaccatgaggctgcggaggaaccacagcaatgcccagttcatcgagagctatgtgtgcaggatgtgcagcagaggagatgaagatgacaagctgctgctgtgtgatggctgtgatgacaactaccacatcttctgcctgctgccccccctgcctgagatccccaagggcgtgtggcgctgccccaagtgtgtgatggccgagtgcaagaggcctcctgaggccttcggctttgagcaggccacccgggagtacaccctgcagagctttggagagatggctgacagcttcaaggctgactacttcaacatgcctgtgcacatggtgcccacagagctggtggagaaggagttctggaggctggtgaacagcattgaagaagatgtgacagtggagtatggagctgacatccacagcaaggagtttggcagcggcttccctgtgtctgacagcaagaggcacctgaccccagaggaggaggagtatgccaccagcggctggaacctgaatgtgatgcctgtgctggagcagagcgtgctgtgccacatcaatgctgacatcagcggcatgaaggtgccctggctgtatgtgggcatggtgttcagcgccttctgctggcacatcgaggaccactggagctacagcatcaactacctgcactggggcgagcccaagacctggtacggcgtgcccagcctggccgctgagcacctggaggaggtgatgaagaagctgaccccagagctgtttgacagccagcctgacctgctgcaccagctggtgaccctgatgaaccccaacaccctgatgagccacggcgtgcctgtggtgaggaccaaccagtgtgccggggagtttgtgatcaccttcccccgggcctaccacagcggcttcaaccagggctacaactttgctgaggccgtgaacttctgcacagctgactggctgcctgctggccggcagtgcatcgagcactacagaaggctgcggcgctactgtgtgttcagccatgaggagctgatctgcaagatggccgcctgcccagagaagctggacctgaacctggccgctgctgtgcacaaggagatgttcatcatggtgcaggaggagcggcggctgaggaaggccctgctggagaagggcatcacagaagctgagcgggaggcctttgagctgctgcctgatgatgagcggcagtgcatcaagtgcaagaccacctgcttcctgagcgccctggcctgctatgactgcccagatggcctggtgtgcctgagccacatcaatgacctgtgcaagtgcagcagcagccggcagtacctgcgctaccgctacaccctggatgagctgcctgccatgctgcacaagctgaaggtgcgggcagagagctttgacacctgggccaacaaggtgcgggtggccctggaggtggaggatggcaggaagaggagcctggaggagctgcgggccctggagagcgaggcccgggagcggcgcttccccaacagcgagctgctgcagcagctgaagaactgcctgtctgaggccgaggcctgtgtgtcccgggccctgggcctggtgtctggccaggaggccggcccccaccgggtggccggcctgcagatgaccctgacagagctgcgggccttcctggaccagatgaacaacctgccctgtgccatgcaccagattggagatgtgaagggcgtgctggagcaggtggaggcctaccaggccgaggcccgggaggccctggccagcctgcccagcagccctggcctgctgcagagcctgctggagcggggccggcagctgggcgtggaggtgcctgaggcccagcagctgcagaggcaggtggagcaggcccgctggctggatgaggtgaagaggaccctggcccccagcgcccggcggggcaccctggccgtgatgaggggcctgctggtggccggggcctctgtggcccccagccctgctgtggacaaggcccaggccgagctgcaggagctgctgaccatcgccgagcgctgggaggagaaggcccacctgtgcctggaggcccggcagaagcaccccccagccaccctggaggccatcatccgggaggccgagaacatccctgtgcacctgcccaacatccaggccctgaaggaggccctggccaaggcccgggcctggattgctgatgtggatgagatccagaatggagaccactacccctgcctggatgacctggagggcctggtggccgtgggccgggacctgcctgtgggcctggaggagctgcggcagctggagctgcaggtgctgacagcccacagctggagggagaaggccagcaagaccttcctgaagaagaacagctgctacaccctgctggaggtgctgtgcccctgtgctgatgctggcagtgacagcaccaagaggagccgctggatggagaaggagctgggcctgtacaagagtgacacagagctgctgggcctgagcgcccaggacctgcgggaccccggcagcgtcatcgtggccttcaaggagggggagcagaaggagaaggagggcatcctgcagctgcggaggaccaacagcgccaagcccagccccctggccagcagcagcacagccagcagcaccaccagcatctgtgtgtgtggccaggtgctggccggggccggggccctgcagtgtgacctgtgccaggactggttccacggccgctgtgtgtctgtgccccggctgctgagcagcccccggcccaaccccaccagcagccccctgctggcctggtgggagtgggacaccaagttcctgtgccccctgtgcatgaggagccggcggccccggctggagaccatcctggccctgctggtggccctgcagaggctgcctgtgcggctgcctgagggggaggccctgcagtgcctgacagagcgggccatctcctggcagggccgggcccggcaggccctggcctctgaagatgtgacagccctgctgggccgcctggccgagctgcggcagaggctgcaggccgagcccaggcctgaggagccccccaactacccagctgccccagccagtgaccccctgcgggagggcagcggcaaggacatgcccaaggtgcagggcctgctggagaatggagacagcgtgaccagccctgagaaggtggcccctgaggagggcagtgacctggagctgctgagcagcctgctgccccagctgactggacctgtgctggagctgcctgaggccacccgggcccccctggaggagctgatgatggagggggacctgctggaggtgaccctggatgagaaccacagcatccctgagagcctggacttctgcatcctgaccccccgctactgcagcgacctgagctcctggggccctgcccctggggtcttccccccctggtag

SEQ ID NO: 158293 - DNA, 4620 bp, Artificial Sequence
  Description of Artificial Sequence: Synthetic coding sequence
atggagcccggctgtgatgagttcctgcccccaccagaatgtcctgtgtttgagcccagctgggccgagttccaggaccccctgggctacatcgccaagatccggcccatcgccgagaagagcggcatctgcaagatccggcccccagctgactggcagcccccatttgctgtggaggtggacaacttccgcttcaccccccgggtgcagaggctgaatgagctggaggcccagaccagggtgaagctgaactacctggaccagatcgccaagttctgggagatccagggcagcagcctgaagatccccaacgtggagaggaagatcctggacctgtacagcctgagcaagatcgtcatcgaggagggcggctatgaggccatctgcaaggaccggcgctgggcccgggtggcccagaggctgcactacccacctgggaagaacatcggcagcctgctgcggagccactatgagcgcatcatctacccctatgagatgttccagagcggggccaaccacgtgcagtgcaacacccacccctttgacaatgaggtgaaggacaaggagtacaagccccacagcatccccctgcggcagagcgtgcagcccagcaagttcagcagctacagcagaagagccaagaggctgcagcctgaccctgagcccacagaagaagatattgagaagcaccctgagctgaagaagctgcagatctacggccctggccccaagatgatgggcctgggcctgatggccaaggacaaggacaagacagtgcacaagaaggtgacctgcccccccaccgtgacagtgaaggatgagcagagcggcggcggcaatgtgagcagcaccctgctgaagcagcacctgagcctggagccctgcaccaagaccaccatgcagctgaggaagaaccacagcagcgcccagttcatcgacagctacatctgccaggtgtgcagcagaggagatgaagatgacaagctgctcttctgtgatggctgtgatgacaactaccacatcttctgcctgctgccccccctgcctgagatcccccggggcatctggcgctgccccaagtgcatcctggccgagtgcaagcagcccccagaggcctttggatttgagcaggccacccaggagtacagcctgcagagctttggagagatggctgacagcttcaagagtgactacttcaacatgcctgtgcacatggtgcccacagagctggtggagaaggagttctggaggctggtgagcagcattgaggaggatgtgacagtggagtatggagctgacatccacagcaaggagtttggaagtggcttccctgtgagcaacagcaagcagaacctgagccctgaggagaaggagtatgccaccagcggctggaacctgaatgtgatgcctgtgctggaccagagcgtgctgtgccacatcaatgctgacatcagcggcatgaaggtgccctggctgtatgtgggcatggtgttttctgccttctgctggcacatcgaggaccactggagctacagcatcaactacctgcactggggcgagcccaagacctggtatggagtgcccagcctggccgctgagcacctggaggaggtgatgaagatgctgaccccagagctgtttgacagccagcctgacctgctgcaccagctggtgaccctgatgaaccccaacaccctgatgagccatggagtgcctgtggtgaggaccaaccagtgtgccggggagtttgtgatcaccttcccccgggcctaccacagcggcttcaaccagggctacaactttgctgaggccgtgaacttctgcacagctgactggctgcctgctggccggcagtgcatcgagcactaccgccgcctgcggcgctactgtgtgttcagccatgaggagctgatctgcaagatggccgccttccctgagaccctggacctgaacctggccgtggccgtgcacaaggagatgttcatcatggtgcaggaggagcggcggctgaggaaggccctgctggagaagggcgtgacagaggccgagcgggaggcctttgagctgctgcctgatgatgagcggcagtgcatcaagtgcaagaccacctgcttcctgagcgccctggcctgctatgactgcccagatggcctggtgtgcctgagccacatcaatgacctgtgcaagtgcagcagcagccggcagtacctgcgctaccgctacaccctggatgagctgcccaccatgctgcacaagctgaagatccgggcagagagctttgacacctgggccaacaaggtgcgggtggccctggaggtggaggatggcaggaagaggagctttgaggagctgcgggccctggagagcgaggcccgggagcggcgcttccccaacagcgagctgctgcagaggctgaagaactgcctgtctgaggtggaggcctgcatcgcccaggtgctgggcctggtgtctggccaggtggccaggatggacaccccccagctgaccctgacagagctgcgggtgctgctggagcagatgggcagcctgccctgtgccatgcaccagattggagatgtgaaggatgtgctggagcaggtggaggcctaccaggccgaggcccgggaggccctggccaccctgcccagcagccctggcctgctgcggagcctgctggagcggggccagcagctgggcgtggaggtgcctgaggcccaccagctgcagcagcaggtggagcaggcccagtggctggatgaggtgaagcaggccctggcccccagcgcccaccggggcagcctggtgatcatgcagggcctgctggtgatgggcgccaagatcgccagcagccccagcgtggacaaggcccgggcagagctgcaggagctgctgaccatcgccgagcgctgggaggagaaggcccacttctgcctggaggcccggcagaagcaccccccagccaccctggaggccatcatccgggagacagagaacatccctgtgcacctgcccaacatccaggccctgaaggaggccctgaccaaggcccaggcctggattgctgatgtggatgagatccagaatggagaccactacccctgcctggatgacctggagggcctggtggccgtgggccgggacctgcctgtgggcctggaggagctgcggcagctggagctgcaggtgctgacagcccacagctggagggagaaggccagcaagaccttcctgaagaagaacagctgctacaccctgctggaggtgctgtgcccctgtgctgatgctggcagtgacagcaccaagaggagccgctggatggagaaggccctgggcctgtaccagtgtgacacagagctgctgggcctgagcgcccaggacctgcgggaccccggcagcgtcatcgtggccttcaaggagggggagcagaaggagaaggagggcatcctgcagctgcggaggaccaacagcgccaagcccagccccctggcccccagcctgatggccagcagccccaccagcatctgtgtgtgtggccaggtgcctgctggggtgggcgtgctgcagtgtgacctgtgccaggactggttccacggccagtgtgtgtctgtgccccacctgctgaccagccccaagcccagcctgaccagcagccccctgctggcctggtgggagtgggacaccaagttcctgtgccccctgtgcatgaggagccggcggccccggctggagaccatcctggccctgctggtggccctgcagaggctgcctgtgcggctgcctgagggggaggccctgcagtgcctgacagagcgggccatcggctggcaggaccgggccaggaaggccctggcctctgaagatgtgacagccctgctgcggcagctggccgagctgcggcagcagctgcaggccaagcccaggcctgaggaggcctctgtgtacaccagcgccacagcctgtgaccccatccgggagggcagcggcaacaacatcagcaaggtgcagggcctgctggagaatggagacagcgtgaccagccctgagaacatggcccctgggaagggcagtgacctggagctgctgagcagcctgctgccccagctgactggacctgtgctggagctgcctgaggccatccgggcccccctggaggagctgatgatggagggggacctgctggaggtgaccctggatgagaaccacagcatctggcagctgctgcaggccggccagcccccagacctggaccgcatccgcaccctgctggagctggagaagtttgagcaccagggcagcaggaccaggagccgggccctggagaggagaagaagacggcagaaggtggaccagggcagaaatgtggagaacctggtgcagcaggagctgcagagcaagagggcccggagcagcggcatcatgagccaggtgggccgggaggaggagcactaccaggagaaggctgaccgggagaacatgttcctgacccccagcacagaccacagccccttcctgaagggcaaccagaacagcctgcagcacaaggacagcggcagcagcgctgcctgccccagcctgatgcccctgctgcagctgagctacagtgatgagcagcagctgtag

SEQ ID NO: 158294 - DNA, 4449 bp, Artificial Sequence
  Description of Artificial Sequence: Synthetic coding sequence
atggagcccggctgtgatgagttcctgcccccaccagaatgtcctgtgtttgagcccagctgggccgagttccaggaccccctgggctacatcgccaagatccggcccatcgccgagaagagcggcatctgcaagatccggcccccagctgactggcagcccccatttgctgtggaggtggacaacttccgcttcaccccccgggtgcagaggctgaatgagctggaggcccagaccagggtgaagctgaactacctggaccagatcgccaagttctgggagatccagggcagcagcctgaagatccccaacgtggagaggaagatcctggacctgtacagcctgagcaagcagtgcaacacccacccctttgacaatgaggtgaaggacaaggagtacaagccccacagcatccccctgcggcagagcgtgcagcccagcaagttcagcagctacagccggcgggccaagaggctgcagcctgaccctgagcccacagaggaggacatcgagaagcaccctgagctgaagaagctgcagatctacggccctggccccaagatgatgggcctgggcctgatggccaaggacaaggacaagacagtgcacaagaaggtgacctgccccccaacagtgacagtgaaggatgagcagagcggcggcggcaatgtgagcagcaccctgctgaagcagcacctgagcctggagccctgcaccaagaccaccatgcagctgaggaagaaccacagcagcgcccagttcatcgacagctacatctgccaggtgtgcagcagaggagatgaagatgacaagctgctcttctgtgatggctgtgatgacaactaccacatcttctgcctgctgccccccctgcctgagatcccccggggcatctggcgctgccccaagtgcatcctggccgagtgcaagcagcccccagaggccttcggctttgagcaggccacccaggagtacagcctgcagagctttggagagatggctgacagcttcaagagtgactacttcaacatgcctgtgcacatggtgcccacagagctggtggagaaggagttctggaggctggtgagcagcattgaagaagatgtgacagtggagtatggagctgacatccacagcaaggagtttggcagcggcttccctgtgagcaacagcaagcagaacctgagccctgaggagaaggagtatgccaccagcggctggaacctgaatgtgatgcctgtgctggaccagagcgtgctgtgccacatcaatgctgacatcagcggcatgaaggtgccctggctgtatgtgggcatggtgttcagcgccttctgctggcacatcgaggaccactggagctacagcatcaactacctgcactggggcgagcccaagacctggtacggcgtgcccagcctggccgctgagcacctggaggaggtgatgaagatgctgaccccagagctgtttgacagccagcctgacctgctgcaccagctggtgaccctgatgaaccccaacaccctgatgagccacggcgtgcctgtggtgaggaccaaccagtgtgccggggagtttgtgatcaccttcccccgggcctaccacagcggcttcaaccagggctacaactttgctgaggccgtgaacttctgcacagctgactggctgcctgctggccggcagtgcatcgagcactacagaaggctgcggcgctactgtgtgttcagccatgaggagctgatctgcaagatggccgccttccctgagaccctggacctgaacctggccgtggccgtgcacaaggagatgttcatcatggtgcaggaggagcggcggctgaggaaggccctgctggagaagggcgtgacagaagctgagcgggaggcctttgagctgctgcctgatgatgagcggcagtgcatcaagtgcaagaccacctgcttcctgagcgccctggcctgctatgactgcccagatggcctggtgtgcctgagccacatcaatgacctgtgcaagtgcagcagcagccggcagtacctgcgctaccgctacaccctggatgagctgcccaccatgctgcacaagctgaagatccgggcagagagctttgacacctgggccaacaaggtgcgggtggccctggaggtggaggatggcaggaagaggagctttgaggagctgcgggccctggagagcgaggcccgggagcggcgcttccccaacagcgagctgctgcagaggctgaagaactgcctgtctgaggtggaggcctgcatcgcccaggtgctgggcctggtgtctggccaggtggccaggatggacaccccccagctgaccctgacagagctgcgggtgctgctggagcagatgggcagcctgccctgtgccatgcaccagattggagatgtgaaggatgtgctggagcaggtggaggcctaccaggccgaggcccgggaggccctggccaccctgcccagcagccctggcctgctgcggagcctgctggagcggggccagcagctgggcgtggaggtgcctgaggcccaccagctgcagcagcaggtggagcaggcccagtggctggatgaggtgaagcaggccctggcccccagcgcccaccggggcagcctggtgatcatgcagggcctgctggtgatgggcgccaagatcgccagcagccccagcgtggacaaggcccgggcagagctgcaggagctgctgaccatcgccgagcgctgggaggagaaggcccacttctgcctggaggcccggcagaagcaccccccagccaccctggaggccatcatccgggagacagagaacatccctgtgcacctgcccaacatccaggccctgaaggaggccctgaccaaggcccaggcctggattgctgatgtggatgagatccagaatggagaccactacccctgcctggatgacctggagggcctggtggccgtgggccgggacctgcctgtgggcctggaggagctgcggcagctggagctgcaggtgctgacagcccacagctggagggagaaggccagcaagaccttcctgaagaagaacagctgctacaccctgctggaggtgctgtgcccctgtgctgatgctggcagtgacagcaccaagaggagccgctggatggagaaggccctgggcctgtaccagtgtgacacagagctgctgggcctgagcgcccaggacctgcgggaccccggctctgtgattgtggccttcaaggagggggagcagaaggagaaggagggcatcctgcagctgcggaggaccaacagcgccaagcccagccccctggcccccagcctgatggccagcagccccaccagcatctgtgtgtgtggccaggtgcctgctggggtgggcgtgctgcagtgtgacctgtgccaggactggttccacggccagtgtgtgtctgtgccccacctgctgaccagccccaagcccagcctgaccagcagccccctgctggcctggtgggagtgggacaccaagttcctgtgccccctgtgcatgaggagcagaagaccccggctggagaccatcctggccctgctggtggccctgcagaggctgcctgtgcggctgcctgagggggaggccctgcagtgcctgacagagcgggccatcggctggcaggaccgggccaggaaggccctggcctctgaagatgtgacagccctgctgcggcagctggccgagctgcggcagcagctgcaggccaagcccaggcctgaggaggcctctgtgtacaccagcgccacagcctgtgaccccatccgggagggcagcggcaacaacatcagcaaggtgcagggcctgctggagaatggagacagcgtgaccagccctgagaacatggcccctggaaaaggaagtgacctggagctgctgagcagcctgctgccccagctgaccggccctgtgctggagctgcctgaggccatccgggcccccctggaggagctgatgatggagggggacctgctggaggtgaccctggatgagaaccacagcatctggcagctgctgcaggccggccagcccccagacctggaccgcatccgcaccctgctggagctggagaagtttgagcaccagggcagcaggaccaggagccgggccctggagaggagaagaagacggcagaaggtggaccagggcagaaatgtggagaacctggtgcagcaggagctgcagagcaagagggcccggagcagcggcatcatgagccaggtgggccgggaggaggagcactaccaggagaaggctgaccgggagaacatgttcctgacccccagcacagaccacagccccttcctgaagggcaaccagaacagcctgcagcacaaggacagcggcagcagcgctgcctgccccagcctgatgcccctgctgcagctgagctacagtgatgagcagcagctgtag

SEQ ID NO: 158295 - DNA, 882 bp, Artificial Sequence
  Description of Artificial Sequence: Synthetic coding sequence
ctgcccaacatccaggccctgaaggaggccctgaccaaggcccaggcctggattgctgatgtggatgagatccagaatggagaccactacccctgcctggatgacctggagggcctggtggccgtgggccgggacctgcctgtgggcctggaggagctgcggcagctggagctgcaggtgctgtgcccctgtgctgatgctggcagtgacagcaccaagaggagccgctggatggagaaggccctgggcctgtaccagtgtgacacagagctgctgggcctgagcgcccaggacctgcgggaccccggcagcgtcatcgtggccttcaaggagggggagcagaaggagaaggagggcatcctgcagctgcggaggaccaacagcgccaagcccagccccctggcccccagcctgatggccagcagccccaccagcatctgtgtgtgtggccaggtgcctgctggggtgggcgtgctgcagtgtgacctgtgccaggactggttccacggccagtgtgtgtctgtgccccacctgctgaccagccccaagcccagcctgaccagcagccccctgctggcctggtgggagtgggacaccaagttcctgtgccccctgtgcatgaggagccggcggccccggctggagaccatcctggccctgctggtggccctgcagaggctgcctgtgcggctgcctgagggggaggccctgcagtgcctgacagagcgggccatcggctggcaggaccgggccaggaaggccctggcctctgaagatgtgacagccctgctgcggcagctggccgagctgcggcagcagctgcaggccaagcccaggcctgaggaggcctctgtgtacaccagcgccacagcctgtgactag

SEQ ID NO: 158296 - DNA, 4431 bp, Artificial Sequence
  Description of Artificial Sequence: Synthetic coding sequence
atggagcccggctgtgatgagttcctgcccccaccagaatgtcctgtgtttgagcccagctgggccgagttccaggaccccctgggctacatcgccaagatccggcccatcgccgagaagagcggcatctgcaagatccggcccccagctgactggcagcccccatttgctgtggaggtggacaacttccgcttcaccccccgggtgcagaggctgaatgagctggagatcgtgattgaggagggcggctatgaggccatctgcaaggaccggcgctgggcccgggtggcccagaggctgcactacccacctgggaagaacatcggcagcctgctgcggagccactatgaaagaatcatctacccctatgagatgttccagagcggggccaaccacgtgcagtgcaacacccacccctttgacaatgaggtgaaggacaaggagtacaagccccacagcatccccctgcggcagagcgtgcagcccagcaagttcagcagctacagccggcgggccaagaggctgcagcctgaccctgagcccacagaggaggacatcgagaagcaccctgagctgaagaagctgcagatctacggccctggccccaagatgatgggcctgggcctgatggccaaggacaaggacaagacagtgcacaagaaggtgacctgccccccaacagtgacagtgaaggatgagcagagcggcggcggcaatgtgagcagcaccctgctgaagcagcacctgagcctggagccctgcaccaagaccaccatgcagctgaggaagaaccacagcagcgcccagttcatcgacagctacatctgccaggtgtgcagcagaggagatgaagatgacaagctgctcttctgtgatggctgtgatgacaactaccacatcttctgcctgctgccccccctgcctgagatcccccggggcatctggcgctgccccaagtgcatcctggccgagtgcaagcagcccccagaggccttcggctttgagcaggccacccaggagtacagcctgcagagctttggagagatggctgacagcttcaagagtgactacttcaacatgcctgtgcacatggtgcccacagagctggtggagaaggagttctggaggctggtgagcagcattgaagaagatgtgacagtggagtatggagctgacatccacagcaaggagtttggcagcggcttccctgtgagcaacagcaagcagaacctgagccctgaggagaaggagtatgccaccagcggctggaacctgaatgtgatgcctgtgctggaccagagcgtgctgtgccacatcaatgctgacatcagcggcatgaaggtgccctggctgtatgtgggcatggtgttcagcgccttctgctggcacatcgaggaccactggagctacagcatcaactacctgcactggggcgagcccaagacctggtacggcgtgcccagcctggccgctgagcacctggaggaggtgatgaagatgctgaccccagagctgtttgacagccagcctgacctgctgcaccagctggtgaccctgatgaaccccaacaccctgatgagccacggcgtgcctgtggtgaggaccaaccagtgtgccggggagtttgtgatcaccttcccccgggcctaccacagcggcttcaaccagggctacaactttgctgaggccgtgaacttctgcacagctgactggctgcctgctggccggcagtgcatcgagcactacagaaggctgcggcgctactgtgtgttcagccatgaggagctgatctgcaagatggccgccttccctgagaccctggacctgaacctggccgtggccgtgcacaaggagatgttcatcatggtgcaggaggagcggcggctgaggaaggccctgctggagaagggcgtgacagaagctgagcgggaggcctttgagctgctgcctgatgatgagcggcagtgcatcaagtgcaagaccacctgcttcctgagcgccctggcctgctatgactgcccagatggcctggtgtgcctgagccacatcaatgacctgtgcaagtgcagcagcagccggcagtacctgcgctaccgctacaccctggatgagctgcccaccatgctgcacaagctgaagatccgggcagagagctttgacacctgggccaacaaggtgcgggtggccctggaggtggaggatggcaggaagaggagctttgaggagctgcgggccctggagagcgaggcccgggagcggcgcttccccaacagcgagctgctgcagaggctgaagaactgcctgtctgaggtggaggcctgcatcgcccaggtgctgggcctggtgtctggccaggtggccaggatggacaccccccagctgaccctgacagagctgcgggtgctgctggagcagatgggcagcctgccctgtgccatgcaccagattggagatgtgaaggatgtgctggagcaggtggaggcctaccaggccgaggcccgggaggccctggccaccctgcccagcagccctggcctgctgcggagcctgctggagcggggccagcagctgggcgtggaggtgcctgaggcccaccagctgcagcagcaggtggagcaggcccagtggctggatgaggtgaagcaggccctggcccccagcgcccaccggggcagcctggtgatcatgcagggcctgctggtgatgggcgccaagatcgccagcagccccagcgtggacaaggcccgggcagagctgcaggagctgctgaccatcgccgagcgctgggaggagaaggcccacttctgcctggaggcccggcagaagcaccccccagccaccctggaggccatcatccgggagacagagaacatccctgtgcacctgcccaacatccaggccctgaaggaggccctgaccaaggcccaggcctggattgctgatgtggatgagatccagaatggagaccactacccctgcctggatgacctggagggcctggtggccgtgggccgggacctgcctgtgggcctggaggagctgcggcagctggagctgcaggtgctgacagcccacagctggagggagaaggccagcaagaccttcctgaagaagaacagctgctacaccctgctggaggtgctgtgcccctgtgctgatgctggcagtgacagcaccaagaggagccgctggatggagaaggccctgggcctgtaccagtgtgacacagagctgctgggcctgagcgcccaggacctgcgggaccccggctctgtgattgtggccttcaaggagggggagcagaaggagaaggagggcatcctgcagctgcggaggaccaacagcgccaagcccagccccctggcccccagcctgatggccagcagccccaccagcatctgtgtgtgtggccaggtgcctgctggggtgggcgtgctgcagtgtgacctgtgccaggactggttccacggccagtgtgtgtctgtgccccacctgctgaccagccccaagcccagcctgaccagcagccccctgctggcctggtgggagtgggacaccaagttcctgtgccccctgtgcatgaggagcagaagaccccggctggagaccatcctggccctgctggtggccctgcagaggctgcctgtgcggctgcctgagggggaggccctgcagtgcctgacagagcgggccatcggctggcaggaccgggccaggaaggccctggcctctgaagatgtgacagccctgctgcggcagctggccgagctgcggcagcagctgcaggccaagcccaggcctgaggaggcctctgtgtacaccagcgccacagcctgtgaccccatccgggagggcagcggcaacaacatcagcaaggtgcagggcctgctggagaatggagacagcgtgaccagccctgagaacatggcccctggaaaaggaagtgacctggagctgctgagcagcctgctgccccagctgaccggccctgtgctggagctgcctgaggccatccgggcccccctggaggagctgatgatggagggggacctgctggaggtgaccctggatgagaaccacagcatctggcagctgctgcaggccggccagcccccagacctggaccgcatccgcaccctgctggagctggagaagtttgagcaccagggcagcaggaccaggagccgggccctggagaggagaagaagacggcagaaggtggaccagggcagaaatgtggagaacctggtgcagcaggagctgcagagcaagagggcccggagcagcggcatcatgagccaggtgggccgggaggaggagcactaccaggagaaggctgaccgggagaacatgttcctgacccccagcacagaccacagccccttcctgaagggcaaccagaacagcctgcagcacaaggacagcggctag

SEQ ID NO: 158297 - DNA, 1278 bp, Artificial Sequence
  Description of Artificial Sequence: Synthetic coding sequence
atggagcccggctgtgatgagttcctgcccccaccagaatgtcctgtgtttgagcccagctgggccgagttccaggaccccctgggctacatcgccaagatccggcccatcgccgagaagagcggcatctgcaagatccggcccccagctgactggcagcccccatttgctgtggaggtggacaacttccgcttcaccccccgggtgcagaggctgaatgagctggaggcccagaccagggtgaagctgaactacctggaccagatcgccaagttctgggagatccagggcagcagcctgaagatccccaacgtggagaggaagatcctggacctgtacagcctgagcaagatcgtcatcgaggagggcggctatgaggccatctgcaaggaccggcgctgggcccgggtggcccagaggctgcactacccacctgggaagaacatcggcagcctgctgcggagccactatgagcgcatcatctacccctatgagatgttccagagcggggccaaccacgtgcctgagcccacagaggaggacatcgagaagcaccctgagctgaagaagctgcagatctacggccctggccccaagatgatgggcctgggcctgatggccaaggacaaggacaagacagtgcacaagaaggtgacctgccccccaacagtgacagtgaaggatgagcagagcggcggcggcaatgtgagcagcaccctgctgaagcagcacctgagcctggagccctgcaccaagaccaccatgcagctgaggaagaaccacagcagcgcccagttcatcgacagctacatctgccaggtgtgcagcagaggagatgaagatgacaagctgctcttctgtgatggctgtgatgacaactaccacatcttctgcctgctgccccccctgcctgagatcccccggggcatctggcgctgccccaagtgcatcctggccgagtgcaagcagcccccagaggccttcggctttgagcaggccacccaggagtacagcctgcagagctttggagagatggctgacagcttcaagagtgactacttcaacatgcctgtgcacatggtgcccacagagctggtggagaaggagttctggaggctggtgagcagcattgaagaagatgtgacagtggagtatggagctgacatccacagcaaggagtttggcagcggcttccctgtgagcaacagcaagcagaacctgagccctgaggagaaggagtatgccaccagcggctggaacctgaatgtgatgccctag

SEQ ID NO: 158298 - DNA, 2667 bp, Artificial Sequence
  Description of Artificial Sequence: Synthetic coding sequence
atggagcccggctgtgatgagttcctgcccccaccagaatgtcctgtgtttgagcccagctgggccgagttccaggaccccctgggctacatcgccaagatccggcccatcgccgagaagagcggcatctgcaagatccggcccccagctgactggcagcccccatttgctgtggaggtggacaacttccgcttcaccccccgggtgcagaggctgaatgagctggaggcccagaccagggtgaagctgaactacctggaccagatcgccaagttctgggagatccagggcagcagcctgaagatccccaacgtggagaggaagatcctggacctgtacagcctgagcaagatcgtcatcgaggagggcggctatgaggccatctgcaaggaccggcgctgggcccgggtggcccagaggctgcactacccacctgggaagaacatcggcagcctgctgcggagccactatgagcgcatcatctacccctatgagatgttccagagcggggccaaccacgtgcagtgcaacacccacccctttgacaatgaggtgaaggacaaggagtacaagccccacagcatccccctgcggcagagcgtgcagcccagcaagttcagcagctacagcagaagagccaagaggctgcagcctgaccctgagcccacagaagaagatattgagaagcaccctgagctgaagaagctgcagatctacggccctggccccaagatgatgggcctgggcctgatggccaaggacaaggacaagacagtgcacaagaaggtgacctgcccccccaccgtgacagtgaaggatgagcagagcggcggcggcaatgtgagcagcaccctgctgaagcagcacctgagcctggagccctgcaccaagaccaccatgcagctgaggaagaaccacagcagcgcccagttcatcgacagctacatctgccaggtgtgcagcagaggagatgaagatgacaagctgctcttctgtgatggctgtgatgacaactaccacatcttctgcctgctgccccccctgcctgagatcccccggggcatctggcgctgccccaagtgcatcctggccgagtgcaagcagcccccagaggcctttggatttgagcaggccacccaggagtacagcctgcagagctttggagagatggctgacagcttcaagagtgactacttcaacatgcctgtgcacatggtgcccacagagctggtggagaaggagttctggaggctggtgagcagcattgaggaggatgtgacagtggagtatggagctgacatccacagcaaggagtttggaagtggcttccctgtgagcaacagcaagcagaacctgagccctgaggagaaggagtatgccaccagcggctggaacctgaatgtgatgcctgtgctggaccagagcgtgctgtgccacatcaatgctgacatcagcggcatgaaggtgccctggctgtatgtgggcatggtgttttctgccttctgctggcacatcgaggaccactggagctacagcatcaactacctgcactggggcgagcccaagacctggtatggagtgcccagcctggccgctgagcacctggaggaggtgatgaagatgctgaccccagagctgtttgacagccagcctgacctgctgcaccagctggtgaccctgatgaaccccaacaccctgatgagccatggagtgcctgtggtgaggaccaaccagtgtgccggggagtttgtgatcaccttcccccgggcctaccacagcggcttcaaccagggctacaactttgctgaggccgtgaacttctgcacagctgactggctgcctgctggccggcagtgcatcgagcactaccgccgcctgcggcgctactgtgtgttcagccatgaggagctgatctgcaagatggccgccttccctgagaccctggacctgaacctggccgtggccgtgcacaaggagatgttcatcatggtgcaggaggagcggcggctgaggaaggccctgctggagaagggcgtgacagaggccgagcgggaggcctttgagctgctgcctgatgatgagcggcagtgcatcaagtgcaagaccacctgcttcctgagcgccctggcctgctatgactgcccagatggcctggtgtgcctgagccacatcaatgacctgtgcaagtgcagcagcagccggcagtacctgcgctaccgctacaccctggatgagctgcccaccatgctgcacaagctgaagatccgggcagagagctttgacacctgggccaacaaggtgcgggtggccctggaggtggaggatggcaggaagaggagctttgaggagctgcgggccctggagagcgaggcccgggagcggcgcttccccaacagcgagctgctgcagaggctgaagaactgcctgtctgaggtggaggcctgcatcgcccaggtgctgggcctggtgtctggccaggtggccaggatggacaccccccagctgaccctgacagagctgcgggtgctgctggagcagatgggcagcctgccctgtgccatgcaccagattggagatgtgaaggtgctgtcctggaagtggaggcgctacgtgttcccctaccacctgtgtgtgtacagcatgcagggcaacatcctgcctgactag

SEQ ID NO: 158299 - DNA, 4713 bp, Artificial Sequence
  Description of Artificial Sequence: Synthetic coding sequence
atggagcccggctgtgatgagttcctgcccccaccagaatgtcctgtgtttgagcccagctgggccgagttccaggaccccctgggctacatcgccaagatccggcccatcgccgagaagagcggcatctgcaagatccggcccccagctgactggcagcccccatttgctgtggaggtggacaacttccgcttcaccccccgggtgcagaggctgaatgagctggaggcccagaccagggtgaagctgaactacctggaccagatcgccaagttctgggagatccagggcagcagcctgaagatccccaacgtggagaggaagatcctggacctgtacagcctgagcaagatcgtcatcgaggagggcggctatgaggccatctgcaaggaccggcgctgggcccgggtggcccagaggctgcactacccacctgggaagaacatcggcagcctgctgcggagccactatgagcgcatcatctacccctatgagatgttccagagcggggccaaccacgtgcagtgcaacacccacccctttgacaatgaggtgaaggacaaggagtacaagccccacagcatccccctgcggcagagcgtgcagcccagcaagttcagcagctacagcagaagagccaagaggctgcagcctgaccctgagcccacagaagaagatattgagaagcaccctgagctgaagaagctgcagatctacggccctggccccaagatgatgggcctgggcctgatggccaaggacaaggacaagacagtgcacaagaaggtgacctgcccccccaccgtgacagtgaaggatgagcagagcggcggcggcaatgtgagcagcaccctgctgaagcagcacctgagcctggagccctgcaccaagaccaccatgcagctgaggaagaaccacagcagcgcccagttcatcgacagctacatctgccaggtgtgcagcagaggagatgaagatgacaagctgctcttctgtgatggctgtgatgacaactaccacatcttctgcctgctgccccccctgcctgagatcccccggggcatctggcgctgccccaagtgcatcctggccgagtgcaagcagcccccagaggcctttggatttgagcaggccacccaggagtacagcctgcagagctttggagagatggctgacagcttcaagagtgactacttcaacatgcctgtgcacatggtgcccacagagctggtggagaaggagttctggaggctggtgagcagcattgaggaggatgtgacagtggagtatggagctgacatccacagcaaggagtttggaagtggcttccctgtgagcaacagcaagcagaacctgagccctgaggagaagaggcagagcctgactgtgctgaccaggctcatcagcagcttctgggcccaggccgtgctgcccccctggccacccaaggtgctgggcctgcaggagtatgccaccagcggctggaacctgaatgtgatgcctgtgctggaccagagcgtgctgtgccacatcaatgctgacatcagcggcatgaaggtgccctggctgtatgtgggcatggtgttcagcgccttctgctggcacatcgaggaccactggagctacagcatcaactacctgcactggggcgagcccaagacctggtacggcgtgcccagcctggccgctgagcacctggaggaggtgatgaagatgctgaccccagagctgtttgacagccagcctgacctgctgcaccagctggtgaccctgatgaaccccaacaccctgatgagccacggcgtgcctgtggtgaggaccaaccagtgtgccggggagtttgtgatcaccttcccccgggcctaccacagcggcttcaaccagggctacaactttgctgaggccgtgaacttctgcacagctgactggctgcctgctggccggcagtgcatcgagcactacagaaggctgcggcgctactgtgtgttcagccatgaggagctgatctgcaagatggccgccttccctgagaccctggacctgaacctggccgtggccgtgcacaaggagatgttcatcatggtgcaggaggagcggcggctgaggaaggccctgctggagaagggcgtgacagaagctgagcgggaggcctttgagctgctgcctgatgatgagcggcagtgcatcaagtgcaagaccacctgcttcctgagcgccctggcctgctatgactgcccagatggcctggtgtgcctgagccacatcaatgacctgtgcaagtgcagcagcagccggcagtacctgcgctaccgctacaccctggatgagctgcccaccatgctgcacaagctgaagatccgggcagagagctttgacacctgggccaacaaggtgcgggtggccctggaggtggaggatggcaggaagaggagctttgaggagctgcgggccctggagagcgaggcccgggagcggcgcttccccaacagcgagctgctgcagaggctgaagaactgcctgtctgaggtggaggcctgcatcgcccaggtgctgggcctggtgtctggccaggtggccaggatggacaccccccagctgaccctgacagagctgcgggtgctgctggagcagatgggcagcctgccctgtgccatgcaccagattggagatgtgaaggatgtgctggagcaggtggaggcctaccaggccgaggcccgggaggccctggccaccctgcccagcagccctggcctgctgcggagcctgctggagcggggccagcagctgggcgtggaggtgcctgaggcccaccagctgcagcagcaggtggagcaggcccagtggctggatgaggtgaagcaggccctggcccccagcgcccaccggggcagcctggtgatcatgcagggcctgctggtgatgggcgccaagatcgccagcagccccagcgtggacaaggcccgggcagagctgcaggagctgctgaccatcgccgagcgctgggaggagaaggcccacttctgcctggaggcccggcagaagcaccccccagccaccctggaggccatcatccgggagacagagaacatccctgtgcacctgcccaacatccaggccctgaaggaggccctgaccaaggcccaggcctggattgctgatgtggatgagatccagaatggagaccactacccctgcctggatgacctggagggcctggtggccgtgggccgggacctgcctgtgggcctggaggagctgcggcagctggagctgcaggtgctgacagcccacagctggagggagaaggccagcaagaccttcctgaagaagaacagctgctacaccctgctggaggtgctgtgcccctgtgctgatgctggcagtgacagcaccaagaggagccgctggatggagaaggccctgggcctgtaccagtgtgacacagagctgctgggcctgagcgcccaggacctgcgggaccccggctctgtgattgtggccttcaaggagggggagcagaaggagaaggagggcatcctgcagctgcggaggaccaacagcgccaagcccagccccctggcccccagcctgatggccagcagccccaccagcatctgtgtgtgtggccaggtgcctgctggggtgggcgtgctgcagtgtgacctgtgccaggactggttccacggccagtgtgtgtctgtgccccacctgctgaccagccccaagcccagcctgaccagcagccccctgctggcctggtgggagtgggacaccaagttcctgtgccccctgtgcatgaggagcagaagaccccggctggagaccatcctggccctgctggtggccctgcagaggctgcctgtgcggctgcctgagggggaggccctgcagtgcctgacagagcgggccatcggctggcaggaccgggccaggaaggccctggcctctgaagatgtgacagccctgctgcggcagctggccgagctgcggcagcagctgcaggccaagcccaggcctgaggaggcctctgtgtacaccagcgccacagcctgtgaccccatccgggagggcagcggcaacaacatcagcaaggtgcagggcctgctggagaatggagacagcgtgaccagccctgagaacatggcccctggaaaaggaagtgacctggagctgctgagcagcctgctgccccagctgaccggccctgtgctggagctgcctgaggccatccgggcccccctggaggagctgatgatggagggggacctgctggaggtgaccctggatgagaaccacagcatctggcagctgctgcaggccggccagcccccagacctggaccgcatccgcaccctgctggagctggagaagtttgagcaccagggcagcaggaccaggagccgggccctggagaggagaagaagacggcagaaggtggaccagggcagaaatgtggagaacctggtgcagcaggagctgcagagcaagagggcccggagcagcggcatcatgagccaggtgggccgggaggaggagcactaccaggagaaggctgaccgggagaacatgttcctgacccccagcacagaccacagccccttcctgaagggcaaccagaacagcctgcagcacaaggacagcggcagcagcgctgcctgccccagcctgatgcccctgctgcagctgagctacagtgatgagcagcagctgtag

SEQ ID NO: 158300 - DNA, 3297 bp, Artificial Sequence
  Description of Artificial Sequence: Synthetic coding sequence
atggacctgggcaccctgtatgagagctgcaaccagccccaggatgccatcaagtgctacctgaatgccaccaggagcaagagctgcagcaacaccagcgccctggccgcccgcatcaagtacctgcaggcccagctgtgcaacctgccccagggcagcctgcagaacaagaccaagctgctgcccagcattgaggaggcctggagcctgcccatcccagctgagctgaccagccggcagggcgccatgaacacagcccagcaggcctgcaagccccaccaccccaacacagagcctgtgctgggcctgagccagacccccatcagccagcagagcctgcccctgcacatgatccccagcagccaggtggatgacctgagcagccctgccaagaggaagaggaccagcagccccaccaagaacaccagtgacaactggagcggcggccatgctgtgagccacccccctgtgcagcagcaggcccacagctggtgcctgaccccccagaagctgcagcacctggagcagctgcgggccaacagaaacaacctgaacccagcccagaagctgatgctggagcagctggagagccagtttgtgctgatgcagcagcaccagatgaggcccaccggggtggcccaggtgcgcagcacaggcatccccaacggccccacagctgacagcagcctgcccaccaacagcgtgtctggccagcagccccagctggccctgaccagggtgcccagcgtgtcccagcccggggtgcggcctgcctgccccggccagcccctggccaacggccccttctctgctggccacgtgccctgcagcaccagcaggaccctgggcagcacagacaccatcctgattggcaacaaccacatcaccggcagcggcagcaatggaaatgtgccctacctgcagagaaatgccctgaccctgccccacaacagaaccaacctgaccagcagcgctgaggagccctggaagaaccagctgagcaacagcacccagggcctgcacaagggccagagcagccacagcgctggccccaacggggagcggcccctgagcagcacaggccccagccagcacctgcaggccgccggcagcggcatccagaaccagaatggccaccccaccctgcccagcaacagcgtgacccagggcgccgccctgaaccacctgagcagccacacagccaccagcggcggccagcagggcatcaccctgaccaaggagagcaagcccagcggcaacatcctgactgtgcctgagaccagccgccacactggagagacccccaacagcacagcctctgtggagggcctgcccaaccacgtgcaccagatgacagcagatgctgtgtgcagccccagccatggagacagcaagagccctggcctgctgagcagtgacaacccccagctgagcgccctgctgatgggcaaggccaacaacaacgtgggcaccggcacctgtgacaaggtgaacaacatccaccctgctgtgcacaccaagacagacaacagcgtggccagcagccccagcagcgccatcagcacagccacccccagccccaagagcacagagcagaccaccaccaacagcgtgaccagcctgaacagcccccacagcggcctgcacaccatcaacggggagggcatggaggagagccagagccccatgaagacagacctgctgctggtgaaccacaagcccagcccccagatcatccccagcatgtctgtgtccatctaccccagcagcgctgaggtgctgaaggcctgcaggaacctgggcaagaatggcctgagcaacagcagcatcctgctggacaagtgccccccaccccggccccccagcagcccctacccacccctgcccaaggacaagctgaacccccccacccccagcatctacctggagaacaagagagatgccttcttcccccccctgcaccagttctgcaccaaccccaacaaccctgtgaccgtcatccggggcctggccggggccctgaagctggacctgggcctcttcagcaccaagaccctggtggaggccaacaatgagcacatggtggaggtgaggacccagctgctgcagcctgcagatgagaactgggaccccaccggcaccaagaagatctggcactgtgagagcaacagaagccacaccaccatcgccaagtatgcccagtaccaggccagcagcttccaggagagcctgcgggaggagaatgagaagaggagccaccacaaggaccacagcgacagcgagagcaccagcagtgacaacagcggcagaagaaggaagggccccttcaagaccatcaagtttggcaccaacatcgacctgagtgatgacaagaagtggaagctgcagctgcacgagctgaccaagctgcctgcctttgtgcgggtggtgtctgctggcaacctgctgagccacgtgggccacaccatcctgggcatgaacacagtgcagctgtacatgaaggtgcccggcagcaggaccccaggccaccaggagaacaacaacttctgcagcgtgaacatcaacatcggccctggggactgtgagtggtttgtggtgcctgagggctactggggcgtgctgaatgacttctgtgagaagaacaacctgaacttcctgatgggctcctggtggcccaacctggaggacctgtatgaggccaacgtgcctgtgtaccgcttcatccagaggcctggggacctggtgtggatcaatgccggcaccgtgcactgggtgcaggccatcggctggtgcaacaacatcgcctggaatgtgggccccctgacagcctgccagtacaagctggccgtggagagatatgagtggaacaagctgcagagcgtgaagagcatcgtgcccatggtgcacctgtcctggaacatggccaggaacatcaaggtgtctgaccccaagctgtttgagatgatcaagtactgcctgctgcggaccctgaagcagtgccagaccctgcgggaggccctgattgctgctgggaaggagatcatctggcacggccgcaccaaggaggagcccgcccactactgcagcatctgtgaggtggaggtgtttgacctgctgtttgtgaccaatgaaagcaacagcaggaagacctacatcgtgcactgccaggactgtgccaggaagaccagcggcaacctggagaactttgtggtgctggagcagtacaagatggaggacctgatgcaggtgtatgaccagttcaccctggccccacccctgcccagcgccagcagctag

SEQ ID NO: 158301 - DNA, 4206 bp, Artificial Sequence
  Description of Artificial Sequence: Synthetic coding sequence
atgaagagctgtggggtgtccctggccacagctgctgctgctgctgctgcctttggagatgaggagaagaagatggctgctgggaaggccagcggggagagcgaggaggccagccccagcctgacagctgaggagcgggaggccctgggcggcctggacagccggctgtttggatttgtgcgcttccatgaagatggagcccggaccaaggccctgctgggcaaggctgtgcgctgctatgagagcctcatcctgaaggccgagggcaaggtggagagtgacttcttctgccagctgggccacttcaacctgctgctggaggactaccccaaggccctgagcgcctaccagcgctactacagcctgcagagcgactactggaagaatgctgccttcctgtatggcctgggcctggtgtacttccactacaatgccttccagtgggccatcaaggccttccaggaggtgctgtatgtggaccccagcttctgccgggccaaggagatccacctgcggctgggcctgatgttcaaggtgaacacagattatgagagcagcctgaagcacttccagctggccctggtggactgcaacccctgcaccctgagcaatgctgagatccagttccacatcgcccacctgtatgagacccagaggaagtaccacagcgccaaggaggcctatgagcagctgctgcagacagagaacctgagcgcccaggtgaaggccaccgtgctgcagcagctgggctggatgcaccacacagtggacctgctgggggacaaggccaccaaggagagctatgccatccagtacctgcagaagagcctggaggccgaccccaacagcggccagagctggtacttcctgggccgctgctacagcagcatcggcaaggtgcaggatgccttcatctcctaccggcagagcattgacaagtctgaggccagcgctgacacctggtgcagcattggagtgctgtaccagcagcagaaccagcccatggatgccctgcaggcctacatctgtgctgtgcagctggaccacggccacgccgccgcctggatggacctgggcaccctgtatgagagctgcaaccagccccaggatgccatcaagtgctacctgaatgccaccaggagcaagagctgcagcaacaccagcgccctggccgcccgcatcaagtacctgcaggcccagctgtgcaacctgccccagggcagcctgcagaacaagaccaagctgctgcccagcattgaggaggcctggagcctgcccatcccagctgagctgaccagccggcagggcgccatgaacacagcccagcagaacaccagtgacaactggagcggcggccatgctgtgagccacccccctgtgcagcagcaggcccacagctggtgcctgaccccccagaagctgcagcacctggagcagctgcgggccaacagaaacaacctgaacccagcccagaagctgatgctggagcagctggagagccagtttgtgctgatgcagcagcaccagatgaggcccactggagtggcccaggtgcgcagcacaggcatccccaacggccccacagctgacagcagcctgcccaccaacagcgtgtctggccagcagccccagctggccctgaccagggtgcccagcgtgtcccagcccggggtgcggcctgcctgccccggccagcccctggccaacggccccttctctgctggccacgtgccctgcagcaccagcaggaccctgggcagcacagacaccatcctgattggcaacaaccacatcactggaagtggcagcaatggaaatgtgccctacctgcagagaaatgccctgaccctgccccacaacagaaccaacctgaccagcagcgctgaggagccctggaagaaccagctgagcaacagcacccagggcctgcacaagggccagagcagccacagcgctggccccaatggagagcggcccctgagcagcacaggccccagccagcacctgcaggccgccggcagcggcatccagaaccagaatggccaccccaccctgcccagcaacagcgtgacccagggcgccgccctgaaccacctgagcagccacacagccaccagcggcggccagcagggcatcaccctgaccaaggagagcaagcccagcggcaacatcctgactgtgcctgagaccagccgccacactggagagacccccaacagcacagcctctgtggagggcctgcccaaccacgtgcaccagatgacagcagatgctgtgtgcagccccagccacggggacagcaagagccctggcctgctgagcagtgacaacccccagctgagcgccctgctgatgggcaaggccaacaacaacgtgggcaccggcacctgtgacaaggtgaacaacatccaccctgctgtgcacaccaagacagacaacagcgtggccagcagccccagcagcgccatcagcacagccacccccagccccaagagcacagagcagaccaccaccaacagcgtgaccagcctgaacagcccccacagcggcctgcacaccatcaatggagagggcatggaggagagccagagccccatgaagacagacctgctgctggtgaaccacaagcccagcccccagatcatccccagcatgtctgtgtccatctaccccagcagcgctgaggtgctgaaggcctgcaggaacctgggcaagaatggcctgagcaacagcagcatcctgctggacaagtgccccccacccaggcctcccagcagcccctacccacccctgcccaaggacaagctgaacccccccacccccagcatctacctggagaacaagagagatgccttcttcccccccctgcaccagttctgcaccaaccccaacaaccctgtgaccgtcatccggggcctggccggggccctgaagctggacctgggcctcttcagcaccaagaccctggtggaggccaacaatgagcacatggtggaggtgaggacccagctgctgcagcctgcagatgagaactgggaccccaccggcaccaagaagatctggcactgtgagagcaacagaagccacaccaccatcgccaagtatgcccagtaccaggccagcagcttccaggagagcctgcgggaggagaatgagaagaggagccaccacaaggaccacagcgacagcgagagcaccagcagtgacaacagcggcagaagaaggaagggccccttcaagaccatcaagtttggcaccaacatcgacctgagtgatgacaagaagtggaagctgcagctgcacgagctgaccaagctgcctgcctttgtgcgggtggtgtctgctggcaacctgctgagccacgtgggccacaccatcctgggcatgaacacagtgcagctgtacatgaaggtgcccggcagcaggaccccaggccaccaggagaacaacaacttctgcagcgtgaacatcaacatcggccctggggactgtgagtggtttgtggtgcctgagggctactggggcgtgctgaatgacttctgtgagaagaacaacctgaacttcctgatgggctcctggtggcccaacctggaggacctgtatgaggccaacgtgcctgtgtaccgcttcatccagaggcctggggacctggtgtggatcaatgccggcaccgtgcactgggtgcaggccatcggctggtgcaacaacatcgcctggaatgtgggccccctgacagcctgccagtacaagctggccgtggagagatatgagtggaacaagctgcagagcgtgaagagcatcgtgcccatggtgcacctgtcctggaacatggccaggaacatcaaggtgtctgaccccaagctgtttgagatgatcaagtactgcctgctgcggaccctgaagcagtgccagaccctgcgggaggccctgattgctgctgggaaggagatcatctggcacggccgcaccaaggaggagcccgcccactactgcagcatctgtgaggtggaggtgtttgacctgctgtttgtgaccaatgaaagcaacagcaggaagacctacatcgtgcactgccaggactgtgccaggaagaccagcggcaacctggagaactttgtggtgctggagcagtacaagatggaggacctgatgcaggtgtatgaccagttcaccctggccccacccctgcccagcgccagcagctag

SEQ ID NO: 158302 - DNA, 4227 bp, Artificial Sequence
  Description of Artificial Sequence: Synthetic coding sequence
atgaagagctgtggggtgtccctggccacagctgctgctgctgctgctgcctttggagatgaggagaagaagatggctgctgggaaggccagcggggagagcgaggaggccagccccagcctgacagctgaggagcgggaggccctgggcggcctggacagccggctgtttggatttgtgcgcttccatgaagatggagcccggaccaaggccctgctgggcaaggctgtgcgctgctatgagagcctcatcctgaaggccgagggcaaggtggagagtgacttcttctgccagctgggccacttcaacctgctgctggaggactaccccaaggccctgagcgcctaccagcgctactacagcctgcagagcgactactggaagaatgctgccttcctgtatggcctgggcctggtgtacttccactacaatgccttccagtgggccatcaaggccttccaggaggtgctgtatgtggaccccagcttctgccgggccaaggagatccacctgcggctgggcctgatgttcaaggtgaacacagattatgagagcagcctgaagcacttccagctggccctggtggactgcaacccctgcaccctgagcaatgctgagatccagttccacatcgcccacctgtatgagacccagaggaagtaccacagcgccaaggaggcctatgagcagctgctgcagacagagaacctgagcgcccaggtgaaggccaccgtgctgcagcagctgggctggatgcaccacacagtggacctgctgggggacaaggccaccaaggagagctatgccatccagtacctgcagaagagcctggaggccgaccccaacagcggccagagctggtacttcctgggccgctgctacagcagcatcggcaaggtgcaggatgccttcatctcctaccggcagagcattgacaagtctgaggccagcgctgacacctggtgcagcattggagtgctgtaccagcagcagaaccagcccatggatgccctgcaggcctacatctgtgctgtgcagctggaccacggccacgccgccgcctggatggacctgggcaccctgtatgagagctgcaaccagccccaggatgccatcaagtgctacctgaatgccaccaggagcaagagctgcagcaacaccagcgccctggccgcccgcatcaagtacctgcaggcctgcaagccccaccaccccaacacagagcctgtgctgggcctgagccagacccccatcagccagcagagcctgcccctgcacatgatccccagcagccaggtggatgacctgagcagccctgccaagaggaagaggaccagcagccccaccaagaacaccagtgacaactggagcggcggccatgctgtgagccacccccctgtgcagcagcaggcccacagctggtgcctgaccccccagaagctgcagcacctggagcagctgcgggccaacagaaacaacctgaacccagcccagaagctgatgctggagcagctggagagccagtttgtgctgatgcagcagcaccagatgaggcccaccggggtggcccaggtgcgcagcacaggcatccccaacggccccacagctgacagcagcctgcccaccaacagcgtgtctggccagcagccccagctggccctgaccagggtgcccagcgtgtcccagcccggggtgcggcctgcctgccccggccagcccctggccaacggccccttctctgctggccacgtgccctgcagcaccagcaggaccctgggcagcacagacaccatcctgattggcaacaaccacatcaccggcagcggcagcaatggaaatgtgccctacctgcagagaaatgccctgaccctgccccacaacagaaccaacctgaccagcagcgctgaggagccctggaagaaccagctgagcaacagcacccagggcctgcacaagggccagagcagccacagcgctggccccaacggggagcggcccctgagcagcacaggccccagccagcacctgcaggccgccggcagcggcatccagaaccagaatggccaccccaccctgcccagcaacagcgtgacccagggcgccgccctgaaccacctgagcagccacacagccaccagcggcggccagcagggcatcaccctgaccaaggagagcaagcccagcggcaacatcctgactgtgcctgagaccagccgccacactggagagacccccaacagcacagcctctgtggagggcctgcccaaccacgtgcaccagatgacagcagatgctgtgtgcagccccagccatggagacagcaagagccctggcctgctgagcagtgacaacccccagctgagcgccctgctgatgggcaaggccaacaacaacgtgggcaccggcacctgtgacaaggtgaacaacatccaccctgctgtgcacaccaagacagacaacagcgtggccagcagccccagcagcgccatcagcacagccacccccagccccaagagcacagagcagaccaccaccaacagcgtgaccagcctgaacagcccccacagcggcctgcacaccatcaacggggagggcatggaggagagccagagccccatgaagacagacctgctgctggtgaaccacaagcccagcccccagatcatccccagcatgtctgtgtccatctaccccagcagcgctgaggtgctgaaggcctgcaggaacctgggcaagaatggcctgagcaacagcagcatcctgctggacaagtgccccccaccccggccccccagcagcccctacccacccctgcccaaggacaagctgaacccccccacccccagcatctacctggagaacaagagagatgccttcttcccccccctgcaccagttctgcaccaaccccaacaaccctgtgaccgtcatccggggcctggccggggccctgaagctggacctgggcctcttcagcaccaagaccctggtggaggccaacaatgagcacatggtggaggtgaggacccagctgctgcagcctgcagatgagaactgggaccccaccggcaccaagaagatctggcactgtgagagcaacagaagccacaccaccatcgccaagtatgcccagtaccaggccagcagcttccaggagagcctgcgggaggagaatgagaagaggagccaccacaaggaccacagcgacagcgagagcaccagcagtgacaacagcggcagaagaaggaagggccccttcaagaccatcaagtttggcaccaacatcgacctgagtgatgacaagaagtggaagctgcagctgcacgagctgaccaagctgcctgcctttgtgcgggtggtgtctgctggcaacctgctgagccacgtgggccacaccatcctgggcatgaacacagtgcagctgtacatgaaggtgcccggcagcaggaccccaggccaccaggagaacaacaacttctgcagcgtgaacatcaacatcggccctggggactgtgagtggtttgtggtgcctgagggctactggggcgtgctgaatgacttctgtgagaagaacaacctgaacttcctgatgggctcctggtggcccaacctggaggacctgtatgaggccaacgtgcctgtgtaccgcttcatccagaggcctggggacctggtgtggatcaatgccggcaccgtgcactgggtgcaggccatcggctggtgcaacaacatcgcctggaatgtgggccccctgacagcctgccagtacaagctggccgtggagagatatgagtggaacaagctgcagagcgtgaagagcatcgtgcccatggtgcacctgtcctggaacatggccaggaacatcaaggtgtctgaccccaagctgtttgagatgatcaagtactgcctgctgcggaccctgaagcagtgccagaccctgcgggaggccctgattgctgctgggaaggagatcatctggcacggccgcaccaaggaggagcccgcccactactgcagcatctgtgaggtggaggtgtttgacctgctgtttgtgaccaatgaaagcaacagcaggaagacctacatcgtgcactgccaggactgtgccaggaagaccagcggcaacctggagaactttgtggtgctggagcagtacaagatggaggacctgatgcaggtgtatgaccagttcaccctggccccacccctgcccagcgccagcagctag

SEQ ID NO: 158303 - DNA, 3000 bp, Artificial Sequence
  Description of Artificial Sequence: Synthetic coding sequence
tgaggaaccctgtatgagagctgcaaccagccccaggatgccatcaagtgctacctgaatgccaccaggagcaagagctgcagcaacaccagcgccctggccgcccgcatcaagtacctgcagaacaccagtgacaactggagcggcggccatgctgtgagccacccccctgtgcagcagcaggcccacagctggtgcctgaccccccagaagctgcagcacctggagcagctgcgggccaacagaaacaacctgaacccagcccagaagctgatgctggagcagctggagagccagtttgtgctgatgcagcagcaccagatgaggcccactggagtggcccaggtgcgcagcacaggcatccccaacggccccacagctgacagcagcctgcccaccaacagcgtgtctggccagcagccccagctggccctgaccagggtgcccagcgtgtcccagcccggggtgcggcctgcctgccccggccagcccctggccaacggccccttctctgctggccacgtgccctgcagcaccagcaggaccctgggcagcacagacaccatcctgattggcaacaaccacatcactggaagtggcagcaatggaaatgtgccctacctgcagagaaatgccctgaccctgccccacaacagaaccaacctgaccagcagcgctgaggagccctggaagaaccagctgagcaacagcacccagggcctgcacaagggccagagcagccacagcgctggccccaatggagagcggcccctgagcagcacaggccccagccagcacctgcaggccgccggcagcggcatccagaaccagaatggccaccccaccctgcccagcaacagcgtgacccagggcgccgccctgaaccacctgagcagccacacagccaccagcggcggccagcagggcatcaccctgaccaaggagagcaagcccagcggcaacatcctgactgtgcctgagaccagccgccacactggagagacccccaacagcacagcctctgtggagggcctgcccaaccacgtgcaccagatgacagcagatgctgtgtgcagccccagccacggggacagcaagagccctggcctgctgagcagtgacaacccccagctgagcgccctgctgatgggcaaggccaacaacaacgtgggcaccggcacctgtgacaaggtgaacaacatccaccctgctgtgcacaccaagacagacaacagcgtggccagcagccccagcagcgccatcagcacagccacccccagccccaagagcacagagcagaccaccaccaacagcgtgaccagcctgaacagcccccacagcggcctgcacaccatcaatggagagggcatggaggagagccagagccccatgaagacagacctgctgctggtgaaccacaagcccagcccccagatcatccccagcatgtctgtgtccatctaccccagcagcgctgaggtgctgaaggcctgcaggaacctgggcaagaatggcctgagcaacagcagcatcctgctggacaagtgccccccacccaggcctcccagcagcccctacccacccctgcccaaggacaagctgaacccccccacccccagcatctacctggagaacaagagagatgccttcttcccccccctgcaccagttctgcaccaaccccaacaaccctgtgaccgtcatccggggcctggccggggccctgaagctggacctgggcctcttcagcaccaagaccctggtggaggccaacaatgagcacatggtggaggtgaggacccagctgctgcagcctgcagatgagaactgggaccccaccggcaccaagaagatctggcactgtgagagcaacagaagccacaccaccatcgccaagtatgcccagtaccaggccagcagcttccaggagagcctgcgggaggagaatgagaagaggagccaccacaaggaccacagcgacagcgagagcaccagcagtgacaacagcggcagaagaaggaagggccccttcaagaccatcaagtttggcaccaacatcgacctgagtgatgacaagaagtggaagctgcagctgcacgagctgaccaagctgcctgcctttgtgcgggtggtgtctgctggcaacctgctgagccacgtgggccacaccatcctgggcatgaacacagtgcagctgtacatgaaggtgcccggcagcaggaccccaggccaccaggagaacaacaacttctgcagcgtgaacatcaacatcggccctggggactgtgagtggtttgtggtgcctgagggctactggggcgtgctgaatgacttctgtgagaagaacaacctgaacttcctgatgggctcctggtggcccaacctggaggacctgtatgaggccaacgtgcctgtgtaccgcttcatccagaggcctggggacctggtgtggatcaatgccggcaccgtgcactgggtgcaggccatcggctggtgcaacaacatcgcctggaatgtgggccccctgacagcctgccagtacaagctggccgtggagagatatgagtggaacaagctgcagagcgtgaagagcatcgtgcccatggtgcacctgtcctggaacatggccaggaacatcaaggtgtctgaccccaagctgtttgagatgatcaagtactgcctgctgcggaccctgaagcagtgccagaccctgcgggaggccctgattgctgctgggaaggagatcatctggcacggccgcaccaaggaggagcccgcccactactgcagcatctgtgaggtggaggtgtttgacctgctgtttgtgaccaatgaaagcaacagcaggaagacctacatcgtgcactgccaggactgtgccaggaagaccagcggcaacctggagaactttgtggtgctggagcagtacaagatggaggacctgatgcaggtgtatgaccagttcaccctggccccacccctgcccagcgccagcagctag

SEQ ID NO: 158304 - DNA, 486 bp, Artificial Sequence
  Description of Artificial Sequence: Synthetic coding sequence
tgagccaggaacatcaaggtgtctgaccccaagctgtttgagatgatcaagatcttcagcctgagccccaacttccgggcagagaagtgcctgcgggaccacctggtgcagcccctgcggagcaatggagagcctgagcccctgcgcttcaccggggagtactgcctgctgcggaccctgaagcagtgccagaccctgcgggaggccctgattgctgctgggaaggagatcatctggcacggccgcaccaaggaggagcccgcccactactgcagcatctgtgaggtggaggtgtttgacctgctgtttgtgaccaatgaaagcaacagcaggaagacctacatcgtgcactgccaggactgtgccaggaagaccagcggcaacctggagaactttgtggtgctggagcagtacaagatggaggacctgatgcaggtgtatgaccagttcaccctggccccacccctgcccagcgccagcagctag

SEQ ID NO: 158305 - DNA, 3135 bp, Artificial Sequence
  Description of Artificial Sequence: Synthetic coding sequence
tgaaacaagaccaagctgctgcccagcattgaggaggcctggagcctgcccatcccagctgagctgaccagccggcagggcgccatgaacacagcccagcaggcctgcaagccccaccaccccaacacagagcctgtgctgggcctgagccagacccccatcagccagcagagcctgcccctgcacatgatccccagcagccaggtggatgacctgagcagccctgccaagaggaagaggaccagcagccccaccaagaacaccagtgacaactggagcggcggccatgctgtgagccacccccctgtgcagcagcaggcccacagctggtgcctgaccccccagaagctgcagcacctggagcagctgcgggccaacagaaacaacctgaacccagcccagaagctgatgctggagcagctggagagccagtttgtgctgatgcagcagcaccagatgaggcccaccggggtggcccaggtgcgcagcacaggcatccccaacggccccacagctgacagcagcctgcccaccaacagcgtgtctggccagcagccccagctggccctgaccagggtgcccagcgtgtcccagcccggggtgcggcctgcctgccccggccagcccctggccaacggccccttctctgctggccacgtgccctgcagcaccagcaggaccctgggcagcacagacaccatcctgattggcaacaaccacatcaccggcagcggcagcaatggaaatgtgccctacctgcagagaaatgccctgaccctgccccacaacagaaccaacctgaccagcagcgctgaggagccctggaagaaccagctgagcaacagcacccagggcctgcacaagggccagagcagccacagcgctggccccaacggggagcggcccctgagcagcacaggccccagccagcacctgcaggccgccggcagcggcatccagaaccagaatggccaccccaccctgcccagcaacagcgtgacccagggcgccgccctgaaccacctgagcagccacacagccaccagcggcggccagcagggcatcaccctgaccaaggagagcaagcccagcggcaacatcctgactgtgcctgagaccagccgccacactggagagacccccaacagcacagcctctgtggagggcctgcccaaccacgtgcaccagatgacagcagatgctgtgtgcagccccagccatggagacagcaagagccctggcctgctgagcagtgacaacccccagctgagcgccctgctgatgggcaaggccaacaacaacgtgggcaccggcacctgtgacaaggtgaacaacatccaccctgctgtgcacaccaagacagacaacagcgtggccagcagccccagcagcgccatcagcacagccacccccagccccaagagcacagagcagaccaccaccaacagcgtgaccagcctgaacagcccccacagcggcctgcacaccatcaacggggagggcatggaggagagccagagccccatgaagacagacctgctgctggtgaaccacaagcccagcccccagatcatccccagcatgtctgtgtccatctaccccagcagcgctgaggtgctgaaggcctgcaggaacctgggcaagaatggcctgagcaacagcagcatcctgctggacaagtgccccccaccccggccccccagcagcccctacccacccctgcccaaggacaagctgaacccccccacccccagcatctacctggagaacaagagagatgccttcttcccccccctgcaccagttctgcaccaaccccaacaaccctgtgaccgtcatccggggcctggccggggccctgaagctggacctgggcctcttcagcaccaagaccctggtggaggccaacaatgagcacatggtggaggtgaggacccagctgctgcagcctgcagatgagaactgggaccccaccggcaccaagaagatctggcactgtgagagcaacagaagccacaccaccatcgccaagtatgcccagtaccaggccagcagcttccaggagagcctgcgggaggagaatgagaagaggagccaccacaaggaccacagcgacagcgagagcaccagcagtgacaacagcggcagaagaaggaagggccccttcaagaccatcaagtttggcaccaacatcgacctgagtgatgacaagaagtggaagctgcagctgcacgagctgaccaagctgcctgcctttgtgcgggtggtgtctgctggcaacctgctgagccacgtgggccacaccatcctgggcatgaacacagtgcagctgtacatgaaggtgcccggcagcaggaccccaggccaccaggagaacaacaacttctgcagcgtgaacatcaacatcggccctggggactgtgagtggtttgtggtgcctgagggctactggggcgtgctgaatgacttctgtgagaagaacaacctgaacttcctgatgggctcctggtggcccaacctggaggacctgtatgaggccaacgtgcctgtgtaccgcttcatccagaggcctggggacctggtgtggatcaatgccggcaccgtgcactgggtgcaggccatcggctggtgcaacaacatcgcctggaatgtgggccccctgacagcctgccagtacaagctggccgtggagagatatgagtggaacaagctgcagagcgtgaagagcatcgtgcccatggtgcacctgtcctggaacatggccaggaacatcaaggtgtctgaccccaagctgtttgagatgatcaagtactgcctgctgcggaccctgaagcagtgccagaccctgcgggaggccctgattgctgctgggaaggagatcatctggcacggccgcaccaaggaggagcccgcccactactgcagcatctgtgaggtggaggtgtttgacctgctgtttgtgaccaatgaaagcaacagcaggaagacctacatcgtgcactgccaggactgtgccaggaagaccagcggcaacctggagaactttgtggtgctggagcagtacaagatggaggacctgatgcaggtgtatgaccagttcaccctggccccacccctgcccagcgccagcagctag

SEQ ID NO: 158306 - DNA, 675 bp, Artificial Sequence
  Description of Artificial Sequence: Synthetic coding sequence
tgactgcaggcctacatctgtgctgtgcagctggaccacggccacgccgccgcctggatggacctgggcaccctgtatgagagctgcaaccagccccaggatgccatcaagtgctacctgaatgccaccaggagcaagagctgcagcaacaccagcgccctggccgcccgcatcaagtacctgcaggcccagctgtgcaacctgccccagggcagcctgcagaacaagaccaagctgctgcccagcattgaggaggcctggagcctgcccatcccagctgagctgaccagccggcagggcgccatgaacacagcccagcagaacaccagtgacaactggagcggcggccatgctgtgagccacccccctgtgcagcagcaggcccacagctggtgcctgaccccccagaagctgcagatgaggcccactggagtggcccaggtgcgcagcacaggcatccccaacggccccacagctgacagcagcctgcccaccaacagcgtgtctggccagcagccccagctggccctgaccagggtgcccagcgtgtcccagcccggggtgcggcctgcctgccccggccagcccctggccaacggccccttctctgctggccacgtgccctgcagcaccagcaggaccctgggcagcacagacaccatcctgattggatag

SEQ ID NO: 158307 - DNA, 516 bp, Artificial Sequence
  Description of Artificial Sequence: Synthetic coding sequence
agcctgcagaacaagaccaagctgctgcccagcattgaggaggcctggagcctgcccatcccagctgagctgaccagccggcagggcgccatgaacacagcccagcagaacaccagtgacaactggagcggcggccatgctgtgagccacccccctgtgcagcagcaggcccacagctggtgcctgaccccccagaagctgcagcacctggagcagctgcgggccaacagaaacaacctgaacccagcccagaagctgatgctggagcagctggagagccagtttgtgctgatgcagcagcaccagatgaggcccaccggggtggcccaggtgcgcagcacaggcatccccaacggccccacagctgacagcagcctgcccaccaacagcgtgtctggccagcagccccagctggccctgaccagggtgcccagcgtgtcccagcccggggtgcggcctgcctgccccggccagcccctggccaacggccccttctgccggccctgcagcctgtag

SEQ ID NO: 158308 - DNA, 4071 bp, Artificial Sequence
  Description of Artificial Sequence: Synthetic coding sequence
atgaagagctgtggggtgtccctggccacagctgctgctgctgctgctgcctttggagatgaggagaagaagatggctgctgggaaggccagcggggagagcgaggaggccagccccagcctgacagctgaggagcgggaggccctgggcggcctggacagccggctgtttggatttgtgcgcttccatgaagatggagcccggaccaaggccctgctgggcaaggctgtgcgctgctatgagagcctcatcctgaaggccgagggcaaggtggagagtgacttcttctgccagctgggccacttcaacctgctgctggaggactaccccaaggccctgagcgcctaccagcgctactacagcctgcagagcgactactggaagaatgctgccttcctgtatggcctgggcctggtgtacttccactacaatgccttccagtgggccatcaaggccttccaggaggtgctgtatgtggaccccagcttctgccgggccaaggagatccacctgcggctgggcctgatgttcaaggtgaacacagattatgagagcagcctgaagcacttccagctggccctggtggactgcaacccctgcaccctgagcaatgctgagatccagttccacatcgcccacctgtatgagacccagaggaagtaccacagcgccaaggaggcctatgagcagctgctgcagacagagaacctgagcgcccaggtgaaggccaccgtgctgcagcagctgggctggatgcaccacacagtggacctgctgggggacaaggccaccaaggagagctatgccatccagtacctgcagaagagcctggaggccgaccccaacagcggccagagctggtacttcctgggccgctgctacagcagcatcggcaaggtgcaggatgccttcatctcctaccggcagagcattgacaagtctgaggccagcgctgacacctggtgcagcattggagtgctgtaccagcagcagaaccagcccatggatgccctgcaggcctacatctgtgctgtgcagctggaccacggccacgccgccgcctggatggacctgggcaccctgtatgagagctgcaaccagccccaggatgccatcaagtgctacctgaatgccaccaggagcaagagctgcagcaacaccagcgccctggccgcccgcatcaagtacctgcagaacaccagtgacaactggagcggcggccatgctgtgagccacccccctgtgcagcagcaggcccacagctggtgcctgaccccccagaagctgcagcacctggagcagctgcgggccaacagaaacaacctgaacccagcccagaagctgatgctggagcagctggagagccagtttgtgctgatgcagcagcaccagatgaggcccaccggggtggcccaggtgcgcagcacaggcatccccaacggccccacagctgacagcagcctgcccaccaacagcgtgtctggccagcagccccagctggccctgaccagggtgcccagcgtgtcccagcccggggtgcggcctgcctgccccggccagcccctggccaacggccccttctctgctggccacgtgccctgcagcaccagcaggaccctgggcagcacagacaccatcctgattggcaacaaccacatcaccggcagcggcagcaatggaaatgtgccctacctgcagagaaatgccctgaccctgccccacaacagaaccaacctgaccagcagcgctgaggagccctggaagaaccagctgagcaacagcacccagggcctgcacaagggccagagcagccacagcgctggccccaacggggagcggcccctgagcagcacaggccccagccagcacctgcaggccgccggcagcggcatccagaaccagaatggccaccccaccctgcccagcaacagcgtgacccagggcgccgccctgaaccacctgagcagccacacagccaccagcggcggccagcagggcatcaccctgaccaaggagagcaagcccagcggcaacatcctgactgtgcctgagaccagccgccacactggagagacccccaacagcacagcctctgtggagggcctgcccaaccacgtgcaccagatgacagcagatgctgtgtgcagccccagccatggagacagcaagagccctggcctgctgagcagtgacaacccccagctgagcgccctgctgatgggcaaggccaacaacaacgtgggcaccggcacctgtgacaaggtgaacaacatccaccctgctgtgcacaccaagacagacaacagcgtggccagcagccccagcagcgccatcagcacagccacccccagccccaagagcacagagcagaccaccaccaacagcgtgaccagcctgaacagcccccacagcggcctgcacaccatcaacggggagggcatggaggagagccagagccccatgaagacagacctgctgctggtgaaccacaagcccagcccccagatcatccccagcatgtctgtgtccatctaccccagcagcgctgaggtgctgaaggcctgcaggaacctgggcaagaatggcctgagcaacagcagcatcctgctggacaagtgccccccaccccggccccccagcagcccctacccacccctgcccaaggacaagctgaacccccccacccccagcatctacctggagaacaagagagatgccttcttcccccccctgcaccagttctgcaccaaccccaacaaccctgtgaccgtcatccggggcctggccggggccctgaagctggacctgggcctcttcagcaccaagaccctggtggaggccaacaatgagcacatggtggaggtgaggacccagctgctgcagcctgcagatgagaactgggaccccaccggcaccaagaagatctggcactgtgagagcaacagaagccacaccaccatcgccaagtatgcccagtaccaggccagcagcttccaggagagcctgcgggaggagaatgagaagaggagccaccacaaggaccacagcgacagcgagagcaccagcagtgacaacagcggcagaagaaggaagggccccttcaagaccatcaagtttggcaccaacatcgacctgagtgatgacaagaagtggaagctgcagctgcacgagctgaccaagctgcctgcctttgtgcgggtggtgtctgctggcaacctgctgagccacgtgggccacaccatcctgggcatgaacacagtgcagctgtacatgaaggtgcccggcagcaggaccccaggccaccaggagaacaacaacttctgcagcgtgaacatcaacatcggccctggggactgtgagtggtttgtggtgcctgagggctactggggcgtgctgaatgacttctgtgagaagaacaacctgaacttcctgatgggctcctggtggcccaacctggaggacctgtatgaggccaacgtgcctgtgtaccgcttcatccagaggcctggggacctggtgtggatcaatgccggcaccgtgcactgggtgcaggccatcggctggtgcaacaacatcgcctggaatgtgggccccctgacagcctgccagtacaagctggccgtggagagatatgagtggaacaagctgcagagcgtgaagagcatcgtgcccatggtgcacctgtcctggaacatggccaggaacatcaaggtgtctgaccccaagctgtttgagatgatcaagtactgcctgctgcggaccctgaagcagtgccagaccctgcgggaggccctgattgctgctgggaaggagatcatctggcacggccgcaccaaggaggagcccgcccactactgcagcatctgtgaggtggaggtgtttgacctgctgtttgtgaccaatgaaagcaacagcaggaagacctacatcgtgcactgccaggactgtgccaggaagaccagcggcaacctggagaactttgtggtgctggagcagtacaagatggaggacctgatgcaggtgtatgaccagttcaccctggccccacccctgcccagcgccagcagctag

SEQ ID NO: 158309 - DNA, 675 bp, Artificial Sequence
  Description of Artificial Sequence: Synthetic coding sequence
atgaagagctgtggggtgtccctggccacagctgctgctgctgctgctgcctttggagatgaggagaagaagatggctgctgggaaggccagcggggagagcgaggaggccagccccagcctgacagctgaggagcgggaggccctgggcggcctggacagccggctgtttggatttgtgcgcttccatgaagatggagcccggaccaaggccctgctgggcaaggctgtgcgctgctatgagagcctcatcctgaaggccgagggcaaggtggagagtgacttcttctgccagctgggccacttcaacctgctgctggaggactaccccaaggccctgagcgcctaccagcgctactacagcctgcagagcgactactggaagaatgctgccttcctgtatggcctgggcctggtgtacttccactacaatgccttccagtgggccatcaaggccttccaggaggtgctgtatgtggaccccagcttctgccgggccaaggagatccacctgcggctgggcctgatgttcaaggtgaacacagattatgagagcagcctgaagcacttccagctggccctggtggactgcaacccctgcaccctgagcaatgctgagatccagttccacatcgcccacctgtatgagacccaggtgggctgcatcaccctgtag

SEQ ID NO: 158310 - DNA, 3969 bp, Artificial Sequence
  Description of Artificial Sequence: Synthetic coding sequence
atgaagagctgtggggtgtccctggccacagctgctgctgctgctgctgcctttggagatgaggagaagaagatggctgctgggaaggccagcggggagagcgaggaggccagccccagcctgacagctgaggagcgggaggccctgggcggcctggacagccggctgtttggatttgtgcgcttccatgaagatggagcccggaccaaggccctgctgggcaaggctgtgcgctgctatgagagcctcatcctgaaggccgagggcaaggtggagagtgacttcttctgccagctgggccacttcaacctgctgctggaggactaccccaaggccctgagcgcctaccagcgctactacagcctgcagagcgactactggaagaatgctgccttcctgtatggcctgggcctggtgtacttccactacaatgccttccagtgggccatcaaggccttccaggaggtgctgtatgtggaccccagcttctgccgggccaaggagatccacctgcggctgggcctgatgttcaaggtgaacacagattatgagagcagcctgaagcacttccagctggccctggtggactgcaacccctgcaccctgagcaatgctgagatccagttccacatcgcccacctgtatgagacccagaggaagtaccacagcgccaaggaggcctatgagcagctgctgcagacagagaacctgagcgcccaggtgaaggccaccgtgctgcagcagctgggctggatgcaccacacagtggacctgctgggggacaaggccaccaaggagagctatgccatccagtacctgcagaagagcctggaggccgaccccaacagcggccagagctggtacttcctgggccgctgctacagcagcatcggcaaggtgcaggatgccttcatctcctaccggcagagcattgacaagtctgaggccagcgctgacacctggtgcagcattggagtgctgtaccagcagcagaaccagcccatggatgccctgcaggcctacatctgtgctgtgcagctggaccacggccacgccgccgcctggatggacctgggcaccctgtatgagagctgcaaccagccccaggatgccatcaagtgctacctgaatgccaccaggagcaagagctgcagcaacaccagcgccctggccgcccgcatcaagtacctgcagaacaccagtgacaactggagcggcggccatgctgtgagccacccccctgtgcagcagcaggcccacagctggtgcctgaccccccagaagctgcagatgaggcccaccggggtggcccaggtgcgcagcacaggcatccccaacggccccacagctgacagcagcctgcccaccaacagcgtgtctggccagcagccccagctggccctgaccagggtgcccagcgtgtcccagcccggggtgcggcctgcctgccccggccagcccctggccaacggccccttctctgctggccacgtgccctgcagcaccagcaggaccctgggcagcacagacaccatcctgattggcaacaaccacatcaccggcagcggcagcaatggaaatgtgccctacctgcagagaaatgccctgaccctgccccacaacagaaccaacctgaccagcagcgctgaggagccctggaagaaccagctgagcaacagcacccagggcctgcacaagggccagagcagccacagcgctggccccaacggggagcggcccctgagcagcacaggccccagccagcacctgcaggccgccggcagcggcatccagaaccagaatggccaccccaccctgcccagcaacagcgtgacccagggcgccgccctgaaccacctgagcagccacacagccaccagcggcggccagcagggcatcaccctgaccaaggagagcaagcccagcggcaacatcctgactgtgcctgagaccagccgccacactggagagacccccaacagcacagcctctgtggagggcctgcccaaccacgtgcaccagatgacagcagatgctgtgtgcagccccagccatggagacagcaagagccctggcctgctgagcagtgacaacccccagctgagcgccctgctgatgggcaaggccaacaacaacgtgggcaccggcacctgtgacaaggtgaacaacatccaccctgctgtgcacaccaagacagacaacagcgtggccagcagccccagcagcgccatcagcacagccacccccagccccaagagcacagagcagaccaccaccaacagcgtgaccagcctgaacagcccccacagcggcctgcacaccatcaacggggagggcatggaggagagccagagccccatgaagacagacctgctgctggtgaaccacaagcccagcccccagatcatccccagcatgtctgtgtccatctaccccagcagcgctgaggtgctgaaggcctgcaggaacctgggcaagaatggcctgagcaacagcagcatcctgctggacaagtgccccccaccccggccccccagcagcccctacccacccctgcccaaggacaagctgaacccccccacccccagcatctacctggagaacaagagagatgccttcttcccccccctgcaccagttctgcaccaaccccaacaaccctgtgaccgtcatccggggcctggccggggccctgaagctggacctgggcctcttcagcaccaagaccctggtggaggccaacaatgagcacatggtggaggtgaggacccagctgctgcagcctgcagatgagaactgggaccccaccggcaccaagaagatctggcactgtgagagcaacagaagccacaccaccatcgccaagtatgcccagtaccaggccagcagcttccaggagagcctgcgggaggagaatgagaagaggagccaccacaaggaccacagcgacagcgagagcaccagcagtgacaacagcggcagaagaaggaagggccccttcaagaccatcaagtttggcaccaacatcgacctgagtgatgacaagaagtggaagctgcagctgcacgagctgaccaagctgcctgcctttgtgcgggtggtgtctgctggcaacctgctgagccacgtgggccacaccatcctgggcatgaacacagtgcagctgtacatgaaggtgcccggcagcaggaccccaggccaccaggagaacaacaacttctgcagcgtgaacatcaacatcggccctggggactgtgagtggtttgtggtgcctgagggctactggggcgtgctgaatgacttctgtgagaagaacaacctgaacttcctgatgggctcctggtggcccaacctggaggacctgtatgaggccaacgtgcctgtgtaccgcttcatccagaggcctggggacctggtgtggatcaatgccggcaccgtgcactgggtgcaggccatcggctggtgcaacaacatcgcctggaatgtgggccccctgacagcctgccagtacaagctggccgtggagagatatgagtggaacaagctgcagagcgtgaagagcatcgtgcccatggtgcacctgtcctggaacatggccaggaacatcaaggtgtctgaccccaagctgtttgagatgatcaagtactgcctgctgcggaccctgaagcagtgccagaccctgcgggaggccctgattgctgctgggaaggagatcatctggcacggccgcaccaaggaggagcccgcccactactgcagcatctgtgaggtggaggtgtttgacctgctgtttgtgaccaatgaaagcaacagcaggaagacctacatcgtgcactgccaggactgtgccaggaagaccagcggcaacctggagaactttgtggtgctggagcagtacaagatggaggacctgatgcaggtgtatgaccagttcaccctggccccacccctgcccagcgccagcagctag

SEQ ID NO: 158311 - DNA, 5049 bp, Artificial Sequence
  Description of Artificial Sequence: Synthetic coding sequence
atgcacagagctgtggaccccccaggggcccgggccgcccgggaggcctttgccctgggcggcctgagctgtgccggggcctggagcagctgccccccccaccccccacccaggtctgcctggctgcccggcggccgctgcagcgccagcatcggccagccccccctgcctgcccccctgccccccagccacggcagcagcagcggccaccccagcaagccctactatgcccctggggcccccaccccccggcccctgcacggcaagctggagagcctgcacggctgtgtgcaggccctgctgcgggagcccgcccagcccggcctgtgggagcagctgggccagctgtatgaaagtgaacatgattctgaggaggccacccgctgctaccacagcgccctgcgctatggaggcagctttgctgagctgggccccagaattggccgcctgcagcaggcccagctgtggaacttccacacaggcagctgccagcaccgggccaaggtgctgccccccctggagcaggtgtggaacctgctgcacctggagcacaagaggaactacggggccaagagaggaggcccccctgtgaagagagctgctgagccccctgtggtgcagcctgtgcccccagctgccctgagcggccccagcggggaggagggcctgagccctgggggcaagagaagaagaggctgcaacagcgagcagacaggcctgcccccaggcctgcccctgcccccaccacccctgcccccacctcctcctcctcctcctcctcctcctccacccctgcccggcctggccaccagcccccccttccagctgaccaagccaggcctgtggagcaccctgcatggagatgcctggggccctgagaggaaaggaagtgcccctcctgagcggcaggagcagaggcacagcctgccccacccctacccctacccagccccagcctacacagcccaccccccaggccaccggctggtgcctgctgcccctcctggccctggccccaggcctcctggagctgagagccacggctgcctgcctgccaccaggcctcctggcagtgacctgcgggagagccgggtgcagaggagcaggatggacagctctgtgtccccagctgccaccacagcctgtgtgccctatgcccccagccggcccccaggcctgcccggcaccaccaccagcagcagcagcagcagcagcagcaacacaggcctgcggggcgtggagcccaaccctggcatccctggagctgaccactaccagaccccagccctggaggtgagccaccacggccgcctgggccccagcgcccacagcagcaggaagcccttcctgggcgccccagctgccaccccccacctgagcctgcccccaggccccagcagccccccacctccaccctgcccccggctgctgcggcccccacctcctccagcctggctgaagggccctgcctgcagagctgcccgggaggatggagagatcctggaggagctgttcttcggcacagagggcccccccaggcctgcccccccacccctgccccaccgggagggcttcctgggccccccagccagccgcttctctgtgggcacccaggacagccacaccccacccaccccacccacccccaccaccagcagcagcaacagcaacagcggcagccacagcagcagccctgctggccctgtgtccttccccccaccaccctacctggcccggagcattgaccccctgcccaggcctcccagccctgcccagaacccccaggacccccccctggtgcccctgaccctggccctgcccccagccccacccagcagctgccaccagaacaccagcggcagcttcagaagacctgagagcccccggccccgggtgtccttccccaagaccccagaggtgggccctggccccccacctggccccctgagcaaggccccccagcctgtgcccccaggagtgggggagctgcctgcccggggcccccggctgtttgacttcccccccacccccctggaggaccagtttgaggagcctgctgagttcaagatcctgcctgatggcctggccaacatcatgaagatgctggatgagagcatcaggaaggaggaggagcagcagcagcatgaagctggggtggccccccagccccccctgaaggagccctttgccagcctgcagagccccttccccacagacacagcccccaccaccacagccccagctgtggccgtgaccaccaccaccaccaccaccaccaccaccacagccacccaggaggaggagaagaagcccccaccagccctgcccccacctccacccctggccaagtttcctccacccagccagccccagcccccacctcctcctccacccagccctgccagcctgctgaagagcctggcctctgtgctggagggccagaagtactgctaccggggcactggagctgctgtgtccaccaggcctggccccctgcccaccacccagtacagccctggccccccatctggggccacagccctgccccccaccagcgctgcccccagcgcccagggcagcccccagcccagcgccagcagcagcagccagttcagcaccagcggcggcccctgggcccgggagcggcgggccggggaggagcctgtgcccggccccatgacccccacccagcccccaccacccctgagcctgcccccagcccggtctgagagcgaggtgctggaggagatcagccgggcctgtgagaccctggtggagcgggtgggccgcagcgccacagatcctgctgaccctgtggacacagctgagcctgctgacagcggcacagagcggctgctgcccccagcccaggccaaggaggaggccggcggcgtggccgctgtgtctggcagctgcaagaggcggcagaaggagcaccagaaggagcaccggcggcacagaagagcctgcaaggacagcgtgggccggcggccccgggagggccgggccaaggccaaggccaaggtgcccaaggagaagagcagaagagtgctgggcaacctggacctgcagagcgaggagatccagggccgggagaagagcaggccagacctgggcggggccagcaaggccaagccacccacagccccagccccacccagcgccccagcccccagcgcccagcccaccccacccagcgcctctgtgcctgggaagaaggcccgggaggaggcccctggccccccaggagtgtccagagctgacatgctgaagctgcggagcctgtctgagggcccccccaaggagctgaagatccgcctcatcaaggtggagagcggggacaaggagaccttcatcgccagcgaggtggaggagcggcggctgaggatggctgacctgaccatcagccactgtgccgcagatgtggtgcgggccagcagaaatgccaaggtgaagggcaagttccgggagagctacctgagccctgcccagagcgtgaagcccaagatcaacacagaggagaagctgccccgggagaagctgaacccccccacccccagcatctacctggagagcaagagagatgccttcagccctgtgctgctgcagttctgcacagaccccaggaaccccatcaccgtcatccggggcctggccggcagcctgcggctgaacctgggcctcttcagcaccaagaccctggtggaggccagcggggagcacacagtggaggtgaggacccaggtgcagcagcccagtgatgagaactgggacctgaccggcacccggcagatctggccctgtgagagcagccgcagccacaccaccatcgccaagtatgcccagtaccaggccagcagcttccaggagagcctgcaggaggagaaggagagtgaagatgaggagagcgaggagccagacagcaccaccggcaccccacccagcagcgccccagaccccaagaaccaccacatcatcaagtttggcaccaacatcgacctgagtgatgccaagcgctggaagccccagctgcaggagctgctgaagctgcctgccttcatgagggtgaccagcactggaaacatgctgagccacgtgggccacaccatcctgggcatgaacacagtgcagctgtacatgaaggtgcccggcagcaggaccccaggccaccaggagaacaacaacttctgcagcgtgaacatcaacatcggccctggggactgtgagtggtttgctgtgcatgagcactactgggagaccatcagcgccttctgtgacagacatggagtggactacctgaccggctcctggtggcccatcctggatgacctgtatgccagcaacatccctgtgtacagatttgtgcagaggcctggggacctggtgtggatcaatgccggcaccgtgcactgggtgcaggccaccggctggtgcaacaacatcgcctggaatgtgggccccctgacagcctaccagtaccagctggccctggagagatatgagtggaatgaggtgaagaatgtgaagagcatcgtgcccatgatccacgtgtcctggaatgtggccaggacagtgaagatcagtgaccctgacctcttcaagatgatcaagttctgcctgctgcagagcatgaagcactgccaggtgcagcgggagagcctggtgcgggccggcaagaagatcgcctaccagggccgggtgaaggatgagcccgcctactactgcaatgaatgtgatgtggaggtgttcaacatcctgtttgtgaccagtgaaaatggcagcaggaacacctacctggtgcactgtgagggctgtgcccggcggcgctctgctggcctgcagggcgtggtggtgctggagcagtacagaacagaggagctggcccaggcctatgatgccttcaccctggtgcgggcccggcgggcccggggccagaggagaagagccctgggccaggccgccggcaccggcttcggcagccctgctgcccccttccctgagcccccaccagccttcagcccccaggccccagccagcaccagcaggtag

SEQ ID NO: 158312 - DNA, 4932 bp, Artificial Sequence
  Description of Artificial Sequence: Synthetic coding sequence
atgcacagagctgtggaccccccaggggcccgggccgcccgggaggcctttgccctgggcggcctgagctgtgccggggcctggagcagctgccccccccaccccccacccaggtctgcctggctgcccggcggccgctgcagcgccagcatcggccagccccccctgcctgcccccctgccccccagccacggcagcagcagcggccaccccagcaagccctactatgcccctggggcccccaccccccggcccctgcacggcaagctggagagcctgcacggctgtgtgcaggccctgctgcgggagcccgcccagcccggcctgtgggagcagctgggccagctgtatgaaagtgaacatgattctgaggaggccacccgctgctaccacagcgccctgcgctatggaggcagctttgctgagctgggccccagaattggccgcctgcagcaggcccagctgtggaacttccacacaggcagctgccagcaccgggccaaggtgctgccccccctggagcaggtgtggaacctgctgcacctggagcacaagaggaactacggggccaagagaggaggcccccctgtgaagagagctgctgagccccctgtggtgcagcctgtgcccccagctgccctgagcggccccagcggggaggagggcctgagccctgggggcaagagaagaagaggctgcaacagcgagcagacaggcctgcccccaggcctgcccctgcccccaccacccctgcccccacctcctcctcctcctcctcctcctcctccacccctgcccggcctggccaccagcccccccttccagctgaccaagccaggcctgtggagcaccctgcatggagatgcctggggccctgagaggaaaggaagtgcccctcctgagcggcaggagcagaggcacagcctgccccacccctacccctacccagccccagcctacacagcccaccccccaggccaccggctggtgcctgctgcccctcctggccctggccccaggcctcctggagctgagagccacggctgcctgcctgccaccaggcctcctggcagtgacctgcgggagagccgggtgcagaggagcaggatggacagctctgtgtccccagctgccaccacagcctgtgtgccctatgcccccagccggcccccaggcctgcccggcaccaccaccagcagcagcagcagcagcagcagcaacacaggcctgcggggcgtggagcccaaccctggcatccctggagctgaccactaccagaccccagccctggaggtgagccaccacggccgcctgggccccagcgcccacagcagcaggaagcccttcctgggcgccccagctgccaccccccacctgagcctgcccccaggccccagcagccccccacctccaccctgcccccggctgctgcggcccccacctcctccagcctggctgaagggccctgcctgcagagctgcccgggaggatggagagatcctggaggagctgttcttcggcacagagggcccccccaggcctgcccccccacccctgccccaccgggagggcttcctgggccccccagccagccgcttctctgtgggcacccaggacagccacaccccacccaccccacccacccccaccaccagcagcagcaacagcaacagcggcagccacagcagcagccctgctggccctgtgtccttccccccaccaccctacctggcccggagcattgaccccctgcccaggcctcccagccctgcccagaacccccaggacccccccctggtgcccctgaccctggccctgcccccagccccacccagcagctgccaccagaacaccagcggcagcttcagaagacctgagagcccccggccccgggtgtccttccccaagaccccagaggtgggccctggccccccacctggccccctgagcaaggccccccagcctgtgcccccaggagtgggggagctgcctgcccggggcccccggctgtttgacttcccccccacccccctggaggaccagtttgaggagcctgctgagttcaagatcctgcctgatggcctggccaacatcatgaagatgctggatgagagcatcaggaaggaggaggagcagcagcagcatgaagctggggtggccccccagccccccctgaaggagccctttgccagcctgcagagccccttccccacagacacagcccccaccaccacagccccagctgtggccgtgaccaccaccaccaccaccaccaccaccaccacagccacccaggaggaggagaagaagcccccaccagccctgcccccacctccacccctggccaagtttcctccacccagccagccccagcccccacctcctcctccacccagccctgccagcctgctgaagagcctggcctctgtgctggagggccagaagtactgctaccggggcactggagctgctgtgtccaccaggcctggccccctgcccaccacccagtacagccctggccccccatctggggccacagccctgccccccaccagcgctgcccccagcgcccagggcagcccccagcccagcgccagcagcagcagccagttcagcaccagcggcggcccctgggcccgggagcggcgggccggggaggagcctgtgcccggccccatgacccccacccagcccccaccacccctgagcctgcccccagcccggtctgagagcgaggtgctggaggagatcagccgggcctgtgagaccctggtggagcgggtgggccgcagcgccacagatcctgctgaccctgtggacacagctgagcctgctgacagcggcacagagcggctgctgcccccagcccaggccaaggaggaggccggcggcgtggccgctgtgtctggcagctgcaagaggcggcagaaggagcaccagaaggagcaccggcggcacagaagagcctgcaaggacagcgtgggccggcggccccgggagggccgggccaaggccaaggccaaggtgcccaaggagaagagcagaagagtgctgggcaacctggacctgcagagcgaggagatccagggccgggagaagagcaggccagacctgggcggggccagcaaggccaagccacccacagccccagccccacccagcgccccagcccccagcgcccagcccaccccacccagcgcctctgtgcctgggaagaaggcccgggaggaggcccctggccccccaggagtgtccagagctgacatgctgaagctgcggagcctgtctgagggcccccccaaggagctgaagatccgcctcatcaaggtggagagcggggacaaggagaccttcatcgccagcgaggtggaggagcggcggctgaggatggctgacctgaccatcagccactgtgccgcagatgtggtgcgggccagcagaaatgccaaggtgaagggcaagttccgggagagctacctgagccctgcccagagcgtgaagcccaagatcaacacagaggagaagctgccccgggagaagctgaacccccccacccccagcatctacctggagagcaagagagatgccttcagccctgtgctgctgcagttctgcacagaccccaggaaccccatcaccgtcatccggggcctggccggcagcctgcggctgaacctgggcctcttcagcaccaagaccctggtggaggccagcggggagcacacagtggaggtgaggacccaggtgcagcagcccagtgatgagaactgggacctgaccggcacccggcagatctggccctgtgagagcagccgcagccacaccaccatcgccaagtatgcccagtaccaggccagcagcttccaggagagcctgcaggaggagaaggagagtgaagatgaggagagcgaggagccagacagcaccaccggcaccccacccagcagcgccccagaccccaagaaccaccacatcatcaagtttggcaccaacatcgacctgagtgatgccaagcgctggaagccccagctgcaggagctgctgaagctgcctgccttcatgagggtgaccagcactggaaacatgctgagccacgtgggccacaccatcctgggcatgaacacagtgcagctgtacatgaaggtgcccggcagcaggaccccaggccaccaggagaacaacaacttctgcagcgtgaacatcaacatcggccctggggactgtgagtggtttgctgtgcatgagcactactgggagaccatcagcgccttctgtgacagacatggagtggactacctgaccggctcctggtggcccatcctggatgacctgtatgccagcaacatccctgtgtacagatttgtgcagaggcctggggacctggtgtggatcaatgccggcaccgtgcactgggtgcaggccaccggctggtgcaacaacatcgcctggaatgtgggccccctgacagcctaccagtaccagctggccctggagagatatgagtggaatgaggtgaagaatgtgaagagcatcgtgcccatgatccacgtgtcctggaatgtggccaggacagtgaagatcagtgaccctgacctcttcaagatgatcaagttctgcctgctgcagagcatgaagcactgccaggtgcagcgggagagcctggtgcgggccggcaagaagatcgcctaccagggccgggtgaaggatgagcccgcctactactgcaatgaatgtgatgtggaggtgttcaacatcctgtttgtgaccagtgaaaatggcagcaggaacacctacctggtgcactgtgagggctgtgcccggcggcgctctgctggcctgcagggcgtggtggtgctggagcagtacagaacagaggagctggcccaggcctatgatgccttcaccctggccccagccagcaccagcaggtag

SEQ ID NO: 158313 - DNA, 1245 bp, Artificial Sequence
  Description of Artificial Sequence: Synthetic coding sequence
atgcacagccggggccgggagatcgtggtgctgctgaacccctggagcatcaatgaggccgtgtcctcctactgcacctacttcatcaagcaggacagcaagagctttggcatcatggtgtcctggaagggcatctacttcatcctgaccctcttctggggcagcttcttcggcagcatcttcatgctgagccccttcctgcccctgatgtttgtgaaccccagctggtaccgctggatcaacaaccggctggtggccacctggctgaccctgcctgtggccctgctggagaccatgtttggagtgaaggtgatcatcactggagatgcctttgtgcctggagagaggagcgtcatcatcatgaaccacaggaccaggatggactggatgttcctgtggaactgcctgatgagatacagctacctgcggctggagaagatctgcctgaaggccagcctgaagggcgtgcccggcttcggctgggccatgcaggccgccgcctacatcttcatccacaggaagtggaaggatgacaagagccactttgaggacatgattgactacttctgtgacatccacgagcccctgcagctgctgatcttccctgagggcacagacctgacagagaacagcaagagccgcagcaatgcctttgctgagaagaatggcctgcagaagtatgaatatgtgctgcaccccaggaccaccggcttcacctttgtggtggaccggctgcgggagggcaagaacctggatgctgtgcatgacatcaccgtggcctacccccacaacatcccccagagcgagaagcacctgctgcagggcgacttcccccgggagatccacttccacgtgcaccgctaccccatcgacaccctgcccaccagcaaggaggacctgcagctgtggtgccacaagcgctgggaggagaaggaggagcggctgcgctccttctaccagggcgagaagaacttctacttcaccggccagagcgtcatccccccctgcaagtctgagctgcgggtgctggtggtgaagctgctgagcatcctgtactggaccctcttcagccctgccatgtgcctgctgatctacctgtacagcctggtgaagtggtacttcatcatcaccatcgtcatctttgtgctgcaggagcgcatctttggaggcctggagatcatcgagctggcctgctaccgcctgctgcacaagcagccccacctgaacagcaagaagaatgaatag

SEQ ID NO: 158314 - DNA, 927 bp, Artificial Sequence
  Description of Artificial Sequence: Synthetic coding sequence
atgcacagccggggccgggagatcgtggtgctgctgaacccctggagcatcaatgaggccgtgtcctcctactgcacctacttcatcaagcaggacagcaagagctttggcatcatggtgtcctggaagggcatctacttcatcctgaccctcttctggggcagcttcttcggcagcatcttcatgctgagccccttcctgcccctgatgtttgtgaaccccagctggtaccgctggatcaacaaccggctggtggccacctggctgaccctgcctgtggccctgctggagaccatgtttggagtgaaggtgatcatcactggagatgcctttgtgcctggagagaggagcgtcatcatcatgaaccacaggaccaggatggactggatgttcctgtggaactgcctgatgagatacagctacctgcggctggagaagatctgcctgaaggccagcctgaagggcgtgcccggcttcggctgggccatgcaggccgccgcctacatcttcatccacaggaagtggaaggatgacaagagccactttgaggacatgattgactacttctgtgacatccacgagcccctgcagctgctgatcttccctgagggcacagacctgacagagaacagcaagagccgcagcaatgcctttgctgagaagaatggcctgcagaagtatgaatatgtgctgcaccccaggaccaccggcttcacctttgtggtggaccggctgcgggagggccggcggcagagcgagggcagcaagggccccctgcagggcgagctgcagatcacagcccagggcaaccagaggggccacaagcagatggagaagcacagcatgctgatggactggaagaaccagtaccgggagatcggccacacagcccagagcaacctgcagatccagtgctacagccactag

SEQ ID NO: 158315 - DNA, 927 bp, Artificial Sequence; identical to SEQ ID NO: 158314
  Description of Artificial Sequence: Synthetic coding sequence

SEQ ID NO: 158316 - DNA, 1131 bp, Artificial Sequence
  Description of Artificial Sequence: Synthetic coding sequence
atggtgtcctggaagggcatctacttcatcctgaccctcttctggggcagcttcttcggcagcatcttcatgctgagccccttcctgcccctgatgtttgtgaaccccagctggtaccgctggatcaacaaccggctggtggccacctggctgaccctgcctgtggccctgctggagaccatgtttggagtgaaggtgatcatcactggagatgcctttgtgcctggagagaggagcgtcatcatcatgaaccacaggaccaggatggactggatgttcctgtggaactgcctgatgagatacagctacctgcggctggagaagatctgcctgaaggccagcctgaagggcgtgcccggcttcggctgggccatgcaggccgccgcctacatcttcatccacaggaagtggaaggatgacaagagccactttgaggacatgattgactacttctgtgacatccacgagcccctgcagctgctgatcttccctgagggcacagacctgacagagaacagcaagagccgcagcaatgcctttgctgagaagaatggcctgcagaagtatgaatatgtgctgcaccccaggaccaccggcttcacctttgtggtggaccggctgcgggagggcaagaacctggatgctgtgcatgacatcaccgtggcctacccccacaacatcccccagagcgagaagcacctgctgcagggcgacttcccccgggagatccacttccacgtgcaccgctaccccatcgacaccctgcccaccagcaaggaggacctgcagctgtggtgccacaagcgctgggaggagaaggaggagcggctgcgctccttctaccagggcgagaagaacttctacttcaccggccagagcgtcatccccccctgcaagtctgagctgcgggtgctggtggtgaagctgctgagcatcctgtactggaccctcttcagccctgccatgtgcctgctgatctacctgtacagcctggtgaagtggtacttcatcatcaccatcgtcatctttgtgctgcaggagcgcatctttggaggcctggagatcatcgagctggcctgctaccgcctgctgcacaagcagccccacctgaacagcaagaagaatgaatag

SEQ ID NO: 158317 - DNA, 993 bp, Artificial Sequence
  Description of Artificial Sequence: Synthetic coding sequence
atggtgtcctggaagggcatctacttcatcctgaccctcttctggggcagcttcttcggcagcatcttcatgctgagccccttcctgcccctgatgtttgtgaaccccagctggtaccgctggatcaacaaccggctggtggccacctggctgaccctgcctgtggccctgctggagaccatgtttggagtgaaggtgatcatcactggagatgcctttgtgcctggagagaggagcgtcatcatcatgaaccacaggaccaggatggactggatgttcctgtggaactgcctgatgagatacagctacctgcggctggagaagatctgcctgaaggccagcctgaagggcgtgcccggcttcggctgggccatgcaggccgccgcctacatcttcatccacaggaagtggaaggatgacaagagccactttgaggacatgattgactacttctgtgacatccacgagcccctgcagctgctgatcttccctgagggcacagacctgacagagaacagcaagagccgcagcaatgcctttgctgagaagaatggcctgcagaagtatgaatatgtgctgcaccccaggaccaccggcttcacctttgtggtggaccggctgcgggagggcaagaacctggatgctgtgcatgacatcaccgtggcctacccccacaacatcccccagagcgagaagcacctgctgcagggcgacttcccccgggagatccacttccacgtgcaccgctaccccatcgacaccctgcccaccagcaaggaggacctgcagctgtggtgccacaagcgctgggaggagaaggaggagcggctgcgctccttctaccagggcgagaagaacttctacttcaccggccagagcgtcatccccccctgcaagtctgagctgcgggtgctggtggtgaagctgtacacagtgctggaccctgtgcagccctgcaatgtgcccacccacatctttgtgcagagctgctag

SEQ ID NO: 158318 - DNA, 462 bp, Artificial Sequence
  Description of Artificial Sequence: Synthetic coding sequence
atgcacagccggggccgggagatcgtggtgctgctgaacccctggagcatcaatgaggccgtgtcctcctactgcacctacttcatcaagcaggacagcaagagctttggcatcatggtgtcctggaagggcatctacttcatcctgaccctcttctggggcagcttcttcggcagcatcttcatgctgagccccttcctgcccctgatgtttgtgaaccccagctggtaccgctggatcaacaaccggctggtggccacctggctgaccctgcctgtggccctgctggagaccatgtttggagtgaaggtgatcatcactggagatgcctttgtgcctggagagaggagcgtcatcatcatgaaccacaggaccaggatggactggatgttcctgtggaactgcctgatgagatacagctacctgcggctggagaagatctgcctgaaggccagcctgtag

SEQ ID NO: 158319 - DNA, 1131 bp, Artificial Sequence; identical to SEQ ID NO: 158316
  Description of Artificial Sequence: Synthetic coding sequence

SEQ ID NO: 158320 - DNA, 1095 bp, Artificial Sequence
  Description of Artificial Sequence: Synthetic coding sequence
atggccgccatcagcaccagcatccctgtgatcagccagccccagttcaccgccatgaatgagccccagtgcttctacaatgaaagcatcgccttcttctacaacagaagtggcaagcacctggccacagagtggaacacagtgtccaagctggtgatgggcctgggcatcaccgtgtgcatcttcatcatgctggccaacctgctggtgatggtggccatctacgtgaacagacgcttccacttccccatctactacctgatggccaacctggccgctgctgacttctttgctggcctggcctacttctacctgatgttcaacacaggccccaacacccggcggctgactgtgtccacctggctgctgcggcagggcctgattgacaccagcctgacagcctctgtggccaacctgctggccatcgccatcgagcggcacatcaccgtcttcaggatgcagctgcacaccaggatgagcaacagaagagtggtggtggtgattgtggtgatctggaccatggccatcgtgatgggcgccatccccagcgtgggctggaactgcatctgtgacatcgagaactgcagcaacatggcccccctgtacagcgacagctacctggtgttctgggccatcttcaacctggtgacctttgtggtgatggtggtgctgtatgcccacatcttcggctacgtgcggcagaggaccatgaggatgagccgccacagcagcggccccaggaggaacagagacaccatgatgagcctgctgaagacagtggtgattgtgctgggcgccttcatcatctgctggaccccaggcctggtgctgctgctgctggatgtgtgctgcccccagtgtgatgtgctggcctatgagaagttcttcctgctgctggccgagttcaacagcgccatgaaccccatcatctacagctacagagacaaggagatgtctgccaccttccggcagatcctgtgctgccagaggtctgagaaccccaccggccccacagagggcagtgacagaagtgccagcagcctgaaccacaccatcctggccggcgtgcacagcaatgaccacagcgtggtgtag

SEQ ID NO: 158321 - DNA, 1095 bp, Artificial Sequence; identical to SEQ ID NO: 158320
  Description of Artificial Sequence: Synthetic coding sequence

SEQ ID NO: 158322 - DNA, 1095 bp, Artificial Sequence; identical to SEQ ID NO: 158320
  Description of Artificial Sequence: Synthetic coding sequence

SEQ ID NO: 158323 - DNA, 549 bp, Artificial Sequence
  Description of Artificial Sequence: Synthetic coding sequence
atggccgccatcagcaccagcatccctgtgatcagccagccccagttcaccgccatgaatgagccccagtgcttctacaatgaaagcatcgccttcttctacaacagaagtggcaagcacctggccacagagtggaacacagtgtccaagctggtgatgggcctgggcatcaccgtgtgcatcttcatcatgctggccaacctgctggtgatggtggccatctacgtgaacagacgcttccacttccccatctactacctgatggccaacctggccgctgctgacttctttgctggcctggcctacttctacctgatgttcaacacaggccccaacacccggcggctgactgtgtccacctggctgctgcggcagggcctgattgacaccagcctgacagcctctgtggccaacctgctggccatcgccatcgagcggcacatcaccgtcttcaggatgcagctgcacaccaggatgagcaacagaagagtggtggtggtgattgtggtgatctggaccatggccatcgtgatgggcgccatcccctag

SEQ ID NO: 158324 - DNA, 1041 bp, Artificial Sequence
  Description of Artificial Sequence: Synthetic coding sequence
atgaatgagccccagtgcttctacaatgaaagcatcgccttcttctacaacagaagtggcaagcacctggccacagagtggaacacagtgtccaagctggtgatgggcctgggcatcaccgtgtgcatcttcatcatgctggccaacctgctggtgatggtggccatctacgtgaacagacgcttccacttccccatctactacctgatggccaacctggccgctgctgacttctttgctggcctggcctacttctacctgatgttcaacacaggccccaacacccggcggctgactgtgtccacctggctgctgcggcagggcctgattgacaccagcctgacagcctctgtggccaacctgctggccatcgccatcgagcggcacatcaccgtcttcaggatgcagctgcacaccaggatgagcaacagaagagtggtggtggtgattgtggtgatctggaccatggccatcgtgatgggcgccatccccagcgtgggctggaactgcatctgtgacatcgagaactgcagcaacatggcccccctgtacagcgacagctacctggtgttctgggccatcttcaacctggtgacctttgtggtgatggtggtgctgtatgcccacatcttcggctacgtgcggcagaggaccatgaggatgagccgccacagcagcggccccaggaggaacagagacaccatgatgagcctgctgaagacagtggtgattgtgctgggcgccttcatcatctgctggaccccaggcctggtgctgctgctgctggatgtgtgctgcccccagtgtgatgtgctggcctatgagaagttcttcctgctgctggccgagttcaacagcgccatgaaccccatcatctacagctacagagacaaggagatgtctgccaccttccggcagatcctgtgctgccagaggtctgagaaccccaccggccccacagagggcagtgacagaagtgccagcagcctgaaccacaccatcctggccggcgtgcacagcaatgaccacagcgtggtgtag

SEQ ID NO: 158325 - DNA, 1098 bp, Artificial Sequence
  Description of Artificial Sequence: Synthetic coding sequence
atggaggagggcgcccagaggtctggggccctgggcgccccccaccagttcaccgccatgaatgagccccagtgcttctacaatgaaagcatcgccttcttctacaacagaagtggcaagcacctggccacagagtggaacacagtgtccaagctggtgatgggcctgggcatcaccgtgtgcatcttcatcatgctggccaacctgctggtgatggtggccatctacgtgaacagacgcttccacttccccatctactacctgatggccaacctggccgctgctgacttctttgctggcctggcctacttctacctgatgttcaacacaggccccaacacccggcggctgactgtgtccacctggctgctgcggcagggcctgattgacaccagcctgacagcctctgtggccaacctgctggccatcgccatcgagcggcacatcaccgtcttcaggatgcagctgcacaccaggatgagcaacagaagagtggtggtggtgattgtggtgatctggaccatggccatcgtgatgggcgccatccccagcgtgggctggaactgcatctgtgacatcgagaactgcagcaacatggcccccctgtacagcgacagctacctggtgttctgggccatcttcaacctggtgacctttgtggtgatggtggtgctgtatgcccacatcttcggctacgtgcggcagaggaccatgaggatgagccgccacagcagcggccccaggaggaacagagacaccatgatgagcctgctgaagacagtggtgattgtgctgggcgccttcatcatctgctggaccccaggcctggtgctgctgctgctggatgtgtgctgcccccagtgtgatgtgctggcctatgagaagttcttcctgctgctggccgagttcaacagcgccatgaaccccatcatctacagctacagagacaaggagatgtctgccaccttccggcagatcctgtgctgccagaggtctgagaaccccaccggccccacagagggcagtgacagaagtgccagcagcctgaaccacaccatcctggccggcgtgcacagcaatgaccacagcgtggtgtag

SEQ ID NO: 158326 - DNA, 1098 bp, Artificial Sequence
  Description of Artificial Sequence: Synthetic coding sequence
atgctgctgctgctgatcccagcccacagctctgtgctggagaatgagttcaccgccatgaatgagccccagtgcttctacaatgaaagcatcgccttcttctacaacagaagtggcaagcacctggccacagagtggaacacagtgtccaagctggtgatgggcctgggcatcaccgtgtgcatcttcatcatgctggccaacctgctggtgatggtggccatctacgtgaacagacgcttccacttccccatctactacctgatggccaacctggccgctgctgacttctttgctggcctggcctacttctacctgatgttcaacacaggccccaacacccggcggctgactgtgtccacctggctgctgcggcagggcctgattgacaccagcctgacagcctctgtggccaacctgctggccatcgccatcgagcggcacatcaccgtcttcaggatgcagctgcacaccaggatgagcaacagaagagtggtggtggtgattgtggtgatctggaccatggccatcgtgatgggcgccatccccagcgtgggctggaactgcatctgtgacatcgagaactgcagcaacatggcccccctgtacagcgacagctacctggtgttctgggccatcttcaacctggtgacctttgtggtgatggtggtgctgtatgcccacatcttcggctacgtgcggcagaggaccatgaggatgagccgccacagcagcggccccaggaggaacagagacaccatgatgagcctgctgaagacagtggtgattgtgctgggcgccttcatcatctgctggaccccaggcctggtgctgctgctgctggatgtgtgctgcccccagtgtgatgtgctggcctatgagaagttcttcctgctgctggccgagttcaacagcgccatgaaccccatcatctacagctacagagacaaggagatgtctgccaccttccggcagatcctgtgctgccagaggtctgagaaccccaccggccccacagagggcagtgacagaagtgccagcagcctgaaccacaccatcctggccggcgtgcacagcaatgaccacagcgtggtgtag

SEQ ID NO: 158327 - DNA, 1056 bp, Artificial Sequence
  Description of Artificial Sequence: Synthetic coding sequence
atggtgatcatgggccagtgctactacaatgagaccatcggcttcttctacaacaacagcggcaaggagctgagcagccactggaggcccaaggatgtggtggtggtggccctgggcctgactgtgtctgtgctggtgctgctgaccaacctgctggtgattgctgccatcgccagcaacagacgcttccaccagcccatctactacctgctgggcaacctggccgctgctgacctgtttgctggggtggcctacctgttcctgatgttccacacaggccccaggacagcccggctgagcctggagggctggttcctgcggcagggcctgctggacaccagcctgacagcctctgtggccaccctgctggccatcgctgtggagcggcacaggtctgtgatggctgtgcagctgcacagccggctgccccggggccgggtggtgatgctgattgtgggcgtgtgggtggccgccctgggcctgggcctgctgcctgcccacagctggcactgcctgtgtgccctggaccgctgcagcaggatggcccccctgctgagccgcagctacctggccgtgtgggccctgagcagcctgctggtgttcctgctgatggtggccgtgtacacccgcatcttcttctacgtgagaagaagagtgcagaggatggccgagcacgtgtcctgccacccccgctaccgggagaccaccctgagcctggtgaagacagtggtgatcatcctgggcgcctttgtggtgtgctggaccccaggccaggtggtgctgctgctggatggcctgggctgtgagagctgcaatgtgctggccgtggagaagtacttcctgctgctggccgaggccaacagcctggtgaatgctgctgtgtacagctgcagagatgctgagatgaggaggaccttccggcggctgctgtgctgtgcctgcctgcggcagagcacccgggagagcgtgcactacaccagcagcgcccagggcggggccagcacccgcatcatgctgcctgaaaatggccaccccctgatggacagcaccctgtag

SEQ ID NO: 158328 - DNA, 1056 bp, Artificial Sequence; identical to SEQ ID NO: 158327
  Description of Artificial Sequence: Synthetic coding sequence

SEQ ID NO: 158329 - DNA, 1062 bp, Artificial Sequence
  Description of Artificial Sequence: Synthetic coding sequence
atgaatgaatgccactatgacaagcacatggacttcttctacaacagaagcaacacagacacagtggatgactggacaggcaccaagctggtgattgtgctgtgtgtgggcaccttcttctgcctcttcatcttcttcagcaacagcctggtgattgctgctgtgatcaagaacaggaagttccacttccccttctactacctgctggccaacctggccgctgctgacttctttgctggcatcgcctacgtgttcctgatgttcaacacaggccctgtgtccaagaccctgactgtgaaccgctggttcctgcggcagggcctgctggacagcagcctgacagccagcctgaccaacctgctggtgattgctgtggagcggcacatgagcatcatgaggatgagggtgcacagcaacctgaccaagaagagggtgaccctgctgatcctgctggtgtgggccatcgccatcttcatgggcgctgtgcccaccctgggctggaactgcctgtgcaacatcagcgcctgcagcagcctggcccccatctacagccgcagctacctggtgttctggacagtgagcaacctgatggccttcctgatcatggtggtggtgtacctgcgcatctacgtgtatgtgaagaggaagaccaacgtgctgagcccccacaccagcggcagcatcagcagaagaaggacccccatgaagctgatgaagacagtgatgacagtgctgggcgcctttgtggtgtgctggaccccaggcctggtggtgctgctgctggatggcctgaactgccggcagtgtggggtgcagcacgtgaagcgctggttcctgctgctggccctgctgaacagcgtggtgaaccccatcatctacagctacaaggatgaggacatgtatggcaccatgaagaagatgatctgctgcttcagccaggagaaccctgagcggcggcccagccgcatccccagcacagtgctgagcagaagtgacaccggcagccagtacattgaagattccatcagccagggcgctgtgtgcaacaagagcaccagctag

SEQ ID NO: 158330 - DNA, 1062 bp, Artificial Sequence; identical to SEQ ID NO: 158329
  Description of Artificial Sequence: Synthetic coding sequence

SEQ ID NO: 158331 - DNA, 1113 bp, Artificial Sequence
  Description of Artificial Sequence: Synthetic coding sequence
atgggagaccggcgcttcatcgacttccagttccaggacagcaacagcagcctgcggccccggctgggcaatgccacagccaacaacacctgcatcgtggatgacagcttcaagtacaacctgaatggagctgtgtacagcgtggtgttcatcctgggcctcatcaccaacagcgtgtccctgtttgtgttctgcttcaggatgaagatgagaagtgaaacagccatcttcatcaccaacctggccgtgtctgacctgctgtttgtgtgcaccctgcccttcaagatcttctacaacttcaacagacactggccctttggagacaccctgtgcaagatcagcggcacagccttcctgaccaacatctacggctccatgctgttcctgacctgcatctctgtggaccgcttcctggccatcgtgtaccccttccgcagcaggaccatccgcaccaggagaaattctgccatcgtgtgtgccggcgtgtggatcctggtgctgagcggcggcatcagcgccagcctcttcagcaccaccaacgtgaacaatgccaccaccacctgctttgagggcttcagcaagagggtgtggaagacctacctgagcaagatcaccatcttcatcgaggtggtgggcttcatcatccccctcatcctgaatgtgtcctgcagctctgtggtgctgcggaccctgaggaagccagccaccctgagccagatcggcaccaacaagaagaaggtgctgaagatgatcaccgtgcacatggctgtgtttgtggtgtgctttgtgccctacaacagcgtgctcttcctgtatgccctggtgcgcagccaggccatcaccaactgcttcctggagagatttgccaagatcatgtaccccatcaccctgtgcctggccaccctgaactgctgctttgaccccttcatctactacttcaccctggagagcttccagaagagcttctacatcaatgcccacatccgcatggagagcctcttcaagacagagacccccctgaccaccaagcccagcctgcctgccatccaggaggaggtgtctgaccagaccaccaacaacggcggggagctgatgctggagagcaccttctag

SEQ ID NO: 158332 - DNA, 1113 bp, Artificial Sequence; identical to SEQ ID NO: 158331
  Description of Artificial Sequence: Synthetic coding sequence

SEQ ID NO: 158333 - DNA, 1119 bp, Artificial Sequence
  Description of Artificial Sequence: Synthetic coding sequence
atgctggccaacagcagcagcaccaacagctctgtgctgccctgcccagactaccggcccacccaccggctgcacctggtggtgtacagcctggtgctggccgccggcctgcccctgaatgccctggccctgtgggtgttcctgcgggccctgcgggtgcacagcgtggtgtctgtgtacatgtgcaacctggccgccagtgacctgctcttcaccctgagcctgcctgtgcggctgagctactatgccctgcaccactggcccttcccagacctgctgtgccagaccactggagccatcttccagatgaacatgtatggcagctgcatcttcctgatgctgatcaacgtggacagatatgctgccatcgtgcaccccctgcggctgcggcacctgcggcggccccgggtggcccggctgctgtgcctgggcgtgtgggccctgatcctggtgtttgctgtgcctgctgcccgggtgcaccggcccagccgctgccgctacagagacctggaggtgcggctgtgctttgagagcttcagtgatgagctgtggaagggccgcctgctgcccctggtgctgctggccgaggccctgggcttcctgctgcccctggccgctgtggtgtacagcagcggccgggtcttctggaccctggcccggccagatgccacccagagccagaggaggaggaagacagtgcggctgctgctggccaacctggtgatcttcctgctgtgctttgtgccctacaacagcaccctggccgtgtatggcctgctgcggagcaagctggtggccgcctctgtgcctgcccgggacagagtgcggggcgtgctgatggtgatggtgctgctggccggggccaactgtgtgctggaccccctggtgtactacttctctgctgagggcttcaggaacaccctgcggggcctgggcaccccccaccgggcccggaccagcgccaccaacggcaccagggctgccctggcccagagcgagaggtctgctgtgaccacagatgccaccaggccagatgctgccagccagggcctgctgcggcccagcgacagccacagcctgagcagcttcacccagtgcccccaggacagcgccctgtag

SEQ ID NO: 158334 - DNA, 1119 bp, Artificial Sequence; identical to SEQ ID NO: 158333
  Description of Artificial Sequence: Synthetic coding sequence

SEQ ID NO: 158335 - DNA, 1290 bp, Artificial Sequence
  Description of Artificial Sequence: Synthetic coding sequence
atgctggccaacagcagcagcaccaacagctctgtgctgccctgcccagactaccggcccacccaccggctgcacctggtggtgtacagcctggtgctggccgccggcctgcccctgaatgccctggccctgtgggtgttcctgcgggccctgcgggtgcacagcgtggtgtctgtgtacatgtgcaacctggccgccagtgacctgctcttcaccctgagcctgcctgtgcggctgagctactatgccctgcaccactggcccttcccagacctgctgtgccagaccactggagccatcttccagatgaacatgtatggcagctgcatcttcctgatgctgatcaacgtggacagatatgctgccatcgtgcaccccctgcggctgcggcacctgcggcggccccgggtggcccggctgctgtgcctgggcgtgtgggccctgatcctggtgtttgctgtgcctgctgcccgggtgcaccggcccagccgctgccgctacagagacctggaggtgcggctgtgctttgagagcttcagtgatgagctgtggaagggccgcctgctgcccctggtgctgctggccgaggccctgggcttcctgctgcccctggccgctgtggtgtacagcagcggccgggtcttctggaccctggcccggccagatgccacccagagccagaggaggaggaagacagtgcggctgctgctggccaacctggtgatcttcctgctgtgctttgtgccctacaacagcaccctggccgtgtatggcctgctgcggagcaagctggtggccgcctctgtgcctgcccgggacagagtgcggggcgtgctgatggtgatggtgctgctggccggggccaactgtgtgctggaccccctggtgtactacttctctgctgagggcttcaggaacaccctgcggggcctgggcaccccccaccgggcccggaccagcgccaccaacggcaccagggctgccctggcccagagcgagaggtctgctgtgaccacagatgccaccaggccagatgctgccagccagggcctgctgcggcccagcgacagccacagcctgagcagcttcacccacgccatcgccctgtctgtgcctgacagccagaggctgtccttctgggaggcctacagagtgtacacccaggagggcggcctgggcacctggaccttcggctggcagttccagctgagcaatgctgaggagtacaaggtgtggaagccaggcccccgggagggcagcgctgctggaaatggcttcttcaagctgtag

SEQ ID NO: 158336 - DNA, 1605 bp, Artificial Sequence
  Description of Artificial Sequence: Synthetic coding sequence
atgaggctgcggggctgcggcccccgggccgccccagccagcagcgctggggccagtgatgcccggctgctggcccctcctggaagaaacccctttgtgcatgagctgcggctgagcgccctgcagaaggcccaggtggccctgatgaccctgaccctcttccctgtgcggctgctggtggccgccgccatgatgctgctggcctggcccctggccctggtggccagcctgggcagcgctgagaaggagcctgagcagcccccagccctgtggaggaaggtggtggacttcctgctgaaggccatcatgaggaccatgtggtttgctgggggcttccaccgggtggccgtgaagggccggcaggccctgcccacagaagctgccatcctgaccctggccccccacagcagctactttgatgccatccctgtgaccatgaccatgagcagcatcgtgatgaaggccgagagccgggacatccccatctggggcaccctcatccagtacatccggcctgtgtttgtgtccagaagtgaccaggacagcaggaggaagacagtggaggagatcaagaggcgggcccagagcaatggcaagtggccccagatcatgatcttccctgagggcacctgcaccaacagaacctgcctgatcaccttcaagccaggggccttcatccctggggcccctgtgcagcctgtggtgctgcgctaccccaacaagctggacaccatcacctggacctggcagggccctggggccctggagatcctgtggctgaccctgtgccagttccacaaccaggtggagattgagttcctgcctgtgtacagccccagcgaggaggagaagagaaatcctgccctgtatgccagcaatgtgagaagagtgatggccgaggccctgggcgtgtctgtgacagactacacctttgaggactgccagctggccctggccgagggccagctgcggctgcctgctgacacctgcctgctggagtttgcccggctggtgcggggcctgggcctgaagccagagaagctggagaaggacctggaccgctacagcgagcgggccaggatgaagggcggggagaagattggaattgctgagtttgctgccagcctggaggtgcctgtgtctgacctgctggaggacatgttcagcctgtttgatgagagcggcagcggggaggtggacctgagagaatgtgtggtggccctgtctgtggtgtgcaggcctgcccggaccctggacaccatccagctggccttcaagatgtacggggcccaggaggatggctctgtgggggagggggacctgagctgcatcctgaagacagccctgggcgtggccgagctgactgtgacagacctcttccgggccatcgaccaggaggagaagggcaagatcacctttgctgacttccacagatttgctgagatgtacccagcctttgctgaggagtacctgtacccagaccagacccactttgagagctgtgccgagaccagccctgcccccatccccaacggcttctgtgccgacttcagccctgagaacagtgatgctggcaggaagcctgtgaggaagaagctggactag

SEQ ID NO: 158337 - DNA, 1605 bp, Artificial Sequence; identical to SEQ ID NO: 158336
  Description of Artificial Sequence: Synthetic coding sequence

SEQ ID NO: 158338 - DNA, 1464 bp, Artificial Sequence
  Description of Artificial Sequence: Synthetic coding sequence
atggccagcagcgcagaaggagatgagggcaccgtggtggccctggccggcgtgctgcagagcggcttccaggagctgagcctgaacaagctggccaccagcctgggcgccagcgagcaggccctgcggctcatcatcagcatcttcctgggctacccctttgccctcttctaccgccactacctgttctacaaggagacctacctgatccacctgttccacaccttcaccggcctgagcatcgcctacttcaactttggaaaccagctgtaccacagcctgctgtgcatcgtgctgcagttcctgatcctgcggctgatgggccgcaccatcacagctgtgctgaccaccttctgcttccagatggcctacctgctggccggctactactacacagccaccggcaactatgacatcaagtggaccatgccccactgtgtgctgaccctgaagctgattggcctggccgtggactactttgatggcggcaaggaccagaacagcctgagcagcgagcagcagaagtatgccatccggggcgtgcccagcctgctggaggtggccggcttctcctacttctacggggccttcctggtgggcccccagttctccatgaaccactacatgaagctggtgcagggcgagctgattgacatccctgggaagatccccaacagcatcatcccagccctgaagaggctgagcctgggcctcttctacctggtgggctacaccctgctgagcccccacatcacagaggactacctgctgacagaagattatgacaaccaccccttctggttccgctgcatgtacatgctgatctggggcaagtttgtgctgtacaagtatgtgacctgctggctggtgacagaaggagtgtgcatcctgaccggcctgggcttcaatggatttgaggagaagggcaaggccaagtgggatgcctgtgccaacatgaaggtgtggctgtttgagaccaacccccgcttcaccggcaccatcgccagcttcaacatcaacaccaatgcctgggtggcccgctacatcttcaagaggctgaagttcctgggcaacaaggagctgagccagggcctgagcctgctcttcctggccctgtggcacggcctgcacagcggctacctggtgtgcttccagatggagttcctgattgtcatcgtggagcggcaggccgcccggctcatccaggagagccccaccctgagcaagctggccgccatcaccgtgctgcagcccttctactacctggtgcagcagaccatccactggctgttcatgggctacagcatgacagccttctgcctcttcacctgggacaagtggctgaaggtgtacaagagcatctacttcctgggccacatcttcttcctgagcctgctcttcatcctgccctacatccacaaggccatggtgcccaggaaggagaagctgaagaagatggagtag

SEQ ID NO: 158339 - DNA, 1575 bp, Artificial Sequence
  Description of Artificial Sequence: Synthetic coding sequence
atgagccagggcagccctggggactgggcccccctggaccccaccccaggccccccagccagccccaacccctttgtgcatgagctgcacctgagccggctgcagagggtgaagttctgcctgctgggcgccctgctggcccccatccgggtgctgctggccttcatcgtgctcttcctgctgtggccctttgcctggctgcaggtggccggcctgtctgaggagcagctgcaggagcccatcaccggctggaggaagacagtgtgccacaatggagtgctgggcctgagccggctgctcttcttcctgctgggcttcctgcgcatccgggtgcggggccagagggccagccggctgcaggcccctgtgctggtggccgccccccacagcaccttctttgaccccatcgtgctgctgccctgtgacctgcccaaggtggtgtccagagctgagaacctgtctgtgcctgtgattggagccctgctgcgcttcaaccaggccatcctggtgtccagacatgaccctgccagcagaagaagagtggtggaggaggtgagaagaagagccaccagcggcggcaagtggccccaggtgctcttcttccctgagggcacctgcagcaacaagaaggccctgctgaagttcaagccaggggccttcatcgccggcgtgcctgtgcagcctgtgctgatccgctaccccaacagcctggacaccacctcctgggcctggaggggccctggggtgctgaaggtgctgtggctgacagccagccagccctgcagcatcgtggatgtggagttcctgcctgtgtaccaccccagccctgaggagagccgggaccccaccctgtatgccaacaacgtgcagagggtgatggcccaggccctgggcatcccagccacagaatgtgaatttgtgggcagcctgcctgtgattgtggtgggccgcctgaaggtggccctggagccccagctgtgggagctgggcaaggtgctgaggaaggccggcctgtctgctggctacgtggatgctggagctgagcccggccgcagcaggatgatcagccaggaggagtttgcccggcagctgcagctgagtgacccccagacagtggccggggccttcggctacttccagcaggacaccaagggcctggtggacttcagagatgtggccctggccctggccgccctggatggcggccgcagcctggaggagctgacccggctggcctttgagctgtttgctgaggagcaggccgagggccccaaccggctgctgtacaaggatggcttcagcaccatcctgcacctgctgctgggcagcccccaccctgctgccacagccctgcatgctgagctgtgccaggccggcagcagccagggcctgagcctgtgccagttccagaacttcagcctgcatgaccccctgtatggcaagctgttcagcacctacctgcggcccccccacaccagccggggcaccagccagaccccaaatgccagcagccctggcaaccccacagccctggccaatggaacagtgcaggcccccaagcagaagggggactag

SEQ ID NO: 158340 - DNA, 693 bp, Artificial Sequence
  Description of Artificial Sequence: Synthetic coding sequence
atgtgtggcaacaacatgagcacccccctgcctgccatcgtgcctgctgccaggaaggccacagctgctgtgatcttcctgcacggcctgggggacaccggccacggctgggccgaggcctttgctggcatccgcagcagccacatcaagtacatctgcccccacgcccctgtgcggcctgtgaccctgaacatgaatgtggccatgcccagctggtttgacatcatcggcctgagcccagacagccaggaggatgaaagtggcatcaagcaggccgctgagaacatcaaggccctgattgaccaggaggtgaagaatggcatccccagcaaccgcatcatcctgggcggcttcagccagggcggggccctgagcctgtacacagccctgaccacccagcagaagctggccggcgtgacagccctgagctgctggctgcccctgcgggccagcttcccccagggccccatcggcggggccaacagagacatcagcatcctgcagtgccacggggactgtgaccccctggtgcccctgatgtttggcagcctgactgtggagaagctgaagaccctggtgaacccagccaacgtgaccttcaagacctatgagggcatgatgcacagcagctgccagcaggagatgatggatgtgaagcagttcatcgacaagctgctgccccccattgattag

SEQ ID NO: 158341 - DNA, 645 bp, Artificial Sequence
  Description of Artificial Sequence: Synthetic coding sequence
atgtgtggcaacaacatgagcacccccctgcctgccatcgtgcctgctgccaggaaggccacagctgctgtgatcttcctgcacggcctgggggacaccggccacggctgggccgaggcctttgctggcatccgcagcagccacatcaagtacatctgcccccacgcctttgacatcatcggcctgagcccagacagccaggaggatgaaagtggcatcaagcaggccgctgagaacatcaaggccctgattgaccaggaggtgaagaatggcatccccagcaaccgcatcatcctgggcggcttcagccagggcggggccctgagcctgtacacagccctgaccacccagcagaagctggccggcgtgacagccctgagctgctggctgcccctgcgggccagcttcccccagggccccatcggcggggccaacagagacatcagcatcctgcagtgccacggggactgtgaccccctggtgcccctgatgtttggcagcctgactgtggagaagctgaagaccctggtgaacccagccaacgtgaccttcaagacctatgagggcatgatgcacagcagctgccagcaggagatgatggatgtgaagcagttcatcgacaagctgctgccccccattgattag

SEQ ID NO: 158342 - DNA, 1092 bp, Artificial Sequence
  Description of Artificial Sequence: Synthetic coding sequence
atggagctgcacgagaggccagatgagaggaggaaggcccggaccagcacccagggccgcctgggggactggaggagagtgcatgctgatggcttcacccaccgggtgtggagcagcagctcctggctggagcccgccatgaccagcaggaccagggtgacctggcccagccccccccggcccctgcctgtgcctgctgctgctgctgtggccttcggggccaagggcacagatcctgctgaggcccggagcagccggggcatcgaggaggccggcccccgggcccacggccgggccggccgggagcctgagcggcggcgcagccggcagcagaggcggggcggcctgcaggcccggcgcagcaccctgctgaagacctgtgcccgggcccgggccacagcccctggggccatgaagatggtggccccctggacccgcttctacagcaacagctgctgcctgtgctgccacgtgaggacaggcaccatcctgctgggcgtgtggtacctgatcatcaatgctgtggtgctgctgatcctgctgagcgccctggccgaccctgaccagtacaacttcagcagcagcgagctgggcggggactttgagttcatggatgatgccaacatgtgcatcgccatcgccatcagcctgctgatgatcctgatctgtgccatggccacctacggggcctacaagcagagagctgcctggatcatccccttcttctgctaccagatctttgattttgccctgaacatgctggtggccatcaccgtgctgatctaccccaacagcatccaggagtacatccggcagctgccccccaacttcccctacagagatgatgtgatgtctgtgaaccccacctgcctggtgctgatcatcctgctcttcatcagcatcatcctgaccttcaagggctacctgatcagctgtgtgtggaactgctaccgctacatcaatggaagaaacagcagtgatgtgctggtgtatgtgaccagcaatgacaccaccgtgctgctgcccccctatgatgatgccaccgtgaatggagctgccaaggagcccccaccaccctacgtgtctgcctag

SEQ ID NO: 158343 - DNA, 954 bp, Artificial Sequence
  Description of Artificial Sequence: Synthetic coding sequence
atgaccagcaggaccagggtgacctggcccagccccccccggcccctgcctgtgcctgctgctgctgctgtggccttcggggccaagggcacagatcctgctgaggcccggagcagccggggcatcgaggaggccggcccccgggcccacggccgggccggccgggagcctgagcggcggcgcagccggcagcagaggcggggcggcctgcaggcccggcgcagcaccctgctgaagacctgtgcccgggcccgggccacagcccctggggccatgaagatggtggccccctggacccgcttctacagcaacagctgctgcctgtgctgccacgtgaggacaggcaccatcctgctgggcgtgtggtacctgatcatcaatgctgtggtgctgctgatcctgctgagcgccctggccgaccctgaccagtacaacttcagcagcagcgagctgggcggggactttgagttcatggatgatgccaacatgtgcatcgccatcgccatcagcctgctgatgatcctgatctgtgccatggccacctacggggcctacaagcagagagctgcctggatcatccccttcttctgctaccagatctttgattttgccctgaacatgctggtggccatcaccgtgctgatctaccccaacagcatccaggagtacatccggcagctgccccccaacttcccctacagagatgatgtgatgtctgtgaaccccacctgcctggtgctgatcatcctgctcttcatcagcatcatcctgaccttcaagggctacctgatcagctgtgtgtggaactgctaccgctacatcaatggaagaaacagcagtgatgtgctggtgtatgtgaccagcaatgacaccaccgtgctgctgcccccctatgatgatgccaccgtgaatggagctgccaaggagcccccaccaccctacgtgtctgcctag

SEQ ID NO: 158344 - DNA, 681 bp, Artificial Sequence
  Description of Artificial Sequence: Synthetic coding sequence
atgaagatggtggccccctggacccgcttctacagcaacagctgctgcctgtgctgccacgtgaggacaggcaccatcctgctgggcgtgtggtacctgatcatcaatgctgtggtgctgctgatcctgctgagcgccctggccgaccctgaccagtacaacttcagcagcagcgagctgggcggggactttgagttcatggatgatgccaacatgtgcatcgccatcgccatcagcctgctgatgatcctgatctgtgccatggccacctatggagcctacaagcagagagctgcctggatcatccccttcttctgctaccagatctttgattttgccctgaacatgctggtggccatcaccgtgctgatctaccccaacagcatccaggagtacatccggcagctgccccccaacttcccctacagagatgatgtgatgtctgtgaaccccacctgcctggtgctgatcatcctgctcttcatcagcatcatcctgaccttcaagggctacctgatcagctgtgtgtggaactgctaccgctacatcaatggaagaaacagcagtgatgtgctggtgtatgtgaccagcaatgacaccaccgtgctgctgcccccctatgatgatgccaccgtgaatggagctgccaaggagcccccaccaccctacgtgtctgcctag

SEQ ID NO: 158345 - DNA, 789 bp, Artificial Sequence
  Description of Artificial Sequence: Synthetic coding sequence
atggacccccggctgagcacagtgcggcagacctgctgctgcttcaacgtgagaattgccaccacagccctggccatctaccacgtgatcatgtctgtgctgctcttcatcgagcacagcgtggaggtggcccacggcaaggccagctgcaagctgagccagatgggctacctgagaattgctgacctgatcagcagcttcctgctgatcaccatgctgttcatcatcagcctgagcctgctgattggagtggtgaagaaccgggagaagtacctgctgcccttcctgagcctgcagatcatggactacctgctgtgcctgctgaccctgctgggcagctacatcgagctgcctgcctacctgaagctggccagccgcagccgggccagcagcagcaagttccccctgatgaccctgcagctgctggacttctgcctgagcatcctgaccctgtgcagcagctacatggaggtgcccacctacctgaacttcaagtccatgaaccacatgaactacctgcccagccaggaggacatgccccacaaccagttcatcaagatgatgatcatcttcagcatcgccttcatcaccgtgctgatcttcaaggtgtacatgtttaaatgtgtgtggcgctgctaccgcctcatcaagtgcatgaacagcgtggaggagaagaggaacagcaagatgctgcagaaggtggtgctgcccagctatgaggaggccctgagcctgcccagcaagaccccagagggcggccctgcccccccaccctacagcgaggtgtag

SEQ ID NO: 158346 - DNA, 873 bp, Artificial Sequence
  Description of Artificial Sequence: Synthetic coding sequence
atggacccccggctgagcacagtgcggcagacctgctgctgcttcaacgtgagaattgccaccacagccctggccatctaccacgtgatcatgtctgtgctgctcttcatcgagcacagcgtggaggtggcccacggcaaggccagctgcaagctgagccagatgggctacctgagaattgctgacctgatcagcagcttcctgctgatcaccatgctgttcatcatcagcctgagcctgctgattggagtggtgaagaaccgggagaagtacctgctgcccttcctgagcctgcagatcatggactacctgctgtgcctgctgaccctgctgggcagctacatcgagctgcctgcctacctgaagctggccagccgcagccgggccagcagcagcaagttccccctgatgaccctgcagctgctggacttctgcctgagcatcctgaccctgtgcagcagctacatggaggtgcccacctacctgaacttcaagtccatgaaccacatgaactacctgcccagccaggaggacatgccccacaaccagttcatcaagatgatgatcatcttcagcatcgccttcatcaccgtgctgatcttcaaggtgtacatgtttaaatgtgtgtggcgctgctaccgcctcatcaagtgcatgaacagcgtggaggagaagaggaacagcaagatgctgcagaaggtggtgctgcccagctatgaggaggccctgagccctgctggccctgtgtcctgcagccagctgggccagcgcttccggctgagccacagcagcggcctgagcatcatccagcccaacaatgcctggttcatcagcatcagcagtgacacctgcctggatgactggcccttctag

SEQ ID NO: 158347 - DNA, 11406 bp, Artificial Sequence
  Description of Artificial Sequence: Synthetic coding sequence
atgagcacagacagcaacagcctggcccgggagttcctgacagatgtgaaccggctgtgcaatgctgtggtgcagagggtggaggcccgggaggaggaggaggaggagacccacatggccaccctgggccagtacctggtgcacggccggggcttcctgctgctgaccaagctgaacagcatcatcgaccaggccctgacctgccgggaggagctgctgaccctgctgctgagcctgctgcccctggtgtggaagatccctgtgcaggaggagaaggccacagacttcaacctgcccctgtctgctgacatcatcctgaccaaggagaagaacagcagcagccagaggagcacccaggagaagctgcacctggagggcagcgccctgagcagccaggtgtctgccaaggtgaatgtgttcaggaagagccggcggcagaggaagatcacccaccgctacagcgtgagagatgccaggaagacccagctgagcaccagtgacagcgaggccaacagtgatgagaagggcatcgccatgaacaagcacagaagaccccacctgctgcaccacttcctgaccagcttccccaagcaggaccaccccaaggccaagctggaccggctggccaccaaggagcagaccccaccagatgccatggccctggagaacagccgggagatcatcccccggcagggcagcaacacagacatcctgtctgagcctgctgccctgagcgtcatcagcaacatgaacaacagcccctttgacctgtgccacgtgctgctgagcctgctggagaaggtgtgcaagtttgatgtgaccctgaaccacaacagccccctggccgcctctgtggtgcccaccctgacagagttcctggccggctttggagactgctgcagcctgagtgacaacctggagagccgggtggtgtctgctggctggacagaggagcctgtggccctgatccagaggatgctgttcagaacagtgctgcacctgctgtctgtggatgtgtccacagctgagatgatgcctgagaacctgaggaagaacctgacagagctgctgcgggccgccctgaagatccgcatctgcctggagaagcagcctgacccctttgccccccggcagaagaagaccctgcaggaggtgcaggaggactttgtgttcagcaagtaccgccaccgggccctgctgctgcctgagctgctggagggcgtgctgcagatcctgatctgctgcctgcagagcgctgccagcaaccccttctacttcagccaggccatggacctggtgcaggagttcatccagcaccacggcttcaacctgtttgaaacagctgtgctgcagatggagtggctggtgctgagagatggagtgcccccagaggccagcgagcacctgaaggccctgatcaacagcgtgatgaagatcatgagcacagtgaagaaggtgaagtctgagcagctgcaccacagcatgtgcaccaggaagaggcaccggcgctgtgagtacagccacttcatgcaccaccaccgggacctgagcggcctgctggtgtctgccttcaagaaccaggtgtccaagaacccctttgaggagacagcagatggagatgtgtactacccagagcgctgctgctgcatcgctgtgtgtgcccaccagtgcctgcggctgctgcagcaggccagcctgagcagcacctgtgtgcagatcctgtctggagtgcacaacatcggcatctgctgctgcatggaccccaagagcgtcatcatccccctgctgcacgccttcaagctgcctgccctgaagaacttccagcagcacatcctgaacatcctgaacaagctgatcctggaccagctgggcggcgctgagatcagccccaagatcaagaaggccgcctgcaacatctgcaccgtggacagcgaccagctggcccagctggaggagaccctgcagggcaacctgtgtgatgctgagctgagcagcagcctgagcagccccagctaccgcttccagggcatcctgcccagcagcggcagcgaggacctgctgtggaagtgggatgccctgaaggcctaccagaactttgtgtttgaagaagatcggctgcacagcatccagatcgccaaccacatctgcaacctgatccagaagggcaacatcgtggtgcagtggaagctgtacaactacatcttcaaccctgtgctgcagaggggcgtggagctggcccaccactgccagcacctgtctgtgaccagcgcccagagccacgtgtgcagccaccacaaccagtgcctgccccaggatgtgctgcagatctacgtgaagaccctgcccatcctgctgaagagcagggtcatccgggacctcttcctgagctgcaatggagtgtcccagatcatcgagctgaactgcctgaatggcatccgcagccacagcctgaaggcctttgagaccctcatcatcagcctgggggagcagcagaaggatgcctctgtgcctgacattgatggcatcgacatcgagcagaaggagctgagctctgtgcacgtgggcaccagcttccaccaccagcaggcctacagcgacagcccccagagcctgagcaagttctacgccggcctgaaggaggcctaccccaagaggaggaagacagtgaaccaggatgtgcacatcaacaccatcaacctcttcctgtgtgtggccttcctgtgtgtgtccaaggaggccgagagtgaccgggagagcgccaatgattctgaggacaccagcggctatgacagcacagccagcgagcccctgagccacatgctgccctgcatcagcctggagagcctggtgctgcccagccctgagcacatgcaccaggccgctgacatctggagcatgtgccgctggatctacatgctgagctctgtgttccagaagcagttctaccgcctgggcggcttccgggtgtgccacaagctgatcttcatgatcatccagaagctgttccgcagccacaaggaggagcagggcaagaaggagggggacacctctgtgaatgaaaaccaggacctgaaccgcatcagccagcccaagaggaccatgaaggaggacctgctgagcctggccatcaagagtgaccccatccccagcgagctgggcagcctgaagaagtctgctgacagcctgggcaagctggagctgcagcacatcagcagcatcaacgtggaggaggtgtctgccacagaagctgcccctgaggaggccaagctgttcaccagccaggagagcgagaccagcctgcagagcatccggctgctggaggccctgctggccatctgcctgcatggagcccggaccagccagcagaagatggagctggagctgcccaaccagaacctgtctgtggagagcatcctgtttgagatgagggaccacctgagccagagcaaggtgattgagacccagctggccaagcccctgtttgatgccctgctgcgggtggccctgggcaactacagcgctgactttgagcacaatgatgccatgacagagaagagccaccagagcgctgaggagctgagcagccagcccggggacttcagcgaggaggccgaggacagccagtgctgcagcttcaagctgctggtggaggaggagggctatgaagctgacagcgagagcaacccagaagatggagagacccaggatgatggagtggacctgaagtcagaaacagagggcttcagcgccagcagcagccccaatgacctgctggagaacctgacccagggcgagatcatctacccagagatctgcatgctggagctgaacctgctgagcgccagcaaggccaagctggatgtgctggcccacgtgtttgagagcttcctgaagatcatccggcagaaggagaagaatgtgttcctgctgatgcagcagggcaccgtgaagaacctgctgggcggcttcctgagcatcctgacccaggatgacagcgacttccaggcctgccagagggtgctggtggacctgctggtgtccctgatgagcagcaggacctgcagcgaggagctgaccctgctgctgcgcatcttcctggagaagagcccctgcaccaagatcctgctgctgggcatcctgaagatcattgaaagtgacaccaccatgagccccagccagtacctgaccttccccctgctgcacgcccccaacctgagcaatggagtgagcagccagaagtacccaggcatcctgaacagcaaggccatgggcctgctgcggcgggcccgggtgagccgcagcaagaaggaggccgaccgggagagcttcccccaccggctgctgagctcctggcacatcgcccctgtgcacctgcccctgctgggccagaactgctggccccacctgtctgagggcttctctgtgtccctgtggttcaacgtggagtgcatccatgaagctgagagcaccacagagaagggcaagaagatcaagaagaggaacaagagcctcatcctgcctgacagcagctttgatggaacagaaagtgacaggcctgagggcgctgagtacatcaaccctggagagcggctcatcgaggagggctgcatccacatcatcagcctgggcagcaaggccctgatgatccaggtgtgggccgacccccacaatgccaccctcatcttccgggtgtgcatggacagcaatgatgacatgaaggctgtgctgctggcccaggtggagagccaggagaacatcttcctgcccagcaagtggcagcacctggtgctgacctacctgcagcagccccagggcaagaggcgcatccacggcaagatcagcatctgggtgtctggccagaggaagccagatgtgaccctggacttcatgctgcccaggaagaccagcctgagcagtgacagcaacaagaccttctgcatgattggccactgcctgagcagccaggaggagttcctgcagctggccggcaagtgggacctgggcaacctgctgctcttcaacggggccaaggtgggcagccaggaggccttctacctgtatgcctgtggccccaaccacacctctgtgatgccctgcaagtatggcaagcctgtgaatgactacagcaagtacatcaacaaggagatcctgcgctgtgagcagatccgggagctgttcatgaccaagaaggatgtggacatcggcctgctgattgagagcctgtctgtggtgtacaccacctactgcccagcccagtacaccatctatgagcccgtcatccggctgaagggccagatgaagacccagctgagccagaggcccttcagcagcaaggaggtgcagagcatcctgctggagccccaccacctgaagaacctgcagcccacagagtacaagaccatccagggcatcctgcacgagatcggcggcaccggcatctttgtgttcctgtttgcccgggtggtggagctgagcagctgtgaggagacccaggccctggccctgcgggtcatcctgagcctcatcaagtacaaccagcagagggtgcatgagctggagaactgcaatggcctgtccatgatccaccaggtgctgatcaagcagaagtgcatcgtgggcttctacatcctgaagaccctgctggagggctgctgcggggaggacatcatctacatgaatgaaaatggagagttcaagctggatgtggacagcaatgccatcatccaggatgtgaagctgctggaggagctgctgctggactggaagatctggagcaaggccgagcagggcgtgtgggagaccctgctggccgccctggaggtgctgatccgggctgaccaccaccagcagatgttcaacatcaagcagctgctgaaggcccaggtggtgcaccacttcctgctgacctgccaggtgctgcaggagtacaaggagggccagctgacccccatgccccgggaggtgtgccgcagctttgtgaagatcatcgccgaggtgctgggcagccccccagacctggagctgctgaccatcatcttcaacttcctgctggccgtgcacccccccaccaacacctacgtgtgccacaaccccaccaacttctacttcagcctgcacattgatggcaagatcttccaggagaaggtgcgcagcatcatgtacctgcggcacagcagcagcggcggccgcagcctgatgagccctggcttcatggtgatcagccccagcggcttcaccgccagcccctatgaaggagagaacagcagcaacatcatcccccagcagatggccgcccacatgctgcggagccgcagcctgcctgccttccccaccagcagcctgctgacccagagccagaagctgaccggcagcctgggctgcagcattgaccggctgcagaacattgctgacacctacgtggccacccagagcaagaagcagaacagcctgggcagcagtgacaccctgaagaagggcaaggaggatgccttcatcagcagctgtgagagcgccaagacagtgtgtgagatggaggccgtgctgagcgcccaggtgtctgtgtctgatgtgcccaagggcgtgctgggcttccctgtggtgaaggctgaccacaagcagctgggcgctgagcccaggagtgaagatgacagccctggagatgagagctgccccaggaggccagactacctgaagggcctggccagcttccagaggagccacagcaccatcgccagcctgggcctggccttccccagccagaatggcagcgctgctgtgggccgctggcccagcctggtggacaggaacacagatgactgggagaactttgcctacagcctgggctatgagcccaactacaacagaacagccagcgcccacagcgtgacagaggactgcctggtgcccatctgctgcggcctgtatgagctgctgagcggcgtgctgctgatcctgcctgatgtgctgctggaggatgtgatggacaagctgatccaggccgacaccctgctggtgctggtgaaccaccccagccctgccatccagcagggcgtcatcaagctgctggatgcctactttgcccgggccagcaaggagcagaaggacaagttcctgaagaacagaggcttcagcctgctggccaaccagctgtacctgcaccggggcacccaggagctgctggagtgcttcatcgagatgttcttcggccgccacatcggcctggatgaggagtttgacctggaggatgtgaggaacatgggcctcttccagaagtggagcgtcatccccatcctgggcctcatcgagaccagcctgtatgacaacatcctgctgcacaatgccctgctgctgctgctgcagatcctgaacagctgcagcaaggtggccgacatgctgctggacaatggcctgctgtatgtgctgtgcaacacagtggccgccctgaatggcctggagaagaacatccccatgtctgagtacaagctgctggcctgtgacatccagcagctgttcatcgctgtgaccatccacgcctgcagcagcagcggcagccagtacttccgggtgattgaggacctgattgtgatgctgggctacctgcagaacagcaagaacaagaggacccagaacatggctgtggccctgcagctgcgggtgctgcaggccgccatggagttcatccgcaccacagccaaccacgacagcgagaacctgacagacagcctgcagagccccagcgccccccaccacgctgtggtgcagaagaggaagagcattgctggccccaggaagttccccctggcccagacagagagcctgctgatgaagatgaggtctgtggccaatgatgagctgcacgtgatgatgcagaggaggatgagccaggagaaccccagccaggccacagaaacagagctggcccagaggctgcagaggctgactgtgctggccgtgaaccgcatcatctaccaggagttcaacagcgacatcatcgacatcctgcggaccccagaaaatgtgacccagagcaagacctctgtgttccagacagagatcagcgaggagaacatccaccacgagcagagcagcgtcttcaaccccttccagaaggagatcttcacctacctggtggagggcttcaaggtgtccatcggcagcagcaaggccagcggcagcaagcagcagtggaccaagatcctgtggagctgcaaggagaccttcaggatgcagctgggccgcctgctggtgcacatcctgagccctgcccatgctgcccaggagaggaagcagatctttgaaattgtgcatgagcccaaccaccaggagatcctgcgggactgcctgagccccagcctgcagcacggggccaagctggtgctgtacctgtctgagctgatccacaaccaccagggcgagctgacagaggaggagctgggcacagctgagctgctgatgaatgccctgaagctgtgtggccacaagtgcatcccccccagcgccagcaccaaggctgacctgatcaagatgatcaaggaggagcagaagaagtatgaaacagaggagggcgtgaacaaggccgcctggcagaagacagtgaacaacaaccagcagagcctcttccagaggctggacagcaagagcaaggacatcagcaagattgctgctgacatcacccaggccgtgtccctgagccagggcaatgaaaggaagaaggtgatccagcacatccggggcatgtacaaggtggacctgagcgccagccgccactggcaggagctgatccagcagctgacccatgacagagctgtgtggtatgaccccatctactaccccacctcctggcagctggaccccacagagggccccaaccgggagcggcggcggctgcagcgctgctacctgaccatccccaacaagtacctgctgcgggaccggcagaagtcagaagatgtggtgaagccacccctgagctacctgtttgaggacaagacccacagcagcttcagcagcacagtgaaggacaaggccgccagcgagagcatccgggtgaacagacgctgcatctctgtggcccccagccgggagacagctggggagctgctgctgggcaaatgtggcatgtactttgtggaggacaatgccagtgacacagtggagagcagcagcctgcagggcgagctggagcccgccagcttctcctggacctatgaggagatcaaggaggtgcacaagcgctggtggcagctgcgggacaatgctgtggagatcttcctgaccaatggaagaaccctgctgctggcctttgacaacaccaaggtgagagatgatgtgtaccacaacatcctgaccaacaacctgcccaacctgctggagtatggcaacatcacagccctgaccaacctgtggtacacaggccagatcaccaactttgagtacctgacccacctgaacaagcatgctggccgctccttcaatgacctgatgcagtaccctgtgttccccttcatcctggccgactatgtgtctgagaccctggacctgaatgacctgctgatctacagaaacctgagcaagcccatcgctgtgcagtacaaggagaaggaggaccgctacgtggacacctacaagtacctggaggaggagtacagaaaaggagccagagaagatgaccccatgcctcctgtgcagccctaccactacggcagccactacagcaacagcggcaccgtgctgcacttcctggtgaggatgccacccttcaccaagatgttcctggcctaccaggaccagagctttgacatcccagacaggaccttccacagcaccaacaccacctggaggctgagcagctttgagagcatgacagatgtgaaggagctgatccctgagttcttctacctgcctgagttcctggtgaaccgggagggctttgattttggagtgcggcagaatggagagcgggtgaaccacgtgaacctgcccccctgggccagaaatgaccccaggctcttcatcctgatccaccggcaggccctggagagtgactatgtgtcccagaacatctgccagtggattgacctggtgtttggctacaagcagaagggcaaggcctctgtgcaggccatcaacgtgttccacccagccacctacttcggcatggatgtgtctgctgtggaggaccctgtgcagaggcgggccctggagaccatgatcaagacctacggccagaccccccggcagctgttccacatggcccacgtgtccaggcctggggccaagctgaacattgaaggagagctgcctgctgctgtgggcctgctggtgcagtttgccttccgggagacccgggagcaggtgaaggagatcacctaccccagccccctgtcctggatcaagggcctgaagtggggcgagtatgtgggcagccccagcgcccctgtgcctgtggtgtgcttcagccagccccatggagagagatttggcagcctgcaggccctgcccacccgggccatctgtggcctgagcaggaacttctgcctgctgatgacctacagcaaggagcagggcgtgcgctccatgaacagcacagacatccagtggagcgccatcctgtcctggggctacgccgacaacatcctgcggctgaagagcaagcagagcgagccccctgtgaacttcatccagagcagccagcagtaccaggtgaccagctgtgcctgggtgcctgacagctgccagctgttcaccggcagcaaatgtggggtcatcacagcctacaccaaccgcttcaccagcagcacccccagcgagattgagatggagacccagatccacctgtatggccacacagaggagatcaccagcctgtttgtgtgcaagccctacagcatcctgatctctgtgtccagagatggcacctgcatcatctgggacctgaaccggctgtgctacgtgcagagcctggccggccacaagagccctgtgacagctgtgtctgccagcgagaccagcggggacatcgccaccgtgtgtgacagcgctgggggcggcagtgacctgcggctgtggacagtgaatggagacctggtgggccacgtgcactgccgggagatcatctgcagcgtggccttcagcaaccagcctgagggcgtgtccatcaacgtgattgctgggggcctggagaatggcatcgtgcggctgtggagcacctgggacctgaagcctgtgcgggagatcaccttccccaagagcaacaagcccatcatcagcctgaccttcagctgtgatggccaccacctgtacacagccaacagtgatggcaccgtcatcgcctggtgcaggaaggaccagcagaggctgaagcagcccatgttctacagcttcctgagcagctatgctgctggatag

SEQ ID NO: 158348 - DNA, 11406 bp, Artificial Sequence; identical to SEQ ID NO: 158347
  Description of Artificial Sequence: Synthetic coding sequence

SEQ ID NO: 158349 - DNA, 4149 bp, Artificial Sequence
  Description of Artificial Sequence: Synthetic coding sequence
atgagcacagacagcaacagcctggcccgggagttcctgacagatgtgaaccggctgtgcaatgctgtggtgcagagggtggaggcccgggaggaggaggaggaggagacccacatggccaccctgggccagtacctggtgcacggccggggcttcctgctgctgaccaagctgaacagcatcatcgaccaggccctgacctgccgggaggagctgctgaccctgctgctgagcctgctgcccctggtgtggaagatccctgtgcaggaggagaaggccacagacttcaacctgcccctgtctgctgacatcatcctgaccaaggagaagaacagcagcagccagaggagcacccaggagaagctgcacctggagggcagcgccctgagcagccaggtgtctgccaaggtgaatgtgttcaggaagagccggcggcagaggaagatcacccaccgctacagcgtgagagatgccaggaagacccagctgagcaccagtgacagcgaggccaacagtgatgagaagggcatcgccatgaacaagcacagaagaccccacctgctgcaccacttcctgaccagcttccccaagcaggaccaccccaaggccaagctggaccggctggccaccaaggagcagaccccaccagatgccatggccctggagaacagccgggagatcatcccccggcagggcagcaacacagacatcctgtctgagcctgctgccctgagcgtcatcagcaacatgaacaacagcccctttgacctgtgccacgtgctgctgagcctgctggagaaggtgtgcaagtttgatgtgaccctgaaccacaacagccccctggccgcctctgtggtgcccaccctgacagagttcctggccggctttggagactgctgcagcctgagtgacaacctggagagccgggtggtgtctgctggctggacagaggagcctgtggccctgatccagaggatgctgttcagaacagtgctgcacctgctgtctgtggatgtgtccacagctgagatgatgcctgagaacctgaggaagaacctgacagagctgctgcgggccgccctgaagatccgcatctgcctggagaagcagcctgacccctttgccccccggcagaagaagaccctgcaggaggtgcaggaggactttgtgttcagcaagtaccgccaccgggccctgctgctgcctgagctgctggagggcgtgctgcagatcctgatctgctgcctgcagagcgctgccagcaaccccttctacttcagccaggccatggacctggtgcaggagttcatccagcaccacggcttcaacctgtttgaaacagctgtgctgcagatggagtggctggtgctgagagatggagtgcccccagaggccagcgagcacctgaaggccctgatcaacagcgtgatgaagatcatgagcacagtgaagaaggtgaagtctgagcagctgcaccacagcatgtgcaccaggaagaggcaccggcgctgtgagtacagccacttcatgcaccaccaccgggacctgagcggcctgctggtgtctgccttcaagaaccaggtgtccaagaacccctttgaggagacagcagatggagatgtgtactacccagagcgctgctgctgcatcgctgtgtgtgcccaccagtgcctgcggctgctgcagcaggccagcctgagcagcacctgtgtgcagatcctgtctggagtgcacaacatcggcatctgctgctgcatggaccccaagagcgtcatcatccccctgctgcacgccttcaagctgcctgccctgaagaacttccagcagcacatcctgaacatcctgaacaagctgatcctggaccagctgggcggcgctgagatcagccccaagatcaagaaggccgcctgcaacatctgcaccgtggacagcgaccagctggcccagctggaggagaccctgcagggcaacctgtgtgatgctgagctgagcagcagcctgagcagccccagctaccgcttccagggcatcctgcccagcagcggcagcgaggacctgctgtggaagtgggatgccctgaaggcctaccagaactttgtgtttgaagaagatcggctgcacagcatccagatcgccaaccacatctgcaacctgatccagaagggcaacatcgtggtgcagtggaagctgtacaactacatcttcaaccctgtgctgcagaggggcgtggagctggcccaccactgccagcacctgtctgtgaccagcgcccagagccacgtgtgcagccaccacaaccagtgcctgccccaggatgtgctgcagatctacgtgaagaccctgcccatcctgctgaagagcagggtcatccgggacctcttcctgagctgcaatggagtgtcccagatcatcgagctgaactgcctgaatggcatccgcagccacagcctgaaggcctttgagaccctcatcatcagcctgggggagcagcagaaggatgcctctgtgcctgacattgatggcatcgacatcgagcagaaggagctgagctctgtgcacgtgggcaccagcttccaccaccagcaggcctacagcgacagcccccagagcctgagcaagttctacgccggcctgaaggaggcctaccccaagaggaggaagacagtgaaccaggatgtgcacatcaacaccatcaacctcttcctgtgtgtggccttcctgtgtgtgtccaaggaggccgagagtgaccgggagagcgccaatgattctgaggacaccagcggctatgacagcacagccagcgagcccctgagccacatgctgccctgcatcagcctggagagcctggtgctgcccagccctgagcacatgcaccaggccgctgacatctggagcatgtgccgctggatctacatgctgagctctgtgttccagaagcagttctaccgcctgggcggcttccgggtgtgccacaagctgatcttcatgatcatccagaagctgttccgcagccacaaggaggagcagggcaagaaggagggggacacctctgtgaatgaaaaccaggacctgaaccgcatcagccagcccaagaggaccatgaaggaggacctgctgagcctggccatcaagagtgaccccatccccagcgagctgggcagcctgaagaagtctgctgacagcctgggcaagctggagctgcagcacatcagcagcatcaacgtggaggaggtgtctgccacagaagctgcccctgaggaggccaagctgttcaccagccaggagagcgagaccagcctgcagagcatccggctgctggaggccctgctggccatctgcctgcatggagcccggaccagccagcagaagatggagctggagctgcccaaccagaacctgtctgtggagagcatcctgtttgagatgagggaccacctgagccagagcaaggtgattgagacccagctggccaagcccctgtttgatgccctgctgcgggtggccctgggcaactacagcgctgactttgagcacaatgatgccatgacagagaagagccaccagagcgctgaggagctgagcagccagcccggggacttcagcgaggaggccgaggacagccagtgctgcagcttcaagctgctggtggaggaggagggctatgaagctgacagcgagagcaacccagaagatggagagacccaggatgatggagtggacctgaagtcagaaacagagggcttcagcgccagcagcagccccaatgacctgctggagaacctgacccagggcgagatcatctacccagagatctgcatgctggagctgaacctgctgagcgccagcaaggccaagctggatgtgctggcccacgtgtttgagagcttcctgaagatcatccggcagaaggagaagaatgtgttcctgctgatgcagcagggcaccgtgaagaacctgctgggcggcttcctgagcatcctgacccaggatgacagcgacttccaggcctgccagagggtgctggtggacctgctggtgtccctgatgagcagcaggacctgcagcgaggagctgaccctgctgctgcgcatcttcctggagaagagcccctgcacccgggccacagaccagaaggtgcagagcacctag

SEQ ID NO: 158350 - DNA, 1254 bp, Artificial Sequence
  Description of Artificial Sequence: Synthetic coding sequence
atggccgcccctggcagcgcccggcggcccctgctgctgctgctgctgctgctgctgctgggcctgatgcactgtgccagcgctgccatgttcatggtgaagaatggaaatggaacagcctgcatcatggccaacttctctgctgccttctctgtgaactatgacaccaagagcggccccaagaacatgacctttgacctgcccagtgatgccaccgtggtgctgaacagaagcagctgtgggaaggagaacaccagtgaccccagcctggtgattgccttcggccggggccacaccctgaccctgaacttcaccagaaatgccacccgctacagcgtgcagctgatgagctttgtgtacaacctgagtgacacccacctgttccccaatgccagcagcaaggagatcaagacagtggagagcatcacagacatccgggctgacatcgacaagaagtaccgctgtgtgtctggcacccaggtgcacatgaacaacgtgacagtgaccctgcatgatgccaccatccaggcctacctgagcaacagcagcttcagcagaggagagacccgctgtgagcaggaccggcccagccccaccacagcccccccagccccacccagccccagccccagccctgtgcccaagagccccagcgtggacaagtacaacgtgtctggcaccaacggcacctgcctgctggcctccatgggcctgcagctgaacctgacctatgaaaggaaggacaacaccaccgtgacccggctgctgaacatcaaccccaacaagaccagcgccagcggcagctgtggggcccacctggtgaccctggagctgcacagcgagggcaccaccgtgctgctcttccagtttggcatgaatgccagcagcagccgcttcttcctgcagggcatccagctgaacaccatcctgcctgatgcccgggaccctgccttcaaggccgccaacggcagcctgcgggccctgcaggccaccgtgggcaacagctacaagtgcaatgctgaggagcacgtgcgggtgaccaaggccttctctgtgaacatcttcaaggtgtgggtgcaggccttcaaggtggagggcggccagtttggatctgtggaggagtgcctgctggatgaaaattccatgctgatccccatcgctgtgggcggggccctggccggcctggtgctgattgtgctgattgcctacctggtgggcaggaagaggagccacgccggctaccagaccatctag

SEQ ID NO: 158351 - DNA, 1095 bp, Artificial Sequence
  Description of Artificial Sequence: Synthetic coding sequence
atggccgcccctggcagcgcccggcggcccctgctgctgctgctgctgctgctgctgctgggcctgatgcactgtgccagcgctgccatgttcatggtgaagaatggaaatggaacagcctgcatcatggccaacttctctgctgccttctctgtgaactatgacaccaagagcggccccaagaacatgacctttgacctgcccagtgatgccaccgtggtgctgaacagaagcagctgtgggaaggagaacaccagtgaccccagcctggtgattgccttcggccggggccacaccctgaccctgaacttcaccagaaatgccacccgctacagcgtgcagctgatgagctttgtgtacaacctgagtgacacccacctgttccccaatgccagcagcaaggagacccgctgtgagcaggaccggcccagccccaccacagcccccccagccccacccagccccagccccagccctgtgcccaagagccccagcgtggacaagtacaacgtgtctggcaccaacggcacctgcctgctggcctccatgggcctgcagctgaacctgacctatgaaaggaaggacaacaccaccgtgacccggctgctgaacatcaaccccaacaagaccagcgccagcggcagctgtggggcccacctggtgaccctggagctgcacagcgagggcaccaccgtgctgctcttccagtttggcatgaatgccagcagcagccgcttcttcctgcagggcatccagctgaacaccatcctgcctgatgcccgggaccctgccttcaaggccgccaacggcagcctgcgggccctgcaggccaccgtgggcaacagctacaagtgcaatgctgaggagcacgtgcgggtgaccaaggccttctctgtgaacatcttcaaggtgtgggtgcaggccttcaaggtggagggcggccagtttggatctgtggaggagtgcctgctggatgagaacagcatgctgatccccatcgctgtgggcggggccctggccggcctggtgctgattgtgctgattgcctacctggtgggcaggaagaggagccatgctggctaccagaccatctag

SEQ ID NO: 158352 - DNA, 1233 bp, Artificial Sequence
  Description of Artificial Sequence: Synthetic coding sequence
atggtgtgcttccgcctcttccctgtgcccggcagcggcctggtgctggtgtgcctggtgctgggcgctgtgcgctcctatgccctggagctgaacctgacagacagtgaaaatgccacctgcctgtatgccaagtggcagatgaacttcaccgtgcgctatgagaccaccaacaagacctacaagacagtgaccatcagtgaccatggaacagtgacctacaacggcagcatctgtggagatgaccagaatggccccaagattgctgtgcagtttggacctggcttctcctggatcgccaacttcaccaaggccgccagcacctacagcattgattctgtgtccttctcctacaacacaggagacaacaccaccttcccagatgctgaggacaagggcatcctgactgtggatgagctgctggccatccgcatccccctgaatgacctcttccgctgcaacagcctgagcaccctggagaagaatgatgtggtgcagcactactgggatgtgctggtgcaggcctttgtgcagaatggaacagtgtccaccaatgagttcctgtgtgacaaggacaagaccagcacagtggcccccaccatccacaccaccgtgcccagccccaccaccacccccacccccaaggagaagccagaggccggcacctacagcgtgaacaatggaaatgacacctgcctgctggccaccatgggcctgcagctgaacatcacccaggacaaggtggccagcgtcatcaacatcaaccccaacaccacccacagcacaggcagctgccgcagccacacagccctgctgcggctgaacagcagcaccatcaagtacctggactttgtgtttgctgtgaagaatgaaaatcgcttctacctgaaggaggtgaacatctccatgtacctggtgaatggatctgtgttcagcatcgccaacaacaacctgagctactgggatgcccccctgggcagcagctacatgtgcaacaaggagcagacagtgtctgtgtctggggccttccagatcaacacctttgacctgcgggtgcagcccttcaacgtgacccagggcaagtacagcacagcccaggactgcagcgcagatgatgacaacttcctggtgcccatcgctgtgggcgccgccctggccggcgtgctgatcctggtgctgctggcctacttcatcggcctgaagcaccaccacgccggctatgagcagttctag

SEQ ID NO: 158353 - DNA, 1233 bp, Artificial Sequence
  Description of Artificial Sequence: Synthetic coding sequence
atggtgtgcttccgcctcttccctgtgcccggcagcggcctggtgctggtgtgcctggtgctgggcgctgtgcgctcctatgccctggagctgaacctgacagacagtgaaaatgccacctgcctgtatgccaagtggcagatgaacttcaccgtgcgctatgagaccaccaacaagacctacaagacagtgaccatcagtgaccatggaacagtgacctacaacggcagcatctgtggagatgaccagaatggccccaagattgctgtgcagtttggacctggcttctcctggatcgccaacttcaccaaggccgccagcacctacagcattgattctgtgtccttctcctacaacacaggagacaacaccaccttcccagatgctgaggacaagggcatcctgactgtggatgagctgctggccatccgcatccccctgaatgacctcttccgctgcaacagcctgagcaccctggagaagaatgatgtggtgcagcactactgggatgtgctggtgcaggcctttgtgcagaatggaacagtgtccaccaatgagttcctgtgtgacaaggacaagaccagcacagtggcccccaccatccacaccaccgtgcccagccccaccaccacccccacccccaaggagaagccagaggccggcacctacagcgtgaacaatggaaatgacacctgcctgctggccaccatgggcctgcagctgaacatcacccaggacaaggtggccagcgtcatcaacatcaaccccaacaccacccacagcacaggcagctgccgcagccacacagccctgctgcggctgaacagcagcaccatcaagtacctggactttgtgtttgctgtgaagaatgaaaatcgcttctacctgaaggaggtgaacatctccatgtacctggtgaatggatctgtgttcagcatcgccaacaacaacctgagctactgggatgcccccctgggcagcagctacatgtgcaacaaggagcagacagtgtctgtgtctggggccttccagatcaacacctttgacctgcgggtgcagcccttcaacgtgacccagggcaagtacagcacagcccaggagtgcagcctggatgatgacaccatcctgatccccatcatcgtgggcgccggcctgagcggcctcatcatcgtcatcgtcatcgcctacgtgattggccgcaggaagagctatgccggctaccagaccctgtag

SEQ ID NO: 158354 - DNA, 1236 bp, Artificial Sequence
  Description of Artificial Sequence: Synthetic coding sequence
atggtgtgcttccgcctcttccctgtgcccggcagcggcctggtgctggtgtgcctggtgctgggcgctgtgcgctcctatgccctggagctgaacctgacagacagtgaaaatgccacctgcctgtatgccaagtggcagatgaacttcaccgtgcgctatgagaccaccaacaagacctacaagacagtgaccatcagtgaccatggaacagtgacctacaacggcagcatctgtggagatgaccagaatggccccaagattgctgtgcagtttggacctggcttctcctggatcgccaacttcaccaaggccgccagcacctacagcattgattctgtgtccttctcctacaacacaggagacaacaccaccttcccagatgctgaggacaagggcatcctgactgtggatgagctgctggccatccgcatccccctgaatgacctcttccgctgcaacagcctgagcaccctggagaagaatgatgtggtgcagcactactgggatgtgctggtgcaggcctttgtgcagaatggaacagtgtccaccaatgagttcctgtgtgacaaggacaagaccagcacagtggcccccaccatccacaccaccgtgcccagccccaccaccacccccacccccaaggagaagccagaggccggcacctacagcgtgaacaatggaaatgacacctgcctgctggccaccatgggcctgcagctgaacatcacccaggacaaggtggccagcgtcatcaacatcaaccccaacaccacccacagcacaggcagctgccgcagccacacagccctgctgcggctgaacagcagcaccatcaagtacctggactttgtgtttgctgtgaagaatgaaaatcgcttctacctgaaggaggtgaacatctccatgtacctggtgaatggatctgtgttcagcatcgccaacaacaacctgagctactgggatgcccccctgggcagcagctacatgtgcaacaaggagcagacagtgtctgtgtctggggccttccagatcaacacctttgacctgcgggtgcagcccttcaacgtgacccagggcaagtacagcacagcagaagaatgttctgctgacagcgacctgaacttcctgatccctgtggccgtgggcgtggccctgggcttcctgatcatcgtggtgttcatctcctacatgattggaagaaggaagagcaggacaggctaccagagcgtgtag

SEQ ID NO: 158355 - DNA, 903 bp, Artificial Sequence
  Description of Artificial Sequence: Synthetic coding sequence
atggtgtgcttccgcctcttccctgtgcccggcagcggcctggtgctggtgtgcctggtgctgggcatcctgactgtggatgagctgctggccatccgcatccccctgaatgacctcttccgctgcaacagcctgagcaccctggagaagaatgatgtggtgcagcactactgggatgtgctggtgcaggcctttgtgcagaatggcaccgtgtccaccaatgagttcctgtgtgacaaggacaagaccagcacagtggcccccaccatccacaccaccgtgcccagccccaccaccacccccacccccaaggagaagccagaggccggcacctacagcgtgaacaatggaaatgacacctgcctgctggccaccatgggcctgcagctgaacatcacccaggacaaggtggccagcgtcatcaacatcaaccccaacaccacccacagcacaggcagctgccgcagccacacagccctgctgcggctgaacagcagcaccatcaagtacctggactttgtgtttgctgtgaagaatgaaaatcgcttctacctgaaggaggtgaacatctccatgtacctggtgaatggcagcgtcttcagcatcgccaacaacaacctgagctactgggatgcccccctgggcagcagctacatgtgcaacaaggagcagacagtgtctgtgtctggggccttccagatcaacacctttgacctgcgggtgcagcccttcaacgtgacccagggcaagtacagcacagctgaggagtgcagcgctgacagcgacctgaacttcctgatccctgtggccgtgggcgtggccctgggcttcctgatcatcgtggtgttcatctcctacatgattggccgcaggaagagcaggacaggctaccagagcgtgtag

SEQ ID NO: 158356 - DNA, 1092 bp, Artificial Sequence
  Description of Artificial Sequence: Synthetic coding sequence
atgaacttcaccgtgcgctatgagaccaccaacaagacctacaagacagtgaccatcagtgaccacggcaccgtgacctacaacggcagcatctgtggagatgaccagaatggccccaagattgctgtgcagtttggacctggcttctcctggatcgccaacttcaccaaggccgccagcacctacagcattgacagcgtgtccttctcctacaacacaggagacaacaccaccttcccagatgctgaagataaaggcatcctgactgtggatgagctgctggccatccgcatccccctgaatgacctcttccgctgcaacagcctgagcaccctggagaagaatgatgtggtgcagcactactgggatgtgctggtgcaggcctttgtgcagaatggcaccgtgtccaccaatgagttcctgtgtgacaaggacaagaccagcacagtggcccccaccatccacaccaccgtgcccagccccaccaccacccccacccccaaggagaagccagaggccggcacctacagcgtgaacaatggaaatgacacctgcctgctggccaccatgggcctgcagctgaacatcacccaggacaaggtggccagcgtcatcaacatcaaccccaacaccacccacagcacaggcagctgccgcagccacacagccctgctgcggctgaacagcagcaccatcaagtacctggactttgtgtttgctgtgaagaatgaaaatcgcttctacctgaaggaggtgaacatctccatgtacctggtgaatggcagcgtcttcagcatcgccaacaacaacctgagctactgggatgcccccctgggcagcagctacatgtgcaacaaggagcagacagtgtctgtgtctggggccttccagatcaacacctttgacctgcgggtgcagcccttcaacgtgacccagggcaagtacagcacagcccaggagtgcagcctggatgatgacaccatcctgatccccatcatcgtgggcgccggcctgagcggcctcatcatcgtgattgtgattgcctacgtgattggaagaaggaagagctatgccggctaccagaccctgtag

SEQ ID NO: 158357 - DNA, 447 bp, Artificial Sequence
  Description of Artificial Sequence: Synthetic coding sequence
atgaaggccctgattgtgctgggcctggtgctgctgtctgtgacagtgcagggcaaggtgtttgagcgctgtgagctggcccggaccctgaagaggctgggcatggatggctaccggggcatcagcctggccaactggatgtgcctggccaagtgggagagcggctacaacacccgggccaccaactacaatgctggggacaggagcacagattatggcatcttccagatcaacagccgctactggtgcaatgatggcaagaccccaggagctgtgaatgcctgccacctgagctgcagcgccctgctgcaggacaacattgctgatgctgtggcctgtgccaagagggtggtgcgggacccccagggcatccgggcctgggtggcctggaggaaccgctgccagaacagagatgtgcggcagtatgtgcagggctgcggcgtgtag

SEQ ID NO: 158358 - DNA, 585 bp, Artificial Sequence
  Description of Artificial Sequence: Synthetic coding sequence
atgcaggatgcccccctgagctgcctgagccccaccaagtggagctctgtgtcctctgctgacagcacagagaagagcgccagcgctgctggcaccaggaacctgcccttccagttctgcctgcggcaggccctgaggatgaaggccgccggcatcctgaccctcatcggctgcctggtgactggagctgagagcaagatctacacccgctgcaagctggccaagatcttcagccgggccggcctggacaactactggggcttcagcctgggcaactggatctgcatggcctactatgaaagtggctacaacaccacagcccagacagtgctggatgatggcagcattgattatggcatcttccagatcaacagctttgcctggtgccggcggggcaagctgaaggagaacaaccactgccacgtggcctgcagcgccctggtgacagatgacctgacagatgccatcatctgtgccaagaagatcgtgaaggagacccagggcatgaactactggcagggctggaagaagcactgtgagggccgggacctgagtgactggaagaaggactgtgaggtgtcctag

SEQ ID NO: 158359 - DNA, 441 bp, Artificial Sequence
  Description of Artificial Sequence: Synthetic coding sequence
atgaaggcctctgtggtgctgagcctgctgggctacctggtggtgcccagcggggcctacatcctgggccgctgcaccgtggccaagaagctgcatgatggcggcctggactactttgagggctacagcctggagaactgggtgtgcctggcctactttgagagcaagttcaaccccatggccatctatgagaacacccgggagggctacacaggcttcggcctcttccagatgaggggcagtgactggtgtggggaccatggaagaaaccgctgccacatgagctgcagcgccctgctgaaccccaacctggagaagaccatcaagtgtgccaagaccatcgtgaagggcaaggagggcatgggcgcctggcccacctggagccgctactgccagtacagcgacaccctggcccgctggctggatggctgcaagctgtag

SEQ ID NO: 158360 - DNA, 441 bp, Artificial Sequence; identical to SEQ ID NO: 158359
  Description of Artificial Sequence: Synthetic coding sequence

SEQ ID NO: 158361 - DNA, 447 bp, Artificial Sequence
  Description of Artificial Sequence: Synthetic coding sequence
atgaccaaggccctgctgatctacctggtgagcagcttcctggccctgaaccaggccagcctcatcagccgctgtgacctggcccaggtgctgcagctggaggacctggatggctttgagggctacagcctgagtgactggctgtgcctggcctttgtggagagcaagttcaacatcagcaagatcaatgaaaatgctgatggcagctttgattatggcctcttccagatcaacagccactactggtgcaatgactacaagagctacagcgagaacctgtgccacgtggactgccaggacctgctgaaccccaacctgctggccggcatccactgtgccaagagaattgtgtctggggcccggggcatgaacaactgggtggagtggaggctgcactgcagcggccggcccctcttctactggctgaccggctgccgcctgaggtag

SEQ ID NO: 158362 - DNA, 447 bp, Artificial Sequence; identical to SEQ ID NO: 158361
  Description of Artificial Sequence: Synthetic coding sequence

SEQ ID NO: 158363 - DNA, 447 bp, Artificial Sequence; identical to SEQ ID NO: 158361
  Description of Artificial Sequence: Synthetic coding sequence

SEQ ID NO: 158364 - DNA, 2952 bp, Artificial Sequence
  Description of Artificial Sequence: Synthetic coding sequence
atggagatgaagctgcccggccaggagggctttgaggccagcagcgcccccaggaacatccccagcggggagctggacagcaacccagaccccggcaccggccccagcccagatggccccagcgacacagagagcaaggagctgggcgtgcccaaggaccccctgctcttcatccagctgaatgagctgctgggctggccccaggccctggagtggagggagaccggcagcagcagcgccagcctgctgctggacatgggagagatgcccagcatcaccctgagcacccacctgcaccaccgctgggtgctgtttgaggagaagctggaggtggccgccggccgctggagcgccccccacgtgcccaccctggccctgcccagcctgcagaagctgcggagcctgctggccgagggcctggtgctgctggactgcccagcccagagcctgctggagctggtggagcaggtgaccagggtggagagcctgagccctgagctgcggggccagctgcaggccctgctgctgcagaggccccagcactacaaccagaccaccggcacccggccctgctggggcagcacccaccccaggaaggccagtgacaatgaggaggcccccctgcgggagcagtgccagaaccccctgcggcagaagctgcccccaggagctgaggccggcaccgtgctggccggggagctgggcttcctggcccagcccctgggcgcctttgtgcggctgaggaaccctgtggtgctgggcagcctgacagaggtgtccctgcccagccgcttcttctgcctgctgctgggcccctgcatgctgggcaagggctaccacgagatgggccgggctgctgctgtgctgctgagtgacccccagttccagtggagcgtgcggcgggccagcaacctgcatgacctgctggccgccctggatgccttcctggaggaggtgacagtgctgcccccaggccgctgggaccccacagcccgcatccccccacccaagtgcctgcccagccagcacaagaggctgcccagccagcagcgggagatccggggccctgctgtgccccggctgaccagcgcagaagatagacaccgccacggcccccacgcccacagccctgagctgcagaggacaggccgcctgtttggaggcctcatccaggatgtgcggaggaaggtgccctggtaccccagcgacttcctggatgccctgcacctgcagtgcttctctgctgtgctgtacatctacctggccaccgtgaccaatgccatcaccttcggcggcctgctgggagatgccacagatggagcccagggcgtgctggagagcttcctgggcacagctgtggccggggccgccttctgcctgatggccggccagcccctgaccatcctgagcagcacaggccctgtgctggtgtttgagcggctgctcttctccttcagccgggactacagcctggactacctgcccttccggctgtgggtgggcatctgggtggccaccttctgcctggtgctggtggccacagaggcctctgtgctggtgcgctacttcacccgcttcacagaggagggcttctgtgccctgatcagcctcatcttcatctatgatgctgtgggcaagatgctgaacctgacccacacctaccccatccagaagccaggcagcagcgcctacggctgcctgtgccagtacccaggccctggaggaaatgaaagccagtggatccgcacccggcccaaggacagagatgacatcgtgtccatggacctgggcctcatcaatgccagcctgctgcccccacctgagtgcacccggcagggcggccacccccggggccctggctgccacacagtgcctgacatcgccttcttcagcctgctgctcttcctgaccagcttcttctttgccatggccctgaagtgtgtgaagaccagccgcttcttccccagcgtggtgaggaagggcctgagtgacttcagctctgtgctggccatcctgctgggctgcggcctggatgccttcctgggcctggccacccccaagctgatggtgccccgggagttcaagcccaccctgcccggccggggctggctggtgagcccctttggagccaacccctggtggtggagcgtggccgccgccctgcctgccctgctgctgagcatcctgatcttcatggaccagcagatcacagctgtgatcctgaacaggatggagtaccgcctgcagaagggggccggcttccacctggacctcttctgtgtggccgtgctgatgctgctgaccagcgccctgggcctgccctggtacgtgtctgccaccgtcatcagcctggcccacatggacagcctgcggcgggagagccgggcctgtgcccctggagagcggcccaacttcctgggcatccgggagcagaggctgaccggcctggtggtgttcatcctgaccggggccagcatcttcctggcccctgtgctgaagttcatccccatgcctgtgctgtatggcatcttcctgtacatgggcgtggccgccctgagcagcatccagttcaccaacagagtgaagctgctgctgatgcctgccaagcaccagcctgacctgctgctgctgcggcacgtgcccctgaccagggtgcacctgttcaccgccatccagctggcctgcctgggcctgctgtggatcatcaagagcaccccagctgccatcatcttccccctgatgctgctgggcctggtgggcgtgaggaaggccctggagagggtcttcagcccccaggagctgctgtggctggatgagctgatgcctgaggaggagaggagcatccctgagaagggcctggagcctgagcacagcttcagcggcagtgacagtgaagattctgagctgatgtaccagcccaaggcccctgagatcaacatctctgtgaactag

SEQ ID NO: 158365 - DNA, 123 bp, Artificial Sequence
  Description of Artificial Sequence: Synthetic coding sequence
atgagatttgcctggacagtgctgctgctgggccccctgcagctgtgtgccctggtgcactgtgcccctcctgctgctggccagcagcagcccccccgggagcccccagctgcccctggatag

SEQ ID NO: 158366 - DNA, 1134 bp, Artificial Sequence
  Description of Artificial Sequence: Synthetic coding sequence
atgagatttgcctggacagtgctgctgctgggccccctgcagctgtgtgccctggtgcactgtgcccctcctgctgctggccagcagcagcccccccgggagcccccagctgcccctggagctgccagcgcccagcagcccaggacccccatcctgctgatccgggacaacagaacagctgctgcccggaccaggacagctggcagcagcggcgtgacagctggccggccccggcccacagcccggcactggttccaggccggctacagcaccagccgggcccgggaggccggggccagcagagctgagaaccagacagcccctggagaggtgcctgccctgagcaacctgcggccccccagccgggtggatggcatggtgggagatgacccctacaacccctacaagtacagtgatgacaacccctactacaactactatgacacctatgaaagacccaggcctgggggccgctacagacctggctatggaacaggctacttccagtatggcctgcctgacctggtggccgacccctactacatccaggccagcacctacgtgcagaagatgtccatgtacaacctgcgctgtgccgctgaggagaactgcctggccagcacagcctacagagcagatgtgcgggactatgaccaccgggtgctgctgcgcttcccccagagggtgaagaaccagggcaccagtgacttcctgcccagccggccccgctacagctgggagtggcacagctgccaccagcactaccacagcatggatgagttcagccactatgacctgctggatgccaacacccagaggagagtggccgagggccacaaggccagcttctgcctggaggacaccagctgtgactatggctaccacagaagatttgcctgcacagcccacacccagggcctgagccctggctgctatgacacctatggagctgacatcgactgccagtggattgacatcacagatgtgaagccaggcaactacatcctgaaggtgtctgtgaaccccagctacctggtgcctgagagtgactacaccaacaacgtggtgcgctgtgacatccgctacacaggccaccacgcctatgccagcggctgcaccatcagcccctactag

SEQ ID NO: 158367 - DNA, 2325 bp, Artificial Sequence
  Description of Artificial Sequence: Synthetic coding sequence
atggagcggcccctgtgcagccacctgtgcagctgcctggccatgctggccctgctgagccccctgagcctggcccagtatgacagctggccccactacccagagtacttccagcagcctgcccctgagtaccaccagccccaggccccagccaacgtggccaagatccagctgcggctggccggccagaagaggaagcacagcgagggccgggtggaggtgtactatgatggccagtggggcaccgtgtgtgatgatgacttcagcatccacgccgcccacgtggtgtgccgggagctgggctacgtggaggccaagtcctggacagccagcagcagctatggcaagggggagggccccatctggctggacaacctgcactgcacaggaaatgaggccaccctggccgcctgcaccagcaatggctggggcgtgacagactgcaagcacacagaagatgtgggcgtggtgtgcagcgacaagagaattcctggcttcaagtttgacaacagcctcatcaaccagatcgagaacctgaacatccaggtggaggacatccgcatccgggccatcctgagcacctacaggaagaggacccctgtgatggagggctacgtggaggtgaaggagggcaagacctggaagcagatctgtgacaagcactggacagccaagaacagccgggtggtgtgtggcatgtttggcttccctggagagaggacctacaacaccaaggtgtacaagatgtttgccagcaggaggaagcagcgctactggcccttctccatggactgcaccggcacagaggcccacatcagcagctgcaagctgggcccccaggtgtccctggaccccatgaagaatgtgacctgtgaaaatggcctgcctgctgtggtgtcctgtgtgcccggccaggtgttctccccagatggccccagccgcttcaggaaggcctacaagccagagcagcccctggtgcggctgcggggcggggcctacatcggggagggccgggtggaggtgctgaagaatggagagtggggcaccgtgtgtgatgacaagtgggacctggtgtctgcctctgtggtgtgccgggagctgggctttggaagtgccaaggaggccgtgacaggcagccggctgggccagggcatcggccccatccacctgaatgagatccagtgcacaggaaatgagaagagcatcatcgactgcaagttcaatgctgagagccagggctgcaaccacgaggaggatgctggggtgcgctgcaacaccccagccatgggcctgcagaagaagctgcggctgaatggaggaagaaacccctatgagggccgggtggaggtgctggtggagagaaatggcagcctggtgtggggcatggtgtgtggccagaactggggcatcgtggaggccatggtggtgtgccggcagctgggcctgggctttgccagcaatgccttccaggagacctggtactggcatggagatgtgaacagcaacaaggtggtgatgtctggagtgaagtgcagcggcacagagctgagcctggcccactgcagacatgatggagaagatgtggcctgcccccagggcggcgtgcagtatggagctggggtggcctgcagcgagacagccccagacctggtgctgaatgctgagatggtgcagcagaccacctacctggaggaccggcccatgttcatgctgcagtgtgccatggaggagaactgcctgagcgccagcgctgcccagacagaccccaccaccggctaccgccgcctgctgcgcttcagcagccagatccacaacaacggccagagcgacttccggcccaagaatggaagacatgcctggatctggcatgactgccaccgccactaccacagcatggaggtgttcacccactatgacctgctgaacctgaatggcaccaaggtggccgagggccacaaggccagcttctgcctggaggacacagaatgtgagggggacatccagaagaactatgaatgtgccaactttggagaccagggcatcaccatgggctgctgggacatgtacagacatgacatcgactgccagtgggtggacatcacagatgtgcccccaggggactacctgttccaggtggtgatcaaccccaactttgaggtggccgagagtgactacagcaacaacatcatgaagtgccgcagccgctatgatggccaccgcatctggatgtacaactgccacatcggcggcagcttcagcgaggagacagagaagaagtttgagcacttcagcggcctgctgaacaaccagctgagcccccagtag

SEQ ID NO: 158368 - DNA, 456 bp, Artificial Sequence
  Description of Artificial Sequence: Synthetic coding sequence
atggagcggcccctgtgcagccacctgtgcagctgcctggccatgctggccctgctgagccccctgagcctggcccagtatgacagctggccccactacccagagtacttccagcagcctgcccctgagtaccaccagccccaggccccagccaacgtggccaagatccagctgcggctggccggccagaagaggaagcacagcgagggccgggtggaggtgtactatgatggccagtggggcaccgtgtgtgatgatgacttcagcatccacgccgcccacgtggtgtgccgggagctgggctacgtggaggccaagtcctggacagccagcagcagctatggcaagggggagggccccatctggctggacaacctgcactgcacaggaaatgaggccaccctggccgcctgcaccagcaatggctggggcgtgacagactgcaagcacacctag

SEQ ID NO: 158369 - DNA, 291 bp, Artificial Sequence
  Description of Artificial Sequence: Synthetic coding sequence
atggagcggcccctgtgcagccacctgtgcagctgcctggccatgctggccctgctgagccccctgagcctggcccagtatgacagctggccccactacccagagtacttccagcagcctgcccctgagtaccaccagccccaggccccagccaacgtggccaagatccagctgcggctggccggccagaagaggaagcacagcgagggccgggtggaggtgtactatgatggccagtggggcaccgtgtgtgatgatgacttcagcatccacgccgcccacgtggtgtag

SEQ ID NO: 158370 - DNA, 420 bp, Artificial Sequence
  Description of Artificial Sequence: Synthetic coding sequence
atggagcggcccctgtgcagccacctgtgcagctgcctggccatgctggccctgctgagccccctgagcctggcccagtatgacagctggccccactacccagagtacttccagcagcctgcccctgagtaccaccagccccaggccccagccaacgtggccaagatccagctgcggctggccggccagaagaggaagcacagcgagggccgggtggaggtgtactatgatggccagtggggcaccgtgtgtgatgatgacttcagcatccacgccgcccacgtggtgtgccgggagctgggctacgtggaggccaagtcctggacagccagcagcagctatggcaagggggagggccccatctggctggacaacctgcactgcacaggaaatgaggccaccctggccgcctgcacctag

SEQ ID NO: 158371 - DNA, 2262 bp, Artificial Sequence
  Description of Artificial Sequence: Synthetic coding sequence
atgaggcctgtgtctgtgtggcagtggagcccctggggcctgctgctgtgcctgctgtgcagcagctgcctgggcagccccagccccagcactggacctgagaagaaggccggcagccagggcctgcgcttccggctggccggcttccccaggaagccctatgagggccgggtggagatccagagagctggggagtggggcaccatctgtgatgatgacttcaccctgcaggccgcccacatcctgtgccgggagctgggcttcacagaggccaccggctggacccacagcgccaagtatggccctggcaccggccgcatctggctggacaacctgagctgcagcggcacagagcagagcgtgacagaatgtgccagccggggctggggcaacagcgactgcacccatgatgaagatgctggggtcatctgcaaggaccagaggctgcccggcttcagtgacagcaatgtcatcgaggtggagcaccacctgcaggtggaggaggtgcgcatccggcctgctgtgggctggggcagaagacccctgcctgtgacagagggcctggtggaggtgcggctgcctgatggctggagccaggtgtgtgacaagggctggagcgcccacaacagccacgtggtgtgtggcatgctgggcttccccagcgagaagagggtgaatgctgccttctaccgcctgctggcccagaggcagcagcacagctttggcctgcacggcgtggcctgtgtgggcacagaggcccacctgagcctgtgcagcctggagttctaccgggccaatgacacagcccgctgccctgggggcggccctgctgtggtgtcctgtgtgcccggccctgtgtatgctgccagcagcggccagaagaagcagcagcagagcaagccccagggcgaggcccgggtgcggctgaagggcggggcccaccctggagagggccgggtggaggtgctgaaggccagcacctggggcaccgtgtgtgacaggaagtgggacctgcacgccgcctctgtggtgtgccgggagctgggcttcggcagcgcccgggaggccctgagcggggccaggatgggccagggcatgggcgccatccacctgtctgaggtgcgctgcagcggccaggagctgagcctgtggaagtgcccccacaagaacatcacagctgaggactgcagccacagccaggatgctggggtgcgctgcaacctgccctacacaggagctgagacccgcatccggctgagcggcggccgcagccagcacgagggccgggtggaggtgcagatcggcggccctggccccctgcgctggggcctcatctgtggagatgactggggcaccctggaggccatggtggcctgccggcagctgggcctgggctacgccaaccacggcctgcaggagacctggtactgggacagcggcaacatcacagaggtggtgatgtctggagtgcgctgcacaggaacagagctgagcctggaccagtgtgcccaccacggcacccacatcacctgcaagaggacaggcacccgcttcaccgctggggtcatctgcagcgagacagccagtgacctgctgctgcacagcgccctggtgcaggagacagcctacattgaagatcggcccctgcacatgctgtactgtgccgctgaggagaactgcctggccagcagcgcccggagcgccaactggccctacggccaccggcggctgctgcgcttcagcagccagatccacaacctgggccgggctgacttccggcccaaggccggccgccacagctgggtgtggcatgaatgtcatggccactaccacagcatggacatcttcacccactatgacatcctgaccccaaatggcaccaaggtggccgagggccacaaggccagcttctgcctggaggacacagagtgccaggaggatgtgtccaagagatatgaatgtgccaactttggagagcagggcatcaccgtgggctgctgggacctgtacagacatgacatcgactgccagtggattgacatcacagatgtgaagccaggcaactacatcctgcaggtggtgatcaaccccaactttgaggtggccgagagtgacttcaccaacaatgccatgaagtgcaactgcaagtatgatggccaccgcatctgggtgcacaactgccacatcggagatgccttcagcgaggaggccaacagaagatttgagcgctacccaggccagaccagcaaccagatcatctag

SEQ ID NO: 158372 - DNA, 1827 bp, Artificial Sequence
  Description of Artificial Sequence: Synthetic coding sequence
atgaggcctgtgtctgtgtggcagtggagcccctggggcctgctgctgtgcctgctgtgcagcagctgcctgggcagccccagccccagcactggacctgagaagaaggccggcagccagggcctgcgcttccggctggccggcttccccaggaagccctatgagggccgggtggagatccagagagctggggagtggggcaccatctgtgatgatgacttcaccctgcaggccgcccacatcctgtgccgggagctgggcttcacagaggccaccggctggacccacagcgccaagtatggccctggcaccggccgcatctggctggacaacctgagctgcagcggcacagagcagagcgtgacagaatgtgccagccggggctggggcaacagcgactgcacccatgatgaagatgctggggtcatctgcaaggaccagaggctgcccggcttcagtgacagcaatgtcatcgaggcccgggtgcggctgaagggcggggcccaccctggagagggccgggtggaggtgctgaaggccagcacctggggcaccgtgtgtgacaggaagtgggacctgcatgctgcctctgtggtgtgccgggagctgggctttggaagtgcccgggaggccctgagcggggccaggatgggccagggcatgggcgccatccacctgtctgaggtgcgctgcagcggccaggagctgagcctgtggaagtgcccccacaagaacatcacagctgaggactgcagccacagccaggatgctggggtgcgctgcaacctgccctacaccggggctgagacccgcatccggctgagcggcggccgcagccagcacgagggccgggtggaggtgcagattggaggccctggccccctgcgctggggcctcatctgtggagatgactggggcaccctggaggccatggtggcctgccggcagctgggcctgggctacgccaaccacggcctgcaggagacctggtactgggacagcggcaacatcacagaggtggtgatgtctggagtgcgctgcaccggcacagagctgagcctggaccagtgtgcccaccacggcacccacatcacctgcaagaggacaggcacccgcttcaccgctggggtcatctgcagcgagacagccagtgacctgctgctgcacagcgccctggtgcaggagacagcctacatcgaggaccggcccctgcacatgctgtactgtgccgctgaggagaactgcctggccagcagcgcccggagcgccaactggccctacggccaccggcggctgctgcgcttcagcagccagatccacaacctgggccgggctgacttccggcccaaggccggccgccacagctgggtgtggcatgagtgccacggccactaccacagcatggacatcttcacccactatgacatcctgacccccaacggcaccaaggtggccgagggccacaaggccagcttctgcctggaggacacagagtgccaggaggatgtgtccaagagatatgaatgtgccaactttggagagcagggcatcaccgtgggctgctgggacctgtacagacatgacatcgactgccagtggattgacatcacagatgtgaagccaggcaactacatcctgcaggtggtgatcaaccccaactttgaggtggccgagagtgacttcaccaacaatgccatgaagtgcaactgcaagtatgatggccaccgcatctgggtgcacaactgccacatcggagatgccttcagcgaggaggccaacagaagatttgagcgctacccaggccagaccagcaaccagatcatctag

SEQ ID NO: 158373 - DNA, 2094 bp, Artificial Sequence
  Description of Artificial Sequence: Synthetic coding sequence
atgaggcctgtgtctgtgtggcagtggagcccctggggcctgctgctgtgcctgctgtgcagcagctgcctgggcagccccagccccagcactggacctgagaagaaggccggcagccagggcctgcgcttccggctggccggcttccccaggaagccctatgagggccgggtggagatccagagagctggggagtggggcaccatctgtgatgatgacttcaccctgcaggccgcccacatcctgtgccgggagctgggcttcacagaggccaccggctggacccacagcgccaagtatggccctggcaccggccgcatctggctggacaacctgagctgcagcggcacagagcagagcgtgacagaatgtgccagccggggctggggcaacagcgactgcacccatgatgaagatgctggggtcatctgcaaggaccagaggctgcccggcttcagtgacagcaatgtcatcgaggtggagcaccacctgcaggtggaggaggtgcgcatccggcctgctgtgggctggggcagaagacccctgcctgtgacagagggcctggtggaggtgcggctgcctgatggctggagccaggtgtgtgacaagggctggagcgcccacaacagccacgtggtgtgtggcatgctgggcttccccagcgagaagagggtgaatgctgccttctaccgcctgctggcccagaggcagcagcacagctttggcctgcacggcgtggcctgtgtgggcacagaggcccacctgagcctgtgcagcctggagttctaccgggccaatgacacagcccgctgccctgggggcggccctgctgtggtgtcctgtgtgcccggccctgtgtatgctgccagcagcggccagaagaagcagcagcagagcaagccccagggcgaggcccgggtgcggctgaagggcggggcccaccctggagagggccgggtggaggtgctgaaggccagcacctggggcaccgtgtgtgacaggaagtgggacctgcacgccgcctctgtggtgtgccgggagctgggcttcggcagcgcccgggaggccctgagcggggccaggatgggccagggcatgggcgccatccacctgtctgaggtgcgctgcagcggccaggagctgagcctgtggaagtgcccccacaagaacatcacagctgaggactgcagccacagccaggatgctggggtgcgctgcaacctgccctacacaggagctgagacccgggagacctggtactgggacagcggcaacatcacagaggtggtgatgtctggagtgcgctgcacaggaacagagctgagcctggaccagtgtgcccaccacggcacccacatcacctgcaagaggacaggcacccgcttcaccgctggggtcatctgcagcgagacagccagtgacctgctgctgcacagcgccctggtgcaggagacagcctacattgaagatcggcccctgcacatgctgtactgtgccgctgaggagaactgcctggccagcagcgcccggagcgccaactggccctacggccaccggcggctgctgcgcttcagcagccagatccacaacctgggccgggctgacttccggcccaaggccggccgccacagctgggtgtggcatgaatgtcatggccactaccacagcatggacatcttcacccactatgacatcctgaccccaaatggcaccaaggtggccgagggccacaaggccagcttctgcctggaggacacagagtgccaggaggatgtgtccaagagatatgaatgtgccaactttggagagcagggcatcaccgtgggctgctgggacctgtacagacatgacatcgactgccagtggattgacatcacagatgtgaagccaggcaactacatcctgcaggtggtgatcaaccccaactttgaggtggccgagagtgacttcaccaacaatgccatgaagtgcaactgcaagtatgatggccaccgcatctgggtgcacaactgccacatcggagatgccttcagcgaggaggccaacagaagatttgagcgctacccaggccagaccagcaaccagatcatctag

SEQ ID NO: 158374 - DNA, 912 bp, Artificial Sequence
  Description of Artificial Sequence: Synthetic coding sequence
atgaggcctgtgtctgtgtggcagtggagcccctggggcctgctgctgtgcctgctgtgcagcagctgcctgggcagccccagccccagcactggacctgagaagaaggccggcagccagggcctgcgcttccggctggccggcttccccaggaagccctatgagggccgggtggagatccagagagctggggagtggggcaccatctgtgatgatgacttcaccctgcaggccgcccacatcctgtgccgggagctgggcttcacagaggccaccggctggacccacagcgccaagtatggccctggcaccggccgcatctggctggacaacctgagctgcagcggcacagagcagagcgtgacagaatgtgccagccggggctggggcaacagcgactgcacccatgatgaagatgctggggtcatctgcaaggaccagaggctgcccggcttcagtgacagcaatgtcatcgaggtggagcaccacctgcaggtggaggaggtgcgcatccggcctgctgtgggctggggcagaagacccctgcctgtgacagagggcctggtggaggtgcggctgcctgatggctggagccaggtgtgtgacaagggctggagcgcccacaacagccacgtggtgtgtggcatgctgggcttccccagcgagaagagggtgaatgctgccttctaccgcctgctggcccagaggcagcagcacagctttggcctgcacggcgtggcctgtgtgggcacagaggcccacctgagcctgtgcagcctggagttctaccgggccaatgacacagcccgctgccctgggggcggccctgctgtggtgtcctgtgtgcccggccctgtgtatgctgccagcagcggccagaagaagcagcagcagagcaagccccagggctag

SEQ ID NO: 158375 - DNA, 2271 bp, Artificial Sequence
  Description of Artificial Sequence: Synthetic coding sequence
atggcctggagccccccagccaccctcttcctgttcctgctgctgctgggccagcccccacccagccggccccagagcctgggcaccaccaagctgcggctggtgggccctgagagcaagccagaggagggccgcctggaggtgctgcaccagggccagtggggcaccgtgtgtgatgacaactttgccatccaggaggccaccgtggcctgccggcagctgggctttgaggccgccctgacctgggcccacagcgccaagtatggccagggcgagggccccatctggctggacaacgtgcgctgtgtgggcacagagagcagcctggaccagtgtggcagcaatggctggggcgtgtctgactgcagccacagtgaagatgtgggcgtcatctgccaccccaggaggcaccggggctacctgtctgagaccgtgtccaatgccctgggcccccagggccggcggctggaggaggtgcggctgaagcccatcctggccagcgccaagcagcacagccctgtgacagaaggagctgtggaggtgaagtatgagggccactggaggcaggtgtgtgaccagggctggaccatgaacaacagccgggtggtgtgtggcatgctgggcttccccagcgaggtgcctgtggacagccactactacaggaaggtgtgggacctgaagatgagggaccccaagagccggctgaagagcctgaccaacaagaacagcttctggatccaccaggtgacctgcctgggcacagagccccacatggccaactgccaggtgcaggtggccccagcccggggcaagctgcggcctgcctgccctgggggcatgcatgctgtggtgtcctgtgtggccggcccccacttccggccccccaagaccaagccccagaggaagggctcctgggccgaggagccccgggtgcggctgcggagcggggcccaggtgggggagggccgggtggaggtgctgatgaaccggcagtggggcaccgtgtgtgaccaccgctggaacctgatcagcgcctctgtggtgtgccggcagctgggcttcggcagcgcccgggaggccctgtttggagcccggctgggccagggcctgggccccatccacctgtctgaggtgcgctgccggggctatgaaagaaccctgagtgactgcccagccctggagggcagccagaatggctgccagcatgaaaatgatgctgctgtgcgctgcaatgtgcccaacatgggcttccagaaccaggtgcggctggccggcggccgcatccctgaggagggcctgctggaggtgcaggtggaggtgaatggagtgccccgctggggctctgtgtgcagcgagaactggggcctgacagaggccatggtggcctgccggcagctgggcctgggctttgccatccacgcctacaaggagacctggttctggagcggcaccccccgggcccaggaggtggtgatgtctggagtgcgctgcagcggcacagagctggccctgcagcagtgccagagacatggccctgtgcactgcagccatggaggcggccgcttcctggccggcgtgtcctgcatggattctgccccagacctggtgatgaatgcccagctggtgcaggagacagcctacctggaggaccggcccctgagccagctgtactgtgcccacgaggagaactgcctgagcaagtctgctgaccacatggactggccctacggctacagaaggctgctgcgcttcagcacccagatctacaacctgggccgcacagacttccggcccaagacaggccgggacagctgggtgtggcaccagtgccaccgccactaccacagcattgaggtgttcacccactatgacctgctgaccctgaatggcagcaaggtggccgagggccacaaggccagcttctgcctggaggacaccaactgccccaccggcctgcagaggagatatgcctgtgccaactttggagagcagggcgtgacagtgggctgctgggacacctacagacatgacatcgactgccagtgggtggacatcacagatgtgggccctggcaactacatcttccaggtgattgtgaacccccactatgaggtggccgagagtgacttcagcaacaacatgctgcagtgccgctgcaagtatgatggccaccgggtgtggctgcacaactgccacactggaaacagctacccagccaatgctgagctgagcctggagcaggagcagaggctgaggaacaacctgatctag

SEQ ID NO: 158376 - DNA, 1794 bp, Artificial Sequence
  Description of Artificial Sequence: Synthetic coding sequence
atggctgctgtgcaggccgctgaggtgaaggtggatggcagcgagcccaagctgagcaagaatgagctgaagaggcggctgaaggccgagaagaaggtggccgagaaggaggccaagcagaaggagctgtctgagaagcagctgagccaggccacagctgctgccaccaaccacaccacagacaacggggtgggccctgaggaggagagcgtggaccccaaccagtactacaagatccgcagccaggccatccaccagctgaaggtgaatggagaggacccctacccccacaagttccacgtggacatcagcctgacagacttcatccagaagtacagccacctgcagcccggggaccacctgacagacatcaccctgaaggtggccggccgcatccacgccaagagggccagcggcggcaagctgatcttctatgacctgcggggggagggcgtgaagctgcaggtgatggccaacagcaggaactacaagtctgaggaggagttcatccacatcaacaacaagctgcggcggggggacatcatcggcgtgcagggcaaccctgggaagaccaagaagggggagctgagcatcatcccctatgagatcaccctgctgagcccctgcctgcacatgctgccccacctgcacttcggcctgaaggacaaggagacccgctaccggcagcgctacctggacctgatcctgaatgactttgtgcggcagaagttcatcatccgcagcaagatcatcacctacatccgctccttcctggatgagctgggcttcctggagattgagacccccatgatgaacatcatccctggaggagctgtggccaagcccttcatcacctaccacaatgagctggacatgaacctgtacatgagaattgcccctgagctgtaccacaagatgctggtggtgggcggcatcgacagagtgtatgagatcggccggcagttcagaaatgaaggaattgacctgacccacaaccctgagttcaccacctgtgagttctacatggcctatgctgactaccatgacctgatggagatcacagagaagatggtgtctggcatggtgaagcacatcaccggcagctacaaggtgacctaccacccagatggccctgagggccaggcctatgatgtggacttcaccccacccttccgccgcatcaacatggtggaggagctggagaaggccctgggcatgaagctgcctgagaccaacctgtttgaaacagaggagaccaggaagatcctggatgacatctgtgtggccaaggctgtggagtgccccccacccaggaccacagcccggctgctggacaagctggtgggggagttcctggaggtgacctgcatcaaccccaccttcatctgtgaccacccccagatcatgagccccctggccaagtggcacaggagcaaggagggcctgacagaaagatttgagctgtttgtgatgaagaaggagatctgcaatgcctacacagagctgaatgaccccatgaggcagaggcagctgtttgaggagcaggccaaggccaaggctgctggagatgatgaggccatgtttattgatgagaacttctgcacagccctggagtatggcctgcccccaacagctggctggggcatgggcatcgacagagtggccatgttcctgacagacagcaacaacatcaaggaggtgctgctcttccctgccatgaagccagaggacaagaaggaaaatgtggccaccacagacaccctggagagcaccaccgtgggcacctctgtgtag

SEQ ID NO: 158377 - DNA, 1878 bp, Artificial Sequence
  Description of Artificial Sequence: Synthetic coding sequence
atgctgacccaggccgctgtgcggctggtgcggggcagcctgaggaagacctcctgggccgagtggggccaccgggagctgcggctgggccagctggcccccttcaccgccccccacaaggacaagagcttcagtgaccagaggtctgagctgaagaggcggctgaaggccgagaagaaggtggccgagaaggaggccaagcagaaggagctgtctgagaagcagctgagccaggccacagctgctgccaccaaccacaccacagacaacggggtgggccctgaggaggagagcgtggaccccaaccagtactacaagatccgcagccaggccatccaccagctgaaggtgaatggagaggacccctacccccacaagttccacgtggacatcagcctgacagacttcatccagaagtacagccacctgcagcccggggaccacctgacagacatcaccctgaaggtggccggccgcatccacgccaagagggccagcggcggcaagctgatcttctatgacctgcggggggagggcgtgaagctgcaggtgatggccaacagcaggaactacaagtctgaggaggagttcatccacatcaacaacaagctgcggcggggggacatcatcggcgtgcagggcaaccctgggaagaccaagaagggggagctgagcatcatcccctatgagatcaccctgctgagcccctgcctgcacatgctgccccacctgcacttcggcctgaaggacaaggagacccgctaccggcagcgctacctggacctgatcctgaatgactttgtgcggcagaagttcatcatccgcagcaagatcatcacctacatccgctccttcctggatgagctgggcttcctggagattgagacccccatgatgaacatcatccctggaggagctgtggccaagcccttcatcacctaccacaatgagctggacatgaacctgtacatgagaattgcccctgagctgtaccacaagatgctggtggtgggcggcatcgacagagtgtatgagatcggccggcagttcagaaatgaaggaattgacctgacccacaaccctgagttcaccacctgtgagttctacatggcctatgctgactaccatgacctgatggagatcacagagaagatggtgtctggcatggtgaagcacatcaccggcagctacaaggtgacctaccacccagatggccctgagggccaggcctatgatgtggacttcaccccacccttccgccgcatcaacatggtggaggagctggagaaggccctgggcatgaagctgcctgagaccaacctgtttgaaacagaggagaccaggaagatcctggatgacatctgtgtggccaaggctgtggagtgccccccacccaggaccacagcccggctgctggacaagctggtgggggagttcctggaggtgacctgcatcaaccccaccttcatctgtgaccacccccagatcatgagccccctggccaagtggcacaggagcaaggagggcctgacagaaagatttgagctgtttgtgatgaagaaggagatctgcaatgcctacacagagctgaatgaccccatgaggcagaggcagctgtttgaggagcaggccaaggccaaggctgctggagatgatgaggccatgtttattgatgagaacttctgcacagccctggagtatggcctgcccccaacagctggctggggcatgggcatcgacagagtggccatgttcctgacagacagcaacaacatcaaggaggtgctgctcttccctgccatgaagccagaggacaagaaggaaaatgtggccaccacagacaccctggagagcaccaccgtgggcacctctgtgtag

SEQ ID NO: 158378 - DNA, 1569 bp, Artificial Sequence
  Description of Artificial Sequence: Synthetic coding sequence
atgcagccctggcacggcaaggccatgcagagggccagcgaggccggggccacagcccccaaggccagcgccagaaatgcccggggggcccccatggaccccacagagagccctgctgcccctgaggccgccctgcccaaggccggcaagtttggacctgccaggaagagcggcagccggcagaagaagagcgccccagacacccaggagcggccccctgtgcgggccactggagcccgggccaagaaggccccccagagggcccaggacacccagcccagtgatgccaccagcgcccctggagctgagggcctggagcccccagctgcccgggagcccgccctgagccgggccggcagctgccggcagagaggagcccgctgcagcaccaagccccggcccccacctggcccctgggatgtgcccagccctggcctgcctgtgtctgcccccatcctggtgagaagagatgctgcccctggggccagcaagctgcgggctgtgctggagaagctgaagctgagcagagatgacatcagcacagctgctggcatggtgaagggcgtggtggaccacctgctgctgcggctgaagtgtgacagcgccttccggggcgtgggcctgctgaacacaggcagctactatgaacatgtgaagatcagcgccccaaatgaatttgatgtgatgttcaagctggaggtgccccgcatccagctggaggagtacagcaacacccgggcctactactttgtgaagttcaagaggaaccccaaggagaaccccctgagccagttcctggagggggagatcctgagcgccagcaagatgctgagcaagttcaggaagatcatcaaggaggagatcaatgacatcaaggacacagatgtgatcatgaagaggaagagaggaggcagccctgctgtgaccctgctgatcagcgagaagatctctgtggacatcaccctggccctggagagcaagagctcctggccagccagcacccaggagggcctgcgcatccagaactggctgagcgccaaggtgaggaagcagctgcggctgaagcccttctacctggtgcccaagcacgccaaggagggcaatggcttccaggaggagacctggaggctgtccttcagccacatcgagaaggagatcctgaacaaccacggcaagagcaagacctgctgtgagaacaaggaggagaagtgctgcaggaaggactgcctgaagctgatgaagtacctgctggagcagctgaaggagcgcttcaaggacaagaagcacctggacaagttcagcagctaccacgtgaagacagccttcttccacgtgtgcacccagaacccccaggacagccagtgggacaggaaggacctgggcctgtgctttgacaactgtgtgacctacttcctgcagtgcctgaggacagagaagctggagaactacttcatccctgagttcaacctcttcagcagcaacctgattgacaagaggagcaaggagttcctgaccaagcagatcgagtatgaaagaaataatgagttccctgtgtttgatgagttctag

SEQ ID NO: 158379 - DNA, 1344 bp, Artificial Sequence
  Description of Artificial Sequence: Synthetic coding sequence
atgcagccctggcacggcaaggccatgcagagggccagcgaggccggggccacagcccccaaggccagcgccagaaatgcccggggggcccccatggaccccacagagagccctgctgcccctgaggccgccctgcccaaggccggcaagtttggacctgccaggaagagcggcagccggcagaagaagagcgccccagacacccaggagcggccccctgtgcgggccactggagcccgggccaagaaggccccccagagggcccaggacacccagcccagtgatgccaccagcgcccctggagctgagggcctggagcccccagctgcccgggagcccgccctgagccgggccggcagctgccggcagagaggagcccgctgcagcaccaagccccggcccccacctggcccctgggatgtgcccagccctggcctgcctgtgtctgcccccatcctggtgagaagagatgctgcccctggggccagcaagctgcgggctgtgctggagaagctgaagctgagcagagatgacatcagcacagctgctggcatggtgaagggcgtggtggaccacctgctgctgcggctgaagtgtgacagcgccttccggggcgtgggcctgctgaacacaggcagctactatgaacatgtgaagatcagcgccccaaatgaatttgatgtgatgttcaagctggaggtgccccgcatccagctggaggagtacagcaacacccgggcctactactttgtgaagttcaagaggaaccccaaggagaaccccctgagccagttcctggagggggagatcctgagcgccagcaagatgctgagcaagttcaggaagatcatcaaggaggagatcaatgacatcaaggacacagatgtgatcatgaagaggaagagaggaggcagccctgctgtgaccctgctgatcagcgagaagatctctgtggacatcaccctggccctggagagcaagagctcctggccagccagcacccaggagggcctgcgcatccagaactggctgagcgccaaggtgaggaagcagctgcggctgaagcccttctacctggtgcccaagcacgccaaggagggcaatggcttccaggaggagacctggaggctgtccttcagccacatcgagaaggagatcctgaacaaccacggcaagagcaagacctgctgtgagaacaaggaggagaagtgctgcaggaaggactgcctgaagctgatgaagtacctgctggagcagctgaaggagcgcttcaaggacaagaagcacctggacaagttcagcagctaccacgtgaagacagccttcttccaccggctgtactag

SEQ ID NO: 158380 - DNA, 1080 bp, Artificial Sequence
  Description of Artificial Sequence: Synthetic coding sequence
atgattgctgcccaggccaagctggtgtaccacctgaacaagtactacaatgagaagtgccaggccaggaaggccgccatcgccaagaccatccgggaggtgtgcaaggtggtgtctgatgtgctgaaggaggtggaggtgcaggagccccgcttcatcagcagcctgaatgagatggacaacagatatgagggcctggaggtgatcagccccacagaatttgaggtggtgctgtacctgaaccagatgggcgtcttcaactttgtggatgatggcagcctgcccggctgtgctgtgctgaagctgagtgatggcaggaagaggtccatgagcctgtgggtggagttcatcacagccagcggctacctgagcgccaggaagatccgcagccgcttccagaccctggtggcccaggccgtggacaagtgcagctacagagatgtggtgaagatggtggccgacaccagcgaggtgaagctgcgcatccgggaccgctacgtggtgcagatcaccccagccttcaagtgcaccggcatctggcccaggtctgctgcccactggcccctgccccacatcccctggccaggccccaacagagtggccgaggtgaaggccgagggcttcaacctgctgagcaaggagtgccacagcctggccggcaagcagagcagcgctgagagtgatgcctgggtgctgcagtttgctgaggccgagaaccggctgcagatgggcggctgcaggaagaagtgcctgagcatcctgaagaccctgcgggacagacacctggagctgcccggccagcccctgaacaactaccacatgaagaccctggtgtcctatgaatgtgagaagcacccccgggagagtgactgggatgagagctgcctgggggaccggctgaatggcatcctgctgcagctgatcagctgcctgcagtgccgccgctgcccccactacttcctgcccaacctggacctcttccagggcaagccccacagcgccctggagaatgctgccaagcagacctggaggctggcccgggagatcctgaccaaccccaagagcctggagaagctgtag

SEQ ID NO: 158381 - DNA, 1176 bp, Artificial Sequence
  Description of Artificial Sequence: Synthetic coding sequence
atgagcggccctgtgcccagccgggcccgggtgtacacagatgtgaacacccaccggccccgggagtactgggactatgagagccacgtggtggagtggggcaaccaggatgactaccagctggtgaggaagctgggccggggcaagtacagcgaggtgtttgaggccatcaacatcaccaacaatgagaaggtggtggtgaagatcctgaagcctgtgaagaagaagaagatcaagcgggagatcaagatcctggagaacctgcggggcggccccaacatcatcaccctggccgacatcgtgaaggaccctgtgtccaggaccccagccctggtgtttgaacatgtgaacaacacagacttcaagcagctgtaccagaccctgacagattatgacatccgcttctacatgtatgagatcctgaaggccctggactactgccacagcatgggcatcatgcacagagatgtgaagccccacaacgtgatgattgaccacgagcacaggaagctgcggctgattgactggggcctggccgagttctaccaccctggccaggagtacaacgtgcgggtggccagccgctacttcaagggccctgagctgctggtggactaccagatgtatgactacagcctggacatgtggagcctgggctgcatgctggcctccatgatcttcaggaaggagcccttcttccacggccatgacaactatgaccagctggtgagaattgccaaggtgctgggcacagaggacctgtatgactacatcgacaagtacaacatcgagctggacccccgcttcaatgacatcctgggccgccacagcaggaagcgctgggagagatttgtgcacagcgagaaccagcacctggtgtccccagaggccctggacttcctggacaagctgctgcgctatgaccaccagagccggctgacagcccgggaggccatggagcacccctacttctacacagtggtgaaggaccaggccaggatgggcagcagctccatgcctgggggcagcacccctgtgagcagcgccaacatgatgagcggcatcagctctgtgcccacccccagccccctgggccccctggccggcagccctgtgattgctgctgccaaccccctgggcatgcctgtgcctgctgctgctggggcccagcagtag

SEQ ID NO: 158382 - DNA, 1347 bp, Artificial Sequence
  Description of Artificial Sequence: Synthetic coding sequence
atgtaccccagcaacaagaagaagaaggtgtggagggaggagaaggagcggctgctgaagatgaccctggaggagaggaggaaggagtacctgcgggactacatccccctgaacagcatcctgtcctggaaggaggagatgaagggcaagggccagaatgatgaggagaacacccaggagaccagccaggtgaagaagagcctgacagagaaggtgtccctgtacagaggagacatcaccctgctggaggtggatgccatcgtgaatgctgccaatgccagcctgctgggcggcggcggcgtggatggctgcatccacagagctgctggcccctgcctgctggccgagtgcaggaacctgaatggctgtgacaccggccacgccaagatcacctgtggctatgacctgcctgccaagtatgtgatccacacagtgggccccatcgcccggggccacatcaatggcagccacaaggaggacctggccaactgctacaagagcagcctgaagctggtgaaggagaacaacatccgctctgtggccttcccctgcatcagcacaggcatctacggcttccccaatgaacctgctgctgtgattgccctgaacaccatcaaggagtggctggccaagaaccaccacgaggtggaccgcatcatcttctgtgtgttcctggaggtggacttcaagatctacaagaagaagatgaatgagttcttctctgtggatgacaacaatgaggaggaggaggatgtggagatgaaggaggacagtgatgaaaatggacctgaggagaagcagagcgtggaggagatggaggagcagagccaggatgctgatggagtgaacacagtgacagtgcccggccctgccagcgaggaggccgtggaggactgcaaggatgaggactttgccaaggatgagaacatcaccaagggcggggaggtgacagaccacagcgtgcgggaccaggaccacccagatggccaggagaatgacagcaccaagaatgagatcaagattgaaacagagagccagagcagctacatggagacagaggagctgagcagcaaccaggaggatgctgtgattgtggagcagcctgaggtgatccccctgacagaggaccaggaggagaaggagggggagaaggcccctggagaggacacccccaggatgcctgggaagtctgagggcagcagtgacctggagaacaccccaggcccagatgtggagatgaacagccaggtggacaaggtgaatgaccccacagagagccagcaggaggaccagctgattgctggggcccaggatgaggccaaggagcagagaaatggcaccaagtag

SEQ ID NO: 158383 - DNA, 642 bp, Artificial Sequence
  Description of Artificial Sequence: Synthetic coding sequence
atgaatgagttcttctctgtggatgacaacaatgaggaggaggaggatgtggagatgaaggaggacagtgatgaaaatggacctgaggagaagcagagcgtggaggagatggaggagcagagccaggatgctgatggagtgaacacagtgacagtgcccggccctgccagcgaggaggccgtggaggactgcaaggatgaagattttgccaaggatgagaacatcaccaagggcggggaggtgacagaccacagcgtgcgggaccaggaccacccagatggccaggagaatgacagcaccaagaatgagatcaagattgaaacagagagccagagcagctacatggagacagaggagctgagcagcaaccaggaggatgctgtgattgtggagcagcctgaggtgatccccctgacagaggaccaggaggagaaggagggggagaaggcccctggagaggacacccccaggatgcctgggaagtctgagggcagcagtgacctggagaacaccccaggcccagatgtggagatgaacagccaggtggacaaggtgaatgaccccacagagagccagcaggaggaccagctgattgctggggcccaggatgaggccaaggagcagagaaatggcaccaagtag

SEQ ID NO: 158384 - DNA, 642 bp, Artificial Sequence; identical to SEQ ID NO: 158383
  Description of Artificial Sequence: Synthetic coding sequence

SEQ ID NO: 158385 - DNA, 1068 bp, Artificial Sequence
  Description of Artificial Sequence: Synthetic coding sequence
atggctgtgcaggagagcgctgcccagctgtccatgaccctgaaggtgcaggagtaccccaccctgaaggtgccctatgagaccctgaacaagcgcttccgggccgcccagaagaacatcgaccgggagaccagccacgtgaccatggtggtggccgagctggagaagaccctgagcggctgcccagctgtggacagcgtggtgtccctgctggatggagtggtggagaagctgtctgtgctgaagaggaaggctgtggagagcatccaggccgaggatgaaagtgccaagctgtgcaagagaagaattgagcacctgaaggagcacagcagtgaccagcctgctgctgcctctgtgtggaagaggaagaggatggacaggatgatggtggagcacctgctgcgctgtggctactacaacacagctgtgaagctggcccggcagagcggcatcgagagctgcctggagttcagcctgcgcatccaggagttcatcgagctgatccggcagaacaagaggctggatgctgtgagacatgccaggaagcacttcagccaggccgagggcagccagctggatgaggtgcggcaggccatgggcatgctggccttccccccagacacccacatcagcccctacaaggacctgctggaccctgcccgctggaggatgctgatccagcagttccgctatgacaactaccgcctgcaccagctgggcaacaacagcgtcttcaccctgaccctgcaggccggcctgagcgccatcaagaccccccagtgctacaaggaggatggcagcagcaagagcccagactgccctgtgtgcagccgcagcctgaacaagctggcccagcccctgcccatggcccactgtgccaacagccggctggtgtgcaagatctctggagatgtgatgaatgaaaacaacccccccatgatgctgcccaacggctacgtgtatggctacaacagcctgctgagcatccggcaggatgacaaggtggtgtgccccaggaccaaggaggtgttccacttcagccaggccgagaaggtgtacatcatgtag

SEQ ID NO: 158386 - DNA, 1191 bp, Artificial Sequence
  Description of Artificial Sequence: Synthetic coding sequence
atggctgtgcaggagagcgctgcccagctgtccatgaccctgaaggtgcaggagtaccccaccctgaaggtgccctatgagaccctgaacaagcgcttccgggccgcccagaagaacatcgaccgggagaccagccacgtgaccatggtggtggccgagctggagaagaccctgagcggctgcccagctgtggacagcgtggtgtccctgctggatggagtggtggagaagctgtctgtgctgaagaggaaggctgtggagagcatccaggccgaggatgaaagtgccaagctgtgcaagagaagaattgagcacctgaaggagcacagcagtgaccagcctgctgctgcctctgtgtggaagaggaagaggatggacaggatgatggtggagcacctgctgcgctgtggctactacaacacagctgtgaagctggcccggcagagcggcatcgaggacctggtgaacatcgagatgttcctgacagccaaggaggtggaggagagcctggagcggcgggagacagccacctgcctggcctggtgccacgacaacaagagccggctgaggaagatgaagagctgcctggagttcagcctgcgcatccaggagttcatcgagctgatccggcagaacaagaggctggatgctgtgagacatgccaggaagcacttcagccaggccgagggcagccagctggatgaggtgcggcaggccatgggcatgctggccttccccccagacacccacatcagcccctacaaggacctgctggaccctgcccgctggaggatgctgatccagcagttccgctatgacaactaccgcctgcaccagctgggcaacaacagcgtcttcaccctgaccctgcaggccggcctgagcgccatcaagaccccccagtgctacaaggaggatggcagcagcaagagcccagactgccctgtgtgcagccgcagcctgaacaagctggcccagcccctgcccatggcccactgtgccaacagccggctggtgtgcaagatctctggagatgtgatgaatgaaaacaacccccccatgatgctgcccaacggctacgtgtatggctacaacagcctgctgagcatccggcaggatgacaaggtggtgtgccccaggaccaaggaggtgttccacttcagccaggccgagaaggtgtacatcatgtag

SEQ ID NO: 158387 - DNA, 987 bp, Artificial Sequence
  Description of Artificial Sequence: Synthetic coding sequence
atggctgtgcaggagagcgctgcccagctgtccatgaccctgaaggtgcaggagtaccccaccctgaaggtgccctatgagaccctgaacaagcgcttccgggccgcccagaagaacatcgaccgggagaccagccacgtgaccatggtggtggccgagctggagaagaccctgagcggctgcccagctgtggacagcgtggtgtccctgctggatggagtggtggagaagctgtctgtgctgaagaggaaggctgtggagagcatccaggccgaggatgaaagtgccaagctgtgcaagagaagaattgagcacctgaaggagcacagcagtgaccagcctgctgctgcctctgtgtggaagaggaagaggatggacaggatgatggtggagcacctgctgcgctgtggctactacaacacagctgtgaagctggcccggcagagcggcatcgagacctgcaagaaggccctgcagcccagccggcgggagcccgccggccgcggggcccctggccacggccacgccggcctgcctgcccggcatgcccacctgcctgtgcagggccccagcggcccctgcaccgtggctgatgctgaccctgctgtgcctgtgcggcagctgcccaccaccccagctgggaagcagttctgtgtgcacccccaccctgctggctggcccctgagccaccaggagcagtgctacaaggaggatggcagcagcaagagcccagactgccctgtgtgcagccgcagcctgaacaagctggcccagcccctgcccatggcccactgtgccaacagccggctggtgtgcaagatctctggagatgtgatgaatgaaaacaacccccccatgatgctgcccaacggctacgtgtatggctacaacagcctgctgagcatccggcaggatgacaaggtggtgtgccccaggaccaaggaggtgttccacttcagccaggccgagaaggtgtacatcatgtag

SEQ ID NO: 158388 - DNA, 954 bp, Artificial Sequence
  Description of Artificial Sequence: Synthetic coding sequence
atgaccctgaaggtgcaggagtaccccaccctgaaggtgccctatgagaccctgaacaagcgcttccgggccgcccagaagaacatcgaccgggagaccagccacgtgaccatggtggtggccgagctggagaagaccctgagcggctgcccagctgtggacagcgtggtgtccctgctggatggagtggtggagaagctgtctgtgctgaagaggaaggacctggtgaacatcgagatgttcctgacagccaaggaggtggaggagagcctggagcggcgggagacagccacctgcctggcctggtgccacgacaacaagagccggctgaggaagatgaagagctgcctggagttcagcctgcgcatccaggagttcatcgagctgatccggcagaacaagaggctggatgctgtgagacatgccaggaagcacttcagccaggccgagggcagccagctggatgaggtgcggcaggccatgggcatgctggccttccccccagacacccacatcagcccctacaaggacctgctggaccctgcccgctggaggatgctgatccagcagttccgctatgacaactaccgcctgcaccagctgggcaacaacagcgtcttcaccctgaccctgcaggccggcctgagcgccatcaagaccccccagtgctacaaggaggatggcagcagcaagagcccagactgccctgtgtgcagccgcagcctgaacaagctggcccagcccctgcccatggcccactgtgccaacagccggctggtgtgcaagatctctggagatgtgatgaatgaaaacaacccccccatgatgctgcccaacggctacgtgtatggctacaacagcctgctgagcatccggcaggatgacaaggtggtgtgccccaggaccaaggaggtgttccacttcagccaggccgagaaggtgtacatcatgtag

SEQ ID NO: 158389 - DNA, 1305 bp, Artificial Sequence
  Description of Artificial Sequence: Synthetic coding sequence
atggctgtgcaggagagcgctgcccagctgtccatgaccctgaaggtgcaggagtaccccaccctgaaggtgccctatgagaccctgaacaagcgcttccgggccgcccagaagaacatcgaccgggagaccagccacgtgaccatggtggtggccgagctggagaagaccctgagcggctgcccagctgtggacagcgtggtgtccctgctggatggagtggtggagaagctgtctgtgctgaagaggaaggctgtggagagcatccaggccgaggatgaaagtgccaagctgtgcaagagaagaattgagcacctgaaggagcacagcagtgaccagcctgctgctgcctctgtgtggaagaggaagaggatggacaggatgatggtggagcacctgctgcgctgtggctactacaacacagctgtgaagctggcccggcagagcggcatcgaggacctggtgaacatcgagatgttcctgacagccaaggaggtggaggagagcctggagcggcgggagacagccacctgcctggcctggtgccacgacaacaagagccggctgaggaagatgaagggccggcagaacaagcatgaggccaagacaggcaggaagagcagagctgccagcagcagccccaaggagagcctggacctgggcatggagaccctgaagggcaagccagagctgagctgcctggagttcagcctgcgcatccaggagttcatcgagctgatccggcagaacaagaggctggatgctgtgagacatgccaggaagcacttcagccaggccgagggcagccagctggatgaggtgcggcaggccatgggcatgctggccttccccccagacacccacatcagcccctacaaggacctgctggaccctgcccgctggaggatgctgatccagcagttccgctatgacaactaccgcctgcaccagctgggcaacaacagcgtcttcaccctgaccctgcaggccggcctgagcgccatcaagaccccccagtgctacaaggaggatggcagcagcaagagcccagactgccctgtgtgcagccgcagcctgaacaagctggcccagcccctgcccatggcccactgtgccaacagccggctggtgtgcaagatctctggagatgtgatgaatgaaaacaacccccccatgatgctgcccaacggctacgtgtatggctacaacagcctgctgagcatccggcaggatgacaaggtggtgtgccccaggaccaaggaggtgttccacttcagccaggccgagaaggtgtacatcatgtag

SEQ ID NO: 158390 - DNA, 1047 bp, Artificial Sequence
  Description of Artificial Sequence: Synthetic coding sequence
atggtggtggccgagctggagaagaccctgagcggctgcccagctgtggacagcgtggtgtccctgctggatggagtggtggagaagctgtctgtgctgaagaggaaggctgtggagagcatccaggccgaggatgaaagtgccaagctgtgcaagagaagaattgagcacctgaaggagcacagcagtgaccagcctgctgctgcctctgtgtggaagaggaagaggatggacaggatgatggtggagcacctgctgcgctgtggctactacaacacagctgtgaagctggcccggcagagcggcatcgaggacctggtgaacatcgagatgttcctgacagccaaggaggtggaggagagcctggagcggcgggagacagccacctgcctggcctggtgccacgacaacaagagccggctgaggaagatgaagagctgcctggagttcagcctgcgcatccaggagttcatcgagctgatccggcagaacaagaggctggatgctgtgagacatgccaggaagcacttcagccaggccgagggcagccagctggatgaggtgcggcaggccatgggcatgctggccttccccccagacacccacatcagcccctacaaggacctgctggaccctgcccgctggaggatgctgatccagcagttccgctatgacaactaccgcctgcaccagctgggcaacaacagcgtcttcaccctgaccctgcaggccggcctgagcgccatcaagaccccccagtgctacaaggaggatggcagcagcaagagcccagactgccctgtgtgcagccgcagcctgaacaagctggcccagcccctgcccatggcccactgtgccaacagccggctggtgtgcaagatctctggagatgtgatgaatgaaaacaacccccccatgatgctgcccaacggctacgtgtatggctacaacagcctgctgagcatccggcaggatgacaaggtggtgtgccccaggaccaaggaggtgttccacttcagccaggccgagaaggtgtacatcatgtag

SEQ ID NO: 158391 - DNA, 1188 bp, Artificial Sequence
  Description of Artificial Sequence: Synthetic coding sequence
atgtggaccctgcgggccaccggccgggaggtgggcagcagcagctgtgaagatactgtggcccctgtgccctatgagaccctgaacaagcgcttccgggccgcccagaagaacatcgaccgggagaccagccacgtgaccatggtggtggccgagctggagaagaccctgagcggctgcccagctgtggacagcgtggtgtccctgctggatggagtggtggagaagctgtctgtgctgaagaggaaggctgtggagagcatccaggctgaagatgagagcgccaagctgtgcaagaggcgcatcgagcacctgaaggagcacagcagtgaccagcctgctgctgcctctgtgtggaagaggaagaggatggacaggatgatggtggagcacctgctgcgctgtggctactacaacacagctgtgaagctggcccggcagagcggcatcgaggacctggtgaacatcgagatgttcctgacagccaaggaggtggaggagagcctggagcggcgggagacagccacctgcctggcctggtgccacgacaacaagagccggctgaggaagatgaagagctgcctggagttcagcctgcgcatccaggagttcatcgagctgatccggcagaacaagaggctggatgctgtgagacatgccaggaagcacttcagccaggccgagggcagccagctggatgaggtgcggcaggccatgggcatgctggccttccccccagacacccacatcagcccctacaaggacctgctggaccctgcccgctggaggatgctgatccagcagttccgctatgacaactaccgcctgcaccagctgggcaacaacagcgtcttcaccctgaccctgcaggccggcctgagcgccatcaagaccccccagtgctacaaggaggatggcagcagcaagagcccagactgccctgtgtgcagccgcagcctgaacaagctggcccagcccctgcccatggcccactgtgccaacagccggctggtgtgcaagatctctggagatgtgatgaatgaaaacaacccccccatgatgctgcccaacggctacgtgtatggctacaacagcctgctgagcatccggcaggatgacaaggtggtgtgccccaggaccaaggaggtgttccacttcagccaggccgagaaggtgtacatcatgtag

SEQ ID NO: 158392 - DNA, 987 bp, Artificial Sequence
  Description of Artificial Sequence: Synthetic coding sequence
atggctgtgcaggagagcgctgcccagctgtccatgaccctgaaggtgcaggagtaccccaccctgaaggtgccctatgagaccctgaacaagcgcttccgggccgcccagaagaacatcgaccgggagaccagccacgtgaccatggtggtggccgagctggagaagaccctgagcggctgcccagctgtggacagcgtggtgtccctgctggatggagtggtggagaagctgtctgtgctgaagaggaaggctgtggagagcatccaggccgaggatgaaagtgccaagctgtgcaagagaagaattgagcacctgaaggagcacagcagtgaccagcctgctgctgcctctgtgtggaagaggaagaggatggacaggatgatggtggagcacctgctgcgctgtggctactacaacacagctgtgaagctggcccggcagagcggcatcgagacctgcaagaaggccctgcagcccagccggcgggagcccgccggccgcggggcccctggccacggccacgccggcctgcctgcccggcatgcccacctgcctgtgcagggccccagcggcccctgcaccgtggctgatgctgaccctgctgtgcctgtgcggcagctgcccaccaccccagctgggaagcagttctgtgtgcacccccaccctgctggctggcccctgagccaccaggacacctgctacaaggaggatggcagcagcaagagcccagactgccctgtgtgcagccgcagcctgaacaagctggcccagcccctgcccatggcccactgtgccaacagccggctggtgtgcaagatctctggagatgtgatgaatgaaaacaacccccccatgatgctgcccaacggctacgtgtatggctacaacagcctgctgagcatccggcaggatgacaaggtggtgtgccccaggaccaaggaggtgttccacttcagccaggccgagaaggtgtacatcatgtag

SEQ ID NO: 158393 - DNA, 1128 bp, Artificial Sequence
  Description of Artificial Sequence: Synthetic coding sequence
atggctgtgcaggagagcgctgcccagctgtccatgaccctgaaggtgcaggagtaccccaccctgaaggtgccctatgagaccctgaacaagcgcttccgggccgcccagaagaacatcgaccgggagaccagccacgtgaccatggtggtggccgagctggagaagctgtctgtgctgaagaggaaggctgtggagagcatccaggctgaagatgagagcgccaagctgtgcaagaggcgcatcgagcacctgaaggagcacagcagtgaccagcctgctgctgcctctgtgtggaagaggaagaggatggacaggatgatggtggagcacctgctgcgctgtggctactacaacacagctgtgaagctggcccggcagagcggcatcgaggacctggtgaacatcgagatgttcctgacagccaaggaggtggaggagagcctggagcggcgggagacagccacctgcctggcctggtgccacgacaacaagagccggctgaggaagatgaagagctgcctggagttcagcctgcgcatccaggagttcatcgagctgatccggcagaacaagaggctggatgctgtgagacatgccaggaagcacttcagccaggccgagggcagccagctggatgaggtgcggcaggccatgggcatgctggccttccccccagacacccacatcagcccctacaaggacctgctggaccctgcccgctggaggatgctgatccagcagttccgctatgacaactaccgcctgcaccagctgggcaacaacagcgtcttcaccctgaccctgcaggccggcctgagcgccatcaagaccccccagtgctacaaggaggatggcagcagcaagagcccagactgccctgtgtgcagccgcagcctgaacaagctggcccagcccctgcccatggcccactgtgccaacagccggctggtgtgcaagatctctggagatgtgatgaatgaaaacaacccccccatgatgctgcccaacggctacgtgtatggctacaacagcctgctgagcatccggcaggatgacaaggtggtgtgccccaggaccaaggaggtgttccacttcagccaggccgagaaggtgtacatcatgtag

SEQ ID NO: 158394 - DNA, 1467 bp, Artificial Sequence
  Description of Artificial Sequence: Synthetic coding sequence
atggccccagctgcctggctgcggtctgctgctgcccgggccctgctgccccccatgctgctgctgctgctgcagcccccacccctgctggcccgggccctgcccccagatgcccaccacctgcatgctgagcggcggggcccccagccctggcatgctgccctgcccagcagccctgccccagccccagccacccaggaggcccccaggcctgccagcagcctgcggcccccaagatgtggggtgcctgaccccagtgatggcctgagcgccaggaaccggcagaagagatttgtgctgagcggcggccgctgggagaagacagacctgacctaccgcatcctgcgcttcccctggcagctggtgcaggagcaggtgcggcagaccatggccgaggccctgaaggtgtggagcgatgtgacccccctgaccttcacagaggtgcatgagggccgggctgacatcatgattgactttgcccgctactggcatggagatgacctgccctttgatggccctgggggcatcctggcccacgccttcttccccaagacccaccgggagggagatgtgcactttgattatgatgagacctggaccatcggagatgaccagggcacagacctgctgcaggtggccgcccatgaatttggacatgtgctgggcctgcagcacaccacagctgccaaggccctgatgtctgccttctacaccttccgctaccccctgagcctgagcccagatgactgccggggcgtgcagcacctgtatggccagccctggcccaccgtgaccagcaggaccccagccctgggcccccaggccggcatcgacaccaatgagatcgcccccctggagccagatgcccccccagatgcctgtgaggccagctttgatgctgtgtccaccatccggggggagctgttcttcttcaaggccggctttgtgtggaggctgcggggcggccagctgcagcccggctacccagccctggccagccgccactggcagggcctgcccagccctgtggatgctgcctttgaagatgcccagggccacatctggttcttccagggcgcccagtactgggtgtatgatggagagaagcctgtgctgggccctgcccccctgacagagctgggcctggtgcgcttccctgtgcatgctgccctggtgtggggccctgagaagaacaagatctacttcttccggggccgggactactggaggttccaccccagcacccggcgggtggacagccctgtgccccggcgggccacagactggaggggcgtgcccagcgagattgatgctgccttccaggatgctgatggctacgcctacttcctgcggggccgcctgtactggaagtttgatcctgtgaaggtgaaggccctggagggcttcccccggctggtgggccctgacttcttcggctgtgccgagcccgccaacaccttcctgtag

SEQ ID NO: 158395 - DNA, 1563 bp, Artificial Sequence
  Description of Artificial Sequence: Synthetic coding sequence
atgaggaacaagaagatcctgaaggaggatgagctgctgtctgagacccagcaggccgccttccaccagatcgccatggagccctttgagatcaacgtgcccaagcccaagagaagaaatggagtgaacttcagcctggccgtggtggtgatctacctgatcctgctgacagctggggccggcctgctggtggtgcaggtgctgaacctgcaggcccggctgcgggtgctggagatgtacttcctgaatgacaccctggccgctgaggacagccccagcttcagcctgctgcagagcgcccaccctggagagcacctggcccagggcgccagccggctgcaggtgctgcaggcccagctgacctgggtgcgggtgtcccatgagcacctgctgcagagggtggacaacttcacccagaaccctggcatgttccgcatcaagggggagcagggcgcccctggcctgcagggccacaagggggccatgggcatgcctggggcccctggccccccaggccccccagctgagaagggggccaagggggccatgggcagagatggagccaccggccccagcggcccccagggccccccaggagtgaagggggaggccggcctgcagggcccccagggcgcccctgggaagcagggcgccaccggcaccccaggcccccagggcgagaagggcagcaaaggagatggcggcctgattggccccaagggggagaccggcaccaagggggagaagggggacctgggcctgcccggcagcaagggggaccggggcatgaagggagatgctggggtgatgggccccccaggggcccagggcagcaaaggagactttggccggcccggccccccaggcctggccggcttccctggggccaagggggaccagggccagcccggcctgcagggcgtgcccggccccccaggagctgtgggccaccctggggccaagggggagcccggcagcgctggcagccctggccgggccggcctgcccggcagccctggcagccctggggccaccggcctgaagggcagcaaaggagacaccggcctgcagggccagcagggcaggaaaggagagagcggcgtgcccggccctgctggggtgaagggggagcagggcagccctggcctggccggccccaagggggcccctggccaggccggccagaagggggaccagggcgtgaagggcagcagtggagagcagggcgtgaagggggagaagggggagagaggagaaaattctgtgtctgtgcgcatcgtgggcagcagcaacagaggccgggcagaggtgtactacagcggcacctggggcaccatctgtgatgatgagtggcagaacagtgatgccatcgtgttctgcaggatgctgggctacagcaagggccgggccctgtacaaggtgggcgccggcaccggccagatctggctggacaacgtgcagtgccggggcacagagagcaccctgtggagctgcaccaagaacagctggggccaccacgactgcagccatgaggaggatgctggggtggagtgcagcgtgtag

SEQ ID NO: 158396 - DNA, 1329 bp, Artificial Sequence
  Description of Artificial Sequence: Synthetic coding sequence
atgtacttcctgaatgacaccctggccgctgaggacagccccagcttcagcctgctgcagagcgcccaccctggagagcacctggcccagggcgccagccggctgcaggtgctgcaggcccagctgacctgggtgcgggtgtcccatgagcacctgctgcagagggtggacaacttcacccagaaccctggcatgttccgcatcaagggggagcagggcgcccctggcctgcagggccacaagggggccatgggcatgcctggggcccctggccccccaggccccccagctgagaagggggccaagggggccatgggcagagatggagccaccggccccagcggcccccagggccccccaggagtgaagggggaggccggcctgcagggcccccagggcgcccctgggaagcagggcgccaccggcaccccaggcccccagggcgagaagggcagcaaaggagatggcggcctgattggccccaagggggagaccggcaccaagggggagaagggggacctgggcctgcccggcagcaagggggaccggggcatgaagggagatgctggggtgatgggccccccaggggcccagggcagcaaaggagactttggccggcccggccccccaggcctggccggcttccctggggccaagggggaccagggccagcccggcctgcagggcgtgcccggccccccaggagctgtgggccaccctggggccaagggggagcccggcagcgctggcagccctggccgggccggcctgcccggcagccctggcagccctggggccaccggcctgaagggcagcaaaggagacaccggcctgcagggccagcagggcaggaaaggagagagcggcgtgcccggccctgctggggtgaagggggagcagggcagccctggcctggccggccccaagggggcccctggccaggccggccagaagggggaccagggcgtgaagggcagcagtggagagcagggcgtgaagggggagaagggggagagaggagaaaattctgtgtctgtgcgcatcgtgggcagcagcaacagaggccgggcagaggtgtactacagcggcacctggggcaccatctgtgatgatgagtggcagaacagtgatgccatcgtgttctgcaggatgctgggctacagcaagggccgggccctgtacaaggtgggcgccggcaccggccagatctggctggacaacgtgcagtgccggggcacagagagcaccctgtggagctgcaccaagaacagctggggccaccacgactgcagccatgaggaggatgctggggtggagtgcagcgtgtag

SEQ ID NO: 158397 - DNA, 1356 bp, Artificial Sequence
  Description of Artificial Sequence: Synthetic coding sequence
atggagcagtgggaccacttccacaaccagcaggaggacacagacagctgcagcgagagcgtgaagtttgatgcccgctccatgacagccctgctgccccccaaccccaagaacagccccagcctgcaggagaagctgaagagcttcaaggccgccctgattgccctgtacctgctggtgtttgctgtgctgatccccctcatcggcatcgtggccgcccagctgctgaagtgggagaccaagaactgcagcgtgagcagcaccaatgccaatgacatcacccagagcctgactggaaaaggaaatgacagcgaggaggagatgaggttccaggaggtgttcatggagcacatgagcaacatggagaagaggatccagcacatcctggacatggaggccaacctgatggacacagagcacttccagaacttctccatgaccacagaccagcgcttcaatgacatcctgctgcagctgagcaccctcttcagctctgtgcagggccatggaaatgccattgatgagatcagcaagagcctcatcagcctgaacaccaccctgctggacctgcagctgaacatcgagaacctgaatggcaagatccaggagaacaccttcaagcagcaggaggagatcagcaagctggaggagcgggtgtacaacgtgtctgctgagatcatggccatgaaggaggagcaggtgcacctggagcaggagatcaagggggaggtgaaggtgctgaacaacatcaccaatgacctgcggctgaaggactgggagcacagccagaccctgaggaacatcaccctcatccagggccccccaggccccccaggagagaagggggaccggggccccactggagagagcggcccccggggcttccctggccccatcggccccccaggcctgaagggggacagaggagccatcggcttccctggcagccggggcctgcccggctacgccggccggcccggcaacagcggccccaagggccagaagggggagaagggcagcggcaacaccctgacccccttcaccaaggtgcggctggtgggcggcagcggcccccatgagggccgggtggagatcctgcacagcggccagtggggcaccatctgtgatgaccgctgggaggtgcgggtgggccaggtggtgtgccgcagcctgggctacccaggagtgcaggccgtgcacaaggccgcccacttcggccagggcaccggccccatctggctgaatgaggtgttctgcttcggccgggagagcagcattgaggagtgcaagatccggcagtggggcacccgggcctgcagccacagtgaagatgctggggtgacctgcaccctgtag

SEQ ID NO: 158398 - DNA, 1167 bp, Artificial Sequence
  Description of Artificial Sequence: Synthetic coding sequence
atggagcagtgggaccacttccacaaccagcaggaggacacagacagctgcagcgagagcgtgaagtttgatgcccgctccatgacagccctgctgccccccaaccccaagaacagccccagcctgcaggagaagctgaagagcttcaaggccgccctgattgccctgtacctgctggtgtttgctgtgctgatccccctcatcggcatcgtggccgcccagctgctgaagtgggagaccaagaactgcagcgtgagcagcaccaatgccaatgacatcacccagagcctgactggaaaaggaaatgacagcgaggaggagatgaggttccaggaggtgttcatggagcacatgagcaacatggagaagaggatccagcacatcctggacatggaggccaacctgatggacacagagcacttccagaacttctccatgaccacagaccagcgcttcaatgacatcctgctgcagctgagcaccctcttcagctctgtgcagggccatggaaatgccattgatgagatcagcaagagcctcatcagcctgaacaccaccctgctggacctgcagctgaacatcgagaacctgaatggcaagatccaggagaacaccttcaagcagcaggaggagatcagcaagctggaggagcgggtgtacaacgtgtctgctgagatcatggccatgaaggaggagcaggtgcacctggagcaggagatcaagggggaggtgaaggtgctgaacaacatcaccaatgacctgcggctgaaggactgggagcacagccagaccctgaggaacatcaccctcatccagggccccccaggccccccaggagagaagggggaccggggccccactggagagagcggcccccggggcttccctggccccatcggccccccaggcctgaagggggacagaggagccatcggcttccctggcagccggggcctgcccggctacgccggccggcccggcaacagcggccccaagggccagaagggggagaagggcagcggcaacaccctgagcacaggccccatctggctgaatgaggtgttctgcttcggccgggagagcagcattgaggagtgcaagatccggcagtggggcacccgggcctgcagccacagtgaagatgctggggtgacctgcaccctgtag

SEQ ID NO: 158399 - DNA, 1167 bp, Artificial Sequence; identical to SEQ ID NO: 158398
  Description of Artificial Sequence: Synthetic coding sequence

SEQ ID NO: 158400 - DNA, 1077 bp, Artificial Sequence
  Description of Artificial Sequence: Synthetic coding sequence
atggagcagtgggaccacttccacaaccagcaggaggacacagacagctgcagcgagagcgtgaagtttgatgcccgctccatgacagccctgctgccccccaaccccaagaacagccccagcctgcaggagaagctgaagagcttcaaggccgccctgattgccctgtacctgctggtgtttgctgtgctgatccccctcatcggcatcgtggccgcccagctgctgaagtgggagaccaagaactgcagcgtgagcagcaccaatgccaatgacatcacccagagcctgactggaaaaggaaatgacagcgaggaggagatgaggttccaggaggtgttcatggagcacatgagcaacatggagaagaggatccagcacatcctggacatggaggccaacctgatggacacagagcacttccagaacttctccatgaccacagaccagcgcttcaatgacatcctgctgcagctgagcaccctcttcagctctgtgcagggccatggaaatgccattgatgagatcagcaagagcctcatcagcctgaacaccaccctgctggacctgcagctgaacatcgagaacctgaatggcaagatccaggagaacaccttcaagcagcaggaggagatcagcaagctggaggagcgggtgtacaacgtgtctgctgagatcatggccatgaaggaggagcaggtgcacctggagcaggagatcaagggggaggtgaaggtgctgaacaacatcaccaatgacctgcggctgaaggactgggagcacagccagaccctgaggaacatcaccctcatccagggccccccaggccccccaggagagaagggggaccggggccccactggagagagcggcccccggggcttccctggccccatcggccccccaggcctgaagggggacagaggagccatcggcttccctggcagccggggcctgcccggctacgccggccggcccggcaacagcggccccaagggccagaagggggagaagggcagcggcaacaccctgcggcctgtgcagctgacagaccacatccgggccggccccagctag

SEQ ID NO: 158401 - DNA, 1410 bp, Artificial Sequence
  Description of Artificial Sequence: Synthetic coding sequence
atgtgctacctgagcgccatcatcagcatcagcctgctgaacaagaagcccagcatggagcagtgggaccacttccacaaccagcaggaggacacagacagctgcagcgagagcgtgaagtttgatgcccgctccatgacagccctgctgccccccaaccccaagaacagccccagcctgcaggagaagctgaagagcttcaaggccgccctgattgccctgtacctgctggtgtttgctgtgctgatccccctcatcggcatcgtggccgcccagctgctgaagtgggagaccaagaactgcagcgtgagcagcaccaatgccaatgacatcacccagagcctgactggaaaaggaaatgacagcgaggaggagatgaggttccaggaggtgttcatggagcacatgagcaacatggagaagaggatccagcacatcctggacatggaggccaacctgatggacacagagcacttccagaacttctccatgaccacagaccagcgcttcaatgacatcctgctgcagctgagcaccctcttcagctctgtgcagggccatggaaatgccattgatgagatcagcaagagcctcatcagcctgaacaccaccctgctggacctgcagctgaacatcgagaacctgaatggcaagatccaggagaacaccttcaagcagcaggaggagatcagcaagctggaggagcgggtgtacaacgtgtctgctgagatcatggccatgaaggaggagcaggtgcacctggagcaggagatcaagggggaggtgaaggtgctgaacaacatcaccaatgacctgcggctgaaggactgggagcacagccagaccctgaggaacatcaccctcatccagggccccccaggccccccaggagagaagggggaccggggccccactggagagagcggcccccggggcttccctggccccatcggccccccaggcctgaagggggacagaggagccatcggcttccctggcagccggggcctgcccggctacgccggccggcccggcaacagcggccccaagggccagaagggggagaagggcagcggcaacaccctgacccccttcaccaaggtgcggctggtgggcggcagcggcccccatgagggccgggtggagatcctgcacagcggccagtggggcaccatctgtgatgaccgctgggaggtgcgggtgggccaggtggtgtgccgcagcctgggctacccaggagtgcaggccgtgcacaaggccgcccacttcggccagggcaccggccccatctggctgaatgaggtgttctgcttcggccgggagagcagcattgaggagtgcaagatccggcagtggggcacccgggcctgcagccacagtgaagatgctggggtgacctgcaccctgtag

SEQ ID NO: 158402 - DNA, 195 bp, Artificial Sequence
  Description of Artificial Sequence: Synthetic coding sequence
atggagcagtgggaccacttccacaaccagcaggaggacacagacagctgcagcgagagcgtgaagtttgatgcccgctccatgacagccctgctgccccccaaccccaagaacagccccagcctgcaggagaagctgaagagcttcaaggccgccctgattgccctgtacctgctggtgtttgctgtgctgtag

SEQ ID NO: 158403 - DNA, 399 bp, Artificial Sequence
  Description of Artificial Sequence: Synthetic coding sequence
atggccatgaaggaggagcaggtgcacctggagcaggagatcaagggggaggtgaaggtgctgaacaacatcaccaatgacctgcggctgaaggactgggagcacagccagaccctgaggaacatcaccctcatccagggccccccaggccccccaggagagaagggggaccggggccccactggagagagcggcccccggggcttccctggccccatcggccccccaggcctgaagggggacagaggagccatcggcttccctggcagccggggcctgcccggctacgccggccggcccggcaacagcggccccaagggccagaagggggagaagggcagcggcaacaccctgcggcctgtgcagctgacagaccacatccgggccggccccagctag

SEQ ID NO: 158404 - DNA, 4203 bp, Artificial Sequence
  Description of Artificial Sequence: Synthetic coding sequence
atggagctgctgccccccctgccccagagcttcctgctgctgctgctgctgcctgccaagccagctgctggggaggactggcagtgccccaggaccccctatgctgccagccgggactttgatgtgaagtatgtggtgcccagcttctctgctgggggcctggtgcaggccatggtgacctatgaaggagacagaaatgaatctgctgtgtttgtggccatccggaaccggctgcacgtgctgggccctgacctgaagtctgtgcagagcctggccactggacctgctggggaccccggctgccagacctgtgccgcctgtggccctggcccccacggccccccaggggacacagacaccaaggtgctggtgctggaccctgccctgcctgccctggtgtcctgtggcagcagcctgcagggccgctgcttcctgcatgacctggagccccagggcacagctgtgcacctggccgccccagcctgcctcttcagcgcccaccacaacagaccagatgactgcccagactgtgtggccagccccctgggcaccagggtgacagtggtggagcagggccaggccagctacttctacgtggccagcagcctggatgctgctgtggccgccagcttcagccccaggtctgtgtccatccggcggctgaaggcagatgccagcggctttgcccctggctttgtggccctgtctgtgctgcccaagcacctggtgtcctacagcattgaatatgtgcacagcttccacactggagcctttgtgtacttcctgactgtgcagcctgcctctgtgacagatgaccccagcgccctgcacacccggctggcccggctgagcgccacagagcctgagctgggggactaccgggagctggtgctggactgccgctttgcccccaagagaagaagaagaggagcccctgagggcggccagccctaccctgtgctgcgggtggcccacagcgcccctgtgggcgcccagctggccacagagctgagcattgctgagggccaggaggtgctgtttggagtgtttgtgacaggcaaggatggcggccctggggtgggccccaacagcgtggtgtgtgccttccccatcgacctgctggacaccctgattgatgaaggagtggagcgctgctgtgagagccctgtgcaccctggcctgcggcggggcctggacttcttccagagccccagcttctgccccaaccccccaggcctggaggccctgagccccaacaccagctgccgccacttccccctgctggtgagcagcagcttcagccgggtggacctcttcaacggcctgctgggccctgtgcaggtgacagccctgtatgtgacccggctggacaacgtgacagtggcccacatgggcaccatggatggccgcatcctgcaggtggagctggtgcgcagcctgaactacctgctgtatgtgagcaacttcagcctgggggacagcggccagcctgtgcagagagatgtgtcccggctgggggaccacctgctgtttgccagcggggaccaggtgttccaggtgcccatccagggccctggctgccgccacttcctgacctgtggccgctgcctgcgggcctggcacttcatgggctgcggctggtgtggcaacatgtgtggccagcagaaggaatgtcctggctcctggcagcaggaccactgcccccccaagctgacagagttccacccccacagcggccccctgcggggcagcacccggctgaccctgtgtggcagcaacttctacctgcaccccagcggcctggtgcctgagggcacccaccaggtgacagtgggccagagcccctgccggcccctgcccaaggacagcagcaagctgcggcctgtgcccaggaaggactttgtggaggagtttgaatgtgagctggagcccctgggcacccaggccgtgggccccaccaacgtgtccctgactgtgaccaacatgcctcctgggaagcacttccgggtggatggcacctctgtgctgcggggcttctccttcatggagcctgtgctgattgctgtgcagcccctgtttggccccagggctgggggcacctgcctgaccctggagggccagagcctgtctgtgggcaccagcagagctgtgctggtgaatggaacagaatgtctgctggcccgggtgtctgagggccagctgctgtgtgccaccccacctggggccaccgtggcctctgtgcccctgagcctgcaggtgggcggggcccaggtgcccggctcctggaccttccagtaccgggaggaccctgtggtgctgagcatcagccccaactgtggctacatcaacagccacatcaccatctgtggccagcacctgaccagcgcctggcacctggtgctgtccttccatgatggcctgcgggctgtggagagccgctgtgagcggcagctgcctgagcagcagctgtgccgcctgcctgaatatgtggtgcgggacccccagggctgggtggccggcaacctgagcgcccggggagatggagctgctggcttcaccctgcccggcttccgcttcctgcccccaccccaccccccatctgccaacctggtgcccctgaagccagaggagcacgccatcaagtttgagtacatcggcctgggcgctgtggccgactgtgtgggcatcaacgtgacagtgggcggggagagctgccagcacgagttccggggggacatggtggtgtgccccctgccccccagcctgcagctgggccaggatggagcccccctgcaggtgtgtgtggatggagagtgccacatcctgggccgggtggtgcggcccggcccagatggagtgccccagagcaccctgctgggcatcctgctgcccctgctgctgctggtggccgccctggccacagccctggtgttctcctactggtggaggaggaagcagctggtgctgccccccaacctgaatgacctggccagcctggaccagacagctggggccacccccctgcccatcctgtacagcggcagtgactacagaagtggcctggccctgcctgccattgatggcctggacagcaccacctgtgtgcacggggccagcttcagtgacagtgaagatgagagctgtgtgcccctgctgaggaaggagagcatccagctgcgggacctggacagcgccctgctggccgaggtgaaggatgtgctgatcccccatgagcgggtggtgacccacagcgacagagtcatcggcaagggccactttggagtggtgtaccacggggagtacatcgaccaggcccagaaccgcatccagtgtgccatcaagagcctgagccgcatcacagagatgcagcaggtggaggccttcctgcgggagggcctgctgatgaggggcctgaaccaccccaacgtgctggccctgattggcatcatgctgcccccagagggcctgccccacgtgctgctgccctacatgtgccacggggacctgctgcagttcatccgcagcccccagaggaaccccaccgtgaaggacctgatcagctttggcctgcaggtggcccgctccatggagtacctggccgagcagaagtttgtgcaccgggacctggccgccaggaactgcatgctggatgagagcttcaccgtgaaggtggccgactttggcctggcccgggacatcctggaccgggagtactacagcgtgcagcagcacagacatgcccggctgcctgtgaagtggatggccctggagagcctgcagacctaccgcttcaccaccaagagtgatgtgtggagctttggagtgctgctgtgggagctgctgaccaggggggccccaccctaccgccacatcgacccctttgacctgacccacttcctggcccagggccggcggctgccccagcctgagtactgcccagacagcctgtaccaggtgatgcagcagtgctgggaggccgaccctgctgtgcggcccaccttccgggtgctggtgggggaggtggagcagatcgtgtctgccctgctgggggaccactacgtgcagctgcctgccacctacatgaacctgggccccagcaccagccatgagatgaatgtgcggcctgagcagccccagttcagccccatgcctggaaatgtgcggcggccccggcccctgtctgagcccccccggcccacctag

SEQ ID NO: 158405 - DNA, 4056 bp, Artificial Sequence
  Description of Artificial Sequence: Synthetic coding sequence
atggagctgctgccccccctgccccagagcttcctgctgctgctgctgctgcctgccaagccagctgctggggaggactggcagtgccccaggaccccctatgctgccagccgggactttgatgtgaagtatgtggtgcccagcttctctgctgggggcctggtgcaggccatggtgacctatgaaggagacagaaatgaatctgctgtgtttgtggccatccggaaccggctgcacgtgctgggccctgacctgaagtctgtgcagagcctggccactggacctgctggggaccccggctgccagacctgtgccgcctgtggccctggcccccacggccccccaggggacacagacaccaaggtgctggtgctggaccctgccctgcctgccctggtgtcctgtggcagcagcctgcagggccgctgcttcctgcatgacctggagccccagggcacagctgtgcacctggccgccccagcctgcctcttcagcgcccaccacaacagaccagatgactgcccagactgtgtggccagccccctgggcaccagggtgacagtggtggagcagggccaggccagctacttctacgtggccagcagcctggatgctgctgtggccgccagcttcagccccaggtctgtgtccatccggcggctgaaggcagatgccagcggctttgcccctggctttgtggccctgtctgtgctgcccaagcacctggtgtcctacagcattgaatatgtgcacagcttccacactggagcctttgtgtacttcctgactgtgcagcctgcctctgtgacagatgaccccagcgccctgcacacccggctggcccggctgagcgccacagagcctgagctgggggactaccgggagctggtgctggactgccgctttgcccccaagagaagaagaagaggagcccctgagggcggccagccctaccctgtgctgcgggtggcccacagcgcccctgtgggcgcccagctggccacagagctgagcattgctgagggccaggaggtgctgtttggagtgtttgtgacaggcaaggatggcggccctggggtgggccccaacagcgtggtgtgtgccttccccatcgacctgctggacaccctgattgatgaaggagtggagcgctgctgtgagagccctgtgcaccctggcctgcggcggggcctggacttcttccagagccccagcttctgccccaaccccccaggcctggaggccctgagccccaacaccagctgccgccacttccccctgctggtgagcagcagcttcagccgggtggacctcttcaacggcctgctgggccctgtgcaggtgacagccctgtatgtgacccggctggacaacgtgacagtggcccacatgggcaccatggatggccgcatcctgcaggtggagctggtgcgcagcctgaactacctgctgtatgtgagcaacttcagcctgggggacagcggccagcctgtgcagagagatgtgtcccggctgggggaccacctgctgtttgccagcggggaccaggtgttccaggtgcccatccagggccctggctgccgccacttcctgacctgtggccgctgcctgcgggcctggcacttcatgggctgcggctggtgtggcaacatgtgtggccagcagaaggaatgtcctggctcctggcagcaggaccactgcccccccaagctgacagagttccacccccacagcggccccctgcggggcagcacccggctgaccctgtgtggcagcaacttctacctgcaccccagcggcctggtgcctgagggcacccaccaggtgacagtgggccagagcccctgccggcccctgcccaaggacagcagcaagctgcggcctgtgcccaggaaggactttgtggaggagtttgaatgtgagctggagcccctgggcacccaggccgtgggccccaccaacgtgtccctgactgtgaccaacatgcctcctgggaagcacttccgggtggatggcacctctgtgctgcggggcttctccttcatggagcctgtgctgattgctgtgcagcccctgtttggccccagggctgggggcacctgcctgaccctggagggccagagcctgtctgtgggcaccagcagagctgtgctggtgaatggaacagaatgtctgctggcccgggtgtctgagggccagctgctgtgtgccaccccacctggggccaccgtggcctctgtgcccctgagcctgcaggtgggcggggcccaggtgcccggctcctggaccttccagtaccgggaggaccctgtggtgctgagcatcagccccaactgtggctacatcaacagccacatcaccatctgtggccagcacctgaccagcgcctggcacctggtgctgtccttccatgatggcctgcgggctgtggagagccgctgtgagcggcagctgcctgagcagcagctgtgccgcctgcctgaatatgtggtgcgggacccccagggctgggtggccggcaacctgagcgcccggggagatggagctgctggcttcaccctgcccggcttccgcttcctgcccccaccccaccccccatctgccaacctggtgcccctgaagccagaggagcacgccatcaagtttgaggtgtgtgtggatggagagtgccacatcctgggccgggtggtgcggcccggcccagatggagtgccccagagcaccctgctgggcatcctgctgcccctgctgctgctggtggccgccctggccacagccctggtgttctcctactggtggaggaggaagcagctggtgctgccccccaacctgaatgacctggccagcctggaccagacagctggggccacccccctgcccatcctgtacagcggcagtgactaccgcagcggcctggccctgcctgccattgatggcctggacagcaccacctgtgtgcatggagccagcttcagtgacagtgaagatgagagctgtgtgcccctgctgaggaaggagagcatccagctgcgggacctggacagcgccctgctggccgaggtgaaggatgtgctgatcccccatgagcgggtggtgacccacagcgacagagtgattggcaagggccactttggagtggtgtaccatggagagtacatcgaccaggcccagaaccgcatccagtgtgccatcaagagcctgagccgcatcacagagatgcagcaggtggaggccttcctgcgggagggcctgctgatgaggggcctgaaccaccccaacgtgctggccctgattggcatcatgctgcccccagagggcctgccccacgtgctgctgccctacatgtgccacggggacctgctgcagttcatccgcagcccccagaggaaccccaccgtgaaggacctgatcagctttggcctgcaggtggcccgctccatggagtacctggccgagcagaagtttgtgcaccgggacctggccgccaggaactgcatgctggatgagagcttcaccgtgaaggtggccgactttggcctggcccgggacatcctggaccgggagtactacagcgtgcagcagcacagacatgcccggctgcctgtgaagtggatggccctggagagcctgcagacctaccgcttcaccaccaagagtgatgtgtggagctttggagtgctgctgtgggagctgctgaccaggggggccccaccctaccgccacatcgacccctttgacctgacccacttcctggcccagggccgccgcctgccccagcctgagtactgcccagacagcctgtaccaggtgatgcagcagtgctgggaggccgaccctgctgtgcggcccaccttccgggtgctggtgggggaggtggagcagatcgtgtctgccctgctgggggaccactacgtgcagctgcctgccacctacatgaacctgggccccagcaccagccatgagatgaatgtgcggcctgagcagccccagttcagccccatgcctggaaatgtgagaagaccccggcccctgtctgagcccccccggcccacctag

SEQ ID NO: 158406 - DNA, 2157 bp, Artificial Sequence
  Description of Artificial Sequence: Synthetic coding sequence
atggaggacctgggggagaacaccatggtgctgagcaccctgcggagcctgaacaacttcatcagccagagggtggagggcggcagcggcctggacatcagcaccagcgcccctggcagcctgcagatgcagtaccagcagagcatgcagctggaggagagagctgagcagatccgcagcaagagccacctgatccaggtggagcgggagaagatgcagatggagctgagccacaagagggcccgggtggagctggagcgggccgccagcaccagcgccaggaactatgaaagagaggtggacaggaaccaggagctgctgacccgcatccggcagctgcaggagcgggaggccggggctgaggagaagatgcaggagcagctggagaggaaccggcagtgccagcagaacctggatgctgccagcaagaggctgcgggagaaggaggacagcctggcccaggccggggagaccatcaatgccctgaagggccgcatcagcgagctgcagtggagcgtgatggaccaggagatgagggtgaagaggctggagagcgagaagcaggagctgcaggagcagctggacctgcagcacaagaagtgccaggaggccaaccagaagatccaggagctgcaggccagccaggaggcccgggctgaccacgagcagcagatcaaggacctggagcagaagctgagcctgcaggagcaggatgctgccatcgtgaagaacatgaagtctgagctggtgcggctgccccggctggagcgggagctgaagcagctgcgggaggagagcgcccacctgcgggagatgagggagaccaacggcctgctgcaggaggagctggagggcctgcagaggaagctgggccggcaggagaagatgcaggagaccctggtgggcctggagctggagaatgaaaggctgctggccaagctgcagagctgggagcggctggaccagaccatgggcctgagcatccgcaccccagaggacctgagcagatttgtggtggagctgcagcagcgggagctggccctgaaggacaagaacagcgctgtgaccagcagcgcccggggcctggagaaggcccggcagcagctgcaggaggagctgcggcaggtgtctggccagctgctggaggagaggaagaagcgggagacccatgaggccctggcccggcggctgcagaagagggtgctgctgctgaccaaggagagagatggcatgagggccatcctgggcagctatgacagcgagctgaccccagctgagtacagcccccagctgaccaggaggatgagggaggccgaggacatggtgcagaaggtgcacagccacagcgctgagatggaggcccagctgagccaggccctggaggagctgggcggccagaagcagagagctgacatgctggagatggagctgaagatgctgaagagccagagcagcagcgctgagcagagcttcctgttcagccgggaggaggccgacaccctgcggctgaaggtggaggagctggagggggagaggagccggctggaggaggagaagaggatgctggaggcccagctggagcggcgggccctgcagggcgactatgaccagagcaggaccaaggtgctgcacatgagcctgaaccccacctctgtggcccggcagaggctgcgggaggaccacagccagctgcaggctgaatgtgagcggctgcggggcctgctgcgggccatggagcggggcggcaccgtgcctgctgacctggaggccgccgccgccagcctgcccagcagcaaggaggtggccgagctgaagaagcaggtggagagcgctgagctgaagaaccagaggctgaaggaggtgttccagaccaagatccaggagttcaggaaggcctgctacaccctgaccggctaccagattgacatcaccacagagaaccagtaccgcctgaccagcctgtatgcagagcaccctggggactgcctgatcttcaaggccaccagccccagcggcagcaagatgcagctgctggagacagagttcagccacacagtgggggagctgattgaggtgcacctgcggcggcaggacagcatcccagccttcctgagcagcctgaccctggagctgttcagccggcagacagtggcctag

SEQ ID NO: 158407 - DNA, 2157 bp, Artificial Sequence; identical to SEQ ID NO: 158406
  Description of Artificial Sequence: Synthetic coding sequence

SEQ ID NO: 158408 - DNA, 1881 bp, Artificial Sequence
  Description of Artificial Sequence: Synthetic coding sequence
atgctgcctgcccggggctgtgtgaggaagaggacagtgtggccccggctggcccgggtgctgattgtgaccctgctgaccctggagctgtcctatgcccccctgccctgccagctgagcggcgtgccctacaacacaggagaccctgtgggccgctgggcccggccctgcatctggccctgcccctggcacaccaccatcaatgccctgaagggccgcatcagcgagctgcagtggagcgtgatggaccaggagatgagggtgaagaggctggagagcgagaagcaggagctgcaggagcagctggacctgcagcacaagaagtgccaggaggccaaccagaagatccaggagctgcaggccagccaggaggcccgggctgaccacgagcagcagatcaaggacctggagcagaagctgagcctgcaggagcaggatgctgccatcgtgaagaacatgaagtctgagctggtgcggctgccccggctggagcgggagctgaagcagctgcgggaggagagcgcccacctgcgggagatgagggagaccaacggcctgctgcaggaggagctggagggcctgcagaggaagctgggccggcaggagaagatgcaggagaccctggtgggcctggagctggagaatgaaaggctgctggccaagctgcagagctgggagcggctggaccagaccatgggcctgagcatccgcaccccagaggacctgagcagatttgtggtggagctgcagcagcgggagctggccctgaaggacaagaacagcgctgtgaccagcagcgcccggggcctggagaaggcccggcagcagctgcaggaggagctgcggcaggtgtctggccagctgctggaggagaggaagaagcgggagacccatgaggccctggcccggcggctgcagaagagggtgctgctgctgaccaaggagagagatggcatgagggccatcctgggcagctatgacagcgagctgaccccagctgagtacagcccccagctgaccaggaggatgagggaggccgaggacatggtgcagaaggtgcacagccacagcgctgagatggaggcccagctgagccaggccctggaggagctgggcggccagaagcagagagctgacatgctggagatggagctgaagatgctgaagagccagagcagcagcgctgagcagagcttcctgttcagccgggaggaggccgacaccctgcggctgaaggtggaggagctggagggggagaggagccggctggaggaggagaagaggatgctggaggcccagctggagcggcgggccctgcagggcgactatgaccagagcaggaccaaggtgctgcacatgagcctgaaccccacctctgtggcccggcagaggctgcgggaggaccacagccagctgcaggctgaatgtgagcggctgcggggcctgctgcgggccatggagcggggcggcaccgtgcctgctgacctggaggccgccgccgccagcctgcccagcagcaaggaggtggccgagctgaagaagcaggtggagagcgctgagctgaagaaccagaggctgaaggaggtgttccagaccaagatccaggagttcaggaaggcctgctacaccctgaccggctaccagattgacatcaccacagagaaccagtaccgcctgaccagcctgtatgcagagcaccctggggactgcctgatcttcaaggccaccagccccagcggcagcaagatgcagctgctggagacagagttcagccacacagtgggggagctgattgaggtgcacctgcggcggcaggacagcatcccagccttcctgagcagcctgaccctggagctgttcagccggcagacagtggcctag

SEQ ID NO: 158409 - DNA, 2157 bp, Artificial Sequence; identical to SEQ ID NO: 158406
  Description of Artificial Sequence: Synthetic coding sequence

SEQ ID NO: 158410 - DNA, 474 bp, Artificial Sequence
  Description of Artificial Sequence: Synthetic coding sequence
atggaggacctgggggagaacaccatggtgctgagcaccctgcggagcctgaacaacttcatcagccagagggtggagggcggcagcggcctggacatcagcaccagcgcccctggcagcctgcagatgcagtaccagcagagcatgcagctggaggagagagctgagcagatccgcagcaagagccacctgatccaggtggagcgggagaagatgcagatggagctgagccacaagagggcccgggtggagctggagcgggccgccagcaccagcgccaggaactatgaaagagaggtggacaggaaccaggagctgctgacccgcatccggcagctgcaggagcgggaggccggggctgaggagaagatgcaggagcagctggagaggaaccggcagtgccagcagaacctggatgctgccagcaagaggctgcgggagaaggaggacagcctggcccaggccggggagtag

SEQ ID NO: 158411 - DNA, 810 bp, Artificial Sequence
  Description of Artificial Sequence: Synthetic coding sequence
atgagggagctggagtttgccaagctggagtgctgcctggcctggcagctgcaggccagcagaagagagctggagatggagctgaagatgctgaagagccagagcagcagcgctgagcagagcttcctgttcagccgggaggaggccgacaccctgcggctgaaggtggaggagctggagggggagaggagccggctggaggaggagaagaggatgctggaggcccagctggagcggcgggccctgcagggcgactatgaccagagcaggaccaaggtgctgcacatgagcctgaaccccacctctgtggcccggcagaggctgcgggaggaccacagccagctgcaggccgagtgtgagcggctgcggggcctgctgcgggccatggagcggggcggcaccgtgcctgctgacctggaggccgctgctgccagcctgcccagcagcaaggaggtggccgagctgaagaagcaggtggagagcgctgagctgaagaaccagaggctgaaggaggtgttccagaccaagatccaggagttcaggaaggcctgctacaccctgaccggctaccagattgacatcaccacagagaaccagtaccgcctgaccagcctgtatgcagagcaccctggggactgcctgatcttcaaggccaccagccccagcggcagcaagatgcagctgctggagacagagttcagccacacagtgggggagctgattgaggtgcacctgcggcggcaggacagcatcccagccttcctgagcagcctgaccctggagctgttcagccggcagacagtggcctag

SEQ ID NO: 158412 - DNA, 618 bp, Artificial Sequence
  Description of Artificial Sequence: Synthetic coding sequence
atggccctgcagctgagccgggagcagggcatcaccctgcggggcagcgctgagatcgtggccgagttcttctcctttggcatcaacagcatcctgtaccagaggggcatctaccccagcgagaccttcaccagggtgcagaagtatggcctgaccctgctggtgaccacagacctggagctgatcaagtacctgaacaacgtggtggagcagctgaaggactggctgtacaagtgcagcgtgcagaagctggtggtggtgatcagcaacattgaaagtggagaggtgctggagcgctggcagtttgatattgaatgtgacaagacagccaaggatgacagcgccccccgggagaagagccagaaggccatccaggatgagatccgcagcgtcatccggcagatcacagccaccgtgaccttcctgcccctgctggaggtgtcctgcagctttgacctgctgatctacacagacaaggacctggtggtgcctgagaagtgggaggagagcggcccccagttcatcaccaacagcgaggaggtgcggctgcgctccttcaccaccaccatccacaaggtgaacagcatggtggcctacaagatccctgtgaatgactag

SEQ ID NO: 158413 - DNA, 1212 bp, Artificial Sequence
  Description of Artificial Sequence: Synthetic coding sequence
atgcccaacaggaaggccagcagaaatgcctactacttctttgtgcaggagaagatccctgagctgcggcggcggggcctgcctgtggcccgggtggctgatgccatcccctactgcagcagtgactgggccaagcctgtgttcacccccctgcggcggcccggcatgctggtgcccaagcagaatgtgtccccaccagacatgtctgccctgagcctgaagggggaccaggccctgctgggcggcatcttctacttcctgaacatcttcagccacggggagctgcccccccactgtgagcagcgcttcctgccctgtgagatcggctgtgtgaagtacagcctgcaggagggcatcatggctgacttccacagcttcatcaaccctggagagatcccccggggcttccgcttccactgccaggccgccagtgacagcagccacaagatccccatcagcaactttgagcggggccacaaccaggccaccgtgctgcagaacctgtaccgcttcatccaccccaaccctggcaactggccacccatctactgcaagagtgatgacaggaccagggtgaactggtgcctgaagcacatggccaaggccagcgagatccggcaggacctgcagctgctgactgtggaggacctggtggtgggcatctaccagcagaagttcctgaaggagcccagcaagacctggatccgcagcctgctggatgtggccatgtgggactacagcagcaacacccgctgcaagtggcatgaagaaaatgacatcctcttctgtgccctggccgtgtgcaagaagatcgcctactgcatcagcaacagcctggccaccctgtttggcatccagctgacagaggcccacgtgcccctgcaggactatgaggccagcaacagcgtgacccccaagatggtggtgctggatgctggccgctaccagaagctgcgggtgggcagcagcggcttcagccacttcaacagcagcaatgaggagcagaggagcaacacccccatcggggactaccccagccgggccaagatcagcggccagaacagctctgtgcggggccggggcatcacccggctgctggagagcatcagcaacagcagcagcaacatccacaagttcagcaactgtgacaccagcctgagcccctacatgagccagaaggatggctacaagagcttcagcagcctgtcctag

SEQ ID NO: 158414 - DNA, 1305 bp, Artificial Sequence
  Description of Artificial Sequence: Synthetic coding sequence
atgcccaacaggaaggccagcagaaatgcctactacttctttgtgcaggagaagatccctgagctgcggcggcggggcctgcctgtggcccgggtggctgatgccatcccctactgcagcagtgactgggccctgctgcgggaggaggagaaggagaagtatgcagagatggcccgggagtggagggctgcccagggcaaggaccccggccccagcgagaagcagaagcctgtgttcacccccctgcggcggcccggcatgctggtgcccaagcagaatgtgagccccccagacatgtctgccctgagcctgaagggggaccaggccctgctgggcggcatcttctacttcctgaacatcttcagccatggagagctgcccccccactgtgagcagcgcttcctgccctgtgaaattggctgtgtgaagtacagcctgcaggagggcatcatggctgacttccacagcttcatcaaccctggagagatcccccggggcttccgcttccactgccaggccgccagtgacagcagccacaagatccccatcagcaactttgagcggggccacaaccaggccaccgtgctgcagaacctgtaccgcttcatccaccccaaccctggcaactggccacccatctactgcaagagtgatgacaggaccagggtgaactggtgcctgaagcacatggccaaggccagcgagatccggcaggacctgcagctgctgactgtggaggacctggtggtgggcatctaccagcagaagttcctgaaggagcccagcaagacctggatccgcagcctgctggatgtggccatgtgggactacagcagcaacacccgctgcaagtggcatgaggagaatgacatcctcttctgtgccctggccgtgtgcaagaagatcgcctactgcatcagcaacagcctggccaccctgtttggcatccagctgacagaggcccacgtgcccctgcaggactatgaggccagcaacagcgtgacccccaagatggtggtgctggatgctggccgctaccagaagctgcgggtgggcagcagcggcttcagccacttcaacagcagcaatgaggagcagaggagcaacacccccatcggggactaccccagccgggccaagatcagcggccagaacagctctgtgcggggccggggcatcacccggctgctggagagcatcagcaacagcagcagcaacatccacaagttcagcaactgtgacaccagcctgagcccctacatgagccagaaggatggctacaagagcttcagcagcctgtcctag

SEQ ID NO: 158415 - DNA, 951 bp, Artificial Sequence
  Description of Artificial Sequence: Synthetic coding sequence
atgcccaacaggaaggccagcagaaatgcctactacttctttgtgcaggagaagatccctgagctgcggcggcggggcctgcctgtggcccgggtggctgatgccatcccctactgcagcagtgactgggccaagcctgtgttcacccccctgcggcggcccggcatgctggtgcccaagcagaatgtgtccccaccagacatgtctgccctgagcctgaagggggaccaggccctgctgggcggcatcttctacttcctgaacatcttcagccacggggagctgcccccccactgtgagcagcgcttcctgccctgtgagatcggctgtgtgaagtacagcctgcaggagggcatcatggctgacttccacagcttcatcaaccctggagagatcccccggggcttccgcttccactgccaggccgccagtgacagcagccacaagatccccatcagcaactttgagcggggccacaaccaggccaccgtgctgcagaacctgtaccgcttcatccaccccaaccctggcaactggccacccatctactgcaagagtgatgacaggaccagggtgaactggtgcctgaagcacatggccaaggccagcgagatccggcaggacctgcagctgctgactgtggaggacctggtggtgggcatctaccagcagaagttcctgaaggagcccagcaagacctggatccgcagcctgctggatgtggccatgtgggactacagcagcaacacccgctgcaagtggcatgaagaaaatgacatcctcttctgtgccctggccgtgtgcaagaagatcgcctactgcatcagcaacagcctggccaccctgtttggcatccagctgacagaggcccacgtgcccctgcaggactatgaggccagcaacagcgtgacccccaagatggtggtgctggatgctggccgctaccagtag

SEQ ID NO: 158416 - DNA, 471 bp, Artificial Sequence
  Description of Artificial Sequence: Synthetic coding sequence
ctgctgcagcgctgcaagtggcatgaggagaatgacatcctcttctgtgccctggccgtgtgcaagaagatcgcctactgcatcagcaacagcctggccaccctgtttggcatccagctgacagaggcccacgtgcccctgcaggactatgaggccagcaacagcgtgacccccaagatggtggtgctggatgctggccgctaccagaagctgcgggtgggcagcagcggcttcagccacttcaacagcagcaatgaggagcagaggagcaacacccccatcggggactaccccagccgggccaagatcagcggccagaacagctctgtgcggggccggggcatcacccggctgctggagagcatcagcaacagcagcagcaacatccacaagttcagcaactgtgacaccagcctgagcccctacatgagccagaaggatggctacaagagcttcagcagcctgtcctag

SEQ ID NO: 158417 - DNA, 747 bp, Artificial Sequence
  Description of Artificial Sequence: Synthetic coding sequence
atggaccagaggcagaggcgcatcctgggccagcccctgagcatccccaccagccagcccaagcagaagaggacctccatgatctccttcttcagcaaggtgtcctggaagctgcgcttccagaagcgggagcccctgaagaatgtgttcttcatcctggccgagcgggcccgggaccccagcgccaagaagaggcacatggccatgaggaacctgggcaccatggcctatgaggccccagacaaggtgaggaagtacaagaagatcgtgctggacctgctggtgtatggcctgtatgaccctgtgaacctggaggtgatccacgagagcatgaagaccctgactgtggtgctgggcaagatccagggcaagggcctgggcagcttcttcatcgacatcaccctgcagaccaggaccctgctggatgatgaaaatgacagcctgcgctacagcgcctttgtgctgtttggccagctggccgcctttgctggcaggaagtggaagaagttcttcaccagccaggtgaagcagacccgggacagcctgctgatccacctgcaggacaggaacccccaggtggccaaggcctgcaagaccaccttccaggcctgcagcccctacctgaagctgaaggaggagtacagcttccagagcgaggaggaccagaggaacaccaagctgtaccagcagctgagccactaccaccctgagatcctgcagttcttctacgccaacaagatcctgtag

SEQ ID NO: 158418 - DNA, 747 bp, Artificial Sequence; identical to SEQ ID NO: 158417
  Description of Artificial Sequence: Synthetic coding sequence

SEQ ID NO: 158419 - DNA, 591 bp, Artificial Sequence
  Description of Artificial Sequence: Synthetic coding sequence
atggaccagaggcagaggcgcatcctgggccagcccctgagcatccccaccagccagcccaagcagaagaggacctccatgatctccttcttcagcaaggtgtcctggaagctgcgcttccagaagcgggagcccctgaagaatgtgttcttcatcctggccgagcgggcccgggaccccagcgccaagaagaggcacatggccatgaggaacctgggcaccatggcctatgaggccccagacaaggtgaggaagtacaagaagatcgtgctggacctgctggtgtatggcctgtatgaccctgtgaacctggaggtgatccacgagagcatgaagaccctgactgtggtgctgggcaagatccagggcaagggcctgggcagcttcttcatcgacatcaccctgcagaccaggaccctgctggatgatgcctgcaagaccaccttccaggcctgcagcccctacctgaagctgaaggaggagtacagcttccagagcgaggaggaccagaggaacaccaagctgtaccagcagctgagccactaccaccctgagatcctgcagttcttctacgccaacaagatcctgtag

SEQ ID NO: 158420 - DNA, 633 bp, Artificial Sequence
  Description of Artificial Sequence: Synthetic coding sequence
atggcctggggcagcaagggcatccagggctgggagaacctggccgagagcagccacctggccaccacccgggagagcagccccccagagagcggcactggaagtggcagcagccggggcagccggctgcaggagccccaggtgtcctggaagctgcgcttccagaagcgggagcccctgaagaatgtgttcttcatcctggccgagcgggcccgggaccccagcgccaagaagaggcacatggccatgaggaacctgggcaccatggcctatgaggccccagacaaggtgaggaagtacaagaagatcgtgctggacctgctggtgtatggcctgtatgaccctgtgaacctggaggtgatccacgagagcatgaagaccctgactgtggtgctgggcaagatccagggcaagggcctgggcagcttcttcatcgacatcaccctgcagaccaggaccctgctggatgatgcctgcaagaccaccttccaggcctgcagcccctacctgaagctgaaggaggagtacagcttccagagcgaggaggaccagaggaacaccaagctgtaccagcagctgagccactaccaccctgagatcctgcagttcttctacgccaacaagatcctgtag

SEQ ID NO: 158421 - DNA, 789 bp, Artificial Sequence
  Description of Artificial Sequence: Synthetic coding sequence
atggcctggggcagcaagggcatccagggctgggagaacctggccgagagcagccacctggccaccacccgggagagcagccccccagagagcggcactggaagtggcagcagccggggcagccggctgcaggagccccaggtgtcctggaagctgcgcttccagaagcgggagcccctgaagaatgtgttcttcatcctggccgagcgggcccgggaccccagcgccaagaagaggcacatggccatgaggaacctgggcaccatggcctatgaggccccagacaaggtgaggaagtacaagaagatcgtgctggacctgctggtgtatggcctgtatgaccctgtgaacctggaggtgatccacgagagcatgaagaccctgactgtggtgctgggcaagatccagggcaagggcctgggcagcttcttcatcgacatcaccctgcagaccaggaccctgctggatgatgaaaatgacagcctgcgctacagcgcctttgtgctgtttggccagctggccgcctttgctggcaggaagtggaagaagttcttcaccagccaggtgaagcagacccgggacagcctgctgatccacctgcaggacaggaacccccaggtggccaaggcctgcaagaccaccttccaggcctgcagcccctacctgaagctgaaggaggagtacagcttccagagcgaggaggaccagaggaacaccaagctgtaccagcagctgagccactaccaccctgagatcctgcagttcttctacgccaacaagatcctgtag

SEQ ID NO: 158422 - DNA, 591 bp, Artificial Sequence; identical to SEQ ID NO: 158419
  Description of Artificial Sequence: Synthetic coding sequence

SEQ ID NO: 158423 - DNA, 771 bp, Artificial Sequence
  Description of Artificial Sequence: Synthetic coding sequence
atgaagctgctggagaacagcagctttgaggccatcaacagccagctgactgtggagactggagatgcccacatcatcggcagaattgagagctacagctgcaagatggctggagatgacaagcacatgttcaagcagttctgccaggagggccagccccacgtgctggaggccctgagccccccccagaccagcggcctgagccccagccggctgagcaagagccagggcggggaggaggagggccccctgagtgacaagtgcagcaggaagaccctcttctacctgattgccaccctgaatgaaagcttccggccagactatgacttcagcacagcccggagccatgagttcagccgggagcccagcctgtcctgggtggtgaatgctgtgaactgcagcctcttctctgctgtgcgggaggacttcaaggacctgaagccccagctgtggaatgctgtggatgaggagatctgcctggccgagtgtgacatctacagctacaacccagacctggacagcgacccctttggagaagatggcagcctgtggagcttcaactacttcttctacaacaagaggctgaagagaattgtgttcttcagctgccgcagcatcagcggcagcacctacacccccagcgaggccggaaatgagctggacatggagctgggggaggaggaggtggaggaggagagccgcagcggcggcagcggggctgaggagaccagcaccatggaggaggacagagtgcctgtgatctgcatctag

SEQ ID NO: 158424 - DNA, 213 bp, Artificial Sequence
  Description of Artificial Sequence: Synthetic coding sequence
atgaagctgctggagaacagcagctttgaggccatcaacagccagctgactgtggagactggagatgcccacatcatcggcagaattgagagctacagctgcaagatggctggagatgacaagcacatgttcaagcagttctgccaggagggccagccccacgtgctggaggccctgagccccccccagaccagcggcctgagccccagctag

SEQ ID NO: 158425 - DNA, 771 bp, Artificial Sequence; identical to SEQ ID NO: 158423
  Description of Artificial Sequence: Synthetic coding sequence

SEQ ID NO: 158426 - DNA, 1104 bp, Artificial Sequence
  Description of Artificial Sequence: Synthetic coding sequence
atgaggaagggcaagggccccatctgcctcttcagccggcccaccctgcggcccagccgcagcaaggtgtccctcatcgagggccgcggggccaacatggccgcccgctggaggttctggtgtgtgtctgtgaccatggtggtggccctgctgattgtgtgtgatgtgcccagcgccagcgcccagaggaagaaggagatggtgctgtctgagaaggtgtcccagctgatggagtggaccaacaagaggcctgtgatccgcatgaatggagacaagttccggcggctggtgaaggccccacccaggaactacagcgtgattgtgatgttcaccgccctgcagctgcaccggcagtgtgtggtgtgcaagcaggctgatgaggagttccagatcctggccaacagctggagatacagcagcgccttcaccaaccgcatcttctttgccatggtggactttgatgagggcagtgatgtgttccagatgctgaacatgaacagcgcccccaccttcatcaacttccctgccaagggcaagcccaagagaggagacacctatgagctgcaggtgcggggcttctctgctgagcagatcgcccgctggattgctgacagaacagatgtgaacatccgggtcatccggccccccaactatgccggccccctgatgctgggcctgctgctggccgtgattggaggcctggtgtacctgcggcgcagcaacatggagttcctgttcaacaagacaggctgggcctttgctgccctgtgctttgtgctggccatgaccagcggccagatgtggaaccacatccggggccccccctatgcccacaagaacccccacactggacatgtgaactacatccacggcagcagccaggcccagtttgtggccgagacccacatcgtgctgctcttcaacggcggcgtgaccctgggcatggtgctgctgtgtgaggccgccaccagtgacatggacatcggcaagaggaagatcatgtgtgtggccggcatcggcctggtggtgctcttcttctcctggatgctgagcatcttccgcagcaagtaccacggctacccctacagcttcctgatgtcctag

SEQ ID NO: 158427 - DNA, 657 bp, Artificial Sequence
  Description of Artificial Sequence: Synthetic coding sequence
atggtggactttgatgagggcagtgatgtgttccagatgctgaacatgaacagcgcccccaccttcatcaacttccctgccaagggcaagcccaagagaggagacacctatgagctgcaggtgcggggcttctctgctgagcagatcgcccgctggattgctgacagaacagatgtgaacatccgggtcatccggccccccaactatgccggccccctgatgctgggcctgctgctggccgtcatcggcggcctggtgtacctgcggcgcagcaacatggagttcctgttcaacaagacaggctgggcctttgctgccctgtgctttgtgctggccatgaccagcggccagatgtggaaccacatccggggccccccctatgcccacaagaacccccacacaggccacgtgaactacatccacggcagcagccaggcccagtttgtggccgagacccacatcgtgctgctcttcaatggaggagtgaccctgggcatggtgctgctgtgtgaggccgccaccagtgacatggacatcggcaagaggaagatcatgtgtgtggccggcatcggcctggtggtgctcttcttctcctggatgctgagcatcttccgcagcaagtaccacggctacccctacagcttcctgatgtcctag

SEQ ID NO: 158428 - DNA, 330 bp, Artificial Sequence
  Description of Artificial Sequence: Synthetic coding sequence
atggagagtgacttctacctgcgctactacgtgggccacaagggcaagtttggacatgagttcctggagtttgagttccggccagatggcaagctgcgctatgccaacaacagcaactacaagaatgatgtgatgatcaggaaggaggagctggagatcgtgattggagatgagcacatctccttcaccaccagcaagattggcagcctgattgatgtgaaccagagcaaggaccctgagggcctgcgggtcttctactacctggtgcaggacctgaagtgcctggtgttcagcctcatcggcctgcacttcaagatcaagcccatctag

SEQ ID NO: 158429 - DNA, 441 bp, Artificial Sequence
  Description of Artificial Sequence: Synthetic coding sequence
atggagagtgacttctacctgcgctactacgtgggccacaagggcaagtttggacatgagttcctggagtttgagttccggccagatggcaagctgcgctatgccaacaacagcaactacaagaatgatgtgatgatcaggaaggaggcctacgtgcacaagtctgtgatggaggagctgaagaggatcattgatgattctgagatcaccaaggaggatgatgccctgtggcccccaccagacagagtgggccggcaggagctggagatcgtgattggagatgagcacatctccttcaccaccagcaagattggcagcctgattgatgtgaaccagagcaaggaccctgagggcctgcgggtcttctactacctggtgcaggacctgaagtgcctggtgttcagcctgattggcctgcacttcaagatcaagcccatctag

SEQ ID NO: 158430 - DNA, 1731 bp, Artificial Sequence
  Description of Artificial Sequence: Synthetic coding sequence
atgggcagcatcctgagcagaagaattgctggggtggaggacatcgacatccaggccaacagcgcctaccgctacccacccaagagcggcaactactttgccagccacttcttcatgggcggggagaagtttgacaccccccaccctgagggctacctgtttggagagaacatggacctgaacttcctgggcagcaggcctgtgcagttcccctacgtgaccccagcccctcatgagcctgtgaagaccctgcggagcctggtgaacatcaggaaggacagcctgcggctggtgcgctacaaggatgatgctgacagccccacagaagatggagacaagccccgggtgctgtacagcctggagttcacctttgatgctgatgcccgggtggccatcaccatctactgccaggccagcgaggagttcctgaatggccgggctgtgtacagccccaagagccccagcctgcagagcgagaccgtgcactacaagaggggcgtgtcccagcagttcagcctgcccagcttcaagattgacttcagcgagtggaaggatgatgagctgaactttgacctggacagaggagtcttccctgtggtgatccaggccgtggtggatgaaggagatgtggtggaggtgacaggccacgcccacgtgctgctggccgcctttgagaagcacatggatggcagcttctctgtgaagcccctgaagcagaagcagatcgtggacagagtgtcctacctgctgcaggagatctacggcatcgagaacaagaacaaccaggagaccaagcccagtgatgatgagaacagcgacaacagcaatgaatgtgtggtgtgcctgagtgacctgcgggacaccctcatcctgccctgccgccacctgtgcctgtgcaccagctgtgccgacaccctgcgctaccaggccaacaactgccccatctgccgcctgcccttccgggccctgctgcagatccgggctgtgaggaagaagccaggggccctgagccctgtgtccttcagccctgtgctggcccagagcctggagcatgatgagcacagctgccccttcaagaagagcaagccccacccagccagcctggccagcaagaagcccaagcgggagaccaacagcgacagcgtgcccccaggctatgagcccatcagcctgctggaggccctgaatggcctgcgggctgtgtccccagccatccccagcgcccccctgtatgaggagatcacctacagcggcatcagtgatggcctgagccaggccagctgccccctggccgccatcgaccacatcctggacagcagccggcagaagggccggccccagagcaaggccccagacagcaccctgcggagccccagcagccccatccatgaagaagatgaggagaagctgtctgaagatgtggatgcccccccacccctgggcggcgctgagctggccctgcgggagagcagcagccctgagagcttcatcacagaggaggtggatgagagcagcagcccccagcagggcaccagggctgccagcattgaaaatgtgctgcaggacagcagccctgagcactgcggccggggccccccagctgacatctacctgcccggccggcccacctccatggagacagcccacggcctggccaccaccagccccacctggccacccctgggcggccccagcccagaccccagcgctgctgagctgacccccctgtag

SEQ ID NO: 158431 - DNA, 1659 bp, Artificial Sequence
  Description of Artificial Sequence: Synthetic coding sequence
atgggcagcatcctgagcagaagaattgctggggtggaggacatcgacatccaggccaacagcgcctaccgctacccacccaagagcggcaactactttgccagccacttcttcatgggcggggagaagtttgacaccccccaccctgagggctacctgtttggagagaacatggacctgaacttcctgggcagcaggcctgtgcagttcccctacgtgaccccagcccctcatgagcctgtgaagaccctgcggagcctggtgaacatcaggaaggacagcctgcggctggtgcgctacaaggatgatgctgacagccccacagaagatggagacaagccccgggtgctgtacagcctggagttcacctttgatgctgatgcccgggtggccatcaccatctactgccaggccagcgaggagttcctgaatggccgggctgtgtacagccccaagagccccagcctgcagagcgagaccgtgcactacaagaggggcgtgtcccagcagttcagcctgcccagcttcaagattgacttcagcgagtggaaggatgatgagctgaactttgacctggacagaggagtcttccctgtggtgatccaggccgtggtggatgaaggagatgtggtggaggtgacaggccacgcccacgtgctgctggccgcctttgagaagcacatggatggcagcttctctgtgaagcccctgaagcagaagcagatcgtggacagagtgtcctacctgctgcaggagatctacggcatcgagaacaagaacaaccaggagaccaagcccagtgatgatgagaacagcgacaacagcaatgaatgtgtggtgtgcctgagtgacctgcgggacaccctcatcctgccctgccgccacctgtgcctgtgcaccagctgtgccgacaccctgcgctaccaggccaacaactgccccatctgccgcctgcccttccgggccctgctgcagatccgggctgtgaggaagaagccaggggccctgagccctgtgtccttcagccctgtgctggcccagagcctggagcatgatgagcacagctgccccttcaagaagagcaagccccacccagccagcctggccagcaagaagcccaagcgggagaccaacagcgacagcgtgcccccaggctatgagcccatcagcctgctggaggccctgaatggcctgcgggctgtgtccccagccatccccagcgcccccctgtatgaggagatcacctacagcggcatcagtgatggcctgagccaggccagctgccccctggccgccatcgaccacatcctggacagcagccggcagaagggccggccccagagcaaggccccagacagcaccctgcggagccccagcagccccatccatgaagaagatgaggagaagctgtctgaagatgtggatgcccccccacccctgggcggcgctgagctggccctgcgggagagcagcagccctgagagcttcatcacagaggaggtggatgagagcagcagcccccagcagggcaccagggctgccagcattgaaaatgtgctgcaggacagcagccctgagcactgcggccggggccccccagctgacatctacctgcctgccctgggccctgacagctgcagcgtgggcattgatgaatag

SEQ ID NO: 158432 - DNA, 1596 bp, Artificial Sequence
  Description of Artificial Sequence: Synthetic coding sequence
atgggcagcatcctgagcagaagaattgctggggtggaggacatcgacatccaggccaacagcgcctaccgctacccacccaagagcggcaactactttgccagccacttcttcatgggcggggagaagtttgacaccccccaccctgagggctacctgtttggagagaacatggacctgaacttcctgggcagcaggcctgtgcagttcccctacgtgaccccagcccctcatgagcctgtgaagaccctgcggagcctggtgaacatcaggaaggacagcctgcggctggtgcgctacaaggatgatgctgacagccccacagaagatggagacaagccccgggtgctgtacagcctggagttcacctttgatgctgatgcccgggtggccatcaccatctactgccaggccagcgaggagttcctgaatggccgggctgtgtacagccccaagagccccagcctgcagagcgagaccgtgcactacaagaggggcgtgtcccagcagttcagcctgcccagcttcaagattgacttcagcgagtggaaggatgatgagctgaactttgacctggacagaggagtcttccctgtggtgatccaggccgtggtggatgaaggagatgctgtggtggaggtgactggacatgcccacgtgctgctggccgcctttgagaagcacatggatggcagcttctctgtgaagcccctgaagcagaagcagatcgtggacagagtgtcctacctgctgcaggagatctatggaattgagaacaagaacaaccaggagaccaagcccagtgatgatgaaaattctgacaacagcaatgaatgtgtggtgtgcctgagtgacctgcgggacaccctcatcctgccctgccgccacctgtgcctgtgcaccagctgtgccgacaccctgcgctaccaggccaacaactgccccatctgccgcctgcccttccgggccctgctgcagatccgggctgtgaggaagaagccaggggccctgagccctgtgtccttcagccctgtgctggcccagagcctggagcatgatgagcacagcaacagcgacagcgtgcccccaggctatgagcccatcagcctgctggaggccctgaatggcctgcgggctgtgtccccagccatccccagcgcccccctgtatgaggagatcacctacagcggcatcagtgatggcctgagccaggccagctgccccctggccgccatcgaccacatcctggacagcagccggcagaagggccggccccagagcaaggccccagacagcaccctgcggagccccagcagccccatccacgaggaggatgaggagaagctgtctgaagatgtggatgcccccccacccctgggcggcgctgagctggccctgcgggagagcagcagccctgagagcttcatcacagaggaggtggatgagagcagcagcccccagcagggcacccgggccgccagcattgaaaatgtgctgcaggacagcagccctgagcactgcggccggggccccccagctgacatctacctgcctgccctgggccctgacagctgcagcgtgggcattgatgaatag

SEQ ID NO: 158433 - DNA, 963 bp, Artificial Sequence
  Description of Artificial Sequence: Synthetic coding sequence
atgggcagcatcctgagcagaagaattgctggggtggaggacatcgacatccaggccaacagcgcctaccgctacccacccaagagcggcaactactttgccagccacttcttcatgggcggggagaagtttgacaccccccaccctgagggctacctgtttggagagaacatggacctgaacttcctgggcagcaggcctgtgcagttcccctacgtgaccccagcccctcatgagcctgtgaagaccctgcggagcctggtgaacatcaggaaggacagcctgcggctggtgcgctacaaggatgatgctgacagccccacagaagatggagacaagccccgggtgctgtacagcctggagttcacctttgatgctgatgcccgggtggccatcaccatctactgccaggccagcgaggagttcctgaatggccgggctgtgtacagccccaagagccccagcctgcagagcgagaccgtgcactacaagaggggcgtgtcccagcagttcagcctgcccagcttcaagattgacttcagcgagtggaaggatgatgagctgaactttgacctggacagaggagtcttccctgtggtgatccaggccgtggtggatgaaggagatgtggtggaggtgacaggccacgcccacgtgctgctggccgcctttgagaagcacatggatggcagcttctctgtgaagcccctgaagcagaagcagatcgtggacagagtgtcctacctgctgcaggagatctacggcatcgagaacaagaacaaccaggagaccaagcccagtgatgatgagaacagcgacaacagcaatgaatgtgtggtgtgcctgagtgacctgcgggacaccctcatcctgccctgccgccacctgtgcctgtgcaccagctgtgccgacaccctgcgctaccaggccaacaactgccccatctgccgcctgcagctgtag

SEQ ID NO: 158434 - DNA, 1632 bp, Artificial Sequence
  Description of Artificial Sequence: Synthetic coding sequence
atggccaagggggagggcgctgagagcggcagcgctgctggcctgctgcccaccagcatcctgcagagcacagagaggcctgcccaggtgaagaaggagcccaagaagaagaagcagcagctgtctgtgtgcaacaagctgtgctacgccctgggcggggccccctaccaggtgacaggctgtgccctgggcttcttcctgcagatctacctgctggatgtggcccagaaggatgaggaggtggtgttctgcttcagcagcttccaggtgggccccttcagcgccagcatcatcctgtttgtgggccgggcctgggatgccatcacagaccccctggtgggcctgtgcatcagcaagagcccctggacctgcctgggccgcctgatgccctggatcatcttcagcacccccctggccgtgattgcctacttcctgatctggtttgtgcctgacttcccccacggccagacctactggtacctgctcttctactgcctgtttgagaccatggtgacctgcttccacgtgccctacagcgccctgaccatgttcatcagcacagagcagacagagcgggacagcgccacagcctacaggatgacagtggaggtgctgggcaccgtgctgggcacagccatccagggccagatcgtgggccaggccgacaccccctgcttccaggacctgaacagcagcacagtggccagccagagcgccaaccacacccacggcaccaccagccaccgggagacccagaaggcctacctgctggccgccggggtcatcgtgtgcatctacatcatctgtgccgtcatcctgatcctgggcgtgcgggagcagcgggagccctatgaggcccagcagagcgagcccatcgcctacttccggggcctgcggctggtgatgagccacggcccctacatcaagctgatcaccggcttcctgttcaccagcctggccttcatgctggtggagggcaactttgtgctcttctgcacctacaccctgggcttcagaaatgagttccagaacctgctgctggccatcatgctgagcgccaccctgaccatccccatctggcagtggttcctgaccaggtttgggaagaagacagctgtgtatgtgggcatcagcagcgctgtgcccttcctgatcctggtggccctgatggagagcaacctgatcatcacctatgctgtggccgtggccgccggcatctctgtggccgccgccttcctgctgccctggagcatgctgcctgatgtgattgatgacttccacctgaagcagccccacttccacggcacagagcccatcttcttctccttctacgtgttcttcaccaagtttgccagcggcgtgtccctgggcatcagcaccctgagcctggactttgctggctaccagacccggggctgcagccagcctgagcgggtgaagttcaccctgaacatgctggtgaccatggcccccatcgtgctgatcctgctgggcctgctgctcttcaagatgtaccccattgatgaggagcggcggcggcagaacaagaaggccctgcaggccctgagagatgaggccagcagcagcggctgcagcgagacagacagcacagagctggccagcatcctgtag

SEQ ID NO: 158435 - DNA, 1593 bp, Artificial Sequence
  Description of Artificial Sequence: Synthetic coding sequence
atggccaagggggagggcgctgagagcggcagcgctgctggcctgctgcccaccagcatcctgcagagcacagagaggcctgcccaggtgaagaaggagcccaagaagaagaagcagcagctgtctgtgtgcaacaagctgtgctacgccctgggcggggccccctaccaggtgacaggctgtgccctgggcttcttcctgcagatctacctgctggatgtggcccaggtgggccccttcagcgccagcatcatcctgtttgtgggccgggcctgggatgccatcacagaccccctggtgggcctgtgcatcagcaagagcccctggacctgcctgggccgcctgatgccctggatcatcttcagcacccccctggccgtcatcgcctacttcctgatctggtttgtgcctgacttcccccacggccagacctactggtacctgctcttctactgcctgtttgagaccatggtgacctgcttccacgtgccctacagcgccctgaccatgttcatcagcacagagcagacagagcgggacagcgccacagcctacaggatgacagtggaggtgctgggcaccgtgctgggcacagccatccagggccagatcgtgggccaggccgacaccccctgcttccaggacctgaacagcagcacagtggccagccagagcgccaaccacacccacggcaccaccagccaccgggagacccagaaggcctacctgctggccgccggcgtgattgtgtgcatctacatcatctgtgctgtgatcctgatcctgggcgtgcgggagcagcgggagccctatgaggcccagcagagcgagcccatcgcctacttccggggcctgcggctggtgatgagccacggcccctacatcaagctgatcaccggcttcctgttcaccagcctggccttcatgctggtggagggcaactttgtgctcttctgcacctacaccctgggcttcagaaatgagttccagaacctgctgctggccatcatgctgagcgccaccctgaccatccccatctggcagtggttcctgaccaggtttgggaagaagacagctgtgtatgtgggcatcagcagcgctgtgcccttcctgatcctggtggccctgatggagagcaacctgatcatcacctatgctgtggccgtggccgccggcatctctgtggccgccgccttcctgctgccctggagcatgctgcctgatgtgattgatgacttccacctgaagcagccccacttccatggaacagagcccatcttcttctccttctacgtgttcttcaccaagtttgccagcggcgtgtccctgggcatcagcaccctgagcctggactttgctggctaccagacccggggctgcagccagcctgagcgggtgaagttcaccctgaacatgctggtgaccatggcccccatcgtgctgatcctgctgggcctgctgctcttcaagatgtaccccattgatgaggagcggcggcggcagaacaagaaggccctgcaggccctgagagatgaggccagcagcagcggctgcagcgagacagacagcacagagctggccagcatcctgtag

SEQ ID NO: 158436 - DNA, 1125 bp, Artificial Sequence
  Description of Artificial Sequence: Synthetic coding sequence
atggtgacctgcttccacgtgccctacagcgccctgaccatgttcatcagcacagagcagacagagcgggacagcgccacagcctacaggatgacagtggaggtgctgggcaccgtgctgggcacagccatccagggccagatcgtgggccaggccgacaccccctgcttccaggacctgaacagcagcacagtggccagccagagcgccaaccacacccacggcaccaccagccaccgggagacccagaaggcctacctgctggccgccggcgtgattgtgtgcatctacatcatctgtgctgtgatcctgatcctgggcgtgcgggagcagcgggagccctatgaggcccagcagagcgagcccatcgcctacttccggggcctgcggctggtgatgagccacggcccctacatcaagctgatcaccggcttcctgttcaccagcctggccttcatgctggtggagggcaactttgtgctcttctgcacctacaccctgggcttcagaaatgagttccagaacctgctgctggccatcatgctgagcgccaccctgaccatccccatctggcagtggttcctgaccaggtttgggaagaagacagctgtgtatgtgggcatcagcagcgctgtgcccttcctgatcctggtggccctgatggagagcaacctgatcatcacctatgctgtggccgtggccgccggcatctctgtggccgccgccttcctgctgccctggagcatgctgcctgatgtgattgatgacttccacctgaagcagccccacttccatggaacagagcccatcttcttctccttctacgtgttcttcaccaagtttgccagcggcgtgtccctgggcatcagcaccctgagcctggactttgctggctaccagacccggggctgcagccagcctgagcgggtgaagttcaccctgaacatgctggtgaccatggcccccatcgtgctgatcctgctgggcctgctgctcttcaagatgtaccccattgatgaggagcggcggcggcagaacaagaaggccctgcaggccctgagagatgaggccagcagcagcggctgcagcgagacagacagcacagagctggccagcatcctgtag

SEQ ID NO: 158437 - DNA, 801 bp, Artificial Sequence
  Description of Artificial Sequence: Synthetic coding sequence
atggccaagggggagggcgctgagagcggcagcgctgctggcctgctgcccaccagcatcctgcagagcacagagaggcctgcccagaaggagcccaagaagaagaagcagcagctgtctgtgtgcaacaagctgtgctacgccctgggcggggccccctaccaggtgacaggctgtgccctgggcttcttcctgcagatctacctgctggatgtggcccaggtgggccccttcagcgccagcatcatcctgtttgtgggccgggcctgggatgccatcacagaccccctggtgggcctgtgcatcagcaagagcccctggacctgcctgggccgcctgatgccctggatcatcttcagcacccccctggccgtcatcgcctacttcctgatctggtttgtgcctgacttcccccacggccagacctactggtacctgctcttctactgcctgtttgagaccatggtgacctgcttccacgtgccctacagcgccctgaccatgttcatcagcacagagcagacagagcgggacagcgccacagcctacaggatgacagtggaggtgctgggcaccgtgctgggcacagccatccagggccagatcgtgggccaggccgacaccccctgcttccaggacctgaacagcagcacagtggccagccagagcgccaaccacacccacggcaccaccagccaccgggagacccagaaggcctacctgctggccgccggcgtgattgtgtgcatctacatcatctgtgctgtgatcctgatcctgggcgtgcgggagcagaggtag

SEQ ID NO: 158438 - DNA, 2376 bp, Artificial Sequence
  Description of Artificial Sequence: Synthetic coding sequence
atggctgatgacaaggtggccatcctgacagatgatgaggaggagcagaagaggaaatatgtgctggccgaccccttcaacggcatcagccgggagcctgagccccccagcaatgagacccccagcagcacagagaccagcgccatccctgaggaggagattgactggattgagaagcactgtgtgaagatcaacaatgacctgctgatcagcaaggtgttctacttcttcttctacagcgcctacggcagcctgtaccccctgctgcctgtgtactacaagcagctgggcatgagccccagccagagcggcctgctggtgggcatccgctacttcatcgagttctgcagcgcccccttctggggcgtggtggccgaccgcttcaagaagggcaagatcgtgctgctcttcagcctgctgtgctgggtgctcttcaacctgggcattggatttgtgaagccagccaccctgcgctgtgtgcccaagatccggcccaccacccaccccaccaatgccagccaccagctgaccatcctgcccaccaacagcagcttcaccagcttcctgaccatcagccccaagatgagggagaagaggaacctgctggagacccggctgaatgtgtctgacacagtgaccctgcccacagcccccaacatgaacagcgagcccaccctgcagccccagacaggagagatcaccaacaggatgatggacctgaccctgaacagcagcacagccacccctgtgtccccaggctctgtgaccaaggagaccaccaccgtgattgtgaccaccaccaagagcctgcccagcgaccaggtgatgctggtgtatgaccagcaggaggtggaggccatcttcctggtgatcctggtggtggtgatcattggagagttcttcagcgccagctctgtgaccatcgtggacacagtgaccctgcagtacctgggcaagcaccgggacagatatggcctgcagaggatgtggggcagcctgggctggggcctggccatgctgtctgtgggcatcggcatcgactacacccacatcgaggtgctgattgatggcaagggctgcaagcccccagagtacagaaactaccagatcgtgttcatcgtgtttggagtgctgatgaccatggccctgattgtggccacccagttccgcttccgctacaaccacttcaagaatgatgacagcaagggcaaggaggtggagatcccccaggtggagaggaacaacagcacagagagcagcgaggagacccccaccaccaccagccacagccaggccttcaacttctgggacctgatcaagctgctgtgcagcgtgcagtatggctctgtgctgtttgtggcctggttcatgggcttcggctacggctttgtgttcaccttcctgtactggcacctggaggacctgaatggcaccaccaccctgtttggagtgtgcagcgtgctgagccacgtgtctgagctgacagcctacttcttcagccacaagctgattgagctgattggccacatccgggtgctgtacatcggcctggcctgcaacacagcccgctacatctacatctcctacctggagaatgcctggacagtgctgcccatggaggtgctgcagggcgtgacccacgccgccatctgggccgcctgcatctcctacctgtctgctgctgtgcccccagagctgcggaccagcgcccagggcatcctgcagggcctgcacctgggcctgggccggggctgtggggccatgattggaggagtgctggtgaactactttggagctgctgccaccttccggggcatcggcatggcctgcctggtgatcctgctgctgtttgccctgatccagtggctggccgtgcctgatgaggaggaggacaagaccatgctggccgagcgcatccctgtgcccagcagccctgtgcccatcgccaccatcgacctggtgcagcagcagacagaagatgtgatgcccagaattgagccccggctgccccccaagaagaccaagcaccaggaggagcaggaggatgtgaacaagccagcctggggcgtgagcagcagcccctgggtgacctttgtgtatgccctgtaccagatcaaggagatgatgcagctgacccgggacaacagagccagcgagatccagcccctgcagggcaccaatgaaaatcgggagaacagccctgctggccgggcccagcctgtgccctgtgagacccacagcgaccccagcaggaaccagcccagcccagatgctgctgccagccagacccagaccagccctgcccaccccagcgtggacccctgcacagaggagagcgaggagcagcaggcccagctggccgccggcggccactag

SEQ ID NO: 158439 - DNA, 2376 bp, Artificial Sequence; identical to SEQ ID NO: 158438
  Description of Artificial Sequence: Synthetic coding sequence

SEQ ID NO: 158440 - DNA, 129 bp, Artificial Sequence
  Description of Artificial Sequence: Synthetic coding sequence
atggctgatgacaaggtggccatcctgacagatgatgaggaggagcagaagaggaaatatgtgctggccgaccccttcaacggcatcagccgggagcctgagccccccagcaatgagacccccagctag

SEQ ID NO: 158441 - DNA, 345 bp, Artificial Sequence
  Description of Artificial Sequence: Synthetic coding sequence
atggctgatgacaaggtggccatcctgacagatgatgaggaggagcagaagaggaaatatgtgctggccgaccccttcaacggcatcagccgggagcctgagccccccagcaatgagacccccagcagcacagagaccagcgccatccctgaggaggagattgactggattgagaagcactgtgtgaagatcaacaatgacctgctgatcagcaaggtgttctacttcttcttctacagcgcctacggcagcctgtaccccctgctgcctgtgtactacaagcagctgggcatgagccccagccagagcggcctgctggtgggcatccgctacttcattgaatag

SEQ ID NO: 158442 - DNA, 471 bp, Artificial Sequence
  Description of Artificial Sequence: Synthetic coding sequence
atggctgatgacaaggtggccatcctgacagatgatgaggaggagcagaagaggaaatatgtgctggccgaccccttcaacggcatcagccgggagcctgagccccccagcaatgagacccccagcagcacagagaccagcgccatccctgaggaggagattgactggattgagaagcactgtgtgaagatcaacaatgacctgctgatcagcaaggtgttctacttcttcttctacagcgcctacggcagcctgtaccccctgctgcctgtgtactacaagcagctgggcatgagccccagccagagcggcctgctggtgggcatccgctacttcatcgagttctgcagcgcccccttctggggcgtggtggccgaccgcttcaagaagggcaagatcgtgctgctcttcagcctgctgtgctgggtgctcttcaacctgggcattggatttgtgaagccagccacctag

SEQ ID NO: 158443 - DNA, 762 bp, Artificial Sequence
  Description of Artificial Sequence: Synthetic coding sequence
atggaggtgctgcagggcgtgacccacgccgccatctgggccgcctgcatctcctacctgtctgctgctgtgcccccagagctgcggaccagcgcccagggcatcctgcagggcctgcacctgggcctgggccggggctgtggggccatgattggaggagtgctggtgaactactttggagctgctgccaccttccggggcatcggcatggcctgcctggtgatcctgctgctgtttgccctgatccagtggctggccgtgcctgatgaggaggaggacaagaccatgctggccgagcgcatccctgtgcccagcagccctgtgcccatcgccaccatcgacctggtgcagcagcagacagaagatgtgatgcccagaattgagccccggctgccccccaagaagaccaagcaccaggaggagcaggaggatgtgaacaagccagcctggggcgtgagcagcagcccctgggtgacctttgtgtatgccctgtaccagatcaaggagatgatgcagctgacccgggacaacagagccagcgagatccagcccctgcagggcaccaatgaaaatcgggagaacagccctgctggccgggcccagcctgtgccctgtgagacccacagcgaccccagcaggaaccagcccagcccagatgctgctgccagccagacccagaccagccctgcccaccccagcgtggacccctgcacagaggagagcgaggagcagcaggcccagctggccgccggcggccactag

SEQ ID NO: 158444 - DNA, 696 bp, Artificial Sequence
  Description of Artificial Sequence: Synthetic coding sequence
atggaggtgctgcagggcgtgacccacgccgccatctgggccgcctgcatctcctacctgtctgctgctgtgcccccagagctgcggaccagcgcccagggcatcctgcagggcctgcacctgggcctgggccggggctgtggggccatgattggaggagtgctggtgaactactttggagctgctgccaccttccggggcatcggcatggcctgcctggtgatcctgctgctgtttgccctgatccagtggctggccgtgcctgatgaggaggaggacaagaccatgctggccgagcgcatccctgtgcccagcagccctgtgcccatcgccaccatcgacctggtgcagcagcagacagaagatgtgaacaagccagcctggggcgtgagcagcagcccctgggtgacctttgtgtatgccctgtaccagatcaaggagatgatgcagctgacccgggacaacagagccagcgagatccagcccctgcagggcaccaatgaaaatcgggagaacagccctgctggccgggcccagcctgtgccctgtgagacccacagcgaccccagcaggaaccagcccagcccagatgctgctgccagccagacccagaccagccctgcccaccccagcgtggacccctgcacagaggagagcgaggagcagcaggcccagctggccgccggcggccactag

SEQ ID NO: 158445 - DNA, 1557 bp, Artificial Sequence
  Description of Artificial Sequence: Synthetic coding sequence
atggccggcctgagaaatgaaagtgagcaggagcccctgctgggggacaccccaggcagccgggagtgggacatcctggagacagaggagcactacaagagccgctggaggagcatccgcatcctgtacctgaccatgttcctgagctctgtgggcttctctgtggtgatgatgagcatctggccctacctgcagaagattgaccccacagctgacaccagcttcctgggctgggtgattgccagctacagcctgggccagatggtggccagccccatcttcggcctgtggagcaactaccggcccaggaaggagcccctcatcgtgtccatcctgatctctgtggccgccaactgcctgtatgcctacctgcacatcccagccagccacaacaagtactacatgctggtggcccggggcctgctgggcatcggggctggaaatgtggccgtggtgcgcagctacacagctggggccaccagcctgcaggagaggaccagctccatggccaacatctccatgtgccaggccctgggcttcatcctgggccctgtgttccagacctgcttcaccttcctgggggagaagggcgtgacctgggatgtgatcaagctgcagatcaacatgtacaccacccctgtgctgctgagcgccttcctgggcatcctgaacatcatcctgatcctggccatcctgcgggagcaccgggtggatgacagcggccggcagtgcaagagcatcaactttgaggaggccagcacagatgaggcccaggtgccccagggcaacatcgaccaggtggccgtggtggccatcaacgtgctcttctttgtgaccctcttcatctttgccctgtttgagaccatcatcacccccctgaccatggacatgtatgcctggacccaggagcaggccgtgctgtacaacggcatcatcctggccgccctgggcgtggaggccgtggtgatcttcctgggcgtgaagctgctgagcaagaagatcggggagcgggccatcctgctgggcggcctgattgtggtgtgggtgggcttcttcatcctgctgccctggggcaaccagttccccaagatccagtgggaggacctgcacaacaacagcatccccaacaccacctttggagagatcatcatcggcctgtggaagagccccatggaggatgacaatgaaagacccaccggctgcagcattgagcaggcctggtgcctgtacacccctgtgatccacctggcccagttcctgaccagcgctgtgctgattggcctgggctaccctgtgtgcaacctgatgagctacaccctgtacagcaagatcctgggccccaagccccagggcgtgtacatgggctggctgacagccagcggcagcggggcccgcatcctgggccccatgttcatcagccaggtgtatgcccactggggcccccgctgggccttcagcctggtgtgtggcatcatcgtgctgaccatcaccctgctgggcgtggtgtacaagaggctgattgccctgtctgtgcgctatggccgcatccaggagtag

SEQ ID NO: 158446 - DNA, 462 bp, Artificial Sequence
  Description of Artificial Sequence: Synthetic coding sequence
atgttcctgagctctgtgggcttctctgtggtgatgatgagcatctggccctacctgcagaagattgaccccacagctgacaccagcttcctgggctgggtgattgccagctacagcctgggccagatggtggccagccccatcttcggcctgtggagcaactaccggcccaggaaggagcccctgattgtgtccatcctgatctctgtggccgccaactgcctgtatgcctacctgcacatcccagccagccacaacaagtactacatgctggtggcccggggcctgctgggcattggagctgtgttccagacctgcttcaccttcctgggggagaagggcgtgacctgggatgtgatcaagctgcagatcaacatgtacaccacccctgtgctgctgagcgccttcctgggcatcctgaacatcatcctgatcctggccatcctgagcaagtacagatag

SEQ ID NO: 158447 - DNA, 555 bp, Artificial Sequence
  Description of Artificial Sequence: Synthetic coding sequence
atgttcctgagctctgtgggcttctctgtggtgatgatgagcatctggccctacctgcagaagattgaccccacagctgacaccagcttcctgggctgggtgattgccagctacagcctgggccagatggtggccagccccatcttcggcctgtggagcaactaccggcccaggaaggagcccctgattgtgtccatcctgatctctgtggccgccaactgcctgtatgcctacctgcacatcccagccagccacaacaagtactacatgctggtggcccggggcctgctgggcattggagctggaaatgtggccgtggtgcgcagctacacagctggggccaccagcctgcaggagaggaccagctccatggccaacatctccatgtgccaggccctgggcttcatcctgggccctgagaacatcgtgtggatgacccaggaggacagcgtgaaggtgctgatcctgaagaagcaggtgcagatgaagctgcgcttccccaaggagatcctgacccggctgctgctgtggcccagcatgttctgcttcctgtag

SEQ ID NO: 158448 - DNA, 750 bp, Artificial Sequence
  Description of Artificial Sequence: Synthetic coding sequence
atgggagagctgatggccttcctgctgcccctcatcatcgtgctgatggtgaagcacagcgacagcaggacccacagcctgcgctacttccggctgggcgtgtctgaccccatccatggagtgcctgagttcatctctgtgggctacgtggacagccaccccatcaccacctatgacagcgtgacccggcagaaggagccccgggccccctggatggccgagaacctggccccagaccactgggagcgctacacccagctgctgcggggctggcagcagatgttcaaggtggagctgaagaggctgcagaggcactacaaccacagcggcagccacacctaccagaggatgattggctgtgagctgctggaggatggcagcaccaccggcttcctgcagtatgcctatgatggccaggacttcctgatcttcaacaaggacaccctgtcctggctggccgtggacaacgtggcccacaccatcaagcaggcctgggaggccaaccagcacgagctgctgtaccagaagaactggctggaggaggagtgcatcgcctggctgaagcgcttcctggagtatggcaaggacaccctgcagaggacagaaagtgagaccatccccctggtgatgaaggctgtgtctggcagcatcgtgctggtgattgtgctggccggcgtgggcgtgctggtgtggaggagaagaccccgggagcagaatggagccatctacctgcccaccccagacagatag

SEQ ID NO: 158449 - DNA, 783 bp, Artificial Sequence
  Description of Artificial Sequence: Synthetic coding sequence
atgaggcctgaggacaggatgttccacatccgggccgtcatcctgcgggccctgagcctggccttcctgctgagcctgcggggagctggggccatcaaggctgaccacgtgtccacctatgctgcctttgtgcagacccaccggcccaccggggagttcatgtttgaatttgatgaagatgagatgttctacgtggacctggacaagaaggagaccgtgtggcacctggaggagtttggccaggccttctcctttgaggcccagggcggcctggccaacatcgccatcctgaacaacaacctgaacaccctcatccagaggagcaaccacacccaggccaccaatgaccccccagaggtgacagtgttccccaaggagcctgtggagctgggccagcccaacaccctcatctgccacatcgacaagttcttcccccctgtgctgaatgtgacctggctgtgcaatggagagctggtgacagagggcgtggccgagagcctcttcctgcccaggacagactacagcttccacaagttccactacctgacctttgtgcccagcgctgaggacttctatgactgccgggtggagcactggggcctggaccagcccctgctgaagcactgggaggcccaggagcccatccagatgcctgagaccacagaaacagtgctgtgtgccctgggcctggtgctgggcctggtgggcatcatcgtgggcaccgtgctgatcatcaagagcctgcggagcggccatgacccccgggcccagggcaccctgtag

SEQ ID NO: 158450 - DNA, 783 bp, Artificial Sequence; identical to SEQ ID NO: 158449
  Description of Artificial Sequence: Synthetic coding sequence

SEQ ID NO: 158451 - DNA, 72 bp, Artificial Sequence
  Description of Artificial Sequence: Synthetic coding sequence
atgaggcctgaggacaggatgttccacatccgggccgtcatcctgcgggccctgagcctggccttcctgtag

SEQ ID NO: 158452 - DNA, 387 bp, Artificial Sequence
  Description of Artificial Sequence: Synthetic coding sequence
tgaaacaccctcatctgccacatcgacaagttcttcccccctgtgctgaatgtgacctggctgtgcaatggagagctggtgacagagggcgtggccgagagcctcttcctgcccaggacagactacagcttccacaagttccactacctgacctttgtgcccagcgctgaggacttctatgactgccgggtggagcactggggcctggaccagcccctgctgaagcactgggaggcccaggagcccatccagatgcctgagaccacagaaacagtgctgtgtgccctgggcctggtgctgggcctggtgggcatcatcgtgggcaccgtgctgatcatcaagagcctgcggagcggccatgacccccgggcccagggcaccctgtag

SEQ ID NO: 158453 - DNA, 630 bp, Artificial Sequence
  Description of Artificial Sequence: Synthetic coding sequence
atgaggcctgaggacaggatgttccacatccgggccgtcatcctgcgggccctgagcctggccttcctgctgagcctgcggggagctggggccatcaaggctgaccacgtgtccacctatgctgcctttgtgcagacccaccggcccaccggggagttcatgtttgaatttgatgaagatgagatgttctacgtggacctggacaagaaggagaccgtgtggcacctggaggagtttggccaggccttctcctttgaggcccagggcggcctggccaacatcgccatcctgaacaacaacctgaacaccctcatccagaggagcaaccacacccaggccaccaatgaccccccagaggtgacagtgttccccaaggagcctgtggagctgggccagcccaacaccctcatctgccacatcgacaagttcttcccccctgtgctgaatgtgacctggctgtgcaatggagagctggtgacagagggcgtggccgagagcctcttcctgcccaggacagactacagcttccacaagttccactacctgacctttgtgcccagcgctgaggacttctatgactgccgggtggagcactggggcctggaccagcccctgctgaagcactggtag

SEQ ID NO: 158454 - DNA, 783 bp, Artificial Sequence; identical to SEQ ID NO: 158449
  Description of Artificial Sequence: Synthetic coding sequence

SEQ ID NO: 158455 - DNA, 72 bp, Artificial Sequence; identical to SEQ ID NO: 158451
  Description of Artificial Sequence: Synthetic coding sequence

SEQ ID NO: 158456 - DNA, 783 bp, Artificial Sequence; identical to SEQ ID NO: 158449
  Description of Artificial Sequence: Synthetic coding sequence

SEQ ID NO: 158457 - DNA, 387 bp, Artificial Sequence; identical to SEQ ID NO: 158452
  Description of Artificial Sequence: Synthetic coding sequence

SEQ ID NO: 158458 - DNA, 783 bp, Artificial Sequence; identical to SEQ ID NO: 158449
  Description of Artificial Sequence: Synthetic coding sequence

SEQ ID NO: 158459 - DNA, 72 bp, Artificial Sequence; identical to SEQ ID NO: 158451
  Description of Artificial Sequence: Synthetic coding sequence

SEQ ID NO: 158460 - DNA, 630 bp, Artificial Sequence; identical to SEQ ID NO: 158453
  Description of Artificial Sequence: Synthetic coding sequence

SEQ ID NO: 158461 - DNA, 72 bp, Artificial Sequence; identical to SEQ ID NO: 158451
  Description of Artificial Sequence: Synthetic coding sequence

SEQ ID NO: 158462 - DNA, 387 bp, Artificial Sequence; identical to SEQ ID NO: 158452
  Description of Artificial Sequence: Synthetic coding sequence

SEQ ID NO: 158463 - DNA, 783 bp, Artificial Sequence; identical to SEQ ID NO: 158449
  Description of Artificial Sequence: Synthetic coding sequence

SEQ ID NO: 158464 - DNA, 387 bp, Artificial Sequence; identical to SEQ ID NO: 158452
  Description of Artificial Sequence: Synthetic coding sequence

SEQ ID NO: 158465 - DNA, 72 bp, Artificial Sequence; identical to SEQ ID NO: 158451
  Description of Artificial Sequence: Synthetic coding sequence

SEQ ID NO: 158466 - DNA, 630 bp, Artificial Sequence; identical to SEQ ID NO: 158453
  Description of Artificial Sequence: Synthetic coding sequence

SEQ ID NO: 158467 - DNA, 639 bp, Artificial Sequence
  Description of Artificial Sequence: Synthetic coding sequence
atgaggcctgaggacaggatgttccacatccgggccgtcatcctgcgggccctgagcctggccttcctgctgagcctgcggggagctggggccatcaaggctgaccacgtgtccacctatgctgcctttgtgcagacccaccggcccaccggggagttcatgtttgaatttgatgaagatgagatgttctacgtggacctggacaagaaggagaccgtgtggcacctggaggagtttggccaggccttctcctttgaggtgaccgtcttccccaaggagcctgtggagctgggccagcccaacaccctcatctgccacatcgacaagttcttcccccctgtgctgaatgtgacctggctgtgcaatggagagctggtgacagaaggagtggccgagagcctcttcctgcccaggacagactacagcttccacaagttccactacctgacctttgtgcccagcgctgaggacttctatgactgccgggtggagcactggggcctggaccagcccctgctgaagcactgggaggcccaggagcccatccagatgcctgagaccacagagaccgtgctgtgtgccctgggcctggtgctgggcctggtgggcatcatcgtgggcaccgtgctgatcatctag

SEQ ID NO: 158468 - DNA, 639 bp, Artificial Sequence; identical to SEQ ID NO: 158467
  Description of Artificial Sequence: Synthetic coding sequence

SEQ ID NO: 158469 - DNA, 387 bp, Artificial Sequence; identical to SEQ ID NO: 158452
  Description of Artificial Sequence: Synthetic coding sequence

SEQ ID NO: 158470 - DNA, 639 bp, Artificial Sequence; identical to SEQ ID NO: 158467
  Description of Artificial Sequence: Synthetic coding sequence

SEQ ID NO: 158471 - DNA, 630 bp, Artificial Sequence; identical to SEQ ID NO: 158453
  Description of Artificial Sequence: Synthetic coding sequence

SEQ ID NO: 158472 - DNA, 72 bp, Artificial Sequence; identical to SEQ ID NO: 158451
  Description of Artificial Sequence: Synthetic coding sequence

SEQ ID NO: 158473 - DNA, 639 bp, Artificial Sequence; identical to SEQ ID NO: 158467
  Description of Artificial Sequence: Synthetic coding sequence

SEQ ID NO: 158474 - DNA, 630 bp, Artificial Sequence; identical to SEQ ID NO: 158453
  Description of Artificial Sequence: Synthetic coding sequence

SEQ ID NO: 158475 - DNA, 387 bp, Artificial Sequence; identical to SEQ ID NO: 158452
  Description of Artificial Sequence: Synthetic coding sequence

SEQ ID NO: 158476 - DNA, 783 bp, Artificial Sequence; identical to SEQ ID NO: 158449
  Description of Artificial Sequence: Synthetic coding sequence

SEQ ID NO: 158477 - DNA, 639 bp, Artificial Sequence; identical to SEQ ID NO: 158467
  Description of Artificial Sequence: Synthetic coding sequence

SEQ ID NO: 158478 - DNA, 72 bp, Artificial Sequence; identical to SEQ ID NO: 158451
  Description of Artificial Sequence: Synthetic coding sequence

SEQ ID NO: 158479 - DNA, 639 bp, Artificial Sequence; identical to SEQ ID NO: 158467
  Description of Artificial Sequence: Synthetic coding sequence

SEQ ID NO: 158480 - DNA, 72 bp, Artificial Sequence; identical to SEQ ID NO: 158451
  Description of Artificial Sequence: Synthetic coding sequence

SEQ ID NO: 158481 - DNA, 639 bp, Artificial Sequence; identical to SEQ ID NO: 158467
  Description of Artificial Sequence: Synthetic coding sequence

SEQ ID NO: 158482 - DNA, 387 bp, Artificial Sequence; identical to SEQ ID NO: 158452
  Description of Artificial Sequence: Synthetic coding sequence

SEQ ID NO: 158483 - DNA, 630 bp, Artificial Sequence; identical to SEQ ID NO: 158453
  Description of Artificial Sequence: Synthetic coding sequence

SEQ ID NO: 158484 - DNA, 783 bp, Artificial Sequence; identical to SEQ ID NO: 158449
  Description of Artificial Sequence: Synthetic coding sequence

SEQ ID NO: 158485 - DNA, 387 bp, Artificial Sequence; identical to SEQ ID NO: 158452
  Description of Artificial Sequence: Synthetic coding sequence

SEQ ID NO: 158486 - DNA, 630 bp, Artificial Sequence; identical to SEQ ID NO: 158453
  Description of Artificial Sequence: Synthetic coding sequence

SEQ ID NO: 158487 - DNA, 630 bp, Artificial Sequence; identical to SEQ ID NO: 158453
  Description of Artificial Sequence: Synthetic coding sequence

SEQ ID NO: 158488 - DNA, 783 bp, Artificial Sequence; identical to SEQ ID NO: 158449
  Description of Artificial Sequence: Synthetic coding sequence

SEQ ID NO: 158489 - DNA, 639 bp, Artificial Sequence; identical to SEQ ID NO: 158467
  Description of Artificial Sequence: Synthetic coding sequence

SEQ ID NO: 158490 - DNA, 783 bp, Artificial Sequence; identical to SEQ ID NO: 158449
  Description of Artificial Sequence: Synthetic coding sequence

SEQ ID NO: 158491 - DNA, 783 bp, Artificial Sequence; identical to SEQ ID NO: 158449
  Description of Artificial Sequence: Synthetic coding sequence

SEQ ID NO: 158492 - DNA, 783 bp, Artificial Sequence; identical to SEQ ID NO: 158449
  Description of Artificial Sequence: Synthetic coding sequence

SEQ ID NO: 158493 - DNA, 783 bp, Artificial Sequence; identical to SEQ ID NO: 158449
  Description of Artificial Sequence: Synthetic coding sequence

SEQ ID NO: 158494 - DNA, 783 bp, Artificial Sequence; identical to SEQ ID NO: 158449
  Description of Artificial Sequence: Synthetic coding sequence

SEQ ID NO: 158495 - DNA, 783 bp, Artificial Sequence; identical to SEQ ID NO: 158449
  Description of Artificial Sequence: Synthetic coding sequence

SEQ ID NO: 158496 - DNA, 777 bp, Artificial Sequence
  Description of Artificial Sequence: Synthetic coding sequence
atgatggtgctgcaggtgtctgctgcccccaggacagtggccctgacagccctgctgatggtgctgctgacctctgtggtgcagggccgggccaccccagagaactacgtgtaccagctgcggcaggagtgctacgccttcaacggcacccagcgcttcctggagcgctacatctacaaccgggaggagtttgtgcgctttgacagtgatgtgggggagttccgggctgtgacagagctgggccgcccagatgaggactactggaacagccagaaggacctgctggaggagaagagagctgtgcctgacagagtgtgccgccacaactatgagctggatgaagctgtgaccctgcagaggagagtgcagcccaaggtgaatgtgagccccagcaagaagggccccctgcagcaccacaacctgctggtgtgccacgtgacagacttctacccaggcagcatccaggtgcgctggttcctgaatggccaggaggagacagctggggtggtgtccaccaacctgatcagaaatggagactggaccttccagatcctggtgatgctggagatgaccccccagcagggagatgtgtacatctgccaggtggagcacaccagcctggacagccctgtgacagtggagtggaaggcccagagcgacagcgcccggagcaagaccctgaccggggccggcggctttgtgctgggcctcatcatctgtggggtgggcatcttcatgcaccggcgcagcaagaaggtgcagaggggcagcgcctag

SEQ ID NO: 158497 - DNA, 687 bp, Artificial Sequence
  Description of Artificial Sequence: Synthetic coding sequence
atgatggtgctgcaggtgtctgctgcccccaggacagtggccctgacagccctgctgatggtgctgctgacctctgtggtgcagggccgggccaccccagagaactacctgttccagggccggcaggagtgctacgccttcaacggcacccagcgcttcctggagcgctacatctacaaccgggaggagctggtgcgctttgacagtgatgtgggggagttccgggctgtgacagagctgggccggcctgaggccgagtactggaacagccagaaggacatcctggaggaggagagagctgtgcctgacaggatgtgccgccacaactatgagctgggcggccccatgaccctgcagaggcggggcagcatccaggtgcgctggttcctgaatggccaggaggagacagctggggtggtgtccaccaacctgatcagaaatggagactggaccttccagatcctggtgatgctggagatgaccccccagcagggagatgtgtacacctgccaggtggagcacaccagcctggacagccctgtgacagtggagtggaaggcccagagcgacagcgcccggagcaagaccctgaccggggccggcggctttgtgctgggcctcatcatctgtggggtgggcatcttcatgcaccggcgcagcaagaaggtgcagaggggcagcgcctag

SEQ ID NO: 158498 - DNA, 777 bp, Artificial Sequence
  Description of Artificial Sequence: Synthetic coding sequence
atgatggtgctgcaggtgtctgctgcccccaggacagtggccctgacagccctgctgatggtgctgctgacctctgtggtgcagggccgggccaccccagagaactacctgttccagggccggcaggagtgctacgccttcaacggcacccagcgcttcctggagcgctacatctacaaccgggaggagctggtgcgctttgacagtgatgtgggggagttccgggctgtgacagagctgggccggcctgaggccgagtactggaacagccagaaggacatcctggaggaggagagagctgtgcctgacaggatgtgccgccacaactatgagctgggcggccccatgaccctgcagaggagagtgcagccccgggtgaatgtgagccccagcaagaagggccccctgcagcaccacaacctgctggtgtgccacgtgacagacttctacccaggcagcatccaggtgcgctggttcctgaatggccaggaggagacagctggggtggtgtccaccaacctgatcagaaatggagactggaccttccagatcctggtgatgctggagatgaccccccagcagggagatgtgtacacctgccaggtggagcacaccagcctggacagccctgtgacagtggagtggaaggcccagagcgacagcgcccggagcaagaccctgaccggggccggcggctttgtgctgggcctcatcatctgtggggtgggcatcttcatgcaccggcgcagcaagaaggtgcagaggggcagcgcctag

SEQ ID NO: 158499 - DNA, 690 bp, Artificial Sequence
  Description of Artificial Sequence: Synthetic coding sequence
aagcaggcctggaggggcagcgccacccggctgggcccccagaacagcggccggcaggagtgctacgccttcaacggcacccagcgcttcctggagcgctacatctacaaccgggaggagctggtgcgctttgacagtgatgtgggggagttccgggctgtgacagagctgggccggcctgaggccgagtactggaacagccagaaggacatcctggaggaggagagagctgtgcctgacaggatgtgccgccacaactatgagctgggcggccccatgaccctgcagaggagagtgcagccccgggtgaatgtgagccccagcaagaagggccccctgcagcaccacaacctgctggtgtgccacgtgacagacttctacccaggcagcatccaggtgcgctggttcctgaatggccaggaggagacagctggggtggtgtccaccaacctgatcagaaatggagactggaccttccagatcctggtgatgctggagatgaccccccagcagggagatgtgtacacctgccaggtggagcacaccagcctggacagccctgtgacagtggagtggaaggcccagagcgacagcgcccggagcaagaccctgactggagctgggggctttgtgctgggcctcatcatctgtggggtgggcatcttcatgcacagaagaagcaagaagtag

SEQ ID NO: 158500 - DNA, 687 bp, Artificial Sequence
  Description of Artificial Sequence: Synthetic coding sequence
atgatggtgctgcaggtgtctgctgcccccaggacagtggccctgacagccctgctgatggtgctgctgacctctgtggtgcagggccgggccaccccagagaactacctgttccagggccggcaggagtgctacgccttcaacggcacccagcgcttcctggagcgctacatctacaaccgggaggagtttgccaggtttgacagtgatgtgggggagttccgggctgtgacagagctgggccggcctgctgctgagtactggaacagccagaaggacatcctggaggagaagagagctgtgcctgacaggatgtgccgccacaactatgagctgggcggccccatgaccctgcagaggcggggcagcatccaggtgcgctggttcctgaatggccaggaggagacagctggggtggtgtccaccaacctgatcagaaatggagactggaccttccagatcctggtgatgctggagatgaccccccagcagggagatgtgtacacctgccaggtggagcacaccagcctggacagccctgtgacagtggagtggaaggcccagagcgacagcgcccggagcaagaccctgaccggggccggcggctttgtgctgggcctcatcatctgtggggtgggcatcttcatgcaccggcgcagcaagaaggtgcagaggggcagcgcctag

SEQ ID NO: 158501 - DNA, 687 bp, Artificial Sequence
  Description of Artificial Sequence: Synthetic coding sequence
atgatggtgctgcaggtgtctgctgcccccaggacagtggccctgacagccctgctgatggtgctgctgacctctgtggtgcagggccgggccaccccagagaactacctgttccagggccggcaggagtgctacgccttcaacggcacccagcgcttcctggagcgctacatctacaaccgggaggagtttgtgcgctttgacagtgatgtgggggagttccgggctgtgacagagctgggccgcccagatgaggagtactggaacagccagaaggacatcctggaggagaagagagctgtgcctgacaggatgtgccgccacaactatgagctgggcggccccatgaccctgcagaggcggggcagcatccaggtgcgctggttcctgaatggccaggaggagacagctggggtggtgtccaccaacctgatcagaaatggagactggaccttccagatcctggtgatgctggagatgaccccccagcagggagatgtgtacacctgccaggtggagcacacctccatggacagccctgtgacagtggagtggaaggcccagagcgacagcgcccggagcaagaccctgaccggggccggcggctttgtgctgggcctcatcatctgtggggtgggcatcttcatgcaccggcgcagcaagaaggtgcagaggggcagcgcctag

SEQ ID NO: 158502 - DNA, 708 bp, Artificial Sequence
  Description of Artificial Sequence: Synthetic coding sequence
tgaaactacctgttccagggccggcaggagtgctacgccttcaacggcacccagcgcttcctggagcgctacatctacaaccgggaggagtttgtgcgctttgacagtgatgtgggggagttccgggctgtgacagagctgggccgcccagatgaggagtactggaacagccagaaggacatcctggaggagaagagagctgtgcctgacaggatgtgccgccacaactatgagctgggcggccccatgaccctgcagaggagagtgcagccccgggtgaatgtgagccccagcaagaagggccccctgcagcaccacaacctgctggtgtgccacgtgacagacttctacccaggcagcatccaggtgcgctggttcctgaatggccaggaggagacagctggggtggtgtccaccaacctgatcagaaatggagactggaccttccagatcctggtgatgctggagatgaccccccagcagggagatgtgtacacctgccaggtggagcacacctccatggacagccctgtgacagtggagtggaaggcccagagcgacagcgcccggagcaagaccctgactggagctgggggctttgtgctgggcctcatcatctgtggggtgggcatcttcatgcacagaagaagcaagaagggggagaaggcctgccgcttcaatgaagacctgcacaagcagggcagctag

SEQ ID NO: 158503 - DNA, 777 bp, Artificial Sequence
  Description of Artificial Sequence: Synthetic coding sequence
atgatggtgctgcaggtgtctgctgcccccaggacagtggccctgacagccctgctgatggtgctgctgacctctgtggtgcagggccgggccaccccagagaactacctgttccagggccggcaggagtgctacgccttcaacggcacccagcgcttcctggagcgctacatctacaaccgggaggagtttgtgcgctttgacagtgatgtgggggagttccgggctgtgacagagctgggccgcccagatgaggagtactggaacagccagaaggacatcctggaggagaagagagctgtgcctgacaggatgtgccgccacaactatgagctgggcggccccatgaccctgcagaggagagtgcagccccgggtgaatgtgagccccagcaagaagggccccctgcagcaccacaacctgctggtgtgccacgtgacagacttctacccaggcagcatccaggtgcgctggttcctgaatggccaggaggagacagctggggtggtgtccaccaacctgatcagaaatggagactggaccttccagatcctggtgatgctggagatgaccccccagcagggagatgtgtacacctgccaggtggagcacacctccatggacagccctgtgacagtggagtggaaggcccagagcgacagcgcccggagcaagaccctgaccggggccggcggctttgtgctgggcctcatcatctgtggggtgggcatcttcatgcaccggcgcagcaagaaggtgcagaggggcagcgcctag

SEQ ID NO: 158504 - DNA, 687 bp, Artificial Sequence; identical to SEQ ID NO: 158500
  Description of Artificial Sequence: Synthetic coding sequence

SEQ ID NO: 158505 - DNA, 690 bp, Artificial Sequence
  Description of Artificial Sequence: Synthetic coding sequence
aagcaggcctggaggggcagcgccacccggctgggcccccagaacagcggccggcaggagtgctacgccttcaacggcacccagcgcttcctggagcgctacatctacaaccgggaggagtttgtgcgctttgacagtgatgtgggggagttccgggctgtgacagagctgggccgcccagatgaggagtactggaacagccagaaggacatcctggaggaggagagagctgtgcctgacaggatgtgccgccacaactatgagctgggcggccccatgaccctgcagaggagagtgcagccccgggtgaatgtgagccccagcaagaagggccccctgcagcaccacaacctgctggtgtgccacgtgacagacttctacccaggcagcatccaggtgcgctggttcctgaatggccaggaggagacagctggggtggtgtccaccaacctgatcagaaatggagactggaccttccagatcctggtgatgctggagatgaccccccagcagggagatgtgtacacctgccaggtggagcacaccagcctggacagccctgtgacagtggagtggaaggcccagagcgacagcgcccggagcaagaccctgactggagctgggggctttgtgctgggcctcatcatctgtggggtgggcatcttcatgcacagaagaagcaagaagtag

SEQ ID NO: 158506 - DNA, 777 bp, Artificial Sequence
  Description of Artificial Sequence: Synthetic coding sequence
atgatggtgctgcaggtgtctgctgcccccaggacagtggccctgacagccctgctgatggtgctgctgacctctgtggtgcagggccgggccaccccagagaactacctgttccagggccggcaggagtgctacgccttcaacggcacccagcgcttcctggagcgctacatctacaaccgggaggagtttgtgcgctttgacagtgatgtgggggagttccgggctgtgacagagctgggccgcccagatgaggagtactggaacagccagaaggacatcctggaggaggagagagctgtgcctgacaggatgtgccgccacaactatgagctgggcggccccatgaccctgcagaggagagtgcagccccgggtgaatgtgagccccagcaagaagggccccctgcagcaccacaacctgctggtgtgccacgtgacagacttctacccaggcagcatccaggtgcgctggttcctgaatggccaggaggagacagctggggtggtgtccaccaacctgatcagaaatggagactggaccttccagatcctggtgatgctggagatgaccccccagcagggagatgtgtacacctgccaggtggagcacaccagcctggacagccctgtgacagtggagtggaaggcccagagcgacagcgcccggagcaagaccctgaccggggccggcggctttgtgctgggcctcatcatctgtggggtgggcatcttcatgcaccggcgcagcaagaaggtgcagaggggcagcgcctag

SEQ ID NO: 158507 - DNA, 708 bp, Artificial Sequence
  Description of Artificial Sequence: Synthetic coding sequence
tgaaactacctgttccagggccggcaggagtgctacgccttcaacggcacccagcgcttcctggagcgctacatctacaaccgggaggagtttgccaggtttgacagtgatgtgggggagttccgggctgtgacagagctgggccggcctgctgctgagtactggaacagccagaaggacatcctggaggagaagagagctgtgcctgacaggatgtgccgccacaactatgagctgggcggccccatgaccctgcagaggagagtgcagccccgggtgaatgtgagccccagcaagaagggccccctgcagcaccacaacctgctggtgtgccacgtgacagacttctacccaggcagcatccaggtgcgctggttcctgaatggccaggaggagacagctggggtggtgtccaccaacctgatcagaaatggagactggaccttccagatcctggtgatgctggagatgaccccccagcagggagatgtgtacacctgccaggtggagcacaccagcctggacagccctgtgacagtggagtggaaggcccagagcgacagcgcccggagcaagaccctgactggagctgggggctttgtgctgggcctcatcatctgtggggtgggcatcttcatgcacagaagaagcaagaagggggagaaggcctgccgcttcaatgaagacctgcacaagcagggcagctag

SEQ ID NO: 158508 - DNA, 690 bp, Artificial Sequence
  Description of Artificial Sequence: Synthetic coding sequence
aagcaggcctggaggggcagcgccacccggctgggcccccagaacagcggccggcaggagtgctacgccttcaacggcacccagcgcttcctggagcgctacatctacaaccgggaggagtttgccaggtttgacagtgatgtgggggagttccgggctgtgacagagctgggccggcctgctgctgagtactggaacagccagaaggacatcctggaggagaagagagctgtgcctgacaggatgtgccgccacaactatgagctgggcggccccatgaccctgcagaggagagtgcagccccgggtgaatgtgagccccagcaagaagggccccctgcagcaccacaacctgctggtgtgccacgtgacagacttctacccaggcagcatccaggtgcgctggttcctgaatggccaggaggagacagctggggtggtgtccaccaacctgatcagaaatggagactggaccttccagatcctggtgatgctggagatgaccccccagcagggagatgtgtacacctgccaggtggagcacaccagcctggacagccctgtgacagtggagtggaaggcccagagcgacagcgcccggagcaagaccctgactggagctgggggctttgtgctgggcctcatcatctgtggggtgggcatcttcatgcacagaagaagcaagaagtag

SEQ ID NO: 158509 - DNA, 777 bp, Artificial Sequence
  Description of Artificial Sequence: Synthetic coding sequence
atgatggtgctgcaggtgtctgctgcccccaggacagtggccctgacagccctgctgatggtgctgctgacctctgtggtgcagggccgggccaccccagagaactacctgttccagggccggcaggagtgctacgccttcaacggcacccagcgcttcctggagcgctacatctacaaccgggaggagtttgccaggtttgacagtgatgtgggggagttccgggctgtgacagagctgggccggcctgctgctgagtactggaacagccagaaggacatcctggaggagaagagagctgtgcctgacaggatgtgccgccacaactatgagctgggcggccccatgaccctgcagaggagagtgcagccccgggtgaatgtgagccccagcaagaagggccccctgcagcaccacaacctgctggtgtgccacgtgacagacttctacccaggcagcatccaggtgcgctggttcctgaatggccaggaggagacagctggggtggtgtccaccaacctgatcagaaatggagactggaccttccagatcctggtgatgctggagatgaccccccagcagggagatgtgtacacctgccaggtggagcacaccagcctggacagccctgtgacagtggagtggaaggcccagagcgacagcgcccggagcaagaccctgaccggggccggcggctttgtgctgggcctcatcatctgtggggtgggcatcttcatgcaccggcgcagcaagaaggtgcagaggggcagcgcctag

SEQ ID NO: 158510 - DNA, 249 bp, Artificial Sequence
  Description of Artificial Sequence: Synthetic coding sequence
atgaccccccagcagggagatgtgtacacctgccaggtggagcacaccagcctggacagccctgtgacagtggagtggaaggcccagagcgacagcgcccggagcaagaccctgactggagctgggggccgggccggggcccaccacctgtggagcggccacctgcacgcccaggaggagcaggagagcagcacccgcatctgcatcaacagagtgcctgagctgacagagaagaccatcgtgccctag

SEQ ID NO: 158511 - DNA, 777 bp, Artificial Sequence; identical to SEQ ID NO: 158503
  Description of Artificial Sequence: Synthetic coding sequence

SEQ ID NO: 158512 - DNA, 690 bp, Artificial Sequence; identical to SEQ ID NO: 158508
  Description of Artificial Sequence: Synthetic coding sequence

SEQ ID NO: 158513 - DNA, 708 bp, Artificial Sequence
  Description of Artificial Sequence: Synthetic coding sequence
tgaaactacctgttccagggccggcaggagtgctacgccttcaacggcacccagcgcttcctggagcgctacatctacaaccgggaggagctggtgcgctttgacagtgatgtgggggagttccgggctgtgacagagctgggccggcctgaggccgagtactggaacagccagaaggacatcctggaggaggagagagctgtgcctgacaggatgtgccgccacaactatgagctgggcggccccatgaccctgcagaggagagtgcagccccgggtgaatgtgagccccagcaagaagggccccctgcagcaccacaacctgctggtgtgccacgtgacagacttctacccaggcagcatccaggtgcgctggttcctgaatggccaggaggagacagctggggtggtgtccaccaacctgatcagaaatggagactggaccttccagatcctggtgatgctggagatgaccccccagcagggagatgtgtacacctgccaggtggagcacaccagcctggacagccctgtgacagtggagtggaaggcccagagcgacagcgcccggagcaagaccctgactggagctgggggctttgtgctgggcctcatcatctgtggggtgggcatcttcatgcacagaagaagcaagaagggggagaaggcctgccgcttcaatgaagacctgcacaagcagggcagctag

SEQ ID NO: 158514 - DNA, 777 bp, Artificial Sequence; identical to SEQ ID NO: 158509
  Description of Artificial Sequence: Synthetic coding sequence

SEQ ID NO: 158515 - DNA, 708 bp, Artificial Sequence
  Description of Artificial Sequence: Synthetic coding sequence
tgaaactacgtgtaccagctgcggcaggagtgctacgccttcaacggcacccagcgcttcctggagcgctacatctacaaccgggaggagtttgtgcgctttgacagtgatgtgggggagttccgggctgtgacagagctgggccgcccagatgaggactactggaacagccagaaggacctgctggaggagaagagagctgtgcctgacagagtgtgccgccacaactatgagctggatgaggccgtgaccctgcagaggagagtgcagcccaaggtgaatgtgagccccagcaagaagggccccctgcagcaccacaacctgctggtgtgccacgtgacagacttctacccaggcagcatccaggtgcgctggttcctgaatggccaggaggagacagctggggtggtgtccaccaacctgatcagaaatggagactggaccttccagatcctggtgatgctggagatgaccccccagcagggagatgtgtacatctgccaggtggagcacaccagcctggacagccctgtgacagtggagtggaaggcccagagcgacagcgcccggagcaagaccctgactggagctgggggctttgtgctgggcctcatcatctgtggggtgggcatcttcatgcacagaagaagcaagaagggggagaaggcctgcaagttcaatgaagacctgcacaagcagggcagctag

SEQ ID NO: 158516 - DNA, 690 bp, Artificial Sequence
  Description of Artificial Sequence: Synthetic coding sequence
aagcaggcctggaggggcagcgccacccggctgggcccccagaacagcggccggcaggagtgctacgccttcaacggcacccagcgcttcctggagcgctacatctacaaccgggaggagtttgtgcgctttgacagtgatgtgggggagttccgggctgtgacagagctgggccgcccagatgaggagtactggaacagccagaaggacatcctggaggagaagagagctgtgcctgacaggatgtgccgccacaactatgagctgggcggccccatgaccctgcagaggagagtgcagccccgggtgaatgtgagccccagcaagaagggccccctgcagcaccacaacctgctggtgtgccacgtgacagacttctacccaggcagcatccaggtgcgctggttcctgaatggccaggaggagacagctggggtggtgtccaccaacctgatcagaaatggagactggaccttccagatcctggtgatgctggagatgaccccccagcagggagatgtgtacacctgccaggtggagcacacctccatggacagccctgtgacagtggagtggaaggcccagagcgacagcgcccggagcaagaccctgactggagctgggggctttgtgctgggcctcatcatctgtggggtgggcatcttcatgcacagaagaagcaagaagtag

SEQ ID NO: 158517 - DNA, 687 bp, Artificial Sequence
  Description of Artificial Sequence: Synthetic coding sequence
atgatggtgctgcaggtgtctgctgcccccaggacagtggccctgacagccctgctgatggtgctgctgacctctgtggtgcagggccgggccaccccagagaactacgtgtaccagctgcggcaggagtgctacgccttcaacggcacccagcgcttcctggagcgctacatctacaaccgggaggagtttgtgcgctttgacagtgatgtgggggagttccgggctgtgacagagctgggccgcccagatgaggactactggaacagccagaaggacctgctggaggagaagagagctgtgcctgacagagtgtgccgccacaactatgagctggatgaagctgtgaccctgcagaggcggggcagcatccaggtgcgctggttcctgaatggccaggaggagacagctggggtggtgtccaccaacctgatcagaaatggagactggaccttccagatcctggtgatgctggagatgaccccccagcagggagatgtgtacatctgccaggtggagcacaccagcctggacagccctgtgacagtggagtggaaggcccagagcgacagcgcccggagcaagaccctgaccggggccggcggctttgtgctgggcctcatcatctgtggggtgggcatcttcatgcaccggcgcagcaagaaggtgcagaggggcagcgcctag

SEQ ID NO: 158518 - DNA, 687 bp, Artificial Sequence; identical to SEQ ID NO: 158501
  Description of Artificial Sequence: Synthetic coding sequence

SEQ ID NO: 158519 - DNA, 687 bp, Artificial Sequence; identical to SEQ ID NO: 158500
  Description of Artificial Sequence: Synthetic coding sequence

SEQ ID NO: 158520 - DNA, 690 bp, Artificial Sequence; identical to SEQ ID NO: 158516
  Description of Artificial Sequence: Synthetic coding sequence

SEQ ID NO: 158521 - DNA, 708 bp, Artificial Sequence
  Description of Artificial Sequence: Synthetic coding sequence
tgaaactacctgttccagggccggcaggagtgctacgccttcaacggcacccagcgcttcctggagcgctacatctacaaccgggaggagtttgtgcgctttgacagtgatgtgggggagttccgggctgtgacagagctgggccgcccagatgaggagtactggaacagccagaaggacatcctggaggaggagagagctgtgcctgacaggatgtgccgccacaactatgagctgggcggccccatgaccctgcagaggagagtgcagccccgggtgaatgtgagccccagcaagaagggccccctgcagcaccacaacctgctggtgtgccacgtgacagacttctacccaggcagcatccaggtgcgctggttcctgaatggccaggaggagacagctggggtggtgtccaccaacctgatcagaaatggagactggaccttccagatcctggtgatgctggagatgaccccccagcagggagatgtgtacacctgccaggtggagcacaccagcctggacagccctgtgacagtggagtggaaggcccagagcgacagcgcccggagcaagaccctgactggagctgggggctttgtgctgggcctcatcatctgtggggtgggcatcttcatgcacagaagaagcaagaagggggagaaggcctgccgcttcaatgaagacctgcacaagcagggcagctag

SEQ ID NO: 158522 - DNA, 708 bp, Artificial Sequence; identical to SEQ ID NO: 158507
  Description of Artificial Sequence: Synthetic coding sequence

SEQ ID NO: 158523 - DNA, 687 bp, Artificial Sequence
  Description of Artificial Sequence: Synthetic coding sequence
atgatggtgctgcaggtgtctgctgcccccaggacagtggccctgacagccctgctgatggtgctgctgacctctgtggtgcagggccgggccaccccagagaactacctgttccagggccggcaggagtgctacgccttcaacggcacccagcgcttcctggagcgctacatctacaaccgggaggagtttgtgcgctttgacagtgatgtgggggagttccgggctgtgacagagctgggccgcccagatgaggagtactggaacagccagaaggacatcctggaggaggagagagctgtgcctgacaggatgtgccgccacaactatgagctgggcggccccatgaccctgcagaggcggggcagcatccaggtgcgctggttcctgaatggccaggaggagacagctggggtggtgtccaccaacctgatcagaaatggagactggaccttccagatcctggtgatgctggagatgaccccccagcagggagatgtgtacacctgccaggtggagcacaccagcctggacagccctgtgacagtggagtggaaggcccagagcgacagcgcccggagcaagaccctgaccggggccggcggctttgtgctgggcctcatcatctgtggggtgggcatcttcatgcaccggcgcagcaagaaggtgcagaggggcagcgcctag

SEQ ID NO: 158524 - DNA, 690 bp, Artificial Sequence
  Description of Artificial Sequence: Synthetic coding sequence
aagcaggcctggaggggcagcgccacccggctgggcccccagaacagcctgcggcaggagtgctacgccttcaacggcacccagcgcttcctggagcgctacatctacaaccgggaggagtttgtgcgctttgacagtgatgtgggggagttccgggctgtgacagagctgggccgcccagatgaggactactggaacagccagaaggacctgctggaggagaagagagctgtgcctgacagagtgtgccgccacaactatgagctggatgaggccgtgaccctgcagaggagagtgcagcccaaggtgaatgtgagccccagcaagaagggccccctgcagcaccacaacctgctggtgtgccacgtgacagacttctacccaggcagcatccaggtgcgctggttcctgaatggccaggaggagacagctggggtggtgtccaccaacctgatcagaaatggagactggaccttccagatcctggtgatgctggagatgaccccccagcagggagatgtgtacatctgccaggtggagcacaccagcctggacagccctgtgacagtggagtggaaggcccagagcgacagcgcccggagcaagaccctgactggagctgggggctttgtgctgggcctcatcatctgtggggtgggcatcttcatgcacagaagaagcaagaagtag

SEQ ID NO: 158525 - DNA, 777 bp, Artificial Sequence; identical to SEQ ID NO: 158509
  Description of Artificial Sequence: Synthetic coding sequence

SEQ ID NO: 158526 - DNA, 708 bp, Artificial Sequence; identical to SEQ ID NO: 158502
  Description of Artificial Sequence: Synthetic coding sequence

SEQ ID NO: 158527 - DNA, 690 bp, Artificial Sequence; identical to SEQ ID NO: 158508
  Description of Artificial Sequence: Synthetic coding sequence

SEQ ID NO: 158528 - DNA, 708 bp, Artificial Sequence; identical to SEQ ID NO: 158507
  Description of Artificial Sequence: Synthetic coding sequence

SEQ ID NO: 158529 - DNA, 372 bp, Artificial Sequence
  Description of Artificial Sequence: Synthetic coding sequence
atgatggtgctgcaggtgtctgctgcccccaggacagtggccctgacagccctgctgatggtgctgctgacctctgtggtgcagggccgggccaccccagagaactacctgttccagggccggcaggagtgctacgccttcaacggcacccagcgcttcctggagcgctacatctacaaccgggaggagtttgccaggtttgacagtgatgtgggggagttccgggctgtgacagagctgggccggcctgctgctgagtactggaacagccagaaggacatcctggaggagaagagagctgtgcctgacaggatgtgccgccacaactatgagctgggcggccccatgaccctgcagaggagaggagagtag

SEQ ID NO: 158530 - DNA, 249 bp, Artificial Sequence; identical to SEQ ID NO: 158510
  Description of Artificial Sequence: Synthetic coding sequence

SEQ ID NO: 158531 - DNA, 249 bp, Artificial Sequence; identical to SEQ ID NO: 158510
  Description of Artificial Sequence: Synthetic coding sequence

SEQ ID NO: 158532 - DNA, 372 bp, Artificial Sequence
  Description of Artificial Sequence: Synthetic coding sequence
atgatggtgctgcaggtgtctgctgcccccaggacagtggccctgacagccctgctgatggtgctgctgacctctgtggtgcagggccgggccaccccagagaactacctgttccagggccggcaggagtgctacgccttcaacggcacccagcgcttcctggagcgctacatctacaaccgggaggagctggtgcgctttgacagtgatgtgggggagttccgggctgtgacagagctgggccggcctgaggccgagtactggaacagccagaaggacatcctggaggaggagagagctgtgcctgacaggatgtgccgccacaactatgagctgggcggccccatgaccctgcagaggagaggagagtag

SEQ ID NO: 158533 - DNA, 372 bp, Artificial Sequence
  Description of Artificial Sequence: Synthetic coding sequence
atgatggtgctgcaggtgtctgctgcccccaggacagtggccctgacagccctgctgatggtgctgctgacctctgtggtgcagggccgggccaccccagagaactacctgttccagggccggcaggagtgctacgccttcaacggcacccagcgcttcctggagcgctacatctacaaccgggaggagtttgtgcgctttgacagtgatgtgggggagttccgggctgtgacagagctgggccgcccagatgaggagtactggaacagccagaaggacatcctggaggagaagagagctgtgcctgacaggatgtgccgccacaactatgagctgggcggccccatgaccctgcagaggagaggagagtag

SEQ ID NO: 158534 - DNA, 372 bp, Artificial Sequence
  Description of Artificial Sequence: Synthetic coding sequence
atgatggtgctgcaggtgtctgctgcccccaggacagtggccctgacagccctgctgatggtgctgctgacctctgtggtgcagggccgggccaccccagagaactacctgttccagggccggcaggagtgctacgccttcaacggcacccagcgcttcctggagcgctacatctacaaccgggaggagtttgtgcgctttgacagtgatgtgggggagttccgggctgtgacagagctgggccgcccagatgaggagtactggaacagccagaaggacatcctggaggaggagagagctgtgcctgacaggatgtgccgccacaactatgagctgggcggccccatgaccctgcagaggagaggagagtag

SEQ ID NO: 158535 - DNA, 750 bp, Artificial Sequence
  Description of Artificial Sequence: Synthetic coding sequence
atggtgctgctgacctctgtggtgcagggccgggccaccccagaaaattatgtgtaccagctgcggcaggagtgctacgccttcaacggcacccagcgcttcctggagcgctacatctacaaccgggaggagtttgtgcgctttgacagtgatgtgggggagttccgggctgtgacagagctgggccgcccagatgaggactactggaacagccagaaggacctgctggaggagaagagagctgtgcctgacagagtgtgccgccacaactatgagctggatgaggccgtgaccctgcagaggagagtgcagcccaaggtgaatgtgagccccagcaagaagggccccctgcagcaccacaacctgctggtgtgccacgtgacagacttctacccaggcagcatccaggtgcgctggttcctgaatggccaggaggagacagctggggtggtgtccaccaacctgatcagaaatggagactggaccttccagatcctggtgatgctggagatgaccccccagcagggagatgtgtacatctgccaggtggagcacaccagcctggacagccctgtgacagtggagtggaaggcccagagcgacagcgcccggagcaagaccctgactggagctgggggctttgtgctgggcctcatcatctgtggggtgggcatcttcatgcacagaagaagcaagaagggggagaaggcctgcaagttcaatgaagacctgcacaagcagggcagctag

SEQ ID NO: 158536 - DNA, 249 bp, Artificial Sequence; identical to SEQ ID NO: 158510
  Description of Artificial Sequence: Synthetic coding sequence

SEQ ID NO: 158537 - DNA, 372 bp, Artificial Sequence; identical to SEQ ID NO: 158529
  Description of Artificial Sequence: Synthetic coding sequence

SEQ ID NO: 158538 - DNA, 372 bp, Artificial Sequence; identical to SEQ ID NO: 158529
  Description of Artificial Sequence: Synthetic coding sequence

SEQ ID NO: 158539 - DNA, 198 bp, Artificial Sequence
  Description of Artificial Sequence: Synthetic coding sequence
atggacagccctgtgacagtggagtggaaggcccagagcgacagcgcccggagcaagaccctgaccggggccggcggccgggccggggcccaccacctgtggagcggccacctgcacgcccaggaggagcaggagagcagcacccgcatctgcatcaacagagtgcctgagctgacagagaagaccatcgtgccctag

SEQ ID NO: 158540 - DNA, 381 bp, Artificial Sequence
  Description of Artificial Sequence: Synthetic coding sequence
atgatggtgctgcaggtgtctgctgcccccaggacagtggccctgacagccctgctgatggtgctgctgacctctgtggtgcagggccgggccaccccagagaactacgtgtaccagctgcggcaggagtgctacgccttcaacggcacccagcgcttcctggagcgctacatctacaaccgggaggagtttgtgcgctttgacagtgatgtgggggagttccgggctgtgacagagctgggccgcccagatgaggactactggaacagccagaaggacctgctggaggagaagagagctgtgcctgacagagtgtgccgccacaactatgagctggatgaagctgtgaccctgcagaggcgggagcggggcaagaagtag

SEQ ID NO: 158541 - DNA, 249 bp, Artificial Sequence
  Description of Artificial Sequence: Synthetic coding sequence
atgaccccccagcagggagatgtgtacatctgccaggtggagcacaccagcctggacagccctgtgacagtggagtggaaggcccagagcgacagcgcccggagcaagaccctgactggagctgggggccgggccggggcccaccacctgtggagcggccacctgcacgcccaggaggagcaggagagcagcacccgcatctgcatcaacagagtgcctgacctgacagagaagaccaacgtgccctag

SEQ ID NO: 158542 - DNA, 249 bp, Artificial Sequence; identical to SEQ ID NO: 158510
  Description of Artificial Sequence: Synthetic coding sequence

SEQ ID NO: 158543 - DNA, 372 bp, Artificial Sequence; identical to SEQ ID NO: 158533
  Description of Artificial Sequence: Synthetic coding sequence

SEQ ID NO: 158544 - DNA, 198 bp, Artificial Sequence; identical to SEQ ID NO: 158539
  Description of Artificial Sequence: Synthetic coding sequence

SEQ ID NO: 158545 - DNA, 768 bp, Artificial Sequence
  Description of Artificial Sequence: Synthetic coding sequence
atgatcctgaacaaggccctgctgctgggcgccctggccctgaccaccgtgatgagcccctgtggcggggaggacatcgtggccgaccacgtggccagctgtggggtgaacctgtaccagttctacggccccagcggccagtacacccatgaatttgatggagatgagcagttctacgtggacctggagaggaaggagacagcctggcgctggccagagttcagcaagtttggaggctttgacccccagggcgccctgaggaacatggctgtggccaagcacaacctgaacatcatgatcaagcgctacaacagcacagctgccaccaatgaggtgcctgaggtgaccgtcttcagcaagagccctgtgaccctgggccagcccaacaccctcatctgcctggtggacaacatcttcccccctgtggtgaacatcacctggctgagcaatggccagagcgtgacagaaggagtgtctgagaccagcttcctgagcaagagtgaccacagcttcttcaagatctcctacctgaccttcctgcccagcgcagatgagatctatgactgcaaggtggagcactggggcctggaccagcccctgctgaagcactgggagcctgagatcccagcccccatgtctgagctgacagagaccgtggtgtgtgccctgggcctgtctgtgggcctgatgggcatcgtggtgggcaccgtcttcatcatccagggcctgcggtctgtgggcgccagccgccaccagggccccctgtag

SEQ ID NO: 158546 - DNA, 768 bp, Artificial Sequence; identical to SEQ ID NO: 158545
  Description of Artificial Sequence: Synthetic coding sequence

SEQ ID NO: 158547 - DNA, 765 bp, Artificial Sequence
  Description of Artificial Sequence: Synthetic coding sequence
atgatcctgaacaaggccctgatgctgggcgccctggccctgaccaccgtgatgagcccctgtggcggggaggacatcgtggccgaccacgtggccagctatggagtgaacctgtaccagagctatggccccagcggccagtacacccatgaatttgatggagatgagcagttctacgtggacctgggcaggaaggagaccgtgtggtgcctgcctgtgctgcggcagttccgctttgacccccagtttgccctgaccaacattgctgtgctgaagcacaacctgaacagcctcatcaagaggagcaacagcacagctgccaccaatgaggtgcctgaggtgacagtgttcagcaagagccctgtgaccctgggccagcccaacatcctgatctgcctggtggacaacatcttcccccctgtggtgaacatcacctggctgagcaatggccacagcgtgacagagggcgtgtctgagaccagcttcctgagcaagagtgaccacagcttcttcaagatctcctacctgaccctgctgcccagcgctgaggagagctatgactgcaaggtggagcactggggcctggacaagcccctgctgaagcactgggagcctgagatcccagcccccatgtctgagctgacagaaacagtggtgtgtgccctgggcctgtctgtgggcctggtgggcatcgtggtgggcaccgtcttcatcatccggggcctgcggtctgtgggcgccagccgccaccagggccccctgtag

SEQ ID NO: 158548 - DNA, 768 bp, Artificial Sequence; identical to SEQ ID NO: 158545
  Description of Artificial Sequence: Synthetic coding sequence

SEQ ID NO: 158549 - DNA, 768 bp, Artificial Sequence; identical to SEQ ID NO: 158545
  Description of Artificial Sequence: Synthetic coding sequence

SEQ ID NO: 158550 - DNA, 765 bp, Artificial Sequence; identical to SEQ ID NO: 158547
  Description of Artificial Sequence: Synthetic coding sequence

SEQ ID NO: 158551 - DNA, 765 bp, Artificial Sequence; identical to SEQ ID NO: 158547
  Description of Artificial Sequence: Synthetic coding sequence

SEQ ID NO: 158552 - DNA, 75 bp, Artificial Sequence
  Description of Artificial Sequence: Synthetic coding sequence
atgatcctgaacaaggccctgatgctgggcgccctggccctgaccaccgtgatgagcccctgtggcggggagtag

SEQ ID NO: 158553 - DNA, 765 bp, Artificial Sequence
  Description of Artificial Sequence: Synthetic coding sequence
atgatcctgaacaaggccctgatgctgggcgccctggccctgaccaccgtgatgagcccctgtggcggggaggacatcgtggccgaccacgtggccagctatggagtgaacctgtaccagagctatggccccagcggccagttcacccatgaatttgatggagatgaggagttctacgtggacctggagaggaaggagaccgtgtggaagctgcccctcttccaccggctgcgctttgacccccagtttgccctgaccaacattgctgtgctgaagcacaacctgaacatcctgatcaagaggagcaacagcacagctgccaccaatgaggtgcctgaggtgacagtgttcagcaagagccctgtgaccctgggccagcccaacaccctcatctgcctggtggacaacatcttcccccctgtggtgaacatcacctggctgagcaatggccacagcgtgacagagggcgtgtctgagaccagcttcctgagcaagagtgaccacagcttcttcaagatctcctacctgaccttcctgcccagcgcagatgagatctatgactgcaaggtggagcactggggcctggatgagcccctgctgaagcactgggagcctgagatcccagcccccatgtctgagctgacagaaacagtggtgtgtgccctgggcctgtctgtgggcctggtgggcatcgtggtgggcaccgtgctgatcatccggggcctgcggtctgtgggcgccagccgccaccagggccccctgtag

SEQ ID NO: 158554 - DNA, 768 bp, Artificial Sequence
  Description of Artificial Sequence: Synthetic coding sequence
atgatcctgaacaaggccctgatgctgggcgccctggccctgaccaccgtgatgagcccctgtggcggggaggacatcgtggccgaccacgtggccagctatggagtgaacctgtaccagagctatggccccagcggccagtacagccatgaatttgatggagatgaggagttctacgtggacctggagaggaaggagaccgtgtggcagctgcccctcttccgccgcttccgccgctttgacccccagtttgccctgaccaacattgctgtgctgaagcacaacctgaacatcgtcatcaagaggagcaacagcacagctgccaccaatgaggtgcctgaggtgaccgtcttcagcaagagccctgtgaccctgggccagcccaacaccctcatctgcctggtggacaacatcttcccccctgtggtgaacatcacctggctgagcaatggccacagcgtgacagaaggagtgtctgagaccagcttcctgagcaagagtgaccacagcttcttcaagatctcctacctgaccttcctgcccagcgcagatgagatctatgactgcaaggtggagcactggggcctggatgagcccctgctgaagcactgggagcctgagatccccacccccatgtctgagctgacagagaccgtggtgtgtgccctgggcctgtctgtgggcctggtgggcatcgtggtgggcaccgtgctgatcatccggggcctgcggtctgtgggcgccagccgccaccagggccccctgtag

SEQ ID NO: 158555 - DNA, 768 bp, Artificial Sequence
  Description of Artificial Sequence: Synthetic coding sequence
atgatcctgaacaaggccctgatgctgggcgccctggccctgaccaccgtgatgagcccctgtggcggggaggacatcgtggccgaccacgtggccagctatggagtgaacctgtaccagagctatggccccagcggccagtacagccatgaatttgatggagatgaggagttctacgtggacctggagaggaaggagaccgtgtggcagctgcccctcttccgccgcttccgccgctttgacccccagtttgccctgaccaacattgctgtgctgaagcacaacctgaacatcgtcatcaagaggagcaacagcacagctgccaccaatgaggtgcctgaggtgaccgtcttcagcaagagccctgtgaccctgggccagcccaacaccctcatctgcctggtggacaacatcttcccccctgtggtgaacatcacctggctgagcaatggccacagcgtgacagaaggagtgtctgagaccagcttcctgagcaagagtgaccacagcttcttcaagatctcctacctgaccttcctgcccagtgatgatgagatctatgactgcaaggtggagcactggggcctggatgagcccctgctgaagcactgggagcctgagatccccacccccatgtctgagctgacagagaccgtggtgtgtgccctgggcctgtctgtgggcctggtgggcatcgtggtgggcaccgtgctgatcatccggggcctgcggtctgtgggcgccagccgccaccagggccccctgtag

SEQ ID NO: 158556 - DNA, 75 bp, Artificial Sequence
  Description of Artificial Sequence: Synthetic coding sequence
atgatcctgaacaaggccctgctgctgggcgccctggccctgaccaccgtgatgagcccctgtggcggggagtag

SEQ ID NO: 158557 - DNA, 768 bp, Artificial Sequence; identical to SEQ ID NO: 158555
  Description of Artificial Sequence: Synthetic coding sequence

SEQ ID NO: 158558 - DNA, 765 bp, Artificial Sequence; identical to SEQ ID NO: 158553
  Description of Artificial Sequence: Synthetic coding sequence

SEQ ID NO: 158559 - DNA, 765 bp, Artificial Sequence; identical to SEQ ID NO: 158553
  Description of Artificial Sequence: Synthetic coding sequence

SEQ ID NO: 158560 - DNA, 765 bp, Artificial Sequence; identical to SEQ ID NO: 158553
  Description of Artificial Sequence: Synthetic coding sequence

SEQ ID NO: 158561 - DNA, 768 bp, Artificial Sequence; identical to SEQ ID NO: 158554
  Description of Artificial Sequence: Synthetic coding sequence

SEQ ID NO: 158562 - DNA, 75 bp, Artificial Sequence; identical to SEQ ID NO: 158552
  Description of Artificial Sequence: Synthetic coding sequence

SEQ ID NO: 158563 - DNA, 75 bp, Artificial Sequence; identical to SEQ ID NO: 158552
  Description of Artificial Sequence: Synthetic coding sequence

SEQ ID NO: 158564 - DNA, 768 bp, Artificial Sequence; identical to SEQ ID NO: 158555
  Description of Artificial Sequence: Synthetic coding sequence

SEQ ID NO: 158565 - DNA, 765 bp, Artificial Sequence; identical to SEQ ID NO: 158553
  Description of Artificial Sequence: Synthetic coding sequence

SEQ ID NO: 158566 - DNA, 765 bp, Artificial Sequence; identical to SEQ ID NO: 158553
  Description of Artificial Sequence: Synthetic coding sequence

SEQ ID NO: 158567 - DNA, 765 bp, Artificial Sequence; identical to SEQ ID NO: 158553
  Description of Artificial Sequence: Synthetic coding sequence

SEQ ID NO: 158568 - DNA, 768 bp, Artificial Sequence; identical to SEQ ID NO: 158555
  Description of Artificial Sequence: Synthetic coding sequence

SEQ ID NO: 158569 - DNA, 765 bp, Artificial Sequence; identical to SEQ ID NO: 158553
  Description of Artificial Sequence: Synthetic coding sequence

SEQ ID NO: 158570 - DNA, 645 bp, Artificial Sequence
  Description of Artificial Sequence: Synthetic coding sequence
atgatcctgaacaaggccctgctgctgggcgccctggccctgaccaccgtgatgagcccctgtggcggggaggacatcgtggccgaccacgtggccagctgtggggtgaacctgtaccagttctacggccccagcggccagtacacccatgaatttgatggagatgagcagttctacgtggacctggagaggaaggagacagcctggcgctggccagagttcagcaagtttggaggctttgacccccagggcgccctgaggaacatggctgtggccaagcacaacctgaacatcatgatcaagcgctacaacagcacagctgccaccaatgaggtgcctgaggtgaccgtcttcagcaagagccctgtgaccctgggccagcccaacaccctcatctgcctggtggacaacatcttcccccctgtggtgaacatcacctggctgagcaatggccagagcgtgacagaaggagtgtctgagaccagcttcctgagcaagagtgaccacagcttcttcaagatctcctacctgaccttcctgcccagcgcagatgagatctatgactgcaaggtggagcactggggcctggaccagcccctgctgaagcactggggcgccagccccagcactggagctgaggagtag

SEQ ID NO: 158571 - DNA, 576 bp, Artificial Sequence
  Description of Artificial Sequence: Synthetic coding sequence
atgagcccctgtggaggagaagatattgtggccgaccacgtggccagctatggagtgaacctgtaccagagctatggccccagcggccagtacagccatgaatttgatggagatgaggagttctacgtggacctggagaggaaggagaccgtgtggcagctgcccctcttccgccgcttcagaagatttgacccccagtttgccctgaccaacattgctgtgctgaagcacaacctgaacatcgtcatcaagaggagcaacagcacagctgccaccaatgaggtgcctgaggtgacagtgttcagcaagagccctgtgaccctgggccagcccaacaccctcatctgcctggtggacaacatcttcccccctgtggtgaacatcacctggctgagcaatggccacagcgtgacagagggcgtgtctgagaccagcttcctgagcaagagtgaccacagcttcttcaagatctcctacctgaccttcctgcccagcgcagatgagatctatgactgcaaggtggagcactggggcctggatgagcccctgctgaagcactggggcctgctgcactag

SEQ ID NO: 158572 - DNA, 441 bp, Artificial Sequence
  Description of Artificial Sequence: Synthetic coding sequence
atgatcctgaacaaggccctgatgctgggcgccctggccctgaccaccgtgatgagcccctgtggcggggaggacatcgtggccgaccacgtggccagctatggagtgaacctgtaccagagctatggccccagcggccagtacacccatgaatttgatggagatgagcagttctacgtggacctgggcaggaaggagaccgtgtggtgcctgcctgtgctgcggcagttccgctttgacccccagtttgccctgaccaacatgtgcatcgccatctaccgcagccggcgggtggacctgctgcatgacctggccctcttcagcggccccatctaccacatccccttcctgctgcagatgttcctgctgagccccctgctgtgggacctgaactgctacatctgcagcgagctgaccaatgcctttgagctgttcccctag

SEQ ID NO: 158573 - DNA, 762 bp, Artificial Sequence
  Description of Artificial Sequence: Synthetic coding sequence
ggctgcctgggcaagaggatgatcctgaacaaggccctgatgctgggcgccctggccctgaccaccgtgatgagcccctgtggcggggaggacatcgtggccgaccacgtggccagctatggagtgaacctgtaccagagctatggccccagcggccagtacacccatgaatttgatggagatgagcagttctacgtggacctgggcaggaaggagaccgtgtggtgcctgcctgtgctgcggcagttccgctttgacccccagtttgccctgaccaacattgctgtgctgaagcacaacctgaacagcctcatcaagaggagcaacagcacagctgccaccaatgaggtgcctgaggtgacagtgttcagcaagagccctgtgaccctgggccagcccaacatcctgatctgcctggtggacaacatcttcccccctgtggtgaacatcacctggctgagcaatggccacagcgtgacagagggcgtgtctgagaccagcttcctgagcaagagtgaccacagcttcttcaagatctcctacctgaccctgctgcccagcgctgaggagagctatgactgcaaggtggagcactggggcctggacaagcccctgctgaagcactggggcaaggatgagttccaccacttcctgatgctgagctgcctgagcagcagcgagctgcctgccttctacagctacatccccaagctggtgttccacacctcctgggtgtccttcttcctgatcttcttcttctag

SEQ ID NO: 158574 - DNA, 603 bp, Artificial Sequence
  Description of Artificial Sequence: Synthetic coding sequence
atgagcccctgtggaggagaagatattgtggccgaccacgtggccagctatggagtgaacctgtaccagagctatggccccagcggccagtacagccatgaatttgatggagatgaggagttctacgtggacctggagaggaaggagaccgtgtggcagctgcccctcttccgccgcttcagaagatttgacccccagtttgccctgaccaacattgctgtgctgaagcacaacctgaacatcgtcatcaagaggagcaacagcacagctgccaccaatgaggtgcctgaggtgacagtgttcagcaagagccctgtgaccctgggccagcccaacaccctcatctgcctggtggacaacatcttcccccctgtggtgaacatcacctggctgagcaatggccacagcgtgacagagggcgtgtctgagaccagcttcctgagcaagagtgaccacagcttcttcaagatctcctacctgaccttcctgcccagcgcagatgagatctatgactgcaaggtggagcactggggcctggatgagcccctgctgaagcactgggagagccagagccgggagagcgaggagagcaccaagagctag

SEQ ID NO: 158575 - DNA, 582 bp, Artificial Sequence
  Description of Artificial Sequence: Synthetic coding sequence
atgagcccctgtggaggagaagatattgtggccgaccacgtggccagctatggagtgaacctgtaccagagctatggccccagcggccagtacacccatgaatttgatggagatgagcagttctacgtggacctgggcaggaaggagaccgtgtggtgcctgcctgtgctgcggcagttccgctttgacccccagtttgccctgaccaacattgctgtgctgaagcacaacctgaacagcctcatcaagaggagcaacagcacagctgccaccaatgaggtgcctgaggtgaccgtcttcagcaagagccctgtgaccctgggccagcccaacatcctgatctgcctggtggacaacatcttcccccctgtggtgaacatcacctggctgagcaatggccacagcgtgacagaaggagtgtctgagaccagcttcctgagcaagagtgaccacagcttcttcaagatctcctacctgaccctgctgcccagcgctgaggagagctatgactgcaaggtggagcactggggcctggacaagcccctgctgaagcactgggtgcacggcttcctgtccttctag

SEQ ID NO: 158576 - DNA, 606 bp, Artificial Sequence
  Description of Artificial Sequence: Synthetic coding sequence
atgagcccctgtggaggagaagatattgtggccgaccacgtggccagctatggagtgaacctgtaccagagctatggccccagcggccagtacagccatgaatttgatggagatgaggagttctacgtggacctggagaggaaggagaccgtgtggcagctgcccctcttccgccgcttcagaagatttgacccccagtttgccctgaccaacattgctgtgctgaagcacaacctgaacatcgtcatcaagaggagcaacagcacagctgccaccaatgaggtgcctgaggtgacagtgttcagcaagagccctgtgaccctgggccagcccaacaccctcatctgcctggtggacaacatcttcccccctgtggtgaacatcacctggctgagcaatggccacagcgtgacagagggcgtgtctgagaccagcttcctgagcaagagtgaccacagcttcttcaagatctcctacctgaccttcctgcccagcgcagatgagatctatgactgcaaggtggagcactggggcctggatgagcccctgctgaagcactggggcatccaggccgaggagggccagaggaggaagaagctgggctag

SEQ ID NO: 158577 - DNA, 258 bp, Artificial Sequence
  Description of Artificial Sequence: Synthetic coding sequence
aacaccctcatctgcctggtggacaacatcttcccccctgtggtgaacatcacctggctgagcaatggccacagcgtgacagaaggagtgtctgagaccagcttcctgagcaagagtgaccacagcttcttcaagatctcctacctgaccttcctgcccagcgcagatgagatctatgactgcaaggtggagcactggggcctggatgagcccctgctgaagcactggggcaaggacttcatgtccttcttctactag

SEQ ID NO: 158578 - DNA, 390 bp, Artificial Sequence
  Description of Artificial Sequence: Synthetic coding sequence
ggctgcctgggcaagaggatgatcctgaacaaggccctgatgctgggcgccctggccctgaccaccgtgatgagcccctgtggcggggaggacatcgtggccgaccacgtggccagctatggagtgaacctgtaccagagctatggccccagcggccagtacagccatgaatttgatggagatgaggagttctacgtggacctggagaggaaggagaccgtgtggcagctgcccctcttccgccgcttccgccgctttgacccccagtttgccctgaccaacattgctgtgctgaagcacaacctgaacatcgtcatcaagaggagcaacagcacagctgccaccaatgaggtgcctgaggtgaccgtcttcagcaagagccctgtgtag

SEQ ID NO: 158579 - DNA, 768 bp, Artificial Sequence
  Description of Artificial Sequence: Synthetic coding sequence
atgatcctgaacaaggccctgctgctgggcgccctggccctgacagctgtgatgagcccctgtggcggggaggacatcgtggccgaccacgtggccagctatggagtgaacttctaccagagccacggccccagcggccagtacacccatgaatttgatggagatgaggagttctacgtggacctggagaccaaggagaccgtgtggcagctgcccatgttcagcaagttcatcagctttgacccccagagcgccctgaggaacatggctgtgggcaagcacaccctggagttcatgatgaggcagagcaacagcacagctgccaccaatgaggtgcctgaggtgaccgtcttcagcaagtttcctgtgaccctgggccagcccaacaccctcatctgcctggtggacaacatcttcccccctgtggtgaacatcacctggctgagcaatggccacagcgtgacagaaggagtgtctgagaccagcttcctgagcaagagtgaccacagcttcttcaagatctcctacctgaccttcctgcccagcgcagatgagatctatgactgcaaggtggagcactggggcctggatgagcccctgctgaagcactgggagcctgagatcccagcccccatgtctgagctgacagagaccctggtgtgtgccctgggcctgtctgtgggcctgatgggcatcgtggtgggcaccgtcttcatcatccagggcctgcggtctgtggatgccagccgccaccagggcctgctgtag

SEQ ID NO: 158580 - DNA, 768 bp, Artificial Sequence
  Description of Artificial Sequence: Synthetic coding sequence
atgatcctgaacaaggccctgctgctgggcgccctggccctgacagctgtgatgagcccctgtggcggggaggacatcgtggccgaccacgtggccagctatggagtgaacttctaccagagccacggccccagcggccagtacacccatgaatttgatggagatgaggagttctacgtggacctggagaccaaggagaccgtgtggcagctgcccatgttcagcaagttcatcagctttgacccccagagcgccctgaggaacatggctgtgggcaagcacaccctggagttcatgatgaggcagagcaacagcacagctgccaccaatgaggtgcctgaggtgaccgtcttcagcaagtttcctgtgaccctgggccagcccaacaccctcatctgcctggtggacaacatcttcccccctgtggtgaacatcacctggctgagcaatggccacagcgtgacagaaggagtgtctgagaccagcttcctgagcaagagtgaccacagcttcttcaagatctcctacctgaccttcctgcccagcgcagatgagatctatgactgcaaggtggagcactggggcctggatgagcccctgctgaagcactgggagcctgagatcccagcccccatgtctgagctgacagagaccctggtgtgtgccctgggcctgtctgtgggcctgatgggcatcgtggtgggcaccgtcttcatcatccagggcctgcggtctgtgggcgccagccgccaccagggcctgctgtag

SEQ ID NO: 158581 - DNA, 768 bp, Artificial Sequence
  Description of Artificial Sequence: Synthetic coding sequence
atgatcctgaacaaggccctgctgctgggcgccctggccctgacagctgtgatgagcccctgtggcggggaggacatcgtggccgaccacgtggccagctatggagtgaacttctaccagagccacggccccagcggccagtacacccatgaatttgatggagatgaggagttctacgtggacctggagaccaaggagaccgtgtggcagctgcccatgttcagcaagttcatcagctttgacccccagagcgccctgaggaacatggctgtgggcaagcacaccctggagttcatgatgggccagagcaacagcacagctgccaccaatgaggtgcctgaggtgaccgtcttcagcaagtttcctgtgaccctgggccagcccaacaccctcatctgcctggtggacaacatcttcccccctgtggtgaacatcacctggctgagcaatggccacagcgtgacagaaggagtgtctgagaccagcttcctgagcaagagtgaccacagcttcttcaagatctcctacctgaccttcctgcccagcgcagatgagatctatgactgcaaggtggagcactggggcctggatgagcccctgctgaagcactgggagcctgagatcccagcccccatgtctgagctgacagagaccctggtgtgtgccctgggcctgtctgtgggcctgatgggcatcgtggtgggcaccgtcttcatcatccagggcctgcggtctgtgggcgccagccgccaccagggcctgctgtag

SEQ ID NO: 158582 - DNA, 768 bp, Artificial Sequence; identical to SEQ ID NO: 158580
  Description of Artificial Sequence: Synthetic coding sequence

SEQ ID NO: 158583 - DNA, 768 bp, Artificial Sequence
  Description of Artificial Sequence: Synthetic coding sequence
atgatcctgaacaaggccctgctgctgggcgccctggccctgacagctgtgatgagcccctgtggcggggaggacatcgtggccgaccacgtggccagctatggagtgaacttctaccagagccacggccccagcggccagtacacccatgaatttgatggagatgaggagttctacgtggacctggagaccaaggagaccgtgtggcagctgcccatgttcagcaagttcatcagctttgacccccagagcgccctgaggaacatggctgtgggcaagcacaccctggagttcatgatgaggcagagcaacagcacagctgccaccaatgaggtgcctgaggtgaccgtcttcagcaagtttcctgtgaccctgggccagcccaacaccctcatctgcctggtggacaacatcttcccccctgtggtgaacatcacctggctgagcaatggccacagcgtgacagaaggagtgtctgagaccagcttcctgagcaagagtgaccacagcttcttcaagatctcctacctgaccttcctgcccagcgcagatgagatctatgactgcaaggtggagcactggggcctggatgagcccctgctgaagcactgggagcctgagatcccagcccccatgtctgagctgacagagaccctggtgtgtgccctgggcctgtctgctggcctgatgggcatcgtggtgggcaccgtcttcatcatccagggcctgcggtctgtgggcgccagccgccaccagggcctgctgtag

SEQ ID NO: 158584 - DNA, 768 bp, Artificial Sequence; identical to SEQ ID NO: 158580
  Description of Artificial Sequence: Synthetic coding sequence

SEQ ID NO: 158585 - DNA, 768 bp, Artificial Sequence; identical to SEQ ID NO: 158580
  Description of Artificial Sequence: Synthetic coding sequence

SEQ ID NO: 158586 - DNA, 768 bp, Artificial Sequence; identical to SEQ ID NO: 158583
  Description of Artificial Sequence: Synthetic coding sequence

SEQ ID NO: 158587 - DNA, 768 bp, Artificial Sequence; identical to SEQ ID NO: 158580
  Description of Artificial Sequence: Synthetic coding sequence

SEQ ID NO: 158588 - DNA, 249 bp, Artificial Sequence
  Description of Artificial Sequence: Synthetic coding sequence
gaccacgtggccagctatggagtgaacttctaccagagccacggccccagcggccagtacacccatgaatttgatggagatgaggagttctacgtggacctggagaccaaggagaccgtgtggcagctgcccatgttcagcaagttcatcagctttgacccccagagcgccctgaggaacatggctgtgggcaagcacaccctggagttcatgatgaggcagagcaacagcacagctgccaccaactag

SEQ ID NO: 158589 - DNA, 768 bp, Artificial Sequence; identical to SEQ ID NO: 158580
  Description of Artificial Sequence: Synthetic coding sequence

SEQ ID NO: 158590 - DNA, 84 bp, Artificial Sequence
  Description of Artificial Sequence: Synthetic coding sequence
atgatcctgaacaaggccctgctgctgggcgccctggccctgacagctgtgatgagcccctgtggcggggaggacatcgtgtag

SEQ ID NO: 158591 - DNA, 810 bp, Artificial Sequence
  Description of Artificial Sequence: Synthetic coding sequence
atgtcctggaagaaggccctgcgcatccctggggacctgcgggtggccaccgtgaccctgatgctggccatgctgagcagcctgctggccgagggccgggacagcccagaagattttgtgttccagttcaagggcatgtgctacttcaccaatggaacagagcgggtgcggctggtgacccgctacatctacaaccgggaggagtatgccaggtttgacagtgatgtgggcgtgtacagagctgtgaccccccagggccgcccagatgctgagtactggaacagccagaaggaggtgctggagggcaccagggctgagctggacacagtgtgccgccacaactatgaggtggccttccggggcatcctgcagaggagagtggagcccaccgtgaccatcagccccagcaggacagaggccctgaaccaccacaacctgctggtgtgcagcgtgacagacttctacccaggccagatcaaggtgcgctggttcagaaatgaccaggaggagacagctggggtggtgtccacccccctcatcagaaatggagactggaccttccagatcctggtgatgctggagatgaccccccagagaggagatgtgtacacctgccacgtggagcaccccagcctgcagagccccatcaccgtggagtggagggcccagagcgagagcgcccagagcaagatgctgtctggagtgggcggctttgtgctgggcctcatcttcctgggcctgggcctcatcatccggcagaggagccagaagggcccccagggccccccacctgctggcctgctgcactag

SEQ ID NO: 158592 - DNA, 786 bp, Artificial Sequence
  Description of Artificial Sequence: Synthetic coding sequence
atgtcctggaagaaggccctgcgcatccctgggggcctgcgggccgccaccgtgaccctgatgctgtccatgctgagcacccctgtggccgagggccgggacagcccagaagattttgtgtaccagttcaagggcatgtgctacttcaccaatggaacagagcgggtgcggctggtgagccgcagcatctacaaccgggaggagatcgtgcgctttgacagtgatgtgggggagttccgggctgtgaccctgctgggcctgcctgctgctgagtactggaacagccagaaggacatcctggagaggaagagagctgctgtggacagagtgtgccgccacaactaccagctggagctgcggaccaccctgcagaggagagtggagcccaccgtgaccatcagccccagcaggacagaggccctgaaccaccacaacctgctggtgtgcagcgtgacagacttctacccagcccagatcaaggtgcgctggttcagaaatgaccaggaggagacagctggggtggtgtccacccccctcatcagaaatggagactggaccttccagatcctggtgatgctggagatgaccccccagagaggagatgtgtacacctgccacgtggagcaccccagcctgcagagccccatcaccgtggagtggagggcccagagcgagagcgcccagagcaagatgctgtctggaattggaggctttgtgctgggcctcatcttcctgggcctgggcctcatcatccaccacaggagccagaagggcctgctgcactag

SEQ ID NO: 158593 - DNA, 786 bp, Artificial Sequence; identical to SEQ ID NO: 158592
  Description of Artificial Sequence: Synthetic coding sequence

SEQ ID NO: 158594 - DNA, 810 bp, Artificial Sequence
  Description of Artificial Sequence: Synthetic coding sequence
atgtcctggaagaaggccctgcgcatccctgggggcctgcgggccgccaccgtgaccctgatgctggccatgctgagcacccctgtggccgagggccgggacagcccagaagattttgtgtaccagttcaaggccatgtgctacttcaccaatggaacagagcgggtgcgctacgtgacccgctacatctacaaccgggaggagtatgccaggtttgacagtgatgtggaggtgtacagagctgtgacccccctgggccccccagatgctgagtactggaacagccagaaggaggtgctggagaggaccagggctgagctggacacagtgtgccgccacaactaccagctggagctgcggaccaccctgcagaggagagtggagcccaccgtgaccatcagccccagcaggacagaggccctgaaccaccacaacctgctggtgtgcagcgtgacagacttctacccagcccagatcaaggtgcgctggttcagaaatgaccaggaggagaccaccggggtggtgtccacccccctcatcagaaatggagactggaccttccagatcctggtgatgctggagatgaccccccagcacggagatgtgtacacctgccacgtggagcaccccagcctgcagaaccccatcaccgtggagtggagggcccagagcgagagcgcccagagcaagatgctgtctggaattggaggctttgtgctgggcctcatcttcctgggcctgggcctcatcatccaccacaggagccagaagggcccccagggccccccacctgctggcctgctgcactag

SEQ ID NO: 158595 - DNA, 810 bp, Artificial Sequence
  Description of Artificial Sequence: Synthetic coding sequence
atgtcctggaagaaggccctgcgcatccctgggggcctgcgggtggccaccgtgaccctgatgctggccatgctgagcacccctgtggccgagggccgggacagcccagaagattttgtgtaccagttcaagggcatgtgctacttcaccaatggaacagagcgggtgcggctggtgacccgctacatctacaaccgggaggagtatgccaggtttgacagtgatgtgggcgtgtacagagctgtgacccccctgggccccccagatgctgagtactggaacagccagaaggaggtgctggagaggaccagggctgagctggacacagtgtgccgccacaactaccagctggagctgcggaccaccctgcagaggagagtggagcccaccgtgaccatcagccccagcaggacagaggccctgaaccaccacaacctgctggtgtgcagcgtgacagacttctacccagcccagatcaaggtgcgctggttcagaaatgaccaggaggagaccaccggggtggtgtccacccccctcatcagaaatggagactggaccttccagatcctggtgatgctggagatgaccccccagagaggagatgtgtacacctgccacgtggagcaccccagcctgcagaaccccatcatcgtggagtggagggcccagagcgagagcgcccagagcaagatgctgtctggaattggaggctttgtgctgggcctcatcttcctgggcctgggcctcatcatccaccacaggagccagaagggcccccagggccccccacctgctggcctgctgcactag

SEQ ID NO: 158596 - DNA, 675 bp, Artificial Sequence
  Description of Artificial Sequence: Synthetic coding sequence
atgtcctggaagaaggccctgcgcatccctggggacctgcgggtggccaccgtgaccctgatgctggccatgctgagcagcctgctggccgagggccgggacagcccagaagattttgtgttccagttcaagggcatgtgctacttcaccaatggaacagagcgggtgcggctggtgacccgctacatctacaaccgggaggagtatgccaggtttgacagtgatgtgggcgtgtacagagctgtgaccccccagggccgcccagatgctgagtactggaacagccagaaggaggtgctggagggcaccagggctgagctggacacagtgtgccgccacaactatgaggtggccttccggggcatcctgcagaggagagtggagcccaccgtgaccatcagccccagcaggacagaggccctgaaccaccacaacctgctggtgtgcagcgtgacagacttctacccaggccagatcaaggtgcgctggttcagaaatgaccaggaggagacagctggggtggtgtccacccccctcatcagaaatggagactggaccttccagatcctggtgatgctggagatgaccccccagagaggagatgtgtacacctgccacgtggagcaccccagcctgcagagccccatcaccgtggagtggaggctgctgcactag

SEQ ID NO: 158597 - DNA, 786 bp, Artificial Sequence
  Description of Artificial Sequence: Synthetic coding sequence
atgtcctggaagaaggccctgcgcatccctggggacctgcgggtggccaccgtgaccctgatgctggccatgctgagcagcctgctggccgagggccgggacagcccagaagattttgtgttccagttcaagggcatgtgctacttcaccaatggaacagagcgggtgcggctggtgacccgctacatctacaaccgggaggagtatgccaggtttgacagtgatgtgggcgtgtacagagctgtgaccccccagggccgcccagatgctgagtactggaacagccagaaggaggtgctggagggcaccagggctgagctggacacagtgtgccgccacaactatgaggtggccttccggggcatcctgcagaggagagtggagcccaccgtgaccatcagccccagcaggacagaggccctgaaccaccacaacctgctggtgtgcagcgtgacagacttctacccaggccagatcaaggtgcgctggttcagaaatgaccaggaggagacagctggggtggtgtccacccccctcatcagaaatggagactggaccttccagatcctggtgatgctggagatgaccccccagagaggagatgtgtacacctgccacgtggagcaccccagcctgcagagccccatcaccgtggagtggagggcccagagcgagagcgcccagagcaagatgctgtctggagtgggcggctttgtgctgggcctcatcttcctgggcctgggcctcatcatccggcagaggagccagaagggcctgctgcactag

SEQ ID NO: 158598 - DNA, 786 bp, Artificial Sequence
  Description of Artificial Sequence: Synthetic coding sequence
atgtcctggaagaaggccctgcgcatccctgggggcctgcgggccgccaccgtgaccctgatgctggccatgctgagcacccctgtggccgagggccgggacagcccagaagattttgtgtaccagttcaaggccatgtgctacttcaccaatggaacagagcgggtgcgctacgtgacccgctacatctacaaccgggaggagtatgccaggtttgacagtgatgtggaggtgtacagagctgtgacccccctgggccccccagatgctgagtactggaacagccagaaggaggtgctggagaggaccagggctgagctggacacagtgtgccgccacaactaccagctggagctgcggaccaccctgcagaggagagtggagcccaccgtgaccatcagccccagcaggacagaggccctgaaccaccacaacctgctggtgtgcagcgtgacagacttctacccagcccagatcaaggtgcgctggttcagaaatgaccaggaggagaccaccggggtggtgtccacccccctcatcagaaatggagactggaccttccagatcctggtgatgctggagatgaccccccagcacggagatgtgtacacctgccacgtggagcaccccagcctgcagaaccccatcaccgtggagtggagggcccagagcgagagcgcccagagcaagatgctgtctggaattggaggctttgtgctgggcctcatcttcctgggcctgggcctcatcatccaccacaggagccagaagggcctgctgcactag

SEQ ID NO: 158599 - DNA, 675 bp, Artificial Sequence
  Description of Artificial Sequence: Synthetic coding sequence
atgtcctggaagaaggccctgcgcatccctgggggcctgcgggccgccaccgtgaccctgatgctgtccatgctgagcacccctgtggccgagggccgggacagcccagaagattttgtgtaccagttcaagggcatgtgctacttcaccaatggaacagagcgggtgcggctggtgagccgcagcatctacaaccgggaggagatcgtgcgctttgacagtgatgtgggggagttccgggctgtgaccctgctgggcctgcctgctgctgagtactggaacagccagaaggacatcctggagaggaagagagctgctgtggacagagtgtgccgccacaactaccagctggagctgcggaccaccctgcagaggagagtggagcccaccgtgaccatcagccccagcaggacagaggccctgaaccaccacaacctgctggtgtgcagcgtgacagacttctacccagcccagatcaaggtgcgctggttcagaaatgaccaggaggagacagctggggtggtgtccacccccctcatcagaaatggagactggaccttccagatcctggtgatgctggagatgaccccccagagaggagatgtgtacacctgccacgtggagcaccccagcctgcagagccccatcaccgtggagtggaggctgctgcactag

SEQ ID NO: 158600 - DNA, 786 bp, Artificial Sequence; identical to SEQ ID NO: 158598
  Description of Artificial Sequence: Synthetic coding sequence

SEQ ID NO: 158601 - DNA, 786 bp, Artificial Sequence
  Description of Artificial Sequence: Synthetic coding sequence
atgtcctggaagaaggccctgcgcatccctgggggcctgcgggtggccaccgtgaccctgatgctggccatgctgagcacccctgtggccgagggccgggacagcccagaagattttgtgtaccagttcaagggcatgtgctacttcaccaatggaacagagcgggtgcggggcgtgacccgctacatctacaaccgggaggagtatgccaggtttgacagtgatgtgggcgtgtacagagctgtgacccccctgggccccccagctgctgagtactggaacagccagaaggaggtgctggagaggaccagggctgagctggacacagtgtgccgccacaactaccagctggagctgcggaccaccctgcagaggagagtggagcccaccgtgaccatcagccccagcaggacagaggccctgaaccaccacaacctgctggtgtgcagcgtgacagacttctacccagcccagatcaaggtgcgctggttcagaaatgaccaggaggagaccaccggggtggtgtccacccccctcatcagaaatggagactggaccttccagatcctggtgatgctggagatgaccccccagagaggagatgtgtacacctgccacgtggagcaccccagcctgcagaaccccatcatcgtggagtggagggcccagagcgagagcgcccagagcaagatgctgtctggaattggaggctttgtgctgggcctcatcttcctgggcctgggcctcatcatccaccacaggagccagaagggcctgctgcactag

SEQ ID NO: 158602 - DNA, 675 bp, Artificial Sequence
  Description of Artificial Sequence: Synthetic coding sequence
atgtcctggaagaaggccctgcgcatccctgggggcctgcgggccgccaccgtgaccctgatgctgtccatgctgagcacccctgtggccgagggccgggacagcccagaagattttgtgtaccagttcaagggcatgtgctacttcaccaatggaacagagcgggtgcggctggtgagccgcagcatctacaaccgggaggagatcgtgcgctttgacagtgatgtgggggagttccgggctgtgaccctgctgggcctgcctgctgctgagtactggaacagccagaaggacatcctggagaggaagagagctgctgtggacagagtgtgccgccacaactaccagctggagctgcggaccaccctgcagaggagagtggagcccaccgtgaccatcagccccagcaggacagaggccctgaaccaccacaacctgctggtgtgcagcgtgacagacttctacccagcccagatcaaggtgcgctggttcagaaatggccaggaggagacagctggggtggtgtccacccccctcatcagaaatggagactggaccttccagatcctggtgatgctggagatgaccccccagagaggagatgtgtacacctgccacgtggagcaccccagcctgcagagccccatcaccgtggagtggaggctgctgcactag

SEQ ID NO: 158603 - DNA, 786 bp, Artificial Sequence
  Description of Artificial Sequence: Synthetic coding sequence
atgtcctggaagaaggccctgcgcatccctgggggcctgcgggtggccaccgtgaccctgatgctggccatgctgagcacccctgtggccgagggccgggacagcccagaagattttgtgtaccagttcaagggcatgtgctacttcaccaatggaacagagcgggtgcggctggtgacccgctacatctacaaccgggaggagtatgccaggtttgacagtgatgtgggcgtgtacagagctgtgacccccctgggccccccagatgctgagtactggaacagccagaaggaggtgctggagaggaccagggctgagctggacacagtgtgccgccacaactaccagctggagctgcggaccaccctgcagaggagagtggagcccaccgtgaccatcagccccagcaggacagaggccctgaaccaccacaacctgctggtgtgcagcgtgacagacttctacccagcccagatcaaggtgcgctggttcagaaatgaccaggaggagaccaccggggtggtgtccacccccctcatcagaaatggagactggaccttccagatcctggtgatgctggagatgaccccccagagaggagatgtgtacacctgccacgtggagcaccccagcctgcagaaccccatcatcgtggagtggagggcccagagcgagagcgcccagagcaagatgctgtctggaattggaggctttgtgctgggcctcatcttcctgggcctgggcctcatcatccaccacaggagccagaagggcctgctgcactag

SEQ ID NO: 158604 - DNA, 786 bp, Artificial Sequence
  Description of Artificial Sequence: Synthetic coding sequence
atgtcctggaagaaggccctgcgcatccctgggggcctgcgggccgccaccgtgaccctgatgctgtccatgctgagcacccctgtggccgagggccgggacagcccagaagattttgtgtaccagttcaagggcatgtgctacttcaccaatggaacagagcgggtgcggctggtgagccgcagcatctacaaccgggaggagatcgtgcgctttgacagtgatgtgggggagttccgggctgtgaccctgctgggcctgcctgctgctgagtactggaacagccagaaggacatcctggagaggaagagagctgctgtggacagagtgtgccgccacaactaccagctggagctgcggaccaccctgcagaggagagtggagcccaccgtgaccatcagccccagcaggacagaggccctgaaccaccacaacctgctggtgtgcagcgtgacagacttctacccagcccagatcaaggtgcgctggttcagaaatggccaggaggagacagctggggtggtgtccacccccctcatcagaaatggagactggaccttccagatcctggtgatgctggagatgaccccccagagaggagatgtgtacacctgccacgtggagcaccccagcctgcagagccccatcaccgtggagtggagggcccagagcgagagcgcccagagcaagatgctgtctggaattggaggctttgtgctgggcctcatcttcctgggcctgggcctcatcatccaccacaggagccagaagggcctgctgcactag

SEQ ID NO: 158605 - DNA, 810 bp, Artificial Sequence
  Description of Artificial Sequence: Synthetic coding sequence
atgtcctggaagaaggccctgcgcatccctgggggcctgcgggccgccaccgtgaccctgatgctgtccatgctgagcacccctgtggccgagggccgggacagcccagaagattttgtgtaccagttcaagggcatgtgctacttcaccaatggaacagagcgggtgcggctggtgagccgcagcatctacaaccgggaggagatcgtgcgctttgacagtgatgtgggggagttccgggctgtgaccctgctgggcctgcctgctgctgagtactggaacagccagaaggacatcctggagaggaagagagctgctgtggacagagtgtgccgccacaactaccagctggagctgcggaccaccctgcagaggagagtggagcccaccgtgaccatcagccccagcaggacagaggccctgaaccaccacaacctgctggtgtgcagcgtgacagacttctacccagcccagatcaaggtgcgctggttcagaaatggccaggaggagacagctggggtggtgtccacccccctcatcagaaatggagactggaccttccagatcctggtgatgctggagatgaccccccagagaggagatgtgtacacctgccacgtggagcaccccagcctgcagagccccatcaccgtggagtggagggcccagagcgagagcgcccagagcaagatgctgtctggaattggaggctttgtgctgggcctcatcttcctgggcctgggcctcatcatccaccacaggagccagaagggcccccagggccccccacctgctggcctgctgcactag

SEQ ID NO: 158606 - DNA, 786 bp, Artificial Sequence; identical to SEQ ID NO: 158603
  Description of Artificial Sequence: Synthetic coding sequence

SEQ ID NO: 158607 - DNA, 675 bp, Artificial Sequence
  Description of Artificial Sequence: Synthetic coding sequence
atgtcctggaagaaggccctgcgcatccctgggggcctgcgggccgccaccgtgaccctgatgctggccatgctgagcacccctgtggccgagggccgggacagcccagaagattttgtgtaccagttcaaggccatgtgctacttcaccaatggaacagagcgggtgcgctacgtgacccgctacatctacaaccgggaggagtatgccaggtttgacagtgatgtggaggtgtacagagctgtgacccccctgggccccccagatgctgagtactggaacagccagaaggaggtgctggagaggaccagggctgagctggacacagtgtgccgccacaactaccagctggagctgcggaccaccctgcagaggagagtggagcccaccgtgaccatcagccccagcaggacagaggccctgaaccaccacaacctgctggtgtgcagcgtgacagacttctacccagcccagatcaaggtgcgctggttcagaaatgaccaggaggagaccaccggggtggtgtccacccccctcatcagaaatggagactggaccttccagatcctggtgatgctggagatgaccccccagcacggagatgtgtacacctgccacgtggagcaccccagcctgcagaaccccatcaccgtggagtggaggctgctgcactag

SEQ ID NO: 158608 - DNA, 786 bp, Artificial Sequence; identical to SEQ ID NO: 158604
  Description of Artificial Sequence: Synthetic coding sequence

SEQ ID NO: 158609 - DNA, 405 bp, Artificial Sequence
  Description of Artificial Sequence: Synthetic coding sequence
atgtcctggaagaaggccctgcgcatccctgggggcctgcgggccgccaccgtgaccctgatgctgtccatgctgagcacccctgtggccgagggccgggacagccctgtggagcccaccgtgaccatcagccccagcaggacagaggccctgaaccaccacaacctgctggtgtgcagcgtgacagacttctacccagcccagatcaaggtgcgctggttcagaaatggccaggaggagacagctggggtggtgtccacccccctcatcagaaatggagactggaccttccagatcctggtgatgctggagatgaccccccagagaggagatgtgtacacctgccacgtggagcaccccagcctgcagagccccatcaccgtggagtggaggctgctgcactag

SEQ ID NO: 158610 - DNA, 405 bp, Artificial Sequence
  Description of Artificial Sequence: Synthetic coding sequence
atgtcctggaagaaggccctgcgcatccctgggggcctgcgggtggccaccgtgaccctgatgctggccatgctgagcacccctgtggccgagggccgggacagccctgtggagcccaccgtgaccatcagccccagcaggacagaggccctgaaccaccacaacctgctggtgtgcagcgtgacagacttctacccagcccagatcaaggtgcgctggttcagaaatgaccaggaggagaccaccggggtggtgtccacccccctcatcagaaatggagactggaccttccagatcctggtgatgctggagatgaccccccagagaggagatgtgtacacctgccacgtggagcaccccagcctgcagaaccccatcatcgtggagtggaggctgctgcactag

SEQ ID NO: 158611 - DNA, 435 bp, Artificial Sequence
  Description of Artificial Sequence: Synthetic coding sequence
atgtcctggaagaaggccctgcgcatccctgggggcctgcgggtggccaccgtgacccccctgggccccccagatgctgagtactggaacagccagaaggaggtgctggagaggaccagggctgagctggacacagtgtgccgccacaactaccagctggagctgcggaccaccctgcagaggagagtggagcccaccgtgaccatcagccccagcaggacagaggccctgaaccaccacaacctgctggtgtgcagcgtgacagacttctacccagcccagatcaaggtgcgctggttcagaaatgaccaggaggagaccaccggggtggtgtccacccccctcatcagaaatggagactggaccttccagatcctggtgatgctggagatgaccccccagagaggagatgtgtacacctgccacgtggagtag

SEQ ID NO: 158612 - DNA, 405 bp, Artificial Sequence
  Description of Artificial Sequence: Synthetic coding sequence
atgtcctggaagaaggccctgcgcatccctgggggcctgcgggccgccaccgtgaccctgatgctggccatgctgagcacccctgtggccgagggccgggacagccctgtggagcccaccgtgaccatcagccccagcaggacagaggccctgaaccaccacaacctgctggtgtgcagcgtgacagacttctacccagcccagatcaaggtgcgctggttcagaaatgaccaggaggagaccaccggggtggtgtccacccccctcatcagaaatggagactggaccttccagatcctggtgatgctggagatgaccccccagcacggagatgtgtacacctgccacgtggagcaccccagcctgcagaaccccatcaccgtggagtggaggctgctgcactag

SEQ ID NO: 158613 - DNA, 786 bp, Artificial Sequence; identical to SEQ ID NO: 158597
  Description of Artificial Sequence: Synthetic coding sequence

SEQ ID NO: 158614 - DNA, 675 bp, Artificial Sequence
  Description of Artificial Sequence: Synthetic coding sequence
atgtcctggaagaaggccctgcgcatccctgggggcctgcgggtggccaccgtgaccctgatgctggccatgctgagcacccctgtggccgagggccgggacagcccagaagattttgtgtaccagttcaagggcatgtgctacttcaccaatggaacagagcgggtgcggctggtgacccgctacatctacaaccgggaggagtatgccaggtttgacagtgatgtgggcgtgtacagagctgtgacccccctgggccccccagatgctgagtactggaacagccagaaggaggtgctggagaggaccagggctgagctggacacagtgtgccgccacaactaccagctggagctgcggaccaccctgcagaggagagtggagcccaccgtgaccatcagccccagcaggacagaggccctgaaccaccacaacctgctggtgtgcagcgtgacagacttctacccagcccagatcaaggtgcgctggttcagaaatgaccaggaggagaccaccggggtggtgtccacccccctcatcagaaatggagactggaccttccagatcctggtgatgctggagatgaccccccagagaggagatgtgtacacctgccacgtggagcaccccagcctgcagaaccccatcatcgtggagtggaggctgctgcactag

SEQ ID NO: 158615 - DNA, 435 bp, Artificial Sequence
  Description of Artificial Sequence: Synthetic coding sequence
atgtcctggaagaaggccctgcgcatccctggggacctgcgggtggccaccgtgaccccccagggccgcccagatgctgagtactggaacagccagaaggaggtgctggagggcaccagggctgagctggacacagtgtgccgccacaactatgaggtggccttccggggcatcctgcagaggagagtggagcccaccgtgaccatcagccccagcaggacagaggccctgaaccaccacaacctgctggtgtgcagcgtgacagacttctacccaggccagatcaaggtgcgctggttcagaaatgaccaggaggagacagctggggtggtgtccacccccctcatcagaaatggagactggaccttccagatcctggtgatgctggagatgaccccccagagaggagatgtgtacacctgccacgtggagtag

SEQ ID NO: 158616 - DNA, 435 bp, Artificial Sequence
  Description of Artificial Sequence: Synthetic coding sequence
atgtcctggaagaaggccctgcgcatccctgggggcctgcgggccgccaccgtgaccctgctgggcctgcctgctgctgagtactggaacagccagaaggacatcctggagaggaagagagctgctgtggacagagtgtgccgccacaactaccagctggagctgcggaccaccctgcagaggagagtggagcccaccgtgaccatcagccccagcaggacagaggccctgaaccaccacaacctgctggtgtgcagcgtgacagacttctacccagcccagatcaaggtgcgctggttcagaaatggccaggaggagacagctggggtggtgtccacccccctcatcagaaatggagactggaccttccagatcctggtgatgctggagatgaccccccagagaggagatgtgtacacctgccacgtggagtag

SEQ ID NO: 158617 - DNA, 435 bp, Artificial Sequence
  Description of Artificial Sequence: Synthetic coding sequence
atgtcctggaagaaggccctgcgcatccctgggggcctgcgggccgccaccgtgacccccctgggccccccagatgctgagtactggaacagccagaaggaggtgctggagaggaccagggctgagctggacacagtgtgccgccacaactaccagctggagctgcggaccaccctgcagaggagagtggagcccaccgtgaccatcagccccagcaggacagaggccctgaaccaccacaacctgctggtgtgcagcgtgacagacttctacccagcccagatcaaggtgcgctggttcagaaatgaccaggaggagaccaccggggtggtgtccacccccctcatcagaaatggagactggaccttccagatcctggtgatgctggagatgaccccccagcacggagatgtgtacacctgccacgtggagtag

SEQ ID NO: 158618 - DNA, 411 bp, Artificial Sequence
  Description of Artificial Sequence: Synthetic coding sequence
atgtcctggaagaaggccctgcgcatccctgggggcctgcgggccgccaccgtgaccctgatgctgtccatgctgagcacccctgtggccgagggccgggacagcccagaagattttgtgtaccagttcaagggcatgtgctacttcaccaatggaacagagcgggtgcggctggtgagccgcagcatctacaaccgggaggagatcgtgcgctttgacagtgatgtgggggagttccgggctgtgaccctgctgggcctgcctgctgctgagtactggaacagccagaaggacatcctggagaggaagagagctgctgtggacagagtgtgccgccacaactaccagctggagctgcggaccaccctgcagaggcggggcatggtgacaggccccagccgctcctggtag

SEQ ID NO: 158619 - DNA, 411 bp, Artificial Sequence
  Description of Artificial Sequence: Synthetic coding sequence
atgtcctggaagaaggccctgcgcatccctgggggcctgcgggccgccaccgtgaccctgatgctggccatgctgagcacccctgtggccgagggccgggacagcccagaagattttgtgtaccagttcaaggccatgtgctacttcaccaatggaacagagcgggtgcgctacgtgacccgctacatctacaaccgggaggagtatgccaggtttgacagtgatgtggaggtgtacagagctgtgacccccctgggccccccagatgctgagtactggaacagccagaaggaggtgctggagaggaccagggctgagctggacacagtgtgccgccacaactaccagctggagctgcggaccaccctgcagaggcggggcaccgtgacaggccccagccgctcctggtag

SEQ ID NO: 158620 - DNA, 411 bp, Artificial Sequence
  Description of Artificial Sequence: Synthetic coding sequence
atgtcctggaagaaggccctgcgcatccctggggacctgcgggtggccaccgtgaccctgatgctggccatgctgagcagcctgctggccgagggccgggacagcccagaagattttgtgttccagttcaagggcatgtgctacttcaccaatggaacagagcgggtgcggctggtgacccgctacatctacaaccgggaggagtatgccaggtttgacagtgatgtgggcgtgtacagagctgtgaccccccagggccgcccagatgctgagtactggaacagccagaaggaggtgctggagggcaccagggctgagctggacacagtgtgccgccacaactatgaggtggccttccggggcatcctgcagaggcggggcatggtgacaggcctgagccgctcctggtag

SEQ ID NO: 158621 - DNA, 717 bp, Artificial Sequence
  Description of Artificial Sequence: Synthetic coding sequence
atgctgagcacccctgtggccgagggccgggacagccctgaggactttgtgtaccagttcaagggcatgtgctacttcaccaacggcacagagcgggtgcggctggtgagccgcagcatctacaaccgggaggagatcgtgcgctttgacagtgatgtgggggagttccgggctgtgaccctgctgggcctgcctgctgctgagtactggaacagccagaaggacatcctggagaggaagagagctgctgtggacagagtgtgccgccacaactaccagctggagctgcggaccaccctgcagaggagagtggagcccaccgtgaccatcagccccagcaggacagaggccctgaaccaccacaacctgctggtgtgcagcgtgacagacttctacccagcccagatcaaggtgcgctggttcagaaatggccaggaggagacagctggggtggtgtccacccccctcatcagaaatggagactggaccttccagatcctggtgatgctggagatgaccccccagagaggagatgtgtacacctgccacgtggagcaccccagcctgcagagccccatcaccgtggagtggagggcccagagcgagagcgcccagagcaagatgctgagcggcatcggcggctttgtgctgggcctcatcttcctgggcctgggcctcatcatccaccacaggagccagaagggcctgctgcactag

SEQ ID NO: 158622 - DNA, 543 bp, Artificial Sequence
  Description of Artificial Sequence: Synthetic coding sequence
atgtgctacttcaccaacggcacagagcgggtgcggggcgtgacccgctacatctacaaccgggaggagtatgccaggtttgacagtgatgtgggcgtgtacagagctgtgacccccctgggccccccagctgctgagtactggaacagccagaaggaggtgctggagaggaccagggctgagctggacacagtgtgccgccacaactaccagctggagctgcggaccaccctgcagaggagagtggagcccaccgtgaccatcagccccagcaggacagaggccctgaaccaccacaacctgctggtgtgcagcgtgacagacttctacccagcccagatcaaggtgcgctggttcagaaatgaccaggaggagaccactggagtggtgtccacccccctcatcagaaatggagactggaccttccagatcctggtgatgctggagatgaccccccagagaggagatgtgtacacctgccacgtggagcaccccagcctgcagaaccccatcatcgtggagtggaggatggatgagttctag

SEQ ID NO: 158623 - DNA, 717 bp, Artificial Sequence
  Description of Artificial Sequence: Synthetic coding sequence
atgctgagcacccctgtggccgagggccgggacagccctgaggactttgtgtaccagttcaagggcatgtgctacttcaccaacggcacagagcgggtgcggctggtgagccgcagcatctacaaccgggaggagatcgtgcgctttgacagtgatgtgggggagttccgggctgtgaccctgctgggcctgcctgctgctgagtactggaacagccagaaggacatcctggagaggaagagagctgctgtggacagagtgtgccgccacaactaccagctggagctgcggaccaccctgcagaggagagtggagcccaccgtgaccatcagccccagcaggacagaggccctgaaccaccacaacctgctggtgtgcagcgtgacagacttctacccagcccagatcaaggtgcgctggttcagaaatgaccaggaggagacagctggggtggtgtccacccccctcatcagaaatggagactggaccttccagatcctggtgatgctggagatgaccccccagagaggagatgtgtacacctgccacgtggagcaccccagcctgcagagccccatcaccgtggagtggagggcccagagcgagagcgcccagagcaagatgctgagcggcatcggcggctttgtgctgggcctcatcttcctgggcctgggcctcatcatccaccacaggagccagaagggcctgctgcactag

SEQ ID NO: 158624 - DNA, 744 bp, Artificial Sequence
  Description of Artificial Sequence: Synthetic coding sequence
atgctgagcacccctgtggccgagggccgggacagccctgaggactttgtgtaccagttcaagggcatgtgctacttcaccaacggcacagagcgggtgcggggcgtgacccgctacatctacaaccgggaggagtatgccaggtttgacagtgatgtgggcgtgtacagagctgtgacccccctgggccccccagctgctgagtactggaacagccagaaggaggtgctggagaggaccagggctgagctggacacagtgtgccgccacaactaccagctggagctgcggaccaccctgcagaggagagtggagcccaccgtgaccatcagccccagcaggacagaggccctgaaccaccacaacctgctggtgtgcagcgtgacagacttctacccagcccagatcaaggtgcgctggttcagaaatgaccaggaggagaccactggagtggtgtccacccccctcatcagaaatggagactggaccttccagatcctggtgatgctggagatgaccccccagagaggagatgtgtacacctgccacgtggagcaccccagcctgcagaaccccatcatcgtggagtggagggcccagagcgagagcgcccagagcaagatgctgagcggcatcggcggctttgtgctgggcctcatcttcctgggcctgggcctcatcatccaccacaggagccagaaggccctgccccagggccccccacctgctggggacatctcctag

SEQ ID NO: 158625 - DNA, 717 bp, Artificial Sequence; identical to SEQ ID NO: 158623
  Description of Artificial Sequence: Synthetic coding sequence

SEQ ID NO: 158626 - DNA, 801 bp, Artificial Sequence
  Description of Artificial Sequence: Synthetic coding sequence
atggtgtgcctgcggctgcccggcggcagctgcatggctgtgctgactgtgaccctgatggtgctgagcagccccctggccctggccggggacacccggccccgcttcctggagtacagcaccagcgagtgccacttcttcaacggcacagagcgggtgcgctacctggaccgctacttccacaaccaggaggagaatgtgcgctttgacagtgatgtgggggagttccgggctgtgacagagctgggccgcccagatgctgagtactggaacagccagaaggacctgctggagcagaagaggggccgggtggacaactactgccgccacaactacggcgtggtggagagcttcaccgtgcagaggagagtgcaccccaaggtgacagtgtaccccagcaagacccagcccctgcagcaccacaacctgctggtgtgcagcgtgtctggcttctacccaggcagcattgaggtgcgctggttcagaaatggccaggaggagaagacaggagtggtgtccacaggcctcatccacaatggagactggaccttccagaccctggtgatgctggagaccgtgcccaggtctggagaggtgtacacctgccaggtggagcaccccagcgtgaccagccccctgactgtggagtggagggcccggtctgagagcgcccagagcaagatgctgagcggcgtgggcggctttgtgctgggcctgctcttcctgggcgccggcctcttcatctacttcaggaaccagaagggccacagcggcctgcagccccggggcttcctgtcctag

SEQ ID NO: 158627 - DNA, 801 bp, Artificial Sequence
  Description of Artificial Sequence: Synthetic coding sequence
atggtgtgcctgaagctgcccggcggcagctgcatgacagccctgactgtgaccctgatggtgctgagcagccccctggccctgagcggggacacccggccccgcttcctgtggcagcccaagcgggagtgccacttcttcaacggcacagagcgggtgcgcttcctggaccgctacttctacaaccaggaggagagcgtgcgctttgacagtgatgtgggggagttccgggctgtgacagagctgggccgcccagatgctgagtactggaacagccagaaggacatcctggagcaggcccgggctgctgtggacacctactgccgccacaactacggcgtggtggagagcttcaccgtgcagaggagagtgcagcccaaggtgacagtgtaccccagcaagacccagcccctgcagcaccacaacctgctggtgtgcagcgtgtctggcttctacccaggcagcattgaggtgcgctggttcctgaatggccaggaggagaaggccggcatggtgtccacaggcctcatccagaatggagactggaccttccagaccctggtgatgctggagaccgtgcccaggtctggagaggtgtacacctgccaggtggagcaccccagcgtgaccagccccctgactgtggagtggagggcccggtctgagagcgcccagagcaagatgctgagcggcgtgggcggctttgtgctgggcctgctcttcctgggcgccggcctcttcatctacttcaggaaccagaagggccacagcggcctgcagcccaccggcttcctgtcctag

SEQ ID NO: 158628 - DNA, 801 bp, Artificial Sequence; identical to SEQ ID NO: 158626
  Description of Artificial Sequence: Synthetic coding sequence

SEQ ID NO: 158629 - DNA, 753 bp, Artificial Sequence
  Description of Artificial Sequence: Synthetic coding sequence
ctgctgaagctgacccgggacttcccccagagacatgagaagtaccagagctgggccggcaccttccacctgtgcctgaagaagaacaagtacccagacagccgcagcaccttcatcaagcacgccggcagctacctgaagagaggagagttcctgagcatccacacagccatcacctgcttcttcctgcagatcagcgcccgcttcctggagcaggtgaagcatgagtgccacttcttcaatggaacagagcgggtgcgcttcctggaccgctacttctaccaccaggaggagtatgtgcgctttgacagtgatgtgggggagtacagagctgtgacagagctgggccgcccagatgctgagtactggaacagccagaaggacctgctggagcagaggagagctgaggtggacacctactgccgccacaactatggagtggtggagagcttcaccgtgcagaggagagtgtacccagaggtgacagtgtacccagccaagacccagcccctgcagcaccacaacctgctggtgtgcagcgtgaatggcttctacccaggcagcattgaggtgcgctggttcagaaatggccaggaggagaagacaggagtggtgtccacaggcctcatccagaatggagactggaccttccagaccctggtgatgctggagaccgtgcccaggtctggagaggtgtacacctgccaggtggagcaccccagcctgaccagccccctgactgtggagtggtag

SEQ ID NO: 158630 - DNA, 756 bp, Artificial Sequence
  Description of Artificial Sequence: Synthetic coding sequence
tgactgctgaagctgacccgggacttcccccagagacatgagaagtaccagagctgggccggcaccttccacctgtgcctgaagaagaacaagtacccagacagccgcagcaccttcatcaagcatgctggcagctacctgaagagaggagagttcctggccatccacacagccatcacctgcttcttccggcagatcagcgcccgcttcctggagtacagcaccagcgagtgccacttcttcaacggcacagagcgggtgcgctacctggaccgctacttccacaaccaggaggagaatgtgcgctttgacagtgatgtgggggagttccgggctgtgacagagctgggccgcccagatgctgagtactggaacagccagaaggacctgctggagcagaagaggggccgggtggacaactactgccgccacaactacggcgtggtggagagcttcaccgtgcagaggagagtgcaccccaaggtgacagtgtaccccagcaagacccagcccctgcagcaccacaacctgctggtgtgcagcgtgtctggcttctacccaggcagcattgaggtgcgctggttcagaaatggccaggaggagaagacaggagtggtgtccacaggcctcatccacaatggagactggaccttccagaccctggtgatgctggagaccgtgcccaggtctggagaggtgtacacctgccaggtggagcaccccagcgtgaccagccccctgactgtggagtggtag

SEQ ID NO: 158631 - DNA, 801 bp, Artificial Sequence
  Description of Artificial Sequence: Synthetic coding sequence
atggtgtgcctgaagtttcctgggggcagctgcatggccgccctgactgtgaccctgatggtgctgagcagccccctggccctggccggggacacccggccccgcttcctggagcaggtgaagcatgagtgccacttcttcaacggcacagagcgggtgcgcttcctggaccgctacttctaccaccaggaggagtatgtgcgctttgacagtgatgtgggggagtacagagctgtgacagagctgggccgcccagatgctgagtactggaacagccagaaggacctgctggagcagaggagagctgaggtggacacctactgccgccacaactacggcgtggtggagagcttcaccgtgcagaggagagtgtacccagaggtgacagtgtacccagccaagacccagcccctgcagcaccacaacctgctggtgtgcagcgtgaatggcttctacccaggcagcattgaggtgcgctggttcagaaatggccaggaggagaagacaggagtggtgtccacaggcctcatccagaatggagactggaccttccagaccctggtgatgctggagaccgtgcccaggtctggagaggtgtacacctgccaggtggagcaccccagcctgaccagccccctgactgtggagtggagggcccggtctgagagcgcccagagcaagatgctgagcggcgtgggcggctttgtgctgggcctgctcttcctgggcgccggcctcttcatctacttcaggaaccagaagggccacagcggcctgcagcccaccggcttcctgtcctag

SEQ ID NO: 158632 - DNA, 756 bp, Artificial Sequence; identical to SEQ ID NO: 158630
  Description of Artificial Sequence: Synthetic coding sequence

SEQ ID NO: 158633 - DNA, 753 bp, Artificial Sequence
  Description of Artificial Sequence: Synthetic coding sequence
tgactgctgaagctgacccgggacttcccccagagacatgagaagtaccagagctgggccggcaccttccacctgtgcctgaagaagaacaagtacccagacagccgcagcaccttcatcaagcatgctggcagctacctgaagagaggagagttcctgagcatccacacagccatcacctgcttcttcctgcagatcagcgcccgcttcctgtggcagggcaagtacaagtgccacttcttcaacggcacagagcgggtgcagttcctggagcggctcttctacaaccaggaggagtttgtgcgctttgacagtgatgtgggggagtacagagctgtgacagagctgggccggcctgtggccgagagctggaacagccagaaggacatcctggaggaccggcggggccaggtggacacagtgtgccgccacaactacggcgtgggggagagcttcaccgtgcagaggagagtgcaccctgaggtgacagtgtacccagccaagacccagcccctgcagcaccacaacctgctggtgtgcagcgtgtctggcttctacccaggcagcattgaggtgcgctggttcagaaatggccaggaggagaaggccggcgtggtgtccacaggcctcatccagaatggagactggaccttccagaccctggtgatgctggagaccgtgcccaggtctggagaggtgtacacctgccaggtggagcaccccagcgtgatgagccccctgactgtggagtag

SEQ ID NO: 158634 - DNA, 801 bp, Artificial Sequence
  Description of Artificial Sequence: Synthetic coding sequence
atggtgtgcctgaagctgcccggcggcagctgcatggccgccctgactgtgaccctgatggtgctgagcagccccctggccctggccggggacacccagccccgcttcctgtggcagggcaagtacaagtgccacttcttcaacggcacagagcgggtgcagttcctggagcggctcttctacaaccaggaggagtttgtgcgctttgacagtgatgtgggggagtacagagctgtgacagagctgggccggcctgtggccgagagctggaacagccagaaggacatcctggaggaccggcggggccaggtggacacagtgtgccgccacaactacggcgtgggggagagcttcaccgtgcagaggagagtgcaccctgaggtgacagtgtacccagccaagacccagcccctgcagcaccacaacctgctggtgtgcagcgtgtctggcttctacccaggcagcattgaggtgcgctggttcagaaatggccaggaggagaaggccggcgtggtgtccacaggcctcatccagaatggagactggaccttccagaccctggtgatgctggagaccgtgcccaggtctggagaggtgtacacctgccaggtggagcaccccagcgtgatgagccccctgactgtggagtggagggcccggtctgagagcgcccagagcaagatgctgagcggcgtgggcggctttgtgctgggcctgctcttcctgggcgccggcctcttcatctacttcaggaaccagaagggccacagcggcctgcagcccaccggcttcctgtcctag

SEQ ID NO: 158635 - DNA, 801 bp, Artificial Sequence; identical to SEQ ID NO: 158634
  Description of Artificial Sequence: Synthetic coding sequence

SEQ ID NO: 158636 - DNA, 810 bp, Artificial Sequence
  Description of Artificial Sequence: Synthetic coding sequence
atgtcctggaagaaggccctgcgcatccctgggggcctgcgggtggccaccgtgaccctgatgctggccatgctgagcacccctgtggccgagggccgggacagcccagaagattttgtgtaccagttcaagggcatgtgctacttcaccaatggaacagagcgggtgcggggcgtgacccgctacatctacaaccgggaggagtatgccaggtttgacagtgatgtgggcgtgtacagagctgtgacccccctgggccccccagctgctgagtactggaacagccagaaggaggtgctggagaggaccagggctgagctggacacagtgtgccgccacaactaccagctggagctgcggaccaccctgcagaggagagtgtacccagaggtgacagtgtacccagccaagacccagcccctgcagcaccacaacctgctggtgtgcagcgtgaatggcttctacccaggcagcattgaggtgcgctggttcagaaatggccaggaggagaagacaggagtggtgtccacaggcctcatccagaatggagactggaccttccagaccctggtgatgctggagaccgtgcccaggtctggagaggtgtacacctgccaggtggagcaccccagcctgaccagccccctgactgtggagtggagggcccggtctgagagcgcccagagcaagatgctgtctggagtgggcggctttgtgctgggcctgctcttcctgggcgccggcctcttcatctacttcaggaaccagaagggccacagcggcctgcagcccaccggcttcctgtcctag

SEQ ID NO: 158637 - DNA, 792 bp, Artificial Sequence
  Description of Artificial Sequence: Synthetic coding sequence
atggtgtgcctgaagtttcctgggggcagctgcatggccgccctgactgtgaccctgatggtgctgagcagccccctggccctggccggggacacccggccccgcttcctggagcaggtgaagcatgagtgccacttcttcaacggcacagagcgggtgcgcttcctggaccgctacttctaccaccaggaggagtatgtgcgctttgacagtgatgtgggggagtacagagctgtgacagagctgggccgcccagatgctgagtactggaacagccagaaggacctgctggagcagaggagagctgaggtggacacctactgccgccacaactacggcgtggtggagagcttcaccgtgcagaggagagtgtacccagaggtgacagtgtacccagccaagacccagcccctgcagcaccacaacctgctggtgtgcagcgtgaatggcttctacccaggcagcattgaggtgcgctggttcagaaatggccaggaggagaagacaggagtggtgtccacaggcctcatccagaatggagactggaccttccagaccctggtgatgctggagaccgtgcccaggtctggagaggtgtacacctgccaggtggagcaccccagcctgaccagccccctgactgtggagtggagggcccggtctgagagcgcccagagcaagatgctgagcggcgtgggcggctttgtgctgggcctgctcttcctgggcgccggcctcttcatctacttcaggaaccagaagggccacagcggcctgcagcccaccggctag

SEQ ID NO: 158638 - DNA, 141 bp, Artificial Sequence
  Description of Artificial Sequence: Synthetic coding sequence
cacagcggcctgcagcccactggaaacaccttcagcagcagcctgaggaacagatttggaggccaggcccagcacgcctgcaaccccagcaccctgggcggccggggcggccgcatcatgagaattcctgagctgaagtag

SEQ ID NO: 158639 - DNA, 891 bp, Artificial Sequence
  Description of Artificial Sequence: Synthetic coding sequence
atggtgtgcctgaagtttcctgggggcagctgcatggccgccctgactgtgaccctgatggtgctgagcagccccctggccctggccggggacacccggccccgcttcctggagcaggtgaagcatgagtgccacttcttcaacggcacagagcgggtgcgcttcctggaccgctacttctaccaccaggaggagtatgtgcgctttgacagtgatgtgggggagtacagagctgtgacagagctgggccgcccagatgctgagtactggaacagccagaaggacctgctggagcagaggagagctgaggtggacacctactgccgccacaactacggcgtggtggagagcttcaccgtgcagaggagagtgtacccagaggtgacagtgtacccagccaagacccagcccctgcagcaccacaacctgctggtgtgcagcgtgaatggcttctacccaggcagcattgaggtgcgctggttcagaaatggccaggaggagaagacaggagtggtgtccacaggcctcatccagaatggagactggaccttccagaccctggtgatgctggagaccgtgcccaggtctggagaggtgtacacctgccaggtggagcaccccagcctgaccagccccctgactgtggagtggagggcccggtctgagagcgcccagagcaagatgctgagcggcgtgggcggctttgtgctgggcctgctcttcctgggcgccggcctcttcatctacttcaggaaccagaagggccacagcggcctgcagcccaccggcaacaccttcagcagcagcctgaggaacagatttggaggccaggcccagtggctgacccctgtgatcccagccctgtgggaggccgaggccggggagagctag

SEQ ID NO: 158640 - DNA, 801 bp, Artificial Sequence
  Description of Artificial Sequence: Synthetic coding sequence
atggtgtgcctgaagctgcccggcggcagcagcctggccgccctgactgtgaccctgatggtgctgagcagccggctggcctttgctggggacacccggccccgcttcctggagctgctgaagtctgagtgccacttcttcaacggcacagagcgggtgcgcttcctggagcggcacttccacaaccaggaggagtatgccaggtttgacagtgatgtgggggagtacagagctgtgcgggagctgggccgcccagatgctgagtactggaacagccagaaggacctgctggagcagaagaggggccaggtggacaactactgccgccacaactacggcgtgggggagagcttcaccgtgcagaggagagtgcacccccaggtgacagtgtacccagccaagacccagcccctgcagcaccacaacctgctggtgtgcagcgtgtctggcttctacccaggcagcattgaggtgcgctggttcagaaatggccaggaggagaaggccggcgtggtgtccacaggcctcatccagaatggagactggaccttccagaccctggtgatgctggagaccgtgcccaggtctggagaggtgtacacctgccaggtggagcaccccagcgtgaccagccccctgactgtggagtggagcgcccggtctgagagcgcccagagcaagatgctgagcggcgtgggcggctttgtgctgggcctgctcttcctgggcgccggcctcttcatctacttcaggaaccagaagggccacagcggcctgcagcccaccggcttcctgtcctag

SEQ ID NO: 158641 - DNA, 801 bp, Artificial Sequence
  Description of Artificial Sequence: Synthetic coding sequence
atggtgtgcctgaagctgcccggcggcagcagcctggccgccctgactgtgaccctgatggtgctgagcagccggctggcctttgctggggacacccggccccgcttcctggagctgaggaagtctgagtgccacttcttcaacggcacagagcgggtgcgctacctggaccgctacttccacaaccaggaggagttcctgcgctttgacagtgatgtgggggagtacagagctgtgacagagctgggccggcctgtggccgagagctggaacagccagaaggacctgctggagcagaagaggggccgggtggacaactactgccgccacaactacggcgtgggggagagcttcaccgtgcagaggagagtgcacccccaggtgacagtgtacccagccaagacccagcccctgcagcaccacaacctgctggtgtgcagcgtgtctggcttctacccaggcagcattgaggtgcgctggttcagaaatggccaggaggagaaggccggcgtggtgtccacaggcctcatccagaatggagactggaccttccagaccctggtgatgctggagaccgtgcccaggtctggagaggtgtacacctgccaggtggagcaccccagcgtgaccagcgccctgactgtggagtggagggcccggtctgagagcgcccagagcaagatgctgagcggcgtgggcggctttgtgctgggcctgctcttcctgggcgccggcctcttcatctacttcaggaaccagaagggccacagcggcctgcagcccaccggcttcctgtcctag

SEQ ID NO: 158642 - DNA, 801 bp, Artificial Sequence; identical to SEQ ID NO: 158640
  Description of Artificial Sequence: Synthetic coding sequence

SEQ ID NO: 158643 - DNA, 801 bp, Artificial Sequence
  Description of Artificial Sequence: Synthetic coding sequence
atggtgtgcctgaagctgcccggcggcagctacatggccaagctgactgtgaccctgatggtgctgagcagccccctggccctggccggggacacccggccccgcttcctgcagcaggacaagtatgagtgccacttcttcaacggcacagagcgggtgcgcttcctgcaccgggacatctacaaccaggaggaggacctgcgctttgacagtgatgtgggggagtacagagctgtgacagagctgggccgcccagatgctgagtactggaacagccagaaggacttcctggaggaccggcgggctgctgtggacacctactgccgccacaactacggcgtgggggagagcttcaccgtgcagaggagagtggagcccaaggtgacagtgtacccagcccggacccagaccctgcagcaccacaacctgctggtgtgcagcgtgaatggcttctacccaggcagcattgaggtgcgctggttcaggaacagccaggaggagaaggccggcgtggtgtccacaggcctcatccagaatggagactggaccttccagaccctggtgatgctggagaccgtgcccaggtctggagaggtgtacacctgccaggtggagcaccccagcgtgaccagccccctgactgtggagtggagggcccagagcgagagcgcccagagcaagatgctgagcggcgtgggcggctttgtgctgggcctgctcttcctgggcgccggcctcttcatctacttcaagaaccagaagggccacagcggcctgcaccccaccggcctggtgtcctag

SEQ ID NO: 158644 - DNA, 891 bp, Artificial Sequence
  Description of Artificial Sequence: Synthetic coding sequence
atgggagagctgatggccttcctgctgcccctcatcatcgtgctgatggtgaagcacagcgacagcaggacccacagcctgcgctacttccggctgggcgtgtctgaccccatccatggagtgcctgagttcatctctgtgggctacgtggacagccaccccatcaccacctatgacagcgtgacccggcagaaggagccccgggccccctggatggccgagaacctggccccagaccactgggagcgctacacccagctgctgcggggctggcagcagatgttcaaggtggagctgaagaggctgcagaggcactacaaccacagcgacaacgtggcccacaccatcaagcaggcctgggaggccaaccagcacgagctgctgtaccagaagaactggctggaggaggagtgcatcgcctggctgaagcgcttcctggagtatggcaaggacaccctgcagaggacagagccccccctggtgcgggtgaacaggaaggagaccttccctggggtgacagccctcttctgcaaggcccacggcttctacccacctgagatctacatgacctggatgaagaatggagaggagatcgtgcaggagattgattatggagacatcctgcccagcggagatggcacctaccaggcctgggccagcattgagctggacccccagagcagcaacctgtacagctgccacgtggagcactgcggcgtgcacatggtgctgcaggtgccccaggagagcgagaccatccccctggtgatgaaggctgtgtctggcagcatcgtgctggtgattgtgctggccggcgtgggcgtgctggtgtggaggcggcggccccgggagcagaatggagccatctacctgcccaccccagacagatag

SEQ ID NO: 158645 - DNA, 1026 bp, Artificial Sequence
  Description of Artificial Sequence: Synthetic coding sequence
atgggagagctgatggccttcctgctgcccctcatcatcgtgctgatggtgaagcacagcgacagcaggacccacagcctgcgctacttccggctgggcgtgtctgaccccatccatggagtgcctgagttcatctctgtgggctacgtggacagccaccccatcaccacctatgacagcgtgacccggcagaaggagccccgggccccctggatggccgagaacctggccccagaccactgggagcgctacacccagctgctgcggggctggcagcagatgttcaaggtggagctgaagaggctgcagaggcactacaaccacagcggcagccacacctaccagaggatgattggctgtgagctgctggaggatggcagcaccaccggcttcctgcagtatgcctatgatggccaggacttcctgatcttcaacaaggacaccctgtcctggctggccgtggacaacgtggcccacaccatcaagcaggcctgggaggccaaccagcacgagctgctgtaccagaagaactggctggaggaggagtgcatcgcctggctgaagcgcttcctggagtatggcaaggacaccctgcagaggacagagccccccctggtgcgggtgaacaggaaggagaccttccctggggtgacagccctcttctgcaaggcccacggcttctacccacctgagatctacatgacctggatgaagaatggagaggagatcgtgcaggagattgattatggagacatcctgcccagcggagatggcacctaccaggcctgggccagcattgagctggacccccagagcagcaacctgtacagctgccacgtggagcactgcggcgtgcacatggtgctgcaggtgccccaggagagcgagaccatccccctggtgatgaaggctgtgtctggcagcatcgtgctggtgattgtgctggccggcgtgggcgtgctggtgtggaggagaagaccccgggagcagaatggagccatctacctgcccaccccagacagatag

SEQ ID NO: 158646 - DNA, 645 bp, Artificial Sequence
  Description of Artificial Sequence: Synthetic coding sequence
atgggagagctgatggccttcctgctgcccctcatcatcgtgctgatggtgaagcacagcgacagcaggacccacagcctgcgctacttccggctgggcgtgtctgaccccatccatggagtgcctgagttcatctctgtgggctacgtggacagccaccccatcaccacctatgacagcgtgacccggcagaaggagccccgggccccctggatggccgagaacctggccccagaccactgggagcgctacacccagctgctgcggggctggcagcagatgttcaaggtggagctgaagaggctgcagaggcactacaaccacagcggcagccacacctaccagaggatgattggctgtgagctgctggaggatggcagcaccaccggcttcctgcagtatgcctatgatggccaggacttcctgatcttcaacaaggacaccctgtcctggctggccgtggacaacgtggcccacaccatcaagcaggcctgggaggccaaccagcacgagctgctgtaccagaagaactggctggaggaggagtgcatcgcctggctgaagcgcttcctggagtatggcaaggacaccctgcagaggacagagcagaatggagccatctacctgcccaccccagacagatag

SEQ ID NO: 158647 - DNA, 792 bp, Artificial Sequence
  Description of Artificial Sequence: Synthetic coding sequence
atgtgggagctgcggagcgccagcttctggagggccatctttgctgagttctttgccaccctcttctacgtgttcttcggcctgggcagcagcctgcgctgggcccctggccccctgcacgtgctgcaggtggccatggccttcggcctggccctggccaccctggtgcagagcgtgggccacatcagcggggcccacgtgaacccagctgtgacctttgccttcctggtgggcagccagatgagcctgctgcgggccttctgctacatggccgcccagctgctgggcgctgtggccggggctgctgtgctgtacagcgtgaccccacctgctgtgcggggcaacctggccctgaacaccctgcaccctgctgtgtctgtgggccaggccaccaccgtggagatcttcctgaccctgcagtttgtgctgtgcatctttgccacctatgatgagaggagaaatggccagctgggctctgtggccctggccgtgggcttcagcctggccctgggccacctgtttggcatgtactacacaggagctggcatgaacccagcccggagctttgccccagccatcctgactggaaacttcaccaaccactgggtgtactgggtgggccccatcatcggcggcggcctgggcagcctgctgtatgacttcctgctcttcccccggctgaagagcatcagcgagcggctgtctgtgctgaagggggccaagccagatgtgtccaatggccagcctgaggtgactggagagcctgtggagctgaacacccaggccctgtag

SEQ ID NO: 158648 - DNA, 2682 bp, Artificial Sequence
  Description of Artificial Sequence: Synthetic coding sequence
atggccacagaggagttcatcatccgcatccccccctaccactacatccacgtgctggaccagaacagcaatgtgtcccgggtggaggtgggccccaagacctacatccggcaggacaatgaaagagtgctgtttgcccccatgaggatggtgacagtgccccccaggcactactgcaccgtggccaaccctgtgtccagagatgcccagggcctggtgctgtttgatgtgacaggccaggtgcggctgcggcatgctgacctggagatccggctggcccaggaccccttccccctgtacccaggagaggtgctggagaaggacatcacccccctgcaggtggtgctgcccaacacagccctgcacctgaaggccctgctggactttgaggacaaggatggagacaaggtggtggccggagatgagtggctgtttgagggccctggcacctacatccccaggaaggaggtggaggtggtggagatcatccaggccaccatcatccggcagaaccaggccctgcggctgcgggccaggaaagaatgctgggacagagatggcaaggagcgggtgactggagaggagtggctggtgaccaccgtgggcgcctacctgcctgctgtgtttgaggaggtgctggacctggtggatgctgtgatcctgacagagaagacagccctgcacctgcgggcccggaggaacttccgggacttccggggcgtgtccagaagaactggagaggagtggctggtgacagtgcaggacacagaggcccacgtgcctgatgtgcatgaggaggtgctgggcgtggtgcccatcaccaccctgggcccccacaactactgcgtcatcctggaccctgtgggcccagatggcaagaaccagctgggccagaagagggtggtgaagggggagaagagcttcttcctgcagcccggggagcagctggagcagggcatccaggatgtgtatgtgctgtctgagcagcagggcctgctgctgcgggccctgcagcccctggaggagggggaggatgaggagaaggtgagccaccaggccggggaccactggctgatccggggccccctggagtatgtgcccagcgccaaggtggaggtggtggaggagcggcaggccatccccctggatgaaaatgaaggcatctacgtgcaggatgtgaagacaggcaaggtgcgggccgtcatcggcagcacctacatgctgacccaggatgaggtgctgtgggagaaggagctgcccccaggagtggaggagctgctgaacaagggccaggaccccctggccgacagaggagagaaggacacagccaagagcctgcagcccctggcccccaggaacaagaccagggtggtgtcctacagagtgccccacaatgctgctgtgcaggtgtatgactaccgggagaagagggcccgggtggtgtttggacctgagctggtgtccctgggccctgaggagcagttcaccgtgctgagcctgtctgctggccggcccaagaggcctcatgcccggcgggccctgtgcctgctgctgggccctgacttcttcacagatgtgatcaccattgaaacagctgaccacgcccggctgcagctgcagctggcctacaactggcactttgaggtgaatgacaggaaggacccccaggagacagccaagctgttctctgtgcctgactttgtgggagatgcctgcaaggccatcgccagccgggtgagaggagctgtggcctctgtgacctttgatgacttccacaagaacagcgcccgcatcatcagaacagctgtgtttggatttgagaccagcgaggccaagggcccagatggcatggccctgccccggccccgggaccaggccgtgttcccccagaatggcctggtggtgtcctctgtggatgtgcagagcgtggagcctgtggaccagaggaccagagatgccctgcagaggtctgtgcagctggccatcgagatcaccaccaacagccaggaggccgccgccaagcatgaggcccagaggctggagcaggaggcccggggccgcctggagcggcagaagatcctggaccagagcgaggccgagaaggccaggaaggagctgctggagctggaggccctgtccatggctgtggagagcactggaacagccaaggccgaggccgagagcagagctgaggccgccagaattgaaggagagggctctgtgctgcaggccaagctgaaggcccaggccctggccattgaaacagaagctgagctgcagagggtgcagaaggtgcgggagctggagctggtgtatgcccgggcccagctggagctggaggtgtccaaggcccagcagctggccgaggtggaggtgaagaagttcaagcagatgacagaggccatcggccccagcaccatccgggacctggccgtggccggccctgagatgcaggtgaagctgctgcagagcctgggcctgaagagcaccctcatcacagatggcagcacccccatcaacctcttcaacacagccttcggcctgctgggcatgggccctgagggccagcccctgggccggcgggtggccagcggccccagccctggagagggcatcagcccccagagcgcccaggccccccaggcccctggggacaaccacgtggtgcctgtgctgaggtag

SEQ ID NO: 158649 - DNA, 2682 bp, Artificial Sequence; identical to SEQ ID NO: 158648
  Description of Artificial Sequence: Synthetic coding sequence

SEQ ID NO: 158650 - DNA, 480 bp, Artificial Sequence
  Description of Artificial Sequence: Synthetic coding sequence
atgtgctggaccaggacagccacctgccctgtgtggaggagcggccagaggcccaccagcggccgcaccatgaggggcagcggctttggaggccgccgccacccctacggcaaggacagccctgcccctcctggcagcgctgagctgcccggcctgcagggctctgtgcccccccactggggcggcgtggccggcaacagcgctggccaccggggcccccgggcccgctgcccccggggcggggccggcggctgtgcccaccaccaccctggccccccccagctgctgcgggacagccggccctgcaggacaggctggcaggagagcgctggagctgaggcccggggccagggccgggaggtgttcttccccccagccaggagagctgctggcaccaggcaccctggctgtgtgtgtgctgtgggcgccgccggggctgctgctgagggccctgctgcccctgggggcggcggcggctag

SEQ ID NO: 158651 - DNA, 1251 bp, Artificial Sequence
  Description of Artificial Sequence: Synthetic coding sequence
atgagcaccaagcagatcacctgccgctacttcatgcatggagtgtgccgggagggcagccagtgcctcttcagccatgacctggccaacagcaagcccagcaccatctgcaagtactaccagaagggctactgtgcctacggcacccgctgccgctatgaccacacccggcccagcgctgctgctgggggcgctgtgggcaccatggcccacagcgtgcccagccctgccttccacagcccccaccccccatctgaggtgacagccagcatcgtgaagaccaacagccatgagcccgggaagcgggagaagaggaccctggtgctgcgggacaggaacctgagcggcatggccgagaggaagacccagcccagcatggtgagcaaccctggcagctgcagcgacccccagcccagccctgagatgaagccccacagctacctggatgccatccgcagcggcctggatgatgtggaggccagcagcagctacagcaatgagcagcagctgtgcccctatgctgctgctggggagtgccgctttggagatgcctgtgtgtacctgcatggagaggtgtgtgagatctgccgcctgcaggtgctgcacccctttgatcctgagcagaggaaggcccacgagaagatctgcatgctgacctttgagcacgagatggagaaggcctttgccttccaggccagccaggacaaggtgtgcagcatctgcatggaggtgatcctggagaaggccagcgccagcgagcggcgcttcggcatcctgagcaactgcaaccacacctactgcctgagctgcatccggcagtggaggtgtgccaagcagtttgagaaccccatcatcaagagctgcccagagtgcagggtcatcagcgagtttgtgatccccagcgtgtactgggtggaggaccagaacaagaagaatgagctgattgaggccttcaagcagggcatgggcaagaaggcctgcaagtactttgagcagggcaagggcacctgccccttcggcagcaagtgcctgtacagacatgcctacccagatggccgcctggccgagcctgagaagcccaggaagcagctgagcagccagggcaccgtgcgcttcttcaacagcgtgcggctgtgggacttcattgaaaatcgggagagcagacatgtgcccaacaatgaagatgtggacatgacagagctgggggacctcttcatgcacctgtctggagtggagagcagcgagccctag

SEQ ID NO: 158652 - DNA, 1524 bp, Artificial Sequence
  Description of Artificial Sequence: Synthetic coding sequence
atggaggagcctgctgcccccagcgaggcccatgaagctgctggggcccaggccggggctgaggccgcccgggagggcgtgtctggccctgacctgcctgtgtgtgagcccagcggggagagcgctgccccagacagcgccctgccccatgctgcccggggctgggcccccttccctgtggcccctgtgcctgcccacctgcggcggggcggcctgcggcctgccccagccagcggcggcggggcctggcccagccccctgcccagccgcagcagcggcatctggaccaagcagatcatctgccgctactacatccacggccagtgcaaggagggggagaactgccgctacagccatgacctgagcggcaggaagatggccacagagggcggcgtgagccccccaggggccagcgctgggggcggccccagcacagctgcccacatcgagccccccacccaggaggtggccgaggcccccccagctgccagcagcctgagcctgcctgtgattggcagcgctgctgagcggggcttctttgaggccgagcgggacaatgctgacagaggagctgctgggggcgccggcgtggagagctgggcagatgccatcgagtttgtgcccggccagccctaccggggccgctgggtggccagcgcccctgaggcccccctgcagagcagcgagacagagaggaagcagatggctgtgggcagcggcctgcgcttctgctactatgccagccggggcgtgtgcttccggggggagagctgcatgtacctgcacggggacatctgtgacatgtgtggcctgcagaccctgcaccccatggatgctgcccagcgggaggagcacatgagggcctgcatcgaggcccacgagaaggacatggagctgagctttgctgtgcagaggggcatggacaaggtgtgtggcatctgcatggaggtggtgtatgagaaggccaaccccaatgacagaagatttggcatcctgagcaactgcaaccacagcttctgcatccgctgcatccgccgctggaggtctgcccggcagtttgagaacagaattgtgaagagctgcccccagtgccgggtgaccagcgagctggtgatccccagcgagttctgggtggaggaggaggaggagaagcagaagctgatccagcagtacaaggaggccatgagcaacaaggcctgccgctactttgctgagggccggggcaactgcccctttggagacacctgcttctacaagcatgagtacccagagggctggggagatgagcccccaggccctgggggcggcagcttcagcgcctactggcaccagctggtggagcctgtgaggatgggagagggcaacatgctgtacaagagcatcaagaaggagctggtggtgctgcggctggccagcctgctcttcaagcgcttcctgagcctgagagatgagctgcccttcagcgaggaccagtgggacctgctgcactatgagctggaggagtacttcaacctgatcctgtag

SEQ ID NO: 158653 - DNA, 462 bp, Artificial Sequence
  Description of Artificial Sequence: Synthetic coding sequence
atggccccagctgctgccactggaggcagcaccctgcccagcggcttctctgtgttcaccaccctgcctgacctgctcttcatctttgagttcatctttggaggcctggtgtggatcctggtggccagcagcctggtgccctggcccctggtgcagggctgggtgatgtttgtgtctgtgttctgctttgtggccaccaccaccctcatcatcctgtacatcattggagcccacggcggggagacctcctgggtgaccctggatgctgcctaccactgcacagctgccctcttctacctgagcgcctctgtgctggaggccctggccaccatcaccatgcaggacggcttcacctaccgccactaccacgagaacattgctgctgtggtgttctcctacatcgccaccctgctgtatgtggtgcatgctgtgttcagcctcatccgctggaagagcagctag

SEQ ID NO: 158654 - DNA, 168 bp, Artificial Sequence
  Description of Artificial Sequence: Synthetic coding sequence
atggccccagctgctgccactggaggcagcaccctgcccagcggcttctctgtgttcaccaccctgcctgacctgctcttcatctttgaatttgtgttctcctacatcgccaccctgctgtatgtggtgcatgctgtgttcagcctcatccgctggaagagcagctag

SEQ ID NO: 158655 - DNA, 336 bp, Artificial Sequence
  Description of Artificial Sequence: Synthetic coding sequence
atggccccagctgctgccactggaggcagcaccctgcccagcggcttctctgtgttcaccaccctgcctgacctgctcttcatctttgagttcatctttggaggcctggtgtggatcctggtggccagcagcctggtgccctggcccctggtgcagggctgggtgatgtttgtgtctgtgttctgctttgtggccaccaccaccctcatcatcctgtacatcattggagcccacggcggggagacctcctgggtgaccctggtgttctcctacatcgccaccctgctgtatgtggtgcatgctgtgttcagcctcatccgctggaagagcagctag

SEQ ID NO: 158656 - DNA, 294 bp, Artificial Sequence
  Description of Artificial Sequence: Synthetic coding sequence
atggccccagctgctgccactggaggcagcaccctgcccagcggcttctctgtgttcaccaccctgcctgacctgctcttcatctttgaatttgatgctgcctaccactgcacagctgccctcttctacctgagcgcctctgtgctggaggccctggccaccatcaccatgcaggacggcttcacctaccgccactaccacgagaacattgctgctgtggtgttctcctacatcgccaccctgctgtatgtggtgcatgctgtgttcagcctcatccgctggaagagcagctag

SEQ ID NO: 158657 - DNA, 462 bp, Artificial Sequence
  Description of Artificial Sequence: Synthetic coding sequence
atggccagcccagaccccccagccaccagctatgcccccagtgatgtgcccagcggcgtggccctcttcctgaccatcccctttgccttcttcctgcctgagctgatcttcggcttcctggtgtggaccatggtggccgccacccacatcgtgtaccccctgctgcagggctgggtgatgtatgtgtccctgaccagcttcctgatcagcctgatgttcctgctgagctacctgtttggcttctacaagagatttgagagctggagggtgctggacagcctgtaccacggcaccaccggcatcctgtacatgtctgctgctgtgctgcaggtgcacgccaccatcgtgtctgagaagctgctggacccccgcatctactacatcaacagcgctgccagcttctttgccttcatcgccaccctgctgtacatcctgcacgccttcagcatctactaccactag

SEQ ID NO: 158658 - DNA, 6216 bp, Artificial Sequence
  Description of Artificial Sequence: Synthetic coding sequence
atggagctggcccacagcctgctgctgaatgaggaggccctggcccagatcacagaggccaagaggcctgtgttcatctttgagtggctgcgcttcctggacaaggtgctggtggccgccaacaagacagatgtgaaggagaagcagaagaagctggtggagcagctgaccggcctcatcagcagcagccctggcccccccaccaggaagctgctggccaagaacctggccgccctgtacagcatcggggacaccttcaccgtcttccagaccctggacaagtgcaatgacatcatccggaacaaggatgacacagctgcctacctgcccaccaagctggccgctgtggcctgtgtgggcgccttctatgagaagatgggccgcatgctgggcagcgccttccctgagaccgtgaacaacctgctgaagagcctgaagtctgctgagagccagggccgctctgagatcctgatgagcctgcagaaggtgctgagcggcctgggcggcgctgctgccagcagccaccgggacatctacaagaatgcccggagcctgctgacagaccgctccatggctgtgcgctgtgctgtggccaagtgcctgctggagctgcagaatgaggccgtgttcatgtggacagctgagctggagaacatcgccaccctgtgcttcaaggccctggagaacagcaactacggcgtgcgggtggccgtgtccaagctgctgggcaccgtgatggccacagccctgatgcccaagcaggccaccgtgatgaggcagaatgtgaagagggccacctttgatgaggtgctggagctgatggccaccggcttcctgcggggcggcagcggcttcctgaagagcggcggggagatgctgaaggtgggcggctctgtgaaccgggaggtgcgggtgggcgtgacccaggcctacgtggtgtttgtgaccaccctgggcggccagtggctggagaggagctttgccaccttcctgagccacgtgctggacctggtgagccacccccgggccacccagacccacgtggaggccgtgtacagccgccgctgtgtgtccttcatcctgcgggccaccgtgggcagcctgctgggggagaaggcccagattgctgctgccaaggagatctgccaggccatcggcaagcagatgaaggctgtggaggccgtggtgaatgacaccagcggggagaacaagtctggagctgctgacattgctgccagccagcacgtgatggtgtgtgccctgcaggagctgggcagcctggtgcagagcctgaatgccacagccagccccctcatccaggaggccagcatcggcctgctggagatcgtgacctctgtgctgctgcaccccagcatggccgcccggctggccgccgcctggtgcctgcgctgtgtggccgtggccctgcccttccagctgacccccttcctggacagatgtgccgagcggctgaacaacctgaagaccagccctgaggccgtgtctggctacagctttgccatggccgccctgctgggcggcgtgcaccagtgccccctgggcatcccccacgccaagggcaagatggtggtgtccattgctgaggacctgctgaggacagctgcccagaacagccggctgagcctgcagaggacccaggccggctggctgctgctgggcgccctgatgaccctgggccccagcgtggtgcgctaccacctgcccaagatgctgctgctgtggagaaatgtgttccccaggagcctgaaggagctggaggccgagaaggcccggggggacagcttcacctggcaggtgaccctggagggccgggccggggccctgtgtgccatgaggagctttgtggcccactgcccagagctgctgacagaagatgtgatcaggaagctgatgacccccattgaatgtgccatgaccatgatgagccacatccccagcgtgatgaaggcccacggggcccacctgaaggccagcgctgccatggtgcggctgcggctgtatgacatcctggccctgctgccccccaagacctatgagggcagcttcaatgccctgctgcgggagctggtggccgagttcaccctgacagacaacagcgccaacaccaccaccagcctgctgcggagcctgtgccactatgatgattctgtgctgctgggctcctggctgcaggagacagaccacaagagcattgaggaccagctgcagcccaacagcgccagcggcagcggggccctggagcatgaccccagcagcatctacctgcgcatcccagctggggaggccgtgcccggccccctgcccctgggcgtgtctgtgattgatgcctctgtggccctgtttggagtggtgttcccccacgtgtcctacaagcaccggctgcagatgctggaccactttgctgaatgtgtgaagcaggccaagggcgtgcggcagcaggccgtgcagctgaacatcttcaccgctgtgctgagcgccctgaagggcctggccgagaacaagagcaccctgggccctgaggaggtgaggaagagcgccctgaccctggtgatgggccccctggacaaccccaaccccatcctgcgctgtgccgccggggaggccctgggccgcatggcccaggtggtgggggaggccaccttcatcgccaggatggcccagtacagctttgacaagctgaagagcgccagagatgtggtgtccaggacaggccacagcctggccctgggctgcctgcaccgctacgtgggcggcatcggcagcggccagcacctgaagacctctgtgtccatcctgctggccctggcccaggacggcaccagccctgaggtgcagacctggagcctgcacagcctggccctgattgtggacagcagcggccccatgtaccggggctacgtggagcccaccctgagcctggtgctgaccctgctgctgactgtgccccccagccacacagaggtgcaccagtgcctgggccgctgcctgggcgccatcatcaccaccgtgggccctgagctgcagggcaatggagccaccaccagcaccatccgcagcagctgcctggtgggctgtgccatcacccaggaccacagcgacagcctggtgcaggccgccgccatcagctgcctgcagcagctgcacatgtttgcccccaggcatgtgaacctgagcagcctggtgcccagcctgtgtgtgcacctgtgcagcagccacctgctgctgcggcgggctgctgtggcctgcctgcggcagctggcccagcgggaggccgctgaggtgtgtgaatatgccatgagcctggccaagaacacaggagacaaggagagcagcagcgccaacgtgagcccctttgcccctggggtgagcagcaggacagacatccactgccgccaccagggcgtgaacatcacagaaacaggcctggagggcctgctgtttggcatgctggaccgggagacagacaggaagctgtgcagcgacatccatgacaccctgggccacatgctgagcagcctggccgtggagaagctgagccactggctgatgctgtgcaaggatgtgctggccgccagcagtgacatgagcacagccaccctgctgagcagcggcaaggatgaggaggccgagaagaaggatgagatggatgatgacaccatgttcaccaccctgggggaggaggacaagagcaagccctttgtggccccccgctgggccaccagggtgtttgctgctgactgcctgtgccgcatcatcaacctgtgtgaaaatgctgaccaggcccactttgacctggccctggcccggagcgccaagctgaggaaccccaccaatgacctgctggtgctgcacctgagtgacctgatccgcatggccttcatggccgccacagaccacagcaaccagctgaggatggccggcctgcaggccctggaggacatcatcaagaagtttgcctctgtgcctgagcctgagttccctggccacgtgatcctggagcagtaccaggccaacgtgggcgccgccctgcggcctgccttcagccaggacacccccagcgacatcatcgccaaggcctgccaggtgtgcagcacctggattggcagcggcgtggtgtctgacctgaatgacctgcggcgggtgcacaacctgctggtgagcagcctggacaaggtgcaggccggcaagggcagcagcagccagctgtaccgggagagcgccaccaccatggagaagctggccgtgctgaaggcctgggccgaggtgtatgtggtggccatgaacatcaagaaggaggccgagagcaagcccaagagggccatcaagaacacagatgatgatgatgatgactgtggcaccattgatgagctgcccccagacagcctcatcaccctggtgcagcctgagctgcccaccctgagccggctgtggctggccgccctgaaggactatgccctgctgaccctgcctgctgagttcagcagccagctgcccccagatggaggagccttctacaccccagagaccatcgacacagcccggctgcactacagaaattcctgggcccccatcctgcatgctgtggccctgtggctgaacagcacaggcttcacctgcagcgagagcacagaggccgccgccatcagcggcctgcagaagaggagcacctctgtgaacctgaaccaggccagcggggctgtgggcagcgccaagagcctgcctgagatcaacaaggacaggatgcacctgatcctgggcgtgtccatccagttcctgtgcagccccaggcctgaggagcccatcgagcacgtgacagcctgcctgcaggccctgcacaccctgctggacagcccctatgcccgggtgcacatcgccgaggaccagctgattggagtggagctgctgtctgtgctgcaccggctgctgctgacctggaaccccagctctgtgcagctgctggtgactggagtggtgcagcagatcgtgcgggccgcccaggactacctgcaggagaagaggaacaccctgaatgaagatgacatggagaaggaggcctgcaccgtgctgggggagggcggggacagcggcggcctcatccctgggaagagcctggtgtttgccaccatggagctgctgatgttcatcctggtgcgccacatgccccacctgagcaccaaggtgtctgacagccccagccacatcgccaccaagacccggctgtctgaggagagcgcccggctggtggccgccaccgtgaccatcctgagtgacctgcccagcctgtgcagccctgctggctgcatgaccatcctgcccaccatcctcttcctgattgcccgcatcctgaaggacacagccatcaagtctgctgacaaccaggtgcccccacctgtgtctgctgccctgcagggcatcaagagcatcgtgaccctgtccatggccaagacagaagctggggtgcagaagcagtggacagccctgatccgcagcaccctggcctgcatcctggagtacagccagccagaagattctgtgcccaccccagatgaggtgtccatgctgacagccatcgccctcttcctgtggagcgccagcaatgagatcatcggcgtgcagagcctgcagaatggctgcatgaaccgcttcaagaatgccctgaacagctgtgacccctgggtgcaggccaagtgctaccagctgctgctgagcgtcttccagcacagcaacagagccctgagcaccccctacatccacagcctggcccccatcgtggtggagaagctgaaggctgtggagaggaacagacctgccagcaacatcgagctgctggccgtgcaggagggcatcaaggtgctggagaccctggtggccctgggggaggagcagaacagagtgcagctgctggccctgctggtgcccaccctcatctcctacctgctggatgaaaattcctttgccagcgccagcagcgccagcaaggacctgcatgaatttgccctgcagaacctgatgcacatcggccccctgtacccccacgccttcaagacagtgatgggcgccgcccctgagctgaaggtgcggctggagacagctgtgcgggccagccaggccagcaaggccaaggccgccgcccggcagcctgccccagccatccacagcgcccccaccatcaagctgaagaccagcttcttctag

SEQ ID NO: 158659 - DNA, 1005 bp, Artificial Sequence
  Description of Artificial Sequence: Synthetic coding sequence
atgtctgagcccatccgggtgctggtgactggagctgctggccagatcgcctacagcctgctgtacagcattggaaatggatctgtgtttgggaaggaccagcccatcatcctggtgctgctggacatcacccccatgatgggcgtgctggatggagtgctgatggagctgcaggactgtgccctgcccctgctgaaggatgtgattgccacagacaaggaggatgtggccttcaaggacctggatgtggccatcctggtgggctccatgccccggcgggagggcatggagaggaaggacctgctgaaggccaacgtgaagatcttcaagagccagggcgccgccctggacaagtatgccaagaagtctgtgaaggtgattgtggtgggcaacccagccaacaccaactgcctgacagccagcaagagcgcccccagcatccccaaggagaacttcagctgcctgacccggctggaccacaacagagccaaggcccagatcgccctgaagctgggcgtgacagccaatgatgtgaagaatgtcatcatctggggcaaccacagcagcacccagtacccagatgtgaaccacgccaaggtgaagctgcagggcaaggaggtgggcgtgtatgaggccctgaaggatgacagctggctgaagggggagtttgtgaccaccgtgcagcagagaggagctgctgtgatcaaggccaggaagctgagcagcgccatgtctgctgccaaggccatctgtgaccacgtgcgggacatctggtttggcaccccagagggggagtttgtgtccatgggcgtcatcagtgatggcaacagctatggagtgcctgatgacctgctgtacagcttccctgtggtgatcaagaacaagacctggaagtttgtggagggcctgcccatcaatgacttcagccgggagaagatggacctgacagccaaggagctgacagaggagaaggagagcgcctttgagttcctgagcagcgcctag

SEQ ID NO: 158660 - DNA, 1059 bp, Artificial Sequence
  Description of Artificial Sequence: Synthetic coding sequence
atgaggcgctgcagctacttccccaaggatgtgacagtgtttgacaaggatgacaagtctgagcccatccgggtgctggtgactggagctgctggccagatcgcctacagcctgctgtacagcattggaaatggatctgtgtttgggaaggaccagcccatcatcctggtgctgctggacatcacccccatgatgggcgtgctggatggagtgctgatggagctgcaggactgtgccctgcccctgctgaaggatgtgattgccacagacaaggaggatgtggccttcaaggacctggatgtggccatcctggtgggctccatgccccggcgggagggcatggagaggaaggacctgctgaaggccaacgtgaagatcttcaagagccagggcgccgccctggacaagtatgccaagaagtctgtgaaggtgattgtggtgggcaacccagccaacaccaactgcctgacagccagcaagagcgcccccagcatccccaaggagaacttcagctgcctgacccggctggaccacaacagagccaaggcccagatcgccctgaagctgggcgtgacagccaatgatgtgaagaatgtcatcatctggggcaaccacagcagcacccagtacccagatgtgaaccacgccaaggtgaagctgcagggcaaggaggtgggcgtgtatgaggccctgaaggatgacagctggctgaagggggagtttgtgaccaccgtgcagcagagaggagctgctgtgatcaaggccaggaagctgagcagcgccatgtctgctgccaaggccatctgtgaccacgtgcgggacatctggtttggcaccccagagggggagtttgtgtccatgggcgtcatcagtgatggcaacagctatggagtgcctgatgacctgctgtacagcttccctgtggtgatcaagaacaagacctggaagtttgtggagggcctgcccatcaatgacttcagccgggagaagatggacctgacagccaaggagctgacagaggagaaggagagcgcctttgagttcctgagcagcgcctag

SEQ ID NO: 158661 - DNA, 738 bp, Artificial Sequence
  Description of Artificial Sequence: Synthetic coding sequence
atgccccggcgggagggcatggagaggaaggacctgctgaaggccaacgtgaagatcttcaagagccagggcgccgccctggacaagtatgccaagaagtctgtgaaggtgattgtggtgggcaacccagccaacaccaactgcctgacagccagcaagagcgcccccagcatccccaaggagaacttcagctgcctgacccggctggaccacaacagagccaaggcccagatcgccctgaagctgggcgtgacagccaatgatgtgaagaatgtcatcatctggggcaaccacagcagcacccagtacccagatgtgaaccacgccaaggtgaagctgcagggcaaggaggtgggcgtgtatgaggccctgaaggatgacagctggctgaagggggagtttgtgaccaccgtgcagcagagaggagctgctgtgatcaaggccaggaagctgagcagcgccatgtctgctgccaaggccatctgtgaccacgtgcgggacatctggtttggcaccccagagggggagtttgtgtccatgggcgtcatcagtgatggcaacagctatggagtgcctgatgacctgctgtacagcttccctgtggtgatcaagaacaagacctggaagtttgtggagggcctgcccatcaatgacttcagccgggagaagatggacctgacagccaaggagctgacagaggagaaggagagcgcctttgagttcctgagcagcgcctag

SEQ ID NO: 158662 - DNA, 1017 bp, Artificial Sequence
  Description of Artificial Sequence: Synthetic coding sequence
atgctgagcgccctggcccggcctgccagcgctgccctgcggcgctccttcagcaccagcgcccagaacaatgccaaggtggccgtgctgggcgccagcggcggcatcggccagcccctgagcctgctgctgaagaacagccccctggtgtcccggctgaccctgtatgacatcgcccacaccccaggagtggccgctgacctgagccacatcgagaccaaggctgctgtgaagggctacctgggccctgagcagctgcctgactgcctgaagggctgtgatgtggtggtgatcccagctggggtgcccaggaagccaggcatgaccagagatgacctcttcaacaccaatgccaccatcgtggccaccctgacagctgcctgtgcccagcactgcccagaggccatgatctgtgtgattgccaaccctgtgaacagcaccatccccatcacagctgaggtgttcaagaagcacggcgtgtacaaccccaacaagatctttggagtgaccaccctggacatcgtgcgggccaacacctttgtggccgagctgaagggcctggaccctgcccgggtgaatgtgcctgtgattggaggccatgctgggaagaccatcatccccctcatcagccagtgcacccccaaggtggacttcccccaggaccagctgacagccctgaccggccgcatccaggaggccggcacagaggtggtgaaggccaaggccggggccggcagcgccaccctgtccatggcctatgctggggccaggtttgtgttcagcctggtggatgccatgaatggcaaggagggcgtggtggagtgcagctttgtgaagagccaggagacagagtgcacctacttcagcacccccctgctgctgggcaagaagggcatcgagaagaacctgggcatcggcaaggtgagcagctttgaggagaagatgatcagtgatgccatccctgagctgaaggccagcatcaagaagggagaagattttgtgaagaccctgaagtag

SEQ ID NO: 158663 - DNA, 1872 bp, Artificial Sequence
  Description of Artificial Sequence: Synthetic coding sequence
atgaaccgctacaccaccatgaggcagctgggagatggcacctacggctctgtgctgatgggcaagagcaatgaaagtggagagctggtggccatcaagaggatgaagaggaagttctacagctgggatgagtgcatgaacctgcgggaggtgaagagcctgaagaagctgaaccacgccaacgtcatcaagctgaaggaggtgatcagagaaaatgaccacctgtacttcatctttgagtacatgaaggagaacctgtaccagctgatgaaggacaggaacaagctgtttcctgagagcgtcatccggaacatcatgtaccagatcctgcagggcctggccttcatccacaagcacggcttcttccaccgggacatgaagccagagaacctgctgtgcatgggccctgagctggtgaagattgctgactttggcctggcccgggagctgcggagccagcccccctacacagattatgtgtccacccgctggtaccgggcccctgaggtgctgctgcggagctctgtgtacagcagccccattgatgtgtgggccgtgggcagcatcatggccgagctgtacatgctgcggcccctcttccctggcaccagcgaggtggatgagatcttcaagatctgccaggtgctgggcacccccaagaagagtgactggccagagggctaccagctggccagctccatgaacttccgcttcccccagtgtgtgcccatcaacctgaagaccctcatccccaatgccagcaatgaggccatccagctgatgacagagatgctgaactgggaccccaagaagaggcccacagccagccaggccctgaagcacccctacttccaggtgggccaggtgctgggccccagcagcaaccacctggagagcaagcagagcctgaacaagcagctgcagcccctggagagcaagcccagcctggtggaggtggagcccaagcccctgcctgacatcatcgaccaggtggtgggccagccccagcccaagaccagccagcagcccctgcagcccatccagcccccccagaacctgtctgtgcagcagccccccaagcagcagagccaggagaagccaccccagaccctcttccccagcatcgtgaagaacatgcccaccaagcccaacggcaccctgagccacaagtctggaagaagacgctggggccagaccatcttcaagagcggggacagctgggaggagctggaggactatgactttggagccagccacagcaagaagcccagcatgggcgtcttcaaggagaagaggaagaaggacagccccttccggctgcctgagcctgtgcccagcggcagcaaccacagcactggagagaacaagagcctgcctgctgtgaccagcctgaagagtgacagcgagctgagcacagcccccaccagcaagcagtactacctgaagcagagccgctacctgcccggggtgaaccccaagaaggtgtccctcatcgccagcggcaaggagatcaacccccacacctggagcaaccagctgttccccaagagcctgggccctgtgggcgctgagctggccttcaagaggagcaatgccggcaacctgggcagctatgccacctacaaccagagcggctacatccccagcttcctgaagaaggaggtgcagagcgctggccagaggatccacctggcccccctgaatgccacagccagcgagtacacctggaacaccaagacaggccggggccagttcagcggccgcacctacaaccccacagccaagaacctgaacatcgtgaacagagcccagcccatccccagcgtgcacggccgcacagactgggtggccaagtatggaggccacaggtag

SEQ ID NO: 158664 - DNA, 1872 bp, Artificial Sequence; identical to SEQ ID NO: 158663
  Description of Artificial Sequence: Synthetic coding sequence

SEQ ID NO: 158665 - DNA, 867 bp, Artificial Sequence
  Description of Artificial Sequence: Synthetic coding sequence
atgaaccgctacaccaccatgaggcagctgggagatggcacctacggctctgtgctgatgggcaagagcaatgaaagtggagagctggtggccatcaagaggatgaagaggaagttctacagctgggatgagtgcatgaacctgcgggaggtgaagagcctgaagaagctgaaccacgccaacgtcatcaagctgaaggaggtgatcagagaaaatgaccacctgtacttcatctttgagtacatgaaggagaacctgtaccagctgatgaaggacaggaacaagctgtttcctgagagcgtcatccggaacatcatgtaccagatcctgcagggcctggccttcatccacaagcacggcttcttccaccgggacatgaagccagagaacctgctgtgcatgggccctgagctggtgaagattgctgactttggcctggcccgggagctgcggagccagcccccctacacagattatgtgtccacccgctggtaccgggcccctgaggtgctgctgcggagctctgtgtacagcagccccattgatgtgtgggccgtgggcagcatcatggccgagctgtacatgctgcggcccctcttccctggcaccagcgaggtggatgagatcttcaagatctgccaggtgctgggcacccccaagaagagtgactggccagagggctaccagctggccagctccatgaacttccgcttcccccagtgtgtgcccatcaacctgaagaccctcatccccaatgccagcaatgaggccatccagctgatgacagagatgctgaactgggaccccaagaagaggcccacagccagccagccctgcttcctggtggaggtggagcggcccaactag

SEQ ID NO: 158666 - DNA, 1374 bp, Artificial Sequence
  Description of Artificial Sequence: Synthetic coding sequence
atgaaccgctacaccaccatgaggcagctgggagatggcacctacggctctgtgctgatgggcaagagcaatgaaagtggagagctggtggccatcaagaggatgaagaggaagttctacagctgggatgagtgcatgaacctgcgggaggtgaagagcctgaagaagctgaaccacgccaacgtcatcaagctgaaggaggtgatcagagaaaatgaccacctgtacttcatctttgagtacatgaaggagaacctgtaccagctgatgaaggacaggaacaagctgtttcctgagagcgtcatccggaacatcatgtaccagatcctgcagggcctggccttcatccacaagcacggcttcttccaccgggacatgaagccagagaacctgctgtgcatgggccctgagctggtgaagattgctgactttggcctggcccgggagctgcggagccagcccccctacacagattatgtgtccacccgctggtaccgggcccctgaggtgctgctgcggagctctgtgtacagcagccccattgatgtgtgggccgtgggcagcatcatggccgagctgtacatgctgcggcccctcttccctggcaccagcgaggtggatgagatcttcaagatctgccaggtgctgggcacccccaagaagagtgactggccagagggctaccagctggccagctccatgaacttccgcttcccccagtgtgtgcccatcaacctgaagaccctcatccccaatgccagcaatgaggccatccagctgatgacagagatgctgaactgggaccccaagaagaggcccacagccagccaggccctgaagcacccctacttccaggtgggccaggtgctgggccccagcagcaaccacctggagagcaagcagagcctgaacaagcagctgcagcccctggagagcaagcccagcctggtggaggtggagcccaagcccctgcctgacatcatcgaccaggtggtgggccagccccagcccaagaccagccagcagcccctgcagcccatccagcccccccagaacctgtctgtgcagcagccccccaagcagcagagccaggagaagccaccccagaccctcttccccagcatcgtgaagaacatgcccaccaagcccaacggcaccctgagccacaagtctggaagaagacgctggggccagaccatcttcaagagcggggacagctgggaggagctggaggactatgactttggagccagccacagcaagaagcccagcatgggcgtcttcaaggagaagaggaagaaggacagccccttccggcagcaggtgaagatggctgtgatcagcctgagcgcccaccagttccccaccctgtag

SEQ ID NO: 158667 - DNA, 942 bp, Artificial Sequence
  Description of Artificial Sequence: Synthetic coding sequence
atggaggagatgtctggagagagcgtggtgagcagcgctgtgcctgctgctgccaccaggaccaccagcttcaagggcaccagccccagcagcaaatatgtgaagctgaatgtgggcggggccctgtactacaccaccatgcagaccctgaccaagcaggacaccatgctgaaggccatgttcagcggccgcatggaggtgctgacagattctgagggctggatcctgattgacagatgtgggaagcacttcggcaccatcctgaactacctgagagatggagctgtgcccctgcctgagagccggcgggagattgaggagctgctggccgaggccaagtactacctggtgcagggcctggtggaggagtgccaggccgccctgcagaacaaggacacctatgagcccttctgcaaggtgcctgtgatcaccagcagcaaggaggagcagaagctgattgccaccagcaacaagccagctgtgaagctgctgtacaacagaagcaacaacaagtacagctacaccagcaacagtgatgacaacatgctgaagaacatcgagctgtttgacaagctgagcctgcgcttcaacggccgggtgctcttcatcaaggatgtgattggagatgagatctgctgctggagcttctacggccagggcaggaagattgctgaggtgtgctgcaccagcatcgtgtatgccacagagaagaagcagaccaaggtggagttccctgaggcccgcatctatgaggagaccctgaacatcctgctgtatgaggcccaggacggccggggccctgacaatgccctgctggaggccactggaggagctgctggccgcagccaccacctggatgaagatgaggagcgggagcgcatcgagcgggtgcggcgcatccacatcaagaggccagatgaccgggcccacctgcaccagtag

SEQ ID NO: 158668 - DNA, 558 bp, Artificial Sequence
  Description of Artificial Sequence: Synthetic coding sequence
atgggccctgagcggcacctgagcggggccccagccaggatggccaccgtggtgctgggcggggacaccatgggccctgagcgcatcttccccaaccagacagaggagctgggccaccagggccccagcgagggcaccggggactggagcagcgaggagcctgaggaggagcaggaggagactggaagtggccctgctggctacagctaccagcccctgaaccaggaccctgagcaggaggaggtggagctggcccctgtgggagatggagatgtggtggccgacatccaggaccgcatccaggccctgggcctgcacctgcctgacccccccctggagagtgaagatgaagatgaggagggcgccacagccctgaacaaccacagcagcatccccatggaccctgagcacgtggagctggtgaagaggaccatggccggcgtgtccctgcctgcccctggggtgcctgcctgggcccgggagatcagtgatgcccagtgggaggatgtggtgcagaaggccctgcaggcccggcaggccagccctgcctggaagtag

SEQ ID NO: 158669 - DNA, 1719 bp, Artificial Sequence
  Description of Artificial Sequence: Synthetic coding sequence
atggagcctgaggccccccggcggcggcacacccaccagaggggctacctgctgaccaggaacccccacctgaacaaggacctggccttcaccctggaggagcggcagcagctgaacatccacggcctgctgcccccatccttcaacagccaggagatccaggtgctgcgggtggtgaagaactttgagcacctgaacagcgactttgaccgctacctgctgctgatggacctgcaggacagaaatgagaagctgttctacagagtgctgaccagtgacatcgagaagttcatgcccatcgtgtacacccccaccgtgggcctggcctgccagcagtacagcctggtgttcaggaagccccggggcctcttcatcaccatccatgaccggggccacatcgcctctgtgctgaatgcctggccagaagatgtgatcaaggccatcgtggtgacagatggagagcgcatcctgggcctgggggacctgggctgcaatggcatgggcatccctgtgggcaagctggccctgtacacagcctgtggcggcatgaacccccaggagtgcctgcccgtcatcctggatgtgggcacagaaaatgaggagctgctgaaggaccccctgtacatcggcctgcggcagaggagagtgcggggctctgaatatgatgacttcctggatgagttcatggaggccgtgagcagcaaatatggcatgaactgcctgatccagtttgaagattttgccaacgtgaatgccttccggctgctgaacaagtacagaaaccagtactgcaccttcaatgatgacatccagggcacagcctctgtggccgtggccggcctgctggccgccctgcgcatcaccaagaacaagctgagtgaccagaccatcctcttccagggcgctggggaggccgccctgggcatcgcccacctgattgtgatggccctggagaaggagggcctgcccaaggagaaggccatcaagaagatctggctggtggacagcaagggcctcatcgtgaagggccgggccagcctgacccaggagaaggagaagtttgcccacgagcacgaggagatgaagaacctggaggccatcgtgcaggagatcaagcccacagccctgattggagtggccgccatcggcggggccttcagcgagcagatcctgaaggacatggccgccttcaatgaaagacccatcatctttgccctgagcaaccccaccagcaaggccgagtgcagcgctgagcagtgctacaagatcaccaagggccgggccatctttgccagcggcagcccctttgatcctgtgaccctgcccaacggccagaccctgtacccaggccagggcaacaacagctatgtgtttcctggggtggccctgggcgtggtggcctgtggcctgcggcagatcacagacaacatcttcctgaccacagctgaggtgattgcccagcaggtgtctgacaagcacctggaggagggccgcctgtacccacccctgaacaccatcagagatgtgtccctgaagattgctgagaagatcgtgaaggatgcctaccaggagaagacagccaccgtgtacccagagccccagaacaaggaggcctttgtgcgcagccagatgtacagcacagattatgaccagatcctgcctgactgctacagctggccagaggaggtgcagaagatccagaccaaggtggaccagtag

SEQ ID NO: 158670 - DNA, 699 bp, Artificial Sequence
  Description of Artificial Sequence: Synthetic coding sequence
gtgaagggccgggccagcctgacccaggagaaggagaagtttgcccacgagcacgaggagatgaagaacctggaggccatcgtgcaggagatcaagcccacagccctgattggagtggccgccatcggcggggccttcagcgagcagatcctgaaggacatggccgccttcaatgaaagacccatcatctttgccctgagcaaccccaccagcaaggccgagtgcagcgctgagcagtgctacaagatcaccaagggccgggccatctttgccagcggcagcccctttgatcctgtgaccctgcccaacggccagaccctgtacccaggccagggcaacaacagctatgtgtttcctggggtggccctgggcgtggtggcctgtggcctgcggcagatcacagacaacatcttcctgaccacagctgaggtgattgcccagcaggtgtctgacaagcacctggaggagggccgcctgtacccacccctgaacaccatcagagatgtgtccctgaagattgctgagaagatcgtgaaggatgcctaccaggagaagacagccaccgtgtacccagagccccagaacaaggaggcctttgtgcgcagccagatgtacagcacagattatgaccagatcctgcctgactgctacagctggccagaggaggtgcagaagatccagaccaaggtggaccagtag

SEQ ID NO: 158671 - DNA, 1221 bp, Artificial Sequence
  Description of Artificial Sequence: Synthetic coding sequence
atgggcatccctgtgggcaagctggccctgtacacagcctgtggcggcatgaacccccaggagtgcctgcccgtcatcctggatgtgggcacagaaaatgaggagctgctgaaggaccccctgtacatcggcctgcggcagaggagagtgcggggctctgaatatgatgacttcctggatgagttcatggaggccgtgagcagcaaatatggcatgaactgcctgatccagtttgaagattttgccaacgtgaatgccttccggctgctgaacaagtacagaaaccagtactgcaccttcaatgatgacatccagggcacagcctctgtggccgtggccggcctgctggccgccctgcgcatcaccaagaacaagctgagtgaccagaccatcctcttccagggcgctggggaggccgccctgggcatcgcccacctgattgtgatggccctggagaaggagggcctgcccaaggagaaggccatcaagaagatctggctggtggacagcaagggcctcatcgtgaagggccgggccagcctgacccaggagaaggagaagtttgcccacgagcacgaggagatgaagaacctggaggccatcgtgcaggagatcaagcccacagccctgattggagtggccgccatcggcggggccttcagcgagcagatcctgaaggacatggccgccttcaatgaaagacccatcatctttgccctgagcaaccccaccagcaaggccgagtgcagcgctgagcagtgctacaagatcaccaagggccgggccatctttgccagcggcagcccctttgatcctgtgaccctgcccaacggccagaccctgtacccaggccagggcaacaacagctatgtgtttcctggggtggccctgggcgtggtggcctgtggcctgcggcagatcacagacaacatcttcctgaccacagctgaggtgattgcccagcaggtgtctgacaagcacctggaggagggccgcctgtacccacccctgaacaccatcagagatgtgtccctgaagattgctgagaagatcgtgaaggatgcctaccaggagaagacagccaccgtgtacccagagccccagaacaaggaggcctttgtgcgcagccagatgtacagcacagattatgaccagatcctgcctgactgctacagctggccagaggaggtgcagaagatccagaccaaggtggaccagtag

SEQ ID NO: 158672 - DNA, 1494 bp, Artificial Sequence
  Description of Artificial Sequence: Synthetic coding sequence
atggacctgcaggacagaaatgagaagctgttctacagagtgctgaccagtgacatcgagaagttcatgcccatcgtgtacacccccaccgtgggcctggcctgccagcagtacagcctggtgttcaggaagccccggggcctcttcatcaccatccatgaccggggccacatcgcctctgtgctgaatgcctggccagaagatgtgatcaaggccatcgtggtgacagatggagagcgcatcctgggcctgggggacctgggctgcaatggcatgggcatccctgtgggcaagctggccctgtacacagcctgtggcggcatgaacccccaggagtgcctgcctgtgatcctggatgtgggcacagaaaatgaggagctgctgaaggaccccctgtacatcggcctgcggcagaggagagtgcggggctctgaatatgatgacttcctggatgagttcatggaggccgtgagcagcaaatatggcatgaactgcctgatccagtttgaggactttgccaacgtgaatgccttccggctgctgaacaagtacagaaaccagtactgcaccttcaatgatgacatccagggcacagcctctgtggccgtggccggcctgctggccgccctgcgcatcaccaagaacaagctgagtgaccagaccatcctcttccagggcgctggggaggccgccctgggcatcgcccacctgattgtgatggccctggagaaggagggcctgcccaaggagaaggccatcaagaagatctggctggtggacagcaagggcctgattgtgaagggccgggccagcctgacccaggagaaggagaagtttgcccatgaacatgaggagatgaagaacctggaggccatcgtgcaggagatcaagcccacagccctgattggagtggccgccatcggcggggccttcagcgagcagatcctgaaggacatggccgccttcaatgaaagacccatcatctttgccctgagcaaccccaccagcaaggcagaatgttctgctgagcagtgctacaagatcaccaagggccgggccatctttgccagcggcagcccctttgatcctgtgaccctgcccaacggccagaccctgtacccaggccagggcaacaacagctatgtgtttcctggggtggccctgggcgtggtggcctgtggcctgcggcagatcacagacaacatcttcctgaccacagctgaggtgattgcccagcaggtgtctgacaagcacctggaggagggccgcctgtacccacccctgaacaccatcagagatgtgtccctgaagattgctgagaagatcgtgaaggatgcctaccaggagaagacagccaccgtgtacccagagccccagaacaaggaggcctttgtgcgcagccagatgtacagcacagattatgaccagatcctgcctgactgctacagctggccagaggaggtgcagaagatccagaccaaggtggaccagtag

SEQ ID NO: 158673 - DNA, 1755 bp, Artificial Sequence
  Description of Artificial Sequence: Synthetic coding sequence
atgctgagccggctgcgggtggtgtccaccacctgcaccctggcctgccgccacctgcacatcaaggagaagggcaagcccctgatgctgaaccccaggaccaacaagggcatggccttcaccctgcaggagcggcagatgctgggcctgcagggcctgctgccccccaagattgagacccaggacatccaggccctgcgcttccacaggaacctgaagaagatgaccagccccctggagaagtacatctacatcatgggcatccaggagagaaatgagaagctgttctaccgcatcctgcaggatgacatcgagagcctgatgcccatcgtgtacacccccaccgtgggcctggcctgcagccagtatggccacatcttccggcggcccaagggcctcttcatcagcatcagtgaccggggccacgtgcgcagcatcgtggacaactggccagagaaccacgtgaaggctgtggtggtgacagatggagagcgcatcctgggcctgggggacctgggcgtgtatggcatgggcatccctgtgggcaagctgtgcctgtacacagcctgtgccggcatccggccagaccgctgcctgcctgtgtgcattgatgtgggcacagacaacatcgccctgctgaaggaccccttctacatgggcctgtaccagaagagggacaggacccagcagtatgatgacctgattgatgagttcatgaaggccatcacagacagatatggcaggaacaccctcatccagtttgaagattttggaaaccacaatgccttccgcttcctgaggaagtaccgggagaagtactgcaccttcaatgatgacatccagggcacagctgctgtggccctggccggcctgctggccgcccagaaggtgatcagcaagcccatcagcgagcacaagatcctcttcctgggcgctggggaggccgccctgggcatcgccaacctgattgtgatgtccatggtggagaatggcctgtctgagcaggaggcccagaagaagatctggatgtttgacaagtatggcctgctggtgaagggcaggaaggccaagattgacagctaccaggagcccttcacccacagcgcccctgagagcatcccagacacctttgaagatgctgtgaacatcctgaagcccagcaccatcatcggcgtggccggggccggccgcctcttcaccccagatgtgatccgggccatggccagcatcaatgaaagacctgtgatctttgccctgagcaaccccacagcccaggctgaatgtacagctgaggaggcctacaccctgacagagggccgctgcctgtttgccagcggcagcccctttggacctgtgaagctgacagatggccgggtcttcaccccaggccagggcaacaacgtgtacatcttccctggggtggccctggccgtcatcctgtgcaacaccaggcacatcagtgacagcgtcttcctggaggccgccaaggccctgaccagccagctgacagatgaggagctggcccagggccgcctgtacccacccctggccaacatccaggaggtgtccatcaacatcgccatcaaggtgacagagtacctgtatgccaacaagatggccttccgctacccagagcctgaggacaaggccaagtatgtgaaggagaggacctggaggagtgaatatgacagcctgctgcctgatgtgtatgagtggccagagagcgccagcagcccccctgtgatcacagaatag

SEQ ID NO: 158674 - DNA, 1440 bp, Artificial Sequence
  Description of Artificial Sequence: Synthetic coding sequence
atgctgagccggctgcgggtggtgtccaccacctgcaccctggcctgccgccacctgcacatcaaggagaagggcaagcccctgatgctgaaccccaggaccaacaagggcatggccttcaccctgcaggagcggcagatgctgggcctgcagggcctgctgccccccaagattgagacccaggacatccaggccctgcgcttccacaggaacctgaagaagatgaccagccccctggagaagtacatctacatcatgggcatccaggagagaaatgagaagctgttctaccgcatcctgcaggatgacatcgagagcctgatgcccatcgtgtacacccccaccgtgggcctggcctgcagccagtatggccacatcttccggcggcccaagggcctcttcatcagcatcagtgaccggggccacgtgcgcagcatcgtggacaactggccagagaaccacgtgaaggctgtggtggtgacagatggagagcgcatcctgggcctgggggacctgggcgtgtatggcatgggcatccctgtgggcaagctgtgcctgtacacagcctgtgccggcatccggccagaccgctgcctgcctgtgtgcattgatgtgggcacagacaacatcgccctgctgaaggaccccttctacatgggcctgtaccagaagagggacaggacccagcagtatgatgacctgattgatgagttcatgaaggccatcacagacagatatggcaggaacaccctcatccagtttgaagattttggaaaccacaatgccttccgcttcctgaggaagtaccgggagaagtactgcaccttcaatgatgacatccagggcacagctgctgtggccctggccggcctgctggccgcccagaaggtgatcagcaagcccatcagcgagcacaagatcctcttcctgggcgctggggaggccgccctgggcatcgccaacctgattgtgatgtccatggtggagaatggcctgtctgagcaggaggcccagaagaagatctggatgtttgacaagtatggcctgctggtgaagggcaggaaggccaagattgacagctaccaggagcccttcacccacagcgcccctgagagcatcccagacacctttgaagatgctgtgaacatcctgaagcccagcaccatcatcggcgtggccggggccggccgcctcttcaccccagatgtgatccgggccatggccagcatcaatgaaagacctgtgatctttgccctgagcaaccccacagcccaggctgaatgtacagctgaggaggcctacaccctgacagagggccgctgcctgtttgccagcggcagcccctttggacctgtgaagctgacagatggccgggtcttcaccccaggccagggcaacaacgtgtacatcttccctggctaccgcatccccatctgctag

SEQ ID NO: 158675 - DNA, 780 bp, Artificial Sequence
  Description of Artificial Sequence: Synthetic coding sequence
atggccttcaccctggaggagcggctgcagctgggcatccacggcctcatccccccctgcttcctgagccaggatgtgcagctgctgcgcatcatgagatactatgagcggcagcagagcgacctggacaagtacatcatcctgatgaccctgcaggacagaaatgagaagctgttctacagagtgctgaccagtgatgtggagaagttcatgcccatcgtgtacacccccaccgtgggcctggcctgccagcactacggcctgaccttcagaagaccccggggcctcttcatcaccatccatgacaagggccacctggccaccatgctgaacagctggccagaggacaacatcaaggctgtggtggtgacagatggagagcgcatcctgggcctgggggacctgggctgctacggcatgggcatccctgtgggcaagctggccctgtacacagcctgtggcggcgtgaacccccagcagtgcctgcctgtgctgctggatgtgggcaccaacaatgaggagctgctgcgggaccccctgtacatcggcctgaagcaccagagggtgcacggcaaggcctatgatgacctgctggatgagttcatgcaggccgtgacagacaagtttggcatcaactgcctgatccagtttgaggactttgccaatgccaatgccttccggctgctgaacaagtacagaaacaagtactgcatgtttaatgatgacatccaggatgacttcagccggggccccaagaggagccagctgttcttcaagtag

SEQ ID NO: 158676 - DNA, 1815 bp, Artificial Sequence
  Description of Artificial Sequence: Synthetic coding sequence
atgggcgccgccctgggcaccggcacccggctggccccctggccaggccgggcctgtggggccctgccccgctggacccccacagccccagcccagggctgccacagcaagccaggccctgcccggcctgtgcccctgaagaagaggggctatgatgtgaccaggaacccccacctgaacaagggcatggccttcaccctggaggagcggctgcagctgggcatccacggcctcatccccccctgcttcctgagccaggatgtgcagctgctgcgcatcatgagatactatgagcggcagcagagcgacctggacaagtacatcatcctgatgaccctgcaggacagaaatgagaagctgttctacagagtgctgaccagtgatgtggagaagttcatgcccatcgtgtacacccccaccgtgggcctggcctgccagcactacggcctgaccttcagaagaccccggggcctcttcatcaccatccatgacaagggccacctggccaccatgctgaacagctggccagaggacaacatcaaggctgtggtggtgacagatggagagcgcatcctgggcctgggggacctgggctgctacggcatgggcatccctgtgggcaagctggccctgtacacagcctgtggcggcgtgaacccccagcagtgcctgcctgtgctgctggatgtgggcaccaacaatgaggagctgctgcgggaccccctgtacatcggcctgaagcaccagagggtgcacggcaaggcctatgatgacctgctggatgagttcatgcaggccgtgacagacaagtttggcatcaactgcctgatccagtttgaggactttgccaatgccaatgccttccggctgctgaacaagtacagaaacaagtactgcatgtttaatgatgacatccagggcacagcctctgtggccgtggccggcatcctggccgccctgcgcatcaccaagaacaagctgagcaaccacgtgtttgtgttccagggcgctggggaggccgccatgggcatcgcccacctgctggtgatggccctggagaaggagggcgtgcccaaggccgaggccaccaggaagatctggatggtggacagcaagggcctgattgtgaagggccgcagccacctgaaccacgagaaggagatgtttgcccaggaccaccctgaggtgaacagcctggaggaggtggtgcggctggtgaagcccacagccatcatcggcgtggccgccatcgccggggccttcacagagcagatcctgcgggacatggccagcttccacgagcggcccatcatctttgccctgagcaaccccaccagcaaggcagaatgtacagctgagaagtgctacagagtgacagagggccggggcatctttgccagcggcagccccttcaagtctgtgaccctggaggatggcaagaccttcatccctggccagggcaacaatgcctacgtgtttcctggggtggccctgggcgtgattgctgggggcatccgccacatcccagatgagatcttcctgctgacagctgagcagatcgcccaggaggtgtctgagcagcacctgagccagggccgcctgtacccacccctgagcaccatcagagatgtgtccctgcgcatcgccatcaaggtgctggactatgcctacaagcacaacctggccagctactacccagagcccaaggacaaggaggcctttgtgcgcagcctggtgtacaccccagactatgacagcttcaccctggacagctacacctggcccaaggaggccatgaatgtgcagacagtgtag

SEQ ID NO: 158677 - DNA, 1815 bp, Artificial Sequence; identical to SEQ ID NO: 158676
  Description of Artificial Sequence: Synthetic coding sequence

SEQ ID NO: 158678 - DNA, 1746 bp, Artificial Sequence
  Description of Artificial Sequence: Synthetic coding sequence
atgggcgccgccctgggcaccggcacccggctggccccctggccaggccgggcctgtggggccctgccccgctggacccccacagccccagcccagggctgccacagcaagccaggccctgcccggcctgtgcccctgaagaagaggggctatgatgtgaccaggaacccccacctgaacaagggcatggccttcaccctggaggagcggctgcagctgggcatccacggcctcatccccccctgcttcctgagccaggatgtgcagctgctgcgcatcatgagatactatgagcggcagcagagcgacctggacaagtacatcatcctgatgaccctgcaggacagaaatgagaagctgttctacagagtgctgaccagtgatgtggagaagttcatgcccatcgtgtacacccccaccgtgggcctggcctgccagcactacggcctgaccttcagaagaccccggggcctcttcatcaccatccatgacaagggccacctggccaccatgctgaacagctggccagaggacaacatcaaggctgtggtggtgacagatggagagcgcatcctgggcctgggggacctgggctgctacggcatgggcatccctgtgggcaagctggccctgtacacagcctgtggcggcgtgaacccccagcagtgcctgcctgtgctgctggatgtgggcaccaacaatgaggagctgctgcgggaccccctgtacatcggcctgaagcaccagagggtgcacggcaaggcctatgatgacctgctggatgagttcatgcaggccgtgacagacaagtttggcatcaactgcctgatccagtttgaggactttgccaatgccaatgccttccggctgctgaacaagtacagaaacaagtactgcatgtttaatgatgacatccagggcacagcctctgtggccgtggccggcatcctggccgccctgcgcatcaccaagaacaagctgagcaaccacgtgtttgtgttccagggcgctggggaggccgccatgggcatcgcccacctgctggtgatggccctggagaaggagggcgtgcccaaggccgaggccaccaggaagatctggatggtggacagcaagggcctgattgtgaagggccgcagccacctgaaccacgagaaggagatgtttgcccaggaccaccctgaggtgaacagcctggaggaggtggtgcggctggtgaagcccacagccatcatcggcgtggccgccatcgccggggccttcacagagcagatcctgcgggacatggccagcttccacgagcggcccatcatctttgccctgagcaaccccaccagcaaggcagaatgtacagctgagaagtgctacagagtgacagagggccggggcatctttgccagcggcagccccttcaagtctgtgaccctggaggatggcaagaccttcatccctggccagggcaacaatgcctacgtgtttcctggggtggccctgggcgtgattgctgggggcatccgccacatcccagatgagatcttcctgctgacagctgagcagatcgcccaggaggtgtctgagcagcacctgagccagggccgcctgtacccacccctgagcaccatcagagatgtgtccctgcgcatcgccatcaaggtgctggactatgcctacaagcacaacctggccagctactacccagagcccaaggacaaggaggcctttgtgcgcagcctggtgtacacctag

SEQ ID NO: 158679 - DNA, 1029 bp, Artificial Sequence
  Description of Artificial Sequence: Synthetic coding sequence
atgggcgccgccctgggcaccggcacccggctggccccctggccaggccgggcctgtggggccctgccccgctggacccccacagccccagcccagggctgccacagcaagccaggccctgcccggcctgtgcccctgaagaagaggggctatgatgtgaccaggaacccccacctgaacaagggcatggccttcaccctggaggagcggctgcagctgggcatccacggcctcatccccccctgcttcctgagccaggatgtgcagctgctgcgcatcatgagatactatgagcggcagcagagcgacctggacaagtacatcatcctgatgaccctgcaggacagaaatgagaagctgttctacagagtgctgaccagtgatgtggagaagttcatgcccatcgtgtacacccccaccgtgggcctggcctgccagcactacggcctgaccttcagaagaccccggggcctcttcatcaccatccatgacaagggccacctggccaccatgctgaacagctggccagaggacaacatcaaggctgtggtggtgacagatggagagcgcatcctgggcctgggggacctgggctgctacggcatgggcatccctgtgggcaagctggccctgtacacagcctgtggcggcgtgaacccccagcagtgcctgcctgtgctgctggatgtgggcaccaacaatgaggagctgctgcgggaccccctgtacatcggcctgaagcaccagagggtgcacggcaaggcctatgatgacctgctggatgagttcatgcaggccgtgacagacaagtttggcatcaactgcctgatccagtttgaggactttgccaatgccaatgccttccggctgctgaacaagtacagaaacaagtactgcatgtttaatgatgacatccagggcaccacctgccacaccttcagctgcccctggcacctgtgggcccaggtgatgttccagcacatccctggccccatgggcttcagcgagtggctgcccaggaacagctag

SEQ ID NO: 158680 - DNA, 189 bp, Artificial Sequence
  Description of Artificial Sequence: Synthetic coding sequence
atgggcgccgccctgggcaccggcacccggctggccccctggccaggccgggcctgtggggccctgccccgctggacccccacagccccagcccagggctgccacagcaagccaggccctgcccggcctgtgcccctgaagaagaggggctatgatgtgaccaggaacccccacctgaacaaggtgtag

SEQ ID NO: 158681 - DNA, 186 bp, Artificial Sequence
  Description of Artificial Sequence: Synthetic coding sequence
atgggcgccgccctgggcaccggcacccggctggccccctggccaggccgggcctgtggggccctgccccgctggacccccacagccccagcccagggctgccacagcaagccaggccctgcccggcctgtgcccctgaagaagaggggctatgatgtgaccaggaacccccacctgaacaagtag

SEQ ID NO: 158682 - DNA, 456 bp, Artificial Sequence
  Description of Artificial Sequence: Synthetic coding sequence
atgggcgccgccctgggcaccggcacccggctggccccctggccaggccgggcctgtggggccctgccccgctggacccccacagccccagcccagggctgccacagcaagccaggccctgcccggcctgtgcccctgaagaagaggggctatgatgtgaccaggaacccccacctgaacaagggcatggccttcaccctggaggagcggctgcagctgggcatccacggcctcatccccccctgcttcctgagccaggatgtgcagctgctgcgcatcatgagatactatgagcggcagcagagcgacctggacaagtacatcatcctgatgaccctgcaggacagaaatgagaagctgttctacagagtgctgaccagtgatgtggagaagttcatgcccatcgtgtacacccccaccgtgggcctggcctgccagcactacggcctgacctag

SEQ ID NO: 158683 - DNA, 240 bp, Artificial Sequence
  Description of Artificial Sequence: Synthetic coding sequence
atgggcgccgccctgggcaccggcacccggctggccccctggccaggccgggcctgtggggccctgccccgctggacccccacagccccagcccagggctgccacagcaagccaggccctgcccggcctgtgcccctgaagaagaggggctatgatgtgaccaggaacccccacctgaacaaggtgatgggccagagagctggccggcctgccctgcggagccggggctgcaggaagtag

SEQ ID NO: 158684 - DNA, 1815 bp, Artificial Sequence; identical to SEQ ID NO: 158676
  Description of Artificial Sequence: Synthetic coding sequence

SEQ ID NO: 158685 - DNA, 759 bp, Artificial Sequence
  Description of Artificial Sequence: Synthetic coding sequence
atggccttcaccctggaggagcggctgcagctgggcatccacggcctcatccccccctgcttcctgagccaggatgtgcagctgctgcgcatcatgagatactatgagcggcagcagagcgacctggacaagtacatcatcctgatgaccctgcaggacagaaatgagaagctgttctacagagtgctgaccagtgatgtggagaagttcatgcccatcgtgtacacccccaccgtgggcctggcctgccagcactacggcctgaccttcagaagaccccggggcctcttcatcaccatccatgacaagggccacctggccaccatgctgaacagctggccagaggacaacatcaaggctgtggtggtgacagatggagagcgcatcctgggcctgggggacctgggctgctacggcatgggcatccctgtgggcaagctggccctgtacacagcctgtggcggcgtgaacccccagcagtgcctgcctgtgctgctggatgtgggcaccaacaatgaggagctgctgcgggaccccctgtacatcggcctgaagcaccagagggtgcacggcaaggcctatgatgacctgctggatgagttcatgcaggccgtgacagacaagtttggcatcaactgcctgatccagtttgaggactttgccaatgccaatgccttccggctgctgaacaagtacagaaacaagtactgcatgtttaatgatgacatccaggcccccagcacagccccagccacctag

SEQ ID NO: 158686 - DNA, 1482 bp, Artificial Sequence
  Description of Artificial Sequence: Synthetic coding sequence
atgaggggcttcggccctggcctgacagcccggcggctgctgcccctgcggctgcccccccggcccccaggcccccggctggccagcggccaggccgccggggccctggagcgggccatggatgagctgctgcggcgggctgtgccccccaccccagcctatgagctgcgggagaagaccccagccccagctgagggccagtgtgccgactttgtgtccttctatggaggcctggccgagacagcccagagagctgagctgctgggccgcctggcccggggctttggagtggaccacggccaggtggccgagcagagcgctggggtgctgcacctgcggcagcagcagcgggaggccgctgtgctgctgcaggccgaggaccggctgcgctatgccctggtgccccgctaccggggcctcttccaccacatcagcaagctggatggcggcgtgcgcttcctggtgcagctgcgggctgacctgctggaggcccaggccctgaagctggtggagggcccagatgtgcgggagatgaatggagtgctgaagggcatgctgtctgagtggttcagcagcggcttcctgaacctggagcgggtgacctggcacagcccctgtgaggtgctgcagaagatcagcgaggccgaggccgtgcaccctgtgaagaactggatggacatgaagagaagagtgggcccctaccgccgctgctacttcttcagccactgcagcaccccaggagagcccctggtggtgctgcacgtggccctgaccggggacatcagcagcaacatccaggccatcgtgaaggagcaccccccatctgaaacagaggagaagaacaagatcacagctgccatcttctacagcatcagcctgacccagcagggcctgcagggcgtggagctgggcaccttcctgatcaagagggtggtgaaggagctgcagcgggagttcccccacctgggcgtcttcagcagcctgagccccatccctggcttcaccaagtggctgctgggcctgctgaacagccagaccaaggagcacggcagaaatgagctgttcacagacagcgagtgcaaggagatcagcgagatcactggaggccccatcaatgagaccctgaagctgctgctgagcagcagcgagtgggtgcagagcgagaagctggtgcgggccctgcagacccccctgatgaggctgtgtgcctggtacctgtatggagagaagcaccggggctacgccctgaaccctgtggccaacttccacctgcagaatggagctgtgctgtggaggatcaactggatggctgatgtgtccctgcggggcatcaccggcagctgtggcctgatggccaactaccgctacttcctggaggagaccggccccaacagcaccagctacctgggcagcaagatcatcaaggccagcgagcaggtgctgagcctggtggcccagttccagaagaacagcaagctgtag

SEQ ID NO: 158687 - DNA, 558 bp, Artificial Sequence
  Description of Artificial Sequence: Synthetic coding sequence
atggccaggaagaagctgaagaagttcaccaccctggagatcgtgctgtctgtgctgctgctggtgctcttcatcatcagcatcgtgctgattgtgctgctggccaaggagagcctgaagagcacagccccagaccccggcaccaccggcaccccagaccccggcaccaccggcaccccagaccccggcaccaccggcaccacccacgcccggaccactggacctccagaccccggcaccaccggcaccacccctgtgtctgcagaatgtcctgtggtgaatgagctggagcgcatcaactgcatcccagaccagccccccaccaaggccacctgtgaccagaggggctgctgctggaacccccagggcgctgtgtctgtgccctggtgctactacagcaagaaccacagctaccacgtggagggcaacctggtgaacaccaatgccggcttcaccgcccggctgaagaacctgcccagcagccctgtgtttggcagcaatgtggacaacgtgctgctgacagctgagtaccagaccagcaaccgcttccacttctag

SEQ ID NO: 158688 - DNA, 4989 bp, Artificial Sequence
  Description of Artificial Sequence: Synthetic coding sequence
gctgtgtctgtgccctggtgctactacagcaagaaccacagctaccacgtggagggcaacctggtgaacaccaatgccggcttcaccgcccggctgaagaacctgcccagcagccctgtgtttggcagcaatgtggacaacgtgctgctgacagctgagtaccagaccagcaaccgcttccacttcaagctgacagaccagaccaacaacagatttgaggtgccccatgagcacgtgcagagcttctctggaaatgctgctgccagcctgacctaccaggtggagatcagccggcagcccttcagcatcaaggtgaccaggaggagcaacaacagagtgctgtttgacagcagcatcggccccctgctgtttgctgaccagttcctgcagctgagcacccggctgcccagcaccaacgtgtatggcctgggggagcacgtgcaccagcagtacagacatgacatgaactggaagacctggcccatcttcaacagagacaccaccccaaatggaaatggcaccaacctgtatggagcccagaccttcttcctgtgcctggaggatgccagcggcctgagctttggagtcttcctgatgaacagcaatgccatggaggtggtgctgcagcctgccccagccatcacctaccgcaccatcggcggcatcctggacttctacgtgttcctgggcaacaccccagagcaggtggtgcaggagtacctggagctgattggccgcccagccctgcccagctactgggccctgggcttccacctgagccgctatgaatatggcaccctggacaacatgagggaggtggtggagaggaacagagctgcccagctgccctatgatgtgcagcacgccgacatcgactacatggatgaaagaagagacttcacctatgacagcgtggacttcaagggcttccctgagtttgtgaatgagctgcacaacaacggccagaagctggtgatcatcgtggaccctgccatcagcaacaacagcagcagcagcaagccctacggcccctatgaccggggcagtgacatgaagatctgggtgaacagcagtgatggagtgacccccctgattggagaggtgtggccaggccagacagtgtttcctgactacaccaaccccaactgtgctgtgtggtggaccaaggagtttgagctgttccacaaccaggtggagtttgatggcatctggattgacatgaatgaggtgagcaactttgtggatggctctgtgtctggctgcagcaccaacaacctgaacaacccccccttcaccccccgcatcctggatggctacctgttctgcaagaccctgtgcatggatgctgtgcagcactggggcaagcagtatgacatccacaacctgtatggctacagcatggctgtggccacagctgaggccgccaagacagtgttccccaacaagaggagcttcatcctgaccaggagcacctttgctggcagcggcaagtttgctgcccactggctgggggacaacacagccacctgggatgacctgcgctggagcatccctggggtgctggagttcaacctgtttggcatccccatggtgggccctgacatctgtggctttgccctggacaccccagaggagctgtgccgccgctggatgcagctgggcgccttctaccccttcagcaggaaccacaacggccagggctacaaggaccaggaccctgccagctttggagctgacagcctgctgctgaacagcagccgccactacctgaacatccgctacaccctgctgccctacctgtacaccctcttcttccgggcccacagcagaggagacacagtggcccggcccctgctgcacgagttctatgaggacaacagcacctgggatgtgcaccagcagttcctgtggggccctggcctgctgatcacccctgtgctggatgagggcgctgagaaggtgatggcctacgtgcctgatgctgtgtggtatgactatgagaccggcagccaggtgcgctggaggaagcagaaggtggagatggagctgcccggggacaagattggcctgcacctgcggggcggctacatcttccccacccagcagcccaacaccaccaccctggccagcaggaagaaccccctgggcctcatcatcgccctggatgagaacaaggaggccaagggggagctgttctgggacaatggagagaccaaggacacagtggccaacaaggtgtacctgctgtgtgagttctctgtgacccagaaccggctggaggtgaacatcagccagagcacctacaaggaccccaacaacctggccttcaatgagatcaagatcctgggcacagaggagcccagcaatgtgacagtgaagcacaatggagtgcccagccagaccagccccaccgtgacctatgacagcaacctgaaggtggccatcatcacagacatcgacctgctgctgggggaggcctacacagtggagtggagcatcaagatcagagatgaggagaagattgactgctacccagatgaaaatggagccagcgctgagaactgcacagcccggggctgcatctgggaggccagcaacagcagcggcgtgcccttctgctactttgtgaatgacctgtacagcgtgtctgatgtgcagtacaacagccacggggccacagctgacatcagcctgaagagctctgtgtatgccaatgccttccccagcacccctgtgaaccccctgcggctggatgtgacctaccacaagaatgagatgctgcagttcaagatctatgaccccaacaagaacagatatgaggtgcctgtgcccctgaacatccccagcatgcccagcagcaccccagagggccagctgtatgatgtgctgatcaagaagaacccctttggaattgagatccggaggaagagcacaggcaccatcatctgggacagccagctgctgggcttcaccttcagtgacatgttcatccgcatcagcacccggctgcccagcaagtacctgtatggctttggagaaacagagcacaggagctaccgccgggacctggagtggcacacctggggcatgttcagccgggaccagcccccaggctacaagaagaacagctatggagtgcacccctactacatgggcctggaggaggatggcagcgcccacggcgtgctgctgctgaacagcaatgccatggatgtgaccttccagcccctgcctgccctgacctaccgcaccactggaggagtgctggacttctacgtgttcctgggccccaccccagagctggtgacccagcagtacacagagctgattggccggcctgtgatggtgccctactggagcctgggcttccagctgtgccgctatggctaccagaatgacagcgagatcgccagcctgtatgatgagatggtggccgcccagatcccctatgatgtgcagtacagcgacatcgactacatggagcggcagctggacttcaccctgagccccaagtttgctggcttccctgccctgatcaacaggatgaaggcagatggcatgagggtcatcctgatcctggaccctgccatctctggaaatgagacccagccctacccagccttcacccggggcgtggaggatgatgtgttcatcaagtacccaaatgatggagacatcgtgtggggcaaggtgtggccagacttcccagatgtggtggtgaatggcagcctggactgggacagccaggtggagctgtaccgggcctacgtggccttcccagacttcttcaggaacagcacagccaagtggtggaagcgggagattgaggagctgtacaacaacccccagaaccctgagaggagcctgaagtttgatggcatgtggattgacatgaatgagcccagcagctttgtgaatggagctgtgtccccaggctgcagagatgccagcctgaaccaccccccctacatgccccacctggagagccgggaccggggcctgagcagcaagaccctgtgcatggagagccagcagatcctgcctgatggcagcctggtgcagcactacaacgtgcacaacctgtatggctggagccagacccggcccacctatgaagctgtgcaggaggtgacaggccagaggggcgtggtgatcaccaggagcaccttccccagcagcggccgctgggccggccactggctgggggacaacacagctgcctgggaccagctgaagaagagcatcatcggcatgatggagttcagcctgtttggcatctcctacacaggagctgacatctgtggcttcttccaggatgctgaatatgagatgtgtgtgcgctggatgcagctgggcgccttctaccccttcagcaggaaccacaacaccatcggcacccggcggcaggaccctgtgtcctgggatgctgcctttgtgaacatcagcagaaatgtgctgcagacccgctacaccctgctgccctacctgtacaccctgatgcagaaggcccacacagaaggagtgacagtggtgcggcccctgctgcacgagtttgtgtctgaccaggtgacctgggacatcgacagccagttcctgctgggccctgccttcctggtgtcccctgtgctggagagaaatgccagaaatgtgacagcctacttcccccgggcccgctggtatgactactacacaggagtggacatcaatgcccggggggagtggaagaccctgcctgcccccctggaccacatcaacctgcacgtgcggggcggctacatcctgccctggcaggagcccgccctgaacacccacctgagcaggaagaaccccctgggcctcatcatcgccctggatgagaacaaggaggccaagggggagctgttctgggatgatggccagaccaaggacacagtggccaagaaggtgtacctgctgtgtgagttctctgtgacccagcaggtggtgttcctgaacatcgtgttcaactag

SEQ ID NO: 158689 - DNA, 5574 bp, Artificial Sequence
  Description of Artificial Sequence: Synthetic coding sequence
atggccaggaagaagctgaagaagttcaccaccctggagatcgtgctgtctgtgctgctgctggtgctcttcatcatcagcatcgtgctgattgtgctgctggccaaggagagcctgaagagcacagccccagaccccggcaccaccggcaccccagaccccggcaccaccggcaccccagaccccggcaccaccggcaccacccacgcccggaccactggacctccagaccccggcaccaccggcaccacccctgtgtctgcagaatgtcctgtggtgaatgagctggagcgcatcaactgcatcccagaccagccccccaccaaggccacctgtgaccagaggggctgctgctggaacccccagggcgctgtgtctgtgccctggtgctactacagcaagaaccacagctaccacgtggagggcaacctggtgaacaccaatgccggcttcaccgcccggctgaagaacctgcccagcagccctgtgtttggcagcaatgtggacaacgtgctgctgacagctgagtaccagaccagcaaccgcttccacttcaagctgacagaccagaccaacaacagatttgaggtgccccatgaacatgtgcagagcttctctggaaatgctgctgccagcctgacctaccaggtggagatcagccggcagcccttcagcatcaaggtgacccggcgcagcaacaacagagtgctgtttgacagcagcatcggccccctgctgtttgctgaccagttcctgcagctgagcacccggctgcccagcaccaacgtgtatggcctgggggagcacgtgcaccagcagtacagacatgacatgaactggaagacctggcccatcttcaacagagacaccaccccaaatggaaatggcaccaacctgtatggagcccagaccttcttcctgtgcctggaggatgccagcggcctgagctttggagtcttcctgatgaacagcaatgccatggaggtggtgctgcagcctgccccagccatcacctaccgcaccatcggcggcatcctggacttctacgtgttcctgggcaacaccccagagcaggtggtgcaggagtacctggagctgattggccggcctgccctgcccagctactgggccctgggcttccacctgagccgctatgaatatggcaccctggacaacatgagggaggtggtggagaggaacagagctgcccagctgccctatgatgtgcagcacgccgacatcgactacatggatgagcggcgggacttcacctatgattctgtggacttcaagggcttccctgagtttgtgaatgagctgcacaacaacggccagaagctggtgatcatcgtggaccctgccatcagcaacaacagcagcagcagcaagccctacggcccctatgaccggggcagtgacatgaagatctgggtgaacagcagtgatggagtgacccccctcatcggggaggtgtggccaggccagaccgtcttcccagactacaccaaccccaactgtgctgtgtggtggaccaaggagtttgagctgttccacaaccaggtggagtttgatggcatctggattgacatgaatgaggtgagcaactttgtggatggctctgtgtctggctgcagcaccaacaacctgaacaacccccccttcaccccccgcatcctggatggctacctgttctgcaagaccctgtgcatggatgctgtgcagcactggggcaagcagtatgacatccacaacctgtatggctacagcatggctgtggccacagctgaggccgccaagacagtgttccccaacaagaggagcttcatcctgaccaggagcacctttgctggcagcggcaagtttgctgcccactggctgggggacaacacagccacctgggatgacctgcgctggagcatccctggggtgctggagttcaacctgtttggcatccccatggtgggccctgacatctgtggctttgccctggacaccccagaggagctgtgccgccgctggatgcagctgggcgccttctaccccttcagcaggaaccacaacggccagggctacaaggaccaggaccctgccagctttggagctgacagcctgctgctgaacagcagccgccactacctgaacatccgctacaccctgctgccctacctgtacaccctcttcttccgggcccacagcagaggagacacagtggcccggcccctgctgcacgagttctatgaggacaacagcacctgggatgtgcaccagcagttcctgtggggccctggcctgctgatcacccctgtgctggatgaaggagctgagaaggtgatggcctacgtgcctgatgctgtgtggtatgactatgaaacaggcagccaggtgcgctggaggaagcagaaggtggagatggagctgcccggggacaagattggcctgcacctgcggggcggctacatcttccccacccagcagcccaacaccaccaccctggccagcaggaagaaccccctgggcctcatcatcgccctggatgagaacaaggaggccaagggggagctgttctgggacaacggggagaccaaggacacagtggccaacaaggtgtacctgctgtgtgagttctctgtgacccagaaccggctggaggtgaacatcagccagagcacctacaaggaccccaacaacctggccttcaatgagatcaagatcctgggcacagaggagcccagcaatgtgacagtgaagcacaacggggtgcccagccagaccagccccaccgtgacctatgacagcaacctgaaggtggccatcatcacagacatcgacctgctgctgggggaggcctacacagtggagtggagcatcaagatcagagatgaggagaagattgactgctacccagatgaaaatggagccagcgctgagaactgcacagcccggggctgcatctgggaggccagcaacagcagtggagtgcccttctgctactttgtgaatgacctgtacagcgtgtctgatgtgcagtacaacagccatggagccacagctgacatcagcctgaagagctctgtgtatgccaatgccttccccagcacccctgtgaaccccctgcggctggatgtgacctaccacaagaatgagatgctgcagttcaagatctatgaccccaacaagaacagatatgaggtgcctgtgcccctgaacatccccagcatgcccagcagcaccccagagggccagctgtatgatgtgctgatcaagaagaaccccttcggcatcgagatccggaggaagagcacaggcaccatcatctgggacagccagctgctgggcttcaccttcagtgacatgttcatccgcatcagcacccggctgcccagcaagtacctgtatggctttggagaaacagagcacaggagctacagaagagacctggagtggcacacctggggcatgttcagccgggaccagcccccaggctacaagaagaacagctatggagtgcacccctactacatgggcctggaggaggatggcagcgcccatggagtgctgctgctgaacagcaatgccatggatgtgaccttccagcccctgcctgccctgacctaccgcaccaccggcggcgtgctggacttctacgtgttcctgggccccaccccagagctggtgacccagcagtacacagagctgattggccggcctgtgatggtgccctactggagcctgggcttccagctgtgccgctatggctaccagaatgattctgaaattgccagcctgtatgatgagatggtggccgcccagatcccctatgatgtgcagtacagcgacatcgactacatggagcggcagctggacttcaccctgagccccaagtttgctggcttccctgccctgatcaacaggatgaaggcagatggcatgagggtcatcctgatcctggaccctgccatctctggaaatgagacccagccctacccagccttcacccggggcgtggaggatgatgtgttcatcaagtacccaaatgatggagacatcgtgtggggcaaggtgtggccagacttcccagatgtggtggtgaatggcagcctggactgggacagccaggtggagctgtaccgggcctacgtggccttcccagacttcttcaggaacagcacagccaagtggtggaagcgggagattgaggagctgtacaacaacccccagaaccctgagaggagcctgaagtttgatggcatgtggattgacatgaatgagcccagcagctttgtgaatggagctgtgtccccaggctgcagagatgccagcctgaaccaccccccctacatgccccacctggagagccgggaccggggcctgagcagcaagaccctgtgcatggagagccagcagatcctgcctgatggcagcctggtgcagcactacaacgtgcacaacctgtatggctggagccagacccggcccacctatgaggccgtgcaggaggtgacaggccagaggggcgtggtgatcaccaggagcaccttccccagcagcggccgctgggccggccactggctgggggacaacacagctgcctgggaccagctgaagaagagcatcatcggcatgatggagttcagcctgtttggcatctcctacaccggggctgacatctgtggcttcttccaggatgctgaatatgagatgtgtgtgcgctggatgcagctgggcgccttctaccccttcagcaggaaccacaacaccatcggcacccggcggcaggaccctgtgtcctgggatgtggcctttgtgaacatcagcaggacagtgctgcagacccgctacaccctgctgccctacctgtacaccctgatgcacaaggcccacacagagggcgtgacagtggtgcggcccctgctgcatgaatttgtgtctgaccaggtgacctgggacatcgacagccagttcctgctgggccctgccttcctggtgtcccctgtgctggagagaaatgccagaaatgtgacagcctacttcccccgggcccgctggtatgactactacacaggagtggacatcaatgcccggggggagtggaagaccctgcctgcccccctggaccacatcaacctgcacgtgcggggcggctacatcctgccctggcaggagcccgccctgaacacccacctgagccggcagaagttcatgggcttcaagatcgccctggatgatgagggcacagctgggggctggctgttctgggatgatggccagagcattgacacctacggcaagggcctgtactacctggccagcttcagcgccagccagaacaccatgcagagccacatcatcttcaacaactacatcaccggcaccaaccccctgaagctgggctacatcgagatctggggcgtgggctctgtgcctgtgacctctgtgtccatctctgtgtctggcatggtgatcacccccagcttcaacaatgaccccaccacccaggtgctgagcattgatgtgacagacaggaacatcagcctgcacaacttcaccagcctgacctggatcagcaccctgtag

SEQ ID NO: 158690 - DNA, 2061 bp, Artificial Sequence
  Description of Artificial Sequence: Synthetic coding sequence
atgctgctgcggggcgtgctgctggccctgcaggccctgcagctggccggggccctggacctgcctgctggcagctgtgcctttgaggagagcacctgtggctttgattctgtgctggccagcctgccctggatcctgaatgaggagggccactacatctacgtggacaccagctttgggaagcagggcgagaaggctgtgctgctgagcccagacctgcaggccgaggagtggagctgcctgcggctggtgtaccagatcaccaccagcagcgagagcctgagtgaccccagccagctgaacctgtacatgagatttgaagatgagagctttgaccggctgctgtggagcgccaaggagcccagcgacagctggctgattgccagcctggacctgcagaacagcagcaagaagttcaagatcctgattgaaggagtgctgggccagggcaacacagccagcatcgccctgtttgagatcaagatgaccaccggctactgcattgaatgtgactttgaggagaaccacctgtgtggctttgtgaaccgctggaaccccaacgtgaactggtttgtgggcggcggcagcatcagaaatgtgcacagcatcctgccccaggaccacaccttcaagtctgagctgggccactacatgtatgtggacagcgtgtatgtgaagcacttccaggaggtggcccagctgatcagccccctgaccacagcccccatggccggctgcctgtccttctactaccagatccagcagggcaatgacaacgtgttcagcctgtacaccagagatgtggccggcctgtatgaggagatctggaaggctgacaggcctggaaatgctgcctggaacctggccgaggtggagttcagcgccccctaccccatggaggtgatctttgaggtggccttcaacggccccaagggcggctacgtggccctggatgacatctccttcagccctgtgcactgccagaaccagacagagctgctcttctctgctgtggaggccagctgcaactttgagcaggacctgtgcaacttctaccaggacaaggagggccctggctggaccagggtgaaggtgaagcccaacatgtaccgggccggggaccacaccaccggcctgggctactacctgctggccaacaccaagttcaccagccagcccggctacatcggccgcctgtatggccccagcctgcccggcaacctgcagtactgcctgcgcttccactacgccatctacggcttcctgaagatgtctgacaccctggccgtgtacatctttgaagaaaatcatgtggtgcaggagaagatctggagcgtgctggagagcccccggggcgtgtggatgcaggccgagatcaccttcaagaagcccatgcccaccaaggtggtgttcatgagcctgtgcaagagcttctgggactgtggcctggtggccctggatgacatcaccatccagctgggcagctgcagcagcagcgagaagctgcccccacctcctggagagtgcacctttgagcaggatgaatgtaccttcacccaggagaagaggaacagaagctcctggcacagaagaagaggagagacccccaccagctacacaggccccaagggggaccacaccaccggggtgggctactacatgtacatcgaggccagccacatggtgtatggccagaaggcccggctgctgagccggcccctgcggggcgtgtctgggaagcactgcctgaccttcttctaccacatgtatggaggcggcaccggcctgctgtctgtgtacctgaagaaggaggaggacagcgaggagagcctgctgtggaggagaagaggagagcagagcatctcctggctgcgggccctgattgagtacagctgtgagcggcagcaccagatcatctttgaggccatccggggcgtgtccatccgcagtgacatcgccattgatgatgtgaagttccaggccggcccctgtggggagatggaggacaccacccagcagagcagcggctacagcgaggacctgaatgaaattgagtactag

SEQ ID NO: 158691 - DNA, 2880 bp, Artificial Sequence
  Description of Artificial Sequence: Synthetic coding sequence
atggaggtgacctgcctgctgctgctggccctgatccccttccactgccggggccagggcgtgtatgccccagcccaggcccagatcgtgcacgccggccaggcctgtgtggtgaaggaggacaacatcagcgagcgggtgtacaccatccgggagggggacaccctgatgctgcagtgcctggtgacaggccacccccggccccaggtgcgctggaccaagacagctggcagcgccagtgacaagttccaggagacctctgtgttcaatgagaccctgagaattgagcgcatcgcccggacccagggcggccgctactactgcaaggcagaaaatggagtgggcgtgcctgccatcaagagcatccgggtggatgtgcagtacctggatgagcccatgctgactgtgcaccagacagtgtctgatgtgcggggcaacttctaccaggagaagacagtgttcctgcgctgcaccgtgaacagcaaccccccagcccgcttcatctggaagaggggcagtgacaccctgagccacagccaggacaacggggtggacatctatgagcccctgtacacccagggcgagaccaaggtgctgaagctgaagaacctgcggccccaggactatgccagctacacctgccaggtgtctgtgagaaatgtgtgtggcatcccagacaaggccatcaccttccggctgaccaacaccacagcccccccagccctgaagctgtctgtgaatgagaccctggtggtgaaccctggagaaaatgtgacagtgcagtgcctgctgactggaggagaccccctgccccagctgcagtggagccacggccctggccccctgcccctgggcgccctggcccagggcggcaccctgagcatccccagcgtgcaggcccgggacagcggctactacaactgcacagccaccaacaacgtgggcaacccagccaagaagacagtgaacctgctggtgcgctccatgaagaatgccaccttccagatcaccccagatgtgatcaaggagagcgagaacatccagctgggccaggacctgaagctgagctgccacgtggatgctgtgccccaggagaaggtgacctaccagtggttcaagaatggcaagccagccaggatgagcaagaggctgctggtgaccagaaatgaccctgagctgcctgctgtgaccagcagcctggagctgattgacctgcacttcagtgactatggcacctacctgtgcatggccagcttccctggggcccctgtgcctgacctgtctgtggaggtgaacatcagcagcgagaccgtgccccccaccatctctgtgcccaagggccgggctgtggtgacagtgcgggagggcagccctgctgagctgcagtgtgaggtgcggggcaagcccaggcctcctgtgctgtggagccgggtggacaaggaggccgccctgctgcccagcggcctgcccctggaggagaccccagatggcaagctgcggctggagcgggtgtcccgggacatgagcggcacctaccgctgccagacagcccgctacaacggcttcaacgtgcggccccgggaggcccaggtgcagctgaatgtgcagagcccctgcttccccccagaggtggagcccagcagccaggatgtgcggcaggccctgggccggcctgtgctgctgcgctgcagcctgctgcggggcagcccccagagaattgccagcgctgtgtggaggttcaagggccagctgctgcccccacctcctgtggtgcctgctgctgctgaggccccagaccatgctgagctgcggctggatgctgtgacccgggacagcagcggcagctatgaatgttctgtgtccaatgatgtgggcagcgctgcctgcctcttccaggtgtctgccaaggcctacagccctgagttctactttgacacccccaaccccaccaggagccacaagctgagcaagaactacagctatgtgctgcagtggacccagcgggagccagatgctgtggaccctgtgctgaactaccgcctgagcatccggcagctgaaccagcacaatgctgtggtgaaggccatccctgtgagaagagtggagaagggccagctgctggagtacatcctgacagacctgcgggtgccccacagctatgaggtgcggctgaccccctacaccaccttcggggccggggacatggccagccgcatcatccactacacagagctgctggccctgcggaccctgagcagtgacaacacctgccactttgaagatgagaagatctgtggctacacccaggacctgacagacaactttgactggacccggcagaatgccctgacccagaaccccaagaggagccccaacacaggccccccaacagacatcagcggcaccccagagggctactacatgttcatcgagaccagccggccccgggagctgggggaccgggcccggctggtgagccccctgtacaatgccagcgccaagttctactgtgtgtccttcttctaccacatgtatggcaagcacatcggcagcctgaacctgctggtgcgcagcagaaataaaggagccctggacacccacgcctggagcctgagcggcaacaagggaaatgtgtggcagcaggcccacgtgcccatcagccccagcggccccttccagatcatctttgagggcgtgcggggccctggctacctgggggacatcgccattgatgatgtgaccctgaagaagggagaatgtcccaggaagcagacagaccccaacaaggtggtggtgatgcctggcagcggggccccctgccagagcagcccccagctgtggggccccatggccatcttcctgctggccctgcagaggtag

SEQ ID NO: 158692 - DNA, 2868 bp, Artificial Sequence
  Description of Artificial Sequence: Synthetic coding sequence
atggaggtgacctgcctgctgctgctggccctgatccccttccactgccggggccagggcgtgtatgccccagcccaggcccagatcgtgcacgccggccaggcctgtgtggtgaaggaggacaacatcagcgagcgggtgtacaccatccgggagggggacaccctgatgctgcagtgcctggtgacaggccacccccggccccaggtgcgctggaccaagacagctggcagcgccagtgacaagttccaggagacctctgtgttcaatgagaccctgagaattgagcgcatcgcccggacccagggcggccgctactactgcaaggcagaaaatggagtgggcgtgcctgccatcaagagcatccgggtggatgtgcagtacctggatgagcccatgctgactgtgcaccagacagtgtctgatgtgcggggcaacttctaccaggagaagacagtgttcctgcgctgcaccgtgaacagcaaccccccagcccgcttcatctggaagaggggcagtgacaccctgagccacagccaggacaacggggtggacatctatgagcccctgtacacccagggcgagaccaaggtgctgaagctgaagaacctgcggccccaggactatgccagctacacctgccaggtgtctgtgagaaatgtgtgtggcatcccagacaaggccatcaccttccggctgaccaacaccacagcccccccagccctgaagctgtctgtgaatgagaccctggtggtgaaccctggagaaaatgtgacagtgcagtgcctgctgactggaggagaccccctgccccagctgcagtggagccacggccctggccccctgcccctgggcgccctggcccagggcggcaccctgagcatccccagcgtgcaggcccgggacagcggctactacaactgcacagccaccaacaacgtgggcaacccagccaagaagacagtgaacctgctggtgcgctccatgaagaatgccaccttccagatcaccccagatgtgatcaaggagagcgagaacatccagctgggccaggacctgaagctgagctgccacgtggatgctgtgccccaggagaaggtgacctaccagtggttcaagaatggcaagccagccaggatgagcaagaggctgctggtgaccagaaatgaccctgagctgcctgctgtgaccagcagcctggagctgattgacctgcacttcagtgactatggcacctacctgtgcatggccagcttccctggggcccctgtgcctgacctgtctgtggaggtgaacatcagcagcgagaccgtgccccccaccatctctgtgcccaagggccgggctgtggtgacagtgcgggagggcagccctgctgagctgcagtgtgaggtgcggggcaagcccaggcctcctgtgctgtggagccgggtggacaaggaggccgccctgctgcccagcggcctgcccctggaggagaccccagatggcaagctgcggctggagcgggtgtcccgggacatgagcggcacctaccgctgccagacagcccgctacaacggcttcaacgtgcggccccgggaggcccaggtgcagctgaatgtgcagttccccccagaggtggagcccagcagccaggatgtgcggcaggccctgggccggcctgtgctgctgcgctgcagcctgctgcggggcagcccccagagaattgccagcgctgtgtggaggttcaagggccagctgctgcccccacctcctgtggtgcctgctgctgctgaggccccagaccacgccgagctgcggctggatgctgtgacccgggacagcagcggcagctatgagtgcagcgtgtccaatgatgtgggcagcgctgcctgcctcttccaggtgtctgccaaggcctacagccctgagttctactttgacacccccaaccccaccaggagccacaagctgagcaagaactacagctatgtgctgcagtggacccagcgggagccagatgctgtggaccctgtgctgaactaccgcctgagcatccggcagctgaaccagcacaatgctgtggtgaaggccatccctgtgcggcgggtggagaagggccagctgctggagtacatcctgacagacctgcgggtgccccacagctatgaggtgcggctgaccccctacaccacctttggagctggggacatggccagccgcatcatccactacacagagcccatcaacagccccaacctgagtgacaacacctgccactttgaagatgagaagatctgtggctacacccaggacctgacagacaactttgactggacccggcagaatgccctgacccagaaccccaagaggagccccaacacaggccccccaacagacatcagcggcaccccagagggctactacatgttcatcgagaccagccggccccgggagctgggggaccgggcccggctggtgagccccctgtacaatgccagcgccaagttctactgtgtgtccttcttctaccacatgtatggcaagcacatcggcagcctgaacctgctggtgcgcagcagaaataaaggagccctggacacccacgcctggagcctgagcggcaacaagggaaatgtgtggcagcaggcccacgtgcccatcagccccagcggccccttccagatcatctttgagggcgtgcggggccctggctacctgggggacatcgccattgatgatgtgaccctgaagaagggagaatgtcccaggaagcagacagaccccaacaaggtggtggtgatgcctggcagcggggccccctgccagagcagcccccagctgtggggccccatggccatcttcctgctggccctgcagaggtag

SEQ ID NO: 158693 - DNA, 2922 bp, Artificial Sequence
  Description of Artificial Sequence: Synthetic coding sequence
atggaggtgacctgcctgctgctgctggccctgatccccttccactgccggggccagggcgtgtatgccccagcccaggcccagatcgtgcacgccggccaggcctgtgtggtgaaggaggacaacatcagcgagcgggtgtacaccatccgggagggggacaccctgatgctgcagtgcctggtgacaggccacccccggccccaggtgcgctggaccaagacagctggcagcgccagtgacaagttccaggagacctctgtgttcaatgagaccctgagaattgagcgcatcgcccggacccagggcggccgctactactgcaaggcagaaaatggagtgggcgtgcctgccatcaagagcatccgggtggatgtgcagtacctggatgagcccatgctgactgtgcaccagacagtgtctgatgtgcggggcaacttctaccaggagaagacagtgttcctgcgctgcaccgtgaacagcaaccccccagcccgcttcatctggaagaggggcagtgacaccctgagccacagccaggacaacggggtggacatctatgagcccctgtacacccagggcgagaccaaggtgctgaagctgaagaacctgcggccccaggactatgccagctacacctgccaggtgtctgtgagaaatgtgtgtggcatcccagacaaggccatcaccttccggctgaccaacaccacagcccccccagccctgaagctgtctgtgaatgagaccctggtggtgaaccctggagaaaatgtgacagtgcagtgcctgctgactggaggagaccccctgccccagctgcagtggagccacggccctggccccctgcccctgggcgccctggcccagggcggcaccctgagcatccccagcgtgcaggcccgggacagcggctactacaactgcacagccaccaacaacgtgggcaacccagccaagaagacagtgaacctgctggtgcgctccatgaagaatgccaccttccagatcaccccagatgtgatcaaggagagcgagaacatccagctgggccaggacctgaagctgagctgccacgtggatgctgtgccccaggagaaggtgacctaccagtggttcaagaatggcaagccagccaggatgagcaagaggctgctggtgaccagaaatgaccctgagctgcctgctgtgaccagcagcctggagctgattgacctgcacttcagtgactatggcacctacctgtgcatggccagcttccctggggcccctgtgcctgacctgtctgtggaggtgaacatcagcagcgagaccgtgccccccaccatctctgtgcccaagggccgggctgtggtgacagtgcgggagggcagccctgctgagctgcagtgtgaggtgcggggcaagcccaggcctcctgtgctgtggagccgggtggacaaggaggccgccctgctgcccagcggcctgcccctggaggagaccccagatggcaagctgcggctggagcgggtgtcccgggacatgagcggcacctaccgctgccagacagcccgctacaacggcttcaacgtgcggccccgggaggcccaggtgcagctgaatgtgcagttccccccagaggtggagcccagcagccaggatgtgcggcaggccctgggccggcctgtgctgctgcgctgcagcctgctgcggggcagcccccagagaattgccagcgctgtgtggaggttcaagggccagctgctgcccccacctcctgtggtgcctgctgctgctgaggccccagaccacgccgagctgcggctggatgctgtgacccgggacagcagcggcagctatgagtgcagcgtgtccaatgatgtgggcagcgctgcctgcctcttccaggtgtctgccaaggcctacagccctgagttctactttgacacccccaaccccaccaggagccacaagctgagcaagaactacagctatgtgctgcagtggacccagcgggagccagatgctgtggaccctgtgctgaactaccgcctgagcatccggcagctgaaccagcacaatgctgtggtgaaggccatccctgtgcggcgggtggagaagggccagctgctggagtacatcctgacagacctgcgggtgccccacagctatgaggtgcggctgaccccctacaccacctttggagctggggacatggccagccgcatcatccactacacagagcccatcaacagccccaacctgagtgacaacacctgccactttgaagatgagaagatctgtggctacacccaggacctgacagacaactttgactggacccggcagaatgccctgacccagaaccccaagaggagccccaacacaggccccccaacagacatcagcggcaccccagagggctactacatgttcatcgagaccagccggccccgggagctgggggaccgggcccggctggtgagccccctgtacaatgccagcgccaagttctactgtgtgtccttcttctaccacatgtatggcaagcacatcggcagcctgaacctgctggtgcgcagcagaaataaaggagccctggacacccacgcctggagcctgagcggcaacaagggaaatgtgtggcagcaggcccacgtgcccatcagccccagcggccccttccagatcatctttgagggcgtgcggggccctggctacctgggggacatcgccattgatgatgtgaccctgaagaagggagaatgtcccaggaagcagacagaccccaacaagggggcccggcgggagggcggcggcggcgctgagagcggcggcagctgtgcctggaggggcttcctgtctgtggagggcggctgcctgggcctgaacagaggctctgaatgtctgagtgatggcaaccacgtggccctgactgtgtag

SEQ ID NO: 158694 - DNA, 2184 bp, Artificial Sequence
  Description of Artificial Sequence: Synthetic coding sequence
atggtgtccttccggctgagcaacaagacagccagccccagcatcaagctgctggtggatgaccccatcgtggtgaaccctggagaggccatcaccctggtgtgtgtgaccaccggcggggagcccgcccccagcctgacctgggtgcgcagctttggcaccctgcctgagaagacagtgctgaatggaggcaccctgaccatcccagccatcaccagtgatgatgctggcacctacagctgcatcgccaacaacaacgtgggcaacccagccaagaagagcaccaacatcatcgtgcgggccctgaagaagggccgcttctggatcaccccagacccctaccacaaggatgacaacatccagatcggccgggaggtgaagatcagctgccaggtggaggccgtgcccagcgaggagctgaccttctcctggttcaagaatggccggcccctgcggagcagcgagaggatggtgatcacccagacagatcctgatgtgtccccaggcaccaccaacctggacatcatcgacctgaagttcacagactttggcacctacacctgtgtggccagcctgaagggcggcggcatcagtgacatcagcattgatgtgaacatcagcagcagcacagtgccccccaacctgactgtgccccaggagaagagccccctggtgacccgggagggggacaccatcgagctgcagtgccaggtgacaggcaagcccaagcccatcatcctgtggagcagagctgacaaggaggtggccatgccagatggctccatgcagatggagagctatgatggcaccctgagaattgtgaatgtgtcccgggagatgagcggcatgtaccgctgccagaccagccagtacaacggcttcaacgtgaagccccgggaggccctggtgcagctgattgtgcagtaccccccagctgtggagcccgccttcctggagatccggcagggccaggacagatctgtgaccatgagctgccgggtgctgcgggcctaccccatccgggtgctgacctatgagtggaggctgggcaacaagctgctgaggacaggccagtttgacagccaggagtacacagaatatgctgtgaagagcctgagcaatgaaaattatggagtgtacaactgcagcatcatcaatgaggccggggccggccgctgcagcttcctggtgacaggcaaggcctatgcccctgagttctactatgacacctacaaccctgtgtggcagaacagacaccgggtgtacagctacagcctgcagtggacccagatgaacccagatgctgtggacagaattgtggcctaccgcctgggcatccggcaggccggccagcagcgctggtgggagcaggagatcaagatcaatggaaacatccagaagggggagctgatcacctacaacctgacagagctgatcaagccagaggcctatgaggtgcggctgacccccctgaccaagtttggagagggggacagcaccatccgggtcatcaagtacagcgcccctgtgaacccccacctgcgggagttccactgcggctttgaagatggcaacatctgcctcttcacccaggatgacacagacaactttgactggaccaagcagagcacagccaccaggaacaccaagtacacccccaacacaggccccaatgctgacaggagcggcagcaaggagggcttctacatgtacatcgagaccagccggccccggctggagggggagaaggcccggctgctgagccctgtgttcagcatcgcccccaagaacccctacggccccaccaacacagcctactgcttctccttcttctaccacatgtatggccagcacatcggcgtgctgaatgtgtacctgcggctgaagggccagaccaccatcgagaaccccctgtggagcagcagcggcaacaagggccagcgctggaatgaggcccacgtgaacatctaccccatcaccagcttccagctgatctttgagggcatccggggccctggcatcgagggggacatcgccattgatgatgtgtccattgctgaaggagaatgtgccaagcaggacctggccaccaagaacagcgtggatggagctgtgggcatcctggtgcacatctggctgttccccatcatcgtgctgatcagcatcctgagccccaggaggtag

SEQ ID NO: 158695 - DNA, 477 bp, Artificial Sequence
  Description of Artificial Sequence: Synthetic coding sequence
atgtacatcgagaccagccggccccggctggagggggagaaggcccggctgctgagccctgtgttcagcatcgcccccaagaacccctacggccccaccaacacagcctactgcttctccttcttctaccacatgtatggccagcacatcggcgtgctgaatgtgtacctgcggctgaagggccagaccaccatcgagaaccccctgtggagcagcagcggcaacaagggccagcgctggaatgaggcccacgtgaacatctaccccatcaccagcttccagctgatctttgagggcatccggggccctggcattgaaggagacatcgccattgatgatgtgtccattgctgagggggagtgtgccaagcaggacctggccaccaagaacagcgtggatggagctgtgggcatcctggtgcacatctggctgttccccatcatcgtgctgatcagcatcctgagccccaggaggtag

SEQ ID NO: 158696 - DNA, 3078 bp, Artificial Sequence
  Description of Artificial Sequence: Synthetic coding sequence
atgtctgtgtggagcgctggcctgctgcggagcgccaggagaagaagaagaggaagaacagatggaagacgcttcctgctgcggcgggctgtgcccggccacctgggcctggcccgggcccgggtggagcgggcctggctggccgccggcctgctgaaggtgcccctgcggaccccctgggccggctacgtgcacgtgcacgtgaagatggacctgctgtatggcctggtgtggctgctgactgtgctgctggagggcatcagcggccagggcgtgtatgcccccccaacagtgcgcatcgtgcacagcggcctggcctgcaacatcgaggaggagcgctacagcgagcgggtgtacaccatccgggagggggagaccctggagctgacctgcctggtgacaggccacccccggccccagatccgctggaccaagacagctggcagcgccagtgaccgcttccaggacagcagcgtcttcaatgagaccctgcgcatcaccaacatccagaggcaccagggcggccgctactactgcaaggccgagaatggcctgggcagccctgccatcaagagcatccgggtggatgtgtactacctggatgatcctgtggtgacagtgcaccagagcattggagaggccaaggagcagttctactatgaaagaacagtgttcctgcgctgtgtggccaacagcaacccccctgtgcgctacagctggaggcggggccaggaggtgctgctgcagggcagtgacaagggcgtggagatctatgagcccttcttcacccagggcgagaccaagatcctgaagctgaagaacctgcggccccaggactatgccaactacagctgcatcgcctctgtgagaaatgtgtgcaacatcccagacaagatggtgtccttccggctgagcaacaagacagccagccccagcatcaagctgctggtggatgaccccatcgtggtgaaccctggagaggccatcaccctggtgtgtgtgaccaccggcggggagcccgcccccagcctgacctgggtgcgcagctttggcaccctgcctgagaagacagtgctgaatggaggcaccctgaccatcccagccatcaccagtgatgatgctggcacctacagctgcatcgccaacaacaacgtgggcaacccagccaagaagagcaccaacatcatcgtgcgggccctgaagaagggccgcttctggatcaccccagacccctaccacaaggatgacaacatccagatcggccgggaggtgaagatcagctgccaggtggaggccgtgcccagcgaggagctgaccttctcctggttcaagaatggccggcccctgcggagcagcgagaggatggtgatcacccagacagatcctgatgtgtccccaggcaccaccaacctggacatcatcgacctgaagttcacagactttggcacctacacctgtgtggccagcctgaagggcggcggcatcagtgacatcagcattgatgtgaacatcagcagcagcacagtgccccccaacctgactgtgccccaggagaagagccccctggtgacccgggagggggacaccatcgagctgcagtgccaggtgacaggcaagcccaagcccatcatcctgtggagcagagctgacaaggaggtggccatgccagatggctccatgcagatggagagctatgatggcaccctgagaattgtgaatgtgtcccgggagatgagcggcatgtaccgctgccagaccagccagtacaacggcttcaacgtgaagccccgggaggccctggtgcagctgattgtgcagtaccccccagctgtggagcccgccttcctggagatccggcagggccaggacagatctgtgaccatgagctgccgggtgctgcgggcctaccccatccgggtgctgacctatgagtggaggctgggcaacaagctgctgaggacaggccagtttgacagccaggagtacacagaatatgctgtgaagagcctgagcaatgaaaattatggagtgtacaactgcagcatcatcaatgaggccggggccggccgctgcagcttcctggtgacaggcaaggcctatgcccctgagttctactatgacacctacaaccctgtgtggcagaacagacaccgggtgtacagctacagcctgcagtggacccagatgaacccagatgctgtggacagaattgtggcctaccgcctgggcatccggcaggccggccagcagcgctggtgggagcaggagatcaagatcaatggaaacatccagaagggggagctgatcacctacaacctgacagagctgatcaagccagaggcctatgaggtgcggctgacccccctgaccaagtttggagagggggacagcaccatccgggtcatcaagtacagcgcccctgtgaacccccacctgcgggagttccactgcggctttgaagatggcaacatctgcctcttcacccaggatgacacagacaactttgactggaccaagcagagcacagccaccaggaacaccaagtacacccccaacacaggccccaatgctgacaggagcggcagcaaggagggcttctacatgtacatcgagaccagccggccccggctggagggggagaaggcccggctgctgagccctgtgttcagcatcgcccccaagaacccctacggccccaccaacacagcctactgcttctccttcttctaccacatgtatggccagcacatcggcgtgctgaatgtgtacctgcggctgaagggccagaccaccatcgagaaccccctgtggagcagcagcggcaacaagggccagcgctggaatgaggcccacgtgaacatctaccccatcaccagcttccagctgatctttgagggcatccggggccctggcatcgagggggacatcgccattgatgatgtgtccattgctgaaggagaatgtgccaagcaggacctggccaccaagaacagcgtggatggagctgtgggcatcctggtgcacatctggctgttccccatcatcgtgctgatcagcatcctgagccccaggaggtag

SEQ ID NO: 158697 - DNA, 2184 bp, Artificial Sequence; identical to SEQ ID NO: 158694
  Description of Artificial Sequence: Synthetic coding sequence

SEQ ID NO: 158698 - DNA, 2871 bp, Artificial Sequence
  Description of Artificial Sequence: Synthetic coding sequence
atggacctgctgtatggcctggtgtggctgctgactgtgctgctggagggcatcagcggccagggcgtgtatgccccacccaccgtgagaattgtgcacagcggcctggcctgcaacatcgaggaggagcgctacagcgagcgggtgtacaccatccgggagggggagaccctggagctgacctgcctggtgacaggccacccccggccccagatccgctggaccaagacagctggcagcgccagtgaccgcttccaggacagctctgtgttcaatgagaccctgcgcatcaccaacatccagaggcaccagggcggccgctactactgcaaggcagaaaatggcctgggcagccctgccatcaagagcatccgggtggatgtgtactacctggatgatcctgtggtgacagtgcaccagagcatcggggaggccaaggagcagttctactatgaaagaacagtgttcctgcgctgtgtggccaacagcaacccccctgtgcgctacagctggaggcggggccaggaggtgctgctgcagggcagtgacaagggcgtggagatctatgagcccttcttcacccagggcgagaccaagatcctgaagctgaagaacctgcggccccaggactatgccaactacagctgcatcgcctctgtgagaaatgtgtgcaacatcccagacaagatggtgtccttccggctgagcaacaagacagccagccccagcatcaagctgctggtggatgaccccatcgtggtgaaccctggagaggccatcaccctggtgtgtgtgaccactggaggagagcccgcccccagcctgacctgggtgcgcagctttggcaccctgcctgagaagacagtgctgaatggaggcaccctgaccatcccagccatcaccagtgatgatgctggcacctacagctgcatcgccaacaacaacgtgggcaacccagccaagaagagcaccaacatcatcgtgcgggccctgaagaagggccgcttctggatcaccccagacccctaccacaaggatgacaacatccagatcggccgggaggtgaagatcagctgccaggtggaggccgtgcccagcgaggagctgaccttctcctggttcaagaatggccggcccctgcggagcagcgagaggatggtgatcacccagacagatcctgatgtgtccccaggcaccaccaacctggacatcatcgacctgaagttcacagactttggcacctacacctgtgtggccagcctgaagggcggcggcatcagtgacatcagcattgatgtgaacatcagcagcagcacagtgccccccaacctgactgtgccccaggagaagagccccctggtgacccgggagggggacaccatcgagctgcagtgccaggtgacaggcaagcccaagcccatcatcctgtggagcagagctgacaaggaggtggccatgccagatggctccatgcagatggagagctatgatggcaccctgcgcatcgtgaatgtgtcccgggagatgagcggcatgtaccgctgccagaccagccagtacaacggcttcaacgtgaagccccgggaggccctggtgcagctgattgtgcagtacccacctgctgtggagcccgccttcctggagatccggcagggccaggacagatctgtgaccatgagctgccgggtgctgcgggcctaccccatccgggtgctgacctatgagtggaggctgggcaacaagctgctgaggacaggccagtttgacagccaggagtacacagaatatgctgtgaagagcctgagcaatgaaaactacggcgtgtacaactgcagcatcatcaatgaagctggagctggccgctgcagcttcctggtgacaggcaaggcctatgcccctgagttctactatgacacctacaaccctgtgtggcagaacagacaccgggtgtacagctacagcctgcagtggacccagatgaacccagatgctgtggaccgcatcgtggcctaccgcctgggcatccggcaggccggccagcagcgctggtgggagcaggagatcaagatcaatggaaacatccagaagggggagctgatcacctacaacctgacagagctgatcaagccagaggcctatgaggtgcggctgacccccctgaccaagtttggagagggggacagcaccatccgggtcatcaagtacagcgcccctgtgaacccccacctgcgggagttccactgcggctttgaagatggcaacatctgcctcttcacccaggatgacacagacaactttgactggaccaagcagagcacagccaccaggaacaccaagtacacccccaacacaggccccaatgctgacagaagtggcagcaaggagggcttctacatgtacatcgagaccagccggccccggctggagggggagaaggcccggctgctgagccctgtgttcagcatcgcccccaagaacccctacggccccaccaacacagcctactgcttctccttcttctaccacatgtatggccagcacatcggcgtgctgaatgtgtacctgcggctgaagggccagaccaccatcgagaaccccctgtggagcagcagcggcaacaagggccagcgctggaatgaggcccacgtgaacatctaccccatcaccagcttccagctgatctttgagggcatccggggccctggcattgaaggagacatcgccattgatgatgtgtccattgctgagggggagtgtgccaagcaggacctggccaccaagaacagcgtggatggagctgtgggcatcctggtgcacatctggctgttccccatcatcgtgctgatcagcatcctgagccccaggaggtag

SEQ ID NO: 158699 - DNA, 1143 bp, Artificial Sequence
  Description of Artificial Sequence: Synthetic coding sequence
atgcgctggctgctgctgtactatgccctgtgcttcagcctgagcaaggccagcgcccacacagtggagctgaacaacatgtttggccagatccagagccctggctacccagacagctaccccagcgacagcgaggtgacctggaacatcaccgtgcctgatggcttccgcatcaagctgtacttcatgcacttcaacctggagagcagctacctgtgtgaatatgactatgtgaaggtggagacagaggaccaggtgctggccaccttctgtggccgggagaccacagacacagagcagaccccaggccaggaggtggtgctgagccctggcagcttcatgagcatcaccttcagaagtgacttcagcaatgaggagcgcttcaccggctttgatgcccactacatggctgtggatgtggatgagtgcaaggagagagaagatgaggagctgagctgtgaccactactgccacaactacatcggcggctactactgcagctgccgcttcggctacatcctgcacacagacaacagaacctgccgggtggagtgcagcgacaacctcttcacccagaggactggagtcatcaccagcccagacttccccaacccctaccccaagagcagtgaatgtctgtacaccatcgagctggaggagggcttcatggtgaacctgcagtttgaggacatctttgatattgaggaccaccctgaggtgccctgcccctatgactacatcaagatcaaggtgggccccaaggtgctgggccccttctgtggggagaaggcccctgagcccatcagcacccagagccacagcgtgctgatcctcttccacagcgacaacagcggggagaacagaggctggaggctgagctacagagctgctggaaatgaatgtcctgagctgcagccccctgtgcacggcaagattgagcccagccaggccaagtacttcttcaaggaccaggtgctggtgtcctgtgacaccggctacaaggtgctgaaggacaacgtggagatggacaccttccagatcgagtgcctgaaggatggcacctggagcaacaagatccccacctgcaagaagaatgaaattgacctggagagcgagctgaagtctgagcaggtgacagaatag

SEQ ID NO: 158700 - DNA, 2187 bp, Artificial Sequence
  Description of Artificial Sequence: Synthetic coding sequence
atgcgctggctgctgctgtactatgccctgtgcttcagcctgagcaaggccagcgcccacacagtggagctgaacaacatgtttggccagatccagagccctggctacccagacagctaccccagcgacagcgaggtgacctggaacatcaccgtgcctgatggcttccgcatcaagctgtacttcatgcacttcaacctggagagcagctacctgtgtgaatatgactatgtgaaggtggagacagaggaccaggtgctggccaccttctgtggccgggagaccacagacacagagcagaccccaggccaggaggtggtgctgagccctggcagcttcatgagcatcaccttcagaagtgacttcagcaatgaggagcgcttcaccggctttgatgcccactacatggctgtggatgtggatgagtgcaaggagagagaagatgaggagctgagctgtgaccactactgccacaactacatcggcggctactactgcagctgccgcttcggctacatcctgcacacagacaacagaacctgccgggtggagtgcagcgacaacctcttcacccagaggactggagtcatcaccagcccagacttccccaacccctaccccaagagcagtgaatgtctgtacaccatcgagctggaggagggcttcatggtgaacctgcagtttgaggacatctttgatattgaggaccaccctgaggtgccctgcccctatgactacatcaagatcaaggtgggccccaaggtgctgggccccttctgtggggagaaggcccctgagcccatcagcacccagagccacagcgtgctgatcctcttccacagcgacaacagcggggagaacagaggctggaggctgagctacagagctgctggaaatgaatgtcctgagctgcagccccctgtgcacggcaagattgagcccagccaggccaagtacttcttcaaggaccaggtgctggtgtcctgtgacaccggctacaaggtgctgaaggacaacgtggagatggacaccttccagatcgagtgcctgaaggatggcacctggagcaacaagatccccacctgcaagatcgtggactgccgggcccctggagagctggagcacggcctcatcaccttcagcaccaggaacaacctgaccacctacaagtctgagatcaagtacagctgccaggagccctactacaagatgctgaacaacaacacaggcatctacacctgcagcgcccagggcgtgtggatgaacaaggtgctgggccgcagcctgcccacctgcctgcctgaatgtggccagcccagccgcagcctgcccagcctggtgaagaggatcattggaggaagaaatgctgagcccggcctcttcccctggcaggccctgattgtggtggaggacaccagccgggtgcccaatgacaagtggtttggaagtggggccctgctgagcgcctcctggatcctgacagctgcccacgtgctgcggagccagaggcgggacaccaccgtcatccctgtgtccaaggagcacgtgacagtgtacctgggcctgcatgatgtgcgggacaagtctggagctgtgaacagcagcgctgcccgggtggtgctgcacccagacttcaacatccagaactacaaccacgacatcgccctggtgcagctgcaggagcctgtgcccctgggcccccacgtgatgcctgtgtgcctgccccggctggagcctgagggccctgccccccacatgctgggcctggtggccggctggggcatcagcaaccccaacgtgacagtggatgagatcatcagcagcggcaccaggaccctgagtgatgtgctgcagtatgtgaagctgcctgtggtgccccatgctgagtgcaagaccagctatgagagccgcagcggcaactacagcgtgacagagaacatgttctgtgccggctactatgaaggaggcaaggacacctgcctgggggacagcggcggggccttcgtcatctttgatgacctgagccagcgctgggtggtgcagggcctggtgtcctggggcggcccagaagaatgtggcagcaagcaggtgtatggagtgtacaccaaggtgagcaactacgtggactgggtgtgggagcagatgggcctgccccagagcgtggtggagccccaggtggagaggtag

SEQ ID NO: 158701 - DNA, 2100 bp, Artificial Sequence
  Description of Artificial Sequence: Synthetic coding sequence
atgcgctggctgctgctgtactatgccctgtgcttcagcctgagcaaggccagcgcccacacagtggagctgaacaacatgtttggccagatccagagccctggctacccagacagctaccccagcgacagcgaggtgacctggaacatcaccgtgcctgatggcttccgcatcaagctgtacttcatgcacttcaacctggagagcagctacctgtgtgaatatgactatgtgaaggtggagacagaggaccaggtgctggccaccttctgtggccgggagaccacagacacagagcagaccccaggccaggaggtggtgctgagccctggcagcttcatgagcatcaccttcagaagtgacttcagcaatgaggagcgcttcaccggctttgatgcccactacatggctgtggatgtggatgagtgcaaggagagagaagatgaggagctgagctgtgaccactactgccacaactacatcggcggctactactgcagctgccgcttcggctacatcctgcacacagacaacagaacctgccgggtggagtgcagcgacaacctcttcacccagaggactggagtcatcaccagcccagacttccccaacccctaccccaagagcagtgaatgtctgtacaccatcgagctggaggagggcttcatggtgaacctgcagtttgaggacatctttgatattgaggaccaccctgaggtgccctgcccctatgactacatcaagatcaaggtgggccccaaggtgctgggccccttctgtggggagaaggcccctgagcccatcagcacccagagccacagcgtgctgatcctcttccacagcgacaacagcggggagaacagaggctggaggctgagctacagagctgctggaaatgaatgtcctgagctgcagccccctgtgcacggcaagattgagcccagccaggccaagtacttcttcaaggaccaggtgctggtgtcctgtgacaccggctacaaggtgctgaaggacaacgtggagatggacaccttccagatcgagtgcctgaaggatggcacctggagcaacaagatccccacctgcaagatcgtggactgccgggcccctggagagctggagcacggcctcatcaccttcagcaccaggaacaacctgaccacctacaagtctgagatcaagtacagctgccaggagccctactacaagatgctgaacaacaacacaggcatctacacctgcagcgcccagggcgtgtggatgaacaaggtgctgggccgcagcctgcccacctgcctgcctgtgtgtggcctgcccaagttcagcaggaagctgatggcccgcatcttcaacggccggcctgcccagaagggcaccaccccctggatcgccatgctgagccacctgaatggccagcccttctgtggcggcagcctgctgggcagctcctggatcgtgacagctgcccactgcctgcaccagagcctggaccctgaggaccccaccctgcgggacagcgacctgctgagccccagcgacttcaagatcatcctgggcaagcactggaggctgcggagtgatgaaaatgagcagcacctgggcgtgaagcacaccaccctgcacccccagtatgaccccaacacctttgaaaatgatgtggccctggtggagctgctggagagccctgtgctgaatgcctttgtgatgcccatctgcctgcctgagggcccccagcaggagggcgccatggtgattgtgtctggctggggcaagcagttcctgcagcgcttccctgagaccctgatggagattgagatccccatcgtggaccacagcacctgccagaaggcctatgcccccctgaagaagaaggtgacccgggacatgatctgtgccggggagaaggagggcggcaaggatgcctgtgccggggacagcggcggccccatggtgaccctgaaccgggagcggggccagtggtacctggtgggcaccgtgtcctggggagatgactgtgggaagaaggacagatatggagtgtacagctacatccaccacaacaaggactggatccagagggtgactggagtgaggaactag

SEQ ID NO: 158702 - DNA, 1848 bp, Artificial Sequence
  Description of Artificial Sequence: Synthetic coding sequence
atgagcatcaccttcagaagtgacttcagcaatgaggagcgcttcaccggctttgatgcccactacatggctgtggatgtggatgagtgcaaggagcgggaggatgaggagctgagctgtgaccactactgccacaactacatcggcggctactactgcagctgccgcttcggctacatcctgcacacagacaacagaacctgccgggtggagtgcagcgacaacctcttcacccagaggactggagtcatcaccagcccagacttccccaacccctaccccaagagcagcgagtgcctgtacaccatcgagctggaggagggcttcatggtgaacctgcagtttgaggacatctttgatattgaggaccaccctgaggtgccctgcccctatgactacatcaagatcaaggtgggccccaaggtgctgggccccttctgtggggagaaggcccctgagcccatcagcacccagagccacagcgtgctgatcctcttccacagcgacaacagcggagaaaatagaggctggaggctgagctacagagctgctggaaatgaatgtcctgagctgcagccccctgtgcacggcaagattgagcccagccaggccaagtacttcttcaaggaccaggtgctggtgtcctgtgacaccggctacaaggtgctgaaggacaacgtggagatggacaccttccagattgaatgtctgaaggatggcacctggagcaacaagatccccacctgcaagatcgtggactgccgggcccctggagagctggagcacggcctcatcaccttcagcaccaggaacaacctgaccacctacaagtctgagatcaagtacagctgccaggagccctactacaagatgctgaacaacaacacaggcatctacacctgcagcgcccagggcgtgtggatgaacaaggtgctgggccgcagcctgcccacctgcctgcctgaatgtggccagcccagccgcagcctgcccagcctggtgaagaggatcatcggcggcagaaatgctgagcccggcctcttcccctggcaggccctgattgtggtggaggacaccagccgggtgcccaatgacaagtggtttggcagcggggccctgctgagcgcctcctggatcctgacagctgcccacgtgctgcggagccagaggcgggacaccaccgtcatccctgtgtccaaggagcacgtgacagtgtacctgggcctgcatgatgtgcgggacaagagcggggctgtgaacagcagcgctgcccgggtggtgctgcacccagacttcaacatccagaactacaaccacgacatcgccctggtgcagctgcaggagcctgtgcccctgggcccccacgtgatgcctgtgtgcctgccccggctggagcctgagggccctgccccccacatgctgggcctggtggccggctggggcatcagcaaccccaacgtgacagtggatgagatcatcagcagcggcaccaggaccctgagtgatgtgctgcagtatgtgaagctgcctgtggtgccccatgctgagtgcaagaccagctatgagagccgcagcggcaactacagcgtgacagagaacatgttctgtgccggctactatgagggcggcaaggacacctgcctgggggacagcggcggggcctttgtgatctttgatgacctgagccagcgctgggtggtgcagggcctggtgtcctggggcggccctgaggagtgtggcagcaagcaggtgtatggagtgtacaccaaggtgagcaactacgtggactgggtgtgggagcagatgggcctgccccagagcgtggtggagccccaggtggagaggtag

SEQ ID NO: 158703 - DNA, 249 bp, Artificial Sequence
  Description of Artificial Sequence: Synthetic coding sequence
atgttctgtgccggctactatgaaggaggcaaggacacctgcctgggggacagcggcggggccttcgtcatctttgatgacctgagccagcgctgggtggtgcagggcctggtgtcctggggcggcccagaagaatgtggcagcaagcaggtgtatggagtgtacaccaaggtgagcaactacgtggactgggtgtgggagcagatgggcctgccccagagcgtggtggagccccaggtggagaggtag

SEQ ID NO: 158704 - DNA, 1443 bp, Artificial Sequence
  Description of Artificial Sequence: Synthetic coding sequence
atgagcatcaccttcagaagtgacttcagcaatgaggagcgcttcaccggctttgatgcccactacatggctgtggatgtggatgagtgcaaggagcgggaggatgaggagctgagctgtgaccactactgccacaactacatcggcggctactactgcagctgccgcttcggctacatcctgcacacagacaacagaacctgccgggtggagtgcagcgacaacctcttcacccagaggactggagtcatcaccagcccagacttccccaacccctaccccaagagcagcgagtgcctgtacaccatcgagctggaggagggcttcatggtgaacctgcagtttgaggacatctttgatattgaggaccaccctgaggtgccctgcccctatgactacatcaagatcaaggtgggccccaaggtgctgggccccttctgtggggagaaggcccctgagcccatcagcacccagagccacagcgtgctgatcctcttccacagcgacaacagcggagaaaatagaggctggaggctgagctacagagctgctggaaatgaatgtcctgagctgcagccccctgtgcacggcaagattgagcccagccaggccaagtacttcttcaaggaccaggtgctggtgtcctgtgacaccggctacaaggtgctgaaggacaacgtggagatggacaccttccagattgaatgtctgaaggatggcacctggagcaacaagatccccacctgcaagatcgtggactgccgggcccctggagagctggagcacggcctcatcaccttcagcaccaggaacaacctgaccacctacaagtctgagatcaagtacagctgccaggagccctactacaagatgctgaacaacaacacaggcatctacacctgcagcgcccagggcgtgtggatgaacaaggtgctgggccgcagcctgcccacctgcctgcctgaatgtggccagcccagccgcagcctgcccagcctggtgaagaggatcatcggcggcagaaatgctgagcccggcctcttcccctggcaggccctgattgtggtggaggacaccagccgggtgcccaatgacaagtggtttggcagcggggccctgctgagcgcctcctggatcctgacagctgcccacgtgctgcggagccagaggcgggacaccaccgtcatccctgtgtccaaggagcacgtgacagtgtacctgggcctgcatgatgtgcgggacaagagcggggctgtgaacagcagcgctgcccgggtggtgctgcacccagacttcaacatccagaactacaaccacgacatcgccctggtgcagctgcaggagcctgtgcccctgggcccccacgtgatgcctgtgtgcctgccccggctggagcccccaggcggccgcctgggccacctgcagagccagtgtgacagctag

SEQ ID NO: 158705 - DNA, 2061 bp, Artificial Sequence
  Description of Artificial Sequence: Synthetic coding sequence
atgaggctgctgaccctgctgggcctgctgtgtggctctgtggccacccccctgggccccaagtggccagagcctgtgtttggccgcctggccagccctggcttccctggagaatatgccaatgaccaggagcggcgctggaccctgacagcccctcctggctaccgcctgcggctgtacttcacccactttgacctggagctgagccacctgtgtgaatatgactttgtgaagctgagcagcggggccaaggtgctggccaccctgtgtggccaggagagcacagacacagagcgggcccctgggaaggacaccttctacagcctgggcagcagcctggacatcaccttcagaagtgactacagcaatgagaagcccttcaccggctttgaggccttctatgctgctgaagatattgatgagtgccaggtggcccctggagaggcccccacctgtgaccaccactgccacaaccacctgggcggcttctactgcagctgcagagctggctacgtgctgcacaggaacaagaggacctgcagcgccctgtgcagcggccaggtgttcacccagaggtctggagagctgagcagccctgagtacccccggccctaccccaagctgagcagctgcacctacagcatcagcctggaggagggcttcagcgtcatcctggactttgtggagagctttgatgtggagacccaccctgagaccctgtgcccctatgacttcctgaagatccagacagaccgggaggagcacggccccttctgtgggaagaccctgccccacagaattgagaccaagagcaacacagtgaccatcacctttgtgacagatgaaagtggggaccacacaggctggaagatccactacaccagcacagcccagccctgcccctaccccatggccccacccaacggccacgtgtcccctgtgcaggccaagtacatcctgaaggacagcttcagcatcttctgtgagaccggctatgagctgctgcagggccacctgcccctgaagagcttcaccgctgtgtgccagaaggatggctcctgggaccggcccatgcctgcctgcagcatcgtggactgtggccccccagatgacctgcccagcggccgggtggagtacatcactggacctggggtgaccacctacaaggccgtcatccagtacagctgtgaggagaccttctacaccatgaaggtgaatgatggcaagtatgtgtgtgaggctgatggcttctggaccagcagcaagggggagaagagcctgcctgtgtgtgagcctgtgtgtggcctgagcgcccggaccactggaggccgcatctacggcggccagaaggccaagccaggggacttcccctggcaggtgctgatcctgggcggcaccacagctgctggggccctgctgtatgacaactgggtgctgacagctgcccatgctgtgtatgagcagaagcatgatgccagcgccctggacatccgcatgggcaccctgaagaggctgagcccccactacacccaggcctggagcgaggccgtgttcatccacgagggctacacccatgatgctggctttgacaatgacatcgccctgatcaagctgaacaacaaggtggtgatcaacagcaacatcacccccatctgcctgcccaggaaggaggccgagagcttcatgaggacagatgacattggaacagccagcggctggggcctgacccagaggggcttcctggccaggaacctgatgtatgtggacatccccatcgtggaccaccagaagtgcacagctgcctatgagaagccaccctacccccggggctctgtgacagccaacatgctgtgtgccggcctggagagcggcggcaaggacagctgccgcggggacagcggcggggccctggtgttcctggacagcgagacagagcgctggtttgtgggcggcatcgtgtcctggggctccatgaactgtggggaggccggccagtatggagtgtacaccaaggtgatcaactacatcccctggattgagaacatcatcagtgacttctag

SEQ ID NO: 158706 - DNA, 558 bp, Artificial Sequence
  Description of Artificial Sequence: Synthetic coding sequence
atgaggctgctgaccctgctgggcctgctgtgtggctctgtggccacccccctgggccccaagtggccagagcctgtgtttggccgcctggccagccctggcttccctggagaatatgccaatgaccaggagcggcgctggaccctgacagcccctcctggctaccgcctgcggctgtacttcacccactttgacctggagctgagccacctgtgtgaatatgactttgtgaagctgagcagcggggccaaggtgctggccaccctgtgtggccaggagagcacagacacagagcgggcccctgggaaggacaccttctacagcctgggcagcagcctggacatcaccttcagaagtgactacagcaatgagaagcccttcaccggctttgaggccttctatgctgctgaagatattgatgagtgccaggtggcccctggagaggcccccacctgtgaccaccactgccacaaccacctgggcggcttctactgcagctgcagagctggctacgtgctgcacaggaacaagaggacctgcagcgagcagagcctgtag

SEQ ID NO: 158707 - DNA, 1089 bp, Artificial Sequence
  Description of Artificial Sequence: Synthetic coding sequence
atggccgcccccagggtcttccccctgagctgtgctgtgcagcagtatgcctggggcaagatgggcagcaacagcgaggtggcccggctgctggccagcagtgaccccctggcccagattgctgaggacaagccctatgcagagctgtggatgggcacccaccccagaggagatgccaagatcctggacaaccgcatcagccagaagaccctgagccagtggattgctgagaaccaggacagcctgggcagcaaggtgaaggacaccttcaatggaaacctgcccttcctgttcaaggtgctgtctgtggagacccccctgagcatccaggcccaccccaacaaggagctggccgagaagctgcacctgcaggccccccagcactacccagatgccaaccacaagccagagatggccatcgccctgacccccttccagggcctgtgtggcttccggcctgtggaggagatcgtgaccttcctgaagacagctgctggcaacaacatggaggacatctttggagagctgctgctgcagctgcaccagcagtacccaggggacatcggctgctttgccatctacttcctgaacctgctgaccctgaagccaggagaggccatgttcctggaggccaacgtgccccacgcctacctgaagggggactgtgtggagtgcatggcctgcagcgacaacacagtgcgggccggcctgacccccaagttcattgatgtgcccaccctgtgtgagatgctgagctacacccccagcagcagcaaggacaggctcttcctgcccaccaggagccaggaggacccctacctgagcatctatgacccccctgtgcctgacttcaccatcatgaagacagaggtgcccggctctgtgacagagtacaaggtgctggccctggacagcgccagcatcctgctgatggtgcagggcaccgtgattgccagcacccccaccacccagacccccatccccctgcagagaggaggagtgctcttcatcggggccaatgaatctgtgtccctgaagctgacagagcccaaggacctgctgatcttccgggcctgctgcctgctgtag

SEQ ID NO: 158708 - DNA, 1272 bp, Artificial Sequence
  Description of Artificial Sequence: Synthetic coding sequence
atggccgcccccagggtcttccccctgagctgtgctgtgcagcagtatgcctggggcaagatgggcagcaacagcgaggtggcccggctgctggccagcagtgaccccctggcccagattgctgaggacaagccctatgcagagctgtggatgggcacccaccccagaggagatgccaagatcctggacaaccgcatcagccagaagaccctgagccagtggattgctgagaaccaggacagcctgggcagcaaggtgaaggacaccttcaatggaaacctgcccttcctgttcaaggtgctgtctgtggagacccccctgagcatccaggcccaccccaacaaggagctggccgagaagctgcacctgcaggccccccagcactacccagatgccaaccacaagccagagatggccatcgccctgacccccttccagggcctgtgtggcttccggcctgtggaggagatcgtgaccttcctgaagaaggtgcctgagttccagttcctgattggagatgaagctgccacccacctgaagcagaccatgagccatgacagccaggccgtggccagcagcctgcagagctgcttcagccacctgatgaagtctgagaagaaggtggtggtggagcagctgaacctgctggtgaagaggatcagccagcaggccgccgccggcaacaacatggaggacatctttggagagctgctgctgcagctgcaccagcagtacccaggggacatcggctgctttgccatctacttcctgaacctgctgaccctgaagccaggagaggccatgttcctggaggccaacgtgccccacgcctacctgaagggggactgtgtggagtgcatggcctgcagcgacaacacagtgcgggccggcctgacccccaagttcattgatgtgcccaccctgtgtgagatgctgagctacacccccagcagcagcaaggacaggctcttcctgcccaccaggagccaggaggacccctacctgagcatctatgacccccctgtgcctgacttcaccatcatgaagacagaggtgcccggctctgtgacagagtacaaggtgctggccctggacagcgccagcatcctgctgatggtgcagggcaccgtcatcgccagcacccccaccacccagacccccatccccctgcagagaggaggagtgctcttcatcggggccaatgaatctgtgtccctgaagctgacagagcccaaggacctgctgatcttccgggcctgctgcctgctgtag

SEQ ID NO: 158709 - DNA, 804 bp, Artificial Sequence
  Description of Artificial Sequence: Synthetic coding sequence
atgggcagcaacagcgaggtggcccggctgctggccagcagtgaccccctggcccagattgctgaggacaagccctatgcagagctgtggatgggcacccaccccagaggagatgccaagatcctggacaaccgcatcagccagaagaccctgagccagtggattgctgagaaccaggacagcctgggcagcaaggtgaaggacaccttcaatggaaacctgcccttcctgttcaaggtgctgtctgtggagacccccctgagcatccaggcccaccccaacaaggagctggccgagaagctgcacctgcaggccccccagcactacccagatgccaaccacaagccagagatggccatcgccctgacccccttccagggcctgtgtggcttccggcctgtggaggagatcgtgaccttcctgaagaaggtgcctgagttccagttcctgattggagatgaagctgccacccacctgaagcagaccatgagccatgacagccaggccgtggccagcagcctgcagagctgcttcagccacctgatgaagtctgagaagaaggtggtggtggagcagctgaacctgctggtgaagaggatcagccagcaggccgccgccggcaacaacatggaggacatctttggagagctgctgctgcagctgcaccagcagtacccaggggacatcggctgctttgccatctacttcctgaacctgctgaccctgaagccaggagaggccatgttcctggaggccaacgtgccccacgcctacctgaagggcggcccctggctgtgccactag

SEQ ID NO: 158710 - DNA, 1122 bp, Artificial Sequence
  Description of Artificial Sequence: Synthetic coding sequence
atgggcacccaccccagaggagatgccaagatcctggacaaccgcatcagccagaagaccctgagccagtggattgctgagaaccaggacagcctgggcagcaaggtgaaggacaccttcaatggaaacctgcccttcctgttcaaggtgctgtctgtggagacccccctgagcatccaggcccaccccaacaaggagctggccgagaagctgcacctgcaggccccccagcactacccagatgccaaccacaagccagagatggccatcgccctgacccccttccagggcctgtgtggcttccggcctgtggaggagatcgtgaccttcctgaagaaggtgcctgagttccagttcctgattggagatgaagctgccacccacctgaagcagaccatgagccatgacagccaggccgtggccagcagcctgcagagctgcttcagccacctgatgaagtctgagaagaaggtggtggtggagcagctgaacctgctggtgaagaggatcagccagcaggccgccgccggcaacaacatggaggacatctttggagagctgctgctgcagctgcaccagcagtacccaggggacatcggctgctttgccatctacttcctgaacctgctgaccctgaagccaggagaggccatgttcctggaggccaacgtgccccacgcctacctgaagggggactgtgtggagtgcatggcctgcagcgacaacacagtgcgggccggcctgacccccaagttcattgatgtgcccaccctgtgtgagatgctgagctacacccccagcagcagcaaggacaggctcttcctgcccaccaggagccaggaggacccctacctgagcatctatgacccccctgtgcctgacttcaccatcatgaagacagaggtgcccggctctgtgacagagtacaaggtgctggccctggacagcgccagcatcctgctgatggtgcagggcaccgtcatcgccagcacccccaccacccagacccccatccccctgcagagaggaggagtgctcttcatcggggccaatgaatctgtgtccctgaagctgacagagcccaaggacctgctgatcttccgggcctgctgcctgctgtag

SEQ ID NO: 158711 - DNA, 4371 bp, Artificial Sequence
  Description of Artificial Sequence: Synthetic coding sequence
atgaggctgcccctgctgctggtgtttgccagcgtcatccctggagctgtgctgctgctggacacccggcagttcctgatctacaatgaagaccacaagagatgtgtggatgctgtgagccccagcgctgtgcagacagctgcctgcaaccaggatgctgagagccagaagttccgctgggtgtctgagagccagatcatgtctgtggccttcaagctgtgcctgggcgtgcccagcaagacagactgggtggccatcaccctgtatgcctgtgacagcaagtctgagttccagaagtgggagtgcaagaatgacaccctgctgggcatcaagggagaagatctcttcttcaactacggcaaccggcaggagaagaacatcatgctgtacaagggcagcggcctgtggagccgctggaagatctacggcaccacagacaacctgtgcagccggggctatgaggccatgtacaccctgctgggcaatgccaacggggccacctgtgccttccccttcaagtttgagaacaagtggtacgccgactgcaccagcgctggccgcagtgatggctggctgtggtgtggcaccaccacagattatgacacagacaagctgtttggctactgccccctgaagtttgagggcagcgagagcctgtggaacaaggaccccctgacctctgtgtcctaccagatcaacagcaagagcgccctgacctggcaccaggccaggaagagctgccagcagcagaatgctgagctgctgagcatcacagagatccacgagcagacctacctgaccggcctgaccagcagcctgaccagcggcctgtggattggcctgaacagcctgtccttcaacagcggctggcagtggagcgacaggagccccttccgctacctgaactggctgcccggcagccccagcgctgagcccgggaagagctgtgtgtccctgaaccctgggaagaatgccaagtgggagaacctggagtgtgtgcagaagctgggctacatctgcaagaagggcaacaccaccctgaacagctttgtgatccccagcgagagtgatgtgcccacccactgccccagccagtggtggccctatgccggccactgctacaagatccacagagatgagaagaagatccagagagatgccctgaccacctgcaggaaggagggcggggacctgaccagcatccacaccatcgaggagctggacttcatcatcagccagctgggctatgagcccaatgatgagctgtggattggcctgaatgacatcaagatccagatgtactttgagtggagcgatggcacccctgtgaccttcaccaagtggctgcggggggagcccagccatgagaacaaccggcaggaggactgtgtggtgatgaagggcaaggatggctactgggccgaccggggctgtgagtggcccctgggctacatctgcaagatgaagagccgcagccagggccctgagatcgtggaggtggagaagggctgcaggaagggctggaagaagcaccacttctactgctacatgattggccacaccctgagcacctttgctgaggccaaccagacctgcaacaatgaaaatgcctacctgaccaccattgaagatagatatgagcaggccttcctgaccagctttgtgggcctgcggcctgagaagtacttctggacaggcctgagtgacatccagaccaagggcaccttccagtggaccatcgaggaggaggtgcgcttcacccactggaacagcgacatgcctggcaggaagccaggctgtgtggccatgaggactggaattgctgggggcctgtgggatgtgctgaagtgtgatgagaaggccaagtttgtgtgcaagcactgggccgagggcgtgacccacccccccaagcccaccaccaccccagagcccaagtgcccagaggactggggcgccagcagcaggaccagcctgtgcttcaagctgtatgccaagggcaagcatgagaagaagacctggtttgagagccgggacttctgccgggccctgggcggggacctggccagcatcaacaacaaggaggagcagcagaccatctggaggctcatcacagccagcggcagctaccacaagctgttctggctgggcctgacctacggcagccccagcgagggcttcacctggagcgatggcagccctgtgtcctatgagaactgggcctatggagagcccaacaactaccagaatgtggagtactgtggggagctgaagggggaccccaccatgtcctggaatgacatcaactgtgagcacctgaacaactggatctgccagatccagaagggccagacccccaagccagagcccaccccagccccccaggacaacccccctgtgacagaagatggctgggtgatctacaaggactaccagtactacttcagcaaggagaaggagaccatggacaatgcccgggccttctgcaagaggaactttggagacctggtgtccatccagagcgagagcgagaagaagttcctgtggaagtatgtgaacagaaatgatgcccagagcgcctacttcatcggcctgctgatcagcctggacaagaagtttgcctggatggatggcagcaaggtggactatgtgtcctgggccactggagagcccaactttgccaatgaagatgagaactgtgtgaccatgtacagcaacagcggcttctggaatgacatcaactgtggctacccaaatgccttcatctgccagaggcacaacagcagcatcaatgccaccaccgtgatgcccaccatgcccagcgtgcccagcggctgcaaggagggctggaacttctacagcaacaagtgcttcaagatcttcggcttcatggaggaggagaggaagaactggcaggaggccaggaaggcctgcatcggctttggaggcaacctggtgtccatccagaatgagaaggagcaggccttcctgacctaccacatgaaggacagcaccttcagcgcctggacaggcctgaatgatgtgaacagcgagcacaccttcctgtggacagatggccggggcgtgcactacaccaactggggcaagggctacccaggcggcagaagaagcagcctgtcctatgaagatgctgactgtgtggtgatcatcggcggggccagcaatgaagctgggaagtggatggatgacacctgtgacagcaagaggggctacatctgccagaccaggagtgaccccagcctgaccaaccccccagccaccatccagacagatggctttgtgaagtatggcaagagcagctacagcctgatgaggcagaagttccagtggcatgaagctgagacctactgcaagctgcacaacagcctcatcgccagcatcctggacccctacagcaatgcctttgcctggctgcagatggagaccagcaatgaaagagtgtggatcgccctgaacagcaacctgacagacaaccagtacacctggacagacaagtggagggtgcgctacaccaactgggccgcagatgagcccaagctgaagagcgcctgtgtgtacctggacctggatggctactggaagacagcccactgcaatgaaagcttctacttcctgtgcaagagaagtgatgagatcccagccacagagcccccccagctgcccggccgctgcccagagagtgaccacacagcctggatccccttccacggccactgctactacatcgagagcagctacaccaggaactggggccaggccagcctggagtgcctgaggatgggcagcagcctggtgtccattgaatctgctgctgagagcagcttcctgagctacagagtggagcccctgaagagcaagaccaacttctggattggcctcttcagaaatgtggagggcacctggctgtggatcaacaacagccctgtgtcctttgtgaactggaacacaggagaccccagcggggagagaaatgactgtgtggccctgcacgccagcagcggcttctggagcaacatccactgcagcagctacaagggctacatctgcaagaggcccaagatcattgatgccaagcccacccatgagctgctgaccaccaaggctgacaccaggaagatggaccccagcaagcccagcagcaatgtggccggcgtggtgatcatcgtcatcctgctgatcctgactggagctggcctggccgcctacttcttctacaagaagagaagagtgcacctgccccaggagggcgcctttgagaacaccctgtacttcaacagccagagcagccctggcaccagtgacatgaaggacctggtgggcaacatcgagcagaatgagcacagcgtcatctag

SEQ ID NO: 158712 - DNA, 4440 bp, Artificial Sequence
  Description of Artificial Sequence: Synthetic coding sequence
atgggccctggccggcctgccccagccccctggcccaggcacctgctgcgctgtgtgctgctgctgggctgcctgcacctgggccggcctggggcccctggagatgctgccctgcctgagcccaacgtgttcctgatcttcagccacggcctgcagggctgcctggaggcccagggcggccaggtgcgggtgaccccagcctgcaacaccagcctgcctgcccagcgctggaagtgggtgtccaggaacagactcttcaacctgggcaccatgcagtgcctgggcaccggctggccaggcaccaacaccacagccagcctgggcatgtatgaatgtgaccgggaggccctgaacctgcgctggcactgcaggaccctgggggaccagctgagcctgctgctgggcgcccggaccagcaacatcagcaagccaggcaccctggagcggggggaccagaccaggagcggccagtggaggatctacggcagcgaggaggacctgtgtgccctgccctaccacgaggtgtacaccatccagggcaacagccacggcaagccctgcaccatccccttcaagtatgacaaccagtggttccacggctgcaccagcactggaagagaagatggccacctgtggtgtgccaccacccaggactatggcaaggatgagcgctggggcttctgccccatcaagagcaatgactgtgagaccttctgggacaaggaccagctgacagacagctgctaccagttcaacttccagagcaccctgtcctggagggaggcctgggccagctgtgagcagcagggcgctgacctgctgagcatcacagagatccacgagcagacctacatcaatggcctgctgaccggctacagcagcaccctgtggattggcctgaatgacctggacaccagcggcggctggcagtggagcgacaacagccccctgaagtacctgaactgggagagtgaccagcctgacaaccccagcgaggagaactgtggggtcatcagaacagagagcagcggcggctggcagaacagagactgcagcatcgccctgccctacgtgtgcaagaagaagcccaatgccacagctgagcccaccccaccagaccgctgggccaacgtgaaggtggagtgtgagcccagctggcagcccttccagggccactgctaccgcctgcaggccgagaagaggtcctggcaggagagcaagaaggcctgcctgcggggcggcggggacctggtgtccatccacagcatggccgagctggagttcatcaccaagcagatcaagcaggaggtggaggagctgtggattggcctgaatgacctgaagctgcagatgaactttgagtggagcgatggcagcctggtgtccttcacccactggcacccctttgagcccaacaacttccgggacagcctggaggactgtgtgaccatctggggccctgagggccgctggaatgacagcccctgcaaccagagcctgcccagcatctgcaagaaggccggccagctgagccagggcgctgctgaagaagatcatggctgcaggaagggctggacctggcacagccccagctgctactggctgggggaggaccaggtgacctacagcgaggcccggcggctgtgcacagaccacggcagccagctggtgaccatcaccaacagatttgagcaggcctttgtgagcagcctcatctacaactgggagggggagtacttctggacagccctgcaggacctgaacagcacaggcagcttcttctggctgtctggagatgaggtgatgtacacccactggaacagagaccagcccggctacagccggggcggctgtgtggccctggccactggaagtgccatgggcctgtgggaggtgaagaactgcaccagcttccgggcccgctacatctgccggcagagcctgggcacccctgtgaccccagagctgcccggccctgaccccacccccagcctgaccggcagctgcccccagggctgggccagtgacaccaagctgcgctactgctacaaggtgttcagcagcgagcggctgcaggacaagaagtcctgggtgcaggcccagggcgcctgccaggagctgggcgcccagctgctgagcctggccagctatgaggaggagcactttgtggccaacatgctgaacaagatctttggagagagcgagcctgagatccacgagcagcactggttctggattggcctgaacagaagagacccccggggcggccagagctggcgctggagcgatggagtgggcttctcctaccacaactttgacaggagcagacatgatgatgatgacatccggggctgtgctgtgctggacctggccagcctgcagtgggtggccatgcagtgtgacacccagctggactggatctgcaagatcccccggggcacagatgtgcgggagccagatgacagcccccagggccggcgggagtggctgcgcttccaggaggccgagtacaagttctttgagcaccacagcacctgggcccaggcccagaggatctgcacctggttccaggccgagctgacctctgtgcacagccaggccgagctggacttcctgagccacaacctgcagaagttcagccgggcccaggagcagcactggtggattggcctgcacaccagcgagagtgatggccgcttccgctggacagatggcagcatcatcaacttcatctcctgggcccctgggaagcccaggcctgtgggcaaggacaagaagtgtgtgtacatgacagccagccgggaggactggggagaccagcgctgcctgacagccctgccctacatctgcaagaggagcaatgtgaccaaggagacccagcccccagacctgcccaccacagccctgggcggctgccccagcgactggatccagttcctgaacaagtgcttccaggtgcagggccaggagccccagagccgggtgaagtggagcgaggcccagttcagctgtgagcagcaggaggcccagctggtgaccatcaccaaccccctggagcaggccttcatcacagccagcctgcccaacgtgacctttgacctgtggattggcctgcacgccagccagagggacttccagtgggtggagcaggagcccctgatgtatgccaactgggcccctggagagcccagcggccccagccctgcccccagcggcaacaagcccaccagctgtgctgtggtgctgcacagccccagcgcccacttcaccggccgctgggatgacaggagctgcacagaggagacccacggcttcatctgccagaagggcacagaccccagcctgagccccagccctgctgccctgcccccagcccctggaacagagctgagctacctgaatggcaccttccggctgctgcagaagcccctgcgctggcatgatgccctgctgctgtgtgagagcagaaatgccagcctggcctacgtgcctgacccctacacccaggccttcctgacccaggccgcccggggcctgcggacccccctgtggattggcctggccggggaggagggcagccgccgctacagctgggtgtctgaggagcccctgaactacgtgggctggcaggatggagagccccagcagcccggcggctgcacctacgtggatgtggatggagcctggaggaccaccagctgtgacaccaagctgcagggcgctgtgtgtggggtgagcagcggccccccaccaccccggcgcatctcctaccacggcagctgcccccagggcctggccgacagcgcctggatccccttccgggagcactgctacagcttccacatggagctgctgctgggccacaaggaggcccggcagcgctgccagagagctgggggcgctgtgctgagcatcctggatgagatggagaatgtgtttgtgtgggagcacctgcagagctatgagggccagagcagaggagcctggctgggcatgaacttcaaccccaagggcggcaccctggtgtggcaggacaacacagctgtgaactacagcaactggggccccccaggcctgggccccagcatgctgagccacaacagctgctactggatccagagcaacagcggcctgtggaggcctggggcctgcaccaacatcaccatgggcgtggtgtgcaagctgcccagggctgagcagagcagcttcagccccagcgccctgcctgagaacccagctgccctggtggtggtgctgatggctgtgctgctgctgctggccctgctgacagctgccctgatcctgtacagaagacggcagagcattgaaagaggagcctttgaaggagcccgctacagccgcagcagcagcagccccacagaggccacagagaagaacatcctggtgtctgacatggagatgaatgagcagcaggagtag

SEQ ID NO: 158713 - DNA, 1038 bp, Artificial Sequence
  Description of Artificial Sequence: Synthetic coding sequence
atgcccaccggccacctgggcagccccctggccctggccctgctgcctgtggccaccaacagacctgctgtgcagtggagctgcacagccccccagcccaccagcctggccgccggcaccatcggggccgcccggcggcggcccatggccagcagcgcccggcgggcccggggcagccgccgctacagctgggtgtctgaggagcccctgaactacgtgggctggcaggatggagagccccagcagcccggcggctgcacctacgtggatgtggatggagcctggaggaccaccagctgtgacaccaagctgcagggcgctgtgtgtggggtgagcagcggccccccaccaccccggcgcatctcctaccacggcagctgcccccagggcctggccgacagcgcctggatccccttccgggagcactgctacagcttccacatggagctgctgctgggccacaaggaggcccggcagcgctgccagagagctgggggcgctgtgctgagcatcctggatgagatggagaatgtgtttgtgtgggagcacctgcagagctatgagggccagagcagaggagcctggctgggcatgaacttcaaccccaagggcggcaccctggtgtggcaggacaacacagctgtgaactacagcaactggggccccccaggcctgggccccagcatgctgagccacaacagctgctactggatccagagcaacagcggcctgtggaggcctggggcctgcaccaacatcaccatgggcgtggtgtgcaagctgcccagggctgagcagagcagcttcagccccagcgccctgcctgagaacccagctgccctggtggtggtgctgatggctgtgctgctgctgctggccctgctgacagctgccctgatcctgtacagaagacggcagagcattgaaagaggagcctttgaaggagcccgctacagccgcagcagcagcagccccacagaggccacagagaagaacatcctggtgtctgacatggagatgaatgagcagcaggagtag

SEQ ID NO: 158714 - DNA, 834 bp, Artificial Sequence
  Description of Artificial Sequence: Synthetic coding sequence
atgttccccttctacagctgctggaggacaggcctgctgctgctgctgctggccgtggccgtgcgggagagctggcagacagaggagaagacctgtgacctggtgggggagaagggcaaggagagcgagaaggagctggccctggtgaagaggctgaagcccctcttcaacaagagctttgagagcacagtgggccagggcagtgacacctacatctacatcttccgggtgtgccgggaggccggcaaccacaccagcggggccggcctggtgcagatcaacaagagcaatggcaaggagaccgtggtgggccgcctgaatgagacccacatcttcaacggcagcaactggatcatgctgatctacaagggaggagatgaatatgacaaccactgtgggaaggagcagaggagagctgtggtgatgatcagctgcaacagacacaccctggccgacaacttcaaccctgtgtctgaggagcggggcaaggtgcaggactgcttctacctgtttgagatggacagcagcctggcctgcagccctgagatcagccacctgtctgtgggcagcatcctgctggtgacctttgccagcctggtggccgtgtatgtggtgggcggcttcctgtaccagaggctggtggtgggcgccaagggcatggagcagttcccccacctggccttctggcaggacctgggcaacctggtggctgatggctgtgactttgtgtgccgcagcaagcccagaaatgtgcctgctgcctacagaggagtgggagatgaccagctgggggaggagagcgaggagagagatgaccacctgctgcccatgtag

SEQ ID NO: 158715 - DNA, 279 bp, Artificial Sequence
  Description of Artificial Sequence: Synthetic coding sequence
atgttccccttctacagctgctggaggacaggcctgctgctgctgctgctggccgtggccgtgcgggagagctggcagacagaggagaagacctgtgacctggtgggggagaagggcaaggagagcgagaaggagctggccctggtgaagaggctgaagcccctcttcaacaagagctttgagagcacagtgggccagggcagtgacacctacatctacatcttccgggtgtgccgggaggccggcaaccacaccagcggggccggcctggtgcagtag

SEQ ID NO: 158716 - DNA, 330 bp, Artificial Sequence
  Description of Artificial Sequence: Synthetic coding sequence
atgttccccttctacagctgctggaggacaggcctgctgctgctgctgctggccgtggccgtgcgggagagctggcagacagaggagaagacctgtgacctggtgggggagaagggcaaggagagcgagaaggagctggccctggtgaagaggctgaagcccctcttcaacaagagctttgagagcacagtgggccagggcagtgacacctacatctacatcttccgggtgtgccgggaggccggcaaccacaccagcggggccggcctggtgcagatcaacaagagcaatggcaaggagaccgtggtgggccgcctgaatgagacctag

SEQ ID NO: 158717 - DNA, 747 bp, Artificial Sequence
  Description of Artificial Sequence: Synthetic coding sequence
atgagcctcttccccagcctgcccctgctgctgctgtccatggtggccgccagctacagcgagaccgtgacctgtgaagatgcccagaagacctgcccagctgtgattgcctgcagcagccctggcatcaatggcttccctgggaaggatggaagagatggcaccaagggggagaagggggagcccggccagggcctgcggggcctgcagggccccccaggcaagctgggccccccaggcaaccctggccccagcggcagccctggccccaagggccagaagggggaccccgggaagagcccagatggagacagcagcctggccgccagcgagaggaaggccctgcagacagagatggcccgcatcaagaagtggctgaccttcagcctgggcaagcaggtgggcaacaagttcttcctgaccaacggggagatcatgacctttgagaaggtgaaggccctgtgtgtgaagttccaggcctctgtggccaccccaagaaatgctgctgaaaatggagccatccagaacctgatcaaggaggaggccttcctgggcatcacagatgagaagacagagggccagtttgtggacctgactggaaaccggctgacctacaccaactggaatgaaggagagcccaacaatgccggcagtgatgaggactgtgtgctgctgctgaagaatggccagtggaatgatgtgccctgcagcaccagccacctggccgtgtgtgagttccccatctag

SEQ ID NO: 158718 - DNA, 744 bp, Artificial Sequence
  Description of Artificial Sequence: Synthetic coding sequence
atggctgctgaggctgatggccccctgaagaggctgctggtgcccatcctgctgcctgagaagtgctatgaccagctgtttgtgcagtgggacctgctgcacgtgccctgcctgaagatcctgctgagcaagggcctgggcctgggcatcgtggccggcagcctgctggtgaagctgccccaggtgttcaagatcctgggcgccaagtctgctgagggcctgagcctgcagagcgtgatgctggagctggtggccctgaccggcaccatggtgtacagcatcaccaacaacttccccttcagctcctggggcgaggccctcttcctgatgctgcagaccatcaccatctgcttcctggtgatgcactaccggggccagacagtgaagggcgtggccttcctggcctgctacggcctggtgctgctggtgctgctgagccccctgacccccctgactgtggtgaccctgctgcaggccagcaatgtgcctgctgtggtggtgggccgcctgctgcaggccgccaccaactaccacaacggccacacaggccagctgagcgccatcaccgtcttcctgctgtttggaggcagcctggcccgcatcttcaccagcatccaggagaccggggaccccctgatggccggcacctttgtggtgagcagcctgtgcaatggcctgattgctgcccagctgctcttctactggaatgccaagccaccccacaagcagaagaaggcccagtag

SEQ ID NO: 158719 - DNA, 381 bp, Artificial Sequence
  Description of Artificial Sequence: Synthetic coding sequence
atggctgctgaggctgatggccccctgaagaggctgctggtgcccatcctgctgcctgagaagtgctatgaccagctgtttgtgcagtgggacctgctgcacgtgccctgcctgaagatcctgctgagcaagggcctgggcctgggcatcgtggccggcagcctgctggtgaagctgccccaggtgttcaagatcctgggcgccaagtctgctgctggcctgaagaaggaggatgaggcccggcctgtgcgcagcgcctccatgagggtgcggggcggcctgggcgcctggggccaccagcagggcgagggctgcatggagtgggagagccagggcgccggcagcggctaccgctgggccgctgtgcccccaggggcctag

SEQ ID NO: 158720 - DNA, 900 bp, Artificial Sequence
  Description of Artificial Sequence: Synthetic coding sequence
atggctgctgaggctgatggccccctgaagaggctgctggtgcccatcctgctgcctgagaagtgctatgaccagctgtttgtgcagtgggacctgctgcacgtgccctgcctgaagatcctgctgagcaagggcctgggcctgggcatcgtggccggcagcctgctggtgaagctgccccaggtgttcaagatcctgggcgccaagtctgctgagggcctgagcctgcagagcgtgatgctggagctggtggccctgaccggcaccatggtgtacagcatcaccaacaacttccccttcagctcctggggcgaggccctcttcctgatgctgcagaccatcaccatctgcttcctggtgatgcactaccggggccagacagtgaagggcgtggccttcctggcctgctacggcctggtgctgctggtgctgctgagccccctgacccccctgactgtggtgccctgcagcggcctgcagtgtgcctgctgcggcggcggggaggccagccctggcagccaccagctgccccagagggcccacaggcctgccctgagccaccacagcctgcctgctgtgtggggcctgcccggccccaacctgcacttccacagcggcaacagaagaagcccagatggctgggacctgtgtggcctgctgagcctgcagaggccccacagaagacctgctgccctgctgctggagtgcaaggccagcccccaggccgagaagggagctgtggagcccgccactggagtcatccccttccccctcatccaccccaccagcggcttcagccccagcgagcccgcctgctggtgtgacctgctgatcctgcacagcagcgccctggccgacttcctgagccagggcttcctgctggtggagaccaacggctag

SEQ ID NO: 158721 - DNA, 636 bp, Artificial Sequence
  Description of Artificial Sequence: Synthetic coding sequence
atggctgctgaggctgatggccccctgaagaggctgctggtgcccatcctgctgcctgagaagtgctatgaccagctgtttgtgcagtgggacctgctgcacgtgccctgcctgaagatcctgctgagcaagggcctgggcctgggcatcgtggccggcagcctgctggtgaagctgccccaggtgttcaagatcctgggcgccaagtctgctgagggcctgagcctgcagagcgtgatgctggagctggtggccctgaccggcaccatggtgtacagcatcaccaacaacttccccttcagctcctggggcgaggccctcttcctgatgctgcagaccatcaccatctgcttcctggtgatgcactaccggggccagacagtgaagggcgtggccttcctggcctgctacggcctggtgctgctggtgctgctgagccccctgacccccctgactgtggtgaccctgctgcaggccagcaatgtgcctgctgtggtggtgggccgcctgctgcaggccgccaccaacaccaccaccggcacccaggccagcagccagcccagccagagcagctgctgcctgggcgccccctggccagagagcagcctgcccttcaggaagccagagatcccctag

SEQ ID NO: 158722 - DNA, 561 bp, Artificial Sequence
  Description of Artificial Sequence: Synthetic coding sequence
atggctgctgaggctgatggccccctgaagaggctgctggtgcccatcctgctgcctgagaagtgctatgaccagctgtttgtgcagtgggacctgctgcacgtgccctgcctgaagatcctgctgagcaagggcctgggcctgggcatcgtggccggcagcctgctggtgaagctgccccaggtgttcaagatcctgggcgccaagtctgctgagggcctgagcctgcagagcgtgatgctggagctggtggccctgaccggcaccatggtgtacagcatcaccaacaacttccccttccgctgccgcttcccccggctgctgcggcccggccctgctggggccagcctgaccagtgatgccctggactgcagccacccagcccctggcctgcagtgtgcctgctgcggcggcggggaggccagccctggcagccaccagctgccccagagggcccacaggcctgccctgagccaccacagcctgcctgctgtgtggggcctgcccggccccaacctgcacttccacagcggcgtgtccatccccttcagccagctgtag

SEQ ID NO: 158723 - DNA, 2826 bp, Artificial Sequence
  Description of Artificial Sequence: Synthetic coding sequence
atggctgctgccccagccctgaagcactggaggaccaccctggagcgggtggagaagtttgtgagccccctgtacttcacagactgcaacctgcggggccgcctgtttggagccagctgccctgtggccgtgctgagcagcttcctgaccccagagcggctgccctaccaggaggccgtgcagagggacttccggcctgcccaggtgggggacagctttggccccacctggtggacctgctggttccgggtggagctgaccatccctgaggcctgggtgggccaggaggtgcacctgtgctgggagagtgatggagagggcctggtgtggagagatggagagcctgtgcagggcctgaccaaggagggggagaagaccagctatgtgctgacagaccggctgggggagcgggaccccaggagcctgaccctgtatgtggaggtggcctgcaatggcctgctgggcgctgggaagggctccatgattgctgccccagaccctgagaagatgttccagctgagcagagctgagctggccgtgttccacagagatgtgcacatgctgctggtggacctggagctgctgctgggcatcgccaaggcccagcagctggagtgggtgaagagccgctacccaggcctgtacagccgcatccaggagtttgcctgccggggccagtttgtgcctgtgggcggcacctgggtggagatggatggcaacctgcccagcggggaggccatggtgcggcagttcctgcagggccagaacttcttcctgcaggagtttgggaagatgtgcagcgagttctggctgcctgacaccttcggctacagcgcccagctgccccagatcatgcacggctgcggcatccgccgcttcctgacccagaagctgtcctggaacctggtgaacagcttcccccaccacaccttcttctgggagggcctggatggcagccgggtgctggtgcacttccccccaggggacagctatggcatgcagggctctgtggaggaggtgctgaagacagtggccaacaacagagacaagggccgggccaaccacagcgccttcctgtttggatttggagatggcggcggcggccccacccagaccatgctggaccggctgaagaggctgagcaacacagatggcctgccccgggtgcagctgagcagcccccggcagctgttcagcgccctggagagtgacagcgagcagctgtgcacctgggtgggggagctgttcctggagctgcacaacggcacctacaccacccacgcccagatcaagaagggcaaccgggagtgtgagcgcatcctgcatgatgtggagctgctgagcagcctggccctggcccggagcgcccagttcctgtacccagctgcccagctgcagcacctgtggaggctgctgctgctgaaccagttccatgatgtggtgacaggcagctgcatccagatggtggccgaggaggccatgtgccactatgaggacatccgcagccacggcaacaccctgctgtctgctgctgctgctgccctgtgtgccggggagcccggccctgagggcctgctgattgtgaacaccctgccctggaagagaattgaggtgatggccctgcccaagccaggaggagcccacagcctggccctggtgacagtgcccagcatgggctacgcccctgtgcccccacccaccagcctgcagcccctgctgccccagcagcctgtgtttgtggtgcaggagacagatggctctgtgaccctggacaatggcatcatccgggtgaagctggaccccaccggccgcctgaccagcctggtgctggtggccagcggccgggaggccatcgccgagggcgctgtgggcaaccagtttgtgctgtttgatgatgtgcccctgtactgggatgcctgggatgtgatggactaccacctggagaccaggaagcctgtgctgggccaggccggcaccctggccgtgggcacagagggcggcctgcggggcagcgcctggttcctgctgcagatcagccccaacagccggctgagccaggaggtggtgctggatgtgggctgcccctacgtgcgcttccacacagaggtgcactggcatgaggcccacaagttcctgaaggtggagttccctgcccgggtgcgcagcagccaggccacctatgagatccagtttggccacctgcagaggcccacccactacaacacctcctgggactgggccaggtttgaggtgtgggcccaccgctggatggacctgtctgagcacggcttcggcctggccctgctgaatgactgcaagtacggggcctctgtgcggggcagcatcctgagcctgagcctgctgcgggcccccaaggccccagatgccacagctgacaccggcagacatgagttcacctacgccctgatgccccacaagggcagcttccaggatgctggggtcatccaggccgcctacagcctgaacttccccctgctggccctgcctgcccccagccctgccccagccacctcctggagcgccttctctgtgagcagccctgctgtggtgctggagaccgtgaagcaggccgagagcagcccccagaggaggagcctggtgctgcggctgtatgaggcccacggcagccacgtggactgctggctgcacctgagcctgcctgtgcaggaggccatcctgtgtgacctgctggagaggccagaccctgctggccacctgaccctgcgggacaaccggctgaagctgaccttcagccccttccaggtgctgagcctgctgctggtgctgcagcccccaccccactag

SEQ ID NO: 158724 - DNA, 3174 bp, Artificial Sequence
  Description of Artificial Sequence: Synthetic coding sequence
atggctgctgccccagccctgaagcactggaggaccaccctggagcgggtggagaagtttgtgagccccctgtacttcacagactgcaacctgcggggccgcctgtttggagccagctgccctgtggccgtgctgagcagcttcctgaccccagagcggctgccctaccaggaggccgtgcagagggacttccggcctgcccaggtgggggacagctttggccccacctggtggacctgctggttccgggtggagctgaccatccctgaggcctgggtgggccaggaggtgcacctgtgctgggagagtgatggagagggcctggtgtggagagatggagagcctgtgcagggcctgaccaaggagggggagaagaccagctatgtgctgacagaccggctgggggagcgggaccccaggagcctgaccctgtatgtggaggtggcctgcaatggcctgctgggcgctgggaagggctccatgattgctgccccagaccctgagaagatgttccagctgagcagagctgagctggccgtgttccacagagatgtgcacatgctgctggtggacctggagctgctgctgggcatcgccaagggcctgggcaaggacaaccagaggagcttccaggccctgtacacagccaaccagatggtgaatgtgtgtgaccctgcccagcctgagaccttccctgtggcccaggccctggccagccgcttcttcggccagcacggcggggagagccagcacaccatccacgccaccggccactgccacatcgacacagcctggctgtggcccttcaaggagaccgtgaggaaatgtgcccgctcctgggtgacagccctgcagctgatggagagaaatcctgagttcatctttgcctgcagccaggcccagcagctggagtgggtgaagagccgctacccaggcctgtacagccgcatccaggagtttgcctgccggggccagtttgtgcctgtgggcggcacctgggtggagatggatggcaacctgcccagcggggaggccatggtgcggcagttcctgcagggccagaacttcttcctgcaggagtttgggaagatgtgcagcgagttctggctgcctgacaccttcggctacagcgcccagctgccccagatcatgcacggctgcggcatccgccgcttcctgacccagaagctgtcctggaacctggtgaacagcttcccccaccacaccttcttctgggagggcctggatggcagccgggtgctggtgcacttccccccaggggacagctatggcatgcagggctctgtggaggaggtgctgaagacagtggccaacaacagagacaagggccgggccaaccacagcgccttcctgtttggatttggagatggcggcggcggccccacccagaccatgctggaccggctgaagaggctgagcaacacagatggcctgccccgggtgcagctgagcagcccccggcagctgttcagcgccctggagagtgacagcgagcagctgtgcacctgggtgggggagctgttcctggagctgcacaacggcacctacaccacccacgcccagatcaagaagggcaacagagaatgtgagcgcatcctgcatgatgtggagctgctgagcagcctggccctggcccggagcgcccagttcctgtacccagctgcccagctgcagcacctgtggaggctgctgctgctgaaccagttccatgatgtggtgacaggcagctgcatccagatggtggccgaggaggccatgtgccactatgaggacatccgcagccacggcaacaccctgctgtctgctgctgctgctgccctgtgtgccggggagcccggccctgagggcctgctgattgtgaacaccctgccctggaagagaattgaggtgatggccctgcccaagccaggaggagcccacagcctgggcctgacccccagccctggggacagcgcccagcacggcctgtgcagctgcagcagcccccacctgacagctgccccagctgccccagctgcctgtgtgcgcagcgcccgggcccccacagattctgccagccggcccccacccaccaagacagatggctctgtgaccctggacaatggcatcatccgggtgaagctggaccccaccggccgcctgaccagcctggtgctggtggccagcggccgggaggccatcgccgagggcgctgtgggcaaccagtttgtgctgtttgatgatgtgcccctgtactgggatgcctgggatgtgatggactaccacctggagaccaggaagcctgtgctgggccaggccggcaccctggccgtgggcacagagggcggcctgcggggcagcgcctggttcctgctgcagatcagccccaacagccggctgagccaggaggtggtgctggatgtgggctgcccctacgtgcgcttccacacagaggtgcactggcatgaggcccacaagttcctgaaggtggagttccctgcccgggtgcgcagcagccaggccacctatgagatccagtttggccacctgcagaggcccacccactacaacacctcctgggactgggccaggtttgaggtgtgggcccaccgctggatggacctgtctgagcacggcttcggcctggccctgctgaatgactgcaagtacggggcctctgtgcggggcagcatcctgagcctgagcctgctgcgggcccccaaggccccagatgccacagctgacaccggcagacatgagttcacctacgccctgatgccccacaagggcagcttccaggatgctggggtcatccaggccgcctacagcctgaacttccccctgctggccctgcctgcccccagccctgccccagccacctcctggagcgccttctctgtgagcagccctgctgtggtgctggagaccgtgaagcaggccgagagcagcccccagaggaggagcctggtgctgcggctgtatgaggcccacggcagccacgtggactgctggctgcacctgagcctgcctgtgcaggaggccatcctgtgtgacctgctggagaggccagaccctgctggccacctgaccctgcgggacaaccggctgaagctgaccttcagccccttccaggtgctgagcctgctgctggtgctgcagcccccaccccactag

SEQ ID NO: 158725 - DNA, 3054 bp, Artificial Sequence
  Description of Artificial Sequence: Synthetic coding sequence
atggctgctgccccagccctgaagcactggaggaccaccctggagcgggtggagaagtttgtgagccccctgtacttcacagactgcaacctgcggggccgcctgtttggagccagctgccctgtggccgtgctgagcagcttcctgaccccagagcggctgccctaccaggaggccgtgcagagggacttccggcctgcccaggtgggggacagctttggccccacctggtggacctgctggttccgggtggagctgaccatccctgaggcctgggtgggccaggaggtgcacctgtgctgggagagtgatggagagggcctggtgtggagagatggagagcctgtgcagggcctgaccaaggagggggagaagaccagctatgtgctgacagaccggctgggggagcgggaccccaggagcctgaccctgtatgtggaggtggcctgcaatggcctgctgggcgctgggaagggctccatgattgctgccccagaccctgagaagatgttccagctgagcagagctgagctggccgtgttccacagagatgtgcacatgctgctggtggacctggagctgctgctgggcatcgccaagggcctgggcaaggacaaccagaggagcttccaggccctgtacacagccaaccagatggtgaatgtgtgtgaccctgcccagcctgagaccttccctgtggcccaggccctggccagccgcttcttcggccagcacggcggggagagccagcacaccatccacgccaccggccactgccacatcgacacagcctggctgtggcccttcaaggagaccgtgaggaaatgtgcccgctcctgggtgacagccctgcagctgatggagagaaatcctgagttcatctttgcctgcagccaggcccagcagctggagtgggtgaagagccgctacccaggcctgtacagccgcatccaggagtttgcctgccggggccagtttgtgcctgtgggcggcacctgggtggagatggatggcaacctgcccagcggggaggccatggtgcggcagttcctgcagggccagaacttcttcctgcaggagtttgggaagatgtgcagcgagttctggctgcctgacaccttcggctacagcgcccagctgccccagatcatgcacggctgcggcatccgccgcttcctgacccagaagctgtcctggaacctggtgaacagcttcccccaccacaccttcttctgggagggcctggatggcagccgggtgctggtgcacttccccccaggggacagctatggcatgcagggctctgtggaggaggtgctgaagacagtggccaacaacagagacaagggccgggccaaccacagcgccttcctgtttggatttggagatggcggcggcggccccacccagaccatgctggaccggctgaagaggctgagcaacacagatggcctgccccgggtgcagctgagcagcccccggcagctgttcagcgccctggagagtgacagcgagcagctgtgcacctgggtgggggagctgttcctggagctgcacaacggcacctacaccacccacgcccagatcaagaagggcaacagagaatgtgagcgcatcctgcatgatgtggagctgctgagcagcctggccctggcccggagcgcccagttcctgtacccagctgcccagctgcagcacctgtggaggctgctgctgctgaaccagttccatgatgtggtgacaggcagctgcatccagatggtggccgaggaggccatgtgccactatgaggacatccgcagccacggcaacaccctgctgtctgctgctgctgctgccctgtgtgccggggagcccggccctgagggcctgctgattgtgaacaccctgccctggaagagaattgaggtgatggccctgcccaagccaggaggagcccacagcctggccctggtgacagtgcccagcatgggctacgcccctgtgcccccacccaccagcctgcagcccctgctgccccagcagcctgtgtttgtggtgcaggagacagatggctctgtgaccctggacaatggcatcatccgggtgaagctggaccccaccggccgcctgaccagcctggtgctggtggccagcggccgggaggccatcgccgagggcgctgtgggcaaccagtttgtgctgtttgatgatgtgcccctgtactgggatgcctgggatgtgatggactaccacctggagaccaggaagcctgtgctgggccaggccggcaccctggccgtgggcacagaaggaggcctgcggggcagcgcctggttcctgctgcagatcagccccaacagccggctgagccaggaggtggtgctggatgtgggctgcccctacgtgcgcttccacacagaggtgcactggcatgaggcccacaagttcctgaaggtggagttccctgcccgggtgcgcagcagccaggccacctatgagatccagtttggccacctgcagaggcccacccactacaacacctcctgggactgggccaggtttgaggtgtgggcccaccgctggatggacctgtctgaacatggcttcggcctggccctgctgaatgactgcaagtatggagcctctgtgcggggcagcatcctgagcctgagcctgctgcgggcccccaaggccccagatgccacagctgacaccggcagacatgagttcacctacgccctgatgccccacaaggcccccagccctgccccagccacctcctggagcgccttctctgtgagcagccctgctgtggtgctggagaccgtgaagcaggccgagagcagcccccagaggaggagcctggtgctgcggctgtatgaggcccacggcagccacgtggactgctggctgcacctgagcctgcctgtgcaggaggccatcctgtgtgacctgctggagaggccagaccctgctggccacctgaccctgcgggacaaccggctgaagctgaccttcagccccttccaggtgctgagcctgctgctggtgctgcagcccccaccccactag

SEQ ID NO: 158726 - DNA, 1104 bp, Artificial Sequence
  Description of Artificial Sequence: Synthetic coding sequence
atgcctgtgggcggcctgctgcccctcttcagcagccctgctgggggcgtgctgggcggcggcctgggcggcggcggcggcaggaaaggaagtggccctgctgccctgcggctgacagagaagtttgtgctgctgctggtgttttctgccttcatcaccctgtgcttcggggccatcttcttcctgcctgacagcagcaagctgctgagcggcgtgctcttccacagcagccctgccctgcagcctgctgctgaccacaagccaggccctggggcccgggcagaagatgctgctgagggccgggcccggcggcgggaggagggcgcccctggggaccctgaggccgccctggaggacaacctggcccgcatccgggagaaccacgagcgggccctgcgggaggccaaggagaccctgcagaagctgcctgaggagatccagagggacatcctgctggagaagaagaaggtggcccaggaccagctgcgggacaaggcccccttccggggcctgccccctgtggactttgtgccccccatcggcgtggagagccgggagccagcagatgctgccatccgggagaagagggccaagatcaaggaggagattgaggccaggaagggccaggccaactgccccggcagcagcagcagctgtgaggtggagatccagatgatgaagcacgcctggaacaactacaagggctacgcctggggcctgaatgagctgaagcccatcagcaagggcggccacagcagcagcctgtttggaaacatcaagggggccaccatcgtggatgccctggacaccctcttcatcatggagatgaagcatgaatttgaggaggccaagtcctgggtggaggagaacctggacttcaacgtgaatgctgagatctctgtgtttgaggtgaacatccgctttgtgggcggcctgctgagcgcctactacctgtctggagaggagatcttcaggaagaaggctgtggagctgggcgtgaagctgctgcctgccttccacaccccatctggcatcccctgggccctgctgaacatgaagcgctggatgtgcaacatcccccgggccatggaggccaccatctag

SEQ ID NO: 158727 - DNA, 1962 bp, Artificial Sequence
  Description of Artificial Sequence: Synthetic coding sequence
atgcctgtgggcggcctgctgcccctcttcagcagccctgctgggggcgtgctgggcggcggcctgggcggcggcggcggcaggaaaggaagtggccctgctgccctgcggctgacagagaagtttgtgctgctgctggtgttttctgccttcatcaccctgtgcttcggggccatcttcttcctgcctgacagcagcaagctgctgagcggcgtgctcttccacagcagccctgccctgcagcctgctgctgaccacaagccaggccctggggcccgggcagaagatgctgctgagggccgggcccggcggcgggaggagggcgcccctggggaccctgaggccgccctggaggacaacctggcccgcatccgggagaaccacgagcgggccctgcgggaggccaaggagaccctgcagaagctgcctgaggagatccagagggacatcctgctggagaagaagaaggtggcccaggaccagctgcgggacaaggcccccttccggggcctgccccctgtggactttgtgccccccatcggcgtggagagccgggagccagcagatgctgccatccgggagaagagggccaagatcaaggagatgatgaagcacgcctggaacaactacaagggctacgcctggggcctgaatgagctgaagcccatcagcaaaggaggccacagcagcagcctgtttggaaacatcaagggggccaccatcgtggatgccctggacaccctcttcatcatggagatgaagcatgaatttgaggaggccaagtcctgggtggaggagaacctggacttcaacgtgaatgctgagatctctgtgtttgaggtgaacatccgctttgtgggcggcctgctgagcgcctactacctgagcggggaggagatcttcaggaagaaggctgtggagctgggcgtgaagctgctgcctgccttccacacccccagcggcatcccctgggccctgctgaacatgaagtctggaattggaagaaactggccctgggccagcggcggcagcagcatcctggccgagtttggcaccctgcacctggagttcatgcacctgagccacctgagcggcaaccccatctttgctgagaaggtgatgaacatcagaacagtgctgaacaagctggagaagccccagggcctgtaccccaactacctgaaccccagcagcggccagtggggccagcaccacgtgtctgtgggcggcctgggggacagcttctatgagtacctgctgaaggcctggctgatgtctgacaagacagacctggaggccaagaagatgtactttgatgctgtgcaggccatcgagacccacctgatcaggaagagcagcagcggcctgacctacatcgccgagtggaagggcggcctgctggagcacaagatgggccacctgacctgctttgctgggggcatgtttgccctgggcgcagatgctgcccctgagggcatggcccagcactacctggagctgggcgctgagatcgcccggacctgccacgagagctacaacagaaccttcatgaagctgggccctgaggccttccgctttgatggaggagtggaggccatcgccacccggcagaatgagaagtactacatcctgcggcctgaggtgatggagacctacatgtacatgtggaggctgacccatgaccccaagtacaggaagtgggcctgggaggccgtggaggccctggagaaccactgccgggtgaatggaggctacagcggcctgagagatgtgtacctgctgcacgagagctatgatgatgtgcagcagagcttcttcctggccgagaccctgaagtacctgtacctgatcttcagtgatgatgacctgctgcccctggagcactggatcttcaacagcgaggcccacctgctgcccatcctgcccaaggacaagaaggaggtggagatccgggaggagtag

SEQ ID NO: 158728 - DNA, 579 bp, Artificial Sequence
  Description of Artificial Sequence: Synthetic coding sequence
atgtttgccctgggcgcagatggcagcagagctgacaaggccggccactacctggagctgggcgctgagatcgcccggacctgccacgagagctatgacagaacagccctgaagctgggccctgagagcttcaagtttgatggagctgtggaggccgtggccgtgcggcaggccgagaagtactacatcctgcggcctgaggtgattgagacctactggtacctgtggaggttcacccatgacccccgctaccggcagtggggctgggaggccgccctggccatcgagaagtactgccgggtgaatggaggcttcagcggcgtgaaggatgtgtacagcagcacccccacccatgatgatgtgcagcagagcttcttcctggccgagaccctgaagtacctgtacctgctcttctctggagatgacctgctgcccctggaccactgggtgttcaacacagaggcccaccccctgcctgtgctgcacctggccaacaccaccctgagcggcaccagccagggcatgaggcggcagaacccctacttccaggtgctgtacctgtactacccagatgactag

SEQ ID NO: 158729 - DNA, 1926 bp, Artificial Sequence
  Description of Artificial Sequence: Synthetic coding sequence
atgaccaccccagccctgctgcccctgagcggccgccgcatcccccccctgaacctgggccccccatccttcccccaccaccgggccaccctgcggctgtctgagaagttcatcctgctgctgatcctgagcgccttcatcaccctgtgctttggagccttcttcttcctgcctgacagcagcaagcacaagagatttgacctgggcctggaggatgtgctgatcccccacgtggatgctgggaagggggccaagaaccctggggtcttcctgattcatggcccagatgagcaccgccaccgggaggaggaggagcggctgaggaacaagatccgggctgaccacgagaaggccctggaggaggccaaggagaagctgaggaagagccgggaggagatccgggcagagatccagacagagaagaacaaggtggtgcaggagatgaagatcaaggagaacaagcccctgccccctgtgcccatccccaacctggtgggcatccggggcggggaccctgaagataatgacatccgggagaagcgggagaagatcaaggagatgatgaagcacgcctgggacaactaccgcacctacggctggggccacaatgagctgcggcccatcgccaggaagggccacagccccaacatcttcggcagcagccagatgggcgccaccatcgtggatgccctggacaccctgtacatcatgggcctgcatgatgagttcctggatggccagcgctggattgaggacaacctggacttctctgtgaacagcgaggtgtctgtgtttgaggtgaacatccgcttcatcggcggcctgctggccgcctactacctgagcggggaggagatcttcaagatcaaggctgtgcagctggccgagaagctgctgcctgccttcaacacccccaccggcatcccctgggccatggtgaacctgaagtctggagtgggcaggaactggggctgggccagcgctggcagcagcatcctggccgagtttggcaccctgcacatggagttcatccacctgagctacctgaccggggacctgacctactacaagaaggtgatgcacatcaggaagctgctgcagaagatggaccggcccaacggcctgtaccccaactacctgaaccccaggacaggccgctggggccagtaccacacctctgtgggcggcctgggggacagcttctatgagtacctgctgaaggcctggctgatgtctgacaagacagaccacgaggccaggaagatgtatgatgatgccatcgaggccatcgagaagcacctgatcaagaagagccggggcggcctgaccttcatcggggagtggaagaatggccacctggagaagaagatgggccacctggcctgctttgctgggggcatgtttgccctgggcgcagatggcagcagagctgacaaggccggccactacctggagctgggcgctgagatcgcccggacctgccacgagagctatgacagaacagccctgaagctgggccctgagagcttcaagtttgatggagctgtggaggccgtggccgtgcggcaggccgagaagtactacatcctgcggcctgaggtgattgagacctactggtacctgtggaggttcacccatgacccccgctaccggcagtggggctgggaggccgccctggccatcgagaagtactgccgggtgaatggaggcttcagcggcgtgaaggatgtgtacagcagcacccccacccatgatgatgtgcagcagagcttcttcctggccgagaccctgaagtacctgtacctgctcttctctggagatgacctgctgcccctggaccactgggtgttcaacacagaggcccaccccctgcctgtgctgcacctggccaacaccaccctgagcggcaacccagctgtgaggtag

SEQ ID NO: 158730 - DNA, 1128 bp, Artificial Sequence
  Description of Artificial Sequence: Synthetic coding sequence
atgggcctgcatgatgagttcctggatggccagcgctggattgaggacaacctggacttctctgtgaacagcgaggtgtctgtgtttgaggtgaacatccgcttcatcggcggcctgctggccgcctactacctgagcggggaggagatcttcaagatcaaggctgtgcagctggccgagaagctgctgcctgccttcaacacccccaccggcatcccctgggccatggtgaacctgaagtctggagtgggcaggaactggggctgggccagcgctggcagcagcatcctggccgagtttggcaccctgcacatggagttcatccacctgagctacctgaccggggacctgacctactacaagaaggtgatgcacatcaggaagctgctgcagaagatggaccggcccaacggcctgtaccccaactacctgaaccccaggacaggccgctggggccagtaccacacctctgtgggcggcctgggggacagcttctatgagtacctgctgaaggcctggctgatgtctgacaagacagaccacgaggccaggaagatgtatgatgatgccatcgaggccatcgagaagcacctgatcaagaagagccggggcggcctgaccttcatcggggagtggaagaatggccacctggagaagaagatgggccacctggcctgctttgctgggggcatgtttgccctgggcgcagatggcagcagagctgacaaggccggccactacctggagctgggcgctgagatcgcccggacctgccacgagagctatgacagaacagccctgaagctgggccctgagagcttcaagtttgatggagctgtggaggccgtggccgtgcggcaggccgagaagtactacatcctgcggcctgaggtgattgagacctactggtacctgtggaggttcacccatgacccccgctaccggcagtggggctgggaggccgccctggccatcgagaagtactgccgggtgaatggaggcttcagcggcgtgaaggatgtgtacagcagcacccccacccatgatgatgtgcagcagagcttcttcctggccgagaccctgaagctggccagctaccacgagaggacagtgtttcctgctggatag

SEQ ID NO: 158731 - DNA, 615 bp, Artificial Sequence
  Description of Artificial Sequence: Synthetic coding sequence
tgaatcaagaagagcagaggaggcctgaccttcatcggggagtggaagaatggccacctggagaagaagatgggccacctggcctgctttgctgggggcatgtttgccctgggcgcagatggcagcagagctgacaaggccggccactacctggagctgggcgctgagatcgcccggacctgccacgagagctatgacagaacagccctgaagctgggccctgagagcttcaagtttgatggagctgtggaggccgtggccgtgcggcaggccgagaagtactacatcctgcggcctgaggtgattgagacctactggtacctgtggaggttcacccatgacccccgctaccggcagtggggctgggaggccgccctggccatcgagaagtactgccgggtgaatggaggcttctctggagtgaaggatgtgtacagcagcacccccacccatgatgatgtgcagcagagcttcttcctggccgagaccctgaagtacctgtacctgctcttctctggagatgacctgctgcccctggaccactgggtgttcaacacagaggcccaccccctgcctgtgctgcacctggccaacaccaccctgtctgagagctag

SEQ ID NO: 158732 - DNA, 294 bp, Artificial Sequence
  Description of Artificial Sequence: Synthetic coding sequence
gagaagtactgccgggtgaatggaggcttctctggagtgaaggatgtgtacagcagcacccccacccatgatgatgtgcagcagagcttcttcctggccgagaccctgaagtacctgtacctgctcttctctggagatgacctgctgcccctggaccactgggtgttcaacacagaggcccaccccctgcctgtgctgcacctggccaacaccaccctgagcggcaccagccagggcatgaggcggcagaacccctacttccaggtgctgtacctgtactacccagatgactag

SEQ ID NO: 158733 - DNA, 1035 bp, Artificial Sequence
  Description of Artificial Sequence: Synthetic coding sequence
tgaatccgcttcatcggcggcctgctggccgcctactacctgtctggagaggagatcttcaagatcaaggctgtgcagctggccgagaagctgctgcctgccttcaacacccccaccggcatcccctgggccatggtgaacctgaagagcggcgtgggcaggaactggggctgggccagcgctggcagcagcatcctggccgagtttggcaccctgcacatggagttcatccacctgagctacctgactggagacctgacctactacaagaaggtgatgcacatcaggaagctgctgcagaagatggaccggcccaacggcctgtaccccaactacctgaaccccaggacaggccgctggggccagtaccacacctctgtgggcggcctgggggacagcttctatgagtacctgctgaaggcctggctgatgtctgacaagacagaccacgaggccaggaagatgtatgatgatgccatcgaggccatcgagaagcacctgatcaagaagagcagaggaggcctgaccttcatcggggagtggaagaatggccacctggagaagaagatgggccacctggcctgctttgctgggggcatgtttgccctgggcgcagatggcagcagagctgacaaggccggccactacctggagctgggcgctgagatcgcccggacctgccacgagagctatgacagaacagccctgaagctgggccctgagagcttcaagtttgatggagctgtggaggccgtggccgtgcggcaggccgagaagtactacatcctgcggcctgaggtgattgagacctactggtacctgtggaggttcacccatgacccccgctaccggcagtggggctgggaggccgccctggccatcgagaagtactgccgggtgaatggaggcttctctggagtgaaggatgtgtacagcagcacccccacccatgatgatgtgcagcagagcttcttcctggccgagaccctgaagctggccagctaccacgagaggacagtgtttcctgctggatag

SEQ ID NO: 158734 - DNA, 2100 bp, Artificial Sequence
  Description of Artificial Sequence: Synthetic coding sequence
atggccgcctgtgagggcagaagaagtggggccctgggcagcagccagagcgacttcctgaccccacctgtgggcggggccccctgggccgtggccaccaccgtggtgatgtacccacctcctcctcctccaccccaccgggacttcatctctgtgaccctgagctttggagagaactatgacaacagcaagtcctggaggcggcgcagctgctggaggaagtggaagcagctgagccggctgcagaggaacatgatcctcttcctgctggccttcctgctcttctgtggcctgctcttctacatcaacctggccgaccactggaaggccctggccttccggctggaggaggagcagaagatgaggcctgagattgctggcctgaagccagccaacccccctgtgctgcctgccccccagaaggctgacacagatcctgagaacctgcctgagatcagcagccagaagacccagaggcacatccagaggggccccccccacctgcagatccggccccccagccaggacctgaaggatggcacccaggaggaggccaccaagaggcaggaggcccctgtggaccccaggcctgagggggacccccagaggacagtcatctcctggagaggagctgtgattgagcctgagcagggcacagagctgcccagccggcgggcagaggtgcccaccaagccacccctgcccccagcccggacccagggcacccctgtgcacctgaactaccggcagaagggcgtgattgatgtgttcctgcacgcctggaagggctacaggaagtttgcctggggccatgatgagctgaagcctgtgagccgctccttcagcgagtggtttggcctgggcctgaccctgattgatgccctggacaccatgtggatcctgggcctgaggaaggagtttgaggaggccaggaagtgggtgtccaagaagctgcactttgagaaggatgtggatgtgaacctgtttgagagcaccatccgcatcctgggcggcctgctgagcgcctaccacctgagcggggacagcctcttcctgaggaaggccgaggactttggaaaccggctgatgcctgccttccgcacccccagcaagatcccctacagtgatgtgaacattggaactggagtggcccaccccccacgctggaccagtgacagcacagtggccgaggtgaccagcatccagctggagttccgggagctgagccggctgaccggggacaagaagttccaggaggccgtggagaaggtgacccagcacatccacggcctgagcggcaagaaggatggcctggtgcccatgttcatcaacacccacagcggcctcttcacccacctgggcgtcttcaccctgggcgcccgggctgacagctactatgagtacctgctgaagcagtggatccagggcggcaagcaggagacccagctgctggaggactatgtggaggccattgaaggagtgaggacccacctgctgcggcacagcgagcccagcaagctgacctttgtgggggagctggcccacggccgcttcagcgccaagatggaccacctggtgtgcttcctgcccggcaccctggccctgggcgtgtaccacggcctgcctgccagccacatggagctggcccaggagctgatggagacctgctaccagatgaaccggcagatggagaccggcctgagccctgagatcgtgcacttcaacctgtacccccagcccggcagaagagatgtggaggtgaagccagctgacagacacaacctgctgcggcctgagaccgtggagagcctcttctacctgtacagagtgactggagacaggaagtaccaggactggggctgggagatcctgcagagcttcagccgcttcaccagggtgcccagcggcggctacagcagcatcaacaacgtgcaggacccccagaagccagagccccgggacaagatggagagcttcttcctgggggagaccctgaagtacctgttcctgctcttcagtgatgaccccaacctgctgagcctggatgcctacgtgttcaacacagaggcccaccccctgcccatctggaccccagcctag

SEQ ID NO: 158735 - DNA, 1209 bp, Artificial Sequence
  Description of Artificial Sequence: Synthetic coding sequence
atgtggatcctgggcctgaggaaggagtttgaggaggccaggaagtgggtgtccaagaagctgcactttgagaaggatgtggatgtgaacctgtttgagagcaccatccgcatcctgggcggcctgctgagcgcctaccacctgagcggggacagcctcttcctgaggaaggcagaagattttggaaaccggctgatgcctgccttccgcacccccagcaagatcccctacagtgatgtgaacatcggcaccggggtggcccaccccccacgctggaccagtgacagcacagtggccgaggtgaccagcatccagctggagttccgggagctgagccggctgactggagacaagaagttccaggaggccgtggagaaggtgacccagcacatccacggcctgagcggcaagaaggatggcctggtgcccatgttcatcaacacccacagcggcctcttcacccacctgggcgtcttcaccctgggcgcccgggctgacagctactatgagtacctgctgaagcagtggatccagggcggcaagcaggagacccagctgctggaggactatgtggaggccatcgagggcgtgaggacccacctgctgcggcacagcgagcccagcaagctgacctttgtgggggagctggcccacggccgcttcagcgccaagatggaccacctggtgtgcttcctgcccggcaccctggccctgggcgtgtaccacggcctgcctgccagccacatggagctggcccaggagctgatggagacctgctaccagatgaaccggcagatggagaccggcctgagccctgagatcgtgcacttcaacctgtacccccagcctggaagaagagatgtggaggtgaagccagctgacagacacaacctgctgcggcctgagaccgtggagagcctcttctacctgtacagagtgactggagacaggaagtaccaggactggggctgggagatcctgcagagcttcagccgcttcaccagggtgcccagcggcggctacagcagcatcaacaacgtgcaggacccccagaagccagagccccgggacaagatggagagcttcttcctgggggagaccctgaagtacctgttcctgctcttcagtgatgaccccaacctgctgagcctggatgcctacgtgttcaacacagaggcccaccccctgcccatctggaccccagcctag

SEQ ID NO: 158736 - DNA, 2118 bp, Artificial Sequence
  Description of Artificial Sequence: Synthetic coding sequence
tgaccctgggccgtggccaccaccgtggtgatgtacccacctcctcctcctccaccccaccgggacttcatctctgtgaccctgagctttggagagaactatgacaacagcaagtcctggaggcggcgcagctgctggaggaagtggaagcagctgagccggctgcagaggaacatgatcctcttcctgctggccttcctgctcttctgtggcctgctcttctacatcaacctggccgaccactggaaggccctggccttccggctggaggaggagcagaagatgaggcctgagattgctggcctgaagccagccaacccccctgtgctgcctgccccccagaaggctgacacagatcctgagaacctgcctgagatcagcagccagaagacccagaggcacatccagaggggccccccccacctgcagatccggccccccagccaggacctgaaggatggcacccaggaggaggccaccaagaggcaggaggcccctgtggaccccaggcctgagggggacccccagaggacagtcatctcctggagaggagctgtgattgagcctgagcagggcacagagctgcccagccggcgggcagaggtgcccaccaagccacccctgcccccagcccggacccagggcacccctgtgcacctgaactaccggcagaagggcgtgattgatgtgttcctgcacgcctggaagggctacaggaagtttgcctggggccatgatgagctgaagcctgtgagccgctccttcagcgagtggtttggcctgggcctgaccctgattgatgccctggacaccatgtggatcctgggcctgaggaaggagtttgaggaggccaggaagtgggtgtccaagaagctgcactttgagaaggatgtggatgtgaacctgtttgagagcaccatccgcatcctgggcggcctgctgagcgcctaccacctgagcggggacagcctcttcctgaggaaggccgaggactttggaaaccggctgatgcctgccttccgcacccccagcaagatcccctacagtgatgtgaacattggaactggagtggcccaccccccacgctggaccagtgacagcacagtggccgaggtgaccagcatccagctggagttccgggagctgagccggctgaccggggacaagaagttccaggaggccgtggagaaggtgacccagcacatccacggcctgagcggcaagaaggatggcctggtgcccatgttcatcaacacccacagcggcctcttcacccacctgggcgtcttcaccctgggcgcccgggctgacagctactatgagtacctgctgaagcagtggatccagggcggcaagcaggagacccagctgctggaggactatgtggaggccattgaaggagtgaggacccacctgctgcggcacagcgagcccagcaagctgacctttgtgggggagctggcccacggccgcttcagcgccaagatggaccacctggtgtgcttcctgcccggcaccctggccctgggcgtgtaccacggcctgcctgccagccacatggagctggcccaggagctgatggagacctgctaccagatgaaccggcagatggagaccggcctgagccctgagatcgtgcacttcaacctgtacccccagcccggcagaagagatgtggaggtgaagccagctgacagacacaacctgctgcggcctgagaccgtggagagcctcttctacctgtacagagtgactggagacaggaagtaccaggactggggctgggagatcctgcagagcttcagccgcttcaccagggtgtccacctgccccaggcctgcctggagccggcccccaggccacagacatggctgggccgtgggcctgcggctggcccccctgctggtggtggccgtgacctggatccgggagggccgggcctgccgcagcctgggcgtggccaccctgcagctgggcggccctggcatccccatccccacagagctgcacggctgcggcacccagagcacctggaggggctgggcccccctcatcttcatcagccagggcctgagccgggagggcctgtgctgcggccccagcatcccccctgtgtag

SEQ ID NO: 158737 - DNA, 3435 bp, Artificial Sequence
  Description of Artificial Sequence: Synthetic coding sequence
atgaagctgagccggcagttcaccgtgtttggcagcgccatcttctgtgtggtgatcttcagcctgtacctgatgctggaccggggccacctggactaccccaggaacccccggcgggagggcagcttcccccagggccagctgtccatgctgcaggagaagattgaccacctggagcggctgctggccgagaacaatgagatcatcagcaacatccgggacagcgtcatcaacctgtctgagagcgtggaggatggccccaagagcagccagagcaacttcagccagggcgccggcagccacctgctgcccagccagctgagcctgtctgtggacacagctgactgcctgtttgccagccagagcggcagccacaacagtgatgtgcagatgctggatgtgtacagcctcatcagctttgacaacccagatggcggcgtgtggaagcagggctttgacatcacctatgagagcaatgagtgggacacagagcccctgcaggtgtttgtggtgccccacagccacaatgaccccggctggctgaagaccttcaatgactacttccgggacaagacccagtacatcttcaacaacatggtgctgaagctgaaggaggacagcaggaggaagttcatctggagcgagatctcctacctgagcaagtggtgggacatcatcgacatccagaagaaggatgctgtgaagagcctgattgaaaatggccagctggagatcgtgactggaggctgggtgatgccagatgaggccaccccccactactttgccctgattgaccagctgattgagggccaccagtggctggagaacaacatcggcgtgaagcccaggagcggctgggccatcgaccccttcggccacagccccaccatggcctacctgctgaacagagctggcctgagccacatgctgatccagagggtgcactatgctgtgaagaagcactttgccctgcacaagaccctggagttcttctggaggcagaactgggacctgggctctgtgacagacatcctgtgccacatgatgcccttctacagctatgacatcccccacacctgtggccctgaccccaagatctgctgccagtttgacttcaagaggctgcccggcggccgcttcggctgcccctggggcgtgcccccagagaccatccaccctggaaatgtgcagagccgggccaggatgctgctggaccagtacaggaagaagagcaagctgttccgcaccaaggtgctgctggcccccctgggagatgacttccgctactgtgagtacacagagtgggacctgcagttcaagaactaccagcagctgtttgactacatgaacagccagagcaagttcaaggtgaagatccagtttggcaccctgagtgacttctttgatgccctggacaaggcagatgagacccagagggacaagggccagagcatgtttcctgtgctgagcggggacttcttcacctatgctgacagagatgaccactactggagcggctacttcaccagccggcccttctacaagaggatggaccgcatcatggagagccacctgcgggctgctgagatcctgtactactttgccctgcggcaggcccacaagtacaagatcaacaagttcctgagcagcagcctgtacacagccctgacagaggcccggaggaacctgggcctcttccagcaccatgatgccatcactggaacagccaaggactgggtggtggtggactatggcaccaggctcttccacagcctgatggtgctggagaagatcatcggcaacagcgccttcctgctgatcctgaaggacaagctgacctatgacagctacagcccagacaccttcctggagatggacctgaagcagaagagccaggacagcctgccccagaagaacatcatccggctgtctgctgagccccgctacctggtggtgtacaaccccctggagcaggaccgcatcagcctggtgtctgtgtatgtgagcagccccaccgtgcaggtgttttctgccagcggcaagcctgtggaggtgcaggtgtctgctgtgtgggacacagccaacaccatcagcgagacagcctatgagatctccttccgggcccacatcccccccctgggcctgaaggtgtacaagatcctggagagcgccagcagcaacagccacctggccgactatgtgctgtacaagaacaaggtggaggacagcggcatcttcaccatcaagaacatgatcaacacagaggagggcatcaccctggagaacagctttgtgctgctgcgctttgaccagacaggcctgatgaagcagatgatgaccaaggaggatggcaagcaccacgaggtgaatgtgcagttctcctggtacggcaccaccatcaagagggacaagagcggggcctacctgttcctgcctgatggaaatgccaagccctacgtgtacaccaccccaccatttgtgcgggtgacccacggccgcatctacagcgaggtgacctgcttctttgaccacgtgacccaccgggtgcggctgtaccacatccagggcatcgagggccagagcgtggaggtgagcaacatcgtggacatcaggaaggtgtacaaccgggagatcgccatgaagatcagcagtgacatcaagagccagaaccgcttctacacagacctgaatggctaccagatccagcccaggatgaccctgagcaagctgcccctgcaggccaacgtgtaccccatgaccaccatggcctacatccaggatgccaagcaccggctgaccctgctgagcgcccagagcctgggcgtgagcagcctgaacagcggccagatcgaggtgatcatggaccggcggctgatgcaggatgacaacagaggcctggagcagggcatccaggacaacaagatcacagccaacctcttccgcatcctgctggagaagaggtctgctgtgaacacagaggaggagaagaagtctgtgtcctaccccagcctgctgagccacatcaccagcagcctgatgaaccaccctgtgatccccatggccaacaagttcagcagccccaccctggagctgcagggcgagttcagccccctgcagagcagcctgccctgtgacatccacctggtgaacctgcggaccatccagagcaaggtgggcaatggccacagcaatgaggccgccctgatcctgcacaggaaaggatttgactgccgcttcagcagcaagggcaccggcctcttctgcagcaccacccagggcaagatcctggtgcagaagctgctgaacaagttcatcgtggagagcctgacccccagcagcctgagcctgatgcacagccccccaggcacccagaacatcagcgagatcaacctgagccccatggagatcagcaccttccgcatccagctgaggtag

SEQ ID NO: 158738 - DNA, 3453 bp, Artificial Sequence
  Description of Artificial Sequence: Synthetic coding sequence
atgaagctgaagaagcaggtgacagtgtgtggggccgccatcttctgtgtggccgtgttcagcctgtacctgatgctggacagagtgcagcacgaccccaccaggcaccagaatggaggcaacttccccaggagccagatctctgtgctgcagaaccgcatcgagcagctggagcagctgctggaggagaaccacgagatcatcagccacatcaaggacagcgtgctggagctgacagccaatgctgagggccccccagccatgctgccctactacacagtgaatggctcctgggtggtgcccccagagccccggcccagcttcttcagcatcagcccccaggactgccagtttgccctgggcggccggggccagaagccagagctgcagatgctgactgtgtctgaggagctgccctttgacaacgtggatggcggcgtgtggaggcagggctttgacatctcctatgacccccatgactgggatgctgaggacctgcaggtgtttgtggtgccccacagccacaatgaccccggctggatcaagacctttgacaagtactacacagagcagacccagcacatcctgaacagcatggtgtccaagctgcaggaggacccccggcggcgcttcctgtgggccgaggtgtccttctttgccaagtggtgggacaacatcaacgtgcagaagagagctgctgtgcggcggctggtgggcaatggccagctggagatcgccactggaggctgggtgatgccagatgaggccaacagccactactttgccctgattgaccagctgattgagggccaccagtggctggagaggaacctgggcgccacccccaggagcggctgggccgtggaccccttcggctacagcagcaccatgccctacctgctgcggcgggccaacctgacctccatgctgatccagagggtgcactacgccatcaagaagcactttgctgccacccacagcctggagttcatgtggaggcagacctgggacagcgacagcagcacagacatcttctgccacatgatgcccttctacagctatgatgtgccccacacctgtggccctgaccccaagatctgctgccagtttgacttcaagaggctgcccggcggccgcatcaactgcccctggaaggtgcccccccgggccatcacagaggccaacgtggccgagcgggccgccctgctgctggaccagtacaggaagaagagccagctgttccgcagcaatgtgctgctggtgcccctgggagatgacttccgctatgacaagccccaggagtgggatgcccagttcttcaactaccagaggctgtttgacttcttcaacagccggcccaacctgcacgtgcaggcccagtttggcaccctgagtgactactttgatgccctgtacaagaggactggagtggagcccggggcccggcccccaggcttccctgtgctgagcggggacttcttctcctatgctgaccgggaggaccactactggacaggctactacaccagccggcccttctacaagagcctggacagagtgctggaggcccacctgcggggagctgaggtgctgtacagcctggccgccgcccacgcccggcgcagcggcctggccggccgctaccccctgagtgacttcaccctgctgacagaggcccggaggaccctgggcctcttccagcaccatgatgccatcactggaacagccaaggaggccgtggtggtggactatggagtgcggctgctgcggagcctggtgaacctgaagcaggtgatcatccacgccgcccactacctggtgctgggggacaaggagacctaccactttgatcctgaggcccccttcctgcaggtggatgacacccggctgagccatgatgccctgcctgagaggacagtcatccagctggacagcagccccaggtttgtggtgctcttcaaccccctggagcaggagcgcttctccatggtgtccctgctggtgaacagcccccgggtgcgggtgctgtctgaggagggccagcccctggccgtgcagatcagcgcccactggagcagcgccacagaagctgtgcctgatgtgtaccaggtgtctgtgcctgtgcggctgcctgccctgggcctgggcgtgctgcagctgcagctgggcctggatggccacaggaccctgcccagctctgtgcgcatctacctgcacggccggcagctgtctgtgtccagacatgaggccttccccctgcgggtcatcgacagcggcaccagtgactttgccctgagcaaccgctacatgcaggtgtggttcagcggcctgaccggcctgctgaagagcatcagaagagtggatgaggagcacgagcagcaggtggacatgcaggtgctggtgtatggcaccaggaccagcaaggacaagagcggggcctacctgttcctgcctgatggagaggccaagccctacgtgcccaaggagccccctgtgctgcgggtgacagagggccccttcttcagcgaggtggtggcctactatgagcacatccaccaggccgtgcggctgtacaacctgcccggggtggagggcctgagcctggacatcagcagcctggtggacatccgggactatgtgaacaaggagctggccctgcacatccacacagacatcgacagccagggcatcttcttcacagacctgaatggcttccaggtgcagccccggcgctacctgaagaagctgcccctgcaggccaacttctaccccatgcctgtgatggcctacatccaggatgcccagaagaggctgaccctgcacacagcccaggccctgggcgtgagcagcctgaaggatggccagctggaggtgatcctggaccggcggctgatgcaggatgacaacagaggcctgggccagggcctgaaggacaacaagaggacctgcaaccgcttccggctgctgctggagaggagaacagtgggcagcgaggtgcaggacagccacagcaccagctaccccagcctgctgagccacctgacctccatgtacctgaatgccccagccctggccctgcctgtggccaggatgcagctgcccggccctggcctgcggagcttccaccccctggccagcagcctgccctgtgacttccacctgctgaacctgcggaccctgcaggccgaggaggacaccctgcccagcgctgagacagccctgatcctgcacaggaaaggatttgactgtggcctggaggccaagaacctgggcttcaactgcaccaccagccagggcaaggtggccctgggcagcctcttccacggcctggatgtggtgttcctgcagcccaccagcctgaccctgctgtaccccctggccagccccagcaacagcacagatgtgtacctggagcccatggagatcgccaccttccggctgcggctgggctag

SEQ ID NO: 158739 - DNA, 1023 bp, Artificial Sequence
  Description of Artificial Sequence: Synthetic coding sequence
atgcaggtgtggttcagcggcctgaccggcctgctgaagccctacgtgcccaaggagccccctgtgctgcgggtgacagagggccccttcttcagcgaggtggtggcctactatgagcacatccaccaggccgtgcggctgtacaacctgcccggggtggagggcctgagcctggacatcagcagcctggtggacatccgggactatgtgaacaaggagctggccctgcacatccacacagacatcgacagccagggcatcttcttcacagacctgaatggcttccaggtgcagccccggcgctacctgaagaagctgcccctgcaggccaacttctaccccatgcctgtgatggcctacatccaggatgcccagaagaggctgaccctgcacacagcccaggccctgggcgtgagcagcctgaaggatggccagctggaggtgatcctggaccggcggctgatgcaggatgacaacagaggcctgggccagggcctgaaggacaacaagaggacctgcaaccgcttccggctgctgctggagaggagaacagtgggcagcgaggtgcaggacagccacagcaccagctaccccagcctgctgagccacctgacctccatgtacctgaatgccccagccctggccctgcctgtggccaggatgcagctgcccggccctggcctgcggagcttccaccccctggccagcagcctgccctgtgacttccacctgctgaacctgcggaccctgcaggccgaggaggacaccctgcccagcgctgagacagccctgatcctgcacaggaaaggatttgactgtggcctggaggccaagaacctgggcttcaactgcaccaccagccagggcaaggtggccctgggcagcctcttccacggcctggatgtggtgttcctgcagcccaccagcctgaccctgctgtaccccctggccagccccagcaacagcacagatgtgtacctggagcccatggagatcgccaccttccggctgcggctgggctag

SEQ ID NO: 158740 - DNA, 1977 bp, Artificial Sequence
  Description of Artificial Sequence: Synthetic coding sequence
atgaccagtgacatgaccagccccaggagcggcatgcccagcagcagcaccaccaacggcagcctgaccagcagcacagctggcctgacctccatgtgccgcggggctgaggtgctgtacagcctggccgccgcccacgcccggcgcagcggcctggccggccgctaccccctgagtgacttcaccctgctgacagaggcccggaggaccctgggcctcttccagcaccatgatgccatcactggaacagccaaggaggccgtggtggtggactatggagtgcggctgctgcggagcctggtgaacctgaagcaggtgatcatccacgccgcccactacctggtgctgggggacaaggagacctaccactttgatcctgaggcccccttcctgcaggtggatgacacccggctgagccatgatgccctgcctgagaggacagtcatccagctggacagcagccccaggtttgtggtgctcttcaaccccctggagcaggagcgcttctccatggtgtccctgctggtgaacagcccccgggtgcgggtgctgtctgaggagggccagcccctggccgtgcagatcagcgcccactggagcagcgccacagaagctgtgcctgatgtgtaccaggtgtctgtgcctgtgcggctgcctgccctgggcctgggcgtgctgcagctgcagctgggcctggatggccacaggaccctgcccagctctgtgcgcatctacctgcacggccggcagctgtctgtgtccagacatgaggccttccccctgcgggtcatcgacagcggcaccagtgactttgccctgagcaaccgctacatgcaggtgtggttcagcggcctgaccggcctgctgaagagcatcagaagagtggatgaggagcacgagcagcaggtggacatgcaggtgctggtgtatggcaccaggaccagcaaggacaagagcggggcctacctgttcctgcctgatggagaggccaagccctacgtgcccaaggagccccctgtgctgcgggtgacagagggccccttcttcagcgaggtggtggcctactatgagcacatccaccaggccgtgcggctgtacaacctgcccggggtggagggcctgagcctggacatcagcagcctggtggacatccgggactatgtgaacaaggagctggccctgcacatccacacagacatcgacagccagggcatcttcttcacagacctgaatggcttccaggtgcagccccggcgctacctgaagaagctgcccctgcaggccaacttctaccccatgcctgtgatggcctacatccaggatgcccagaagaggctgaccctgcacacagcccaggccctgggcgtgagcagcctgaaggatggccagctggaggtgatcctggaccggcggctgatgcaggatgacaacagaggcctgggccagggcctgaaggacaacaagaggacctgcaaccgcttccggctgctgctggagaggagaacagtgggcagcgaggtgcaggacagccacagcaccagctaccccagcctgctgagccacctgacctccatgtacctgaatgccccagccctggccctgcctgtggccaggatgcagctgcccggccctggcctgcggagcttccaccccctggccagcagcctgccctgtgacttccacctgctgaacctgcggaccctgcaggccgaggaggacaccctgcccagcgctgagacagccctgatcctgcacaggaaaggatttgactgtggcctggaggccaagaacctgggcttcaactgcaccaccagccagggcaaggtggccctgggcagcctcttccacggcctggatgtggtgttcctgcagcccaccagcctgaccctgctgtaccccctggccagccccagcaacagcacagatgtgtacctggagcccatggagatcgccaccttccggctgcggctgggctag

SEQ ID NO: 158741 - DNA, 219 bp, Artificial Sequence
  Description of Artificial Sequence: Synthetic coding sequence
atgaagctgaagaagcaggtgacagtgtgtggggccgccatcttctgtgtggccgtgttcagcctgtacctgatgctggacagagtgcagcacgaccccaccaggcaccagaatggaggcaacttccccaggagccagatctctgtgctgcagaaccgcatcgagcagctggagcagctgctggaggagaaccacgagatcatcagccacatcaagtag

SEQ ID NO: 158742 - DNA, 153 bp, Artificial Sequence
  Description of Artificial Sequence: Synthetic coding sequence
atgaagctgaagaagcaggtgacagtgtgtggggccgccatcttctgtgtggccgtgttcagcctgtacctgatgctggacagagtgcagcacgaccccaccaggcaccagaatggaggcaacttccccaggagccagatctctgtgctgtag

SEQ ID NO: 158743 - DNA, 3192 bp, Artificial Sequence
  Description of Artificial Sequence: Synthetic coding sequence
atgctgccctactacacagtgaatggctcctgggtggtgcccccagagccccggcccagcttcttcagcatcagcccccaggactgccagtttgccctgggcggccggggccagaagccagagctgcagatgctgactgtgtctgaggagctgccctttgacaacgtggatggaggagtgtggaggcagggctttgacatctcctatgacccccatgactgggatgctgaggacctgcaggtgtttgtggtgccccacagccacaatgaccccggctggatcaagacctttgacaagtactacacagagcagacccagcacatcctgaacagcatggtgtccaagctgcaggaggacccccggcggcgcttcctgtgggccgaggtgtccttctttgccaagtggtgggacaacatcaacgtgcagaagagagctgctgtgcggcggctggtgggcaatggccagctggagatcgccaccggcggctgggtgatgccagatgaggccaacagccactactttgccctgattgaccagctgattgagggccaccagtggctggagaggaacctgggcgccacccccaggagcggctgggccgtggaccccttcggctacagcagcaccatgccctacctgctgcggcgggccaacctgacctccatgctgatccagagggtgcactacgccatcaagaagcactttgctgccacccacagcctggagttcatgtggaggcagacctgggacagcgacagcagcacagacatcttctgccacatgatgcccttctacagctatgatgtgccccacacctgtggccctgaccccaagatctgctgccagtttgacttcaagaggctgcccggcggccgcatcaactgcccctggaaggtgcccccccgggccatcacagaggccaacgtggccgagagagctgccctgctgctggaccagtacaggaagaagagccagctgttccgcagcaatgtgctgctggtgcccctgggagatgacttccgctatgacaagccccaggagtgggatgcccagttcttcaactaccagaggctgtttgacttcttcaacagccggcccaacctgcacgtgcaggcccagtttggcaccctgagtgactactttgatgccctgtacaagaggactggagtggagcccggggcccggcccccaggcttccctgtgctgagcggggacttcttctcctatgctgaccgggaggaccactactggacaggctactacaccagccggcccttctacaagagcctggacagagtgctggaggcccacctgcggggagctgaggtgctgtacagcctggccgccgcccacgccaggagaagtggcctggccggccgctaccccctgagtgacttcaccctgctgacagaggcccggaggaccctgggcctcttccagcaccatgatgccatcaccggcacagccaaggaggccgtggtggtggactatggagtgcggctgctgcggagcctggtgaacctgaagcaggtgatcatccatgctgcccactacctggtgctgggggacaaggagacctaccactttgatcctgaggcccccttcctgcaggtggatgacacccggctgagccatgatgccctgcctgagaggacagtcatccagctggacagcagccccaggtttgtggtgctcttcaaccccctggagcaggagcgcttctccatggtgtccctgctggtgaacagcccccgggtgcgggtgctgtctgaggagggccagcccctggccgtgcagatcagcgcccactggagcagcgccacagaggccgtgcctgatgtgtaccaggtgtctgtgcctgtgcggctgcctgccctgggcctgggcgtgctgcagctgcagctgggcctggatggccacaggaccctgcccagctctgtgcgcatctacctgcacggccggcagctgtctgtgtccagacatgaggccttccccctgcgggtgattgattctggcaccagtgactttgccctgagcaaccgctacatgcaggtgtggttcagcggcctgaccggcctgctgaagagcatccggcgggtggatgaggagcacgagcagcaggtggacatgcaggtgctggtgtatggcaccaggaccagcaaggacaagagcggggcctacctgttcctgcctgatggagaggccaagccctacgtgcccaaggagccccctgtgctgcgggtgacagagggccccttcttcagcgaggtggtggcctactatgagcacatccaccaggccgtgcggctgtacaacctgcccggggtggagggcctgagcctggacatcagcagcctggtggacatccgggactatgtgaacaaggagctggccctgcacatccacacagacatcgacagccagggcatcttcttcacagacctgaatggcttccaggtgcagccccggcgctacctgaagaagctgcccctgcaggccaacttctaccccatgcctgtgatggcctacatccaggatgcccagaagaggctgaccctgcacacagcccaggccctgggcgtgagcagcctgaaggatggccagctggaggtgatcctggaccggcggctgatgcaggatgacaacagaggcctgggccagggcctgaaggacaacaagaggacctgcaaccgcttccggctgctgctggagaggagaacagtgggcagcgaggtgcaggacagccacagcaccagctaccccagcctgctgagccacctgacctccatgtacctgaatgccccagccctggccctgcctgtggccaggatgcagctgcccggccctggcctgcgctccttccaccccctggccagcagcctgccctgtgacttccacctgctgaacctgcggaccctgcaggccgaggaggacaccctgcccagcgctgagacagccctgatcctgcacaggaagggctttgactgtggcctggaggccaagaacctgggcttcaactgcaccaccagccagggcaaggtggccctgggcagcctcttccacggcctggatgtggtgttcctgcagcccaccagcctgaccctgctgtaccccctggccagccccagcaacagcacagatgtgtacctggagcccatggagatcgccaccttccggctgcggctgggctag

SEQ ID NO: 158744 - DNA, 231 bp, Artificial Sequence
  Description of Artificial Sequence: Synthetic coding sequence
atgaagctgaagaagcaggtgacagtgtgtggggccgccatcttctgtgtggccgtgttcagcctgtacctgatgctggacagagtgcagcacgaccccaccaggcaccagaatggaggcaacttccccaggagccagatctctgtgctgcagaaccgcatcgagcagctggagcagctgctggaggagaaccacgagatcatcagccacatcaaggacagcgtgctgtag

SEQ ID NO: 158745 - DNA, 363 bp, Artificial Sequence
  Description of Artificial Sequence: Synthetic coding sequence
atgaagctgaagaagcaggtgacagtgtgtggggccgccatcttctgtgtggccgtgttcagcctgtacctgatgctggacagagtgcagcacgaccccaccaggcaccagaatggaggcaacttccccaggagccagatctctgtgctgcagaaccgcatcgagcagctggagcagctgctggaggagaaccacgagatcatcagccacatcaaggacagcgtgctggagctgacagccaatgctgagggccccccagccatgctgccctactacacagtgaatggctcctgggtggtgcccccagagccccggcccagcttcttcagcatcagcccccaggactgccagtttgccctgtag

SEQ ID NO: 158746 - DNA, 3123 bp, Artificial Sequence
  Description of Artificial Sequence: Synthetic coding sequence
atggctgctgccccagccctgaagcactggaggaccaccctggagcgggtggagaagtttgtgagccccctgtacttcacagactgcaacctgcggggccgcctgtttggagccagctgccctgtggccgtgctgagcagcttcctgaccccagagcggctgccctaccaggaggccgtgcagagggacttccggcctgcccaggtgggggacagctttggccccacctggtggacctgctggttccgggtggagctgaccatccctgaggcctgggtgggccaggaggtgcacctgtgctgggagagtgatggagagggcctggtgtggagagatggagagcctgtgcagggcctgaccaaggagggggagaagaccagctatgtgctgacagaccggctgggggagcgggaccccaggagcctgaccctgtatgtggaggtggcctgcaatggcctgctgggcgctgggaagggctccatgattgctgccccagaccctgagaagatgttccagctgagcagagctgagctggccgtgttccacagagatgtgcacatgctgctggtggacctggagctgctgctgggcatcgccaagggcctgggcaaggacaaccagaggagcttccaggccctgtacacagccaaccagatggtgaatgtgtgtgaccctgcccagcctgagaccttccctgtggcccaggccctggccagccgcttcttcggccagcacggcggggagagccagcacaccatccacgccaccggccactgccacatcgacacagcctggctgtggcccttcaaggagaccgtgaggaaatgtgcccgctcctgggtgacagccctgcagctgatggagagaaatcctgagttcatctttgcctgcagccaggcccagcagctggagtgggtgaagagccgctacccaggcctgtacagccgcatccaggagtttgcctgccggggccagtttgtgcctgtgggcggcacctgggtggagatggatggcaacctgcccagcggggaggccatggtgcggcagttcctgcagggccagaacttcttcctgcaggagtttgggaagatgtgcagcgagttctggctgcctgacaccttcggctacagcgcccagctgccccagatcatgcacggctgcggcatccgccgcttcctgacccagaagctgtcctggaacctggtgaacagcttcccccaccacaccttcttctgggagggcctggatggcagccgggtgctggtgcacttccccccaggggacagctatggcatgcagggctctgtggaggaggtgctgaagacagtggccaacaacagagacaagggccgggccaaccacagcgccttcctgtttggatttggagatggcggcggcggccccacccagaccatgctggaccggctgaagaggctgagcaacacagatggcctgccccgggtgcagctgagcagcccccggcagctgttcagcgccctggagagtgacagcgagcagctgtgcacctgggtgggggagctgttcctggagctgcacaacggcacctacaccacccacgcccagatcaagaagggcaacagagaatgtgagcgcatcctgcatgatgtggagctgctgagcagcctggccctggcccggagcgcccagttcctgtacccagctgcccagctgcagcacctgtggaggctgctgctgctgaaccagttccatgatgtggtgacaggcagctgcatccagatggtggccgaggaggccatgtgccactatgaggacatccgcagccacggcaacaccctgctgtctgctgctgctgctgccctgtgtgccggggagcccggccctgagggcctgctgattgtgaacaccctgccctggaagagaattgaggtgatggccctgcccaagccaggaggagcccacagcctggccctggtgacagtgcccagcatgggctacgcccctgtgcccccacccaccagcctgcagcccctgctgccccagcagcctgtgtttgtggtgcaggagacagatggctctgtgaccctggacaatggcatcatccgggtgaagctggaccccaccggccgcctgaccagcctggtgctggtggccagcggccgggaggccatcgccgagggcgctgtgggcaaccagtttgtgctgtttgatgatgtgcccctgtactgggatgcctgggatgtgatggactaccacctggagaccaggaagcctgtgctgggccaggccggcaccctggccgtgggcacagaaggaggcctgcggggcagcgcctggttcctgctgcagatcagccccaacagccggctgagccaggaggtggtgctggatgtgggctgcccctacgtgcgcttccacacagaggtgcactggcatgaggcccacaagttcctgaaggtggagttccctgcccgggtgcgcagcagccaggccacctatgagatccagtttggccacctgcagaggcccacccactacaacacctcctgggactgggccaggtttgaggtgtgggcccaccgctggatggacctgtctgaacatggcttcggcctggccctgctgaatgactgcaagtatggagcctctgtgcggggcagcatcctgagcctgagcctgctgcgggcccccaaggccccagatgccacagctgacaccggcagacatgagttcacctacgccctgatgccccacaagggcagcttccaggatgctggggtcatccaggccgcctacagcctgaacttccccctgctggccctgcctgcccccagccctgccccagccacctcctggagcgccttctctgtgagcagccctgctgtggtgctggagaccgtgaagcaggccgagagcagcccccagaggaggagcctggtgctgcggctgtatgaggcccacggcagccacgtggactgctggctgcacctgagcctgcctgtgcaggaggccatcctgtgtgacctgctggagaggccagaccctgctggccacctgaccctgcgggacaaccggctgaagctgaccttcagccccttccaggtgctgagcctgctgctggtgctgcagcccccaccccactag

SEQ ID NO: 158747 - DNA, 630 bp, Artificial Sequence
  Description of Artificial Sequence: Synthetic coding sequence
atggctgctgccccagccctgaagcactggaggaccaccctggagcgggtggagaagtttgtgagccccctgtacttcacagactgcaacctgcggggccgcctgtttggagccagctgccctgtggccgtgctgagcagcttcctgaccccagagcggctgccctaccaggaggccgtgcagagggacttccggcctgcccaggtgggggacagctttggccccacctggtggacctgctggttccgggtggagctgaccatccctgaggcctgggtgggccaggaggtgcacctgtgctgggagagtgatggagagggcctggtgtggagagatggagagcctgtgcagggcctgaccaaggagggggagaagaccagctatgtgctgacagaccggctgggggagcgggaccccaggagcctgaccctgtatgtggaggtggcctgcaatggcctgctgggcgctgggaagggctccatgattgctgccccagaccctgagaagatgttccagctgagcagagctgagctggccgtgttccacagagatgtgcacatgctgctggtggacctggagctgctgctgggcatcgccaagccaggcttcggccccagcaagaggctgtag

SEQ ID NO: 158748 - DNA, 2910 bp, Artificial Sequence
  Description of Artificial Sequence: Synthetic coding sequence
atggctgaagatgacccctacctgggccggcctgagcagatgttccacctggaccccagcctgacccacaccatcttcaaccctgaggtgttccagccccagatggccctgcccacagcagatggcccctacctgcagatcctggagcagcccaagcagaggggcttccgcttccgctacgtgtgtgagggccccagccatggaggcctgcccggggccagcagcgagaagaacaagaagagctacccccaggtgaagatctgcaactacgtgggccctgccaaggtgattgtgcagctggtgaccaacgggaagaacatccacctgcacgcccacagcctggtgggcaagcactgtgaagatggcatctgcaccgtgacagctggccccaaggacatggtggtgggctttgccaacctgggcatcctgcacgtgaccaagaagaaggtgtttgagaccctggaggccaggatgacagaggcctgcatccggggctacaaccctggcctgctggtgcacccagacctggcctacctgcaggccgagggcggcggggaccggcagctgggggaccgggagaaggagctgatccggcaggccgccctgcagcagaccaaggagatggacctgtctgtggtgcggctgatgttcaccgccttcctgcctgacagcacaggcagcttcacccggcggctggagcctgtggtgtctgatgccatctatgacagcaaggccccaaatgccagcaacctgaagatcgtgaggatggacagaacagctggctgtgtgactggaggagaggagatctacctgctgtgtgacaaggtgcagaaggatgacatccagatccgcttctatgaggaggaggagaatggaggagtgtgggagggctttggagacttcagccccacagatgtgcaccggcagtttgccatcgtgttcaagacccccaagtacaaggacatcaacatcaccaagccagcctctgtgtttgtgcagctgcggaggaagagtgacctggagaccagcgagcccaagcccttcctgtactacccagagatcaaggacaaggaggaggtgcagaggaagaggcagaagctgatgcccaacttcagtgacagctttggaggcggcagcggggccggggccggcggcggcggcatgtttggaagtggcggcggcggcggcggcaccggcagcactggacctggctacagcttcccccactacggcttccccacctatggaggcatcaccttccaccctggcaccaccaagagcaatgccggcatgaagcacggcaccatggacacagagagcaagaaggaccctgagggctgtgacaagagtgatgacaagaacacagtgaacctgtttgggaaggtgattgagaccacagagcaggaccaggagcccagcgaggccaccgtgggcaatggagaggtgaccctgacctacgccaccggcaccaaggaggagagcgctggggtgcaggacaacctcttcctggagaaggccatgcagctggccaagagacatgccaatgccctgtttgattatgctgtgactggagatgtgaagatgctgctggccgtgcagaggcacctgacagctgtgcaggatgaaaatggagacagcgtgctgcacctggccatcatccacctgcacagccagctggtgcgggacctgctggaggtgaccagcggcctcatcagtgatgacatcatcaacatgagaaatgacctgtaccagacccccctgcacctggccgtcatcaccaagcaggaggatgtggtggaggacctgctgcgggccggggctgacctgagcctgctggaccggctgggcaacagcgtgctgcacctggccgccaaggagggccatgacaaggtgctgagcatcctgctgaagcacaagaaggccgccctgctgctggaccaccccaatggagatggcctgaatgccatccacctggccatgatgagcaacagcctgccctgcctgctgctgctggtggccgccggggctgatgtgaatgcccaggagcagaagagcggccgcacagccctgcacctggccgtggagcatgacaacatcagcctggccggctgcctgctgctggagggagatgcccacgtggacagcaccacctatgatggcaccacccccctgcacatcgccgccggccggggcagcacccggctggccgccctgctgaaggccgccggggctgaccccctggtggagaactttgagcccctgtatgacctggatgacagctgggagaatgctggggaggatgaaggagtggtgcccggcaccacccccctggacatggccacctcctggcaggtgtttgacatcctgaatggcaagccctatgagcctgagttcaccagtgatgacctgctggcccagggcgacatgaagcagctggccgaggatgtgaagctgcagctgtacaagctgctggagatcccagaccctgacaagaactgggccaccctggcccagaagctgggcctgggcatcctgaacaatgccttccggctgagccctgcccccagcaagaccctgatggacaactatgaggtgtctgggggcaccgtgcgggagctggtggaggccctgcggcagatgggctacacagaggccatcgaggtgatccaggccgccagcagccctgtgaagaccaccagccaggcccacagcctgcccctgagccctgccagcacccggcagcagattgatgagctgcgggacagcgacagcgtgtgtgacagcggcgtggagaccagcttcaggaagctgtccttcacagagagcctgaccagcggggccagcctgctgaccctgaacaagatgcctcatgactatggccaggagggccccctggagggcaagatctag

SEQ ID NO: 158749 - DNA, 1389 bp, Artificial Sequence
  Description of Artificial Sequence: Synthetic coding sequence
atggccaagttcagaagaaggacctgcatcatcctggccctcttcatcctcttcatcttcagcctgatgatgggcctgaagatgctgcggcccaacacagccaccttcggggcccccttcggcctggacctgctgcctgagctgcaccagaggaccatccacctgggcaagaactttgacttccagaagagtgaccgcatcaacagcgagaccaacaccaagaacctgaagtctgtggagatcaccatgaagcccagcaaggccagcgagctgaacctggatgagctgccccccctgaacaactacctgcacgtgttctactacagctggtacggcaacccccagtttgatggcaagtacatccactggaaccaccctgtgctggagcactgggaccccagaattgccaagaactacccccagggccgccacaaccccccagatgacatcggcagcagcttctacccagagctgggcagctacagcagccgggaccccagcgtgattgagacccacatgaggcagatgaggtctgccagcattggagtgctggccctgtcctggtaccccccagatgtgaatgatgaaaatggagagcccacagacaacctggtgcccaccatcctggacaaggcccacaagtacaacctgaaggtgaccttccacatcgagccctacagcaacagagatgaccagaacatgtacaagaatgtgaagtacatcatcgacaagtatggcaaccacccagccttctaccgctacaagaccaagacaggaaatgccctgcccatgttctacgtgtatgacagctacatcaccaagccagagaagtgggccaacctgctgaccaccagcggcagccgcagcatccggaacagcccctatgatggcctcttcatcgccctgctggtggaggagaagcacaagtatgacatcctgcagagcggctttgatggcatctacacctactttgccaccaacggcttcacctacggcagcagccaccagaactgggccagcctgaagctgttctgtgacaagtacaacctgatcttcatccccagcgtgggccctggctacatcgacaccagcatccggccctggaacacccagaacaccaggaaccgcatcaacgggaagtactatgagatcggcctgtctgctgccctgcagacccggcccagcctcatcagcatcaccagcttcaatgagtggcatgagggcacccagatcgagaaggctgtgcccaagaggaccagcaacacagtgtacctggactaccggccccacaagccaggcctgtacctggagctgaccaggaagtggagcgagaagtacagcaaggagcgggccacctacgccctggaccggcagctgcctgtgtcctag

SEQ ID NO: 158750 - DNA, 597 bp, Artificial Sequence
  Description of Artificial Sequence: Synthetic coding sequence
atggccaagttcagaagaaggacctgcatcatcctggccctcttcatcctcttcatcttcagcctgatgatgggcctgaagatgctgcggcccaacacagccaccttcggggcccccttcggcctggacctgctgcctgagctgcaccagaggaccatccacctgggcaagaactttgacttccagaagagtgaccgcatcaacagcgagaccaacaccaagaacctgaagtctgtggagatcaccatgaagcccagcaaggccagcgagctgaacctggatgagctgccccccctgaacaactacctgcacgtgttctactacagctggtacggcaacccccagtttgatggcaagtacatccactggaaccaccctgtgctggagcactgggaccccagaattgccaagaactacccccagggccgccacaaccccccagatgacatcggcagcagcttctacccagagctgggcagctacagcagccgggaccccagcgtgattgagacccacatgaggcagatgaggtctgccagcatcggcaactactgcatctacatctacgtgtgcctgtgcctgtacatctgcatctag

SEQ ID NO: 158751 - DNA, 624 bp, Artificial Sequence
  Description of Artificial Sequence: Synthetic coding sequence
atggccaagttcagaagaaggacctgcatcatcctggccctcttcatcctcttcatcttcagcctgatgatgggcctgaagatgctgcggcccaacacagccaccttcggggcccccttcggcctggacctgctgcctgagctgcaccagaggaccatccacctgggcaagaactttgacttccagaagagtgaccgcatcaacagcgagaccaacaccaagaacctgaagtctgtggagatcaccatgaagcccagcaaggccagcgagctgaacctggatgagctgccccccctgaacaactacctgcacgtgttctactacagctggtacggcaacccccagtttgatggcaagtacatccactggaaccaccctgtgctggagcactgggaccccagaattgccaagaactacccccagggccgccacaaccccccagatgacatcggcagcagcttctacccagagctgggcagctacagcagccgggaccccagcgtgattgagacccacatgaggcagatgaggtctgccagcatcggcaactactgcatctacatctgtgtgtttgtgtctgtgtacatgcacatcaatgacttcctgtgcaacttcaccagctag

SEQ ID NO: 158752 - DNA, 2379 bp, Artificial Sequence
  Description of Artificial Sequence: Synthetic coding sequence
atgatcaccgtgaacccagatggcaagatcatggtgcggcgctgcctggtgaccctgcggcccttccggctgtttgtgctgggcatcggcttcttcaccctgtgcttcctgatgaccagcctgggcggccagttcagcgcccggcggctgggggacagccccttcaccatcagaacagaggtgatgggcggccctgagagcagaggagtgctgaggaagatgtctgacctgctggagctgatggtgaagaggatggatgccctggcccggctggagaacagcagcgagctgcaccgggccggcggggacctgcacttccctgctgacaggatgcctcctggagctggcctgatggagcgcatccaggccatcgcccagaatgtgtctgacattgctgtgaaggtggaccagatcctgcggcacagcctgctgctgcacagcaaggtgtctgagggcagaagagaccagtgtgaggcccccagcgaccccaagttcccagactgcagcggcaaggtggagtggatgagggcccgctggaccagtgacccctgctacgccttcttcggcgtggatggaacagagtgcagcttcctgatctacctgtctgaggtggagtggttctgcccccccctgccctggaggaaccagacagctgcccagagggcccccaagcccctgcccaaggtgcaggccgtgttccgcagcaacctgagccacctgctggacctgatgggcagcggcaaggagagcctcatcttcatgaagaagaggaccaagaggctgacagcccagtgggccctggccgcccagaggctggcccagaagctgggcgccacccagagggaccagaagcagatcctggtgcacatcggcttcctgacagaggagagcggagatgtgttcagcccccgggtgctgaagggcggccccctgggggagatggtgcagtgggccgacatcctgacagccctgtatgtgctgggccacggcctgcgggtgacagtgtccctgaaggagctgcagagcaacctgggcgtgcccccaggccggggcagctgccccctgaccatgcccctgccctttgacctgatctacacagactaccacggcctgcagcagatgaagaggcacatgggcctgtccttcaagaagtaccgctgccgcatccgggtcatcgacacctttggaacagagcccgcctacaaccacgaggagtatgccaccctgcacggctaccgcaccaactggggctactggaacctgaaccccaagcagttcatgaccatgttcccccacaccccagacaacagcttcatgggctttgtgtctgaggagctgaatgaaacagagaagaggctcatcaagggcggcaaggccagcaacatggctgtggtgtatggcaaggaggccagcatctggaagctgcagggcaaggagaagttcctgggcatcctgaacaagtacatggagatccacggcaccgtgtactatgagagccagaggcctcctgaggtgcctgcctttgtgaagaaccacggcctgctgccccagcctgagttccagcagctgctgaggaaggccaagctgttcatcggcttcggcttcccctatgagggccctgcccccctggaggccatcgccaacggctgcatcttcctgcagagccgcttcagccccccccacagcagcctgaaccacgagttcttccggggcaagcccaccagccgggaggtgttcagccagcacccctatgcagagaacttcatcggcaagccccacgtgtggacagtggactacaacaacagcgaggagtttgaagctgccatcaaggccatcatgaggacccaggtggacccctacctgccctatgagtacacctgtgagggcatgctggagcgcatccacgcctacatccagcaccaggacttctgccgggccccagaccctgccctgcctgaggcccacgccccccagagcccctttgtgctggccccaaatgccacccacctggagtgggccaggaacaccagcctggcccctggggcctggcccccagcccacgccctgcgggcctggctggccgtgcccggccgggcctgcacagacacctgcctggaccacggcctcatctgtgagcccagcttcttccccttcctgaacagccaggatgccttcctgaagctgcaggtgccctgtgacagcacagaaagtgagatgaaccacctgtacccagcctttgcccagcccggccaggagtgctacctgcagaaggagcccctgctcttcagctgtgccggcagcaacaccaagtaccgccgcctgtgcccctgccgggacttcaggaagggccaggtggccctgtgccagggctgcctgtag

SEQ ID NO: 158753 - DNA, 1338 bp, Artificial Sequence
  Description of Artificial Sequence: Synthetic coding sequence
atgctgaagaagcagagcgctggcctggtgctgtggggcgccatcctgtttgtggcctggaatgccctgctgctgctcttcttctggaccaggcctgcccctggccggcccccatctgtgtctgccctggatggagaccctgccagcctgacccgggaggtgatccggctggcccaggatgctgaggtggagctggagcggcagaggggcctgctgcagcagattggagatgccctgagcagccagaggggccgggtgcccacagctgcccccccagcccagccccgggtgcctgtgaccccagccccagctgtgatccccatcctggtgattgcctgtgacaggagcacagtgcggcgctgcctggacaagctgctgcactaccggcccagcgctgagctgttccccatcatcgtgtcccaggactgtggccacgaggagacagcccaggccatcgccagctatggcagcgctgtgacccacatccggcagcctgacctgagcagcattgctgtgcccccagaccacaggaagttccagggctactacaagatcgcccggcactaccgctgggccctgggccaggtgttccggcagttccgcttccctgctgctgtggtggtggaggatgacctggaggtggccccagacttctttgagtacttccgggccacctaccccctgctgaaggctgaccccagcctgtggtgtgtgtctgcctggaatgacaacgggaaggagcagatggtggatgccagcaggcctgagctgctgtacagaacagacttcttccctggcctgggctggctgctgctggccgagctgtgggccgagctggagcccaagtggcccaaggccttctgggatgactggatgagaagacctgagcagaggcagggccgggcctgcatccggcctgagatcagcaggaccatgaccttcggcaggaaaggagtgagccacggccagttctttgaccagcacctgaagttcatcaagctgaaccagcagtttgtgcacttcacccagctggacctgagctacctgcagcgggaggcctatgaccgggacttcctggcccgggtgtatggagccccccagctgcaggtggagaaggtgaggaccaatgacaggaaggagctgggggaggtgcgggtgcagtacacaggccgggacagcttcaaggcctttgccaaggccctgggcgtgatggatgacctgaagtctggagtgccccgggccggctaccggggcatcgtgaccttccagttccggggcagaagagtgcacctggccccacccctgacctgggagggctatgaccccagctggaactag

SEQ ID NO: 158754 - DNA, 1338 bp, Artificial Sequence; identical to SEQ ID NO: 158753
  Description of Artificial Sequence: Synthetic coding sequence

SEQ ID NO: 158755 - DNA, 1338 bp, Artificial Sequence; identical to SEQ ID NO: 158753
  Description of Artificial Sequence: Synthetic coding sequence

SEQ ID NO: 158756 - DNA, 1338 bp, Artificial Sequence; identical to SEQ ID NO: 158753
  Description of Artificial Sequence: Synthetic coding sequence

SEQ ID NO: 158757 - DNA, 1338 bp, Artificial Sequence; identical to SEQ ID NO: 158753
  Description of Artificial Sequence: Synthetic coding sequence

SEQ ID NO: 158758 - DNA, 909 bp, Artificial Sequence
  Description of Artificial Sequence: Synthetic coding sequence
atgctgaagaagcagagcgctggcctggtgctgtggggcgccatcctgtttgtggcctggaatgccctgctgctgctcttcttctggaccaggcctgcccctggccggcccccatctgtgtctgccctggatggagaccctgccagcctgaccagggtcttccggcagttccgcttccctgctgctgtggtggtggaggatgacctggaggtggccccagacttctttgagtacttccgggccacctaccccctgctgaaggctgaccccagcctgtggtgtgtgtctgcctggaatgacaatggcaaggagcagatggtggatgccagcaggcctgagctgctgtacagaacagacttcttccctggcctgggctggctgctgctggccgagctgtgggccgagctggagcccaagtggcccaaggccttctgggatgactggatgaggaggcctgagcagaggcagggccgggcctgcatccggcctgagatcagcaggaccatgacctttggaaggaagggcgtgagccacggccagttctttgaccagcacctgaagttcatcaagctgaaccagcagtttgtgcacttcacccagctggacctgagctacctgcagcgggaggcctatgaccgggacttcctggcccgggtgtatggagccccccagctgcaggtggagaaggtgaggaccaatgacaggaaggagctgggggaggtgcgggtgcagtacacaggccgggacagcttcaaggcctttgccaaggccctgggcgtgatggatgacctgaagagcggcgtgcccagggctggctaccggggcatcgtgaccttccagttccggggccggcgggtgcacctggccccacccctgacctgggagggctatgaccccagctggaactag

SEQ ID NO: 158759 - DNA, 312 bp, Artificial Sequence
  Description of Artificial Sequence: Synthetic coding sequence
atgctgaagaagcagagcgctggcctggtgctgtggggcgccatcctgtttgtggcctggaatgccctgctgctgctcttcttctggaccaggcctgcccctggccggcccccatctgtgtctgccctggatggagaccctgccagcctgacccgggaggtgatccggctggcccaggatgctgaggtggagctggagcggcagaggggcctgctgcagcagattggagatgccctgagcagccagaggggccgggtgcccacagctgcccccccagcccagccccgggtgcctgtgaccccagccccctag

SEQ ID NO: 158760 - DNA, 600 bp, Artificial Sequence
  Description of Artificial Sequence: Synthetic coding sequence
atgctgaagaagcagagcgctggcctggtgctgtggggcgccatcctgtttgtggcctggaatgccctgctgctgctcttcttctggaccaggcctgcccctggccggcccccatctgtgtctgccctggatggagaccctgccagcctgacccgggaggtgatccggctggcccaggatgctgaggtggagctggagcggcagaggggcctgctgcagcagattggagatgccctgagcagccagaggggccgggtgcccacagctgcccccccagcccagccccgggtgcctgtgaccccagccccagctgtgatccccatcctggtgattgcctgtgacaggagcacagtgcggcgctgcctggacaagctgctgcactaccggcccagcgctgagctgttccccatcatcgtgtcccaggactgtggccacgaggagacagcccaggccatcgccagctatggcagcgctgtgacccacatccggcagcctgacctgagcagcattgctgtgcccccagaccacaggaagttccagggctactacaagatcgcccggcactaccgctgggccctgggccaggtgttccggcagtag

SEQ ID NO: 158761 - DNA, 336 bp, Artificial Sequence
  Description of Artificial Sequence: Synthetic coding sequence
atgctgaagaagcagagcgctggcctggtgctgtggggcgccatcctgtttgtggcctggaatgccctgctgctgctcttcttctggaccaggcctgcccctggccggcccccatctgtgtctgccctggatggagaccctgccagcctgacccgggaggtgatccggctggcccaggatgctgaggtggagctggagcggcagaggggcctgctgcagcagattggagatgccctgagcagccagaggggccgggtgcccacagctgcccccccagcccagccccgggtgcctgtgaccccagccccagctgtgatccccatcctggtgatctag

SEQ ID NO: 158762 - DNA, 465 bp, Artificial Sequence
  Description of Artificial Sequence: Synthetic coding sequence
atgctgaagaagcagagcgctggcctggtgctgtggggcgccatcctgtttgtggcctggaatgccctgctgctgctcttcttctggaccaggcctgcccctggccggcccccatctgtgtctgccctggatggagaccctgccagcctgacccgggaggtgatccggctggcccaggatgctgaggtggagctggagcggcagaggggcctgctgcagcagattggagatgccctgagcagccagaggggccgggtgcccacagctgcccccccagcccagccccgggtgcctgtgaccccagccccagctgtgatccccatcctggtgattgcctgtgacaggagcacagtgcggcgctgcctggacaagctgctgcactaccggcccagcgctgagctgttccccatcatcgtgtcccaggactgtggccacgaggagacagcccaggccatcgccagctag

SEQ ID NO: 158763 - DNA, 105 bp, Artificial Sequence
  Description of Artificial Sequence: Synthetic coding sequence
atgctgaagaagcagagcgctggcctggtgctgtggggcgccatcctgtttgtggcctggaatgccctgctgctgctcttcttctggaccaggcctgccccctag

SEQ ID NO: 158764 - DNA, 348 bp, Artificial Sequence
  Description of Artificial Sequence: Synthetic coding sequence
atgctgaagaagcagagcgctggcctggtgctgtggggcgccatcctgtttgtggcctggaatgccctgctgctgctcttcttctggaccaggcctgcccctggccggcccccatctgtgtctgccctggatggagaccctgccagcctgacccgggaggtgatccggctggcccaggatgctgaggtggagctggagcggcagaggggcctgctgcagcagattggagatgccctgagcagccagaggggccgggtgcccacagctgcccccccagcccagccccgggtgcctgtgaccccagccccagctgtgatccccatcctggtgattgcctgtgacagatag

SEQ ID NO: 158765 - DNA, 288 bp, Artificial Sequence
  Description of Artificial Sequence: Synthetic coding sequence
atgctgaagaagcagagcgctggcctggtgctgtggggcgccatcctgtttgtggcctggaatgccctgctgctgctcttcttctggaccaggcctgcccctggccggcccccatctgtgtctgccctggatggagaccctgccagcctgacccgggaggtgatccggctggcccaggatgctgaggtggagctggagcggcagaggggcctgctgcagcagattggagatgccctgagcagccagaggggccgggtgcccacagctgcccccccagcccagccctag

SEQ ID NO: 158766 - DNA, 384 bp, Artificial Sequence
  Description of Artificial Sequence: Synthetic coding sequence
atgctgaagaagcagagcgctggcctggtgctgtggggcgccatcctgtttgtggcctggaatgccctgctgctgctcttcttctggaccaggcctgcccctggccggcccccatctgtgtctgccctggatggagaccctgccagcctgacccgggaggtgatccggctggcccaggatgctgaggtggagctggagcggcagaggggcctgctgcagcagattggagatgccctgagcagccagaggggccgggtgcccacagctgcccccccagcccagccccgggtgcctgtgaccccagccccagctgtgatccccatcctggtgattgcctgtgacaggagcacagtgcggcgctgcctggacaagctgctgcactag

SEQ ID NO: 158767 - DNA, 318 bp, Artificial Sequence
  Description of Artificial Sequence: Synthetic coding sequence
atgctgaagaagcagagcgctggcctggtgctgtggggcgccatcctgtttgtggcctggaatgccctgctgctgctcttcttctggaccaggcctgcccctggccggcccccatctgtgtctgccctggatggagaccctgccagcctgacccgggaggtgatccggctggcccaggatgctgaggtggagctggagcggcagaggggcctgctgcagcagattggagatgccctgagcagccagaggggccgggtgcccacagctgcccccccagcccagccccgggtgcctgtgaccccagccccagctgtgtag

SEQ ID NO: 158768 - DNA, 1608 bp, Artificial Sequence
  Description of Artificial Sequence: Synthetic coding sequence
atgaggctgagaaatggaacagtggccacagccctggccttcatcaccagcttcctgaccctgtcctggtacaccacctggcagaatggcaaggagaagctgattgcctaccagcgggagttcctggccctgaaggagcggctgagaattgctgagcaccgcatcagccagaggagcagcgagctgaacaccatcgtgcagcagttcaagagggtgggcgctgagaccaacggcagcaaggatgccctgaacaagttcagtgacaacaccctgaagctgctgaaggagctgaccagcaagaagagcctgcaggtgcccagcatctactaccacctgccccacctgctgaagaatgaaggcagcctgcagcctgctgtgcagattggaaatggccgcactggagtgtccatcgtgatgggcatccccaccgtgaagcgggaggtgaagagctacctgattgagaccctgcacagcctgattgacaacctgtacccagaggagaagctggactgtgtgattgtggtgttcatcggggagacagacatcgactatgtgcacggcgtggtggccaacctggagaaggagttcagcaaggagatcagcagcggcctggtggaggtgatcagccccccagagagctactacccagacctgaccaacctgaaggagacctttggagacagcaaggagcgggtgcgctggaggaccaagcagaacctggactactgcttcctgatgatgtatgcccaggagaagggcatctactacatccagctggaggatgacatcatcgtgaagcagaactacttcaacaccatcaagaactttgccctgcagctgagcagcgaggagtggatgatcctggagttcagccagctgggcttcatcggcaagatgttccaggccccagacctgaccctcatcgtggagttcatcttcatgttctacaaggagaagcccatcgactggctgctggaccacatcctgtgggtgaaggtgtgcaaccctgagaaggatgccaagcactgtgaccggcagaaggccaacctgcgcatccgcttccggcccagcctcttccagcacgtgggcctgcacagcagcctgagcggcaagatccagaagctgacagacaaggactacatgaagcccctgctgctgaagatccacgtgaaccccccagctgaggtgtccaccagcctgaaggtgtaccagggccacaccctggagaagacctacatgggagaggacttcttctgggccatcacccccatcgccggggactacatcctcttcaagtttgacaagcctgtgaatgtggagagctacctgttccacagcggcaaccaggagcaccctggggacatcctgctgaacaccaccgtggaggtgctgcccttcaagtctgagggcctggagatcagcaaggagaccaaggacaagaggctggaggatggctacttcagaattggcaagtttgaaaatggagtggccgagggcatggtggaccccagcctgaaccccatcagcgccttccggctgagcgtcatccagaacagcgctgtgtgggccatcctgaatgagatccacatcaagaaggccaccaactag

SEQ ID NO: 158769 - DNA, 1608 bp, Artificial Sequence; identical to SEQ ID NO: 158768
  Description of Artificial Sequence: Synthetic coding sequence

SEQ ID NO: 158770 - DNA, 1608 bp, Artificial Sequence; identical to SEQ ID NO: 158768
  Description of Artificial Sequence: Synthetic coding sequence

SEQ ID NO: 158771 - DNA, 1272 bp, Artificial Sequence
  Description of Artificial Sequence: Synthetic coding sequence
atgaactacagcatcaccgtgtccatcgtgatgggcatccccaccgtgaagcgggaggtgaagagctacctgattgagaccctgcacagcctgattgacaacctgtacccagaggagaagctggactgtgtgattgtggtgttcatcggggagacagacatcgactatgtgcacggcgtggtggccaacctggagaaggagttcagcaaggagatcagcagcggcctggtggaggtgatcagccccccagagagctactacccagacctgaccaacctgaaggagacctttggagacagcaaggagcgggtgcgctggaggaccaagcagaacctggactactgcttcctgatgatgtatgcccaggagaagggcatctactacatccagctggaggatgacatcatcgtgaagcagaactacttcaacaccatcaagaactttgccctgcagctgagcagcgaggagtggatgatcctggagttcagccagctgggcttcatcggcaagatgttccaggccccagacctgaccctcatcgtggagttcatcttcatgttctacaaggagaagcccatcgactggctgctggaccacatcctgtgggtgaaggtgtgcaaccctgagaaggatgccaagcactgtgaccggcagaaggccaacctgcgcatccgcttccggcccagcctcttccagcacgtgggcctgcacagcagcctgagcggcaagatccagaagctgacagacaaggactacatgaagcccctgctgctgaagatccacgtgaaccccccagctgaggtgtccaccagcctgaaggtgtaccagggccacaccctggagaagacctacatgggagaggacttcttctgggccatcacccccatcgccggggactacatcctcttcaagtttgacaagcctgtgaatgtggagagctacctgttccacagcggcaaccaggagcaccctggggacatcctgctgaacaccaccgtggaggtgctgcccttcaagtctgagggcctggagatcagcaaggagaccaaggacaagaggctggaggatggctacttcagaattggcaagtttgaaaatggagtggccgagggcatggtggaccccagcctgaaccccatcagcgccttccggctgagcgtcatccagaacagcgctgtgtgggccatcctgaatgagcagagggtcttcagcggctggtggcagaagagccgggacaaggccgagggcccccaggcccccctgctcttctag

SEQ ID NO: 158772 - DNA, 1647 bp, Artificial Sequence
  Description of Artificial Sequence: Synthetic coding sequence
atgaggctgagaaatggcaccttcctgaccctgctgctcttctgcctgtgtgccttcctgagcctgtcctggtacgccgccctgagcggccagaagggagatgtggtggatgtgtaccagcgggagttcctggccctgcgggaccggctgcacgccgctgagcaggagagcctgaagaggagcaaggagctgaacctggtgctggatgagatcaagagagctgtgtctgagcggcaggccctgagagatggagatggcaacagaacctggggccgcctgacagaggacccccggctgaagccctggaatggcagccaccgccacgtgctgcacctgcccaccgtcttccaccacctgccccacctgctggccaaggagagcagcctgcagcctgctgtgcgggtgggccagggccgcactggagtgtctgtggtgatgggcatccccagcgtgcggcgggaggtgcacagctacctgacagacaccctgcacagcctcatcagcgagctgagcccccaggagaaggaggacagcgtcatcgtggtgctgattgctgagacagacagccagtacaccagcgctgtgacagagaacatcaaggccctcttccccacagagatccacagcggcctgctggaggtgatcagccccagcccccacttctacccagacttcagccggctgcgggagagctttggagaccccaaggagcgggtgcgctggaggaccaagcagaacctggactactgcttcctgatgatgtatgcccagagcaagggcatctactacgtgcagctggaggatgacatcgtggccaagcccaactacctgagcaccatgaagaactttgccctgcagcagcccagcgaggactggatgatcctggagttcagccagctgggcttcatcggcaagatgttcaagagcctggacctgagcctgattgtggagttcatcctgatgttctacagagacaagcccatcgactggctgctggaccacatcctgtgggtgaaggtgtgcaaccctgagaaggatgccaagcactgtgaccggcagaaggccaacctgcgcatccgcttcaagcccagcctcttccagcacgtgggcacccacagcagcctggccggcaagatccagaagctgaaggacaaggactttgggaagcaggccctgaggaaggagcacgtgaaccccccagctgaggtgtccaccagcctgaagacctaccagcacttcaccctggagaaggcctacctgcgggaggacttcttctgggccttcaccccagctgctggggacttcatccgcttccgcttcttccagcccctgcggctggagcgcttcttcttccgcagcggcaacatcgagcaccctgaggacaagctgttcaacacctctgtggaggtgctgccctttgacaacccccagagcgacaaggaggccctgcaggagggccgcacagccaccctgcgctaccccaggagcccagatggctacctgcagatcggcagcttctacaagggcgtggccgagggggaggtggaccctgccttcggccccctggaggccctgcggctgagcatccagacagacagccctgtgtgggtgatcctgtctgagatcttcctgaagaaggctgactag

SEQ ID NO: 158773 - DNA, 1692 bp, Artificial Sequence
  Description of Artificial Sequence: Synthetic coding sequence
atgagccgggtggccggcaccaggacagatgtgaatgagctgctgcagcgctggaccccccgctgtgtgcgctggcacactggaggagccaggagagtggccctggaccggcccctggtgacagcctgcctgcccccagctggagatgtggtggatgtgtaccagcgggagttcctggccctgcgggaccggctgcatgctgctgagcaggagagcctgaagaggagcaaggagctgaacctggtgctggatgagatcaagagagctgtgtctgagcggcaggccctgagagatggagatggcaacagaacctggggccgcctgacagaggacccccggctgaagccctggaatggcagccacagacatgtgctgcacctgcccaccgtcttccaccacctgccccacctgctggccaaggagagcagcctgcagcctgctgtgcgggtgggccagggccgcactggagtgtctgtggtgatgggcatccccagcgtgagaagagaggtgcacagctacctgacagacaccctgcacagcctcatcagcgagctgagcccccaggagaaggaggacagcgtgattgtggtgctgattgctgagacagacagccagtacaccagcgctgtgacagagaacatcaaggccctcttccccacagagatccacagcggcctgctggaggtgatcagccccagcccccacttctacccagacttcagccggctgcgggagagctttggagaccccaaggagcgggtgcgctggaggaccaagcagaacctggactactgcttcctgatgatgtatgcccagagcaagggcatctactacgtgcagctggaggatgacatcgtggccaagcccaactacctgagcaccatgaagaactttgccctgcagcagcccagcgaggactggatgatcctggagttcagccagctgggcttcatcggcaagatgttcaagagcctggacctgagcctcatcgtggagttcatcctgatgttctacagagacaagcccatcgactggctgctggaccacatcctgtgggtgaaggtgtgcaaccctgagaaggatgccaagcactgtgaccggcagaaggccaacctgcgcatccgcttcaagcccagcctcttccagcacgtgggcacccacagcagcctggccggcaagatccagaagctgaaggacaaggactttgggaagcaggccctgaggaaggagcacgtgaaccccccagctgaggtgtccaccagcctgaagacctaccagcacttcaccctggagaaggcctacctgcgggaggacttcttctgggccttcaccccagctgctggggacttcatccgcttccgcttcttccagcccctgcggctggagcgcttcttcttccgcagcggcaacatcgagcaccctgaggacaagctgttcaacacctctgtggaggtgctgccctttgacaacccccagagcgacaaggaggccctgcaggagggccgcacagccaccctgcgctaccccaggagcccagatggctacctgcagatcggcagcttctacaagggcgtggccgagggggaggtggaccctgccttcggccccctggaggccctgcggctgagcatccagacagacagccctgtgtgggtgatcctgtctgagatcttcctgaagaaggctgactag

SEQ ID NO: 158774 - DNA, 1344 bp, Artificial Sequence
  Description of Artificial Sequence: Synthetic coding sequence
atgaggttccgcatctacaagaggaaggtgctgatcctgaccctggtggtggccgcctgtggctttgtgctgtggagcagcaatggccggcagaggaagaatgaggccctggccccacccctgctggatgctgagcccgcccggggggccggcggccggggcggggaccaccccagcgtggccgtgggcatcagaagagtgtccaatgtgtctgctgccagcctggtgcctgctgtgccccagcctgaggccgacaacctgaccctgcgctaccgcagcctggtgtaccagctgaactttgaccagaccctgagaaatgtggacaaggccggcacctgggccccccgggagctggtgctggtggtgcaggtgcacaacagacctgagtacctgcggctgctgctggacagcctgaggaaggcccagggcatcgacaacgtgctggtgatcttcagccatgacttctggagcacagagatcaaccagctgattgctggggtgaacttctgccctgtgctgcaggtgttcttccccttcagcatccagctgtacccaaatgagttccctggcagtgacccccgggactgcccccgggacctgcccaagaatgctgccctgaagctgggctgcatcaatgctgagtacccagacagctttggccactaccgggaggccaagttcagccagaccaagcaccactggtggtggaagctgcactttgtgtgggagcgggtgaagatcctgcgggactatgccggcctcatcctcttcctggaggaggaccactacctggccccagacttctaccacgtgttcaagaagatgtggaagctgaagcagcaggagtgcccagaatgtgatgtgctgagcctgggcacctacagcgccagccgctccttctacggcatggctgacaaggtggatgtgaagacctggaagagcacagagcacaacatgggcctggccctgaccagaaatgcctaccagaagctgattgaatgtacagacaccttctgcacctatgatgactacaactgggactggaccctgcagtacctgactgtgtcctgcctgcccaagttctggaaggtgctggtgccccagatcccccgcatcttccacgccggggactgtggcatgcaccacaagaagacctgccggcccagcacccagagcgcccagatcgagagcctgctgaacaacaacaagcagtacatgtttcctgagaccctgaccatcagcgagaagttcaccgtggtggccatcagcccccccaggaagaatggaggctggggagacatccgggaccacgagctgtgcaagagctaccgccgcctgcagtag

SEQ ID NO: 158775 - DNA, 1362 bp, Artificial Sequence
  Description of Artificial Sequence: Synthetic coding sequence
atggagaggacagagaccatgaggttccgcatctacaagaggaaggtgctgatcctgaccctggtggtggccgcctgtggctttgtgctgtggagcagcaatggccggcagaggaagaatgaggccctggccccacccctgctggatgctgagcccgcccggggggccggcggccggggcggggaccaccccagcgtggccgtgggcatcagaagagtgtccaatgtgtctgctgccagcctggtgcctgctgtgccccagcctgaggccgacaacctgaccctgcgctaccgcagcctggtgtaccagctgaactttgaccagaccctgagaaatgtggacaaggccggcacctgggccccccgggagctggtgctggtggtgcaggtgcacaacagacctgagtacctgcggctgctgctggacagcctgaggaaggcccagggcatcgacaacgtgctggtgatcttcagccatgacttctggagcacagagatcaaccagctgattgctggggtgaacttctgccctgtgctgcaggtgttcttccccttcagcatccagctgtacccaaatgagttccctggcagtgacccccgggactgcccccgggacctgcccaagaatgctgccctgaagctgggctgcatcaatgctgagtacccagacagctttggccactaccgggaggccaagttcagccagaccaagcaccactggtggtggaagctgcactttgtgtgggagcgggtgaagatcctgcgggactatgccggcctcatcctcttcctggaggaggaccactacctggccccagacttctaccacgtgttcaagaagatgtggaagctgaagcagcaggagtgcccagaatgtgatgtgctgagcctgggcacctacagcgccagccgctccttctacggcatggctgacaaggtggatgtgaagacctggaagagcacagagcacaacatgggcctggccctgaccagaaatgcctaccagaagctgattgaatgtacagacaccttctgcacctatgatgactacaactgggactggaccctgcagtacctgactgtgtcctgcctgcccaagttctggaaggtgctggtgccccagatcccccgcatcttccacgccggggactgtggcatgcaccacaagaagacctgccggcccagcacccagagcgcccagatcgagagcctgctgaacaacaacaagcagtacatgtttcctgagaccctgaccatcagcgagaagttcaccgtggtggccatcagcccccccaggaagaatggaggctggggagacatccgggaccacgagctgtgcaagagctaccgccgcctgcagtag

SEQ ID NO: 158776 - DNA, 2373 bp, Artificial Sequence
  Description of Artificial Sequence: Synthetic coding sequence
atgatcaccgtgaacccagatggcaagatcatggtgcggcgctgcctggtgaccctgcggcccttccggctgtttgtgctgggcatcggcttcttcaccctgtgcttcctgatgaccagcctgggcggccagttcagcgcccggcggctgggggacagccccttcaccatcagaacagaggtgatgggcggccctgagagcagaggagtgctgaggaagatgtctgacctgctggagctgatggtgaagaggatggatgccctggcccggctggagaacagcagcgagctgcaccgggccggcggggacctgcacttccctgctgacaggatgcctcctggagctggcctgatggagcgcatccaggccatcgcccagaatgtgtctgacattgctgtgaaggtggaccagatcctgcggcacagcctgctgctgcacagcaaggtgtctgagggcagaagagaccagtgtgaggcccccagcgaccccaagttcccagactgcagcggcaaggtggagtggatgagggcccgctggaccagtgacccctgctacgccttcttcggcgtggatggaacagagtgcagcttcctgatctacctgtctgaggtggagtggttctgcccccccctgccctggaggaaccagacagctgcccagagggcccccaagcccctgcccaaggtgcaggccgtgttccgcagcaacctgagccacctgctggacctgatgggcagcggcaaggagagcctcatcttcatgaagaagaggaccaagaggctgacagcccagtgggccctggccgcccagaggctggcccagaagctgggcgccacccagagggaccagaagcagatcctggtgcacatcggcttcctgacagaggagagcggagatgtgttcagcccccgggtgctgaagggcggccccctgggggagatggtgcagtgggccgacatcctgacagccctgtatgtgctgggccacggcctgcgggtgacagtgtccctgaaggagctgcagagcaacctgggcgtgcccccaggccggggcagctgccccctgaccatgcccctgccctttgacctgatctacacagactaccacggcctgcagcagatgaagaggcacatgggcctgtccttcaagaagtaccgctgccgcatccgggtcatcgacacctttggaacagagcccgcctacaaccacgaggagtatgccaccctgcacggctaccgcaccaactggggctactggaacctgaaccccaagcagttcatgaccatgttcccccacaccccagacaacagcttcatgggctttgtgtctgaggagctgaatgaaacagagaagaggctcatcaagggcggcaaggccagcaacatggctgtggtgtatggcaaggaggccagcatctggaagggcaaggagaagttcctgggcatcctgaacaagtacatggagatccacggcaccgtgtactatgagagccagaggcctcctgaggtgcctgcctttgtgaagaaccacggcctgctgccccagcctgagttccagcagctgctgaggaaggccaagctgttcatcggcttcggcttcccctatgagggccctgcccccctggaggccatcgccaacggctgcatcttcctgcagagccgcttcagccccccccacagcagcctgaaccacgagttcttccggggcaagcccaccagccgggaggtgttcagccagcacccctatgcagagaacttcatcggcaagccccacgtgtggacagtggactacaacaacagcgaggagtttgaagctgccatcaaggccatcatgaggacccaggtggacccctacctgccctatgagtacacctgtgagggcatgctggagcgcatccacgcctacatccagcaccaggacttctgccgggccccagaccctgccctgcctgaggcccacgccccccagagcccctttgtgctggccccaaatgccacccacctggagtgggccaggaacaccagcctggcccctggggcctggcccccagcccacgccctgcgggcctggctggccgtgcccggccgggcctgcacagacacctgcctggaccacggcctcatctgtgagcccagcttcttccccttcctgaacagccaggatgccttcctgaagctgcaggtgccctgtgacagcacagaaagtgagatgaaccacctgtacccagcctttgcccagcccggccaggagtgctacctgcagaaggagcccctgctcttcagctgtgccggcagcaacaccaagtaccgccgcctgtgcccctgccgggacttcaggaagggccaggtggccctgtgccagggctgcctgtag

SEQ ID NO: 158777 - DNA, 1185 bp, Artificial Sequence
  Description of Artificial Sequence: Synthetic coding sequence
atgatcaccgtgaacccagatggcaagatcatggtgcggcgctgcctggtgaccctgcggcccttccggctgtttgtgctgggcatcggcttcttcaccctgtgcttcctgatgaccagcctgggcggccagttcagcgcccggcggctgggggacagccccttcaccatcagaacagaggtgatgggcggccctgagagcagaggagtgctgaggaagatgtctgacctgctggagctgatggtgaagaggatggatgccctggcccggctggagaacagcagcgagctgcaccgggccggcggggacctgcacttccctgctgacaggatgcctcctggagctggcctgatggagcgcatccaggccatcgcccagaatgtgtctgacattgctgtgaaggtggaccagatcctgcggcacagcctgctgctgcacagcaaggtgtctgagggcagaagagaccagtgtgaggcccccagcgaccccaagttcccagactgcagcggcaaggtggagtggatgagggcccgctggaccagtgacccctgctacgccttcttcggcgtggatggaacagagtgcagcttcctgatctacctgtctgaggtggagtggttctgcccccccctgccctggaggaaccagacagctgcccagagggcccccaagcccctgcccaaggtgcaggccgtgttccgcagcaacctgagccacctgctggacctgatgggcagcggcaaggagagcctcatcttcatgaagaagaggaccaagaggctgacagcccagtgggccctggccgcccagaggctggcccagaagctgggcgccacccagagggaccagaagcagatcctggtgcacatcggcttcctgacagaggagagcggagatgtgttcagcccccgggtgctgaagggcggccccctgggggagatggtgcagtgggccgacatcctgacagccctgtatgtgctgggccacggcctgcgggtgacagtgtccctgaaggagctgcagaggcagaggcggctgcggagcagccaggagcaggcccgctgtggggtgatgggcgcctgtgagaagatgctgctggagggagatgtggccagcaacaccctgctgattgagaagcccagcaagaaggagacagagaagtgccccaagaacctggtgacctag

SEQ ID NO: 158778 - DNA, 2406 bp, Artificial Sequence
  Description of Artificial Sequence: Synthetic coding sequence
atgcacagctttgtgaagcacctgtgcagccgctacgtggtggagcggcagggcaccatggccctgcctgccctgctgacccggctgctgcccctgcggcggctgtttgtgctgggcatcggcttcttcaccctgtgcttcctgatgaccagcctgggcggccagttcagcgcccggcggctgggggacagccccttcaccatcagaacagaggtgatgggcggccctgagagccggggcgtgctgaggaagatgtctgacctgctggagctgatggtgaagaggatggatgccctggcccggctggagaacagcagcgagctgcacagagctggaggagacctgcacttccctgctgacaggatgcctcctggggccggcctgatggagcgcatccaggccatcgcccagaatgtgtctgacattgctgtgaaggtggaccagatcctgcggcacagcctgctgctgcacagcaaggtgtctgagggccggcgggaccagtgtgaggcccccagcgaccccaagttcccagactgcagcggcaaggtggagtggatgagggcccgctggaccagtgacccctgctacgccttctttggagtggatggaacagaatgttccttcctgatctacctgtctgaggtggagtggttctgcccccccctgccctggaggaaccagacagctgcccagagggcccccaagcccctgcccaaggtgcaggccgtgttccgcagcaacctgagccacctgctggacctgatgggcagcggcaaggagagcctcatcttcatgaagaagaggaccaagaggctgacagcccagtgggccctggccgcccagaggctggcccagaagctgggcgccacccagagggaccagaagcagatcctggtgcacatcggcttcctgacagaggagagcggagatgtgttcagcccccgggtgctgaagggcggccccctgggggagatggtgcagtgggccgacatcctgacagccctgtatgtgctgggccacggcctgcgggtgacagtgtccctgaaggagctgcagagcaacctgggcgtgcccccaggccggggcagctgccccctgaccatgcccctgccctttgacctgatctacacagactaccacggcctgcagcagatgaagaggcacatgggcctgtccttcaagaagtaccgctgccgcatccgggtgattgacaccttcggcacagagcccgcctacaaccacgaggagtatgccaccctgcacggctaccgcaccaactggggctactggaacctgaaccccaagcagttcatgaccatgttcccccacaccccagacaacagcttcatgggctttgtgtctgaggagctgaatgaaacagagaagaggctcatcaagggcggcaaggccagcaacatggctgtggtgtatggcaaggaggccagcatctggaagggcaaggagaagttcctgggcatcctgaacaagtacatggagatccatggaacagtgtactatgagagccagaggcctcctgaggtgcctgcctttgtgaagaaccacggcctgctgccccagcctgagttccagcagctgctgaggaaggccaagctgttcatcggcttcggcttcccctatgagggccctgcccccctggaggccatcgccaacggctgcatcttcctgcagagccgcttcagccccccccacagcagcctgaaccacgagttcttccggggcaagcccaccagccgggaggtgttcagccagcacccctatgcagagaacttcatcggcaagccccacgtgtggacagtggactacaacaacagcgaggagtttgaggccgccatcaaggccatcatgaggacccaggtggacccctacctgccctatgagtacacctgtgagggcatgctggagcgcatccacgcctacatccagcaccaggacttctgccgggccccagaccctgccctgcctgaggcccacgccccccagagcccctttgtgctggccccaaatgccacccacctggagtgggccaggaacaccagcctggcccctggggcctggcccccagcccacgccctgcgggcctggctggccgtgcccggccgggcctgcacagacacctgcctggaccacggcctcatctgtgagcccagcttcttccccttcctgaacagccaggatgccttcctgaagctgcaggtgccctgtgacagcacagagagcgagatgaaccacctgtacccagcctttgcccagcccggccaggagtgctacctgcagaaggagcccctgctcttcagctgtgccggcagcaacaccaagtacagaaggctgtgcccctgccgggacttcaggaagggccaggtggccctgtgccagggctgcctgtag

SEQ ID NO: 158779 - DNA, 1602 bp, Artificial Sequence
  Description of Artificial Sequence: Synthetic coding sequence
atgaagatgaggcgctacaagctgttcctgatgttctgcatggccggcctgtgcctgatctccttcctgcacttcttcaagaccctgtcctatgtgaccttcccccgggagctggccagcctgagccccaacctggtgagcagcttcttctggaacaatgcccctgtgaccccccaggccagccctgagcccggcggccctgacctgctgcggacccccctgtacagccacagccccctgctgcagcccctgccccccagcaaggctgctgaggagctgcaccgggtggacctggtgctgcctgaggacaccacagagtactttgtgaggaccaaggccggcggcgtgtgcttcaagccaggcaccaagatgctggagcggcccccacctggccggcctgaggagaagccagagggcgccaacggcagcagcgcccggcggcccccacgctacctgctgagcgcccgggagaggactggaggccgcggggcccggaggaagtgggtggagtgtgtgtgcctgcccggctggcacggccccagctgtggggtgcccaccgtggtgcagtacagcaacctgcccaccaaggagcggctggtgccccgggaggtgccccggcgggtcatcaatgccatcaacgtgaaccacgagtttgacctgctggatgtgcgcttccacgagctgggagatgtggtggatgcctttgtggtgtgtgagagcaacttcaccgcctatggagagccccggcccctgaagttccgggagatgctgaccaacggcacctttgagtacatccgccacaaggtgctgtatgtgttcctggaccacttccccccaggcggccggcaggacggctggattgctgatgactacctgcggaccttcctgacccaggatggagtgtcccggctgaggaacctgcggccagatgatgtgttcatcattgatgatgctgatgagatcccagccagagatggagtgctcttcctgaagctgtatgatggctggacagagccctttgccttccacatgaggaagagcctgtatggcttcttctggaagcagcccggcaccctggaggtggtgtctggctgcaccgtggacatgctgcaggccgtgtatggcctggatggcatccggctgcggcggcggcagtactacaccatgcccaacttccggcagtatgagaacagaacaggccacatcctggtgcagtggagcctgggcagccccctgcactttgctggctggcactgctcctggtgcttcaccccagagggcatctacttcaagctggtgtctgcccagaatggagacttcccccgctggggagactatgaggacaagagggacctgaactacatccggggcctcatcagaactggaggctggtttgatggcacccagcaggagtacccacctgctgaccccagcgagcacatgtatgcccccaagtacctgctgaagaactatgaccgcttccactacctgctggacaacccctaccaggagcccaggagcacagctgctgggggctggaggcaccggggccctgagggccggcccccagcccggggcaagctggatgaagctgaggtgtag

SEQ ID NO: 158780 - DNA, 327 bp, Artificial Sequence
  Description of Artificial Sequence: Synthetic coding sequence
atggagagctgcagctgccaccctggcagcggcgtgcagtggagggaccacggcagcctgcagctgcccccacctggcttcaagatgaagatgaggcgctacaagctgttcctgatgttctgcatggccggcctgtgcctgatctccttcctgcacttcttcaagaccctgtcctatgtgaccttcccccgggagctggccagcctgagccccaacctggtgagcagcttcttctggaacaatgcccctgtgaccccccaggccagccctgagcccggcggccctgacctgctgcggacccccctgtacagccacagccccctgtag

SEQ ID NO: 158781 - DNA, 486 bp, Artificial Sequence
  Description of Artificial Sequence: Synthetic coding sequence
atgaagatgaggcgctacaagctgttcctgatgttctgcatggccggcctgtgcctgatctccttcctgcacttcttcaagaccctgtcctatgtgaccttcccccgggagctggccagcctgagccccaacctggtgagcagcttcttctggaacaatgcccctgtgaccccccaggccagccctgagcccggcggccctgacctgctgcggacccccctgtacagccacagccccctgctgcagcccctgccccccagcaaggctgctgaggagctgcaccgggtggacctggtgctgcctgaggacaccacagagtactttgtgaggaccaaggccggcggcgtgtgcttcaagccaggcaccaagatgctggagcggcccccacctggccggcctgaggagaagccagagggcgccaacggcagcagcgcccggcggcccccacgctacctgctgagcgcccgggagaggactggaggatag

SEQ ID NO: 158782 - DNA, 1044 bp, Artificial Sequence
  Description of Artificial Sequence: Synthetic coding sequence
atggtgagcagccagaagctggagaagcccatcgagatgggcagcagcgagcccctgcccatcgcagatggagacagaagaaggaagaagaagaggcggggccgggccacagacagcctgcccgggaagtttgaggacatgtacaagctgaccagcgagctgctgggggagggcgcctatgccaaggtgcagggcgctgtgtccctgcagaatggcaaggagtatgctgtgaagatcatcgagaagcaggccggccacagccgcagcagggtcttccgggaggtggagaccctgtaccagtgccagggcaacaagaacatcctggagctgattgagttctttgaagatgacacccgcttctacctggtgtttgagaagctgcagggcggcagcatcctggcccacatccagaagcagaagcacttcaatgaaagagaggccagccgggtggtgagagatgtggccgccgccctggacttcctgcacaccaagggcatcgcccaccgggacctgaagccagagaacatcctgtgtgagagccctgagaaggtgtcccctgtgaagatctgtgactttgacctgggcagcggcatgaagctgaacaacagctgcacccccatcaccaccccagagctgaccaccccctgtggcagcgctgagtacatggcccctgaggtggtggaggtgttcacagaccaggccaccttctatgacaagagatgtgacctgtggagcctgggcgtggtgctgtacatcatgctgagcggctaccccccatttgtgggccactgtggggctgactgtggctgggacagaggagaggtgtgccgggtgtgccagaacaagctgtttgagagcatccaggagggcaagtatgagttcccagacaaggactgggcccacatcagcagcgaggccaaggacctgatcagcaagctgctggtgagagatgccaagcagaggctgtctgctgcccaggtgctgcagcacccctgggtgcagggcgagcagcagcacaacggcccagatgccctgcggagctag

SEQ ID NO: 158783 - DNA, 990 bp, Artificial Sequence
  Description of Artificial Sequence: Synthetic coding sequence
atggccaagtccatgcccagcaagagcagcaggaacaagcagggcaccgtgggcgtgggctgctttgagcgctggaggcgctgcatctctgtgcgggagaccagcagcatcctggcccacatccagaagcagaagcacttcaatgaaagagaggccagccgggtggtgagagatgtggccgccgccctggacttcctgcacaccaagggcatcgcccaccgggacctgaagccagagaacatcctgtgtgagagccctgagaaggtgtcccctgtgaagatctgtgactttgacctgggcagcggcatgaagctgaacaacagctgcacccccatcaccaccccagagctgaccaccccctgtggcagcgctgagtacatggcccctgaggtggtggaggtgttcacagaccaggccaccttctatgacaagagatgtgacctgtggagcctgggcgtggtgctgtacatcatgctgagcggctaccccccatttgtgggccactgtggggctgactgtggctgggacagaggagaggtgtgccgggtgtgccagaacaagctgtttgagagcatccaggagggcaagtatgagttcccagacaaggactgggcccacatcagcagcgaggccaaggacctgatcagcaagctgctggtgagagatgccaagcagaggctgtctgctgcccaggtgctgcagcacccctgggtgcagggccaggcccctgagaagggcctgcccaccccccaggtgctgcagaggaacagcagcaccatggacctgaccctgtttgctgctgaggccatcgccctgaaccggcagctgagccagcatgaagaaaatgagctggccgaggagcctgaggccctggctgatggcctgtgcagcatgaagctgagccccccctgcaagagccggctggccaggagaagagccctggcccaggccggcagaggagaagatagaagccccccaacagccctgtag

SEQ ID NO: 158784 - DNA, 1275 bp, Artificial Sequence
  Description of Artificial Sequence: Synthetic coding sequence
atggtgagcagccagaagctggagaagcccatcgagatgggcagcagcgagcccctgcccatcgcagatggagacagaagaaggaagaagaagaggcggggccgggccacagacagcctgcccgggaagtttgaggacatgtacaagctgaccagcgagctgctgggggagggcgcctatgccaaggtgcagggcgctgtgtccctgcagaatggcaaggagtatgctgtgaagatcatcgagaagcaggccggccacagccgcagcagggtcttccgggaggtggagaccctgtaccagtgccagggcaacaagaacatcctggagctgattgagttctttgaagatgacacccgcttctacctggtgtttgagaagctgcagggcggcagcatcctggcccacatccagaagcagaagcacttcaatgaaagagaggccagccgggtggtgagagatgtggccgccgccctggacttcctgcacaccaagggcatcgcccaccgggacctgaagccagagaacatcctgtgtgagagccctgagaaggtgtcccctgtgaagatctgtgactttgacctgggcagcggcatgaagctgaacaacagctgcacccccatcaccaccccagagctgaccaccccctgtggcagcgctgagtacatggcccctgaggtggtggaggtgttcacagaccaggccaccttctatgacaagagatgtgacctgtggagcctgggcgtggtgctgtacatcatgctgagcggctaccccccatttgtgggccactgtggggctgactgtggctgggacagaggagaggtgtgccgggtgtgccagaacaagctgtttgagagcatccaggagggcaagtatgagttcccagacaaggactgggcccacatcagcagcgaggccaaggacctgatcagcaagctgctggtgagagatgccaagcagaggctgtctgctgcccaggtgctgcagcacccctgggtgcagggccaggcccctgagaagggcctgcccaccccccaggtgctgcagaggaacagcagcaccatggacctgaccctgtttgctgctgaggccatcgccctgaaccggcagctgagccagcacgaggagaatgagctggccgaggagcctgaggccctggctgatggcctgtgcagcatgaagctgagccccccctgcaagagccggctggcccggcggcgggccctggcccaggccggccgcggggaggacaggagccccccaacagccctgtag

SEQ ID NO: 158785 - DNA, 1398 bp, Artificial Sequence
  Description of Artificial Sequence: Synthetic coding sequence
atggtgagcagccagaagctggagaagcccatcgagatgggcagcagcgagcccctgcccatcgcagatggagacagaagaaggaagaagaagaggcggggccgggccacagacagcctgcccgggaagtttgaggacatgtacaagctgaccagcgagctgctgggggagggcgcctatgccaaggtgcagggcgctgtgtccctgcagaatggcaaggagtatgctgtgaagatcatcgagaagcaggccggccacagccgcagcagggtcttccgggaggtggagaccctgtaccagtgccagggcaacaagaacatcctggagctgattgagttctttgaagatgacacccgcttctacctggtgtttgagaagctgcagggcggcagcatcctggcccacatccagaagcagaagcacttcaatgaaagagaggccagccgggtggtgagagatgtggccgccgccctggacttcctgcacaccaaggacaaggtgtccctgtgccacctgggctggagcgccatggcccccagcggcctgacagctgcccccaccagcctgggcagcagtgacccccccaccagcgccagccaggtggccggcaccactggaattgcccaccgggacctgaagccagagaacatcctgtgtgagagccctgagaaggtgtcccctgtgaagatctgtgactttgacctgggcagcggcatgaagctgaacaacagctgcacccccatcaccaccccagagctgaccaccccctgtggcagcgctgagtacatggcccctgaggtggtggaggtgttcacagaccaggccaccttctatgacaagagatgtgacctgtggagcctgggcgtggtgctgtacatcatgctgagcggctaccccccatttgtgggccactgtggggctgactgtggctgggacagaggagaggtgtgccgggtgtgccagaacaagctgtttgagagcatccaggagggcaagtatgagttcccagacaaggactgggcccacatcagcagcgaggccaaggacctgatcagcaagctgctggtgagagatgccaagcagaggctgtctgctgcccaggtgctgcagcacccctgggtgcagggccaggcccctgagaagggcctgcccaccccccaggtgctgcagaggaacagcagcaccatggacctgaccctgtttgctgctgaggccatcgccctgaaccggcagctgagccagcatgaagaaaatgagctggccgaggagcctgaggccctggctgatggcctgtgcagcatgaagctgagccccccctgcaagagccggctggccaggagaagagccctggcccaggccggcagaggagaagatagaagccccccaacagccctgtag

SEQ ID NO: 158786 - DNA, 1044 bp, Artificial Sequence; identical to SEQ ID NO: 158782
  Description of Artificial Sequence: Synthetic coding sequence

SEQ ID NO: 158787 - DNA, 537 bp, Artificial Sequence
  Description of Artificial Sequence: Synthetic coding sequence
atggtgagcagccagaagctggagaagcccatcgagatgggcagcagcgagcccctgcccatcgcagatggagacagaagaaggaagaagaagaggcggggccgggccacagacagcctgcccgggaagtttgaggacatgtacaagctgaccagcgagctgctgggggagggcgcctatgccaaggtgcagggcgctgtgtccctgcagaatggcaaggagtatgctgtgaagatcatcgagaagcaggccggccacagccgcagcagggtcttccgggaggtggagaccctgtaccagtgccagggcaacaagaacatcctggagctgattgagttctttgaagatgacacccgcttctacctggtgtttgagaagctgcagggcggcagcatcctggcccacatccagaagcagaagcacttcaatgaaagagaggccagccgggtggtgagagatgtggccgccgccctggacttcctgcacaccaagggcatcgcccaccgggacctgaagccagagaacatcctgtgctag

SEQ ID NO: 158788 - DNA, 306 bp, Artificial Sequence
  Description of Artificial Sequence: Synthetic coding sequence
atggtgagcagccagaagctggagaagcccatcgagatgggcagcagcgagcccctgcccatcgcagatggagacagaagaaggaagaagaagaggcggggccgggccacagacagcctgcccgggaagtttgaggacatgtacaagctgaccagcgagctgctgggggagggcgcctatgccaaggtgcagggcgctgtgtccctgcagaatggcaaggagtatgctgtgaagatcatcgagaagcaggccggccacagccgcagcagggtcttccgggaggtggagaccctgtaccagtgctag

SEQ ID NO: 158789 - DNA, 303 bp, Artificial Sequence
  Description of Artificial Sequence: Synthetic coding sequence
atggtgagcagccagaagctggagaagcccatcgagatgggcagcagcgagcccctgcccatcgcagatggagacagaagaaggaagaagaagaggcggggccgggccacagacagcctgcccgggaagtttgaggacatgtacaagctgaccagcgagctgctgggggagggcgcctatgccaaggtgcagggcgctgtgtccctgcagaatggcaaggagtatgctgtgaagatcatcgagaagcaggccggccacagccgcagcagggtcttccgggaggtggagaccctgtaccagtag

SEQ ID NO: 158790 - DNA, 402 bp, Artificial Sequence
  Description of Artificial Sequence: Synthetic coding sequence
atggtgagcagccagaagctggagaagcccatcgagatgggcagcagcgagcccctgcccatcgcagatggagacagaagaaggaagaagaagaggcggggccgggccacagacagcctgcccgggaagtttgaggacatgtacaagctgaccagcgagctgctgggggagggcgcctatgccaaggtgcagggcgctgtgtccctgcagaatggcaaggagtatgctgtgaagatcatcgagaagcaggccggccacagccgcagcagggtcttccgggaggtggagaccctgtaccagtgccagggcaacaagaacatcctggagctgattgagttctttgaagatgacacccgcttctacctggtgtttgagaagctgcagggcggcacctacagatag

SEQ ID NO: 158791 - DNA, 1398 bp, Artificial Sequence
  Description of Artificial Sequence: Synthetic coding sequence
atggtgcagaagaagccagctgagctgcagggcttccaccgctccttcaagggccagaacccctttgagctggccttcagcctggaccagcctgaccatggagacagcgactttggcctgcagtgcagcgcccggccagacatgcctgccagccagcccatcgacatcccagatgccaagaagaggggcaagaagaagaagaggggccgggccacagacagcttcagcggccgctttgaagatgtgtaccagctgcaggaggatgtgctgggggagggcgcccacgcccgggtgcagacctgcatcaacctgatcaccagccaggagtatgctgtgaagatcatcgagaagcagcccggccacatccgcagcagggtcttccgggaggtggagatgctgtaccagtgccagggccacagaaatgtgctggagctgattgagttctttgaggaggaggaccgcttctacctggtgtttgagaagatgaggggcggcagcatcctgagccacatccacaagaggaggcacttcaatgagctggaggcctctgtggtggtgcaggatgtggccagcgccctggacttcctgcacaacaagggcatcgcccaccgggacctgaagccagagaacatcctgtgtgagcaccccaaccaggtgtcccctgtgaagatctgtgactttgacctgggcagcggcatcaagctgaatggagactgcagccccatcagcaccccagagctgctgaccccctgtggcagcgctgagtacatggcccctgaggtggtggaggccttcagcgaggaggccagcatctatgacaagagatgtgacctgtggagcctgggcgtcatcctgtacatcctgctgagcggctaccccccatttgtgggccgctgtggcagtgactgtggctgggacagaggagaggcctgcccagcctgccagaacatgctgtttgagagcatccaggagggcaagtatgagttcccagacaaggactgggcccacatcagctgtgccgccaaggacctgatcagcaagctgctggtgagagatgccaagcagaggctgtctgctgcccaggtgctgcagcacccctgggtgcagggctgtgcccctgagaacaccctgcccacccccatggtgctgcagaggaacagctgtgccaaggacctgaccagctttgctgctgaggccatcgccatgaaccggcagctggcccagcatgatgaggacctggccgaggaggaggccgccggccagggccagcctgtgctggtgcgggccaccagccgctgcctgcagctgagcccccccagccagagcaagctggcccagaggcggcagagggccagcctgagcagcgcccctgtggtgctggtgggggaccacgcctag

SEQ ID NO: 158792 - DNA, 1245 bp, Artificial Sequence
  Description of Artificial Sequence: Synthetic coding sequence
atggtgcagaagaagccagctgagctgcagggcttccaccgctccttcaagggccagaacccctttgagctggccttcagcctggaccagcctgaccatggagacagcgactttggcctgcagtgcagcgcccggccagacatgcctgccagccagcccatcgacatcccagatgccaagaagaggggcaagaagaagaagaggggccgggccacagacagcttcagcggccgctttgaagatgtgtaccagctgcaggaggatgtgctgggggagggcgcccacgcccgggtgcagacctgcatcaacctgatcaccagccaggagtatgctgtgaagatcatcgagaagcagcccggccacatccgcagcagggtcttccgggaggtggagatgctgtaccagtgccagggccacagaaatgtgctggagctgattgagttctttgaggaggaggaccgcttctacctggtgtttgagaagatgaggggcggcagcatcctgagccacatccacaagaggaggcacttcaatgagctggaggcctctgtggtggtgcaggatgtggccagcgccctggacttcctgcacaacaagggcatcgcccaccgggacctgaagccagagaacatcctgtgtgagcaccccaaccaggtgtcccctgtgaagatctgtgactttgacctgggcagcggcatcaagctgaatggagactgcagccccatcagcaccccagagctgctgaccccctgtggcagcgctgagtacatggcccctgaggtggtggaggccttcagcgaggaggccagcatctatgacaagagatgtgacctgtggagcctgggcgtcatcctgtacatcctgctgagcggctaccccccatttgtgggccgctgtggcagtgactgtggctgggacagaggagaggcctgcccagcctgccagaacatgctgtttgagagcatccaggagggcaagtatgagttcccagacaaggactgggcccacatcagctgtgccgccaaggacctgatcagcaagctgctggtgagagatgccaagcagaggctgtctgctgcccaggtgctgcagcacccctgggtgcagggctgtgcccctgagaacaccctgcccacccccatggtgctgcagcgctgggacagccacttcctgctgcccccccacccctgccgcatccacgtgcggcctgggggcctggtgaggacagtgacagtgaatgaatag

SEQ ID NO: 158793 - DNA, 1005 bp, Artificial Sequence
  Description of Artificial Sequence: Synthetic coding sequence
atgctgtaccagtgccagggccacagaaatgtgctggagctgattgagttctttgaggaggaggaccgcttctacctggtgtttgagaagatgagaggaggcagcatcctgagccacatccacaagagaagacacttcaatgagctggaggcctctgtggtggtgcaggatgtggccagcgccctggacttcctgcacaacaagggcatcgcccaccgggacctgaagccagagaacatcctgtgtgagcaccccaaccaggtgtcccctgtgaagatctgtgactttgacctgggcagcggcatcaagctgaatggagactgcagccccatcagcaccccagagctgctgaccccctgtggcagcgctgagtacatggcccctgaggtggtggaggccttcagcgaggaggccagcatctatgacaagagatgtgacctgtggagcctgggcgtcatcctgtacatcctgctgagcggctaccccccatttgtgggccgctgtggcagtgactgtggctgggacagaggagaggcctgcccagcctgccagaacatgctgtttgagagcatccaggagggcaagtatgagttcccagacaaggactgggcccacatcagctgtgccgccaaggacctgatcagcaagctgctggtgagagatgccaagcagaggctgtctgctgcccaggtgctgcagcacccctgggtgcagggctgtgcccctgagaacaccctgcccacccccatggtgctgcagaggaacagctgtgccaaggacctgaccagctttgctgctgaggccatcgccatgaaccggcagctggcccagcatgatgaggacctggccgaggaggaggccgccggccagggccagcctgtgctggtgcgggccaccagccgctgcctgcagctgagcccccccagccagagcaagctggcccagaggcggcagagggccagcctgagcagcgcccctgtggtgctggtgggggaccacgcctag

SEQ ID NO: 158794 - DNA, 1218 bp, Artificial Sequence
  Description of Artificial Sequence: Synthetic coding sequence
atgcctgccagccagcccatcgacatcccagatgccaagaagaggggcaagaagaagaagaggggccgggccacagacagcttcagcggccgctttgaagatgtgtaccagctgcaggaggatgtgctgggggagggcgcccacgcccgggtgcagacctgcatcaacctgatcaccagccaggagtatgctgtgaagatcatcgagaagcagcccggccacatccgcagcagggtcttccgggaggtggagatgctgtaccagtgccagggccacagaaatgtgctggagctgattgagaagatgaggggcggcagcatcctgagccacatccacaagaggaggcacttcaatgagctggaggcctctgtggtggtgcaggatgtggccagcgccctggacttcctgcacaacaagggcatcgcccaccgggacctgaagccagagaacatcctgtgtgagcaccccaaccaggtgtcccctgtgaagatctgtgactttgacctgggcagcggcatcaagctgaatggagactgcagccccatcagcaccccagagctgctgaccccctgtggcagcgctgagtacatggcccctgaggtggtggaggccttcagcgaggaggccagcatctatgacaagagatgtgacctgtggagcctgggcgtcatcctgtacatcctgctgagcggctaccccccatttgtgggccgctgtggcagtgactgtggctgggacagaggagaggcctgcccagcctgccagaacatgctgtttgagagcatccaggagggcaagtatgagttcccagacaaggactgggcccacatcagctgtgccgccaaggacctgatcagcaagctgctggtgagagatgccaagcagaggctgtctgctgcccaggtgctgcagcacccctgggtgcagggctgtgcccctgagaacaccctgcccacccccatggtgctgcagaggaacagctgtgccaaggacctgaccagctttgctgctgaggccatcgccatgaaccggcagctggcccagcatgatgaggacctggccgaggaggaggccgccggccagggccagcctgtgctggtgcgggccaccagccgctgcctgcagctgagcccccccagccagagcaagctggcccagaggcggcagagggccagcctgagcagcgcccctgtggtgctggtgggggaccacgcctag

SEQ ID NO: 158795 - DNA, 2388 bp, Artificial Sequence
  Description of Artificial Sequence: Synthetic coding sequence
atgtctgcccggacccccctgcccaccgtgaatgaaagagacacagagaaccacacctctgtggatggctacacagagccccacatccagcccaccaagagcagcagccggcagaacatcccccgctgcaggaacagcatcaccagcgccacagatgagcagccccacatcggcaactaccgcctgcagaagaccatcggcaagggcaactttgccaaggtgaagctggcccggcacgtgctgaccggccgggaggtggccgtgaagatcatcgacaagacccagctgaaccccaccagcctgcagaagctgttccgggaggtgcgcatcatgaagatcctgaaccaccccaacatcgtgaagctgtttgaagtcatcgagacagagaagaccctgtacctggtgatggagtatgccagcggcggggaggtgtttgactacctggtggcccacggccgcatgaaggagaaggaggcccgggccaagttccggcagatcgtgtctgctgtgcagtactgccaccagaagtacatcgtgcaccgggacctgaaggccgagaacctgctgctggatggagacatgaacatcaagattgctgactttggcttcagcaatgagttcaccgtgggcaacaagctggacaccttctgtggcagccccccctatgctgcccctgagctgttccagggcaagaagtatgatggccctgaggtggatgtgtggagcctgggcgtcatcctgtacaccctggtgtctggcagcctgccctttgatggccagaacctgaaggagctgcgggagcgggtgctgcggggcaagtaccgcatccccttctacatgagcacagactgtgagaacctgctgaagaagctgctggtgctgaaccccatcaagaggggcagcctggagcagatcatgaaggaccgctggatgaatgtgggccacgaggaggaggagctgaagccctacacagagccagaccctgacttcaatgacaccaagagaattgacatcatggtgaccatgggctttgccagagatgagatcaatgatgccctgatcaaccagaagtatgatgaggtgatggccacctacatcctgctgggcaggaagcccccagagtttgaaggaggagagagcctgagcagcggcaacctgtgccagaggagccggcccagcagtgacctgaacaacagcaccctgcagagccctgcccacctgaaggtgcagaggagcatcagcgccaaccagaagcagaggcgcttcagtgaccacgccggccccagcatccccccagctgtgtcctacaccaagaggccccaggccaacagcgtggagagcgagcagaaggaggagtgggacaaggatgtggccaggaagctgggcagcaccaccgtgggcagcaagtctgagatgacagccagccccctggtgggccctgagaggaagaagagcagcaccatccccagcaacaacgtgtacagcggcggctccatggcccggaggaacacctacgtgtgtgagaggaccacagaccgctacgtggccctgcagaatggcaaggacagcagcctgacagagatgtctgtgagcagcatcagcagcgctggcagctctgtggccagcgctgtgcccagcgcccggcccaggcaccagaagtccatgagcaccagcggccaccccatcaaggtgaccctgcccaccatcaaggatggcagcgaggcctaccggcccggcaccacccagagggtgcctgctgccagccccagcgcccacagcatcagcacagccaccccagacaggacccgcttcccccggggcagcagcagccgcagcaccttccatggagagcagctgcgggagcggcgctctgtggcctacaacggccccccagccagccccagccatgagaccggggcctttgcccacgcccggcggggcaccagcacaggcatcatcagcaagatcaccagcaagtttgtgcggcgggaccccagcgagggggaggccagcggccgcacagacaccagccgcagcaccagcggggagcccaaggagcgggacaaggaggagggcaaggacagcaagcccaggagcctgcgcttcacctggagcatgaagaccaccagctccatggaccccaatgacatgatgagggagatcaggaaggtgctggatgccaacaactgtgactatgagcagaaggagcgcttcctgctcttctgtgtgcatggagatgcccggcaggacagcctggtgcagtgggagatggaggtgtgcaagctgccccggctgagcctgaatggagtgcgcttcaagaggatcagcggcaccagcatcgccttcaagaacatcgccagcaagatcgccaatgagctgaagctgtag

SEQ ID NO: 158796 - DNA, 2277 bp, Artificial Sequence
  Description of Artificial Sequence: Synthetic coding sequence
atgtctgcccggacccccctgcccaccgtgaatgaaagagacacagagaaccacacctctgtggatggctacacagagccccacatccagcccaccaagagcagcagccggcagaacatcccccgctgcaggaacagcatcaccagcgccacagatgagcagccccacatcggcaactaccgcctgcagaagaccatcggcaagggcaactttgccaaggtgaagctggcccggcacgtgctgaccggccgggaggtggccgtgaagatcatcgacaagacccagctgaaccccaccagcctgcagaagctgttccgggaggtgcgcatcatgaagatcctgaaccaccccaacattggagaggtgtttgactacctggtggcccacggccgcatgaaggagaaggaggcccgggccaagttccggcagatcgtgtctgctgtgcagtactgccaccagaagtacatcgtgcaccgggacctgaaggccgagaacctgctgctggatggagacatgaacatcaagattgctgactttggcttcagcaatgagttcaccgtgggcaacaagctggacaccttctgtggcagccccccctatgctgcccctgagctgttccagggcaagaagtatgatggccctgaggtggatgtgtggagcctgggcgtcatcctgtacaccctggtgtctggcagcctgccctttgatggccagaacctgaaggagctgcgggagcgggtgctgcggggcaagtaccgcatccccttctacatgagcacagactgtgagaacctgctgaagaagctgctggtgctgaaccccatcaagaggggcagcctggagcagatcatgaaggaccgctggatgaatgtgggccacgaggaggaggagctgaagccctacacagagccagaccctgacttcaatgacaccaagagaattgacatcatggtgaccatgggctttgccagagatgagatcaatgatgccctgatcaaccagaagtatgatgaggtgatggccacctacatcctgctgggcaggaagcccccagagtttgaaggaggagagagcctgagcagcggcaacctgtgccagaggagccggcccagcagtgacctgaacaacagcaccctgcagagccctgcccacctgaaggtgcagaggagcatcagcgccaaccagaagcagaggcgcttcagtgaccacgccggccccagcatccccccagctgtgtcctacaccaagaggccccaggccaacagcgtggagagcgagcagaaggaggagtgggacaaggatgtggccaggaagctgggcagcaccaccgtgggcagcaagtctgagatgacagccagccccctggtgggccctgagaggaagaagagcagcaccatccccagcaacaacgtgtacagcggcggctccatggcccggaggaacacctacgtgtgtgagaggaccacagaccgctacgtggccctgcagaatggcaaggacagcagcctgacagagatgtctgtgagcagcatcagcagcgctggcagctctgtggccagcgctgtgcccagcgcccggcccaggcaccagaagtccatgagcaccagcggccaccccatcaaggtgaccctgcccaccatcaaggatggcagcgaggcctaccggcccggcaccacccagagggtgcctgctgccagccccagcgcccacagcatcagcacagccaccccagacaggacccgcttcccccggggcagcagcagccgcagcaccttccatggagagcagctgcgggagcggcgctctgtggcctacaacggccccccagccagccccagccatgagaccggggcctttgcccacgcccggcggggcaccagcacaggcatcatcagcaagatcaccagcaagtttgtgcggcgcagcaccagcggggagcccaaggagcgggacaaggaggagggcaaggacagcaagcccaggagcctgcgcttcacctggagcatgaagaccaccagctccatggaccccaatgacatgatgagggagatcaggaaggtgctggatgccaacaactgtgactatgagcagaaggagcgcttcctgctcttctgtgtgcatggagatgcccggcaggacagcctggtgcagtgggagatggaggtgtgcaagctgccccggctgagcctgaatggagtgcgcttcaagaggatcagcggcaccagcatcgccttcaagaacatcgccagcaagatcgccaatgagctgaagctgtag

SEQ ID NO: 158797 - DNA, 1938 bp, Artificial Sequence
  Description of Artificial Sequence: Synthetic coding sequence
atggagtatgccagcggcggggaggtgtttgactacctggtggcccacggccgcatgaaggagaaggaggcccgggccaagttccggcagatcgtgtctgctgtgcagtactgccaccagaagtacatcgtgcaccgggacctgaaggccgagaacctgctgctggatggagacatgaacatcaagattgctgactttggcttcagcaatgagttcaccgtgggcaacaagctggacaccttctgtggcagccccccctatgctgcccctgagctgttccagggcaagaagtatgatggccctgaggtggatgtgtggagcctgggcgtcatcctgtacaccctggtgtctggcagcctgccctttgatggccagaacctgaaggagctgcgggagcgggtgctgcggggcaagtaccgcatccccttctacatgagcacagactgtgagaacctgctgaagaagctgctggtgctgaaccccatcaagaggggcagcctggagcagatcatgaaggaccgctggatgaatgtgggccacgaggaggaggagctgaagccctacacagagccagaccctgacttcaatgacaccaagagaattgacatcatggtgaccatgggctttgccagagatgagatcaatgatgccctgatcaaccagaagtatgatgaggtgatggccacctacatcctgctgggcaggaagcccccagagtttgagggcggggagagcctgagcagcggcaacctgtgccagaggagccggcccagcagtgacctgaacaacagcaccctgcagagccctgcccacctgaaggtgcagaggagcatcagcgccaaccagaagcagaggcgcttcagtgaccatgctggccccagcatccccccagctgtgtcctacaccaagaggccccaggccaacagcgtggagagcgagcagaaggaggagtgggacaaggatgtggccaggaagctgggcagcaccaccgtgggcagcaagtctgagatgacagccagccccctggtgggccctgagaggaagaagagcagcaccatccccagcaacaacgtgtacagcggcggctccatggcccggaggaacacctacgtgtgtgagaggaccacagacagatatgtggccctgcagaatggcaaggacagcagcctgacagagatgtctgtgagcagcatcagcagcgctggcagctctgtggccagcgctgtgcccagcgcccggcccaggcaccagaagtccatgagcaccagcggccaccccatcaaggtgaccctgcccaccatcaaggatggcagcgaggcctacagacctggcaccacccagagggtgcctgctgccagccccagcgcccacagcatcagcacagccaccccagacaggacccgcttcccccggggcagcagcagccgcagcaccttccacggggagcagctgcgggagaggagatctgtggcctacaatggacctccagccagccccagccatgaaacaggagcctttgcccacgcccggcggggcaccagcacaggcatcatcagcaagatcaccagcaagtttgtgagaagaagcaccagcggggagcccaaggagcgggacaaggaggagggcaaggacagcaagcccaggagcctgcgcttcacctggagcatgaagaccaccagctccatggaccccaatgacatgatgagggagatcaggaaggtgctggatgccaacaactgtgactatgagcagaaggagcgcttcctgctcttctgtgtgcatggagatgcccggcaggacagcctggtgcagtgggagatggaggtgtgcaagctgccccggctgagcctgaatggagtgcgcttcaagaggatcagcggcaccagcatcgccttcaagaacatcgccagcaagatcgccaatgagctgaagctgtag

SEQ ID NO: 158798 - DNA, 2340 bp, Artificial Sequence
  Description of Artificial Sequence: Synthetic coding sequence
atgagcagcgcccggacccccctgcccaccctgaatgaaagagacacagagcagcccaccctgggccacctggacagcaagcccagcagcaagagcaacatgatccggggcaggaacagcgccaccagcgcagatgagcagccccacatcggcaactaccgcctgctgaagaccatcggcaaaggaaactttgccaaggtgaagctggcccggcacatcctgaccgggaaggaggtggccgtgaagatcatcgacaagacccagctgaacagcagcagcctgcagaagctgttccgggaggtgcgcatcatgaaggtgctgaaccaccccaacatcgtgaagctgtttgaggtgattgaaacagagaagaccctgtacctggtgatggagtatgccagcggcggggaggtgtttgactacctggtggcccacggccgcatgaaggagaaggaggcccgggccaagttccggcagatcgtgtctgctgtgcagtactgccaccagaagttcatcgtgcaccgggacctgaaggccgagaacctgctgctggatgctgacatgaacatcaagattgctgactttggcttcagcaatgagttcaccttcggcaacaagctggacaccttctgtggcagccccccctatgctgcccctgagctgttccagggcaagaagtatgatggccctgaggtggatgtgtggagcctgggcgtcatcctgtacaccctggtgtctggcagcctgccctttgatggccagaacctgaaggagctgcgggagcgggtgctgcggggcaagtaccgcatccccttctacatgagcacagactgtgagaacctgctgaagaagttcctgatcctgaaccccagcaagaggggcaccctggagcagatcatgaaggaccgctggatgaatgtgggccatgaagatgatgagctgaagccctacgtggagcccctgcctgactacaaggaccccaggagaacagagctgatggtgtccatgggctacacccgggaggagatccaggacagcctggtgggccagcgctacaatgaggtgatggccacctacctgctgctgggctacaagagcagcgagctggagggggacaccatcaccctgaagccccggcccagcgctgacctgaccaacagcagcgcccccagccccagccacaaggtgcagaggtctgtgtctgccaaccccaagcagaggcgcttcagtgaccaggccgccggccctgccatccccaccagcaacagctacagcaagaagacccagagcaacaatgctgagaacaagaggccagaagaagatcgggagagcggcaggaaggccagcagcacagccaaggtgcctgccagccccctgcccggcctggagaggaagaagaccacccccacccccagcaccaacagcgtgctgagcaccagcaccaacagaagcaggaacagccccctgctggagcgggccagcctgggccaggccagcatccagaatggcaaggacagcctgaccatgcctggcagccgggccagcacagccagcgccagcgctgctgtgtctgctgcccggccccggcagcaccagaagtccatgtctgcctctgtgcaccccaacaaggccagcggcctgcccccaacagagagcaactgtgaggtgccccggcccagcacagccccccagagggtgcctgtggccagccccagcgcccacaacatcagcagcagcggcggggccccagacaggaccaacttcccccggggcgtgagcagccgcagcaccttccacgccggccagctgcggcaggtgcgggaccagcagaacctgccctatggagtgaccccagccagccccagcggccacagccagggcagaagaggagccagcggcagcatcttcagcaagttcaccagcaagtttgtgagaagaaacctgaatgaacctgagagcaaggacagagtggagaccctgcggccccacgtggtgggcagcggcggcaatgacaaggagaaggaggagttccgggaggccaagcccaggagcctgcgcttcacctggagcatgaagaccaccagctccatggagcccaatgagatgatgagggagatcaggaaggtgctggatgccaacagctgccagagcgagctgcacgagaagtacatgctgctgtgcatgcacggcaccccaggccacgaggactttgtgcagtgggagatggaggtgtgcaagctgccccggctgagcctgaatggagtgcgcttcaagaggatcagcggcacctccatggccttcaagaacatcgccagcaagatcgccaatgagctgaagctgtag

SEQ ID NO: 158799 - DNA, 2130 bp, Artificial Sequence
  Description of Artificial Sequence: Synthetic coding sequence
atgagcagcgcccggacccccctgcccaccctgaatgaaagagacacagagcagcccaccctgggccacctggacagcaagcccagcagcaagagcaacatgatccggggcaggaacagcgccaccagcgcagatgagcagccccacatcggcaactaccgcctgctgaagaccatcggcaaaggaaactttgccaaggtgaagctggcccggcacatcctgaccgggaaggaggtggccgtgaagatcatcgacaagacccagctgaacagcagcagcctgcagaagctgttccgggaggtgcgcatcatgaaggtgctgaaccaccccaacatcgtgaagctgtttgaggtgattgaaacagagaagaccctgtacctggtgatggagtatgccagcggcggggaggtgtttgactacctggtggcccacggccgcatgaaggagaaggaggcccgggccaagttccggcagatcgtgtctgctgtgcagtactgccaccagaagttcatcgtgcaccgggacctgaaggccgagaacctgctgctggatgctgacatgaacatcaagattgctgactttggcttcagcaatgagttcaccttcggcaacaagctggacaccttctgtggcagccccccctatgctgcccctgagctgttccagggcaagaagtatgatggccctgaggtggatgtgtggagcctgggcgtcatcctgtacaccctggtgtctggcagcctgccctttgatggccagaacctgaaggagctgcgggagcgggtgctgcggggcaagtaccgcatccccttctacatgagcacagactgtgagaacctgctgaagaagttcctgatcctgaaccccagcaagaggggcaccctggagcagatcatgaaggaccgctggatgaatgtgggccatgaagatgatgagctgaagccctacgtggagcccctgcctgactacaaggaccccaggagaacagagctgatggtgtccatgggctacacccgggaggagatccaggacagcctggtgggccagcgctacaatgaggtgatggccacctacctgctgctgggctacaagagcagcgagctggagggggacaccatcaccctgaagccccggcccagcgctgacctgaccaacagcagcgcccccagccccagccacaaggtgcagaggtctgtgtctgccaaccccaagcagaggcgcttcagtgaccaggccggccctgccatccccaccagcaacagctacagcaagaagacccagagcaacaatgctgagaacaagaggcctgaggaggaccgggagagcggcaggaaggccagcagcacagccaaggtgcctgccagccccctgcccggcctggagaggaagaagaccacccccacccccagcaccaacagcgtgctgagcaccagcaccaacagaagcaggaacagccccctgctggagcgggccagcctgggccaggccagcatccagaatggcaaggacagcacagccccccagagggtgcctgtggccagccccagcgcccacaacatcagcagcagtggaggagccccagacaggaccaacttcccccggggcgtgagcagccgcagcaccttccacgccggccagctgcggcaggtgcgggaccagcagaacctgccctacggcgtgaccccagccagccccagcggccacagccagggccggcggggggccagcggcagcatcttcagcaagttcaccagcaagtttgtgagaagaccccacgtggtgggcagcggcggcaatgacaaggagaaggaggagttccgggaggccaagcccaggagcctgcgcttcacctggagcatgaagaccaccagctccatggagcccaatgagatgatgagggagatcaggaaggtgctggatgccaacagctgccagagcgagctgcacgagaagtacatgctgctgtgcatgcacggcaccccaggccacgaggactttgtgcagtgggagatggaggtgtgcaagctgccccggctgagcctgaatggagtgcgcttcaagaggatcagcggcacctccatggccttcaagaacatcgccagcaagatcgccaatgagctgaagctgtag

SEQ ID NO: 158800 - DNA, 2160 bp, Artificial Sequence
  Description of Artificial Sequence: Synthetic coding sequence
atgagcagcgcccggacccccctgcccaccctgaatgaaagagacacagagcagcccaccctgggccacctggacagcaagcccagcagcaagagcaacatgatccggggcaggaacagcgccaccagcgcagatgagcagccccacatcggcaactaccgcctgctgaagaccatcggcaaaggaaactttgccaaggtgaagctggcccggcacatcctgaccgggaaggaggtggccgtgaagatcatcgacaagacccagctgaacagcagcagcctgcagaagctgttccgggaggtgcgcatcatgaaggtgctgaaccaccccaacatcgtgaagctgtttgaggtgattgaaacagagaagaccctgtacctggtgatggagtatgccagcggcggggaggtgtttgactacctggtggcccacggccgcatgaaggagaaggaggcccgggccaagttccggcagatcgtgtctgctgtgcagtactgccaccagaagttcatcgtgcaccgggacctgaaggccgagaacctgctgctggatgctgacatgaacatcaagattgctgactttggcttcagcaatgagttcaccttcggcaacaagctggacaccttctgtggcagccccccctatgctgcccctgagctgttccagggcaagaagtatgatggccctgaggtggatgtgtggagcctgggcgtcatcctgtacaccctggtgtctggcagcctgccctttgatggccagaacctgaaggagctgcgggagcgggtgctgcggggcaagtaccgcatccccttctacatgagcacagactgtgagaacctgctgaagaagttcctgatcctgaaccccagcaagaggggcaccctggagcagatcatgaaggaccgctggatgaatgtgggccatgaagatgatgagctgaagccctacgtggagcccctgcctgactacaaggaccccaggagaacagagctgatggtgtccatgggctacacccgggaggagatccaggacagcctggtgggccagcgctacaatgaggtgatggccacctacctgctgctgggctacaagagcagcgagctggagggggacaccatcaccctgaagccccggcccagcgctgacctgaccaacagcagcgcccccagccccagccacaaggtgcagaggtctgtgtctgccaaccccaagcagaggcgcttcagtgaccaggccgccggccctgccatccccaccagcaacagctacagcaagaagacccagagcaacaatgctgagaacaagaggccagaagaagatcgggagagcggcaggaaggccagcagcacagccaaggtgcctgccagccccctgcccggcctggagaggaagaagaccacccccacccccagcaccaacagcgtgctgagcaccagcaccaacagaagcaggaacagccccctgctggagcgggccagcctgggccaggccagcatccagaatggcaaggacagcacagccccccagagggtgcctgtggccagccccagcgcccacaacatcagcagcagcggcggggccccagacaggaccaacttcccccggggcgtgagcagccgcagcaccttccacgccggccagctgcggcaggtgcgggaccagcagaacctgccctatggagtgaccccagccagccccagcggccacagccagggcagaagaggagccagcggcagcatcttcagcaagttcaccagcaagtttgtgagaagaaacctgtccttccgctttgcccggcggccccacgtggtgggcagcggcggcaatgacaaggagaaggaggagttccgggaggccaagcccaggagcctgcgcttcacctggagcatgaagaccaccagctccatggagcccaatgagatgatgagggagatcaggaaggtgctggatgccaacagctgccagagcgagctgcacgagaagtacatgctgctgtgcatgcacggcaccccaggccacgaggactttgtgcagtgggagatggaggtgtgcaagctgccccggctgagcctgaatggagtgcgcttcaagaggatcagcggcacctccatggccttcaagaacatcgccagcaagatcgccaatgagctgaagctgtag

SEQ ID NO: 158801 - DNA, 2322 bp, Artificial Sequence
  Description of Artificial Sequence: Synthetic coding sequence
atgagcagcgcccggacccccctgcccaccctgaatgaaagagacacagagcagcccaccctgggccacctggacagcaagcccagcagcaagagcaacatgatccggggcaggaacagcgccaccagcgcagatgagcagccccacatcggcaactaccgcctgctgaagaccatcggcaaaggaaactttgccaaggtgaagctggcccggcacatcctgaccgggaaggaggtggccgtgaagatcatcgacaagacccagctgaacagcagcagcctgcagaagctgttccgggaggtgcgcatcatgaaggtgctgaaccaccccaacatcgtgaagctgtttgaggtgattgaaacagagaagaccctgtacctggtgatggagtatgccagcggcggggaggtgtttgactacctggtggcccacggccgcatgaaggagaaggaggcccgggccaagttccggcagatcgtgtctgctgtgcagtactgccaccagaagttcatcgtgcaccgggacctgaaggccgagaacctgctgctggatgctgacatgaacatcaagattgctgactttggcttcagcaatgagttcaccttcggcaacaagctggacaccttctgtggcagccccccctatgctgcccctgagctgttccagggcaagaagtatgatggccctgaggtggatgtgtggagcctgggcgtcatcctgtacaccctggtgtctggcagcctgccctttgatggccagaacctgaaggagctgcgggagcgggtgctgcggggcaagtaccgcatccccttctacatgagcacagactgtgagaacctgctgaagaagttcctgatcctgaaccccagcaagaggggcaccctggagcagatcatgaaggaccgctggatgaatgtgggccatgaagatgatgagctgaagccctacgtggagcccctgcctgactacaaggaccccaggagaacagagctgatggtgtccatgggctacacccgggaggagatccaggacagcctggtgggccagcgctacaatgaggtgatggccacctacctgctgctgggctacaagagcagcgagctggagggggacaccatcaccctgaagccccggcccagcgctgacctgaccaacagcagcgcccccagccccagccacaaggtgcagaggtctgtgtctgccaaccccaagcagaggcgcttcagtgaccaggccgccggccctgccatccccaccagcaacagctacagcaagaagacccagagcaacaatgctgagaacaagaggccagaagaagatcgggagagcggcaggaaggccagcagcacagccaaggtgcctgccagccccctgcccggcctggagaggaagaagaccacccccacccccagcaccaacagcgtgctgagcaccagcaccaacagaagcaggaacagccccctgctggagcgggccagcctgggccaggccagcatccagaatggcaaggacagcctgaccatgcctggcagccgggccagcacagccagcgccagcgctgctgtgtctgctgcccggccccggcagcaccagaagtccatgtctgcctctgtgcaccccaacaaggccagcggcctgcccccaacagagagcaactgtgaggtgccccggcccagcacagccccccagagggtgcctgtggccagccccagcgcccacaacatcagcagcagcggcggggccccagacaggaccaacttcccccggggcgtgagcagccgcagcaccttccacgccggccagctgcggcaggtgcgggaccagcagaacctgccctatggagtgaccccagccagccccagcggccacagccagggcagaagaggagccagcggcagcatcttcagcaagttcaccagcaagtttgtgagaagaaacctgtccttccgctttgcccggcggccccacgtggtgggcagcggcggcaatgacaaggagaaggaggagttccgggaggccaagcccaggagcctgcgcttcacctggagcatgaagaccaccagctccatggagcccaatgagatgatgagggagatcaggaaggtgctggatgccaacagctgccagagcgagctgcacgagaagtacatgctgctgtgcatgcacggcaccccaggccacgaggactttgtgcagtgggagatggaggtgtgcaagctgccccggctgagcctgaatggagtgcgcttcaagaggatcagcggcacctccatggccttcaagaacatcgccagcaagatcgccaatgagctgaagctgtag

SEQ ID NO: 158802 - DNA, 2076 bp, Artificial Sequence
  Description of Artificial Sequence: Synthetic coding sequence
atgatccggggcagaaattctgccaccagcgcagatgagcagccccacatcggcaactaccgcctgctgaagaccatcggcaagggcaactttgccaaggtgaagctggcccggcacatcctgaccgggaaggaggtggccgtgaagatcatcgacaagacccagctgaacagcagcagcctgcagaagctgttccgggaggtgcgcatcatgaaggtgctgaaccaccccaacatcgtgaagctgtttgaagtcatcgagacagagaagaccctgtacctggtgatggagtatgccagcggcggggaggtgtttgactacctggtggcccacggccgcatgaaggagaaggaggcccgggccaagttccggcagatcgtgtctgctgtgcagtactgccaccagaagttcatcgtgcaccgggacctgaaggccgagaacctgctgctggatgctgacatgaacatcaagattgctgactttggcttcagcaatgagttcacctttggaaacaagctggacaccttctgtggcagccccccctatgctgcccctgagctgttccagggcaagaagtatgatggccctgaggtggatgtgtggagcctgggcgtcatcctgtacaccctggtgtctggcagcctgccctttgatggccagaacctgaaggagctgcgggagcgggtgctgcggggcaagtaccgcatccccttctacatgagcacagactgtgagaacctgctgaagaagttcctgatcctgaaccccagcaagaggggcaccctggagcagatcatgaaggaccgctggatgaatgtgggccatgaagatgatgagctgaagccctacgtggagcccctgcctgactacaaggaccccaggagaacagagctgatggtgtccatgggctacacccgggaggagatccaggacagcctggtgggccagcgctacaatgaggtgatggccacctacctgctgctgggctacaagagcagcgagctggagggggacaccatcaccctgaagccccggcccagcgctgacctgaccaacagcagcgcccccagccccagccacaaggtgcagaggtctgtgtctgccaaccccaagcagaggcgcttcagtgaccaggccggccctgccatccccaccagcaacagctacagcaagaagacccagagcaacaatgctgagaacaagaggccagaagaagatcgggagagcggcaggaaggccagcagcacagccaaggtgcctgccagccccctgcccggcctggagaggaagaagaccacccccacccccagcaccaacagcgtgctgagcaccagcaccaacagaagcaggaacagccccctgctggagcgggccagcctgggccaggccagcatccagaatggcaaggacagcacagccccccagagggtgcctgtggccagccccagcgcccacaacatcagcagcagcggcggggccccagacaggaccaacttcccccggggcgtgagcagccgcagcaccttccacgccggccagctgcggcaggtgcgggaccagcagaacctgccctatggagtgaccccagccagccccagcggccacagccagggcagaagaggagccagcggcagcatcttcagcaagttcaccagcaagtttgtgagaagaaacctgaatgaacctgagagcaaggacagagtggagaccctgcggccccacgtggtgggcagcggcggcaatgacaaggagaaggaggagttccgggaggccaagcccaggagcctgcgcttcacctggagcatgaagaccaccagctccatggagcccaatgagatgatgagggagatcaggaaggtgctggatgccaacagctgccagagcgagctgcacgagaagtacatgctgctgtgcatgcacggcaccccaggccacgaggactttgtgcagtgggagatggaggtgtgcaagctgccccggctgagcctgaatggagtgcgcttcaagaggatcagcggcacctccatggccttcaagaacatcgccagcaagatcgccaatgagctgaagctgtag

SEQ ID NO: 158803 - DNA, 2367 bp, Artificial Sequence
  Description of Artificial Sequence: Synthetic coding sequence
atgagcagcgcccggacccccctgcccaccctgaatgaaagagacacagagcagcccaccctgggccacctggacagcaagcccagcagcaagagcaacatgatccggggcaggaacagcgccaccagcgcagatgagcagccccacatcggcaactaccgcctgctgaagaccatcggcaaaggaaactttgccaaggtgaagctggcccggcacatcctgaccgggaaggaggtggccgtgaagatcatcgacaagacccagctgaacagcagcagcctgcagaagctgttccgggaggtgcgcatcatgaaggtgctgaaccaccccaacatcgtgaagctgtttgaggtgattgaaacagagaagaccctgtacctggtgatggagtatgccagcggcggggaggtgtttgactacctggtggcccacggccgcatgaaggagaaggaggcccgggccaagttccggcagatcgtgtctgctgtgcagtactgccaccagaagttcatcgtgcaccgggacctgaaggccgagaacctgctgctggatgctgacatgaacatcaagattgctgactttggcttcagcaatgagttcaccttcggcaacaagctggacaccttctgtggcagccccccctatgctgcccctgagctgttccagggcaagaagtatgatggccctgaggtggatgtgtggagcctgggcgtcatcctgtacaccctggtgtctggcagcctgccctttgatggccagaacctgaaggagctgcgggagcgggtgctgcggggcaagtaccgcatccccttctacatgagcacagactgtgagaacctgctgaagaagttcctgatcctgaaccccagcaagaggggcaccctggagcagatcatgaaggaccgctggatgaatgtgggccatgaagatgatgagctgaagccctacgtggagcccctgcctgactacaaggaccccaggagaacagagctgatggtgtccatgggctacacccgggaggagatccaggacagcctggtgggccagcgctacaatgaggtgatggccacctacctgctgctgggctacaagagcagcgagctggagggggacaccatcaccctgaagccccggcccagcgctgacctgaccaacagcagcgcccccagccccagccacaaggtgcagaggtctgtgtctgccaaccccaagcagaggcgcttcagtgaccaggccgccggccctgccatccccaccagcaacagctacagcaagaagacccagagcaacaatgctgagaacaagaggccagaagaagatcgggagagcggcaggaaggccagcagcacagccaaggtgcctgccagccccctgcccggcctggagaggaagaagaccacccccacccccagcaccaacagcgtgctgagcaccagcaccaacagaagcaggaacagccccctgctggagcgggccagcctgggccaggccagcatccagaatggcaaggacagcctgaccatgcctggcagccgggccagcacagccagcgccagcgctgctgtgtctgctgcccggccccggcagcaccagaagtccatgtctgcctctgtgcaccccaacaaggccagcggcctgcccccaacagagagcaactgtgaggtgccccggcccagcacagccccccagagggtgcctgtggccagccccagcgcccacaacatcagcagcagcggcggggccccagacaggaccaacttcccccggggcgtgagcagccgcagcaccttccacgccggccagctgcggcaggtgcgggaccagcagaacctgccctatggagtgaccccagccagccccagcggccacagccagggcagaagaggagccagcggcagcatcttcagcaagttcaccagcaagtttgtgagaagaaacctgtccttccgctttgcccggaggaacctgaatgaacctgagagcaaggacagagtggagaccctgcggccccacgtggtgggcagcggcggcaatgacaaggagaaggaggagttccgggaggccaagcccaggagcctgcgcttcacctggagcatgaagaccaccagctccatggagcccaatgagatgatgagggagatcaggaaggtgctggatgccaacagctgccagagcgagctgcacgagaagtacatgctgctgtgcatgcacggcaccccaggccatgaagattttgtgcagtgggagatggaggtgtgcaagctgccccggctgagcctgaatggagtgcgcttcaagaggatcagcggcacctccatggccttcaagaacatcgccagcaagatcgccaatgagctgaagctgtag

SEQ ID NO: 158804 - DNA, 2076 bp, Artificial Sequence; identical to SEQ ID NO: 158802
  Description of Artificial Sequence: Synthetic coding sequence

SEQ ID NO: 158805 - DNA, 2205 bp, Artificial Sequence
  Description of Artificial Sequence: Synthetic coding sequence
atgagcagcgcccggacccccctgcccaccctgaatgaaagagacacagagcagcccaccctgggccacctggacagcaagcccagcagcaagagcaacatgatccggggcaggaacagcgccaccagcgcagatgagcagccccacatcggcaactaccgcctgctgaagaccatcggcaaaggaaactttgccaaggtgaagctggcccggcacatcctgaccgggaaggaggtggccgtgaagatcatcgacaagacccagctgaacagcagcagcctgcagaagctgttccgggaggtgcgcatcatgaaggtgctgaaccaccccaacatcgtgaagctgtttgaggtgattgaaacagagaagaccctgtacctggtgatggagtatgccagcggcggggaggtgtttgactacctggtggcccacggccgcatgaaggagaaggaggcccgggccaagttccggcagatcgtgtctgctgtgcagtactgccaccagaagttcatcgtgcaccgggacctgaaggccgagaacctgctgctggatgctgacatgaacatcaagattgctgactttggcttcagcaatgagttcaccttcggcaacaagctggacaccttctgtggcagccccccctatgctgcccctgagctgttccagggcaagaagtatgatggccctgaggtggatgtgtggagcctgggcgtcatcctgtacaccctggtgtctggcagcctgccctttgatggccagaacctgaaggagctgcgggagcgggtgctgcggggcaagtaccgcatccccttctacatgagcacagactgtgagaacctgctgaagaagttcctgatcctgaaccccagcaagaggggcaccctggagcagatcatgaaggaccgctggatgaatgtgggccatgaagatgatgagctgaagccctacgtggagcccctgcctgactacaaggaccccaggagaacagagctgatggtgtccatgggctacacccgggaggagatccaggacagcctggtgggccagcgctacaatgaggtgatggccacctacctgctgctgggctacaagagcagcgagctggagggggacaccatcaccctgaagccccggcccagcgctgacctgaccaacagcagcgcccccagccccagccacaaggtgcagaggtctgtgtctgccaaccccaagcagaggcgcttcagtgaccaggccgccggccctgccatccccaccagcaacagctacagcaagaagacccagagcaacaatgctgagaacaagaggccagaagaagatcgggagagcggcaggaaggccagcagcacagccaaggtgcctgccagccccctgcccggcctggagaggaagaagaccacccccacccccagcaccaacagcgtgctgagcaccagcaccaacagaagcaggaacagccccctgctggagcgggccagcctgggccaggccagcatccagaatggcaaggacagcacagccccccagagggtgcctgtggccagccccagcgcccacaacatcagcagcagcggcggggccccagacaggaccaacttcccccggggcgtgagcagccgcagcaccttccacgccggccagctgcggcaggtgcgggaccagcagaacctgccctatggagtgaccccagccagccccagcggccacagccagggcagaagaggagccagcggcagcatcttcagcaagttcaccagcaagtttgtgagaagaaacctgtccttccgctttgcccggaggaacctgaatgaacctgagagcaaggacagagtggagaccctgcggccccacgtggtgggcagcggcggcaatgacaaggagaaggaggagttccgggaggccaagcccaggagcctgcgcttcacctggagcatgaagaccaccagctccatggagcccaatgagatgatgagggagatcaggaaggtgctggatgccaacagctgccagagcgagctgcacgagaagtacatgctgctgtgcatgcacggcaccccaggccatgaagattttgtgcagtgggagatggaggtgtgcaagctgccccggctgagcctgaatggagtgcgcttcaagaggatcagcggcacctccatggccttcaagaacatcgccagcaagatcgccaatgagctgaagctgtag

SEQ ID NO: 158806 - DNA, 2343 bp, Artificial Sequence
  Description of Artificial Sequence: Synthetic coding sequence
atgagcagcgcccggacccccctgcccaccctgaatgaaagagacacagagcagcccaccctgggccacctggacagcaagcccagcagcaagagcaacatgatccggggcaggaacagcgccaccagcgcagatgagcagccccacatcggcaactaccgcctgctgaagaccatcggcaaaggaaactttgccaaggtgaagctggcccggcacatcctgaccgggaaggaggtggccgtgaagatcatcgacaagacccagctgaacagcagcagcctgcagaagctgttccgggaggtgcgcatcatgaaggtgctgaaccaccccaacatcgtgaagctgtttgaggtgattgaaacagagaagaccctgtacctggtgatggagtatgccagcggcggggaggtgtttgactacctggtggcccacggccgcatgaaggagaaggaggcccgggccaagttccggcagatcgtgtctgctgtgcagtactgccaccagaagttcatcgtgcaccgggacctgaaggccgagaacctgctgctggatgctgacatgaacatcaagattgctgactttggcttcagcaatgagttcaccttcggcaacaagctggacaccttctgtggcagccccccctatgctgcccctgagctgttccagggcaagaagtatgatggccctgaggtggatgtgtggagcctgggcgtcatcctgtacaccctggtgtctggcagcctgccctttgatggccagaacctgaaggagctgcgggagcgggtgctgcggggcaagtaccgcatccccttctacatgagcacagactgtgagaacctgctgaagaagttcctgatcctgaaccccagcaagaggggcaccctggagcagatcatgaaggaccgctggatgaatgtgggccatgaagatgatgagctgaagccctacgtggagcccctgcctgactacaaggaccccaggagaacagagctgatggtgtccatgggctacacccgggaggagatccaggacagcctggtgggccagcgctacaatgaggtgatggccacctacctgctgctgggctacaagagcagcgagctggagggggacaccatcaccctgaagccccggcccagcgctgacctgaccaacagcagcgcccccagccccagccacaaggtgcagaggtctgtgtctgccaaccccaagcagaggcgcttcagtgaccaggccggccctgccatccccaccagcaacagctacagcaagaagacccagagcaacaatgctgagaacaagaggcctgaggaggaccgggagagcggcaggaaggccagcagcacagccaaggtgcctgccagccccctgcccggcctggagaggaagaagaccacccccacccccagcaccaacagcgtgctgagcaccagcaccaacagaagcaggaacagccccctgctggagcgggccagcctgggccaggccagcatccagaatggcaaggacagcctgaccatgcctggcagccgggccagcacagccagcgccagcgctgctgtgtctgctgcccggccccggcagcaccagaagtccatgtctgcctctgtgcaccccaacaaggccagcggcctgcccccaacagagagcaactgtgaggtgccccggccccggcaggtgacagccccccagagggtgcctgtggccagccccagcgcccacaacatcagcagcagtggaggagccccagacaggaccaacttcccccggggcgtgagcagccgcagcaccttccacgccggccagctgcggcaggtgcgggaccagcagaacctgccctacggcgtgaccccagccagccccagcggccacagccagggccggcggggggccagcggcagcatcttcagcaagttcaccagcaagtttgtgagaagaaacctgaatgaacctgagagcaaggacagagtggagaccctgcggccccacgtggtgggcagcggcggcaatgacaaggagaaggaggagttccgggaggccaagcccaggagcctgcgcttcacctggagcatgaagaccaccagctccatggagcccaatgagatgatgagggagatcaggaaggtgctggatgccaacagctgccagagcgagctgcacgagaagtacatgctgctgtgcatgcacggcaccccaggccatgaagattttgtgcagtgggagatggaggtgtgcaagctgccccggctgagcctgaatggagtgcgcttcaagaggatcagcggcacctccatggccttcaagaacatcgccagcaagatcgccaatgagctgaagctgtag

SEQ ID NO: 158807 - DNA, 126 bp, Artificial Sequence
  Description of Artificial Sequence: Synthetic coding sequence
atgagcagcgcccggacccccctgcccaccctgaatgaaagagacacagagcagcccaccctgggccacctggacagcaagcccagcagcaagagcaacatgatccggggcaggaacagcgcctag

SEQ ID NO: 158808 - DNA, 2175 bp, Artificial Sequence
  Description of Artificial Sequence: Synthetic coding sequence
atgagcagcgcccggacccccctgcccaccctgaatgaaagagacacagagcagcccaccctgggccacctggacagcaagcccagcagcaagagcaacatgatccggggcaggaacagcgccaccagcgcagatgagcagccccacatcggcaactaccgcctgctgaagaccatcggcaaaggaaactttgccaaggtgaagctggcccggcacatcctgaccgggaaggaggtggccgtgaagatcatcgacaagacccagctgaacagcagcagcctgcagaagctgttccgggaggtgcgcatcatgaaggtgctgaaccaccccaacatcgtgaagctgtttgaggtgattgaaacagagaagaccctgtacctggtgatggagtatgccagcggcggggaggtgtttgactacctggtggcccacggccgcatgaaggagaaggaggcccgggccaagttccggcagatcgtgtctgctgtgcagtactgccaccagaagttcatcgtgcaccgggacctgaaggccgagaacctgctgctggatgctgacatgaacatcaagattgctgactttggcttcagcaatgagttcaccttcggcaacaagctggacaccttctgtggcagccccccctatgctgcccctgagctgttccagggcaagaagtatgatggccctgaggtggatgtgtggagcctgggcgtcatcctgtacaccctggtgtctggcagcctgccctttgatggccagaacctgaaggagctgcgggagcgggtgctgcggggcaagtaccgcatccccttctacatgagcacagactgtgagaacctgctgaagaagttcctgatcctgaaccccagcaagaggggcaccctggagcagatcatgaaggaccgctggatgaatgtgggccatgaagatgatgagctgaagccctacgtggagcccctgcctgactacaaggaccccaggagaacagagctgatggtgtccatgggctacacccgggaggagatccaggacagcctggtgggccagcgctacaatgaggtgatggccacctacctgctgctgggctacaagagcagcgagctggagggggacaccatcaccctgaagccccggcccagcgctgacctgaccaacagcagcgcccccagccccagccacaaggtgcagaggtctgtgtctgccaaccccaagcagaggcgcttcagtgaccaggccggccctgccatccccaccagcaacagctacagcaagaagacccagagcaacaatgctgagaacaagaggcctgaggaggaccgggagagcggcaggaaggccagcagcacagccaaggtgcctgccagccccctgcccggcctggagaggaagaagaccacccccacccccagcaccaacagcgtgctgagcaccagcaccaacagaagcaggaacagccccctgctggagcgggccagcctgggccaggccagcatccagaatggcaaggacagcacagccccccagagggtgcctgtggccagccccagcgcccacaacatcagcagcagtggaggagccccagacaggaccaacttcccccggggcgtgagcagccgcagcaccttccacgccggccagctgcggcaggtgcgggaccagcagaacctgccctacggcgtgaccccagccagccccagcggccacagccagggccggcggggggccagcggcagcatcttcagcaagttcaccagcaagtttgtgagaagaaacctgaatgaacctgagagcaaggacagagtggagaccctgcggccccacgtggtgggcagcggcggcaatgacaaggagaaggaggagttccgggaggccaagcccaggagcctgcgcttcacctggagcatgaagaccaccagctccatggagcccaatgagatgatgagggagatcaggaaggtgctggatgccaacagctgccagagcgagctgcacgagaagtacatgctgctgtgcatgcacggcaccccaggccatgaagattttgtgcagtgggagatggaggtgtgcaagctgccccggctgagcctgaatggagtgcgcttcaagaggatcagcggcacctccatggccttcaagaacatcgccagcaagatcgccaatgagctgaagctgtag

SEQ ID NO: 158809 - DNA, 186 bp, Artificial Sequence
  Description of Artificial Sequence: Synthetic coding sequence
atggaggtggccggcagccccttccccttcctgcagagcgtggcctgcctgctgaccctggcccacatcccagctgtgggcaacatcctgcagcacagaagaagaggagctggccccaccctgggccacctggacagcaagcccagcagcaagagcaacatgatccggggcaggaacagcgcctag

SEQ ID NO: 158810 - DNA, 339 bp, Artificial Sequence
  Description of Artificial Sequence: Synthetic coding sequence
atgatccggggcagaaattctgccaccagcgcagatgagcagccccacatcggcaactaccgcctgctgaagaccatcggcaagggcaactttgccaaggtgaagctggcccggcacatcctgaccgggaaggaggtggccgtgaagatcatcgacaagacccagctgaacagcagcagcctgcagaagctgttccgggaggtgcgcatcatgaaggtgctgaaccaccccaacatcgtgaagctgtttgaagtcatcgagacagagaagaccctgtacctggtgatggagtatgccagcggcggggaggtgtttgactacctggtggcccatggatag

SEQ ID NO: 158811 - DNA, 486 bp, Artificial Sequence
  Description of Artificial Sequence: Synthetic coding sequence
atgatccggggcagaaattctgccaccagcgcagatgagcagccccacatcggcaactaccgcctgctgaagaccatcggcaagggcaactttgccaaggtgaagctggcccggcacatcctgaccgggaaggaggtggccgtgaagatcatcgacaagacccagctgaacagcagcagcctgcagaagctgttccgggaggtgcgcatcatgaaggtgctgaaccaccccaacatcgtgaagctgtttgaagtcatcgagacagagaagaccctgtacctggtgatggagtatgccagcggcggggaggtgtttgactacctggtggcccacggccgcatgaaggagaaggaggcccgggccaagttccggcagatcgtgtctgctgtgcagtactgccaccagaagttcatcgtgcaccgggacctgaaggccgagaacctgctgctggatgctgacatgaacatcaagattgctgacttctag

SEQ ID NO: 158812 - DNA, 276 bp, Artificial Sequence
  Description of Artificial Sequence: Synthetic coding sequence
atgggcggccagaggaacacctctgtgggcaacatcgtgcagcgctggagggaccacgtggtgtgccagaaggccggggtcatctacagcggcaggaaggcccaggagcacggcactggaagaacagacttcaccccagcccagaggctgatgatgcccaccctgggccacctggacagcaagcccagcagcaagagcaacatgatccggggcaggaacagcgccaccagcgcagatgagcagccccacatcggcaactaccgcctgctgaagtag

SEQ ID NO: 158813 - DNA, 2238 bp, Artificial Sequence
  Description of Artificial Sequence: Synthetic coding sequence
atgatccggggcagaaattctgccaccagcgcagatgagcagccccacatcggcaactaccgcctgctgaagaccatcggcaagggcaactttgccaaggtgaagctggcccggcacatcctgaccgggaaggaggtggccgtgaagatcatcgacaagacccagctgaacagcagcagcctgcagaagctgttccgggaggtgcgcatcatgaaggtgctgaaccaccccaacatcgtgaagctgtttgaagtcatcgagacagagaagaccctgtacctggtgatggagtatgccagcggcggggaggtgtttgactacctggtggcccacggccgcatgaaggagaaggaggcccgggccaagttccggcagatcgtgtctgctgtgcagtactgccaccagaagttcatcgtgcaccgggacctgaaggccgagaacctgctgctggatgctgacatgaacatcaagattgctgactttggcttcagcaatgagttcacctttggaaacaagctggacaccttctgtggcagccccccctatgctgcccctgagctgttccagggcaagaagtatgatggccctgaggtggatgtgtggagcctgggcgtcatcctgtacaccctggtgtctggcagcctgccctttgatggccagaacctgaaggagctgcgggagcgggtgctgcggggcaagtaccgcatccccttctacatgagcacagactgtgagaacctgctgaagaagttcctgatcctgaaccccagcaagaggggcaccctggagcagatcatgaaggaccgctggatgaatgtgggccatgaagatgatgagctgaagccctacgtggagcccctgcctgactacaaggaccccaggagaacagagctgatggtgtccatgggctacacccgggaggagatccaggacagcctggtgggccagcgctacaatgaggtgatggccacctacctgctgctgggctacaagagcagcgagctggagggggacaccatcaccctgaagccccggcccagcgctgacctgaccaacagcagcgcccccagccccagccacaaggtgcagaggtctgtgtctgccaaccccaagcagaggcgcttcagtgaccaggccggccctgccatccccaccagcaacagctacagcaagaagacccagagcaacaatgctgagaacaagaggccagaagaagatcgggagagcggcaggaaggccagcagcacagccaaggtgcctgccagccccctgcccggcctggagaggaagaagaccacccccacccccagcaccaacagcgtgctgagcaccagcaccaacagaagcaggaacagccccctgctggagcgggccagcctgggccaggccagcatccagaatggcaaggacagcctgaccatgcctggcagccgggccagcacagccagcgccagcgctgctgtgtctgctgcccggccccggcagcaccagaagtccatgtctgcctctgtgcaccccaacaaggccagcggcctgcccccaacagagagcaactgtgaggtgccccggcccagcacagccccccagagggtgcctgtggccagccccagcgcccacaacatcagcagcagcggcggggccccagacaggaccaacttcccccggggcgtgagcagccgcagcaccttccacgccggccagctgcggcaggtgcgggaccagcagaacctgccctatggagtgaccccagccagccccagcggccacagccagggcagaagaggagccagcggcagcatcttcagcaagttcaccagcaagtttgtgagaagaaacctgaatgaacctgagagcaaggacagagtggagaccctgcggccccacgtggtgggcagcggcggcaatgacaaggagaaggaggagttccgggaggccaagcccaggagcctgcgcttcacctggagcatgaagaccaccagctccatggagcccaatgagatgatgagggagatcaggaaggtgctggatgccaacagctgccagagcgagctgcacgagaagtacatgctgctgtgcatgcacggcaccccaggccacgaggactttgtgcagtgggagatggaggtgtgcaagctgccccggctgagcctgaatggagtgcgcttcaagaggatcagcggcacctccatggccttcaagaacatcgccagcaagatcgccaatgagctgaagctgtag

SEQ ID NO: 158814 - DNA, 4128 bp, Artificial Sequence
  Description of Artificial Sequence: Synthetic coding sequence
atggagggggacagagtggccggccggcctgtgctgagcagcctgcctgtgctgctgctgctgcccctgctgatgctgcgggctgctgccctgcacccagatgagctgttcccccatggagagagctggggagaccagctgctgcaggagggagatgatgagagcagcgctgtggtgaagctggccaaccccctgcacttctatgaggcccgcttcagcaacctgtatgtgggcaccaacggcatcatcagcacccaggacttcccccgggagacccagtatgtggactatgacttccccacagacttccctgccatcgcccccttcctggccgacatcgacaccagccacggccggggccgggtgctgtaccgggaggacaccagccctgctgtgctgggcctggccgcccgctacgtgcgggccggcttccccaggtctgcccgcttcacccccacccacgccttcctggccacctgggagcaggtgggcgcctatgaggaggtgaagagaggagccctgcccagcggggagctgaacaccttccaggccgtgctggccagtgatggcagtgacagctatgccctcttcctgtacccagccaacggcctgcagttcctgggcacccggcccaaggagagctacaacgtgcagctgcagctgcctgcccgggtgggcttctgccgcggggaggctgatgacctgaagtctgagggcccctacttcagcctgaccagcacagagcagagcgtgaagaacctgtaccagctgagcaacctgggcatccctggggtgtgggccttccacatcggcagcaccagccccctggacaacgtgcggcctgctgctgtgggggacctgtctgctgcccacagctctgtgcccctgggccgctccttcagccacgccacagccctggagagtgactacaatgaagacaacctggactactatgatgtgaatgaggaggaggccgagtacctgcctggagagcctgaggaggccctgaatggccacagcagcattgatgtgtccttccagagcaaggtggacaccaagcccctggaggagagcagcaccctggacccccacaccaaggagggcaccagcctgggggaggtgggcggccctgacctgaagggccaggtggagccctgggatgagcgggagaccaggagccctgcccctcctgaggtggaccgggacagcctggcccccagctgggagaccccaccaccctacccagaaaatggcagcatccagccctacccagatggcggccctgtgcccagcgagatggatgtgcccccagcccaccctgaggaggagatcgtgctgcggagctacccagccagcggccacaccacccccctgagccggggcacctatgaggtgggcctggaggacaacatcggcagcaacacagaggtgttcacctacaatgctgccaacaaggagacctgtgagcacaaccaccggcagtgcagcagacatgccttctgcacagattatgccaccggcttctgctgccactgccagagcaagttctatggaaatggcaagcactgcctgcctgagggcgccccccaccgggtgaatggcaaggtgtctggccacctgcacgtgggccacacccctgtgcacttcacagatgtggacctgcacgcctacatcgtgggcaatgatggccgggcctacacagccatcagccacatcccccagcctgctgcccaggccctgctgcccctgacccccatcggcggcctgtttggctggctgtttgccctggagaagccaggctctgaaaatggcttcagcctggccggggccgccttcacccatgacatggaggtgaccttctacccaggagaggagaccgtgcgcatcacccagacagctgagggcctggaccctgagaactacctgagcatcaagaccaacatccagggccaggtgccctacgtgtctgccaacttcaccgcccacatcagcccctacaaggagctgtaccactacagcgacagcacagtgaccagcaccagcagccgggactacagcctgacctttggagccatcaaccagacctggagctaccgcatccaccagaacatcacctaccaggtgtgcagacatgcccccaggcaccccagcttccccaccacccagcagctgaatgtggacagagtgtttgccctgtacaatgatgaggagcgggtgctgcgctttgctgtgaccaaccagatcggccctgtgaaggaggacagcgaccccaccccaggcaacccctgctatgatggcagccacatgtgtgacaccacagcccgctgccaccctggcaccggggtggactacacctgtgaatgtgccagcggctaccagggagatggaagaaactgtgtggatgaaaatgaatgtgccaccggcttccaccgctgtggccccaacagcgtgtgcatcaacctgcccggcagctaccgctgtgagtgccgcagcggctatgaatttgctgatgacagacacacctgcatcctgatcaccccaccagccaacccctgtgaagatggcagccacacctgtgccccagctggccaggcccgctgtgtgcaccacggcggcagcaccttcagctgtgcctgcctgcccggctatgctggagatggccaccagtgcacagatgtggatgaatgttctgagaaccgctgccaccctgctgccacctgctacaacaccccaggcagcttcagctgccgctgccagcccggctactatggagatggcttccagtgcatcccagacagcaccagcagcctgaccccctgtgagcagcagcagagacatgcccaggcccagtatgcctacccaggggcccgcttccacatcccccagtgtgatgagcagggcaacttcctgcccctgcagtgccacggcagcacaggcttctgctggtgtgtggaccctgatggccacgaggtgcccggcacccagaccccacctggcagcaccccaccccactgcggccccagccctgagcccacccagaggcctcccaccatctgtgagcgctggagggagaacctgctggagcactacggcggcaccccaagagatgaccagtatgtgccccagtgtgatgacctgggccacttcatccccctgcagtgccacggcaagagtgacttctgctggtgtgtggacaaggatggccgggaggtgcagggcaccaggagccagcccggcaccaccccagcctgcatccccaccgtggccccacccatggtgcggcccacccccaggccagatgtgaccccaccttctgtgggcaccttcctgctgtacacccagggccagcagatcggctacctgcccctgaatggcacccggctgcagaaggatgctgccaagaccctgctgagcctgcacggcagcatcatcgtgggcattgattatgactgccgggagaggatggtgtactggacagatgtggccggccgcaccatcagcagagctggcctggagctgggcgctgagcctgagaccatcgtgaacagcggcctcatcagccctgagggcctggccatcgaccacatccggaggaccatgtactggacagattctgtgctggacaagattgagagcgccctgctggatggcagcgagaggaaggtgctcttctacacagacctggtgaacccccgggccatcgctgtggaccccatccggggcaacctgtactggacagactggaaccgggaggcccccaagattgagaccagcagcctggatggagaaaatcgccgcatcctgatcaacacagacatcggcctgcccaacggcctgacctttgaccccttcagcaagctgctgtgctgggcagatgctggcaccaagaagctggagtgcaccctgcctgatggcaccggccggcgggtcatccagaacaacctgaagtaccccttcagcatcgtgtcctatgctgaccacttctaccacacagactggaggagagatggagtggtgtctgtgaacaagcacagcggccagttcacagatgagtacctgcctgagcagaggagccacctgtatggcatcacagctgtgtacccctactgccccaccggcaggaagtag

SEQ ID NO: 158815 - DNA, 2190 bp, Artificial Sequence
  Description of Artificial Sequence: Synthetic coding sequence
atgagcaccaggacccccctgcccaccgtgaatgaaagagacacagagaaccacaccagccatggagatggccggcaggaggtgaccagcaggaccagccgcagcggggcccgctgcaggaacagcatcgccagctgtgctgatgagcagccccacatcggcaactaccgcctgctgaagaccatcggcaagggcaactttgccaaggtgaagctggcccggcacatcctgaccggccgggaggtggccatcaagatcatcgacaagacccagctgaaccccaccagcctgcagaagctgttccgggaggtgcgcatcatgaagatcctgaaccaccccaacatcgtgaagctgtttgaagtcatcgagacagagaagaccctgtacctgatcatggagtatgccagcggcggggaggtgtttgactacctggtggcccacggccgcatgaaggagaaggaggcccggagcaagttccggcagatcgtgtctgctgtgcagtactgccaccagaagagaattgtgcaccgggacctgaaggccgagaacctgctgctggatgctgacatgaacatcaagattgctgactttggcttcagcaatgagttcaccgtgggcggcaagctggacaccttctgtggcagccccccctatgctgcccctgagctgttccagggcaagaagtatgatggccctgaggtggatgtgtggagcctgggcgtcatcctgtacaccctggtgtctggcagcctgccctttgatggccagaacctgaaggagctgcgggagcgggtgctgcggggcaagtaccgcatccccttctacatgagcacagactgtgagaacctgctgaagcgcttcctggtgctgaaccccatcaagaggggcaccctggagcagatcatgaaggaccgctggatcaatgccggccatgaagaagatgagctgaagccctttgtggagcctgagctggacatcagtgaccagaagagaattgacatcatggtgggcatgggctacagccaggaggagatccaggagagcctgagcaagatgaagtatgatgagatcacagccacctacctgctgctgggcaggaagagcagcgagctggatgccagtgacagcagcagcagcagcaacctgagcctggccaaggtgcggcccagcagtgacctgaacaacagcacaggccagagcccccaccacaaggtgcagaggagcgtcttcagcagccagaagcagaggcgctacagcgaccacgccggccctgccatccccagcgtggtggcctaccccaagaggagccagaccagcacagctgacagcgacctgaaggaggatggcatcagcagcaggaagagcagcggcagcgctgtgggcggcaaaggaattgccccagccagccccatgctgggcaatgccagcaaccccaacaaggctgacatccctgagaggaagaagagcagcacagtgcccagcagcaacacagccagcggcggcatgaccaggaggaacacctacgtgtgcagcgagaggaccacagctgacagacacagcgtcatccagaatggcaaggagaacagcaccatcccagaccagaggacccctgtggccagcacccacagcatcagcagcgctgccaccccagaccgcatccgcttcccccggggcacagccagccgcagcaccttccacggccagccccgggagaggagaacagccacctacaacggccccccagccagccccagcctgagccatgaggccacccccctgagccagaccaggagccggggcagcaccaacctcttcagcaagctgaccagcaagctgaccaggagcagaaatgtgtctgctgagcagaaggatgagaacaaggaggccaagcccaggagcctgcgcttcacctggagcatgaagaccaccagctccatggaccccggggacatgatgagggagatcaggaaggtgctggatgccaacaactgtgactatgagcagcgggagcgcttcctgctcttctgtgtgcatggagatggccatgctgagaacctggtgcagtgggagatggaggtgtgcaagctgccccggctgagcctgaatggagtgcgcttcaagaggatcagcggcaccagcatcgccttcaagaacatcgccagcaagatcgccaatgagctgaagctgtag

SEQ ID NO: 158816 - DNA, 1338 bp, Artificial Sequence
  Description of Artificial Sequence: Synthetic coding sequence
atgaagtatgatgagatcacagccacctacctgctgctgggcaggaagagcagcgagctggatgccagtgacagcagcagcagcagcaacctgagcctggccaaggtgcggcccagcagtgacctgaacaacagcacaggccagagcccccaccacaaggtgcagaggtctgtgttcagcagccagaagcagaggcgctacagcgaccatgctggccctgccatccccagcgtggtggcctaccccaagaggagccagaccagcacagctgacagcgacctgaaggaggatggcatcagcagcaggaagagcagcggcagcgctgtgggcggcaagggcatcgccccagccagccccatgctgggcaatgccagcaaccccaacaaggctgacatccctgagaggaagaagagcagcacagtgcccagcagcaacacagccagcggcggcatgaccaggaggaacacctacgtgtgcagcgagaggaccacagctgacagacattctgtcatccagaatggcaaggagaacagcctgacagagatgtttgcctatgctgccagccctgcctctgtgtgcaccagcacctgccgcctgcggcaccagaagtccatgtccatgtctgccagcggccaccccaagatgatgctgccccccatcgacagcgagggggacaacttcaaggccatcaccatcccagaccagaggacccctgtggccagcacccacagcatcagcagcgctgccaccccagaccgcatccgcttcccccggggcacagccagccgcagcaccttccacggccagccccgggagaggagaacagccacctacaatggacctccagccagccccagcctgagccatgaggccacccccctgagccagaccaggagccggggcagcaccaacctcttcagcaagctgaccagcaagctgacccggcggctgcccacagaatatgaaagaaatggccgctatgagggcagcagcagaaatgtgtctgctgagcagaaggatgagaacaaggaggccaagcccaggagcctgcgcttcacctggagcatgaagaccaccagctccatggaccccggggacatgatgagggagatcaggaaggtgctggatgccaacaactgtgactatgagcagcgggagcgcttcctgctcttctgtgtgcatggagatggccatgctgagaacctggtgcagtgggagatggaggtgtgcaagctgccccggctgagcctgaatggagtgcgcttcaagaggatcagcggcaccagcatcgccttcaagaacatcgccagcaagatcgccaatgagctgaagctgtag

SEQ ID NO: 158817 - DNA, 2259 bp, Artificial Sequence
  Description of Artificial Sequence: Synthetic coding sequence
atgagcaccaggacccccctgcccaccgtgaatgaaagagacacagagaaccacaccagccatggagatggccggcaggaggtgaccagcaggaccagccgcagcggggcccgctgcaggaacagcatcgccagctgtgctgatgagcagccccacatcggcaactaccgcctgctgaagaccatcggcaagggcaactttgccaaggtgaagctggcccggcacatcctgaccggccgggaggtggccatcaagatcatcgacaagacccagctgaaccccaccagcctgcagaagctgttccgggaggtgcgcatcatgaagatcctgaaccaccccaacatcgtgaagctgtttgaagtcatcgagacagagaagaccctgtacctgatcatggagtatgccagcggcggggaggtgtttgactacctggtggcccacggccgcatgaaggagaaggaggcccggagcaagttccggcagggctgccaggccggccagaccatcaaggtgcaggtgtcctttgacctgctgagcctgatgttcaccttcatcgtgtctgctgtgcagtactgccaccagaagagaattgtgcaccgggacctgaaggccgagaacctgctgctggatgctgacatgaacatcaagattgctgactttggcttcagcaatgagttcaccgtgggcggcaagctggacaccttctgtggcagccccccctatgctgcccctgagctgttccagggcaagaagtatgatggccctgaggtggatgtgtggagcctgggcgtcatcctgtacaccctggtgtctggcagcctgccctttgatggccagaacctgaaggagctgcgggagcgggtgctgcggggcaagtaccgcatccccttctacatgagcacagactgtgagaacctgctgaagcgcttcctggtgctgaaccccatcaagaggggcaccctggagcagatcatgaaggaccgctggatcaatgccggccacgaggaggatgagctgaagccctttgtggagcctgagctggacatcagtgaccagaagagaattgacatcatggtgggcatgggctacagccaggaggagatccaggagagcctgagcaagatgaagtatgatgagatcacagccacctacctgctgctgggcaggaagagcagcgagctggatgccagtgacagcagcagcagcagcaacctgagcctggccaaggtgcggcccagcagtgacctgaacaacagcacaggccagagcccccaccacaaggtgcagaggtctgtgttcagcagccagaagcagaggcgctacagcgaccatgctggccctgccatccccagcgtggtggcctaccccaagaggagccagaccagcacagctgacagcgacctgaaggaggatggcatcagcagcaggaagagcagcggcagcgctgtgggcggcaagggcatcgccccagccagccccatgctgggcaatgccagcaaccccaacaaggctgacatccctgagaggaagaagagcagcacagtgcccagcagcaacacagccagcggcggcatgaccaggaggaacacctacgtgtgcagcgagaggaccacagctgacagacattctgtcatccagaatggcaaggagaacagcaccatcccagaccagaggacccctgtggccagcacccacagcatcagcagcgctgccaccccagaccgcatccgcttcccccggggcacagccagccgcagcaccttccacggccagccccgggagaggagaacagccacctacaatggacctccagccagccccagcctgagccatgaggccacccccctgagccagaccaggagccggggcagcaccaacctcttcagcaagctgaccagcaagctgaccaggagcagaaatgtgtctgctgagcagaaggatgagaacaaggaggccaagcccaggagcctgcgcttcacctggagcatgaagaccaccagctccatggaccccggggacatgatgagggagatcaggaaggtgctggatgccaacaactgtgactatgagcagcgggagcgcttcctgctcttctgtgtgcatggagatggccacgccgagaacctggtgcagtgggagatggaggtgtgcaagctgccccggctgagcctgaatggagtgcgcttcaagaggatcagcggcaccagcatcgccttcaagaacatcgccagcaagatcgccaatgagctgaagctgtag

SEQ ID NO: 158818 - DNA, 2262 bp, Artificial Sequence
  Description of Artificial Sequence: Synthetic coding sequence
atgagcaccaggacccccctgcccaccgtgaatgaaagagacacagagaaccacaccagccatggagatggccggcaggaggtgaccagcaggaccagccgcagcggggcccgctgcaggaacagcatcgccagctgtgctgatgagcagccccacatcggcaactaccgcctgctgaagaccatcggcaagggcaactttgccaaggtgaagctggcccggcacatcctgaccggccgggaggtggccatcaagatcatcgacaagacccagctgaaccccaccagcctgcagaagctgttccgggaggtgcgcatcatgaagatcctgaaccaccccaacatcgtgaagctgtttgaagtcatcgagacagagaagaccctgtacctgatcatggagtatgccagcggcggggaggtgtttgactacctggtggcccacggccgcatgaaggagaaggaggcccggagcaagttccggcagatcgtgtctgctgtgcagtactgccaccagaagagaattgtgcaccgggacctgaaggccgagaacctgctgctggatgctgacatgaacatcaagattgctgactttggcttcagcaatgagttcaccgtgggcggcaagctggacaccttctgtggcagccccccctatgctgcccctgagctgttccagggcaagaagtatgatggccctgaggtggatgtgtggagcctgggcgtcatcctgtacaccctggtgtctggcagcctgccctttgatggccagaacctgaaggagctgcgggagcgggtgctgcggggcaagtaccgcatccccttctacatgagcacagactgtgagaacctgctgaagcgcttcctggtgctgaaccccatcaagaggggcaccctggagcagatcatgaaggaccgctggatcaatgccggccatgaagaagatgagctgaagccctttgtggagcctgagctggacatcagtgaccagaagagaattgacatcatggtgggcatgggctacagccaggaggagatccaggagagcctgagcaagatgaagtatgatgagatcacagccacctacctgctgctgggcaggaagagcagcgagctggatgccagtgacagcagcagcagcagcaacctgagcctggccaaggtgcggcccagcagtgacctgaacaacagcacaggccagagcccccaccacaaggtgcagaggagcgtcttcagcagccagaagcagaggcgctacagcgaccacgccggccctgccatccccagcgtggtggcctaccccaagaggagccagaccagcacagctgacagcgacctgaaggaggatggcatcagcagcaggaagagcagcggcagcgctgtgggcggcaaaggaattgccccagccagccccatgctgggcaatgccagcaaccccaacaaggctgacatccctgagaggaagaagagcagcacagtgcccagcagcaacacagccagcggcggcatgaccaggaggaacacctacgtgtgcagcgagaggaccacagctgacagacacagcgtcatccagaatggcaaggagaacagcaccatcccagaccagaggacccctgtggccagcacccacagcatcagcagcgctgccaccccagaccgcatccgcttcccccggggcacagccagccgcagcaccttccacggccagccccgggagaggagaacagccacctacaacggccccccagccagccccagcctgagccatgaggccacccccctgagccagaccaggagccggggcagcaccaacctcttcagcaagctgaccagcaagctgaccaggaggaacatgtccttccgcttcatcaagaggctgcccacagaatatgaaagaaatggccgctatgagggcagcagcagaaatgtgtctgctgagcagaaggatgagaacaaggaggccaagcccaggagcctgcgcttcacctggagcatgaagaccaccagctccatggaccccggggacatgatgagggagatcaggaaggtgctggatgccaacaactgtgactatgagcagcgggagcgcttcctgctcttctgtgtgcatggagatggccatgctgagaacctggtgcagtgggagatggaggtgtgcaagctgccccggctgagcctgaatggagtgcgcttcaagaggatcagcggcaccagcatcgccttcaagaacatcgccagcaagatcgccaatgagctgaagctgtag

SEQ ID NO: 158819 - DNA, 1980 bp, Artificial Sequence
  Description of Artificial Sequence: Synthetic coding sequence
atgagcaccaggacccccctgcccaccgtgaatgaaagagacacagagaaccacaccagccatggagatggccggcaggaggtgaccagcaggaccagccgcagcggggcccgctgcaggaacagcatcgccagctgtgctgatgagcagccccacatcggcaactaccgcctgctgaagaccatcggcaagggcaactttgccaaggtgaagctggcccggcacatcctgaccggccgggaggtggccatcaagatcatcgacaagacccagctgaaccccaccagcctgcagaagctgttccgggaggtgcgcatcatgaagatcctgaaccaccccaacatcgtgaagctgtttgaagtcatcgagacagagaagaccctgtacctgatcatggagtatgccagcggcggggaggtgtttgactacctggtggcccacggccgcatgaaggagaaggaggcccggagcaagttccggcagatcgtgtctgctgtgcagtactgccaccagaagagaattgtgcaccgggacctgaaggagctgcgggagcgggtgctgcggggcaagtaccgcatccccttctacatgagcacagactgtgagaacctgctgaagcgcttcctggtgctgaaccccatcaagaggggcaccctggagcagatcatgaaggaccgctggatcaatgccggccacgaggaggatgagctgaagccctttgtggagcctgagctggacatcagtgaccagaagagaattgacatcatggtgggcatgggctacagccaggaggagatccaggagagcctgagcaagatgaagtatgatgagatcacagccacctacctgctgctgggcaggaagagcagcgagctggatgccagtgacagcagcagcagcagcaacctgagcctggccaaggtgcggcccagcagtgacctgaacaacagcacaggccagagcccccaccacaaggtgcagaggtctgtgttcagcagccagaagcagaggcgctacagcgaccatgctggccctgccatccccagcgtggtggcctaccccaagaggagccagaccagcacagctgacagcgacctgaaggaggatggcatcagcagcaggaagagcagcggcagcgctgtgggcggcaagggcatcgccccagccagccccatgctgggcaatgccagcaaccccaacaaggctgacatccctgagaggaagaagagcagcacagtgcccagcagcaacacagccagcggcggcatgaccaggaggaacacctacgtgtgcagcgagaggaccacagctgacagacattctgtcatccagaatggcaaggagaacagcaccatcccagaccagaggacccctgtggccagcacccacagcatcagcagcgctgccaccccagaccgcatccgcttcccccggggcacagccagccgcagcaccttccacggccagccccgggagaggagaacagccacctacaatggacctccagccagccccagcctgagccatgaggccacccccctgagccagaccaggagccggggcagcaccaacctcttcagcaagctgaccagcaagctgaccaggaggaacatgtccttccgcttcatcaagagcagaaatgtgtctgctgagcagaaggatgagaacaaggaggccaagcccaggagcctgcgcttcacctggagcatgaagaccaccagctccatggaccccggggacatgatgagggagatcaggaaggtgctggatgccaacaactgtgactatgagcagcgggagcgcttcctgctcttctgtgtgcatggagatggccatgctgagaacctggtgcagtgggagatggaggtgtgcaagctgccccggctgagcctgaatggagtgcgcttcaagaggatcagcggcaccagcatcgccttcaagaacatcgccagcaagatcgccaatgagctgaagctgtag

SEQ ID NO: 158820 - DNA, 2235 bp, Artificial Sequence
  Description of Artificial Sequence: Synthetic coding sequence
atgagcaccaggacccccctgcccaccgtgaatgaaagagacacagagaaccacaccagccatggagatggccggcaggaggtgaccagcaggaccagccgcagcggggcccgctgcaggaacagcatcgccagctgtgctgatgagcagccccacatcggcaactaccgcctgctgaagaccatcggcaagggcaactttgccaaggtgaagctggcccggcacatcctgaccggccgggaggtggccatcaagatcatcgacaagacccagctgaaccccaccagcctgcagaagctgttccgggaggtgcgcatcatgaagatcctgaaccaccccaacatcgtgaagctgtttgaagtcatcgagacagagaagaccctgtacctgatcatggagtatgccagcggcggggaggtgtttgactacctggtggcccacggccgcatgaaggagaaggaggcccggagcaagttccggcagatcgtgtctgctgtgcagtactgccaccagaagagaattgtgcaccgggacctgaaggccgagaacctgctgctggatgctgacatgaacatcaagattgctgactttggcttcagcaatgagttcaccgtgggcggcaagctggacaccttctgtggcagccccccctatgctgcccctgagctgttccagggcaagaagtatgatggccctgaggtggatgtgtggagcctgggcgtcatcctgtacaccctggtgtctggcagcctgccctttgatggccagaacctgaaggagctgcgggagcgggtgctgcggggcaagtaccgcatccccttctacatgagcacagactgtgagaacctgctgaagcgcttcctggtgctgaaccccatcaagaggggcaccctggagcagatcatgaaggaccgctggatcaatgccggccatgaagaagatgagctgaagccctttgtggagcctgagctggacatcagtgaccagaagagaattgacatcatggtgggcatgggctacagccaggaggagatccaggagagcctgagcaagatgaagtatgatgagatcacagccacctacctgctgctgggcaggaagagcagcgagctggatgccagtgacagcagcagcagcagcaacctgagcctggccaaggtgcggcccagcagtgacctgaacaacagcacaggccagagcccccaccacaaggtgcagaggagcgtcttcagcagccagaagcagaggcgctacagcgaccacgccggccctgccatccccagcgtggtggcctaccccaagaggagccagaccagcacagctgacagcgacctgaaggaggatggcatcagcagcaggaagagcagcggcagcgctgtgggcggcaaaggaattgccccagccagccccatgctgggcaatgccagcaaccccaacaaggctgacatccctgagaggaagaagagcagcacagtgcccagcagcaacacagccagcggcggcatgaccaggaggaacacctacgtgtgcagcgagaggaccacagctgacagacacagcgtcatccagaatggcaaggagaacagcaccatcccagaccagaggacccctgtggccagcacccacagcatcagcagcgctgccaccccagaccgcatccgcttcccccggggcacagccagccgcagcaccttccacggccagccccgggagaggagaacagccacctacaacggccccccagccagccccagcctgagccatgaggccacccccctgagccagaccaggagccggggcagcaccaacctcttcagcaagctgaccagcaagctgacccggcggctgcccacagaatatgaaagaaatggccgctatgagggcagcagcagaaatgtgtctgctgagcagaaggatgagaacaaggaggccaagcccaggagcctgcgcttcacctggagcatgaagaccaccagctccatggaccccggggacatgatgagggagatcaggaaggtgctggatgccaacaactgtgactatgagcagcgggagcgcttcctgctcttctgtgtgcatggagatggccacgccgagaacctggtgcagtgggagatggaggtgtgcaagctgccccggctgagcctgaatggagtgcgcttcaagaggatcagcggcaccagcatcgccttcaagaacatcgccagcaagatcgccaatgagctgaagctgtag

SEQ ID NO: 158821 - DNA, 1518 bp, Artificial Sequence
  Description of Artificial Sequence: Synthetic coding sequence
tgagtggatgtgtggagcctgggcgtcatcctgtacaccctggtgtctggcagcctgccctttgatggccagaacctgaaggagctgcgggagcgggtgctgcggggcaagtaccgcatccccttctacatgagcacagactgtgagaacctgctgaagcgcttcctggtgctgaaccccatcaagaggggcaccctggagcagatcatgaaggaccgctggatcaatgccggccatgaagaagatgagctgaagccctttgtggagcctgagctggacatcagtgaccagaagagaattgacatcatggtgggcatgggctacagccaggaggagatccaggagagcctgagcaagatgaagtatgatgagatcacagccacctacctgctgctgggcaggaagagcagcgaggtgcggcccagcagtgacctgaacaacagcacaggccagagcccccaccacaaggtgcagaggagcgtcttcagcagccagaagcagaggcgctacagcgaccacgccggccctgccatccccagcgtggtggcctaccccaagaggagccagaccagcacagctgacagcgacctgaaggaggatggcatcagcagcaggaagagcagcggcagcgctgtgggcggcaaaggaattgccccagccagccccatgctgggcaatgccagcaaccccaacaaggctgacatccctgagaggaagaagagcagcacagtgcccagcagcaacacagccagcggcggcatgaccaggaggaacacctacgtgtgcagcgagaggaccacagctgacagacacagcgtcatccagaatggcaaggagaacagcaccatcccagaccagaggacccctgtggccagcacccacagcatcagcagcgctgccaccccagaccgcatccgcttcccccggggcacagccagccgcagcaccttccacggccagccccgggagaggagaacagccacctacaacggccccccagccagccccagcctgagccatgaggccacccccctgagccagaccaggagccggggcagcaccaacctcttcagcaagctgaccagcaagctgaccaggaggaacatgtccttccgcttcatcaagaggctgcccacagaatatgaaagaaatggccgctatgagggcagcagcagaaatgtgtctgctgagcagaaggatgagaacaaggaggccaagcccaggagcctgcgcttcacctggagcatgaagaccaccagctccatggaccccggggacatgatgagggagatcaggaaggtgctggatgccaacaactgtgactatgagcagcgggagcgcttcctgctcttctgtgtgcatggagatggccatgctgagaacctggtgcagtgggagatggaggtgtgcaagctgccccggctgagcctgaatggagtgcgcttcaagaggatcagcggcaccagcatcgccttcaagaacatcgccagcaagatcgccaatgagctgaagctgtag

SEQ ID NO: 158822 - DNA, 2259 bp, Artificial Sequence
  Description of Artificial Sequence: Synthetic coding sequence
atgagcagcaggacagtgctggcccctggaaatgacaggaacagcgacacccacggcaccctgggcagcggccgcagcagtgacaagggccccagctggagcagccgcagcctgggcgcccgctgcagaaattccatcgccagctgcccagaggagcagccccacgtgggcaactaccgcctgctgcggaccatcggcaaaggaaactttgccaaggtgaagctggcccggcacatcctgaccggccgggaggtggccatcaagatcatcgacaagacccagctgaaccccagcagcctgcagaagctgttccgggaggtgcgcatcatgaagggcctgaaccaccccaacatcgtgaagctgtttgaggtgattgaaacagagaagaccctgtacctggtgatggagtatgccagcgctggggaggtgtttgactacctggtgagccacggccgcatgaaggagaaggaggcccgggccaagttccggcagatcgtgtctgctgtgcactactgccaccagaagaacatcgtgcaccgggacctgaaggccgagaacctgctgctggatgctgaggccaacatcaagattgctgactttggcttcagcaatgagttcaccctgggcagcaagctggacaccttctgtggcagccccccctatgctgcccctgagctgttccagggcaagaagtatgatggccctgaggtggacatctggagcctgggcgtcatcctgtacaccctggtgtctggcagcctgccctttgatggccacaacctgaaggagctgcgggagcgggtgctgcggggcaagtacagagtgcccttctacatgagcacagactgtgagagcatcctgcggcgcttcctggtgctgaacccagccaagcgctgcaccctggagcagatcatgaaggacaagtggatcaacatcggctatgaaggagaggagctgaagccctacacagagccagaagaagattttggagacaccaagagaattgaggtgatggtgggcatgggctacacccgggaggagatcaaggagagcctgaccagccagaagtacaatgaggtgacagccacctacctgctgctgggcaggaagacagaggagggcggggacagaggagcccctggcctggccctggcccgggtgcgggcccccagcgacaccaccaacggcaccagcagcagcaagggcaccagccacagcaagggccagaggagcagcagcagcacctaccaccggcagaggaggcacagcgacttctgtggccccagccctgcccccctgcaccccaagaggagccccaccagcactggagaggccgagctgaaggaggagcggctgcccggcaggaaggccagctgcagcacagctggcagcggcagccggggcctgccccccagcagccccatggtgagcagcgcccacaaccccaacaaggccgagatccctgagaggaggaaggacagcaccagcacccccaacaacctgccccccagcatgatgaccaggaggaacacctacgtgtgcacagagaggcctggagctgagcggcccagcctgctgcccaacgggaaggagaacagcagcggcaccccccgggtgcccccagccagccccagcagccacagcctggcccctccttctggagagaggagccggctggcccggggcagcaccatccgcagcaccttccacggcggccaggtgcgggacagaagagctgggggcggcggcggcggcggcgtgcagaatggacctccagccagccccaccctggcccatgaagctgcccccctgcctgctggccggccccggcccaccaccaacctcttcaccaagctgaccagcaagctgaccaggagagtggctgatgagcctgagcgcatcggcggccctgaggtgaccagctgccacctgccctgggaccagacagaaacagccccccggctgctgcgcttcccctggagcgtgaagctgaccagcagcaggcctcctgaggccctgatggccgccctgcggcaggccacagctgctgcccgctgccgctgccggcagccccagcccttcctgctggcctgcctgcacggcggggccggcggccctgagcccctgagccactttgaggtggaggtgtgccagctgccccggcccggcctgcggggcgtgctcttccggcgggtggccggcacagccctggccttccgcaccctggtgacccgcatcagcaatgacctggagctgtag

SEQ ID NO: 158823 - DNA, 1389 bp, Artificial Sequence
  Description of Artificial Sequence: Synthetic coding sequence
atgagcagcaggacagtgctggcccctggaaatgacaggaacagcgacacccacggcaccctgggcagcggccgcagcagtgacaagggccccagctggagcagccgcagcctgggcgcccgctgcagaaattccatcgccagctgcccagaggagcagccccacgtgggcaactaccgcctgctgcggaccatcggcaaaggaaactttgccaaggtgaagctggcccggcacatcctgaccggccgggaggtggccatcaagatcatcgacaagacccagctgaaccccagcagcctgcagaagctgttccgggaggtgcgcatcatgaagggcctgaaccaccccaacatcgtgaagctgtttgaggtgattgaaacagagaagaccctgtacctggtgatggagtatgccagcgctggggagccccccaccctgagcgccctgcccctgtgccacctgcccctgcccctgcacctgaccctgacccccctgggcctgtgcccagctggggaggtgtttgactacctggtgagccacggccgcatgaaggagaaggaggcccgggccaagttccggcagatcgtgtctgctgtgcactactgccaccagaagaacatcgtgcaccgggacctgaaggccgagaacctgctgctggatgctgaggccaacatcaagattgctgactttggcttcagcaatgagttcaccctgggcagcaagctggacaccttctgtggcagccccccctatgctgcccctgagctgttccagggcaagaagtatgatggccctgaggtggacatctggagcctgggcgtcatcctgtacaccctggtgtctggcagcctgccctttgatggccacaacctgaaggagctgcgggagcgggtgctgcggggcaagtacagagtgcccttctacatgagcacagactgtgagagcatcctgcggcgcttcctggtgctgaacccagccaagcgctgcaccctggagcagatcatgaaggacaagtggatcaacatcggctatgaaggagaggagctgaagccctacacagagccagaagaagattttggagacaccaagagaattgaggtgatggtgggcatgggctacacccgggaggagatcaaggagagcctgaccagccagaagtacaatgaggtgacagccacctacctgctgctgggcaggaagacagagccagatgagcacggcggcggcggcgctgagggcggggccgccgcccggcctgagggggagctgcagcacagaggagagtgggagagcagagctgcccccctgcagccccacggccagcagaggccccagccccagcagggccgggaccccagggctgctgagggccagcacgagcacccctag

SEQ ID NO: 158824 - DNA, 2067 bp, Artificial Sequence
  Description of Artificial Sequence: Synthetic coding sequence
atgagcagcaggacagtgctggcccctggaaatgacaggaacagcgacacccacggcaccctgggcagcggccgcagcagtgacaagggccccagctggagcagccgcagcctgggcgcccgctgcagaaattccatcgccagctgcccagaggagcagccccacgtgggcaactaccgcctgctgcggaccatcggcaaaggaaactttgccaaggtgaagctggcccggcacatcctgaccggccgggaggtggccatcaagatcatcgacaagacccagctgaaccccagcagcctgcagaagctgttccgggaggtgcgcatcatgaagggcctgaaccaccccaacatcgtgaagctgtttgaggtgattgaaacagagaagaccctgtacctggtgatggagtatgccagcgctggggaggtgtttgactacctggtgagccacggccgcatgaaggagaaggaggcccgggccaagttccggcagatcgtgtctgctgtgcactactgccaccagaagaacatcgtgcaccgggacctgaaggccgagaacctgctgctggatgctgaggccaacatcaagattgctgactttggcttcagcaatgagttcaccctgggcagcaagctggacaccttctgtggcagccccccctatgctgcccctgagctgttccagggcaagaagtatgatggccctgaggtggacatctggagcctgggcgtcatcctgtacaccctggtgtctggcagcctgccctttgatggccacaacctgaaggagctgcgggagcgggtgctgcggggcaagtacagagtgcccttctacatgagcacagactgtgagagcatcctgcggcgcttcctggtgctgaacccagccaagcgctgcaccctggagcagatcatgaaggacaagtggatcaacatcggctatgaaggagaggagctgaagccctacacagagccagaagaagattttggagacaccaagagaattgaggtgatggtgggcatgggctacacccgggaggagatcaaggagagcctgaccagccagaagtacaatgaggtgacagccacctacctgctgctgggcaggaagacagaggagggcggggacagaggagcccctggcctggccctggcccgggtgcgggcccccagcgacaccaccaacggcaccagcagcagcaagggcaccagccacagcaagggccagaggagcagcagcagcacctaccaccggcagaggaggcacagcgacttctgtggccccagccctgcccccctgcaccccaagaggagccccaccagcactggagaggccgagctgaaggaggagcggctgcccggcaggaaggccagctgcagcacagctggcagcggcagccggggcctgccccccagcagccccatggtgagcagcgcccacaaccccaacaaggccgagatccctgagaggaggaaggacagcaccagcacccccaacaacctgccccccagcatgatgaccaggaggaacacctacgtgtgcacagagaggcctggagctgagcggcccagcctgctgcccaacgggaaggagaacagcagcggcaccccccgggtgcccccagccagccccagcagccacagcctggcccctccttctggagagaggagccggctggcccggggcagcaccatccgcagcaccttccacggcggccaggtgcgggacagaagagctgggggcggcggcggcggcggcgtgcagaatggacctccagccagccccaccctggcccatgaagctgcccccctgcctgctggccggccccggcccaccaccaacctcttcaccaagctgaccagcaagctgaccaggagagtgaccctggaccccagcaagaggcagaacagcaacagatgtgtgtctggggccagcctgccccagggcagcaagatccgcagccagaccaacctgcgggagagcggggacctgcggagccaggtggccatctacctgggcatcaagaggaagcccccacctggctgcagcgacagccctggggtgtag

SEQ ID NO: 158825 - DNA, 240 bp, Artificial Sequence
  Description of Artificial Sequence: Synthetic coding sequence
atggccgccctgcggcaggccacagctgctgcccgctgccgctgccggcagccccagcccttcctgctggcctgcctgcatggaggagctgggggccctgagcccctgagccactttgaggtggaggtgtgccagctgcccaggcctggcctgcggggcgtgctcttcagaagagtggccggcacagccctggccttccgcaccctggtgacccgcatcagcaatgacctggagctgtag

SEQ ID NO: 158826 - DNA, 1032 bp, Artificial Sequence
  Description of Artificial Sequence: Synthetic coding sequence
atggctgctgccacagagctgaaccggcccagcagcggggacaggaacctggagcggcgctgccggcccaacctgagccgggaggtgctgtatgagatcttccgcagcctgcacaccctggtgggccagctggacctgagagatgatgtggtgaagatcaccatcgactggaacaagctgcagagcctgagcgccttccagcctgccctgctcttcagcgccctggagcagcacatcctgtacctgcagcccttcctggccaagctgcagagccccatcaaggaggagaacaccacagctgtggaggagatcggccgcacagagatgggcaacaagaatgaggtgaatgacaagttcagcattggagacctgcaggaggaggagaagcacaaggagagtgacctgagagatgtgaagaagacccagatccactttgatcctgaggtggtgcagatcaaggccggcaaggccgagattgaccggcgcatcagcgccttcattgaaaggaagcaggccgagatcaatgaaaacaacgtgcgggagttctgcaacgtcatcgactgcaaccaggagaacagctgtgccaggacagatgccatcttcaccccctacccaggcttcaagagccacgtgaaggtgtcccgggtggtgaacacctacggcccccagaccaggcctgagggcatccctggcagcggccacaagcccaacagcatgctgcgggactgtggcaaccaggccgtggaggagcggctgcagaacatcgaggcccacctgcggctgcagacaggaggccctgtgccccgggacatctaccagaggatcaagaagctggaggacaagatcctggagctggagggcatcagccctgagtacttccagagcgtgtccttcagcggcaagaggaggaaggtgcagcccccccagaactacagcctggccgagctggatgagaagatcagcgccctgaagcaggccctgctgaggaagagccgggaggccgagagcatggccacccaccacctgccctag

SEQ ID NO: 158827 - DNA, 1035 bp, Artificial Sequence
  Description of Artificial Sequence: Synthetic coding sequence
atggctgctgccacagagctgaaccggcccagcagcggggacaggaacctggagcggcgctgccggcccaacctgagccgggaggtgctgtatgagatcttccgcagcctgcacaccctggtgggccagctggacctgagagatgatgtggtgaagatcaccatcgactggaacaagctgcagagcctgagcgccttccagcctgccctgctcttcagcgccctggagcagcacatcctgtacctgcagcccttcctggccaagctgcagagccccatcaaggaggagaacaccacagctgtggaggagatcggccgcacagagatgggcaacaagaatgaggtgaatgacaagttcagcattggagacctgcaggaggaggagaagcacaaggagagtgacctgagagatgtgaagaagacccagatccactttgatcctgaggtggtgcagatcaaggccggcaaggccgagattgaccggcgcatcagcgccttcattgaaaggaagcaggccgagatcaatgaaaacaacgtgcgggagttctgcaacgtcatcgactgcaaccaggagaacagctgtgccaggacagatgccatcttcaccccctacccaggcttcaagagccacgtgaaggtgtcccgggtggtgaacacctacggcccccagaccaggcctgagggcatccctggcagcggccacaagcccaacagcatgctgcgggactgtggcaaccaggccgtggaggagcggctgcagaacatcgaggcccacctgcggctgcagacaggaggccctgtgccccgggacatctaccagaggatcaagaagctggaggacaagatcctggagctggagggcatcagccctgagtacttccagagcgtgtccttcagcggcaagaggaggaaggtgcagcccccccagcagaactacagcctggccgagctggatgagaagatcagcgccctgaagcaggccctgctgaggaagagccgggaggccgagagcatggccacccaccacctgccctag

SEQ ID NO: 158828 - DNA, 4944 bp, Artificial Sequence
  Description of Artificial Sequence: Synthetic coding sequence
atggtgcagaagaagaagttctgcccccggctgctggactacctggtgattgtgggcgcccggcaccccagcagtgacagcgtggcccagaccccagagctgctgcggcgctaccccctggaggaccacacagagttccccctgcccccagatgtggtgttcttctgccagcctgagggctgcctgtctgtgcggcagaggaggatgagcctgagagatgacaccagctttgtgttcaccctgacagacaaggacaccggggtgaccaggtatggcatctgtgtgaacttctaccgctccttccagaagaggatcagcaaggagaagggggagggcggggccggcagccggggcaaggagggcacccacgccacctgtgccagcgaggagggcggcacagagagcagcgagagcggcagcagcctgcagcccctgtctgctgacagcaccccagatgtgaaccagagcccccggggcaagagaagagccaaggccggcagccgcagcaggaacagcaccctgaccagcctgtgtgtgctgagccactaccccttcttcagcaccttcagagaatgtctgtacaccctgaagaggctggtggactgctgcagcgagcggctgctgggcaagaagctgggcatcccccggggcgtgcagagggacaccatgtggaggatcttcaccggcagcctgctggtggaggagaagagcagcgccctgctgcatgacctgcgggagattgaggcctggatctaccgcctgctgcggagccctgtgcctgtgtctggccagaagagggtggacatcgaggtgctgccccaggagctgcagcctgccctgacctttgccctgcctgaccccagccgcttcaccctggtggacttccccctgcacctgcccctggagctgctgggcgtggatgcctgcctgcaggtgctgacctgcatcctgctggagcacaaggtggtgctgcagagccgggactacaatgccctgtccatgtctgtgatggcctttgtggccatgatctaccccctggagtacatgtttcctgtgatccccctgctgcccacctgcatggccagcgctgagcagctgctgctggcccccaccccctacatcattggagtgcctgccagcttcttcctgtacaagctggacttcaagatgccagatgatgtgtggctggtggacctggacagcaacagagtgattgcccccaccaatgctgaggtgctgcccatcctgcctgagcctgagagcctggagctgaagaagcacctgaagcaggccctggcctccatgagcctgaacacccagcccatcctgaacctggagaagttccacgagggccaggagatccccctgctgctgggccggcccagcaatgacctgcagagcacccccagcacagagttcaaccccctcatctatggaaatgatgtggacagcgtggatgtggccaccagggtggccatggtgcgcttcttcaacagcgccaacgtgctgcagggcttccagatgcacaccaggaccctgcggctcttccccaggcctgtggtggccttccaggccggcagcttcctggccagccggccccggcagaccccatttgctgagaagctggcccggacccaggccgtggagtactttggagagtggatcctgaaccccaccaactatgccttccagaggatccacaacaacatgtttgatcctgccctgattggagacaagcccaagtggtacgcccaccagctgcagcccatccactacagagtgtatgacagcaacagccagctggccgaggccctgtctgtgcccccagagcgggacagcgacagcgagcccacagatgattctggcagtgacagcatggactatgatgacagcagcagcagctacagcagcctgggggactttgtgtctgagatgatgaagtgtgacatcaatggagacacccccaacgtggaccccctgacccatgctgccctgggagatgccagcgaggtggagattgatgagctgcagaaccagaaggaggccgaggagcccggcccagattctgagaacagccaggagaacccccccctgcggagcagcagcagcaccacagccagcagcagccccagcaccgtcatccatggagccaacagcgagcctgctgacagcacagagatggatgacaaggctgctgtgggcgtgtccaagcccctgcccagcgtgcccccatccatcggcaagagcaatgtggaccggcggcaggccgagatcggggagggctctgtgagaagacgcatctatgacaacccctactttgagccccagtatggcttccccccagaagaagatgaagatgagcagggcgagagctacaccccccgcttcagccagcacgtgtctggcaacagagcccagaagctgctgcggcccaacagcctgcggctggccagtgacagtgatgctgagagtgacagccgggccagcagccccaacagcacagtgagcaacaccagcacagagggctttggaggcatcatgagctttgccagcagcctgtacagaaaccacagcaccagcttcagcctgagcaacctgaccctgcccaccaagggggcccgggagaaggccacccccttccccagcctgaaggtgtttggcctgaacaccctgatggagatcgtgacagaggccggccctggcagcggggagggcaacagaagagccctggtggaccagaagagcagcgtcatcaagcacagccccaccgtgaagcgggagccccccagcccccagggccgcagcagcaacagcagcgagaaccagcagttcctgaaggaggtggtgcacagcgtgctggatggccagggcgtgggctggctgaacatgaagaaggtgcggcggctgctggagagcgagcagctgcgggtgtttgtgctgagcaagctgaacaggatggtgcagagtgaagatgatgcccggcaggacatcatcccagatgtggagatcagcaggaaggtgtacaagggcatgctggacctgctgaagtgcaccgtgctgagcctggagcagagctatgcccatgctggcctgggcggcatggccagcatcttcggcctgctggagatcgcccagacccactactacagcaaggagccagacaagaggaagaggagccccacagaatctgtgaacacccctgtgggcaaggaccccggcctggccggccgcggggaccccaaggccatggcccagctgcgggtgccccagctgggcccccgggcccccagcgccaccgggaagggccccaaggagctggacaccaggagcctgaaggaggagaacttcatcgccagcattgagctgtggaacaagcaccaggaggtgaagaagcagaaggccctggagaagcagaggcctgaggtgatcaagcctgtgtttgacctgggggagacagaggagaagaagagccagatctctgctgacagcggcgtgtccctgaccagcagcagccagaggacagaccaggacagcgtcatcggcgtgtccccagctgtgatgatccgcagcagcagccaggacagcgaggtgtccacagtggtgagcaacagcagtggagagaccctgggcgctgacagcgacctgagcagcaatgctggagatggccctggaggagagggctctgtgcacctggccagcagccggggcaccctgagtgacagcgagattgagaccaacagcgccaccagcaccatctttgggaaggcccacagcctgaagcccagcatcaaggagaagctggccggcagccccatccgcaccagtgaagatgtgtcccagagggtgtacctgtatgagggcctgctgggccgggacaagggctccatgtgggaccagctggaggatgctgccatggagaccttcagcatcagcaaggagaggagcaccctgtgggaccagatgcagttctgggaggatgccttcctggatgctgtgatgctggagcgggagggcatgggcatggaccagggcccccaggagatgattgaccgctacctgagcctgggggagcatgacaggaagaggctggaggatgatgaagatcggctgctggccaccctgctgcacaacctgatctcctacatgctgctgatgaaggtgaacaagaatgacatcaggaagaaggtgcggcggctgatgggcaagagccacatcggcctggtgtacagccagcagatcaatgaggtgctggaccagctggccaacctgaatggccgggacctgagcatctggagcagcggcagccgccacatgaagaagcagacctttgtggtgcatgctggaacagacaccaacggggacatcttcttcatggaggtgtgtgatgactgtgtggtgctgcggagcaacattggaacagtgtatgagcgctggtggtatgagaagctgatcaacatgacctactgccccaagaccaaggtgctgtgcctgtggaggagaaatggaagtgagacccagctgaacaagttctacaccaagaagtgccgggagctgtactactgtgtgaaggacagcatggagagagctgctgcccggcagcagagcatcaagccaggccctgagctgggcggggagttccctgtgcaggacctgaagacaggagagggcggcctgctgcaggtgaccctggagggcatcaacctgaagttcatgcacaaccaggtgttcatcgagctgaaccacatcaagaagtgcaacacagtgcggggcgtgtttgtgctggaggagtttgtgcctgagatcaaggaggtggtgagccacaagtacaagacccccatggcccacgagatctgctacagcgtgctgtgcctcttctcctatgtggccgctgtgcacagcagcgaggaggacctgcggaccccacccaggcctgtgagcagctag

SEQ ID NO: 158829 - DNA, 4767 bp, Artificial Sequence
  Description of Artificial Sequence: Synthetic coding sequence
atggtgcagaagaagaagttctgcccccggctgctggactacctggtgattgtgggcgcccggcaccccagcagtgacagcgtggcccagaccccagagctgctgcggcgctaccccctggaggaccacacagagttccccctgcccccagatgtggtgttcttctgccagcctgagggctgcctgtctgtgcggcagaggaggatgagcctgagagatgacaccagctttgtgttcaccctgacagacaaggacaccggggtgaccaggtatggcatctgtgtgaacttctaccgctccttccagaagaggatcagcaaggagaagggggagggcggggccggcagccggggcaaggagggcacccacgccacctgtgccagcgaggagggcggcacagagagcagcgagagcggcagcagcctgcagcccctgtctgctgacagcaccccagatgtgaaccagagcccccggggcaagagaagagccaaggccggcagccgcagcaggaacagcaccctgaccagcctgtgtgtgctgagccactaccccttcttcagcaccttcagagaatgtctgtacaccctgaagaggctggtggactgctgcagcgagcggctgctgggcaagaagctgggcatcccccggggcgtgcagagggacaccatgtggaggatcttcaccggcagcctgctggtggaggagaagagcagcgccctgctgcatgacctgcgggagattgaggcctggatctaccgcctgctgcggagccctgtgcctgtgtctggccagaagagggtggacatcgaggtgctgccccaggagctgcagcctgccctgacctttgccctgcctgaccccagccgcttcaccctggtggacttccccctgcacctgcccctggagctgctgggcgtggatgcctgcctgcaggtgctgacctgcatcctgctggagcacaaggtggtgctgcagagccgggactacaatgccctgtccatgtctgtgatggcctttgtggccatgatctaccccctggagtacatgtttcctgtgatccccctgctgcccacctgcatggccagcgctgagcagctgctgctggcccccaccccctacatcattggagtgcctgccagcttcttcctgtacaagctggacttcaagatgccagatgatgtgtggctggtggacctggacagcaacagagtgattgcccccaccaatgctgaggtgctgcccatcctgcctgagcctgagagcctggagctgaagaagcacctgaagcaggccctggcctccatgagcctgaacacccagcccatcctgaacctggagaagttccacgagggccaggagatccccctgctgctgggccggcccagcaatgacctgcagagcacccccagcacagagttcaaccccctcatctatggaaatgatgtggacagcgtggatgtggccaccagggtggccatggtgcgcttcttcaacagcgccaacgtgctgcagggcttccagatgcacaccaggaccctgcggctcttccccaggcctgtggtggccttccaggccggcagcttcctggccagccggccccggcagaccccatttgctgagaagctggcccggacccaggccgtggagtactttggagagtggatcctgaaccccaccaactatgccttccagaggatccacaacaacatgtttgatcctgccctgattggagacaagcccaagtggtacgcccaccagctgcagcccatccactacagagtgtatgacagcaacagccagctggccgaggccctgtctgtgcccccagagcgggacagcgacagcgagcccacagatgattctggcagtgacagcatggactatgatgacagcagcagcagctacagcagcctgggggactttgtgtctgagatgatgaagtgtgacatcaatggagacacccccaacgtggaccccctgacccatgctgccctgggagatgccagcgaggtggagattgatgagctgcagaaccagaaggaggccgaggagcccggcccagattctgagaacagccaggagaacccccccctgcggagcagcagcagcaccacagccagcagcagccccagcaccgtcatccatggagccaacagcgagcctgctgacagcacagagatggatgacaaggctgctgtgggcgtgtccaagcccctgcccagcgtgcccccatccatcggcaagagcaatgtggaccggcggcaggccgagatcggggagggctctgtgagaagacgcatctatgacaacccctactttgagccccagtatggcttccccccagaagaagatgaagatgagcagggcgagagctacaccccccgcttcagccagcacgtgtctggcaacagagcccagaagctgctgcggcccaacagcctgcggctggccagtgacagtgatgctgagagtgacagccgggccagcagccccaacagcacagtgagcaacaccagcacagagggctttggaggcatcatgagctttgccagcagcctgtacagaaaccacagcaccagcttcagcctgagcaacctgaccctgcccaccaagggggcccgggagaaggccacccccttccccagcctgaagggcaacagaagagccctggtggaccagaagagcagcgtcatcaagcacagccccaccgtgaagcgggagccccccagcccccagggccgcagcagcaacagcagcgagaaccagcagttcctgaaggaggtggtgcacagcgtgctggatggccagggcgtgggctggctgaacatgaagaaggtgcggcggctgctggagagcgagcagctgcgggtgtttgtgctgagcaagctgaacaggatggtgcagagtgaagatgatgcccggcaggacatcatcccagatgtggagatcagcaggaaggtgtacaagggcatgctggacctgctgaagtgcaccgtgctgagcctggagcagagctatgcccatgctggcctgggcggcatggccagcatcttcggcctgctggagatcgcccagacccactactacagcaaggagccagacaagaggaagaggagccccacagaatctgtgaacacccctgtgggcaaggaccccggcctggccggccgcggggaccccaaggccatggcccagctgcgggtgccccagctgggcccccgggcccccagcgccaccgggaagggccccaaggagctggacaccaggagcctgaaggaggagaacttcatcgccagcatcggccctgaggtgatcaagcctgtgtttgacctgggggagacagaggagaagaagagccagatctctgctgacagcggcgtgtccctgaccagcagcagccagaggacagaccaggacagcgtcatcggcgtgtccccagctgtgatgatccgcagcagcagccaggacagcgaggtgtccacagtggtgagcaacagcagtggagagaccctgggcgctgacagcgacctgagcagcaatgctggagatggccctggaggagagggctctgtgcacctggccagcagccggggcaccctgagtgacagcgagattgagaccaacagcgccaccagcaccatctttgggaaggcccacagcctgaagcccagcatcaaggagaagctggccggcagccccatccgcaccagtgaagatgtgtcccagagggtgtacctgtatgagggcctgctgggcaaggagaggagcaccctgtgggaccagatgcagttctgggaggatgccttcctggatgctgtgatgctggagcgggagggcatgggcatggaccagggcccccaggagatgattgaccgctacctgagcctgggggagcatgacaggaagaggctggaggatgatgaggaccggctgctggccaccctgctgcacaacctgatctcctacatgctgctgatgaaggtgaacaagaatgacatcaggaagaaggtgcggcggctgatgggcaagagccacatcggcctggtgtacagccagcagatcaatgaggtgctggaccagctggccaacctgaatggccgggacctgagcatctggagcagcggcagccgccacatgaagaagcagacctttgtggtgcacgccggcacagacaccaatggagacatcttcttcatggaggtgtgtgatgactgtgtggtgctgcggagcaacatcggcaccgtgtatgagcgctggtggtatgagaagctgatcaacatgacctactgccccaagaccaaggtgctgtgcctgtggaggagaaatggcagcgagacccagctgaacaagttctacaccaagaagtgccgggagctgtactactgtgtgaaggacagcatggagagagctgctgcccggcagcagagcatcaagccaggccctgagctgggcggggagttccctgtgcaggacctgaagacaggagagggcggcctgctgcaggtgaccctggagggcatcaacctgaagttcatgcacaaccaggtgttcatcgagctgaaccacatcaagaagtgcaacacagtgcggggcgtgtttgtgctggaggagtttgtgcctgagatcaaggaggtggtgagccacaagtacaagacccccatggcccacgagatctgctacagcgtgctgtgcctcttctcctatgtggccgctgtgcacagcagcgaggaggacctgcggaccccacccaggcctgtgagcagctag

SEQ ID NO: 158830 - DNA, 4827 bp, Artificial Sequence
  Description of Artificial Sequence: Synthetic coding sequence
atggtgcagaagaagaagttctgcccccggctgctggactacctggtgattgtgggcgcccggcaccccagcagtgacagcgtggcccagaccccagagctgctgcggcgctaccccctggaggaccacacagagttccccctgcccccagatgtggtgttcttctgccagcctgagggctgcctgtctgtgcggcagaggaggatgagcctgagagatgacaccagctttgtgttcaccctgacagacaaggacaccggggtgaccaggtatggcatctgtgtgaacttctaccgctccttccagaagaggatcagcaaggagaagggggagggcggggccggcagccggggcaaggagggcacccacgccacctgtgccagcgaggagggcggcacagagagcagcgagagcggcagcagcctgcagcccctgtctgctgacagcaccccagatgtgaaccagagcccccggggcaagagaagagccaaggccggcagccgcagcaggaacagcaccctgaccagcctgtgtgtgctgagccactaccccttcttcagcaccttcagagaatgtctgtacaccctgaagaggctggtggactgctgcagcgagcggctgctgggcaagaagctgggcatcccccggggcgtgcagagggacaccatgtggaggatcttcaccggcagcctgctggtggaggagaagagcagcgccctgctgcatgacctgcgggagattgaggcctggatctaccgcctgctgcggagccctgtgcctgtgtctggccagaagagggtggacatcgaggtgctgccccaggagctgcagcctgccctgacctttgccctgcctgaccccagccgcttcaccctggtggacttccccctgcacctgcccctggagctgctgggcgtggatgcctgcctgcaggtgctgacctgcatcctgctggagcacaaggtggtgctgcagagccgggactacaatgccctgtccatgtctgtgatggcctttgtggccatgatctaccccctggagtacatgtttcctgtgatccccctgctgcccacctgcatggccagcgctgagcagctgctgctggcccccaccccctacatcattggagtgcctgccagcttcttcctgtacaagctggacttcaagatgccagatgatgtgtggctggtggacctggacagcaacagagtgattgcccccaccaatgctgaggtgctgcccatcctgcctgagcctgagagcctggagctgaagaagcacctgaagcaggccctggcctccatgagcctgaacacccagcccatcctgaacctggagaagttccacgagggccaggagatccccctgctgctgggccggcccagcaatgacctgcagagcacccccagcacagagttcaaccccctcatctatggaaatgatgtggacagcgtggatgtggccaccagggtggccatggtgcgcttcttcaacagcgccaacgtgctgcagggcttccagatgcacaccaggaccctgcggctcttccccaggcctgtggtggccttccaggccggcagcttcctggccagccggccccggcagaccccatttgctgagaagctggcccggacccaggccgtggagtactttggagagtggatcctgaaccccaccaactatgccttccagaggatccacaacaacatgtttgatcctgccctgattggagacaagcccaagtggtacgcccaccagctgcagcccatccactacagagtgtatgacagcaacagccagctggccgaggccctgtctgtgcccccagagcgggacagcgacagcgagcccacagatgattctggcagtgacagcatggactatgatgacagcagcagcagctacagcagcctgggggactttgtgtctgagatgatgaagtgtgacatcaatggagacacccccaacgtggaccccctgacccatgctgccctgggagatgccagcgaggtggagattgatgagctgcagaaccagaaggaggccgaggagcccggcccagattctgagaacagccaggagaacccccccctgcggagcagcagcagcaccacagccagcagcagccccagcaccgtcatccatggagccaacagcgagcctgctgacagcacagagatggatgacaaggctgctgtgggcgtgtccaagcccctgcccagcgtgcccccatccatcggcaagagcaatgtggaccggcggcaggccgagatcggggagggctctgtgagaagacgcatctatgacaacccctactttgagccccagtatggcttccccccagaagaagatgaagatgagcagggcgagagctacaccccccgcttcagccagcacgtgtctggcaacagagcccagaagctgctgcggcccaacagcctgcggctggccagtgacagtgatgctgagagtgacagccgggccagcagccccaacagcacagtgagcaacaccagcacagagggctttggaggcatcatgagctttgccagcagcctgtacagaaaccacagcaccagcttcagcctgagcaacctgaccctgcccaccaagggggcccgggagaaggccacccccttccccagcctgaaggtgtttggcctgaacaccctgatggagatcgtgacagaggccggccctggcagcggggagggcaacagaagagccctggtggaccagaagagcagcgtcatcaagcacagccccaccgtgaagcgggagccccccagcccccagggccgcagcagcaacagcagcgagaaccagcagttcctgaaggaggtggtgcacagcgtgctggatggccagggcgtgggctggctgaacatgaagaaggtgcggcggctgctggagagcgagcagctgcgggtgtttgtgctgagcaagctgaacaggatggtgcagagtgaagatgatgcccggcaggacatcatcccagatgtggagatcagcaggaaggtgtacaagggcatgctggacctgctgaagtgcaccgtgctgagcctggagcagagctatgcccatgctggcctgggcggcatggccagcatcttcggcctgctggagatcgcccagacccactactacagcaaggagccagacaagaggaagaggagccccacagaatctgtgaacacccctgtgggcaaggaccccggcctggccggccgcggggaccccaaggccatggcccagctgcgggtgccccagctgggcccccgggcccccagcgccaccgggaagggccccaaggagctggacaccaggagcctgaaggaggagaacttcatcgccagcatcggccctgaggtgatcaagcctgtgtttgacctgggggagacagaggagaagaagagccagatctctgctgacagcggcgtgtccctgaccagcagcagccagaggacagaccaggacagcgtcatcggcgtgtccccagctgtgatgatccgcagcagcagccaggacagcgaggtgtccacagtggtgagcaacagcagtggagagaccctgggcgctgacagcgacctgagcagcaatgctggagatggccctggaggagagggctctgtgcacctggccagcagccggggcaccctgagtgacagcgagattgagaccaacagcgccaccagcaccatctttgggaaggcccacagcctgaagcccagcatcaaggagaagctggccggcagccccatccgcaccagtgaagatgtgtcccagagggtgtacctgtatgagggcctgctgggcaaggagaggagcaccctgtgggaccagatgcagttctgggaggatgccttcctggatgctgtgatgctggagcgggagggcatgggcatggaccagggcccccaggagatgattgaccgctacctgagcctgggggagcatgacaggaagaggctggaggatgatgaggaccggctgctggccaccctgctgcacaacctgatctcctacatgctgctgatgaaggtgaacaagaatgacatcaggaagaaggtgcggcggctgatgggcaagagccacatcggcctggtgtacagccagcagatcaatgaggtgctggaccagctggccaacctgaatggccgggacctgagcatctggagcagcggcagccgccacatgaagaagcagacctttgtggtgcacgccggcacagacaccaatggagacatcttcttcatggaggtgtgtgatgactgtgtggtgctgcggagcaacatcggcaccgtgtatgagcgctggtggtatgagaagctgatcaacatgacctactgccccaagaccaaggtgctgtgcctgtggaggagaaatggcagcgagacccagctgaacaagttctacaccaagaagtgccgggagctgtactactgtgtgaaggacagcatggagagagctgctgcccggcagcagagcatcaagccaggccctgagctgggcggggagttccctgtgcaggacctgaagacaggagagggcggcctgctgcaggtgaccctggagggcatcaacctgaagttcatgcacaaccaggtgttcatcgagctgaaccacatcaagaagtgcaacacagtgcggggcgtgtttgtgctggaggagtttgtgcctgagatcaaggaggtggtgagccacaagtacaagacccccatggcccacgagatctgctacagcgtgctgtgcctcttctcctatgtggccgctgtgcacagcagcgaggaggacctgcggaccccacccaggcctgtgagcagctag

SEQ ID NO: 158831 - DNA, 4746 bp, Artificial Sequence
  Description of Artificial Sequence: Synthetic coding sequence
atggtgcagaagaagaagttctgcccccggctgctggactacctggtgattgtgggcgcccggcaccccagcagtgacagcgtggcccagaccccagagctgctgcggcgctaccccctggaggaccacacagagttccccctgcccccagatgtggtgttcttctgccagcctgagggctgcctgtctgtgcggcagaggaggatgagcctgagagatgacaccagctttgtgttcaccctgacagacaaggacaccggggtgaccaggtatggcatctgtgtgaacttctaccgctccttccagaagaggatcagcaaggagaagggggagggcggggccggcagccggggcaaggagggcacccacgccacctgtgccagcgaggagggcggcacagagagcagcgagagcggcagcagcctgcagcccctgtctgctgacagcaccccagatgtgaaccagagcccccggggcaagagaagagccaaggccggcagccgcagcaggaacagcaccctgaccagcctgtgtgtgctgagccactaccccttcttcagcaccttcagagaatgtctgtacaccctgaagaggctggtggactgctgcagcgagcggctgctgggcaagaagctgggcatcccccggggcgtgcagagggacaccatgtggaggatcttcaccggcagcctgctggtggaggagaagagcagcgccctgctgcatgacctgcgggagattgaggcctggatctaccgcctgctgcggagccctgtgcctgtgtctggccagaagagggtggacatcgaggtgctgccccaggagctgcagcctgccctgacctttgccctgcctgaccccagccgcttcaccctggtggacttccccctgcacctgcccctggagctgctgggcgtggatgcctgcctgcaggtgctgacctgcatcctgctggagcacaaggtggtgctgcagagccgggactacaatgccctgtccatgtctgtgatggcctttgtggccatgatctaccccctggagtacatgtttcctgtgatccccctgctgcccacctgcatggccagcgctgagcagctgctgctggcccccaccccctacatcattggagtgcctgccagcttcttcctgtacaagctggacttcaagatgccagatgatgtgtggctggtggacctggacagcaacagagtgattgcccccaccaatgctgaggtgctgcccatcctgcctgagcctgagagcctggagctgaagaagcacctgaagcaggccctggcctccatgagcctgaacacccagcccatcctgaacctggagaagttccacgagggccaggagatccccctgctgctgggccggcccagcaatgacctgcagagcacccccagcacagagttcaaccccctcatctatggaaatgatgtggacagcgtggatgtggccaccagggtggccatggtgcgcttcttcaacagcgccaacgtgctgcagggcttccagatgcacaccaggaccctgcggctcttccccaggcctgtggtggccttccaggccggcagcttcctggccagccggccccggcagaccccatttgctgagaagctggcccggacccaggccgtggagtactttggagagtggatcctgaaccccaccaactatgccttccagaggatccacaacaacatgtttgatcctgccctgattggagacaagcccaagtggtacgcccaccagctgcagcccatccactacagagtgtatgacagcaacagccagctggccgaggccctgtctgtgcccccagagcgggacagcgacagcgagcccacagatgattctggcagtgacagcatggactatgatgacagcagcagcagctacagcagcctgggggactttgtgtctgagatgatgaagtgtgacatcaatggagacacccccaacgtggaccccctgacccatgctgccctgggagatgccagcgaggtggagattgatgagctgcagaaccagaaggaggccgaggagcccggcccagattctgagaacagccaggagaacccccccctgcggagcagcagcagcaccacagccagcagcagccccagcaccgtcatccatggagccaacagcgagcctgctgacagcacagagatggatgacaaggctgctgtgggcgtgtccaagcccctgcccagcgtgcccccatccatcggcaagagcaatgtggaccggcggcaggccgagatcggggagggctctgtgagaagacgcatctatgacaacccctactttgagccccagtatggcttccccccagaagaagatgaagatgagcagggcgagagctacaccccccgcttcagccagcacgtgtctggcaacagagcccagaagctgctgcggcccaacagcctgcggctggccagtgacagtgatgctgagagtgacagccgggccagcagccccaacagcacagtgagcaacaccagcacagagggctttggaggcatcatgagctttgccagcagcctgtacagaaaccacagcaccagcttcagcctgagcaacctgaccctgcccaccaagggggcccgggagaaggccacccccttccccagcctgaaggtgtttggcctgaacaccctgatggagatcgtgacagaggccggccctggcagcggggagggcaacagaagagccctggtggaccagaagagcagcgtcatcaagcacagccccaccgtgaagcgggagccccccagcccccagggccgcagcagcaacagcagcgagaaccagcagttcctgaaggaggtggtgcacagcgtgctggatggccagggcgtgggctggctgaacatgaagaaggtgcggcggctgctggagagcgagcagctgcgggtgtttgtgctgagcaagctgaacaggatggtgcagagtgaagatgatgcccggcaggacatcatcccagatgtggagatcagcaggaaggtgtacaagggcatgctggacctgctgaagtgcaccgtgctgagcctggagcagagctatgcccatgctggcctgggcggcatggccagcatcttcggcctgctggagatcgcccagacccactactacagcaaggagccagacaagaggaagaggagccccacagaatctgtgaacacccctgtgggcaaggaccccggcctggccggccgcggggaccccaaggccatggcccagctgcgggtgccccagctgggcccccgggcccccagcgccaccgggaagggccccaaggagctggacaccaggagcctgaaggaggagaacttcatcgccagcattgagctgtggaacaagcaccaggaggtgaagaagcagaaggccctggagaagcagaggcctgaggtgatcaagcctgtgtttgacctgggggagacagaggagaagaagagccagatctctgctgacagcggcgtgtccctgaccagcagcagccagaggacagaccaggacagcgtcatcggcgtgtccccagctgtgatgatccgcagcagcagccaggacagcgaggtgtccacagtggtgagcaacagcagtggagagaccctgggcgctgacagcgacctgagcagcaatgctggagatggccctggaggagagggctctgtgcacctggccagcagccggggcaccctgagtgacagcgagattgagaccaacagcgccaccagcaccatctttgggaaggcccacagcctgaagcccagcatcaaggagaagctggccggcagccccatccgcaccagtgaagatgtgtcccagagggtgtacctgtatgagggcctgctgggccgggacaagggctccatgtgggaccagctggaggatgctgccatggagaccttcagcatcagcaaggagaggagcaccctgtgggaccagatgcagttctgggaggatgccttcctggatgctgtgatgctggagcgggagggcatgggcatggaccagggcccccaggagatgattgaccgctacctgagcctgggggagcatgacaggaagaggctggaggatgatgaagatcggctgctggccaccctgctgcacaacctgatctcctacatgctgctgatgaaggtgaacaagaatgacatcaggaagaaggtgcggcggctgatgggcaagagccacatcggcctggtgtacagccagcagatcaatgaggtgctggaccagctggccaacctgaatggccgggacctgagcatctggagcagcggcagccgccacatgaagaagcagacctttgtggtgcatgctggaacagacaccaacggggacatcttcttcatggaggtgtgtgatgactgtgtggtgctgcggagcaacattggaacagtgtatgagcgctggtggtatgagaagctgatcaacatgacctactgccccaagaccaaggtgctgtgcctgtggaggagaaatggaagtgagacccagctgaacaagttctacaccaagaagtgccgggagctgtactactgtgtgaaggacagcatggagagagctgctgcccggcagcagagcatcaagccaggccctgagctgggcggggagttccctgtgcaggacctgaagacaggagagggcggcctgctgcaggtgaccctggagggcatcaacctgaagttcatgcacaaccagttcctgaagctgaagaagtggtag

SEQ ID NO: 158832 - DNA, 4440 bp, Artificial Sequence
  Description of Artificial Sequence: Synthetic coding sequence
atggtgcagaagaagaagttctgcccccggctgctggactacctggtgattgtgggcgcccggcaccccagcagtgacagcgtggcccagaccccagagctgctgcggcgctaccccctggaggaccacacagagttccccctgcccccagatgtggtgttcttctgccagcctgagggctgcctgtctgtgcggcagaggaggatgagcctgagagatgacaccagctttgtgttcaccctgacagacaaggacaccggggtgaccaggtatggcatctgtgtgaacttctaccgctccttccagaagaggatcagcaaggagaagggggagggcggggccggcagccggggcaaggagggcacccacgccacctgtgccagcgaggagggcggcacagagagcagcgagagcggcagcagcctgcagcccctgtctgctgacagcaccccagatgtgaaccagagcccccggggcaagagaagagccaaggccggcagccgcagcaggaacagcaccctgaccagcctgtgtgtgctgagccactaccccttcttcagcaccttcagagaatgtctgtacaccctgaagaggctggtggactgctgcagcgagcggctgctgggcaagaagctgggcatcccccggggcgtgcagagggacaccatgtggaggatcttcaccggcagcctgctggtggaggagaagagcagcgccctgctgcatgacctgcgggagattgaggcctggatctaccgcctgctgcggagccctgtgcctgtgtctggccagaagagggtggacatcgaggtgctgccccaggagctgcagcctgccctgacctttgccctgcctgaccccagccgcttcaccctggtggacttccccctgcacctgcccctggagctgctgggcgtggatgcctgcctgcaggtgctgacctgcatcctgctggagcacaaggtggtgctgcagagccgggactacaatgccctgtccatgtctgtgatggcctttgtggccatgatctaccccctggagtacatgtttcctgtgatccccctgctgcccacctgcatggccagcgctgagcagctgctgctggcccccaccccctacatcattggagtgcctgccagcttcttcctgtacaagctggacttcaagatgccagatgatgtgtggctggtggacctggacagcaacagagtgattgcccccaccaatgctgaggtgctgcccatcctgcctgagcctgagagcctggagctgaagaagcacctgaagcaggccctggcctccatgagcctgaacacccagcccatcctgaacctggagaagttccacgagggccaggagatccccctgctgctgggccggcccagcaatgacctgcagagcacccccagcacagagttcaaccccctcatctatggaaatgatgtggacagcgtggatgtggccaccagggtggccatggtgcgcttcttcaacagcgccaacgtgctgcagggcttccagatgcacaccaggaccctgcggctcttccccaggcctgtggtggccttccaggccggcagcttcctggccagccggccccggcagaccccatttgctgagaagctggcccggacccaggccgtggagtactttggagagtggatcctgaaccccaccaactatgccttccagaggatccacaacaacatgtttgatcctgccctgattggagacaagcccaagtggtacgcccaccagctgcagcccatccactacagagtgtatgacagcaacagccagctggccgaggccctgtctgtgcccccagagcgggacagcgacagcgagcccacagatgattctggcagtgacagcatggactatgatgacagcagcagcagctacagcagcctgggggactttgtgtctgagatgatgaagtgtgacatcaatggagacacccccaacgtggaccccctgacccatgctgccctgggagatgccagcgaggtggagattgatgagctgcagaaccagaaggaggccgaggagcccggcccagattctgagaacagccaggagaacccccccctgcggagcagcagcagcaccacagccagcagcagccccagcaccgtcatccatggagccaacagcgagcctgctgacagcacagagatggatgacaaggctgctgtgggcgtgtccaagcccctgcccagcgtgcccccatccatcggcaagagcaatgtggaccggcggcaggccgagatcggggagggcgcccagaagctgctgcggcccaacagcctgcggctggccagtgacagtgatgctgagagtgacagccgggccagcagccccaacagcacagtgagcaacaccagcacagagggctttggaggcatcatgagctttgccagcagcctgtacagaaaccacagcaccagcttcagcctgagcaacctgaccctgcccaccaagggggcccgggagaaggccacccccttccccagcctgaagggcaacagaagagccctggtggaccagaagagcagcgtcatcaagcacagccccaccgtgaagcgggagccccccagcccccagggccgcagcagcaacagcagcgagaaccagcagttcctgaaggaggtggtgcacagcgtgctggatggccagggcgtgggctggctgaacatgaagaaggtgcggcggctgctggagagcgagcagctgcgggtgtttgtgctgagcaagctgaacaggatggtgcagagtgaagatgatgcccggcaggacatcatcccagatgtggagatcagcaggaaggtgtacaagggcatgctggacctgctgaagtgcaccgtgctgagcctggagcagagctatgcccacgccggcctgggcggcatggccagcatcttcggcctgctggagatcgcccagacccactactacagcaaggagccagacaagaggaagaggagccccacagagagcgtgaacacccctgtgggcaaggaccccggcctggccggccgcggggaccccaaggccatggcccagctgcgggtgccccagctgggcccccgggcccccagcgccaccgggaagggccccaaggagctggacaccaggagcctgaaggaggagaacttcatcgccagcatcggccctgaggtgatcaagcctgtgtttgacctgggggagacagaggagaagaagagccagatctctgctgacagcggcgtgtccctgaccagcagcagccagaggacagaccaggacagcgtgattggagtgtccccagctgtgatgatccgcagcagcagccaggacagcgaggtgtccacagtggtgagcaacagcagcggggagaccctgggcgctgacagcgacctgagcagcaatgctggagatggccctggaggagagggctctgtgcacctggccagcagccggggcaccctgagtgacagcgagattgagaccaacagcgccaccagcaccatctttgggaaggcccacagcctgaagcccagcatcaaggagaagctggccggcagccccatccgcaccagtgaagatgtgtcccagagggtgtacctgtatgagggcctgctgggcaaggagaggagcaccctgtgggaccagatgcagttctgggaggatgccttcctggatgctgtgatgctggagcgggagggcatgggcatggaccagggcccccaggagatgattgaccgctacctgagcctgggggagcatgacaggaagaggctggaggatgatgaagatcggctgctggccaccctgctgcacaacctgatctcctacatgctgctgatgaaggtgaacaagaatgacatcaggaagaaggtgcggcggctgatgggcaagagccacatcggcctggtgtacagccagcagatcaatgaggtgctggaccagctggccaacctgaatggccgggacctgagcatctggagcagcggcagccgccacatgaagaagcagacctttgtggtgcatgctggaacagacaccaacggggacatcttcttcatggaggtgtgtgatgactgtgtggtgctgcggagcaacattggaacagtgtatgagcgctggtggtatgagaagctgatcaacatgacctactgccccaagaccaaggtgctgtgcctgtggaggagaaatggaagtgagacccagctgaacaagttctacaccaagaagtgccgggagctgtactactgtgtgaaggacagcatggagagagctgctgcccggcagcagagcatcaagccaggccctgagctgggcggggagttccctgtgcaggacctgaagacaggagagggcggcctgctgcaggtgaccctggagggcatcaacctgaagttcatgcacaaccagctgctgcggcggctgcgctggtag

SEQ ID NO: 158833 - DNA, 4626 bp, Artificial Sequence
  Description of Artificial Sequence: Synthetic coding sequence
atggtgcagaagaagaagttctgcccccggctgctggactacctggtgattgtgggcgcccggcaccccagcagtgacagcgtggcccagaccccagagctgctgcggcgctaccccctggaggaccacacagagttccccctgcccccagatgtggtgttcttctgccagcctgagggctgcctgtctgtgcggcagaggaggatgagcctgagagatgacaccagctttgtgttcaccctgacagacaaggacaccggggtgaccaggtatggcatctgtgtgaacttctaccgctccttccagaagaggatcagcaaggagaagggggagggcggggccggcagccggggcaaggagggcacccacgccacctgtgccagcgaggagggcggcacagagagcagcgagagcggcagcagcctgcagcccctgtctgctgacagcaccccagatgtgaaccagagcccccggggcaagagaagagccaaggccggcagccgcagcaggaacagcaccctgaccagcctgtgtgtgctgagccactaccccttcttcagcaccttcagagaatgtctgtacaccctgaagaggctggtggactgctgcagcgagcggctgctgggcaagaagctgggcatcccccggggcgtgcagagggacaccatgtggaggatcttcaccggcagcctgctggtggaggagaagagcagcgccctgctgcatgacctgcgggagattgaggcctggatctaccgcctgctgcggagccctgtgcctgtgtctggccagaagagggtggacatcgaggtgctgccccaggagctgcagcctgccctgacctttgccctgcctgaccccagccgcttcaccctggtggacttccccctgcacctgcccctggagctgctgggcgtggatgcctgcctgcaggtgctgacctgcatcctgctggagcacaaggtggtgctgcagagccgggactacaatgccctgtccatgtctgtgatggcctttgtggccatgatctaccccctggagtacatgtttcctgtgatccccctgctgcccacctgcatggccagcgctgagcagctgctgctggcccccaccccctacatcattggagtgcctgccagcttcttcctgtacaagctggacttcaagatgccagatgatgtgtggctggtggacctggacagcaacagagtgattgcccccaccaatgctgaggtgctgcccatcctgcctgagcctgagagcctggagctgaagaagcacctgaagcaggccctggcctccatgagcctgaacacccagcccatcctgaacctggagaagttccacgagggccaggagatccccctgctgctgggccggcccagcaatgacctgcagagcacccccagcacagagttcaaccccctcatctatggaaatgatgtggacagcgtggatgtggccaccagggtggccatggtgcgcttcttcaacagcgccaacgtgctgcagggcttccagatgcacaccaggaccctgcggctcttccccaggcctgtggtggccttccaggccggcagcttcctggccagccggccccggcagaccccatttgctgagaagctggcccggacccaggccgtggagtactttggagagtggatcctgaaccccaccaactatgccttccagaggatccacaacaacatgtttgatcctgccctgattggagacaagcccaagtggtacgcccaccagctgcagcccatccactacagagtgtatgacagcaacagccagctggccgaggccctgtctgtgcccccagagcgggacagcgacagcgagcccacagatgattctggcagtgacagcatggactatgatgacagcagcagcagctacagcagcctgggggactttgtgtctgagatgatgaagtgtgacatcaatggagacacccccaacgtggaccccctgacccatgctgccctgggagatgccagcgaggtggagattgatgagctgcagaaccagaaggaggccgaggagcccggcccagattctgagaacagccaggagaacccccccctgcggagcagcagcagcaccacagccagcagcagccccagcaccgtcatccatggagccaacagcgagcctgctgacagcacagagatggatgacaaggctgctgtgggcgtgtccaagcccctgcccagcgtgcccccatccatcggcaagagcaatgtggaccggcggcaggccgagatcggggagggcgcccagaagctgctgcggcccaacagcctgcggctggccagtgacagtgatgctgagagtgacagccgggccagcagccccaacagcacagtgagcaacaccagcacagagggctttggaggcatcatgagctttgccagcagcctgtacagaaaccacagcaccagcttcagcctgagcaacctgaccctgcccaccaagggggcccgggagaaggccacccccttccccagcctgaagggcaacagaagagccctggtggaccagaagagcagcgtcatcaagcacagccccaccgtgaagcgggagccccccagcccccagggccgcagcagcaacagcagcgagaaccagcagttcctgaaggaggtggtgcacagcgtgctggatggccagggcgtgggctggctgaacatgaagaaggtgcggcggctgctggagagcgagcagctgcgggtgtttgtgctgagcaagctgaacaggatggtgcagagtgaagatgatgcccggcaggacatcatcccagatgtggagatcagcaggaaggtgtacaagggcatgctggacctgctgaagtgcaccgtgctgagcctggagcagagctatgcccacgccggcctgggcggcatggccagcatcttcggcctgctggagatcgcccagacccactactacagcaaggagccagacaagaggaagaggagccccacagagagcgtgaacacccctgtgggcaaggaccccggcctggccggccgcggggaccccaaggccatggcccagctgcgggtgccccagctgggcccccgggcccccagcgccaccgggaagggccccaaggagctggacaccaggagcctgaaggaggagaacttcatcgccagcatcggccctgaggtgatcaagcctgtgtttgacctgggggagacagaggagaagaagagccagatctctgctgacagcggcgtgtccctgaccagcagcagccagaggacagaccaggacagcgtgattggagtgtccccagctgtgatgatccgcagcagcagccaggacagcgaggtgagcaacagcagcggggagaccctgggcgctgacagcgacctgagcagcaatgctggagatggccctggaggagagggctctgtgcacctggccagcagccggggcaccctgagtgacagcgagattgagaccaacagcgccaccagcaccatctttgggaaggcccacagcctgaagcccagcatcaaggagaagctggccggcagccccatccgcaccagtgaagatgtgtcccagagggtgtacctgtatgagggcctgctgggcaaggagaggagcaccctgtgggaccagatgcagttctgggaggatgccttcctggatgctgtgatgctggagcgggagggcatgggcatggaccagggcccccaggagatgattgaccgctacctgagcctgggggagcatgacaggaagaggctggaggatgatgaagatcggctgctggccaccctgctgcacaacctgatctcctacatgctgctgatgaaggtgaacaagaatgacatcaggaagaaggtgcggcggctgatgggcaagagccacatcggcctggtgtacagccagcagatcaatgaggtgctggaccagctggccaacctgaatggccgggacctgagcatctggagcagcggcagccgccacatgaagaagcagacctttgtggtgcatgctggaacagacaccaacggggacatcttcttcatggaggtgtgtgatgactgtgtggtgctgcggagcaacattggaacagtgtatgagcgctggtggtatgagaagctgatcaacatgacctactgccccaagaccaaggtgctgtgcctgtggaggagaaatggaagtgagacccagctgaacaagttctacaccaagaagtgccgggagctgtactactgtgtgaaggacagcatggagagagctgctgcccggcagcagagcatcaagccaggccctgagctgggcggggagttccctgtgcaggacctgaagacaggagagggcggcctgctgcaggtgaccctggagggcatcaacctgaagttcatgcacaaccaggtgttcatcgagctgaaccacatcaagaagtgcaacacagtgcggggcgtgtttgtgctggaggagtttgtgcctgagatcaaggaggtggtgagccacaagtacaagacccccatggcccacgagatctgctacagcgtgctgtgcctcttctcctatgtggccgctgtgcacagcagcgaggaggacctgcggaccccacccaggcctgtgagcagctag

SEQ ID NO: 158834 - DNA, 4764 bp, Artificial Sequence
  Description of Artificial Sequence: Synthetic coding sequence
atggtgcagaagaagaagttctgcccccggctgctggactacctggtgattgtgggcgcccggcaccccagcagtgacagcgtggcccagaccccagagctgctgcggcgctaccccctggaggaccacacagagttccccctgcccccagatgtggtgttcttctgccagcctgagggctgcctgtctgtgcggcagaggaggatgagcctgagagatgacaccagctttgtgttcaccctgacagacaaggacaccggggtgaccaggtatggcatctgtgtgaacttctaccgctccttccagaagaggatcagcaaggagaagggggagggcggggccggcagccggggcaaggagggcacccacgccacctgtgccagcgaggagggcggcacagagagcagcgagagcggcagcagcctgcagcccctgtctgctgacagcaccccagatgtgaaccagagcccccggggcaagagaagagccaaggccggcagccgcagcaggaacagcaccctgaccagcctgtgtgtgctgagccactaccccttcttcagcaccttcagagaatgtctgtacaccctgaagaggctggtggactgctgcagcgagcggctgctgggcaagaagctgggcatcccccggggcgtgcagagggacaccatgtggaggatcttcaccggcagcctgctggtggaggagaagagcagcgccctgctgcatgacctgcgggagattgaggcctggatctaccgcctgctgcggagccctgtgcctgtgtctggccagaagagggtggacatcgaggtgctgccccaggagctgcagcctgccctgacctttgccctgcctgaccccagccgcttcaccctggtggacttccccctgcacctgcccctggagctgctgggcgtggatgcctgcctgcaggtgctgacctgcatcctgctggagcacaaggtggtgctgcagagccgggactacaatgccctgtccatgtctgtgatggcctttgtggccatgatctaccccctggagtacatgtttcctgtgatccccctgctgcccacctgcatggccagcgctgagcagctgctgctggcccccaccccctacatcattggagtgcctgccagcttcttcctgtacaagctggacttcaagatgccagatgatgtgtggctggtggacctggacagcaacagagtgattgcccccaccaatgctgaggtgctgcccatcctgcctgagcctgagagcctggagctgaagaagcacctgaagcaggccctggcctccatgagcctgaacacccagcccatcctgaacctggagaagttccacgagggccaggagatccccctgctgctgggccggcccagcaatgacctgcagagcacccccagcacagagttcaaccccctcatctatggaaatgatgtggacagcgtggatgtggccaccagggtggccatggtgcgcttcttcaacagcgccaacgtgctgcagggcttccagatgcacaccaggaccctgcggctcttccccaggcctgtggtggccttccaggccggcagcttcctggccagccggccccggcagaccccatttgctgagaagctggcccggacccaggccgtggagtactttggagagtggatcctgaaccccaccaactatgccttccagaggatccacaacaacatgtttgatcctgccctgattggagacaagcccaagtggtacgcccaccagctgcagcccatccactacagagtgtatgacagcaacagccagctggccgaggccctgtctgtgcccccagagcgggacagcgacagcgagcccacagatgattctggcagtgacagcatggactatgatgacagcagcagcagctacagcagcctgggggactttgtgtctgagatgatgaagtgtgacatcaatggagacacccccaacgtggaccccctgacccatgctgccctgggagatgccagcgaggtggagattgatgagctgcagaaccagaaggaggccgaggagcccggcccagattctgagaacagccaggagaacccccccctgcggagcagcagcagcaccacagccagcagcagccccagcaccgtcatccatggagccaacagcgagcctgctgacagcacagagatggatgacaaggctgctgtgggcgtgtccaagcccctgcccagcgtgcccccatccatcggcaagagcaatgtggaccggcggcaggccgagatcggggagggctctgtgagaagacgcatctatgacaacccctactttgagccccagtatggcttccccccagaagaagatgaagatgagcagggcgagagctacaccccccgcttcagccagcacgtgtctggcaacagagcccagaagctgctgcggcccaacagcctgcggctggccagtgacagtgatgctgagagtgacagccgggccagcagccccaacagcacagtgagcaacaccagcacagagggctttggaggcatcatgagctttgccagcagcctgtacagaaaccacagcaccagcttcagcctgagcaacctgaccctgcccaccaagggggcccgggagaaggccacccccttccccagcctgaagggcaacagaagagccctggtggaccagaagagcagcgtcatcaagcacagccccaccgtgaagcgggagccccccagcccccagggccgcagcagcaacagcagcgagaaccagcagttcctgaaggaggtggtgcacagcgtgctggatggccagggcgtgggctggctgaacatgaagaaggtgcggcggctgctggagagcgagcagctgcgggtgtttgtgctgagcaagctgaacaggatggtgcagagtgaagatgatgcccggcaggacatcatcccagatgtggagatcagcaggaaggtgtacaagggcatgctggacctgctgaagtgcaccgtgctgagcctggagcagagctatgcccatgctggcctgggcggcatggccagcatcttcggcctgctggagatcgcccagacccactactacagcaaggagccagacaagaggaagaggagccccacagaatctgtgaacacccctgtgggcaaggaccccggcctggccggccgcggggaccccaaggccatggcccagctgcgggtgccccagctgggcccccgggcccccagcgccaccgggaagggccccaaggagctggacaccaggagcctgaaggaggagaacttcatcgccagcatcggccctgaggtgatcaagcctgtgtttgacctgggggagacagaggagaagaagagccagatctctgctgacagcggcgtgtccctgaccagcagcagccagaggacagaccaggacagcgtcatcggcgtgtccccagctgtgatgatccgcagcagcagccaggacagcgaggtgtccacagtgagcaacagcagcggggagaccctgggcgctgacagcgacctgagcagcaatgctggagatggccctggaggagagggctctgtgcacctggccagcagccggggcaccctgagtgacagcgagattgagaccaacagcgccaccagcaccatctttgggaaggcccacagcctgaagcccagcatcaaggagaagctggccggcagccccatccgcaccagtgaagatgtgtcccagagggtgtacctgtatgagggcctgctgggcaaggagaggagcaccctgtgggaccagatgcagttctgggaggatgccttcctggatgctgtgatgctggagcgggagggcatgggcatggaccagggcccccaggagatgattgaccgctacctgagcctgggggagcatgacaggaagaggctggaggatgatgaagatcggctgctggccaccctgctgcacaacctgatctcctacatgctgctgatgaaggtgaacaagaatgacatcaggaagaaggtgcggcggctgatgggcaagagccacatcggcctggtgtacagccagcagatcaatgaggtgctggaccagctggccaacctgaatggccgggacctgagcatctggagcagcggcagccgccacatgaagaagcagacctttgtggtgcatgctggaacagacaccaacggggacatcttcttcatggaggtgtgtgatgactgtgtggtgctgcggagcaacattggaacagtgtatgagcgctggtggtatgagaagctgatcaacatgacctactgccccaagaccaaggtgctgtgcctgtggaggagaaatggaagtgagacccagctgaacaagttctacaccaagaagtgccgggagctgtactactgtgtgaaggacagcatggagagagctgctgcccggcagcagagcatcaagccaggccctgagctgggcggggagttccctgtgcaggacctgaagacaggagagggcggcctgctgcaggtgaccctggagggcatcaacctgaagttcatgcacaaccaggtgttcatcgagctgaaccacatcaagaagtgcaacacagtgcggggcgtgtttgtgctggaggagtttgtgcctgagatcaaggaggtggtgagccacaagtacaagacccccatggcccacgagatctgctacagcgtgctgtgcctcttctcctatgtggccgctgtgcacagcagcgaggaggacctgcggaccccacccaggcctgtgagcagctag

SEQ ID NO: 158835 - DNA, 4638 bp, Artificial Sequence
  Description of Artificial Sequence: Synthetic coding sequence
atggtgcagaagaagaagttctgcccccggctgctggactacctggtgattgtgggcgcccggcaccccagcagtgacagcgtggcccagaccccagagctgctgcggcgctaccccctggaggaccacacagagttccccctgcccccagatgtggtgttcttctgccagcctgagggctgcctgtctgtgcggcagaggaggatgagcctgagagatgacaccagctttgtgttcaccctgacagacaaggacaccggggtgaccaggtatggcatctgtgtgaacttctaccgctccttccagaagaggatcagcaaggagaagggggagggcggggccggcagccggggcaaggagggcacccacgccacctgtgccagcgaggagggcggcacagagagcagcgagagcggcagcagcctgcagcccctgtctgctgacagcaccccagatgtgaaccagagcccccggggcaagagaagagccaaggccggcagccgcagcaggaacagcaccctgaccagcctgtgtgtgctgagccactaccccttcttcagcaccttcagagaatgtctgtacaccctgaagaggctggtggactgctgcagcgagcggctgctgggcaagaagctgggcatcccccggggcgtgcagagggacaccatgtggaggatcttcaccggcagcctgctggtggaggagaagagcagcgccctgctgcatgacctgcgggagattgaggcctggatctaccgcctgctgcggagccctgtgcctgtgtctggccagaagagggtggacatcgaggtgctgccccaggagctgcagcctgccctgacctttgccctgcctgaccccagccgcttcaccctggtggacttccccctgcacctgcccctggagctgctgggcgtggatgcctgcctgcaggtgctgacctgcatcctgctggagcacaaggtggtgctgcagagccgggactacaatgccctgtccatgtctgtgatggcctttgtggccatgatctaccccctggagtacatgtttcctgtgatccccctgctgcccacctgcatggccagcgctgagcagctgctgctggcccccaccccctacatcattggagtgcctgccagcttcttcctgtacaagctggacttcaagatgccagatgatgtgtggctggtggacctggacagcaacagagtgattgcccccaccaatgctgaggtgctgcccatcctgcctgagcctgagagcctggagctgaagaagcacctgaagcaggccctggcctccatgagcctgaacacccagcccatcctgaacctggagaagttccacgagggccaggagatccccctgctgctgggccggcccagcaatgacctgcagagcacccccagcacagagttcaaccccctcatctatggaaatgatgtggacagcgtggatgtggccaccagggtggccatggtgcgcttcttcaacagcgccaacgtgctgcagggcttccagatgcacaccaggaccctgcggctcttccccaggcctgtggtggccttccaggccggcagcttcctggccagccggccccggcagaccccatttgctgagaagctggcccggacccaggccgtggagtactttggagagtggatcctgaaccccaccaactatgccttccagaggatccacaacaacatgtttgatcctgccctgattggagacaagcccaagtggtacgcccaccagctgcagcccatccactacagagtgtatgacagcaacagccagctggccgaggccctgtctgtgcccccagagcgggacagcgacagcgagcccacagatgattctggcagtgacagcatggactatgatgacagcagcagcagctacagcagcctgggggactttgtgtctgagatgatgaagtgtgacatcaatggagacacccccaacgtggaccccctgacccatgctgccctgggagatgccagcgaggtggagattgatgagctgcagaaccagaaggaggccgaggagcccggcccagattctgagaacagccaggagaacccccccctgcggagcagcagcagcaccacagccagcagcagccccagcaccgtcatccatggagccaacagcgagcctgctgacagcacagagatggatgacaaggctgctgtgggcgtgtccaagcccctgcccagcgtgcccccatccatcggcaagagcaatgtggaccggcggcaggccgagatcggggagggcgcccagaagctgctgcggcccaacagcctgcggctggccagtgacagtgatgctgagagtgacagccgggccagcagccccaacagcacagtgagcaacaccagcacagagggctttggaggcatcatgagctttgccagcagcctgtacagaaaccacagcaccagcttcagcctgagcaacctgaccctgcccaccaagggggcccgggagaaggccacccccttccccagcctgaagggcaacagaagagccctggtggaccagaagagcagcgtcatcaagcacagccccaccgtgaagcgggagccccccagcccccagggccgcagcagcaacagcagcgagaaccagcagttcctgaaggaggtggtgcacagcgtgctggatggccagggcgtgggctggctgaacatgaagaaggtgcggcggctgctggagagcgagcagctgcgggtgtttgtgctgagcaagctgaacaggatggtgcagagtgaagatgatgcccggcaggacatcatcccagatgtggagatcagcaggaaggtgtacaagggcatgctggacctgctgaagtgcaccgtgctgagcctggagcagagctatgcccacgccggcctgggcggcatggccagcatcttcggcctgctggagatcgcccagacccactactacagcaaggagccagacaagaggaagaggagccccacagagagcgtgaacacccctgtgggcaaggaccccggcctggccggccgcggggaccccaaggccatggcccagctgcgggtgccccagctgggcccccgggcccccagcgccaccgggaagggccccaaggagctggacaccaggagcctgaaggaggagaacttcatcgccagcatcggccctgaggtgatcaagcctgtgtttgacctgggggagacagaggagaagaagagccagatctctgctgacagcggcgtgtccctgaccagcagcagccagaggacagaccaggacagcgtgattggagtgtccccagctgtgatgatccgcagcagcagccaggacagcgaggtgtccacagtggtgagcaacagcagcggggagaccctgggcgctgacagcgacctgagcagcaatgctggagatggccctggaggagagggctctgtgcacctggccagcagccggggcaccctgagtgacagcgagattgagaccaacagcgccaccagcaccatctttgggaaggcccacagcctgaagcccagcatcaaggagaagctggccggcagccccatccgcaccagtgaagatgtgtcccagagggtgtacctgtatgagggcctgctgggcaaggagaggagcaccctgtgggaccagatgcagttctgggaggatgccttcctggatgctgtgatgctggagcgggagggcatgggcatggaccagggcccccaggagatgattgaccgctacctgagcctgggggagcatgacaggaagaggctggaggatgatgaagatcggctgctggccaccctgctgcacaacctgatctcctacatgctgctgatgaaggtgaacaagaatgacatcaggaagaaggtgcggcggctgatgggcaagagccacatcggcctggtgtacagccagcagatcaatgaggtgctggaccagctggccaacctgaatggccgggacctgagcatctggagcagcggcagccgccacatgaagaagcagacctttgtggtgcatgctggaacagacaccaacggggacatcttcttcatggaggtgtgtgatgactgtgtggtgctgcggagcaacattggaacagtgtatgagcgctggtggtatgagaagctgatcaacatgacctactgccccaagaccaaggtgctgtgcctgtggaggagaaatggaagtgagacccagctgaacaagttctacaccaagaagtgccgggagctgtactactgtgtgaaggacagcatggagagagctgctgcccggcagcagagcatcaagccaggccctgagctgggcggggagttccctgtgcaggacctgaagacaggagagggcggcctgctgcaggtgaccctggagggcatcaacctgaagttcatgcacaaccaggtgttcatcgagctgaaccacatcaagaagtgcaacacagtgcggggcgtgtttgtgctggaggagtttgtgcctgagatcaaggaggtggtgagccacaagtacaagacccccatggcccacgagatctgctacagcgtgctgtgcctcttctcctatgtggccgctgtgcacagcagcgaggaggacctgcggaccccacccaggcctgtgagcagctag

SEQ ID NO: 158836 - DNA, 4440 bp, Artificial Sequence
  Description of Artificial Sequence: Synthetic coding sequence
atggtgcagaagaagaagttctgcccccggctgctggactacctggtgattgtgggcgcccggcaccccagcagtgacagcgtggcccagaccccagagctgctgcggcgctaccccctggaggaccacacagagttccccctgcccccagatgtggtgttcttctgccagcctgagggctgcctgtctgtgcggcagaggaggatgagcctgagagatgacaccagctttgtgttcaccctgacagacaaggacaccggggtgaccaggtatggcatctgtgtgaacttctaccgctccttccagaagaggatcagcaaggagaagggggagggcggggccggcagccggggcaaggagggcacccacgccacctgtgccagcgaggagggcggcacagagagcagcgagagcggcagcagcctgcagcccctgtctgctgacagcaccccagatgtgaaccagagcccccggggcaagagaagagccaaggccggcagccgcagcaggaacagcaccctgaccagcctgtgtgtgctgagccactaccccttcttcagcaccttcagagaatgtctgtacaccctgaagaggctggtggactgctgcagcgagcggctgctgggcaagaagctgggcatcccccggggcgtgcagagggacaccatgtggaggatcttcaccggcagcctgctggtggaggagaagagcagcgccctgctgcatgacctgcgggagattgaggcctggatctaccgcctgctgcggagccctgtgcctgtgtctggccagaagagggtggacatcgaggtgctgccccaggagctgcagcctgccctgacctttgccctgcctgaccccagccgcttcaccctggtggacttccccctgcacctgcccctggagctgctgggcgtggatgcctgcctgcaggtgctgacctgcatcctgctggagcacaaggtggtgctgcagagccgggactacaatgccctgtccatgtctgtgatggcctttgtggccatgatctaccccctggagtacatgtttcctgtgatccccctgctgcccacctgcatggccagcgctgagcagctgctgctggcccccaccccctacatcattggagtgcctgccagcttcttcctgtacaagctggacttcaagatgccagatgatgtgtggctggtggacctggacagcaacagagtgattgcccccaccaatgctgaggtgctgcccatcctgcctgagcctgagagcctggagctgaagaagcacctgaagcaggccctggcctccatgagcctgaacacccagcccatcctgaacctggagaagttccacgagggccaggagatccccctgctgctgggccggcccagcaatgacctgcagagcacccccagcacagagttcaaccccctcatctatggaaatgatgtggacagcgtggatgtggccaccagggtggccatggtgcgcttcttcaacagcgccaacgtgctgcagggcttccagatgcacaccaggaccctgcggctcttccccaggcctgtggtggccttccaggccggcagcttcctggccagccggccccggcagaccccatttgctgagaagctggcccggacccaggccgtggagtactttggagagtggatcctgaaccccaccaactatgccttccagaggatccacaacaacatgtttgatcctgccctgattggagacaagcccaagtggtacgcccaccagctgcagcccatccactacagagtgtatgacagcaacagccagctggccgaggccctgtctgtgcccccagagcgggacagcgacagcgagcccacagatgattctggcagtgacagcatggactatgatgacagcagcagcagctacagcagcctgggggactttgtgtctgagatgatgaagtgtgacatcaatggagacacccccaacgtggaccccctgacccatgctgccctgggagatgccagcgaggtggagattgatgagctgcagaaccagaaggaggccgaggagcccggcccagattctgagaacagccaggagaacccccccctgcggagcagcagcagcaccacagccagcagcagccccagcaccgtcatccatggagccaacagcgagcctgctgacagcacagagatggatgacaaggctgctgtgggcgtgtccaagcccctgcccagcgtgcccccatccatcggcaagagcaatgtggaccggcggcaggccgagatcggggagggcgcccagaagctgctgcggcccaacagcctgcggctggccagtgacagtgatgctgagagtgacagccgggccagcagccccaacagcacagtgagcaacaccagcacagagggctttggaggcatcatgagctttgccagcagcctgtacagaaaccacagcaccagcttcagcctgagcaacctgaccctgcccaccaagggggcccgggagaaggccacccccttccccagcctgaagggcaacagaagagccctggtggaccagaagagcagcgtcatcaagcacagccccaccgtgaagcgggagccccccagcccccagggccgcagcagcaacagcagcgagaaccagcagttcctgaaggaggtggtgcacagcgtgctggatggccagggcgtgggctggctgaacatgaagaaggtgcggcggctgctggagagcgagcagctgcgggtgtttgtgctgagcaagctgaacaggatggtgcagagtgaagatgatgcccggcaggacatcatcccagatgtggagatcagcaggaaggtgtacaagggcatgctggacctgctgaagtgcaccgtgctgagcctggagcagagctatgcccacgccggcctgggcggcatggccagcatcttcggcctgctggagatcgcccagacccactactacagcaaggagccagacaagaggaagaggagccccacagagagcgtgaacacccctgtgggcaaggaccccggcctggccggccgcggggaccccaaggccatggcccagctgcgggtgccccagctgggcccccgggcccccagcgccaccgggaagggccccaaggagctggacaccaggagcctgaaggaggagaacttcatcgccagcatcggccctgaggtgatcaagcctgtgtttgacctgggggagacagaggagaagaagagccagatctctgctgacagcggcgtgtccctgaccagcagcagccagaggacagaccaggacagcgtgattggagtgtccccagctgtgatgatccgcagcagcagccaggacagcgaggtgtccacagtggtgagcaacagcagcggggagaccctgggcgctgacagcgacctgagcagcaatgctggagatggccctggaggagagggctctgtgcacctggccagcagccggggcaccctgagtgacagcgagattgagaccaacagcgccaccagcaccatctttgggaaggcccacagcctgaagcccagcatcaaggagaagctggccggcagccccatccgcaccagtgaagatgtgtcccagagggtgtacctgtatgagggcctgctgggcaaggagaggagcaccctgtgggaccagatgcagttctgggaggatgccttcctggatgctgtgatgctggagcgggagggcatgggcatggaccagggcccccaggagatgattgaccgctacctgagcctgggggagcatgacaggaagaggctggaggatgatgaagatcggctgctggccaccctgctgcacaacctgatctcctacatgctgctgatgaaggtgaacaagaatgacatcaggaagaaggtgcggcggctgatgggcaagagccacatcggcctggtgtacagccagcagatcaatgaggtgctggaccagctggccaacctgaatggccgggacctgagcatctggagcagcggcagccgccacatgaagaagcagacctttgtggtgcatgctggaacagacaccaacggggacatcttcttcatggaggtgtgtgatgactgtgtggtgctgcggagcaacattggaacagtgtatgagcgctggtggtatgagaagctgatcaacatgacctactgccccaagaccaaggtgctgtgcctgtggaggagaaatggaagtgagacccagctgaacaagttctacaccaagaagtgccgggagctgtactactgtgtgaaggacagcatggagagagctgctgcccggcagcagagcatcaagccaggccctgagctgggcggggagttccctgtgcaggacctgaagacaggagagggcggcctgctgcaggtgaccctggagggcatcaacctgaagttcatgcacaaccagttcctgaagctgaagaagtggtag

SEQ ID NO: 158837 - DNA, 4698 bp, Artificial Sequence
  Description of Artificial Sequence: Synthetic coding sequence
atggtgcagaagaagaagttctgcccccggctgctggactacctggtgattgtgggcgcccggcaccccagcagtgacagcgtggcccagaccccagagctgctgcggcgctaccccctggaggaccacacagagttccccctgcccccagatgtggtgttcttctgccagcctgagggctgcctgtctgtgcggcagaggaggatgagcctgagagatgacaccagctttgtgttcaccctgacagacaaggacaccggggtgaccaggtatggcatctgtgtgaacttctaccgctccttccagaagaggatcagcaaggagaagggggagggcggggccggcagccggggcaaggagggcacccacgccacctgtgccagcgaggagggcggcacagagagcagcgagagcggcagcagcctgcagcccctgtctgctgacagcaccccagatgtgaaccagagcccccggggcaagagaagagccaaggccggcagccgcagcaggaacagcaccctgaccagcctgtgtgtgctgagccactaccccttcttcagcaccttcagagaatgtctgtacaccctgaagaggctggtggactgctgcagcgagcggctgctgggcaagaagctgggcatcccccggggcgtgcagagggacaccatgtggaggatcttcaccggcagcctgctggtggaggagaagagcagcgccctgctgcatgacctgcgggagattgaggcctggatctaccgcctgctgcggagccctgtgcctgtgtctggccagaagagggtggacatcgaggtgctgccccaggagctgcagcctgccctgacctttgccctgcctgaccccagccgcttcaccctggtggacttccccctgcacctgcccctggagctgctgggcgtggatgcctgcctgcaggtgctgacctgcatcctgctggagcacaaggtggtgctgcagagccgggactacaatgccctgtccatgtctgtgatggcctttgtggccatgatctaccccctggagtacatgtttcctgtgatccccctgctgcccacctgcatggccagcgctgagcagctgctgctggcccccaccccctacatcattggagtgcctgccagcttcttcctgtacaagctggacttcaagatgccagatgatgtgtggctggtggacctggacagcaacagagtgattgcccccaccaatgctgaggtgctgcccatcctgcctgagcctgagagcctggagctgaagaagcacctgaagcaggccctggcctccatgagcctgaacacccagcccatcctgaacctggagaagttccacgagggccaggagatccccctgctgctgggccggcccagcaatgacctgcagagcacccccagcacagagttcaaccccctcatctatggaaatgatgtggacagcgtggatgtggccaccagggtggccatggtgcgcttcttcaacagcgccaacgtgctgcagggcttccagatgcacaccaggaccctgcggctcttccccaggcctgtggtggccttccaggccggcagcttcctggccagccggccccggcagaccccatttgctgagaagctggcccggacccaggccgtggagtactttggagagtggatcctgaaccccaccaactatgccttccagaggatccacaacaacatgtttgatcctgccctgattggagacaagcccaagtggtacgcccaccagctgcagcccatccactacagagtgtatgacagcaacagccagctggccgaggccctgtctgtgcccccagagcgggacagcgacagcgagcccacagatgattctggcagtgacagcatggactatgatgacagcagcagcagctacagcagcctgggggactttgtgtctgagatgatgaagtgtgacatcaatggagacacccccaacgtggaccccctgacccatgctgccctgggagatgccagcgaggtggagattgatgagctgcagaaccagaaggaggccgaggagcccggcccagattctgagaacagccaggagaacccccccctgcggagcagcagcagcaccacagccagcagcagccccagcaccgtcatccatggagccaacagcgagcctgctgacagcacagagatggatgacaaggctgctgtgggcgtgtccaagcccctgcccagcgtgcccccatccatcggcaagagcaatgtggaccggcggcaggccgagatcggggagggcgcccagaagctgctgcggcccaacagcctgcggctggccagtgacagtgatgctgagagtgacagccgggccagcagccccaacagcacagtgagcaacaccagcacagagggctttggaggcatcatgagctttgccagcagcctgtacagaaaccacagcaccagcttcagcctgagcaacctgaccctgcccaccaagggggcccgggagaaggccacccccttccccagcctgaaggtgtttggcctgaacaccctgatggagatcgtgacagaagctggccctggcagcggggagggcaacagaagagccctggtggaccagaagagcagcgtcatcaagcacagccccaccgtgaagcgggagccccccagcccccagggccgcagcagcaacagcagcgagaaccagcagttcctgaaggaggtggtgcacagcgtgctggatggccagggcgtgggctggctgaacatgaagaaggtgcggcggctgctggagagcgagcagctgcgggtgtttgtgctgagcaagctgaacaggatggtgcagagtgaagatgatgcccggcaggacatcatcccagatgtggagatcagcaggaaggtgtacaagggcatgctggacctgctgaagtgcaccgtgctgagcctggagcagagctatgcccacgccggcctgggcggcatggccagcatcttcggcctgctggagatcgcccagacccactactacagcaaggagccagacaagaggaagaggagccccacagagagcgtgaacacccctgtgggcaaggaccccggcctggccggccgcggggaccccaaggccatggcccagctgcgggtgccccagctgggcccccgggcccccagcgccaccgggaagggccccaaggagctggacaccaggagcctgaaggaggagaacttcatcgccagcatcggccctgaggtgatcaagcctgtgtttgacctgggggagacagaggagaagaagagccagatctctgctgacagcggcgtgtccctgaccagcagcagccagaggacagaccaggacagcgtgattggagtgtccccagctgtgatgatccgcagcagcagccaggacagcgaggtgtccacagtggtgagcaacagcagcggggagaccctgggcgctgacagcgacctgagcagcaatgctggagatggccctggaggagagggctctgtgcacctggccagcagccggggcaccctgagtgacagcgagattgagaccaacagcgccaccagcaccatctttgggaaggcccacagcctgaagcccagcatcaaggagaagctggccggcagccccatccgcaccagtgaagatgtgtcccagagggtgtacctgtatgagggcctgctgggcaaggagaggagcaccctgtgggaccagatgcagttctgggaggatgccttcctggatgctgtgatgctggagcgggagggcatgggcatggaccagggcccccaggagatgattgaccgctacctgagcctgggggagcatgacaggaagaggctggaggatgatgaagatcggctgctggccaccctgctgcacaacctgatctcctacatgctgctgatgaaggtgaacaagaatgacatcaggaagaaggtgcggcggctgatgggcaagagccacatcggcctggtgtacagccagcagatcaatgaggtgctggaccagctggccaacctgaatggccgggacctgagcatctggagcagcggcagccgccacatgaagaagcagacctttgtggtgcatgctggaacagacaccaacggggacatcttcttcatggaggtgtgtgatgactgtgtggtgctgcggagcaacattggaacagtgtatgagcgctggtggtatgagaagctgatcaacatgacctactgccccaagaccaaggtgctgtgcctgtggaggagaaatggaagtgagacccagctgaacaagttctacaccaagaagtgccgggagctgtactactgtgtgaaggacagcatggagagagctgctgcccggcagcagagcatcaagccaggccctgagctgggcggggagttccctgtgcaggacctgaagacaggagagggcggcctgctgcaggtgaccctggagggcatcaacctgaagttcatgcacaaccaggtgttcatcgagctgaaccacatcaagaagtgcaacacagtgcggggcgtgtttgtgctggaggagtttgtgcctgagatcaaggaggtggtgagccacaagtacaagacccccatggcccacgagatctgctacagcgtgctgtgcctcttctcctatgtggccgctgtgcacagcagcgaggaggacctgcggaccccacccaggcctgtgagcagctag

SEQ ID NO: 158838 - DNA, 588 bp, Artificial Sequence
  Description of Artificial Sequence: Synthetic coding sequence
atgggcagccagagcagcaaggcccccagaggagatgtgacagctgaggaggccgccggggccagccctgccaaggccaacggccaggagaatggacatgtgaagagcaatggagacctgagccccaagggggagggggagagcccccctgtgaatggaacagatgaagctgctggggccactggagatgccattgaaccagccccacccagccagggcgctgaggccaagggggaggtgccccccaaggagacccccaagaagaagaagaagttctccttcaagaagcccttcaagctgagcggcctgtccttcaagaggaacaggaaggagggcggcggggacagcagcgccagcagccccacagaggaggagcaggagcagggcgagattggagcctgcagtgatgagggcacagcccaggagggcaaggccgccgccaccccagagagccaggagccccaggccaagggagctgaggccagcgctgccagcgaggaggaggccggcccccaggccacagagcccagcacccccagcggccctgagagcggccccaccccagccagcgctgagcagaatgaatag

SEQ ID NO: 158839 - DNA, 1377 bp, Artificial Sequence
  Description of Artificial Sequence: Synthetic coding sequence
atgagcaatgatggccgcagcaggaacagagaccggcgctatgatgaggtgcccagcgacctgccctaccaggacaccaccatccgcacccaccccaccctgcatgattctgaaagagctgtgtctgctgaccccctgcccccaccacccctgcccctgcagcccccatttggaccagacttctacagcagtgacacagaggagcccgccatcgccccagacctgaagcctgtgagaagatttgtgcctgacagctggaagaacttcttccggggcaagaagaaggaccctgagtgggacaagcctgtgtctgacatccgctacatcagtgatggagtggagtgcagccccccagccagccctgcccggcccaaccacaggagccccctgaacagctgcaaggacccctatggaggcagcgagggcaccttcagcagcaggaaggaggctgatgctgtgttcccccgggacccctacggcagcctggacagacacacccagacagtgaggacctacagcgagaaggtggaggagtacaacctgcgctacagctacatgaagtcctgggccggcctgctgcgcatcctgggcgtggtggagctgctgctgggcgctggggtgtttgcctgtgtgacagcctacatccacaaggacagcgagtggtacaacctgtttggctacagccagccctacggcatgggcggcgtgggcggcctgggctccatgtatggaggctactactacacaggccccaagaccccatttgtgctggtggtggccggcctggcctggatcaccaccatcatcatcctggtgctgggcatgtccatgtactaccgcaccatcctgctggacagcaactggtggcccctgacagaatttggcatcaacgtggccctcttcatcctgtacatggctgctgccatcgtgtatgtgaatgacaccaacagaggaggcctgtgctactaccccctcttcaacacccctgtgaatgctgtgttctgccgggtggagggcggccagattgctgccatgatcttcctgtttgtgaccatgattgtgtacctgatcagcgccctggtgtgcctgaagctgtggaggcatgaggccgcccggcggcaccgggagtacatggagcagcaggagatcaatgagcccagcctgagcagcaagaggaagatgtgtgagatggccaccagcggggaccggcagagggacagcgaggtgaacttcaaggagctgaggacagccaagatgaagccagagctgctgagcggccacatccccccacccaggcctgccaacttctttgtgttcctggtggagatgggcttccaccgggtgtcccaggatgacctggacctgctgaccagctag

SEQ ID NO: 158840 - DNA, 1677 bp, Artificial Sequence
  Description of Artificial Sequence: Synthetic coding sequence
atgagcaatgatggccgcagcaggaacagagaccggcgctatgatgaggtgcccagcgacctgccctaccaggacaccaccatccgcacccaccccaccctgcatgattctgaaagagctgtgtctgctgaccccctgcccccaccacccctgcccctgcagcccccatttggaccagacttctacagcagtgacacagaggagcccgccatcgccccagacctgaagcctgtgagaagatttgtgcctgacagctggaagaacttcttccggggcaagaagaaggaccctgagtgggacaagcctgtgtctgacatccgctacatcagtgatggagtggagtgcagccccccagccagccctgcccggcccaaccacaggagccccctgaacagctgcaaggacccctatggaggcagcgagggcaccttcagcagcaggaaggaggctgatgctgtgttcccccgggacccctacggcagcctggacagacacacccagacagtgaggacctacagcgagaaggtggaggagtacaacctgcgctacagctacatgaagtcctgggccggcctgctgcgcatcctgggcgtggtggagctgctgctgggcgctggggtgtttgcctgtgtgacagcctacatccacaaggacagcgagtggtacaacctgtttggctacagccagccctacggcatgggcggcgtgggcggcctgggctccatgtatggaggctactactacacaggccccaagaccccatttgtgctggtggtggccggcctggcctggatcaccaccatcatcatcctggtgctgggcatgtccatgtactaccgcaccatcctgctggacagcaactggtggcccctgacagaatttggcatcaacgtggccctcttcatcctgtacatggctgctgccatcgtgtatgtgaatgacaccaacagaggaggcctgtgctactaccccctcttcaacacccctgtgaatgctgtgttctgccgggtggagggcggccagattgctgccatgatcttcctgtttgtgaccatgattgtgtacctgatcagcgccctggtgtgcctgaagctgtggaggcatgaggccgcccggcggcaccgggagtacatggagcagcaggagatcaatgagcccagcctgagcagcaagaggaagatgtgtgagatggccaccagcggggaccggcagagggacagcgaggtgaacttcaaggagctgaggacagccaagatgaagccagagctgctgagcggccacatccccccaggccacatccccaagcccatcgtgatgccagactatgtggccaagtaccctgtgatccagacagatgatgagcgggagcgctacaaggctgtgttccaggaccagttcagcgagtacaaggagctgtctgctgaggtgcaggccgtgctgaggaagtttgatgagctggatgctgtgatgagccggctgccccaccacagcgagagccggcaggagcacgagcgcatcagccgcatccacgaggagttcaagaagaagaagaatgaccccaccttcctggagaagaaggagcgctgtgactacctgaagaacaagctgagccacatcaagcagaggatccaggagtatgacaaggtgatgaactgggatgtgcagggctacagctag

SEQ ID NO: 158841 - DNA, 1329 bp, Artificial Sequence
  Description of Artificial Sequence: Synthetic coding sequence
atgagcaatgatggccgcagcaggaacagagaccggcgctatgatgaggtgcccagcgacctgccctaccaggacaccaccatccgcacccaccccaccctgcatgattctgaaagagctgtgtctgctgaccccctgcccccaccacccctgcccctgcagcccccatttggaccagacttctacagcagtgacacagaggagcccgccatcgccccagacctgaagcctgtgagaagatttgtgcctgacagctggaagaacttcttccggggcaagaagaaggaccctgagtgggacaagcctgtgtctgacatccgctacatcagtgatggagtggagtgcagccccccagccagccctgcccggcccaaccacaggagccccctgaacagctgcaaggacccctatggaggcagcgagggcaccttcagcagcaggaaggaggctgatgctgtgttcccccgggacccctacggcagcctggacagacacacccagacagtgaggacctacagcgagaaggtggaggagtacaacctgcgctacagctacatgaagtcctgggccggcctgctgcgcatcctgggcgtggtggagctgctgctgggcgctggggtgtttgcctgtgtgacagcctacatccacaaggacagcgagtggtacaacctgtttggctacagccagccctacggcatgggcggcgtgggcggcctgggcagcatcgccctggtgtgcctgaagctgtggaggcatgaggccgcccggcggcaccgggagtacatggagcagcaggagatcaatgagcccagcctgagcagcaagaggaagatgtgtgagatggccaccagcggggaccggcagagggacagcgaggtgaacttcaaggagctgaggacagccaagatgaagccagagctgctgagcggccacatccccccaggccacatccccaagcccatcgtgatgccagactatgtggccaagtaccctgtgatccagacagatgatgagcgggagcgctacaaggctgtgttccaggaccagttcagcgagtacaaggagctgtctgctgaggtgcaggccgtgctgaggaagtttgatgagctggatgctgtgatgagccggctgccccaccacagcgagagccggcaggagcacgagcgcatcagccgcatccacgaggagttcaagaagaagaagaatgaccccaccttcctggagaagaaggagcgctgtgactacctgaagaacaagctgagccacatcaagcagaggatccaggagtatgacaaggtgatgaactgggatgtgcagggctacagctag

SEQ ID NO: 158842 - DNA, 1641 bp, Artificial Sequence
  Description of Artificial Sequence: Synthetic coding sequence
atgagcaatgatggccgcagcaggaacagagaccggcgctatgatgaggtgcccagcgacctgccctaccaggacaccaccatccgcacccaccccaccctgcatgattctgaaagagctgtgtctgctgaccccctgcccccaccacccctgcccctgcagcccccatttggaccagacttctacagcagtgacacagaggagcccgccatcgccccagacctgaagcctgtgagaagatttgtgcctgacagctggaagaacttcttccggggcaagaagaaggaccctgagtgggacaagcctgtgtctgacatccgctacatcagtgatggagtggagtgcagccccccagccagccctgcccggcccaaccacaggagccccctgaacagctgcaaggacccctatggaggcagcgagggcaccttcagcagcaggaaggaggctgatgctgtgttcccccgggacccctacggcagcctggacagacacacccagacagtgaggacctacagcgagaaggtggaggagtacaacctgcgctacagctacatgaagtcctgggccggcctgctgcgcatcctgggcgtggtggagctgctgctgggcgctggggtgtttgcctgtgtgacagcctacatccacaaggacagcgagtggtacaacctgtttggctacagccagccctacggcatgggcggcgtgggcggcctgggctccatgtatggaggctactactacacaggccccaagaccccatttgtgctggtggtggccggcctggcctggatcaccaccatcatcatcctggtgctgggcatgtccatgtactaccgcaccatcctgctggacagcaactggtggcccctgacagaatttggcatcaacgtggccctcttcatcctgtacatggctgctgccatcgtgtatgtgaatgacaccaacagaggaggcctgtgctactaccccctcttcaacacccctgtgaatgctgtgttctgccgggtggagggcggccagattgctgccatgatcttcctgtttgtgaccatgattgtgtacctgatcagcgccctggtgtgcctgaagctgtggaggcatgaggccgcccggcggcaccgggagtacatggagcagcaggagtgtgagatggccaccagcggggaccggcagagggacagcgaggtgaacttcaaggagctgaggacagccaagatgaagccagagctgctgagcggccacatccccccaggccacatccccaagcccatcgtgatgccagactatgtggccaagtaccctgtgatccagacagatgatgagcgggagcgctacaaggctgtgttccaggaccagttcagcgagtacaaggagctgtctgctgaggtgcaggccgtgctgaggaagtttgatgagctggatgctgtgatgagccggctgccccaccacagcgagagccggcaggagcacgagcgcatcagccgcatccacgaggagttcaagaagaagaagaatgaccccaccttcctggagaagaaggagcgctgtgactacctgaagaacaagctgagccacatcaagcagaggatccaggagtatgacaaggtgatgaactgggatgtgcagggctacagctag

SEQ ID NO: 158843 - DNA, 1551 bp, Artificial Sequence
  Description of Artificial Sequence: Synthetic coding sequence
atgagcaatgatggccgcagcaggaacagagaccggcgctatgatgaggtgcccagcgacctgccctaccaggacaccaccatccgcacccaccccaccctgcatgattctgaaagagctgtgtctgctgaccccctgcccccaccacccctgcccctgcagcccccatttggaccagacttctacagcagtgacacagaggagcccgccatcgccccagacctgaagcctgtgagaagatttgtgcctgacagctggaagaacttcttccggggcaagaagaaggaccctgagtgggacaagcctgtgtctgacatccgctacatcagtgatggagtggagtgcagccccccagccagccctgcccggcccaaccacaggagccccctgaacagctgcaaggacccctatggaggcagcgagggcaccttcagcagcaggaaggaggctgatgctgtgttcccccgggacccctacggcagcctggacagacacacccagacagtgaggacctacagcgagaaggtggaggagtacaacctgcgctacagctacatgaagtcctgggccggcctgctgcgcatcctgggcgtggtggagctgctgctgggcgctggggtgtttgcctgtgtgacagcctacatccacaaggacagcgagtggtacaacctgtttggctacagccagccctacggcatgggcggcgtgggcggcctgggctccatgtatggaggctactactacacaggccccaagaccccatttgtgctggtggtggccggcctggcctggatcaccaccatcatcatcctggtgctgggcatgtccatgtactaccgcaccatcctgctggacagcaactggtggcccctgacagaatttggcatcaacgtggccctcttcatcctgtacatggctgctgccatcgtgtatgtgaatgacaccaacagaggaggcctgtgctactaccccctcttcaacacccctgtgaatgctgtgttctgccgggtggagggcggccagattgctgccatgatcttcctgtttgtgaccatgattgtgtacctgatcagcgccctggtgtgcctgaagctgtggaggcatgaggccgcccggcggcaccgggagtacatggagcagcaggagatcaatgagcccagcctgagcagcaagaggaagatgtgtgagatggccaccagcggggaccggcagagggacagcgaggtgaacttcaaggagctgaggacagccaagatgaagccagagctgctgagcggccacatccccccaggccacatccccaagcccatcgtgatgccagactatgtggccaagtaccctgtgatccagacagatgatgagcgggagcgctacaaggctgtgttccaggaccagttcagcgagtacaaggagctgtctgctgaggtgcaggccgtgctgaggaagtttgatgagctggatgctgtgatgagccggctgccccaccacagcgagagccggcaggagcacgagcgcatcagccgcatccacgaggagttcaagaagaagtag

SEQ ID NO: 158844 - DNA, 438 bp, Artificial Sequence
  Description of Artificial Sequence: Synthetic coding sequence
atgagcaatgatggccgcagcaggaacagagaccggcgctatgatgaggtgcccagcgacctgccctaccaggacaccaccatccgcacccaccccaccctgcatgattctgaaagagctgtgtctgctgaccccctgcccccaccacccctgcccctgcagcccccatttggaccagacttctacagcagtgacacagaggagcccgccatcgccccagacctgaagcctgtgagaagatttgtgcctgacagctggaagaacttcttccggggcaagaagaaggaccctgagtgggacaagcctgtgtctgacatccgctacatcagtgatggagtggagtgcagccccccagccagccctgcccggcccaaccacaggagccccctgaacagctgcaaggacccctatggaggcagcgagggcaccttctcctag

SEQ ID NO: 158845 - DNA, 1206 bp, Artificial Sequence
  Description of Artificial Sequence: Synthetic coding sequence
atggaggaccccagcggggcccgggagccccgggcccggccccgggagcgggaccctggaagaagaccccacccagaccagggccgcacccatgaccggccccgggacaggcctggggaccccaggaggaagaggagcagtgatggcaacagaagaagagatggagaccgggaccctgagcgggaccaggagagagatggcaacagagacaggaacagagaccgggagcgggagcgggagcgggagcgggaccctgaccggggcccccggcgggacacccacagagatgctggccccagggctggggagcacggcgtgtgggagaagccccggcagagcaggaccagagatggagcccggggcctgacctgggatgctgctgcccctcctggccctgccccctgggaggcccctgagcccccccagccccagaggaagggggaccctggaagaagaagacctgagagcgagccccccagcgagcgctacctgcccagcaccccccggcccggccgggaggaggtggagtactaccagagcgaggccgagggcctgctggagtgccacaagtgcaagtacctgtgcaccggccgggcctgctgccagatgctggaggtgctgctgaacctgctgatcctggcctgcagctctgtgtcctacagcagcactggaggctacacaggcatcaccagcctgggcggcatctactactaccagtttggaggagcctacagcggctttgatggagcagatggagagaaggcccagcagctggatgtgcagttctaccagctgaagctgcccatggtgacagtggccatggcctgcagcggggccctgacagccctgtgctgcctgtttgtggccatgggcgtgctgcgggtgccctggcactgccccctgctgctggtgacagagggcctgctggacatgctgattgctgggggctacatcccagccctgtacttctacttccactacctgtctgctgcctacggcagccctgtgtgcaaggagcggcaggccctgtaccagagcaagggctacagcggcttcggctgcagcttccatggagctgacattggagctggcatctttgctgccctgggcatcgtggtgtttgccctgggcgctgtgctggccatcaagggctacaggaaggtgaggaagctgaaggagaagccagctgagatgtttgagttctag

SEQ ID NO: 158846 - DNA, 1233 bp, Artificial Sequence
  Description of Artificial Sequence: Synthetic coding sequence
atggaggaccccagcggggcccgggagccccgggcccggccccgggagcgggaccctggaagaagaccccacccagaccagggccgcacccatgaccggccccgggacaggcctggggaccccaggaggaagaggagcagtgatggcaacagaagaagagatggagaccgggaccctgagcgggaccaggagagagatggcaacagagacaggaacagagaccgggagcgggagcgggagcgggagcgggaccctgaccggggcccccggcgggacacccacagagatgctggccccagggctggggagcacggcgtgtgggagaagccccggcagagcaggaccagagatggagcccggggcctgacctgggatgctgctgcccctcctggccctgccccctgggaggcccctgagcccccccagccccagaggaagggggaccctggaagaagaagacctgagagcgagccccccagcgagcgctacctgcccagcaccccccggcccggccgggaggaggtggagtactaccagagcgaggccgagggcctgctggagtgccacaagtgcaagtacctgtgcaccggccggggcgtggtgcagatcgtggaggtggtgctgaatggcatggtgctgatctgcatcgtggccagctactttgtgctggccggcttcagcgccagcttcagcagcggcggcggcttcggcaacaactactacagcccctttgagggcacagagctggagcaggtgcggcagctggaccagcagtacaccatcctgcggagccccctcatctacggcggcgtggccgtgtccctgggcctgggcgtgctgaccatgggcgtgctgctgcagggcgccaagagcaggaccatgctgagcggcaagtggctgctgacagaggccgccttcagcctgctggccgctgtgggctactgcaccggcatcggcgtgtacctgcacgtggccctgcagatcaacagcacagacacctgcaagacccgggagcggctgtatgccaggaagggcctgacctggatggactgccagctggccggcacagatggagctgctgccacctttgcctgcctgctggtgatcatgtatggagcctctgtggtgctggccctgcggagctaccgggagcagaagcgctacaagggcagccgggagcagcccggcagctacagtgatgcccctgagtacctgtggagcggcaccctgtag

SEQ ID NO: 158847 - DNA, 978 bp, Artificial Sequence
  Description of Artificial Sequence: Synthetic coding sequence
atggatggcagcaatgtgaccagctttgtggtggaggagcccaccaacatcagcactggaagaaatgcctctgtgggcaatgcccaccggcagatccccatcgtgcactgggtgatcatgagcatcagccctgtgggctttgtggagaatggcatcctgctgtggttcctgtgcttcaggatgagaagaaaccccttcaccgtgtacatcacccacctgagcattgctgacatcagcctgctcttctgcatcttcatcctgagcattgattatgccctggactatgagctgagcagcggccactactacaccatcgtgaccctgtctgtgaccttcctgtttggctacaacacaggcctgtacctgctgacagccatctctgtggagcgctgcctgtctgtgctgtaccccatctggtaccgctgccaccggcccaagtaccagagcgccctggtgtgtgccctgctgtgggccctgagctgcctggtgaccaccatggagtatgtgatgtgcatcgaccgggaggaggagagccacagcagaaatgactgccgggccgtcatcatcttcatcgccatcctgtccttcctggtgttcacccccctgatgctggtgagcagcaccatcctggtggtgaagatcaggaagaacacctgggccagccacagcagcaagctgtacatcgtcatcatggtgaccatcatcatcttcctgatctttgccatgcccatgaggctgctgtacctgctgtactatgagtactggagcaccttcggcaacctgcaccacatcagcctgctcttcagcaccatcaacagcagcgccaaccccttcatctacttctttgtgggcagcagcaagaagaagcgcttcaaggagagcctgaaggtggtgctgacccgggccttcaaggatgagatgcagccccggcggcagaaggacaactgcaacacagtgacagtggagaccgtggtgtag

SEQ ID NO: 158848 - DNA, 1137 bp, Artificial Sequence
  Description of Artificial Sequence: Synthetic coding sequence
atggtgtggggcaagatctgctggttcagccagagagctggctggacagtgtttgctgagagccagatcagcctgagctgcagcctgtgcctgcacagcggggaccaggaggcccagaaccccaacctggtgtcccagctgtgtggggtcttcctgcagaatgagaccaatgagaccatccacatgcagatgtccatggctgtgggccagcaggccctgcccctgaacatcatcgcccccaaggctgtgctggtgtccctgtgtggggtgctgctgaatggaacagtgttctggctgctgtgctgcggggccaccaacccctacatggtgtacatcctgcacctggtggccgcagatgtgatctacctgtgctgcagcgctgtgggcttcctgcaggtgaccctgctgacctaccatggagtggtgttcttcatcccagacttcctggccatcctgagccccttctcctttgaggtgtgcctgtgcctgctggtggccatcagcacagagcgctgtgtgtgtgtgctcttccccatctggtaccgctgccaccggcccaagtacaccagcaatgtggtgtgcaccctcatctggggcctgcccttctgcatcaacatcgtgaagagcctcttcctgacctactggaagcacgtgaaggcctgtgtgatcttcctgaagctgagcggcctcttccacgccatcctgagcctggtgatgtgtgtgagcagcctgaccctgctgatccgcttcctgtgctgcagccagcagcagaaggccaccagggtgtatgctgtggtgcagatcagcgcccccatgttcctgctgtgggccctgcccctgtctgtggcccccctcatcacagacttcaagatgtttgtgaccaccagctacctgatcagcctcttcctgatcatcaacagcagcgccaaccccatcatctacttctttgtgggcagcctgaggaagaagaggctgaaggagagcctgcgggtcatcctgcagagggccctggccgacaagccagaggtgggcaggaacaagaaggccgccggcatcgaccccatggagcagccccacagcacccagcacgtggagaacctgctgccccgggagcaccgggtggatgtggagacctag

SEQ ID NO: 158849 - DNA, 1137 bp, Artificial Sequence; identical to SEQ ID NO: 158848
  Description of Artificial Sequence: Synthetic coding sequence

SEQ ID NO: 158850 - DNA, 1137 bp, Artificial Sequence; identical to SEQ ID NO: 158848
  Description of Artificial Sequence: Synthetic coding sequence

SEQ ID NO: 158851 - DNA, 1137 bp, Artificial Sequence; identical to SEQ ID NO: 158848
  Description of Artificial Sequence: Synthetic coding sequence

SEQ ID NO: 158852 - DNA, 1137 bp, Artificial Sequence; identical to SEQ ID NO: 158848
  Description of Artificial Sequence: Synthetic coding sequence

SEQ ID NO: 158853 - DNA, 1137 bp, Artificial Sequence; identical to SEQ ID NO: 158848
  Description of Artificial Sequence: Synthetic coding sequence

SEQ ID NO: 158854 - DNA, 1137 bp, Artificial Sequence; identical to SEQ ID NO: 158848
  Description of Artificial Sequence: Synthetic coding sequence

SEQ ID NO: 158855 - DNA, 1137 bp, Artificial Sequence; identical to SEQ ID NO: 158848
  Description of Artificial Sequence: Synthetic coding sequence

SEQ ID NO: 158856 - DNA, 966 bp, Artificial Sequence
  Description of Artificial Sequence: Synthetic coding sequence
atgaaccagaccctgaacagcagcggcaccgtggagagcgccctgaactacagccggggcagcacagtgcacacagcctacctggtgctgagcagcctggccatgttcacctgcctgtgtggcatggccggcaacagcatggtgatctggctgctgggcttcaggatgcacaggaaccccttctgcatctacatcctgaacctggccgctgctgacctgctcttcctgttctccatggccagcaccctgagcctggagacccagcccctggtgaacaccacagacaaggtgcatgagctgatgaagaggctgatgtactttgcctacacagtgggcctgagcctgctgacagccatcagcacccagcgctgcctgtctgtgctcttccccatctggttcaagtgccaccggcccaggcacctgagcgcctgggtgtgtggcctgctgtggaccctgtgcctgctgatgaatggcctgaccagcagcttctgcagcaagttcctgaagttcaatgaagatcgctgcttccgggtggacatggtgcaggccgccctgatcatgggcgtgctgacccctgtgatgaccctgagcagcctgaccctgtttgtgtgggtgcggcgcagcagccagcagtggaggcggcagcccacccggctgtttgtggtggtgctggcctctgtgctggtgttcctgatctgcagcctgcccctgagcatctactggtttgtgctgtactggctgagcctgcccccagagatgcaggtgctgtgcttcagcctgagccggctgagcagctctgtgagcagcagcgccaaccctgtgatctacttcctggtgggcagccgccgcagccaccggctgcccaccaggagcctgggcaccgtgctgcagcaggccctgcgggaggagcctgagctggagggcggggagacccccaccgtgggcaccaatgagatgggcgcctag

SEQ ID NO: 158857 - DNA, 936 bp, Artificial Sequence
  Description of Artificial Sequence: Synthetic coding sequence
atggagccccgggaggccggccagcacgtgggcgccgccaacggggcccaggaggatgtggccttcaacctgatcatcctgagcctgacagagggcctgggcctgggcggcctgctgggcaatggagctgtgctgtggctgctgagcagcaatgtgtacagaaacccctttgccatctacctgctggatgtggcctgtgccgacctgatcttcctgggctgccacatggtggccatcgtgcctgacctgctgcagggccgcctggacttccctggctttgtgcagaccagcctggccaccctgcgcttcttctgctacatcgtgggcctgagcctgctggccgctgtgtctgtggagcagtgcctggccgccctcttccctgcctggtacagctgcagaagacccaggcacctgaccacctgtgtgtgtgccctgacctgggccctgtgcctgctgctgcacctgctgctgagcggggcctgcacccagttctttggagagcccagccgccacctgtgcaggaccctgtggctggtggccgctgtgctgctggccctgctgtgctgcaccatgtgtggggccagcctgatgctgctgctgcgggtggagcggggcccccagaggcccccaccccggggcttccctggcctcatcctgctgactgtgctgctcttcctgttctgtggcctgcccttcggcatctactggctgagcaggaacctgctgtggtacatcccccactacttctaccacttctccttcctgatggctgctgtgcactgtgccgccaagcctgtggtgtacttctgcctgggcagcgcccagggccgccgcctgcccctgcggctggtgctgcagagggccctgggagatgaagctgagctgggcgctgtgcgggagaccagcagaagaggcctggtggacattgctgcctag

SEQ ID NO: 158858 - DNA, 939 bp, Artificial Sequence
  Description of Artificial Sequence: Synthetic coding sequence
atgatggagccccgggaggccggccagcacgtgggcgccgccaatggagcccaggaggatgtggccttcaacctgatcatcctgagcctgacagagggcctgggcctgggcggcctgctgggcaatggagctgtgctgtggctgctgagcagcaatgtgtacagaaacccctttgccatctacctgctggatgtggcctgtgccgacctgatcttcctgggctgccacatggtggccatcgtgcctgacctgctgcagggccgcctggacttccctggctttgtgcagaccagcctggccaccctgcgcttcttctgctacatcgtgggcctgagcctgctggccgctgtgtctgtggagcagtgcctggccgccctcttccctgcctggtacagctgccggcggcccaggcacctgaccacctgtgtgtgtgccctgacctgggccctgtgcctgctgctgcacctgctgctgagcggggcctgcacccagttcttcggggagcccagccgccacctgtgcaggaccctgtggctggtggccgctgtgctgctggccctgctgtgctgcaccatgtgtggggccagcctgatgctgctgctgcgggtggagcggggcccccagaggcccccaccccggggcttccctggcctcatcctgctgactgtgctgctcttcctgttctgtggcctgcccttcggcatctactggctgagcaggaacctgctgtggtacatcccccactacttctaccacttctccttcctgatggctgctgtgcactgtgccgccaagcctgtggtgtacttctgcctgggcagcgcccagggccggcggctgcccctgcggctggtgctgcagagggccctgggagatgaggccgagctgggcgctgtgcgggagaccagccggcggggcctggtggacattgctgcctag

SEQ ID NO: 158859 - DNA, 1032 bp, Artificial Sequence
  Description of Artificial Sequence: Synthetic coding sequence
atggccggcaactgctcctgggaggcccaccctggcaacagaaacaagatgtgccccggcctgtctgaggcccctgagctgtacagccggggcttcctgaccatcgagcagatcgccatgctgcccccacctgctgtgatgaactacatcttcctgctgctgtgcctgtgtggcctggtgggcaatggcctggtgctgtggttcttcggcttcagcatcaagaggaaccccttcagcatctacttcctgcacctggccagcgcagatgtgggctacctgttcagcaaggctgtgttcagcatcctgaacacaggaggcttcctgggcacctttgctgactacatccgctctgtgtgccgggtgctgggcctgtgcatgttcctgactggagtgtccctgctgcctgctgtgtctgctgagcgctgtgccagcgtcatcttccctgcctggtactggaggcggcggcccaagaggctgtctgctgtggtgtgtgccctgctgtgggtgctgagcctgctggtgacctgcctgcacaactacttctgtgtgttcctgggccgcggggcccctggggccgcctgccgccacatggacatcttcctgggcatcctgctcttcctgctgtgctgccccctgatggtgctgccctgcctggccctgatcctgcacgtggagtgccgggcccggcggcggcagaggtctgccaagctgaaccacgtgatcctggccatggtgtctgtgttcctggtgagcagcatctacctgggcatcgactggttcctgttctgggtgttccagatcccagcccccttcccagaatatgtgacagacctgtgcatctgcatcaacagcagcgccaagcccatcgtgtacttcctggccggccgggacaagagccagaggctgtgggagcccctgcgggtggtgttccagagggccctgagagatggagctgagctgggggaggccggcggcagcacccccaacacagtgaccatggagatgcagtgccccccaggaaatgccagctag

SEQ ID NO: 158860 - DNA, 948 bp, Artificial Sequence
  Description of Artificial Sequence: Synthetic coding sequence
atggccggcaactgctcctgggaggcccaccctggcaacagaaacaagatgtgccccggcctgtctgaggcccctgagctgtacagccggggcttcctgaccatcgagcagatcgccatgctgcccccacctgctgtgatgaactacatcttcctgctgctgtgcctgtgtggcctggtgggcaatggcctggtgctgtggttcttcggcttcagcatcctgaacacaggaggcttcctgggcacctttgctgactacatccgctctgtgtgccgggtgctgggcctgtgcatgttcctgactggagtgtccctgctgcctgctgtgtctgctgagcgctgtgccagcgtcatcttccctgcctggtactggaggcggcggcccaagaggctgtctgctgtggtgtgtgccctgctgtgggtgctgagcctgctggtgacctgcctgcacaactacttctgtgtgttcctgggccgcggggcccctggggccgcctgccgccacatggacatcttcctgggcatcctgctcttcctgctgtgctgccccctgatggtgctgccctgcctggccctgatcctgcacgtggagtgccgggcccggcggcggcagaggtctgccaagctgaaccacgtgatcctggccatggtgtctgtgttcctggtgagcagcatctacctgggcatcgactggttcctgttctgggtgttccagatcccagcccccttcccagaatatgtgacagacctgtgcatctgcatcaacagcagcgccaagcccatcgtgtacttcctggccggccgggacaagagccagaggctgtgggagcccctgcgggtggtgttccagagggccctgagagatggagctgagctgggggaggccggcggcagcacccccaacacagtgaccatggagatgcagtgccccccaggaaatgccagctag

SEQ ID NO: 158861 - DNA, 1032 bp, Artificial Sequence; identical to SEQ ID NO: 158859
  Description of Artificial Sequence: Synthetic coding sequence

SEQ ID NO: 158862 - DNA, 870 bp, Artificial Sequence
  Description of Artificial Sequence: Synthetic coding sequence
atgtttggcctgtttggcctgtggaggacctttgattctgtggtgttctacctgaccctgattgtgggcctgggcggccctgtgggcaatggcctggtgctgtggaacctgggcttccgcatcaagaagggccccttcagcatctacctgctgcacctggccgctgctgacttcctgttcctgagctgccgggtgggcttctctgtggcccaggccgccctgggcgcccaggacaccctgtactttgtgctgaccttcctgtggtttgctgtgggcctgtggctgctggccgccttctctgtggagcgctgcctgagtgacctcttccctgcctgctaccagggctgccggcccaggcatgccagcgctgtgctgtgtgccctggtgtggacccccaccctgcctgctgtgcccctgcctgccaatgcctgtggcctgctgaggaacagcgcctgccccctggtgtgcccccgctaccacgtggcctctgtgacctggttcctggtgctggcccgggtggcctggacagctggggtggtgctgtttgtgtgggtgacctgctgcagcacccggccccggccccggctgtatggaattgtgctgggcgccctgctgctgctcttcttctgtggcctgcccagcgtcttctactggagcctgcagcccctgctgaacttcctgctgcctgtgttcagccccctggccaccctgctggcctgtgtgaacagcagcagcaagcccctcatctacagcggcctgggccggcagcccgggaagcgggagcccctgcggtctgtgctgcggcgggccctgggggagggcgctgagctgggcgcccggggccagagcctgcccatgggcctgctgtag

SEQ ID NO: 158863 - DNA, 969 bp, Artificial Sequence
  Description of Artificial Sequence: Synthetic coding sequence
atggaccccaccatcagcaccctggacacagagctgacccccatcaatggaacagaggagaccctgtgctacaagcagaccctgagcctgactgtgctgacctgcatcgtgtccctggtgggcctgactggaaatgctgtggtgctgtggctgctgggctgcaggatgagaagaaatgccttcagcatctacatcctgaacctggccgctgctgacttcctgttcctgagcggccgcctcatctacagcctgctgtccttcatcagcatcccccacaccatcagcaagatcctgtaccctgtgatgatgttctcctactttgctggcctgtccttcctgtctgctgtgtccacagagcgctgcctgtctgtgctgtggcccatctggtaccgctgccaccggcccacccacctgtctgctgtggtgtgtgtgctgctgtgggccctgagcctgctgcggagcatcctggagtggatgctgtgtggcttcctgttcagcggggctgacagcgcctggtgccagaccagtgacttcatcaccgtggcctggctgatcttcctgtgtgtggtgctgtgtggcagcagcctggtgctgctgatccgcatcctgtgtggcagcaggaagatccccctgacccggctgtatgtgaccatcctgctgactgtgctggtgttcctgctgtgtggcctgcccttcggcatccagttcttcctgttcctgtggattcatgtggaccgggaggtgctcttctgccacgtgcacctggtgtccatcttcctgagcgccctgaacagcagcgccaaccccatcatctacttctttgtgggcagcttccggcagaggcagaaccggcagaacctgaagctggtgctgcagagggccctgcaggatgccagcgaggtggatgagggcggcggccagctgcctgaggagatcctggagctgagcggcagccggctggagcagtag

SEQ ID NO: 158864 - DNA, 993 bp, Artificial Sequence
  Description of Artificial Sequence: Synthetic coding sequence
atggaccccaccaccccagcctggggcacagagagcaccaccgtgaatggaaatgaccaggccctgctgctgctgtgtgggaaggagaccctcatccctgtgttcctgatcctcttcatcgccctggtgggcctggtgggcaatggatttgtgctgtggctgctgggcttcaggatgagaagaaatgccttctctgtgtatgtgctgagcctggccggggctgacttcctgttcctgtgcttccagatcatcaactgcctggtgtacctgagcaacttcttctgcagcatcagcatcaacttccccagcttcttcaccaccgtgatgacctgtgcctacctggccggcctgtccatgctgagcacagtgtccacagagcgctgcctgtctgtgctgtggcccatctggtaccgctgccggcggcccaggcacctgtctgctgtggtgtgtgtgctgctgtgggccctgagcctgctgctgagcatcctggagggcaagttctgtggcttcctgttcagtgatggagacagcggctggtgccagacctttgacttcatcacagctgcctggctgatcttcctgttcatggtgctgtgtggcagcagcctggccctgctggtgcgcatcctgtgtggcagccggggcctgcccctgacccggctgtacctgaccatcctgctgactgtgctggtgttcctgctgtgtggcctgcccttcggcatccagtggttcctgatcctgtggatctggaaggacagtgatgtgctcttctgccacatccaccctgtgtctgtggtgctgagcagcctgaacagcagcgccaaccccatcatctacttctttgtgggcagcttcaggaagcagtggaggctgcagcagcccatcctgaagctggccctgcagagggccctgcaggacattgctgaggtggaccacagcgagggctgcttccggcagggcaccccagagatgagccgcagcagcctggtgtag

SEQ ID NO: 158865 - DNA, 969 bp, Artificial Sequence
  Description of Artificial Sequence: Synthetic coding sequence
atggacagcaccatccctgtgctgggcacagagctgacccccatcaatggccgggaggagaccccctgctacaagcagaccctgtccttcaccggcctgacctgcatcgtgtccctggtggccctgactggaaatgctgtggtgctgtggctgctgggctgcaggatgagaagaaatgctgtgtccatctacatcctgaacctggtggccgctgacttcctgttcctgagcggccacatcatctgcagccccctgcggctcatcaacatccgccaccccatcagcaagatcctgagccctgtgatgaccttcccctacttcatcggcctgtccatgctgagcgccatcagcacagagcgctgcctgagcatcctgtggcccatctggtaccactgcagaagaccccgctacctgagctctgtgatgtgtgtgctgctgtgggccctgagcctgctgcggagcatcctggagtggatgttctgtgacttcctgttcagcggggccaacagcgtgtggtgtgagaccagtgacttcatcaccatcgcctggctggtgttcctgtgtgtggtgctgtgtggcagcagcctggtgctgctggtgcgcatcctgtgtggcagcaggaagatgcccctgacccggctgtatgtgaccatcctgctgactgtgctggtgttcctgctgtgtggcctgcccttcggcatccagtgggccctcttcagccgcatccacctggactggaaggtgctcttctgccacgtgcacctggtgtccatcttcctgagcgccctgaacagcagcgccaaccccatcatctacttctttgtgggcagcttccggcagaggcagaaccggcagaacctgaagctggtgctgcagagggccctgcaggacaccccagaggtggatgagggcggcggctggctgccccaggagaccctggagctgagcggcagccggctggagcagtag

SEQ ID NO: 158866 - DNA, 741 bp, Artificial Sequence
  Description of Artificial Sequence: Synthetic coding sequence
atggacagcaccatccctgtgctgggcacagagctgacccccatcaatggccgggaggagaccccctgctacaagcagaccctgtccttcaccggcctgacctgcatcgtgtccctggtggccctgactggaaatgctgtggtgctgtggctgctgggctgcaggatgagaagaaatgctgtgtccatctacatcctgaacctggtggccgctgacttcctgttcctgagcggccacatcatctgcagccccctgcggctcatcaacatccgccaccccatcagcaagatcctgagccctgtgatgaccttcccctacttcatcggcctgtccatgctgagcgccatcagcacagagcgctgcctgagcatcctgtggcccatctggtaccactgcagaagaccccgctacctgagctctgtgatgtgtgtgctgctgtgggccctgagcctgctgcggagcatcctggagtggatgttctgtgacttcctgttcagcggggccaacagcgtgtggtgtgagaccagtgacttcatcaccatcgcctggctggtgttcctgtgtgtggtgctgtgtggcagcagcctggtgctgctggtgcgcatcctgtgtggcagcaggaagatgcccctgacccggctgtatgtgaccatcctgctgactgtgctggtgttcctgctgtgtggcctgcccttcggcatccagtgggccctcttcagccgcatccacctggactggtag

SEQ ID NO: 158867 - DNA, 969 bp, Artificial Sequence
  Description of Artificial Sequence: Synthetic coding sequence
atggaccccaccgtgcctgtgtttggcaccaagctgacccccatcaatggccgggaggagaccccctgctacaaccagaccctgtccttcaccgtgctgacctgcatcatcagcctggtgggcctgactggaaatgctgtggtgctgtggctgctgggctacaggatgagaagaaatgctgtgtccatctacatcctgaacctggccgctgctgacttcctgttcctgtccttccagatcatccggctgcccctgcggctcatcaacatcagccacctgatcaggaagatcctggtgtctgtgatgaccttcccctacttcaccggcctgtccatgctgagcgccatcagcacagagcgctgcctgtctgtgctgtggcccatctggtaccgctgcagaagacccacccacctgtctgctgtggtgtgtgtgctgctgtggggcctgagcctgctcttctccatgctggagtggaggttctgtgacttcctgttcagcggggctgacagctcctggtgtgagaccagtgacttcatccctgtggcctggctgatcttcctgtgtgtggtgctgtgtgtgagcagcctggtgctgctggtgcgcatcctgtgtggcagcaggaagatgcccctgacccggctgtatgtgaccatcctgctgactgtgctggtgttcctgctgtgtggcctgcccttcggcatcctgggcgccctgatctacaggatgcacctgaacctggaggtgctgtactgccacgtgtacctggtgtgcatgagcctgagcagcctgaacagcagcgccaaccccatcatctacttctttgtgggcagcttccggcagaggcagaaccggcagaacctgaagctggtgctgcagagggccctgcaggacaagccagaggtggacaagggggagggccagctgcctgaggagagcctggagctgagcggcagccggctgggcccctag

SEQ ID NO: 158868 - DNA, 3051 bp, Artificial Sequence
  Description of Artificial Sequence: Synthetic coding sequence
atggtgctgcccacctgccccatggccgagtttgccctgcccaggcacagcgctgtgatggagcggctgcggaggagaattgagctgtgcagaagacaccacagcacctgtgaggcccgctatgaagctgtgtccccagagcggctggagctggagcggcagcacacctttgccctgcaccagcgctgcatccaggccaaggccaagagagctgggaagcaccggcagcccccagctgccacagccccagccccagctgccccagccccccggctggatgctgctgatggccctgagcacggccgcccagccacccacctgcatgacacagtgaagaggaacctggacagcgccaccagcccccagaatggagaccagcagaatggctacggggacctcttccctggccacaagaagacccggcgggaggcccccctgggcgtggccatcagcagcaatggcctgcccccagccagccccctgggccagagcgacaagcccagcggggctgatgccctgcagagcagcggcaagcacagcctgggcctggacagcctgaacaagaagaggctggccgacagcagcctgcacctgaatggaggcagcaaccccagcgagagcttccccctgagcctgaacaaggagctgaagcaggagcctgtggaggacctgccctgcatgatcactggaacagtgggcagcatcagccagagcaacctgatgccagacctgaacctgaatgagcaggagtggaaggagctgattgaggagctgaacagatctgtgcctgatgaggacatgaaggacctcttcaatgaagattttgaggagaagaaggaccctgagagcagcggcagcgccacccagacccccctggcccaggacatcaacatcaagacagagttcagccctgctgcctttgagcaggagcagctgggcagcccccaggtgcgggccggcagcgctggccagaccttcctgggccccagcagcgcccctgtgtccacagacagccccagcctgggcggcagccagaccctcttccacaccagcggccagcccagggctgacaaccccagccccaacctgatgcctgccagcgcccaggcccagaatgcccagagggccctggccggcgtggtgctgcccagccagggccctggaggagccagcgagctgagcagcgcccaccagctgcagcagattgctgccaagcagaagcgggagcagatgctgcagaacccccagcaggccaccccagccccagcccctggccagatgagcacctggcagcagacaggccccagccacagcagcctggatgtgccctaccccatggagaagccagccagccccagcagctacaagcaggacttcaccaacagcaagctgctgatgatgcccagcgtgaacaagagcagccccaggcctgggggcccctacctgcagcccagccacgtgaacctgctgagccaccagccccccagcaacctgaaccagaacagcgccaacaaccagggctctgtgctggactatggcaacaccaagcccctgagccactacaaggctgactgtggccagggcagccctggcagcggccagagcaagccagccctgatggcctacctgccccagcagctgagccacatcagccatgagcagaacagcctcttcctgatgaagcccaagccaggcaacatgcccttccgcagcctggtgcccccaggccaggagcagaaccccagctctgtgcctgtgcaggcccaggccacctctgtgggcacccagcccccagctgtgtctgtggccagcagccacaacagcagcccctacctgagcagccagcagcaggccgctgtgatgaagcagcaccagctgctgctggaccagcagaagcagcgggagcagcagcagaagcacctgcagcagcagcagttcctgcagaggcagcagcacctgctggccgagcaggagaagcagcagttccagaggcacctgacccggcccccaccccagtaccaggaccccacccagggcagcttcccccagcaggtgggccagttcaccggcagcagcgctgctgtgcccggcatgaacaccctgggccccagcaacagcagctgccccagggtcttcccccaggccggcaacctgatgcccatgggccctggccacgcctctgtgagcagcctgcccaccaacagcggccagcaggacagaggagtggcccagtttcctggcagccagaacatgccccagagcagcctgtatggcatggccagcggcatcacccagatcgtggcccagcccccaccccaggccaccaacggccacgcccacatcccccggcagaccaacgtgggccagaacacctctgtgtctgctgcctacggccagaacagcctgggcagcagcggcctgagccagcagcacaacaagggcaccctgaaccctggcctgaccaagccccctgtgccccgggtgtccccagccatgggcggccagaacagctcctggcagcaccagggcatgcccaacctgagcggccagaccccaggcaacagcaatgtgagccccttcaccgctgccagcagcttccacatgcagcagcaggcccacctgaagatgagcagcccccagttcagccaggccgtgcccaaccggcccatggcccccatgagcagcgctgctgctgtgggcagcctgctgccccctgtgtctgcccagcagaggaccagcgccccagccccagcccccccacccacagccccccagcagggcctgcccggcctgagccctgctggccctgagctgggcgccttcagccagagccctgccagccagatgggcggccgggccggcctgcactgcacccaggcctaccctgtgaggacagctggccaggagctgccctttgcctacagcggccagcccggcggcagcggcctgagctctgtggccggccacacagacctgattgacagcctgctgaagaacagaaccagcgaggagtggatgtctgacctggatgacctgctgggcagccagtag

SEQ ID NO: 158869 - DNA, 2286 bp, Artificial Sequence
  Description of Artificial Sequence: Synthetic coding sequence
cggggcaagcagtggggccggggcggcggggagcggccccggctggaggtgggcagcaagaggcggctgggcgtgggccccagcggggccggcggcaagccagctgctgcccgggagcccgcccccctgcccagcggggcctggaggggccgggaggccgagcggggcagcagaggagagaggagcccccagtgccagcctgccccccggggccctgcccctggccctgcccgggccgcccggggcccctggtgctgccccccagccccctggaggagcagccgctgccggggcacagcccgctcctggagcgcctttgctggggccagcagctgtgccggggccaccacagccccagcccggcctgctgccccagccccccggctggatgctgctgatggccctgagcacggccggcctgccacccacctgcatgacacagtgaagaggaacctggacagcgccaccagcccccagaatggagaccagcagaatggctatggagacctcttccctggccacaagaagacccggcgggaggcccccctgggcgtggccatcagcagcaatggcctgcccccagccagccccctgggccagagcgacaagcccagcggggctgatgccctgcagagcagcggcaagcacagcctgggcctggacagcctgaacaagaagaggctggccgacagcagcctgcacctgaatggaggcagcaaccccagcgagagcttccccctgagcctgaacaaggagctgaagcaggagcctgtggaggacctgccctgcatgatcaccggcaccgtgggcagcatcagccagagcaacctgatgccagacctgaacctgaatgagcaggagtggaaggagctgattgaggagctgaacagatctgtgcctgatgaggacatgaaggacctcttcaatgaagattttgaggagaagaaggaccctgagagcagcggcagcgccacccagacccccctggcccaggacatcaacatcaagacagagttctccccagctgcctttgagcaggagcagctgggcagcccccaggtgcgggccggcagcgctggccagaccttcctgggccccagcagcgcccctgtgtccacagacagccccagcctgggcggcagccagaccctcttccacaccagcggccagcccagggctgacaaccccagccccaacctgatgcctgccagcgcccaggcccagaatgcccagagggccctggccggcgtggtgctgcccagccagggccctgggggcgccagcgagctgagcagcgcccaccagctgcagcagattgctgccaagcagaagcgggagcagatgctgcagaacccccagcaggccaccccagccccagcccctggccagatgagcacctggcagcagacaggccccagccacagcagcctggatgtgccctaccccatggagaagccagccagccccagcagctacaagcaggacttcaccaacagcaagctgctgatgatgcccagcgtgaacaagagcagccccaggcctgggggcccctacctgcagcccagccacgtgaacctgctgagccaccagccccccagcaacctgaaccagaacagcgccaacaaccagggctctgtgctggactatggcaacaccaagcccctgagccactacaaggctgactgtggccagggcagccctggcagcggccagagcaagccagccctgatggcctacctgccccagcagctgagccacatcagccatgagcagaacagcctcttcctgatgaagcccaagccaggcaacatgcccttccgcagcctggtgcccccaggccaggagcagaaccccagctctgtgcctgtgcaggcccaggccacctctgtgggcacccagcccccagctgtgtctgtggccagcagccacaacagcagcccctacctgagcagccagcagcaggccgctgtgatgaagcagcaccagctgctgctggaccagcagaagcagcgggagcagcagcagaagcacctgcagcagcagcagttcctgcagaggcagcagcacctgctggccgagcaggagaagcagcagttccagaggcacctgacccggcccccaccccagtaccaggaccccacccagggcagcttcccccagcaggtgggccagttcaccgcccagggcctgagctgtgccctgcccatgatccacagcacagaggtgctgatcagcagcctgtgcaatggatctgctggcctgtctgctgcccagaggtcctggtag

SEQ ID NO: 158870 - DNA, 3471 bp, Artificial Sequence
  Description of Artificial Sequence: Synthetic coding sequence
atgggagacacagccccaccccaggccccagctgggggcctgggcggggccagcggggccggcctgctgggcggcggctctgtgaccccccgggtgcacagcgccatcgtggagcggctgcgggccagaattgctgtgtgccggcagcaccacctgagctgtgagggccgctatgaaagaggccgggcagagagcagtgaccgggagcgggagagcaccctgcagctgctgagcctggtgcagcacggccagggcgccaggaaggccggcaagcacaccaaggccacagccacagctgccaccaccacagcccctcctcctcctcctgctgcccccccagctgccagccaggccgccgccacagctgcccctcctcctcctccagactaccaccaccaccaccagcagcacctgctgaacagcagcaacaacggcggcagcggcggcatcaatggagagcagcagcccccagccagcacccctggggaccagagaaattctgccctgattgccctgcagggcagcctgaagaggaagcaggtggtgaacctgagccctgccaacagcaagaggcccaatggatttgtggacaacagcttcctggacatcaagaggatccgggtgggggagaacctgtctgctggccagggcggcctgcagatcaacaacggccagagccagatcatgagcggcaccctgcccatgagccaggcccccctgaggaagaccaacaccctgcccagccacacccacagccctggaaatggcctcttcaacatgggcctgaaggaggtgaagaaggagcctggagagaccctgagctgcagcaagcacatggatggccagatgacccaggagaacatcttccccaacagatatggagatgatcctggagagcagctgatggaccctgagctgcaggagctgttcaatgagctgaccaacatctctgtgccccccatgtctgacctggagctggagaacatgatcaatgccaccatcaagcaggatgaccccttcaacatcgacctgggccagcagagccagaggagcaccccccggcccagcctgcccatggagaagatcgtcatcaagtctgagtacagccctggcctgacccagggccccagcggcagcccccagctgcggccccccagcgctggccctgccttctccatggccaacagcgccctgagcaccagcagccccatccccagcgtgccccagagccaggcccagccccagacaggcagcggggccagccgggccctgcccagctggcaggaggtgagccacgcccagcagctgaagcagattgctgccaaccggcagcagcacgccaggatgcagcagcaccagcagcagcaccagcccaccaactggagcgccctgcccagcagcgctggccccagccctggccccttcggccaggagaagatccccagccccagctttggccagcagaccttcagcccccagagcagccccatgcctggggtggccggcggcagcggccagagcaaggtgatggccaactacatgtacaaggccggccccagcgcccagggcggccacctggatgtgctgatgcagcagaagccccaggacctgagccgctccttcatcaacaacccccacccagccatggagccccggcagggcaacaccaagcccctcttccacttcaacagcgaccaggccaaccagcagatgcccagcgtgctgcccagccagaacaagcccagcctgctgcactacacccagcagcagcagcagcagcagcagcagcagcagcagcagcagcagcagcagcagcagcagcagcagcagcagcagcagcagcagcagcagcagcagcagcagagcagcatcagcgcccagcagcagcagcagcagcagagcagcatcagcgcccagcagcagcagcagcagcagcagcagcagcagcagcagcagcagcagcagcagcagcagcagcagcagcagcagcagcagcccagcagccagcctgcccagagcctgcccagccagcccctgctgcggagccccctgcccctgcagcagaagctgctgctgcagcagatgcagaaccagcccatcgccggcatgggctaccaggtgtcccagcagcagaggcaggaccagcacagcgtggtgggccagaacacaggccccagccccagccccaacccctgcagcaaccccaacacaggcagcggctacatgaacagccagcagagcctgctgaaccagcagctgatgggcaagaagcagaccctgcagaggcagatcatggagcagaagcagcagctgctgctgcagcagcagatgctggctgatgctgagaagatcgccccccaggaccagatcaacagacacctgagcaggcctcctccagactacaaggaccagaggagaaatgtgggcaacatgcagcccacagcccagtacagcggcggcagcagcaccatcagcctgaacagcaaccaggccctggccaaccctgtgtccacccacaccatcctgacccccaacagcagcctgctgagcaccagccacggcaccaggatgcccagcctgagcacagctgtgcagaacatgggcatgtatggcaacctgccctgcaaccagcccaacacctacagcgtgaccagcggcatgaaccagctgacccagcagaggaaccccaagcagctgctggccaaccagaacaaccccatgatgcccaggcctcccaccctgggccccagcaacaacaacaacgtggccacctttggagctggctctgtgggcaacagccagcagctgcggcccaacctgacccacagcatggcctccatgccaccccagaggaccagcaatgtgatgatcaccagcaacaccacagcccccaactgggccagccaggagggcaccagcaagcagcaggaggccctgaccagcgctggggtgcgcttccccaccggcaccccagctgcctacacccccaaccagagcctgcagcaggccgtgggcagccagcagttcagccagagagctgtggccccacccaaccagctgaccccagctgtgcagatgaggcccatgaaccagatgagccagaccctgaatggccagaccatgggccccctgcggggcctgaacctgcggcccaaccagctgagcacccagatcctgcccaacctgaaccagagcggcaccggcctgaaccagagcaggacaggcatcaaccagccccccagcctgacccccagcaacttccccagccccaaccagagcagccgggccttccagggcacagaccacagcagtgacctggcctttgacttcctgagccagcagaatgacaacatgggccctgccctgaacagtgatgctgacttcatcgacagcctgctgaagacagagcctggaaatgatgactggatgaaggacatcaacctggatgagatcctgggcaacaacagctag

SEQ ID NO: 158871 - DNA, 3471 bp, Artificial Sequence; identical to SEQ ID NO: 158870
  Description of Artificial Sequence: Synthetic coding sequence

SEQ ID NO: 158872 - DNA, 1632 bp, Artificial Sequence
  Description of Artificial Sequence: Synthetic coding sequence
ctgcaggagaccgtgaagaggaagctggagggcgcccggagccccctgaatggagaccagcagaatggagcctgtgatggcaacttcagccccaccagcaagaggatcaggaaggacatctctgctggcatggaggccatcaacaacctgcccagcaacatgcccctgcccagcgccagccccctgcaccagctggacctgaagcccagcctgcccctgcagaacagcggcacccacaccccaggcctgctggaggacctgagcaagaatggccgcctgcctgagatcaagctgcctgtgaatggctgcagcgacctggaggacagcttcaccatcctgcagagcaaggacctgaagcaggagcccctggatgaccccacctgcatcgacaccagcgagaccagcctgagcaaccagaacaagctgttcagtgacatcaacctgaatgaccaggagtggcaggagctgattgatgagctggccaacacagtgcctgaagatgacatccaggacctcttcaatgaagattttgaggagaagaaggagcctgagttcagccagcctgccacagagacccccctgagccaggagagcgcctctgtgaagagtgaccccagccacagcccctttgcccacgtgtccatgggcagcccccaggcccggcccagcagcagcggcccccccttcagcacagtgtccacagccaccagcctgcccagcgtggccagcaccccagctgcccccaacccagccagcagccctgccaactgtgctgtgcagagcccccagacccccaaccaggcccacaccccaggccaggccccacccaggcctggaaatggctacctgctgaacccagctgctgtgacagtggccggcagcgccagcggccctgtggccgtgcccagcagtgacatgagccctgctgagcagctgaagcagatggccgcccagcagcagcagagggccaagctgatgcagcagaagcagcagcagcagcagcagcagcagcagcagcagcagcagcagcagcagcagcagcagcagcagcagcagcagcagcacagcaaccagaccagcaactggagccccctgggcccccccagcagcccctacggggccgccttcaccgctgagaagcccaacagccccatgatgtacccccaggccttcaacaaccagaaccccatcgtgccccccatggccaacaacctgcagaagaccaccatgaacaactacctgccccagaaccacatgaacatgatcaaccagcagcccaacaacctgggcaccaacagcctgaacaagcagcacaacatcctgacctacggcaacaccaagcccctgacccacttcaatgctgacctgagccagaggatgaccccacctgtggccaaccccaacaagaaccccctgatgccctacatccagcagcagcagcagcagcagcagcagcagcagcagcagcagcagcagcagcagcccccaccaccccagctgcaggccccccgggcccacctgtctgaggaccagaagaggctgctgctgatgaagcagaagggcgtgatgaaccagcccatggcctatgctgccctgcccagccacggccaggagcagcagcctgtgggctag

SEQ ID NO: 158873 - DNA, 831 bp, Artificial Sequence
  Description of Artificial Sequence: Synthetic coding sequence
atgagccctgctgagcagctgaagcagatggccgcccagcagcagcagagggccaagctgatgcagcagaagcagcagcagcagcagcagcagcagcagcagcagcagcagcagcacagcaaccagaccagcaactggagccccctgggcccccccagcagcccctacggggccgccttcaccgctgagaagcccaacagccccatgatgtacccccaggccttcaacaaccagaaccccatcgtgccccccatggccaacaacctgcagaagaccaccatgaacaactacctgccccagaaccacatgaacatgatcaaccagcagcccaacaacctgggcaccaacagcctgaacaagcagcacaacatcctgacctacggcaacaccaagcccctgacccacttcaatgctgacctgagccagaggatgaccccacctgtggccaaccccaacaagaaccccctgatgccctacatccagcagcagcagcagcagcagcagcagcagcagcagcagcagcagcagcagcagcccccaccaccccagctgcaggccccccgggcccacctgtctgaggaccagaagaggctgctgctgatgaagcagaagggcgtgatgaaccagcccatggcctatgctgccctgcccagccacggccaggtgtctgtgaaggtgacccacagcagcagcagcagctgtggggcctttgactgccgctgtgtgatgttctacaagagcacagtggtgggcagcaactgcctgcagaagaccagcctgcacccccaggtggtggccaggtttggagtcttcttcttccacttctcctag

SEQ ID NO: 158874 - DNA, 3417 bp, Artificial Sequence
  Description of Artificial Sequence: Synthetic coding sequence
atgggagactttgctgccccagctgctgctgccaacggcagcagcatctgcatcaacagcagcctgaacagcagcctgggcggggccggcattggagtgaacaacacccccaacagcaccccagctgcccccagcagcaaccaccctgctgctgggggctgcggcggcagcggcggccctgggggcggcagcgctgctgtgcccaagcacagcacagtggtggagcggctgcggcagagaattgagggctgcagaagacaccacgtgaactgtgagaaccgctaccagcaggcccaggtggagcagctggagctggagcggcgggacacagtgtccctgtaccagaggaccctggagcagagggccaagaagtctggagctggcaccgggaagcagcagcaccccagcaagccccagcaggatgctgaggccgccagcgctgagcagaggaaccacaccctcatcatgctgcaggagaccgtgaagaggaagctggagggcgcccggagccccctgaatggagaccagcagaatggagcctgtgatggcaacttcagccccaccagcaagaggatcaggaaggacatctctgctggcatggaggccatcaacaacctgcccagcaacatgcccctgcccagcgccagccccctgcaccagctggacctgaagcccagcctgcccctgcagaacagcggcacccacaccccaggcctgctggaggacctgagcaagaatggccgcctgcctgagatcaagctgcctgtgaatggctgcagcgacctggaggacagcttcaccatcctgcagagcaaggacctgaagcaggagcccctggatgaccccacctgcatcgacaccagcgagaccagcctgagcaaccagaacaagctgttcagtgacatcaacctgaatgaccaggagtggcaggagctgattgatgagctggccaacacagtgcctgaagatgacatccaggacctcttcaatgaagattttgaggagaagaaggagcctgagttcagccagcctgccacagagacccccctgagccaggagagcgcctctgtgaagagtgaccccagccacagcccctttgcccacgtgtccatgggcagcccccaggcccggcccagcagcagcggcccccccttcagcacagtgtccacagccaccagcctgcccagcgtggccagcaccccagctgcccccaacccagccagcagccctgccaactgtgctgtgcagagcccccagacccccaaccaggcccacaccccaggccaggccccacccaggcctggaaatggctacctgctgaacccagctgctgtgacagtggccggcagcgccagcggccctgtggccgtgcccagcagtgacatgagccctgctgagcagctgaagcagatggccgcccagcagcagcagagggccaagctgatgcagcagaagcagcagcagcagcagcagcagcagcagcagcagcagcagcagcagcagcagcagcagcagcagcagcagcagcagcacagcaaccagaccagcaactggagccccctgggcccccccagcagcccctacggggccgccttcaccgctgagaagcccaacagccccatgatgtacccccaggccttcaacaaccagaaccccatcgtgccccccatggccaacaacctgcagaagaccaccatgaacaactacctgccccagaaccacatgaacatgatcaaccagcagcccaacaacctgggcaccaacagcctgaacaagcagcacaacatcctgacctacggcaacaccaagcccctgacccacttcaatgctgacctgagccagaggatgaccccacctgtggccaaccccaacaagaaccccctgatgccctacatccagcagcagcagcagcagcagcagcagcagcagcagcagcagcagcagcagcagcccccaccaccccagctgcaggccccccgggcccacctgtctgaggaccagaagaggctgctgctgatgaagcagaagggcgtgatgaaccagcccatggcctatgctgccctgcccagccacggccaggagcagcaccctgtgggcctgcccaggaccaccggccccatgcagagctctgtgcccccaggcagcggcggcatggtgtctggggccagccctgctggccctggcttcctgggcagccagccccaggccgccatcatgaagcagatgctgattgaccagagggcccagctgattgagcagcagaagcagcagttcctgcgggagcagaggcagcagcagcagcagcagcagcagcagatcctggccgagcagcagctgcagcagagccacctgccccggcagcacctgcagccccagaggaacccctaccctgtgcagcaggtgaaccagttccagggcagcccccaggacattgctgctgtgcgcagccaggccgccctgcagagcatgaggaccagccggctgatggcccagaatgccggcatgatgggcatcggccccagccagaaccctggcaccatggccacagctgctgcccagagcgagatgggcctggccccctacagcaccacccccaccagccagcccggcatgtacaacatgagcacaggcatgacccagatgctgcagcaccccaaccagagcggcatgagcatcacccacaaccaggcccagggcccccggcagcctgccagcggccagggcgtgggcatggtgtctggcttcggccagagcatgctggtgaacagcgccatcacccagcagcacccccagatgaagggccctgtgggccaggccctgccccggccccaggccccaccccggctgcagagcctgatgggcaccgtgcagcagggcgcccagagctggcagcagaggagcctgcagggcatgcctggccgcaccagcggggagctgggccccttcaacaacggggccagctaccccctgcaggccggccagccccggctgaccaagcagcacttcccccagggcctgagccagagcgtggtggatgccaacacaggaacagtgaggaccctgaacccagctgccatgggccggcagatgatgcccagcctgcccggccagcagggcaccagccaggcccggcccatggtgatgagcggcctgagccagggcgtgcccggcatgcctgccttcagccagcccccagcccagcagcagatccccagcggcagctttgcccccagcagccagagccaggcctatgaaagaaatgccccccaggatgtgtcctacaactacagcggagatggagctgggggcagcttccctggcctgcctgatggagctgacctggtggacagcatcatcaagggcggccctggagatgagtggatgcaggagctggatgagctgtttggaaacccctag

SEQ ID NO: 158875 - DNA, 1338 bp, Artificial Sequence
  Description of Artificial Sequence: Synthetic coding sequence
gagcagcaccctgtgggcctgcccaggaccaccggccccatgcagagctctgtgcccccaggcagcggcggcatggtgtctggggccagccctgctggccctggcttcctgggcagccagccccaggccgccatcatgaagcagatgctgattgaccagagggcccagctgattgagcagcagaagcagcagttcctgcgggagcagaggcagcagcagcagcagcagcagcagcagatcctggccgagcagcagctgcagcagagccacctgccccggcagcacctgcagccccagaggaacccctaccctgtgcagcaggtgaaccagttccagggcagcccccaggacattgctgctgtgcgcagccaggccgccctgcagagcatgaggaccagccggctgatggcccagaatgccggcatgatgggcatcggccccagccagaaccctggcaccatggccacagctgctgcccagagcgagatgggcctggccccctacagcaccacccccaccagccagcccggcatgtacaacatgagcacaggcatgacccagatgctgcagcaccccaaccagagcggcatgagcatcacccacaaccaggcccagggcccccggcagcctgccagcggccagggcgtgggcatggtgtctggcttcggccagagcatgctggtgaacagcgccatcacccagcagcacccccagatgaagggccctgtgggccaggccctgccccggccccaggccccaccccggctgcagagcctgatgggcaccgtgcagcagggcgcccagagctggcagcagaggagcctgcagggcatgcctggccgcaccagcggggagctgggccccttcaacaatggagccagctaccccctgcaggccggccagccccggctgaccaagcagcacttcccccagggcctgagccagagcgtggtggatgccaacacaggcaccgtgaggaccctgaacccagctgccatgggccggcagatgatgcccagcctgcccggccagcagggcaccagccaggcccggcccatggtgatgagcggcctgagccagggcgtgcccggcatgcctgccttcagccagcccccagcccagcagcagatccccagcggcagctttgcccccagcagccagagccaggcctatgaaagaaatgccccccaggatgtgtcctacaactacagcggagatggagctgggggcagcttccctggcctgcctgatggagctgacctggtggacagcatcatcaagggcggccctggagatgagtggatgcaggagctggatgagctgtttggaaacccctag

SEQ ID NO: 158876 - DNA, 2325 bp, Artificial Sequence
  Description of Artificial Sequence: Synthetic coding sequence
atggatgactggaagagccggctggtgatcaagtccatgctgccccactttgccatggtgggcaaccggcaggagcccaggaagctgcaggagagcggcaagaagcccagctggatggaggaggaggacctgtccttcctgtacaagagcagccctggcaggaagcaccagggcaccgtgaagaggcggcaggaggaggaccacttccagttcccagacatggctgatggcggctaccccaacaagatcaagaggccctgcctggaggatgtgaccctggccatgggccctggggcccaccccagcacagcctgtgccgagctgcaggtgccccccctgaccatcaaccccagccctgctgccatgggcgtggccggccagagcctgctgctggagaacaaccccatgaatggaaacatcatgggcagcccctttgtggtgccccagaccacagaggtgggcctgaagggccccaccgtgccctactatgagaagatcaacagcgtgcctgctgtggaccaggagctgcaggagctgctggaggagctgaccaagatccaggaccccagccccaatgagctggacctggagaagatcctgggcaccaagccagaggagcccctggtgctggaccacccccaggccaccctgagcaccacccccaagcccagcgtgcagatgagccacctggagagcctggccagcagcaaggagtttgccagcagctgcagccaggtgacaggcatgagcctgcagatccccagcagcagcacaggcatctcctacagcatccccagcaccagcaagcagatcgtgagccccagcagctccatggcccagagcaagagccaggtgcaggccatgctgcctgtggccctgccccccctgcctgtgccccagtggcaccacgcccaccagctgaaggccctggccgccagcaagcagggcagcgccaccaagcagcagggccccacccccagctggagcggcctgcccccacctggcctgagccccccctacagacctgtgcccagcccccaccccccacccctgcccctgcccccacctcctccacccttcagcccccagagcctgatggtgtcctgcatgagcagcaacaccctgagcggcagcaccctgcggggcagccccaatgccctgctgagctccatgaccagcagcagcaatgctgccctgggccctgccatgccctatgcccctgagaagctgcccagccctgccctgacccagcagccccagtttggcccccagagcagcatcctggccaacctgatgagcagcaccatcaagaccccccagggccacctgatgtctgccctgcctgccagcaaccctggccccagccccccctacagacctgagaagctgagcagccctggcctgccccagcagagcttcaccccccagtgcagcctcatccgcagcctgacccccaccagcaacctgctgagccagcagcagcagcagcagcagcagcagcagcaggccaacgtcatcttcaagcccatcagcagcaacagcagcaagaccctgtccatgatcatgcagcagggcatggccagcagcagccctggggccacagagcccttcacctttggaaacaccaagcccctgagccactttgtgtctgagcccggcccccagaagatgcccagcatgcccaccaccagccggcagcccagcctgctgcactacctgcagcagcccacccccacccaggccagcagcgccacagccagcagcacagccacagccaccctgcagctgcagcagcagcagcagcagcagcagcagcagcctgaccacagcagcttcctgctgcagcagatgatgcagcagccccagcgcttccagaggtctgtggccagtgacagcatgcctgccctgccccggcagggctgctgccacctgtttgcctggaccagcgctgccagctctgtgaagccccagcaccagcacggcaacagcttcaccagccggcaggacccccagcctggagatgtgagccccagcaacatcacccacgtggacaaggcctgcaagctgggggaggcccggcacccccaggtgtccctgggccggcagccccccagctgccaggccctgggcagcgagagcttcctgcccggcagcagctttgcccacgagctggcccgggtgaccagcagctacagcaccagcgaggccgccccctggggctcctgggaccccaaggcctggaggcaggtgcctgcccccctgctgcccagctgtgatgccacagcccggggcacagagatccgctcctatggaaatgacccctag

SEQ ID NO: 158877 - DNA, 411 bp, Artificial Sequence
  Description of Artificial Sequence: Synthetic coding sequence
atggatgactggaagagccggctggtgatcaagtccatgctgccccactttgccatggtgggcaaccggcaggagcccaggaagctgcaggagagcggcaagaagcccagctggatggaggaggaggacctgtccttcctgtacaagagcagccctggcaggaagcaccagggcaccgtgaagaggcggcaggaggaggaccacttccagttcccagacatggctgatggcggctaccccaacaagatcaagaggccctgcctggaggatgtgaccctggccatgggccctggggcccaccccagcacagcctgtgccgagctgcaggtgccccccctgaccatcaaccccagccctgctgccatgggcgtggccggccagagcctgctgctggagaacaaccccatgtag

SEQ ID NO: 158878 - DNA, 2325 bp, Artificial Sequence; identical to SEQ ID NO: 158876
  Description of Artificial Sequence: Synthetic coding sequence

SEQ ID NO: 158879 - DNA, 2250 bp, Artificial Sequence
  Description of Artificial Sequence: Synthetic coding sequence
atggatgactggaagagccggctggtgatcaagtccatgctgccccactttgccatggtgggcaaccggcaggagcccaggaagctgcaggagagcggcaccgtgaagaggcggcaggaggaggaccacttccagttcccagacatggctgatggcggctaccccaacaagatcaagaggccctgcctggaggatgtgaccctggccatgggccctggggcccaccccagcacagcctgtgccgagctgcaggtgccccccctgaccatcaaccccagccctgctgccatgggcgtggccggccagagcctgctgctggagaacaaccccatgaatggaaacatcatgggcagcccctttgtggtgccccagaccacagaggtgggcctgaagggccccaccgtgccctactatgagaagatcaacagcgtgcctgctgtggaccaggagctgcaggagctgctggaggagctgaccaagatccaggaccccagccccaatgagctggacctggagaagatcctgggcaccaagccagaggagcccctggtgctggaccacccccaggccaccctgagcaccacccccaagcccagcgtgcagatgagccacctggagagcctggccagcagcaaggagtttgccagcagctgcagccaggtgacaggcatgagcctgcagatccccagcagcagcacaggcatctcctacagcatccccagcaccagcaagcagatcgtgagccccagcagctccatggcccagagcaagagccaggtgcaggccatgctgcctgtggccctgccccccctgcctgtgccccagtggcaccacgcccaccagctgaaggccctggccgccagcaagcagggcagcgccaccaagcagcagggccccacccccagctggagcggcctgcccccacctggcctgagccccccctacagacctgtgcccagcccccaccccccacccctgcccctgcccccacctcctccacccttcagcccccagagcctgatggtgtcctgcatgagcagcaacaccctgagcggcagcaccctgcggggcagccccaatgccctgctgagctccatgaccagcagcagcaatgctgccctgggccctgccatgccctatgcccctgagaagctgcccagccctgccctgacccagcagccccagtttggcccccagagcagcatcctggccaacctgatgagcagcaccatcaagaccccccagggccacctgatgtctgccctgcctgccagcaaccctggccccagccccccctacagacctgagaagctgagcagccctggcctgccccagcagagcttcaccccccagtgcagcctcatccgcagcctgacccccaccagcaacctgctgagccagcagcagcagcagcagcagcagcagcagcaggccaacgtcatcttcaagcccatcagcagcaacagcagcaagaccctgtccatgatcatgcagcagggcatggccagcagcagccctggggccacagagcccttcaccttcggcaacaccaagcccctgagccactttgtgtctgagcccggcccccagaagatgcccagcatgcccaccaccagccggcagcccagcctgctgcactacctgcagcagcccacccccacccaggccagcagcgccacagccagcagcacagccacagccaccctgcagctgcagcagcagcagcagcagcagcagcagcagcctgaccacagcagcttcctgctgcagcagatgatgcagcagccccagcgcttccagaggtctgtggccagtgacagcatgcctgccctgccccggcagggctgctgccacctgtttgcctggaccagcgctgccagctctgtgaagccccagcaccagcacggcaacagcttcaccagccggcaggacccccagcctggagatgtgagccccagcaacatcacccacgtggacaaggcctgcaagctgggggaggcccggcacccccaggtgtccctgggccggcagccccccagctgccaggccctgggcagcgagagcttcctgcccggcagcagctttgcccacgagctggcccgggtgaccagcagctacagcaccagcgaggccgccccctggggctcctgggaccccaaggcctggaggcaggtgcctgcccccctgctgcccagctgtgatgccacagcccggggcacagagatccgctcctatggaaatgacccctag

SEQ ID NO: 158880 - DNA, 2997 bp, Artificial Sequence
  Description of Artificial Sequence: Synthetic coding sequence
atggatgactggaagagccggctggtgatcaagtccatgctgccccactttgccatggtgggcaaccggcaggagcccaggaagctgcaggagagcggcaccgtgaagaggcggcaggaggaggaccacttccagttcccagacatggctgatggcggctaccccaacaagatcaagaggccctgcctggaggatgtgaccctggccatgggccctggggcccaccccagcacagcctgtgccgagctgcaggtgccccccctgaccatcaaccccagccctgctgccatgggcgtggccggccagagcctgctgctggagaacaaccccatgaatggaaacatcatgggcagcccctttgtggtgccccagaccacagaggtgggcctgaagggccccaccgtgccctactatgagaagatcaacagcgtgcctgctgtggaccaggagctgcaggagctgctggaggagctgaccaagatccaggaccccagccccaatgagctggacctggagaagatcctgggcaccaagccagaggagcccctggtgctggaccacccccaggccaccctgagcaccacccccaagcccagcgtgcagatgagccacctggagagcctggccagcagcaaggagtttgccagcagctgcagccaggtgacaggcatgagcctgcagatccccagcagcagcacaggcatctcctacagcatccccagcaccagcaagcagatcgtgagccccagcagctccatggcccagagcaagagccaggtgcaggccatgctgcctgtggccctgccccccctgcctgtgccccagtggcaccacgcccaccagctgaaggccctggccgccagcaagcagggcagcgccaccaagcagcagggccccacccccagctggagcggcctgcccccacctggcctgagccccccctacagacctgtgcccagcccccaccccccacccctgcccctgcccccacctcctccacccttcagcccccagagcctgatggtgtcctgcatgagcagcaacaccctgagcggcagcaccctgcggggcagccccaatgccctgctgagctccatgaccagcagcagcaatgctgccctgggccctgccatgccctatgcccctgagaagctgcccagccctgccctgacccagcagccccagtttggcccccagagcagcatcctggccaacctgatgagcagcaccatcaagaccccccagggccacctgatgtctgccctgcctgccagcaaccctggccccagccccccctacagacctgagaagctgagcagccctggcctgccccagcagagcttcaccccccagtgcagcctcatccgcagcctgacccccaccagcaacctgctgagccagcagcagcagcagcagcagcagcagcagcaggccaacgtcatcttcaagcccatcagcagcaacagcagcaagaccctgtccatgatcatgcagcagggcatggccagcagcagccctggggccacagagcccttcaccttcggcaacaccaagcccctgagccactttgtgtctgagcccggcccccagaagatgcccagcatgcccaccaccagccggcagcccagcctgctgcactacctgcagcagcccacccccacccaggccagcagcgccacagccagcagcacagccacagccaccctgcagctgcagcagcagcagcagcagcagcagcagcagcctgaccacagcagcttcctgctgcagcagatgatgcagcagccccagcgcttccagaggtctgtggccagtgacagcatgcctgccctgccccggcagcaggaggagcagaggagcggcctgatggccatgaccccagagcggcagaatgcctacatcagccagcagatgagcccctttgaagctgtgcaggagcaggtgaccagcaagtgcagccgcatcaaggccagcccccccagcagcaagcacctgatgccacccaggacaggcctgctgcagaacaacctgagccctggcatgatccccctgaccaggcaccagagctgtgagggcatgggcgtcatcagccccaccctgggcaagaggcagggcatcttcaccagcagcccccagtgccccatcctgagccacagcggccagacccccctgggccgcctggacagcgtgtgccagcacatgcagagccccaaggccaccccacctgaggtgcccctgcccggcttctgccccagcagcctgggcacccagagcctgagcccccaccagctgcggcggcccagcgtgcccaggatgcccacagccttcaacaatgctgcctgggtgacagctgctgctgctgtgaccacagctgtgtctgggaagacccccctgagccaggtggacaacagcgtgcagcagcacagccccagcggccaggcctgcctgcagaggcccagcgactgggaggcccaggtgcctgctgccatgggcacccaggtgcccctggccaacaaccccagcttcagcctgctgggcagccagagcctgcggcagagccctgtgcagggccctgtgcctgtggccaacaccaccaagttcctgcagcagggcatggccagcttcagccccctgagccccatccagggcatcgagccccccagctatgtggccgctgctgccacagctgctgctgccagcgctgtggccgccagccagtttcctggcccctttgacagaacagacatccccccagagctgcccccagctgacttcctgcggcagccccagccccccctgaatgacctgatcagcagcccagactgcaatgaggtggacttcatcgaggccctgctgaagggcagctgtgtgtccccagatgaggactgggtgtgcaacctgcggctgattgatgacatcctggagcagcacgccgccgcccagaatgccacagcccagaacagcggccaggtgacccaggatgctggggccctgtag

SEQ ID NO: 158881 - DNA, 1941 bp, Artificial Sequence
  Description of Artificial Sequence: Synthetic coding sequence
atggaggaggaggacctgtccttcctgtacaagagcagccctggcaggaagcaccagggcaccgtgaagaggcggcaggaggaggaccacttccagttcccagacatggctgatggcggctaccccaacaagatcaagaggccctgcctggaggatgtgaccctggccatgggccctggggcccaccccagcacagcctgtgccgagctgcaggtgccccccctgaccatcaaccccagccctgctgccatgggcgtggccggccagagcctgctgctggagaacaaccccatgaatggaaacatcatgggcagcccctttgtggtgccccagaccacagaggtgggcctgaagggccccaccgtgccctactatgagaagatcaacagcgtgcctgctgtggaccaggagctgcaggagctgctggaggagctgaccaagatccaggaccccagccccaatgagctggacctggagaagatcctgggcaccaagccagaggagcccctggtgctggaccacccccaggccaccctgagcaccacccccaagcccagcgtgcagatgagccacctggagagcctggccagcagcaaggagtttgccagcagctgcagccaggtgacaggcatgagcctgcagatccccagcagcagcacaggcatctcctacagcatccccagcaccagcaagcagatcgtgagccccagcagctccatggcccagagcaagagccaggtgcaggccatgctgcctgtggccctgccccccctgcctgtgccccagtggcaccacgcccaccagctgaaggccctggccgccagcaagcagggcagcgccaccaagcagcagggccccacccccagctggagcggcctgcccccacctggcctgagccccccctacagacctgtgcccagcccccaccccccacccctgcccctgcccccacctcctccacccttcagcccccagagcctgatggtgtcctgcatgagcagcaacaccctgagcggcagcaccctgcggggcagccccaatgccctgctgagctccatgaccagcagcagcaatgctgccctgggccctgccatgccctatgcccctgagaagctgcccagccctgccctgacccagcagccccagtttggcccccagagcagcatcctggccaacctgatgagcagcaccatcaagaccccccagggccacctgatgtctgccctgcctgccagcaaccctggccccagccccccctacagacctgagaagctgagcagccctggcctgccccagcagagcttcaccccccagtgcagcctgctgcactacctgcagcagcccacccccacccaggccagcagcgccacagccagcagcacagccacagccaccctgcagctgcagcagcagcagcagcagcagcagcagcagcctgaccacagcagcttcctgctgcagcagatgatgcagcagccccagcgcttccagaggtctgtggccagtgacagcatgcctgccctgccccggcagggctgctgccacctgtttgcctggaccagcgctgccagctctgtgaagccccagcaccagcacggcaacagcttcaccagccggcaggacccccagcctggagatgtgagccccagcaacatcacccacgtggacaaggcctgcaagctgggggaggcccggcacccccaggtgtccctgggccggcagccccccagctgccaggccctgggcagcgagagcttcctgcccggcagcagctttgcccacgagctggcccgggtgaccagcagctacagcaccagcgaggccgccccctggggctcctgggaccccaaggcctggaggcaggtgcctgcccccctgctgcccagctgtgatgccacagcccggggcacagagatccgctcctatggaaatgacccctag

SEQ ID NO: 158882 - DNA, 645 bp, Artificial Sequence
  Description of Artificial Sequence: Synthetic coding sequence
atgatcatgcagcagggcatggccagcagcagccctggggccacagagcccttcaccttcggcaacaccaagcccctgagccactttgtgtctgagcccggcccccagaagatgcccagcatgcccaccaccagccggcagcccagcctgctgcactacctgcagcagcccacccccacccaggccagcagcgccacagccagcagcacagccacagccaccctgcagctgcagcagcagcagcagcagcagcagcagcagcctgaccacagcagcttcctgctgcagcagatgatgcagcagccccagcgcttccagaggtctgtggccagtgacagcatgcctgccctgccccggcagacccacgtggacaaggcctgcaagctgggggaggcccggcacccccaggtgtccctgggccggcagccccccagctgccaggccctgggcagcgagagcttcctgcccggcagcagctttgcccacgagctggcccgggtgaccagcagctacagcaccagcgaggccgccccctggggctcctgggaccccaaggcctggaggcaggtgcctgcccccctgctgcccagctgtgatgccacagcccggggcacagagatccgctcctatggaaatgacccctag

SEQ ID NO: 158883 - DNA, 1956 bp, Artificial Sequence
  Description of Artificial Sequence: Synthetic coding sequence
atgaaggactatgatgagctgctgaagtactatgagctgcacgagaccatcggcactggaggctttgccaaggtgaagctggcctgccacatcctgactggagagatggtggccatcaagatcatggacaagaacaccctgggcagtgacctgccccgcatcaagacagaaattgaggccctgaagaacctgcggcaccagcacatctgccagctgtaccacgtgctggagacagccaacaagatcttcatggtgctggagtactgccctggaggagagctgtttgactacatcatcagccaggaccggctgtctgaggaggagaccagggtggtgttccggcagatcgtgtctgctgtggcctacgtgcacagccagggctacgcccaccgggacctgaagccagagaacctgctgtttgatgagtaccacaagctgaagctgattgactttggcctgtgtgccaagcccaagggcaacaaggactaccacctgcagacctgctgcggcagcctggcctatgctgcccctgagctgatccagggcaagagctacctgggcagcgaggctgatgtgtggagcatgggcatcctgctgtatgtgctgatgtgtggcttcctgccctttgatgatgacaacgtgatggccctgtacaagaagatcatgaggggcaagtatgatgtgcccaagtggctgagccccagcagcatcctgctgctgcagcagatgctgcaggtggaccccaagaagaggatctccatgaagaacctgctgaaccacccctggatcatgcaggactacaactaccctgtggagtggcagagcaagaaccccttcatccacctggatgatgactgtgtgacagagctgtctgtgcaccacaggaacaaccggcagaccatggaggacctgatcagcctgtggcagtatgaccacctgacagccacctacctgctgctgctggccaagaaggcccggggcaagcctgtgcggctgcggctgagcagcttcagctgtggccaggccagcgccacccccttcacagacatcaagagcaacaactggagcctggaggatgtgacagccagtgacaagaactacgtggccggcctgattgattatgactggtgtgaagatgacctgagcactggagctgccacccccaggaccagccagttcaccaagtactggacagagagcaatggagtggagagcaagagcctgaccccagccctgtgcaggaccccagccaacaagctgaagaacaaggaaaatgtgtacacccccaagtctgctgtgaagaatgaggagtacttcatgtttcctgagcccaagacccctgtgaacaagaaccagcacaagcgggagatcctgaccacccccaaccgctacaccacccccagcaaggccaggaaccagtgcctgaaggagacccccatcaagatccctgtgaacagcactggaacagacaagctgatgactggagtcatcagccctgagcggcgctgccgctctgtggagctggacctgaaccaggcccacatggaggagacccccaagaggaagggggccaaggtgtttggcagcctggagcggggcctggacaaggtgatcaccgtgctgaccaggagcaagaggaaaggaagtgccagagatggcccccggcggctgaagctgcactacaacgtgaccaccacccggctggtgaacccagaccagctgctgaatgagatcatgagcatcctgcccaagaagcacgtggactttgtgcagaagggctacaccctgaagtgccagacccagagcgactttgggaaggtgaccatgcagtttgagctggaggtgtgccagctgcagaagccagatgtggtgggcatccggcggcagaggctgaagggagatgcctgggtgtacaagaggctggtggaggacatcctgagcagctgcaaggtgtag

SEQ ID NO: 158884 - DNA, 1743 bp, Artificial Sequence
  Description of Artificial Sequence: Synthetic coding sequence
atgatgaacttcagcaacatcatgaactacatgaagctgctgggccagtactgccctggaggagagctgtttgactacatcatcagccaggaccggctgtctgaggaggagaccagggtggtgttccggcagatcgtgtctgctgtggcctacgtgcacagccagggctacgcccaccgggacctgaagccagagaacctgctgtttgatgagtaccacaagctgaagctgattgactttggcctgtgtgccaagcccaagggcaacaaggactaccacctgcagacctgctgcggcagcctggcctatgctgcccctgagctgatccagggcaagagctacctgggcagcgaggctgatgtgtggagcatgggcatcctgctgtatgtgctgatgtgtggcttcctgccctttgatgatgacaacgtgatggccctgtacaagaagatcatgaggggcaagtatgatgtgcccaagtggctgagccccagcagcatcctgctgctgcagcagatgctgcaggtggaccccaagaagaggatctccatgaagaacctgctgaaccacccctggatcatgcaggactacaactaccctgtggagtggcagagcaagaaccccttcatccacctggatgatgactgtgtgacagagctgtctgtgcaccacaggaacaaccggcagaccatggaggacctgatcagcctgtggcagtatgaccacctgacagccacctacctgctgctgctggccaagaaggcccggggcaagcctgtgcggctgcggctgagcagcttcagctgtggccaggccagcgccacccccttcacagacatcaagagcaacaactggagcctggaggatgtgacagccagtgacaagaactacgtggccggcctgattgattatgactggtgtgaagatgacctgagcactggagctgccacccccaggaccagccagttcaccaagtactggacagagagcaatggagtggagagcaagagcctgaccccagccctgtgcaggaccccagccaacaagctgaagaacaaggaaaatgtgtacacccccaagtctgctgtgaagaatgaggagtacttcatgtttcctgagcccaagacccctgtgaacaagaaccagcacaagcgggagatcctgaccacccccaaccgctacaccacccccagcaaggccaggaaccagtgcctgaaggagacccccatcaagatccctgtgaacagcactggaacagacaagctgatgactggagtcatcagccctgagcggcgctgccgctctgtggagctggacctgaaccaggcccacatggaggagacccccaagaggaaaggagccaaggtgtttggcagcctggagcggggcctggacaaggtgatcaccgtgctgaccaggagcaagaggaagggcagcgccagagatggcccccggcggctgaagctgcactacaacgtgaccaccacccggctggtgaacccagaccagctgctgaatgagatcatgagcatcctgcccaagaagcacgtggactttgtgcagaagggctacaccctgaagtgccagacccagagcgactttgggaaggtgaccatgcagtttgagctggaggtgtgccagctgcagaagccagatgtggtgggcatccggcggcagaggctgaagggagatgcctgggtgtacaagaggctggtggaggacatcctgagcagctgcaaggtgtag

SEQ ID NO: 158885 - DNA, 1812 bp, Artificial Sequence
  Description of Artificial Sequence: Synthetic coding sequence
atgaaggactatgatgagctgctgaagtactatgagctgcacgagaccatcggcactggaggctttgccaaggtgaagctggcctgccacatcctgactggagagatggtggccatcaagatcatggacaagaacaccctgggcagtgacctgccccgcatcaagacagaaattgaggccctgaagaacctgcggcaccagcacatctgccagctgtaccacgtgctggagacagccaacaagatcttcatggtgctggaggagaacctgctgtttgatgagtaccacaagctgaagctgattgactttggcctgtgtgccaagcccaagggcaacaaggactaccacctgcagacctgctgcggcagcctggcctatgctgcccctgagctgatccagggcaagagctacctgggcagcgaggctgatgtgtggagcatgggcatcctgctgtatgtgctgatgtgtggcttcctgccctttgatgatgacaacgtgatggccctgtacaagaagatcatgaggggcaagtatgatgtgcccaagtggctgagccccagcagcatcctgctgctgcagcagatgctgcaggtggaccccaagaagaggatctccatgaagaacctgctgaaccacccctggatcatgcaggactacaactaccctgtggagtggcagagcaagaaccccttcatccacctggatgatgactgtgtgacagagctgtctgtgcaccacaggaacaaccggcagaccatggaggacctgatcagcctgtggcagtatgaccacctgacagccacctacctgctgctgctggccaagaaggcccggggcaagcctgtgcggctgcggctgagcagcttcagctgtggccaggccagcgccacccccttcacagacatcaagagcaacaactggagcctggaggatgtgacagccagtgacaagaactacgtggccggcctgattgattatgactggtgtgaagatgacctgagcactggagctgccacccccaggaccagccagttcaccaagtactggacagagagcaatggagtggagagcaagagcctgaccccagccctgtgcaggaccccagccaacaagctgaagaacaaggaaaatgtgtacacccccaagtctgctgtgaagaatgaggagtacttcatgtttcctgagcccaagacccctgtgaacaagaaccagcacaagcgggagatcctgaccacccccaaccgctacaccacccccagcaaggccaggaaccagtgcctgaaggagacccccatcaagatccctgtgaacagcactggaacagacaagctgatgactggagtcatcagccctgagcggcgctgccgctctgtggagctggacctgaaccaggcccacatggaggagacccccaagaggaagggggccaaggtgtttggcagcctggagcggggcctggacaaggtgatcaccgtgctgaccaggagcaagaggaaaggaagtgccagagatggcccccggcggctgaagctgcactacaacgtgaccaccacccggctggtgaacccagaccagctgctgaatgagatcatgagcatcctgcccaagaagcacgtggactttgtgcagaagggctacaccctgaagtgccagacccagagcgactttgggaaggtgaccatgcagtttgagctggaggtgtgccagctgcagaagccagatgtggtgggcatccggcggcagaggctgaagggagatgcctgggtgtacaagaggctggtggaggacatcctgagcagctgcaaggtgtag

SEQ ID NO: 158886 - DNA, 1563 bp, Artificial Sequence
  Description of Artificial Sequence: Synthetic coding sequence
atggtgctggaggagaacctgctgtttgatgagtaccacaagctgaagctgattgactttggcctgtgtgccaagcccaagggcaacaaggactaccacctgcagacctgctgcggcagcctggcctatgctgcccctgagctgatccagggcaagagctacctgggcagcgaggctgatgtgtggagcatgggcatcctgctgtatgtgctgatgtgtggcttcctgccctttgatgatgacaacgtgatggccctgtacaagaagatcatgaggggcaagtatgatgtgcccaagtggctgagccccagcagcatcctgctgctgcagcagatgctgcaggtggaccccaagaagaggatctccatgaagaacctgctgaaccacccctggatcatgcaggactacaactaccctgtggagtggcagagcaagaaccccttcatccacctggatgatgactgtgtgacagagctgtctgtgcaccacaggaacaaccggcagaccatggaggacctgatcagcctgtggcagtatgaccacctgacagccacctacctgctgctgctggccaagaaggcccggggcaagcctgtgcggctgcggctgagcagcttcagctgtggccaggccagcgccacccccttcacagacatcaagagcaacaactggagcctggaggatgtgacagccagtgacaagaactacgtggccggcctgattgattatgactggtgtgaagatgacctgagcactggagctgccacccccaggaccagccagttcaccaagtactggacagagagcaatggagtggagagcaagagcctgaccccagccctgtgcaggaccccagccaacaagctgaagaacaaggaaaatgtgtacacccccaagtctgctgtgaagaatgaggagtacttcatgtttcctgagcccaagacccctgtgaacaagaaccagcacaagcgggagatcctgaccacccccaaccgctacaccacccccagcaaggccaggaaccagtgcctgaaggagacccccatcaagatccctgtgaacagcactggaacagacaagctgatgactggagtcatcagccctgagcggcgctgccgctctgtggagctggacctgaaccaggcccacatggaggagacccccaagaggaaaggagccaaggtgtttggcagcctggagcggggcctggacaaggtgatcaccgtgctgaccaggagcaagaggaagggcagcgccagagatggcccccggcggctgaagctgcactacaacgtgaccaccacccggctggtgaacccagaccagctgctgaatgagatcatgagcatcctgcccaagaagcacgtggactttgtgcagaagggctacaccctgaagtgccagacccagagcgactttgggaaggtgaccatgcagtttgagctggaggtgtgccagctgcagaagccagatgtggtgggcatccggcggcagaggctgaagggagatgcctgggtgtacaagaggctggtggaggacatcctgagcagctgcaaggtgtag

SEQ ID NO: 158887 - DNA, 1374 bp, Artificial Sequence
  Description of Artificial Sequence: Synthetic coding sequence
atgggcatcctgctgtatgtgctgatgtgtggcttcctgccctttgatgatgacaacgtgatggccctgtacaagaagatcatgaggggcaagtatgatgtgcccaagtggctgagccccagcagcatcctgctgctgcagcagatgctgcaggtggaccccaagaagaggatctccatgaagaacctgctgaaccacccctggatcatgcaggactacaactaccctgtggagtggcagagcaagaaccccttcatccacctggatgatgactgtgtgacagagctgtctgtgcaccacaggaacaaccggcagaccatggaggacctgatcagcctgtggcagtatgaccacctgacagccacctacctgctgctgctggccaagaaggcccggggcaagcctgtgcggctgcggctgagcagcttcagctgtggccaggccagcgccacccccttcacagacatcaagagcaacaactggagcctggaggatgtgacagccagtgacaagaactacgtggccggcctgattgattatgactggtgtgaagatgacctgagcactggagctgccacccccaggaccagccagttcaccaagtactggacagagagcaatggagtggagagcaagagcctgaccccagccctgtgcaggaccccagccaacaagctgaagaacaaggaaaatgtgtacacccccaagtctgctgtgaagaatgaggagtacttcatgtttcctgagcccaagacccctgtgaacaagaaccagcacaagcgggagatcctgaccacccccaaccgctacaccacccccagcaaggccaggaaccagtgcctgaaggagacccccatcaagatccctgtgaacagcactggaacagacaagctgatgactggagtcatcagccctgagcggcgctgccgctctgtggagctggacctgaaccaggcccacatggaggagacccccaagaggaagggggccaaggtgtttggcagcctggagcggggcctggacaaggtgatcaccgtgctgaccaggagcaagaggaaaggaagtgccagagatggcccccggcggctgaagctgcactacaacgtgaccaccacccggctggtgaacccagaccagctgctgaatgagatcatgagcatcctgcccaagaagcacgtggactttgtgcagaagggctacaccctgaagtgccagacccagagcgactttgggaaggtgaccatgcagtttgagctggaggtgtgccagctgcagaagccagatgtggtgggcatccggcggcagaggctgaagggagatgcctgggtgtacaagaggctggtggaggacatcctgagcagctgcaaggtgtag

SEQ ID NO: 158888 - DNA, 1833 bp, Artificial Sequence
  Description of Artificial Sequence: Synthetic coding sequence
atgaaggactatgatgagctgctgaagtactatgagctgcacgagaccatcggcactggaggctttgccaaggtgaagctggcctgccacatcctgactggagagatggtggccatcaagatcatggacaagaacaccctgggcagtgacctgccccgcatcaagacagaaattgaggccctgaagaacctgcggcaccagcacatctgccagctgtaccacgtgctggagacagccaacaagatcttcatggtgctggagtactgccctggaggagagctgtttgactacatcatcagccaggaccggctgtctgaggaggagaccagggtggtgttccggcagatcgtgtctgctgtggcctacgtgcacagccagggctacgcccaccgggacctgaagccagagaacctgctgtttgatgagtaccacaagctgaagctgattgactttggcctgtgtgccaagcccaagggcaacaaggactaccacctgcagacctgctgcggcagcctggcctatgctgcccctgagctgatccagggcaagagctacctgggcagcgaggctgatgtgtggagcatgggcatcctgctgtatgtgctgatgtgtggcttcctgccctttgatgatgacaacgtgatggccctgtacaagaagatcatgaggggcaagtatgatgtgcccaagtggctgagccccagcagcatcctgctgctgcagcagatgctgcaggtggaccccaagaagaggatctccatgaagaacctgctgaaccacccctggatcatgcaggactacaactaccctgtggagtggcagagcaagaaccccttcatccacctggatgatgactgtgtgacagagctgtctgtgcaccacaggaacaaccggcagaccatggaggacctgatcagcctgtggcagtatgaccacctgacagccacctacctgctgctgctggccaagaaggcccggggcaagcctgtgcggctgcggctgagcagcttcagctgtggccaggccagcgccacccccttcacagacatcaagttcaccaagtactggacagagagcaatggagtggagagcaagagcctgaccccagccctgtgcaggaccccagccaacaagctgaagaacaaggaaaatgtgtacacccccaagtctgctgtgaagaatgaggagtacttcatgtttcctgagcccaagacccctgtgaacaagaaccagcacaagcgggagatcctgaccacccccaaccgctacaccacccccagcaaggccaggaaccagtgcctgaaggagacccccatcaagatccctgtgaacagcactggaacagacaagctgatgactggagtcatcagccctgagcggcgctgccgctctgtggagctggacctgaaccaggcccacatggaggagacccccaagaggaaaggagccaaggtgtttggcagcctggagcggggcctggacaaggtgatcaccgtgctgaccaggagcaagaggaagggcagcgccagagatggcccccggcggctgaagctgcactacaacgtgaccaccacccggctggtgaacccagaccagctgctgaatgagatcatgagcatcctgcccaagaagcacgtggactttgtgcagaagggctacaccctgaagtgccagacccagagcgactttgggaaggtgaccatgcagtttgagctggaggtgtgccagctgcagaagccagatgtggtgggcatccggcggcagaggctgaagggagatgcctgggtgtacaagaggctggtggaggacatcctgagcagctgcaaggtgtag

SEQ ID NO: 158889 - DNA, 1860 bp, Artificial Sequence
  Description of Artificial Sequence: Synthetic coding sequence
atgatgaacttcagcaacatcatgaactacatgaagctgctgggccagagcgacctgccccgcatcaagacagaaattgaggccctgaagaacctgcggcaccagcacatctgccagctgtaccacgtgctggagacagccaacaagatcttcatggtgctggagtactgccctggaggagagctgtttgactacatcatcagccaggaccggctgtctgaggaggagaccagggtggtgttccggcagatcgtgtctgctgtggcctacgtgcacagccagggctacgcccaccgggacctgaagccagagaacctgctgtttgatgagtaccacaagctgaagctgattgactttggcctgtgtgccaagcccaagggcaacaaggactaccacctgcagacctgctgcggcagcctggcctatgctgcccctgagctgatccagggcaagagctacctgggcagcgaggctgatgtgtggagcatgggcatcctgctgtatgtgctgatgtgtggcttcctgccctttgatgatgacaacgtgatggccctgtacaagaagatcatgaggggcaagtatgatgtgcccaagtggctgagccccagcagcatcctgctgctgcagcagatgctgcaggtggaccccaagaagaggatctccatgaagaacctgctgaaccacccctggatcatgcaggactacaactaccctgtggagtggcagagcaagaaccccttcatccacctggatgatgactgtgtgacagagctgtctgtgcaccacaggaacaaccggcagaccatggaggacctgatcagcctgtggcagtatgaccacctgacagccacctacctgctgctgctggccaagaaggcccggggcaagcctgtgcggctgcggctgagcagcttcagctgtggccaggccagcgccacccccttcacagacatcaagagcaacaactggagcctggaggatgtgacagccagtgacaagaactacgtggccggcctgattgattatgactggtgtgaagatgacctgagcactggagctgccacccccaggaccagccagttcaccaagtactggacagagagcaatggagtggagagcaagagcctgaccccagccctgtgcaggaccccagccaacaagctgaagaacaaggaaaatgtgtacacccccaagtctgctgtgaagaatgaggagtacttcatgtttcctgagcccaagacccctgtgaacaagaaccagcacaagcgggagatcctgaccacccccaaccgctacaccacccccagcaaggccaggaaccagtgcctgaaggagacccccatcaagatccctgtgaacagcactggaacagacaagctgatgactggagtcatcagccctgagcggcgctgccgctctgtggagctggacctgaaccaggcccacatggaggagacccccaagaggaagggggccaaggtgtttggcagcctggagcggggcctggacaaggtgatcaccgtgctgaccaggagcaagaggaaaggaagtgccagagatggcccccggcggctgaagctgcactacaacgtgaccaccacccggctggtgaacccagaccagctgctgaatgagatcatgagcatcctgcccaagaagcacgtggactttgtgcagaagggctacaccctgaagtgccagacccagagcgactttgggaaggtgaccatgcagtttgagctggaggtgtgccagctgcagaagccagatgtggtgggcatccggcggcagaggctgaagggagatgcctgggtgtacaagaggctggtggaggacatcctgagcagctgcaaggtgtag

SEQ ID NO: 158890 - DNA, 1743 bp, Artificial Sequence
  Description of Artificial Sequence: Synthetic coding sequence
atgaaggactatgatgagctgctgaagtactatgagctgcacgagaccatcggcactggaggctttgccaaggtgaagctggcctgccacatcctgactggagagatggtggccatcaagatcatggacaagaacaccctgggcagtgacctgccccgcatcaagacagaaattgaggccctgaagaacctgcggcaccagcacatctgccagctgtaccacgtgctggagacagccaacaagatcttcatggtgctggagggcaacaaggactaccacctgcagacctgctgcggcagcctggcctatgctgcccctgagctgatccagggcaagagctacctgggcagcgaggctgatgtgtggagcatgggcatcctgctgtatgtgctgatgtgtggcttcctgccctttgatgatgacaacgtgatggccctgtacaagaagatcatgaggggcaagtatgatgtgcccaagtggctgagccccagcagcatcctgctgctgcagcagatgctgcaggtggaccccaagaagaggatctccatgaagaacctgctgaaccacccctggatcatgcaggactacaactaccctgtggagtggcagagcaagaaccccttcatccacctggatgatgactgtgtgacagagctgtctgtgcaccacaggaacaaccggcagaccatggaggacctgatcagcctgtggcagtatgaccacctgacagccacctacctgctgctgctggccaagaaggcccggggcaagcctgtgcggctgcggctgagcagcttcagctgtggccaggccagcgccacccccttcacagacatcaagagcaacaactggagcctggaggatgtgacagccagtgacaagaactacgtggccggcctgattgattatgactggtgtgaagatgacctgagcactggagctgccacccccaggaccagccagttcaccaagtactggacagagagcaatggagtggagagcaagagcctgaccccagccctgtgcaggaccccagccaacaagctgaagaacaaggaaaatgtgtacacccccaagtctgctgtgaagaatgaggagtacttcatgtttcctgagcccaagacccctgtgaacaagaaccagcacaagcgggagatcctgaccacccccaaccgctacaccacccccagcaaggccaggaaccagtgcctgaaggagacccccatcaagatccctgtgaacagcactggaacagacaagctgatgactggagtcatcagccctgagcggcgctgccgctctgtggagctggacctgaaccaggcccacatggaggagacccccaagaggaaaggagccaaggtgtttggcagcctggagcggggcctggacaaggtgatcaccgtgctgaccaggagcaagaggaagggcagcgccagagatggcccccggcggctgaagctgcactacaacgtgaccaccacccggctggtgaacccagaccagctgctgaatgagatcatgagcatcctgcccaagaagcacgtggactttgtgcagaagggctacaccctgaagtgccagacccagagcgactttgggaaggtgaccatgcagtttgagctggaggtgtgccagctgcagaagccagatgtggtgggcatccggcggcagaggctgaagggagatgcctgggtgtacaagaggctggtggaggacatcctgagcagctgcaaggtgtag

SEQ ID NO: 158891 - DNA, 1491 bp, Artificial Sequence
  Description of Artificial Sequence: Synthetic coding sequence
atgagggtgctgagcggcaccagcctgatgctgtgcagcctgctgctgctgctgcaggccctgtgcagccctggcctggccccccagagccggggccacctgtgcaggacccggcccacagacctggtgtttgtggtggacagcagccgctctgtgcggcctgtggagtttgagaaggtgaaggtgttcctgagccaggtgattgagagcctggatgtgggccccaatgccaccagggtgggcatggtgaactatgccagcacagtgaagcaggagttcagcctgcgggcccacgtgtccaaggccgccctgctgcaggccgtgcggcgcatccagcccctgagcacaggcaccatgacaggcctggccatccagtttgccatcaccaaggcctttggagatgctgagggcggccgcagccgcagcccagacatcagcaaggtggtgattgtggtgacagatggccggccccaggacagcgtgcaggatgtgtctgcccgggcccgggccagcggcgtggagctgtttgccatcggcgtgggctctgtggacaaggccaccctgcggcagatcgccagcgagccccaggatgaacatgtggactatgtggagagctacagcgtgattgagaagctgagcaggaagttccaggaggccttctgtgtggtgtctgacctgtgtgccactggagaccatgactgtgagcaggtgtgcatcagcagccctggcagctacacctgtgcctgccacgagggcttcaccctgaacagtgatggcaagacctgcaatgtgtgcagcggcggcggcggcagcagcgccacagacctggtgttcctgattgatggcagcaagtctgtgcggccagaaaattttgagctggtgaagaagttcatcagccagatcgtggacaccctggatgtgtctgacaagctggcccaggtgggcctggtgcagtacagcagctctgtgcggcaggagttccccctgggccgcttccacaccaagaaggacatcaaggctgctgtgaggaacatgagctacatggagaagggcaccatgaccggggccgccctgaagtacctgattgacaacagcttcaccgtgagcagcggggcccggcctggggcccagaaggtgggcatcgtgttcacagatggccgcagccaggactacatcaatgatgctgccaagaaggccaaggacctgggcttcaagatgtttgctgtgggcgtgggcaatgctgtggaggatgagctgcgggagatcgccagcgagcctgtggccgagcactacttctacacagctgacttcaagaccatcaaccagatcggcaagaagctgcagaagaagatctgtgtggaggaggacccctgtgcctgtgagagcctggtgaagttccaggccaaggtggagggcctgctgcaggccctgaccaggaagctggaggccgtgtccaagaggctggccatcctggagaacacagtggtgtag

SEQ ID NO: 158892 - DNA, 2874 bp, Artificial Sequence
  Description of Artificial Sequence: Synthetic coding sequence
atggagaagatgctggccggctgcttcctgctgatcctgggccagatcgtgctgctgcctgctgaggcccgggagaggagccggggccgcagcatcagccggggcagacatgcccggacccacccccagacagccctgctggagagcagctgtgagaacaagagagctgacctggtgttcatcatcgacagcagccgctctgtgaacacccatgactatgccaaggtgaaggagttcatcgtggacatcctgcagttcctggacattggaccagatgtgaccagggtgggcctgctgcagtatggcagcacagtgaagaatgagttcagcctgaagaccttcaagaggaagtctgaggtggagagagctgtgaagaggatgaggcacctgagcacaggcaccatgacaggcctggccatccagtatgccctgaacatcgccttcagcgaggccgagggcgcccggcccctgagagaaaatgtgcccagggtcatcatgattgtgacagatggccggccccaggacagcgtggccgaggtggccgccaaggcccgggacaccggcatcctgatctttgccatcggcgtgggccaggtggacttcaacaccctgaagagcatcggcagcgagccccatgaagatcatgtgttcctggtggccaacttcagccagatcgagaccctgaccagcgtcttccagaagaagctgtgcacagcccacatgtgcagcaccctggagcacaactgtgcccacttctgcatcaacatccctggcagctatgtgtgccgctgcaagcagggctacatcctgaacagcgaccagaccacctgccgcatccaggacctgtgtgccatggaggaccacaactgtgagcagctgtgtgtgaatgtgcccggcagctttgtgtgccagtgctacagcggctacgccctggctgaagatggcaagagatgtgtggccgtggactactgtgcctctgaaaatcatggctgtgaacatgaatgtgtgaatgctgatggcagctacctgtgccagtgccacgagggctttgccctgaacccagacaagaagacctgcaccaagattgactactgtgccagcagcaaccacggctgccagcatgaatgtgtgaacacagatgacagctacagctgccactgcctgaagggcttcaccctgaacccagacaagaagacctgccgccgcatcaactactgtgccctgaacaagccaggctgtgaacatgaatgtgtgaacatggaggagagctactactgccgctgccaccggggctacaccctggaccccaacgggaagacctgcagccgggtggaccactgtgcccagcaggaccacggctgtgagcagctgtgcctgaacacagaggacagctttgtgtgccagtgcagcgagggcttcctgatcaatgaagacctgaagacctgcagccgggtggactactgcctgctgagtgaccacggctgtgagtacagctgtgtgaacatggacaggagctttgcctgccagtgcccagagggccacgtgctgcggagtgatggcaagacctgtgccaagctggacagctgtgccctgggggaccacggctgtgagcacagctgtgtgtcctctgaggacagctttgtgtgccagtgctttgagggctacatcctgagagaagatggcaagacctgcaggaggaaggatgtgtgccaggccatcgaccacggctgtgagcacatctgtgtgaacagtgatgacagctacacctgtgaatgtctggagggcttccggctggccgaggatggcaagcgctgcaggaggaaggatgtgtgcaagagcacccaccacggctgtgagcacatctgtgtgaacaatggaaacagctacatctgcaagtgcagcgagggctttgtgctggctgaagatggccgccgctgcaagaagtgcacagagggccccatcgacctggtgtttgtgattgatggcagcaagagcctgggggaggagaactttgaggtggtgaagcagtttgtgacaggcatcatcgacagcctgaccatcagccccaaggccgcccgggtgggcctgctgcagtacagcacccaggtgcacacagagttcaccctgaggaacttcaacagcgccaaggacatgaagaaggctgtggcccacatgaagtacatgggcaagggctccatgacaggcctggccctgaagcacatgtttgagaggagcttcacccagggcgagggcgcccggcccctgagcaccagggtgccccgggccgccatcgtgttcacagatggccgggcccaggatgatgtgtctgagtgggccagcaaggccaaggccaacggcatcaccatgtatgctgtgggcgtgggcaaggccatcgaggaggagctgcaggagatcgccagcgagcccaccaacaagcacctgttctatgcagaggacttcagcaccatggatgagatcagcgagaagctgaagaagggcatctgtgaggccctggaggacagtgatggccggcaggacagccctgctggggagctgcccaagacagtgcagcagcccacagagagcgagcctgtgaccatcaacatccaggacctgctgagctgcagcaactttgctgtgcagcaccgctacctgtttgaggaggacaacctgctgcggagcacccagaagctgagccacagcaccaagcccagcggcagccccctggaggagaagcatgaccagtgcaagtgtgaaaatctcatcatgttccagaacctggccaatgaggaggtgaggaagctgacccagaggctgctggaggagatgacccagaggatggaggccctggagaaccggctgcgctacagatag

SEQ ID NO: 158893 - DNA, 2754 bp, Artificial Sequence
  Description of Artificial Sequence: Synthetic coding sequence
atggagaagatgctggccggctgcttcctgctgatcctgggccagatcgtgctgctgcctgctgaggcccgggagaggagccggggccgcagcatcagccggggcagacatgcccggacccacccccagacagccctgctggagagcagctgtgagaacaagagagctgacctggtgttcatcatcgacagcagccgctctgtgaacacccatgactatgccaaggtgaaggagttcatcgtggacatcctgcagttcctggacattggaccagatgtgaccagggtgggcctgctgcagtatggcagcacagtgaagaatgagttcagcctgaagaccttcaagaggaagtctgaggtggagagagctgtgaagaggatgaggcacctgagcacaggcaccatgacaggcctggccatccagtatgccctgaacatcgccttcagcgaggccgagggcgcccggcccctgagagaaaatgtgcccagggtcatcatgattgtgacagatggccggccccaggacagcgtggccgaggtggccgccaaggcccgggacaccggcatcctgatctttgccatcggcgtgggccaggtggacttcaacaccctgaagagcatcggcagcgagccccatgaagatcatgtgttcctggtggccaacttcagccagatcgagaccctgaccagcgtcttccagaagaagctgtgcacagcccacatgtgcagcaccctggagcacaactgtgcccacttctgcatcaacatccctggcagctatgtgtgccgctgcaagcagggctacatcctgaacagcgaccagaccacctgccgcatccaggacctgtgtgccatggaggaccacaactgtgagcagctgtgtgtgaatgtgcccggcagctttgtgtgccagtgctacagcggctacgccctggctgaagatggcaagagatgtgtggccgtggactactgtgcctctgaaaatcatggctgtgaacatgaatgtgtgaatgctgatggcagctacctgtgccagtgccacgagggctttgccctgaacccagacaagaagacctgcacccgcatcaactactgtgccctgaacaagccaggctgtgaacatgaatgtgtgaacatggaggagagctactactgccgctgccaccggggctacaccctggaccccaacgggaagacctgcagccgggtggaccactgtgcccagcaggaccacggctgtgagcagctgtgcctgaacacagaagattcttttgtgtgccagtgcagcgagggcttcctgatcaatgaagacctgaagacctgcagccgggtggactactgcctgctgagtgaccacggctgtgagtacagctgtgtgaacatggacaggagctttgcctgccagtgcccagagggccacgtgctgcggagtgatggcaagacctgtgccaagctggacagctgtgccctgggggaccacggctgtgagcacagctgtgtgtccagtgaagattcttttgtgtgccagtgctttgagggctacatcctgcgggaggatggcaagacctgcaggaggaaggatgtgtgccaggccatcgaccacggctgtgagcacatctgtgtgaacagtgatgacagctacacctgtgagtgcctggagggcttccggctggctgaagatggcaagcgctgcaggaggaaggatgtgtgcaagagcacccaccacggctgtgagcacatctgtgtgaacaacggcaacagctacatctgcaagtgcagcgagggctttgtgctggccgaggatggaagacgctgcaagaagtgcacagagggccccatcgacctggtgtttgtgattgatggcagcaagagcctgggggaggagaactttgaggtggtgaagcagtttgtgacaggcatcatcgacagcctgaccatcagccccaaggccgcccgggtgggcctgctgcagtacagcacccaggtgcacacagagttcaccctgaggaacttcaacagcgccaaggacatgaagaaggctgtggcccacatgaagtacatgggcaagggctccatgacaggcctggccctgaagcacatgtttgagaggagcttcacccagggcgagggcgcccggcccctgagcaccagggtgcccagggctgccatcgtgttcacagatggccgggcccaggatgatgtgtctgagtgggccagcaaggccaaggccaacggcatcaccatgtatgctgtgggcgtgggcaaggccatcgaggaggagctgcaggagatcgccagcgagcccaccaacaagcacctgttctatgcagaggacttcagcaccatggatgagatcagcgagaagctgaagaagggcatctgtgaggccctggaggacagtgatggccggcaggacagccctgctggggagctgcccaagacagtgcagcagcccacagaaagtgagcctgtgaccatcaacatccaggacctgctgagctgcagcaactttgctgtgcagcaccgctacctgtttgaggaggacaacctgctgcggagcacccagaagctgagccacagcaccaagcccagcggcagccccctggaggagaagcatgaccagtgcaagtgtgagaacctgatcatgttccagaacctggccaatgaggaggtgaggaagctgacccagcgctacctgctggaggagatgacccagaggatggaggccctggagaaccggctgcgctacagatag

SEQ ID NO: 158894 - DNA, 348 bp, Artificial Sequence
  Description of Artificial Sequence: Synthetic coding sequence
atggaggaccacaactgtgagcagctgtgtgtgaatgtgcccggcagctttgtgtgccagtgctacagcggctacgccctggctgaagatggcaagagatgtgtggccgtggactactgtgcctctgaaaatcatggctgtgaacatgaatgtgtgaatgctgatggcagctacctgtgccagtgccacgagggctttgccctgaacccagacaagaagacctgcaccaagattgactactgtgccagcagcaaccacggctgccagcatgaatgtgtgaacacagatgacagctacagctgccactgcctgaagggcttcaccctgaacccagacaagaagacctag

SEQ ID NO: 158895 - DNA, 2871 bp, Artificial Sequence
  Description of Artificial Sequence: Synthetic coding sequence
atggagaagatgctggccggctgcttcctgctgatcctgggccagatcgtgctgctgcctgctgaggcccgggagaggagccggggccgcagcatcagccggggcagacatgcccggacccacccccagacagccctgctggagagcagctgtgagaacaagagagctgacctggtgttcatcatcgacagcagccgctctgtgaacacccatgactatgccaaggtgaaggagttcatcgtggacatcctgcagttcctggacattggaccagatgtgaccagggtgggcctgctgcagtatggcagcacagtgaagaatgagttcagcctgaagaccttcaagaggaagtctgaggtggagagagctgtgaagaggatgaggcacctgagcacaggcaccatgacaggcctggccatccagtatgccctgaacatcgccttcagcgaggccgagggcgcccggcccctgagagaaaatgtgcccagggtcatcatgattgtgacagatggccggccccaggacagcgtggccgaggtggccgccaaggcccgggacaccggcatcctgatctttgccatcggcgtgggccaggtggacttcaacaccctgaagagcatcggcagcgagccccatgaagatcatgtgttcctggtggccaacttcagccagatcgagaccctgaccagcgtcttccagaagaagctgtgcacagcccacatgtgcagcaccctggagcacaactgtgcccacttctgcatcaacatccctggcagctatgtgtgccgctgcaagcagggctacatcctgaacagcgaccagaccacctgccgcatccaggacctgtgtgccatggaggaccacaactgtgagcagctgtgtgtgaatgtgcccggcagctttgtgtgccagtgctacagcggctacgccctggctgaagatggcaagagatgtgtggccgtggactactgtgcctctgaaaatcatggctgtgaacatgaatgtgtgaatgctgatggcagctacctgtgccagtgccacgagggctttgccctgaacccagacaagaagacctgcaccaagattgactactgtgccagcagcaaccacggctgccagcatgaatgtgtgaacacagatgacagctacagctgccactgcctgaagggcttcaccctgaacccagacaagaagacctgccgccgcatcaactactgtgccctgaacaagccaggctgtgaacatgaatgtgtgaacatggaggagagctactactgccgctgccaccggggctacaccctggaccccaacgggaagacctgcagccgggtggaccactgtgcccagcaggaccacggctgtgagcagctgtgcctgaacacagaggacagctttgtgtgccagtgcagcgagggcttcctgatcaatgaagacctgaagacctgcagccgggtggactactgcctgctgagtgaccacggctgtgagtacagctgtgtgaacatggacaggagctttgcctgccagtgcccagagggccacgtgctgcggagtgatggcaagacctgtgccaagctggacagctgtgccctgggggaccacggctgtgagcacagctgtgtgtcctctgaggacagctttgtgtgccagtgctttgagggctacatcctgagagaagatggcaagacctgcaggaggaaggatgtgtgccaggccatcgaccacggctgtgagcacatctgtgtgaacagtgatgacagctacacctgtgaatgtctggagggcttccggctggccgaggatggcaagcgctgcaggaggaaggatgtgtgcaagagcacccaccacggctgtgagcacatctgtgtgaacaatggaaacagctacatctgcaagtgcagcgagggctttgtgctggctgaagatggccgccgctgcaagaagtgcacagagggccccatcgacctggtgtttgtgattgatggcagcaagagcctgggggaggagaactttgaggtggtgaagcagtttgtgacaggcatcatcgacagcctgaccatcagccccaaggccgcccgggtgggcctgctgcagtacagcacccaggtgcacacagagttcaccctgaggaacttcaacagcgccaaggacatgaagaaggctgtggcccacatgaagtacatgggcaagggctccatgacaggcctggccctgaagcacatgtttgagaggagcttcacccagggcgagggcgcccggcccctgagcaccagggtgccccgggccgccatcgtgttcacagatggccgggcccaggatgatgtgtctgagtgggccagcaaggccaaggccaacggcatcaccatgtatgctgtgggcgtgggcaaggccatcgaggaggagctgcaggagatcgccagcgagcccaccaacaagcacctgttctatgcagaggacttcagcaccatggatgagatcagcgagaagctgaagaagggcatctgtgaggccctggaggacagtgatggccggcaggacagccctgctggggagctgcccaagacagtgcagcagcccacagagagcgagcctgtgaccatcaacatccaggacctgctgagctgcagcaactttgctgtgcagcaccgctacctgtttgaggaggacaacctgctgcggagcacccagaagctgagccacagcaccaagcccagcggcagccccctggaggagaagcatgaccagtgcaagtgtgaaaatctcatcatgttccagaacctggccaatgaggaggtgaggaagctgacccagaggctggaggagatgacccagaggatggaggccctggagaaccggctgcgctacagatag

SEQ ID NO: 158896 - DNA, 2814 bp, Artificial Sequence
  Description of Artificial Sequence: Synthetic coding sequence
atggagaagatgctggccggctgcttcctgctgatcctgggccagatcgtgctgctgcctgctgaggcccgggagaggagccggggccgcagcatcagccggggcagacatgcccggacccacccccagacagccctgctggagagcagctgtgagaacaagagagctgacctggtgttcatcatcgacagcagccgctctgtgaacacccatgactatgccaaggtgaaggagttcatcgtggacatcctgcagttcctggacattggaccagatgtgaccagggtgggcctgctgcagtatggcagcacagtgaagaatgagttcagcctgaagaccttcaagaggaagtctgaggtggagagagctgtgaagaggatgaggcacctgagcacaggcaccatgacaggcctggccatccagtatgccctgaacatcgccttcagcgaggccgagggcgcccggcccctgagagaaaatgtgcccagggtcatcatgattgtgacagatggccggccccaggacagcgtggccgaggtggccgccaaggcccgggacaccggcatcctgatctttgccatcggcgtgggccaggtggacttcaacaccctgaagagcatcggcagcgagccccatgaagatcatgtgttcctggtggccaacttcagccagatcgagaccctgaccagcgtcttccagaagaagctgtgcacagcccacatgtgcagcaccctggagcacaactgtgcccacttctgcatcaacatccctggcagctatgtgtgccgctgcaagcagggctacatcctgaacagcgaccagaccacctgccgcatccaggacctgtgtgccatggaggaccacaactgtgagcagctgtgtgtgaatgtgcccggcagctttgtgtgccagtgctacagcggctacgccctggctgaagatggcaagagatgtgtggccgtggactactgtgcctctgaaaatcatggctgtgaacatgaatgtgtgaatgctgatggcagctacctgtgccagtgccacgagggctttgccctgaacccagacaagaagacctgcaccaagattgactactgtgccagcagcaaccacggctgccagcatgaatgtgtgaacacagatgacagctacagctgccactgcctgaagggcttcaccctgaacccagacaagaagacctgccgccgcatcaactactgtgccctgaacaagccaggctgtgaacatgaatgtgtgaacatggaggagagctactactgccgctgccaccggggctacaccctggaccccaacgggaagacctgcagccgggtggaccactgtgcccagcaggaccacggctgtgagcagctgtgcctgaacacagaggacagctttgtgtgccagtgcagcgagggcttcctgatcaatgaagacctgaagacctgcagccgggtggactactgcctgctgagtgaccacggctgtgagtacagctgtgtgaacatggacaggagctttgcctgccagtgcccagagggccacgtgctgcggagtgatggcaagacctgtgccaagctggacagctgtgccctgggggaccacggctgtgagcacagctgtgtgtcctctgaggacagctttgtgtgccagtgctttgagggctacatcctgagagaagatggcaagacctgcaggaggaaggatgtgtgccaggccatcgaccacggctgtgagcacatctgtgtgaacagtgatgacagctacacctgtgaatgtctggagggcttccggctggccgaggatggcaagcgctgcaggaggaaggatgtgtgcaagagcacccaccacggctgtgagcacatctgtgtgaacaatggaaacagctacatctgcaagtgcagcgagggctttgtgctggctgaagatggccgccgctgcaagaagtgcacagagggccccatcgacctggtgtttgtgattgatggcagcaagagcctgggggaggagaactttgaggtggtgaagcagtttgtgacaggcatcatcgacagcctgaccatcagccccaaggccgcccgggtgggcctgctgcagtacagcacccaggtgcacacagagttcaccctgaggaacttcaacagcgccaaggacatgaagaaggctgtggcccacatgaagtacatgggcaagggctccatgacaggcctggccctgaagcacatgtttgagaggagcttcacccagggcgagggcgcccggcccctgagcaccagggtgccccgggccgccatcgtgttcacagatggccgggcccaggatgatgtgtctgagtgggccagcaaggccaaggccaacggcatcaccatgtatgctgtgggcgtgggcaaggccatcgaggaggagctgcaggagatcgccagcgagcccaccaacaagcacctgttctatgcagaggacttcagcaccatggatgagatcagcgagaagctgaagaagggcatctgtgaggccctggaggacagtgatggccggcaggacagccctgctggggagctgcccaagacagtgcagcagcccaccgtgcagcaccgctacctgtttgaggaggacaacctgctgcggagcacccagaagctgagccacagcaccaagcccagcggcagccccctggaggagaagcatgaccagtgcaagtgtgagaacctgatcatgttccagaacctggccaatgaggaggtgaggaagctgacccagaggctggaggagatgacccagaggatggaggccctggagaaccggctgcgctacagatag

SEQ ID NO: 158897 - DNA, 2019 bp, Artificial Sequence
  Description of Artificial Sequence: Synthetic coding sequence
atggaggaccacaactgtgagcagctgtgtgtgaatgtgcccggcagctttgtgtgccagtgctacagcggctacgccctggctgaagatggcaagagatgtgtggccgtggactactgtgcctctgaaaatcatggctgtgaacatgaatgtgtgaatgctgatggcagctacctgtgccagtgccacgagggctttgccctgaacccagacaagaagacctgcaccaagattgactactgtgccagcagcaaccacggctgccagcatgaatgtgtgaacacagatgacagctacagctgccactgcctgaagggcttcaccctgaacccagacaagaagacctgccgccgcatcaactactgtgccctgaacaagccaggctgtgaacatgaatgtgtgaacatggaggagagctactactgccgctgccaccggggctacaccctggaccccaacgggaagacctgcagccgggtggaccactgtgcccagcaggaccacggctgtgagcagctgtgcctgaacacagaggacagctttgtgtgccagtgcagcgagggcttcctgatcaatgaagacctgaagacctgcagccgggtggactactgcctgctgagtgaccacggctgtgagtacagctgtgtgaacatggacaggagctttgcctgccagtgcccagagggccacgtgctgcggagtgatggcaagacctgtgccaagctggacagctgtgccctgggggaccacggctgtgagcacagctgtgtgtcctctgaggacagctttgtgtgccagtgctttgagggctacatcctgagagaagatggcaagacctgcaggaggaaggatgtgtgccaggccatcgaccacggctgtgagcacatctgtgtgaacagtgatgacagctacacctgtgaatgtctggagggcttccggctggccgaggatggcaagcgctgcaggaggaaggatgtgtgcaagagcacccaccacggctgtgagcacatctgtgtgaacaatggaaacagctacatctgcaagtgcagcgagggctttgtgctggctgaagatggccgccgctgcaagaagtgcacagagggccccatcgacctggtgtttgtgattgatggcagcaagagcctgggggaggagaactttgaggtggtgaagcagtttgtgacaggcatcatcgacagcctgaccatcagccccaaggccgcccgggtgggcctgctgcagtacagcacccaggtgcacacagagttcaccctgaggaacttcaacagcgccaaggacatgaagaaggctgtggcccacatgaagtacatgggcaagggctccatgacaggcctggccctgaagcacatgtttgagaggagcttcacccagggcgagggcgcccggcccctgagcaccagggtgccccgggccgccatcgtgttcacagatggccgggcccaggatgatgtgtctgagtgggccagcaaggccaaggccaacggcatcaccatgtatgctgtgggcgtgggcaaggccatcgaggaggagctgcaggagatcgccagcgagcccaccaacaagcacctgttctatgcagaggacttcagcaccatggatgagatcagcgagaagctgaagaagggcatctgtgaggccctggaggacagtgatggccggcaggacagccctgctggggagctgcccaagacagtgcagcagcccacagagagcgagcctgtgaccatcaacatccaggacctgctgagctgcagcaactttgctgtgcagcaccgctacctgtttgaggaggacaacctgctgcggagcacccagaagctgagccacagcaccaagcccagcggcagccccctggaggagaagcatgaccagtgcaagtgtgaaaatctcatcatgttccagaacctggccaatgaggaggtgaggaagctgacccagaggctggaggagatgacccagaggatggaggccctggagaaccggctgcgctacagatag

SEQ ID NO: 158898 - DNA, 2748 bp, Artificial Sequence
  Description of Artificial Sequence: Synthetic coding sequence
atggagaagatgctggccggctgcttcctgctgatcctgggccagatcgtgctgctgcctgctgaggcccgggagaggagccggggccgcagcatcagccggggcagacatgcccggacccacccccagacagccctgctggagagcagctgtgagaacaagagagctgacctggtgttcatcatcgacagcagccgctctgtgaacacccatgactatgccaaggtgaaggagttcatcgtggacatcctgcagttcctggacattggaccagatgtgaccagggtgggcctgctgcagtatggcagcacagtgaagaatgagttcagcctgaagaccttcaagaggaagtctgaggtggagagagctgtgaagaggatgaggcacctgagcacaggcaccatgacaggcctggccatccagtatgccctgaacatcgccttcagcgaggccgagggcgcccggcccctgagagaaaatgtgcccagggtcatcatgattgtgacagatggccggccccaggacagcgtggccgaggtggccgccaaggcccgggacaccggcatcctgatctttgccatcggcgtgggccaggtggacttcaacaccctgaagagcatcggcagcgagccccatgaagatcatgtgttcctggtggccaacttcagccagatcgagaccctgaccagcgtcttccagaagaagctgtgcacagcccacatgtgcagcaccctggagcacaactgtgcccacttctgcatcaacatccctggcagctatgtgtgccgctgcaagcagggctacatcctgaacagcgaccagaccacctgccgcatccaggacctgtgtgccatggaggaccacaactgtgagcagctgtgtgtgaatgtgcccggcagctttgtgtgccagtgctacagcggctacgccctggctgaagatggcaagagatgtgtggccgtggactactgtgcctctgaaaatcatggctgtgaacatgaatgtgtgaatgctgatggcagctacctgtgccagtgccacgagggctttgccctgaacccagacaagaagacctgcacccgcatcaactactgtgccctgaacaagccaggctgtgaacatgaatgtgtgaacatggaggagagctactactgccgctgccaccggggctacaccctggaccccaacgggaagacctgcagccgggtggaccactgtgcccagcaggaccacggctgtgagcagctgtgcctgaacacagaagattcttttgtgtgccagtgcagcgagggcttcctgatcaatgaagacctgaagacctgcagccgggtggactactgcctgctgagtgaccacggctgtgagtacagctgtgtgaacatggacaggagctttgcctgccagtgcccagagggccacgtgctgcggagtgatggcaagacctgtgccaagctggacagctgtgccctgggggaccacggctgtgagcacagctgtgtgtccagtgaagattcttttgtgtgccagtgctttgagggctacatcctgcgggaggatggcaagacctgcaggaggaaggatgtgtgccaggccatcgaccacggctgtgagcacatctgtgtgaacagtgatgacagctacacctgtgagtgcctggagggcttccggctggctgaagatggcaagcgctgcaggaggaaggatgtgtgcaagagcacccaccacggctgtgagcacatctgtgtgaacaacggcaacagctacatctgcaagtgcagcgagggctttgtgctggccgaggatggaagacgctgcaagaagtgcacagagggccccatcgacctggtgtttgtgattgatggcagcaagagcctgggggaggagaactttgaggtggtgaagcagtttgtgacaggcatcatcgacagcctgaccatcagccccaaggccgcccgggtgggcctgctgcagtacagcacccaggtgcacacagagttcaccctgaggaacttcaacagcgccaaggacatgaagaaggctgtggcccacatgaagtacatgggcaagggctccatgacaggcctggccctgaagcacatgtttgagaggagcttcacccagggcgagggcgcccggcccctgagcaccagggtgcccagggctgccatcgtgttcacagatggccgggcccaggatgatgtgtctgagtgggccagcaaggccaaggccaacggcatcaccatgtatgctgtgggcgtgggcaaggccatcgaggaggagctgcaggagatcgccagcgagcccaccaacaagcacctgttctatgcagaggacttcagcaccatggatgagatcagcgagaagctgaagaagggcatctgtgaggccctggaggacagtgatggccggcaggacagccctgctggggagctgcccaagacagtgcagcagcccacagaaagtgagcctgtgaccatcaacatccaggacctgctgagctgcagcaactttgctgtgcagcaccgctacctgtttgaggaggacaacctgctgcggagcacccagaagctgagccacagcaccaagcccagcggcagccccctggaggagaagcatgaccagtgcaagtgtgagaacctgatcatgttccagaacctggccaatgaggaggtgaggaagctgacccagaggctggaggagatgacccagaggatggaggccctggagaaccggctgcgctacagatag

SEQ ID NO: 158899 - DNA, 1461 bp, Artificial Sequence
  Description of Artificial Sequence: Synthetic coding sequence
atgcccaggcctgccccagcccggcggctgcccggcctgctgctgctgctgtggcccctgctgctgctgcccagcgctgccccagaccctgtggcccggcccggcttccggcggctggagacccggggccctgggggcagccctggccggcggcccagccctgctgccccagatggagccccagccagcggcaccagcgagcccggccgggcccggggggccggcgtgtgcaagagccggcccctggacctggtgttcatcatcgacagcagccgctctgtgcggcccctggagttcaccaaggtgaagacctttgtgagccgcatcatcgacaccctggacatcggccctgctgacaccagggtggccgtggtgaactatgccagcacagtgaagattgagttccagctgcaggcctacacagacaagcagagcctgaagcaggccgtgggccgcatcacccccctgagcacaggcaccatgagcggcctggccatccagacagccatggatgaggccttcaccgtggaggccggggcccgggagcccagcagcaacatccccaaggtggccatcatcgtgacagatggccggccccaggaccaggtgaatgaggtggccgcccgggcccaggccagcggcatcgagctgtatgctgtgggcgtggacagagctgacatggccagcctgaagatgatggccagcgagcccctggaggagcacgtgttctacgtggagacctacggcgtgattgagaagctgagcagccgcttccaggagaccttctgtgccctggacccctgtgtgctgggcacccaccagtgccagcacgtgtgcatcagtgatggagagggcaagcaccactgtgagtgcagccagggctacaccctgaatgctgacaagaagacctgcagcgccctggacagatgtgccctgaacacccacggctgtgagcacatctgtgtgaatgacaggagcggcagctaccactgtgagtgctatgagggctacaccctgaatgaagacaggaagacctgcagcgcccaggacaagtgtgccctgggcacccacggctgccagcacatctgtgtgaatgacagaacaggcagccaccactgtgagtgctatgagggctacaccctgaatgctgacaagaagacctgcagcgtgcgggacaagtgtgccctgggcagccacggctgccagcacatctgtgtgtctgatggagctgccagctaccactgtgactgctacccaggctacaccctgaatgaagacaagaagacctgcagcgccacagaggaggcccggcggctggtgtccacagaagatgcctgtggctgtgaggccaccctggccttccaggacaaggtgagcagctacctgcagaggctgaacaccaagctggatgacatcctggagaagctgaagatcaatgaatatggccagatccacaggtag

SEQ ID NO: 158900 - DNA, 1335 bp, Artificial Sequence
  Description of Artificial Sequence: Synthetic coding sequence
atgcccaggcctgccccagcccggcggctgcccggcctgctgctgctgctgtggcccctgctgctgctgcccagcgctgccccagaccctgtggcccggcccggcttccggcggctggagacccggggccctgggggcagccctggccggcggcccagccctgctgccccagatggagccccagccagcggcaccagcgagcccggccgggcccggggggccggcgtgtgcaagagccggcccctggacctggtgttcatcatcgacagcagccgctctgtgcggcccctggagttcaccaaggtgaagacctttgtgagccgcatcatcgacaccctggacatcggccctgctgacaccagggtggccgtggtgaactatgccagcacagtgaagattgagttccagctgcaggcctacacagacaagcagagcctgaagcaggccgtgggccgcatcacccccctgagcacaggcaccatgagcggcctggccatccagacagccatggatgaggccttcaccgtggaggccggggcccgggagcccagcagcaacatccccaaggtggccatcatcgtgacagatggccggccccaggaccaggtgaatgaggtggccgcccgggcccaggccagcggcatcgagctgtatgctgtgggcgtggacagagctgacatggccagcctgaagatgatggccagcgagcccctggaggagcacgtgttctacgtggagacctacggcgtgattgagaagctgagcagccgcttccaggagaccttctgtgccctggacagatgtgccctgaacacccacggctgtgagcacatctgtgtgaatgacaggagcggcagctaccactgtgagtgctatgagggctacaccctgaatgaagacaggaagacctgcagcgcccaggacaagtgtgccctgggcacccacggctgccagcacatctgtgtgaatgacagaacaggcagccaccactgtgagtgctatgagggctacaccctgaatgctgacaagaagacctgcagcgtgcgggacaagtgtgccctgggcagccacggctgccagcacatctgtgtgtctgatggagctgccagctaccactgtgactgctacccaggctacaccctgaatgaagacaagaagacctgcagcgccacagaggaggcccggcggctggtgtccacagaagatgcctgtggctgtgaggccaccctggccttccaggacaaggtgagcagctacctgcagaggctgaacaccaagctggatgacatcctggagaagctgaagatcaatgaatatggccagatccacaggtag

SEQ ID NO: 158901 - DNA, 1869 bp, Artificial Sequence
  Description of Artificial Sequence: Synthetic coding sequence
atgaggggcctgctgtgctggcctgtgctgctgctgctgctgcagccctgggagacccagctgcagctgaccggcccccgctgccacacaggccccctggacctggtgtttgtgattgacagcagccgctctgtgcggccctttgaatttgagaccatgaggcagttcctgatgggcctgctgcggggcctgaatgtgggccccaatgccaccagggtgggcgtcatccagtacagcagccaggtgcagagcgtcttccccctgcgggccttcagcagaagagaggacatggagcgggccatccgggacctggtgcccctggcccagggcaccatgacaggcctggccatccagtatgccatgaatgtggccttctctgtggccgagggcgcccggcccccagaggagcgggtgccccgggtggccgtcatcgtgacagatggccggccccaggacagagtggccgaggtggccgcccaggcccgggcccggggcatcgagatctatgctgtgggcgtgcagagagcagatgtgggcagcctgcgggccatggccagcccccccctggatgagcacgtgttcctggtggagagctttgacctgatccaggagtttggcctgcagttccagagccggctgtgtgggaaggaccagtgtgccgagggcggccacggctgccagcaccagtgtgtgaatgcctgggccatgttccactgcacctgcaaccctggctacaagctggccgctgacaacaagagctgcctggccatcgacctgtgtgccgagggcacccacggctgtgagcaccactgtgtgaacagccctggcagctacttctgccactgccaggtgggctttgtgctgcagcaggaccagaggagctgccgggccatcgactactgcagctttggaaaccacagctgccagcatgaatgtgtgtccacccctgggggcccccgctgccactgccgggagggccatgacctgcagccagatggccgcagctgccaggtgcgggacctgtgcaatggagtggaccacggctgtgagttccagtgtgtgtctgagggcctgagctaccgctgcctgtgcccagagggccggcagctgcaggctgatggcaagagctgcaaccgctgccgggagggccacgtggacctggtgctgctggtggatggcagcaagtctgtgcggccccagaactttgagctggtgaagagatttgtgaaccagatcgtggacttcctggatgtgtccccagagggcaccagggtgggcctggtgcagttcagcagccgggtgaggacagagttccccctgggccgctatggaacagctgctgaggtgaagcaggccgtgctggccgtggagtacatggagcggggcaccatgacaggcctggccctgcggcacatggtggagcacagcttcagcgaggcccagggcgcccggccccgggccctgaatgtgccccgggtgggcctggtgttcacagatggccgcagccaggatgacatctctgtgtgggccgcccgggccaaggaggagggcatcgtgatgtatgctgtgggcgtgggcaaggctgtggaggccgagctgcgggagatcgccagcgagcctgctgagctgcacgtgtcctatgccccagactttggcaccatgacccacctgctggagaacctgcggggcagcatctgcccagaggagggcatctctgctggaacagagctgcggagcccctgtgaatgtgagagcctggtggagttccagggccgcaccctgggcgccctggagagcctgaccctgaacctggcccagctgacagcccggctggaggacctggagaaccagctggccaaccagaagtag

SEQ ID NO: 158902 - DNA, 1746 bp, Artificial Sequence
  Description of Artificial Sequence: Synthetic coding sequence
atgaggggcctgctgtgctggcctgtgctgctgctgctgctgcagccctgggagacccagctgcagctgaccggcccccgctgccacacaggccccctggacctggtgtttgtgattgacagcagccgctctgtgcggccctttgaatttgagaccatgaggcagttcctgatgggcctgctgcggggcctgaatgtgggccccaatgccaccagggtgggcgtcatccagtacagcagccaggtgcagagcgtcttccccctgcgggccttcagcagaagagaggacatggagcgggccatccgggacctggtgcccctggcccagggcaccatgacaggcctggccatccagtatgccatgaatgtggccttctctgtggccgagggcgcccggcccccagaggagcgggtgccccgggtggccgtcatcgtgacagatggccggccccaggacagagtggccgaggtggccgcccaggcccgggcccggggcatcgagatctatgctgtgggcgtgcagagagcagatgtgggcagcctgcgggccatggccagcccccccctggatgagcacgtgttcctggtggagagctttgacctgatccaggagtttggcctgcagttccagagccggctgtgtgccatcgacctgtgtgccgagggcacccacggctgtgagcaccactgtgtgaacagccctggcagctacttctgccactgccaggtgggctttgtgctgcagcaggaccagaggagctgccgggccatcgactactgcagctttggaaaccacagctgccagcatgaatgtgtgtccaccccaggcggcccccgctgccactgccgggagggccatgacctgcagccagatggccgcagctgccaggtgcgggacctgtgcaatggagtggaccacggctgtgagttccagtgtgtgtctgagggcctgagctaccgctgcctgtgcccagagggccggcagctgcaggctgatggcaagagctgcaaccgctgccgggagggccacgtggacctggtgctgctggtggatggcagcaagtctgtgcggccccagaactttgagctggtgaagagatttgtgaaccagatcgtggacttcctggatgtgtccccagagggcaccagggtgggcctggtgcagttcagcagccgggtgaggacagagttccccctgggccgctatggaacagctgctgaggtgaagcaggccgtgctggccgtggagtacatggagcggggcaccatgacaggcctggccctgcggcacatggtggagcacagcttcagcgaggcccagggcgcccggccccgggccctgaatgtgccccgggtgggcctggtgttcacagatggccgcagccaggatgacatctctgtgtgggccgcccgggccaaggaggagggcatcgtgatgtatgctgtgggcgtgggcaaggctgtggaggccgagctgcgggagatcgccagcgagcctgctgagctgcacgtgtcctatgccccagactttggcaccatgacccacctgctggagaacctgcggggcagcatctgcccagaggagggcatctctgctggaacagagctgcggagcccctgtgaatgtgagagcctggtggagttccagggccgcaccctgggcgccctggagagcctgaccctgaacctggcccagctgacagcccggctggaggacctggagaaccagctggccaaccagaagtag

SEQ ID NO: 158903 - DNA, 1500 bp, Artificial Sequence
  Description of Artificial Sequence: Synthetic coding sequence
atgaggggcctgctgtgctggcctgtgctgctgctgctgctgcagccctgggagacccagctgcagctgaccggcccccgctgccacacaggccccctggacctggtgtttgtgattgacagcagccgctctgtgcggccctttgaatttgagaccatgaggcagttcctgatgggcctgctgcggggcctgaatgtgggccccaatgccaccagggtgggcgtcatccagtacagcagccaggtgcagagcgtcttccccctgcgggccttcagcagaagagaggacatggagcgggccatccgggacctggtgcccctggcccagggcaccatgacaggcctggccatccagtatgccatgaatgtggccttctctgtggccgagggcgcccggcccccagaggagcgggtgccccgggtggccgtcatcgtgacagatggccggccccaggacagagtggccgaggtggccgcccaggcccgggcccggggcatcgagatctatgctgtgggcgtgcagagagcagatgtgggcagcctgcgggccatggccagcccccccctggatgagcacgtgttcctggtggagagctttgacctgatccaggagtttggcctgcagttccagagccggctgtgtgtgcgggacctgtgcaatggagtggaccacggctgtgagttccagtgtgtgtctgagggcctgagctaccgctgcctgtgcccagagggccggcagctgcaggctgatggcaagagctgcaaccgctgccgggagggccacgtggacctggtgctgctggtggatggcagcaagtctgtgcggccccagaactttgagctggtgaagagatttgtgaaccagatcgtggacttcctggatgtgtccccagagggcaccagggtgggcctggtgcagttcagcagccgggtgaggacagagttccccctgggccgctatggaacagctgctgaggtgaagcaggccgtgctggccgtggagtacatggagcggggcaccatgacaggcctggccctgcggcacatggtggagcacagcttcagcgaggcccagggcgcccggccccgggccctgaatgtgccccgggtgggcctggtgttcacagatggccgcagccaggatgacatctctgtgtgggccgcccgggccaaggaggagggcatcgtgatgtatgctgtgggcgtgggcaaggctgtggaggccgagctgcgggagatcgccagcgagcctgctgagctgcacgtgtcctatgccccagactttggcaccatgacccacctgctggagaacctgcggggcagcatctgcccagaggagggcatctctgctggaacagagctgcggagcccctgtgaatgtgagagcctggtggagttccagggccgcaccctgggcgccctggagagcctgaccctgaacctggcccagctgacagcccggctggaggacctggagaaccagctggccaaccagaagtag

SEQ ID NO: 158904 - DNA, 1623 bp, Artificial Sequence
  Description of Artificial Sequence: Synthetic coding sequence
atgaggggcctgctgtgctggcctgtgctgctgctgctgctgcagccctgggagacccagctgcagctgaccggcccccgctgccacacaggccccctggacctggtgtttgtgattgacagcagccgctctgtgcggccctttgaatttgagaccatgaggcagttcctgatgggcctgctgcggggcctgaatgtgggccccaatgccaccagggtgggcgtcatccagtacagcagccaggtgcagagcgtcttccccctgcgggccttcagcagaagagaggacatggagcgggccatccgggacctggtgcccctggcccagggcaccatgacaggcctggccatccagtatgccatgaatgtggccttctctgtggccgagggcgcccggcccccagaggagcgggtgccccgggtggccgtcatcgtgacagatggccggccccaggacagagtggccgaggtggccgcccaggcccgggcccggggcatcgagatctatgctgtgggcgtgcagagagcagatgtgggcagcctgcgggccatggccagcccccccctggatgagcacgtgttcctggtggagagctttgacctgatccaggagtttggcctgcagttccagagccggctgtgtgccatcgactactgcagctttggaaaccacagctgccagcatgaatgtgtgtccacccctgggggcccccgctgccactgccgggagggccatgacctgcagccagatggccgcagctgccaggtgcgggacctgtgcaatggagtggaccacggctgtgagttccagtgtgtgtctgagggcctgagctaccgctgcctgtgcccagagggccggcagctgcaggctgatggcaagagctgcaaccgctgccgggagggccacgtggacctggtgctgctggtggatggcagcaagtctgtgcggccccagaactttgagctggtgaagagatttgtgaaccagatcgtggacttcctggatgtgtccccagagggcaccagggtgggcctggtgcagttcagcagccgggtgaggacagagttccccctgggccgctatggaacagctgctgaggtgaagcaggccgtgctggccgtggagtacatggagcggggcaccatgacaggcctggccctgcggcacatggtggagcacagcttcagcgaggcccagggcgcccggccccgggccctgaatgtgccccgggtgggcctggtgttcacagatggccgcagccaggatgacatctctgtgtgggccgcccgggccaaggaggagggcatcgtgatgtatgctgtgggcgtgggcaaggctgtggaggccgagctgcgggagatcgccagcgagcctgctgagctgcacgtgtcctatgccccagactttggcaccatgacccacctgctggagaacctgcggggcagcatctgcccagaggagggcatctctgctggaacagagctgcggagcccctgtgaatgtgagagcctggtggagttccagggccgcaccctgggcgccctggagagcctgaccctgaacctggcccagctgacagcccggctggaggacctggagaaccagctggccaaccagaagtag

SEQ ID NO: 158905 - DNA, 1299 bp, Artificial Sequence
  Description of Artificial Sequence: Synthetic coding sequence
atgaggggcctgctgtgctggcctgtgctgctgctgctgctgcagccctgggagacccagctgcagctgaccgggaaggaccagtgtgccgagggcggccacggctgccagcaccagtgtgtgaatgcctgggccatgttccactgcacctgcaaccctggctacaagctggccgctgacaacaagagctgcctggccatcgacctgtgtgccgagggcacccacggctgtgagcaccactgtgtgaacagccctggcagctacttctgccactgccaggtgggctttgtgctgcagcaggaccagaggagctgccgggccatcgactactgcagctttggaaaccacagctgccagcatgaatgtgtgtccacccctgggggcccccgctgccactgccgggagggccatgacctgcagccagatggccgcagctgccaggtgcgggacctgtgcaatggagtggaccacggctgtgagttccagtgtgtgtctgagggcctgagctaccgctgcctgtgcccagagggccggcagctgcaggctgatggcaagagctgcaaccgctgccgggagggccacgtggacctggtgctgctggtggatggcagcaagtctgtgcggccccagaactttgagctggtgaagagatttgtgaaccagatcgtggacttcctggatgtgtccccagagggcaccagggtgggcctggtgcagttcagcagccgggtgaggacagagttccccctgggccgctatggaacagctgctgaggtgaagcaggccgtgctggccgtggagtacatggagcggggcaccatgacaggcctggccctgcggcacatggtggagcacagcttcagcgaggcccagggcgcccggccccgggccctgaatgtgccccgggtgggcctggtgttcacagatggccgcagccaggatgacatctctgtgtgggccgcccgggccaaggaggagggcatcgtgatgtatgctgtgggcgtgggcaaggctgtggaggccgagctgcgggagatcgccagcgagcctgctgagctgcacgtgtcctatgccccagactttggcaccatgacccacctgctggagaacctgcggggcagcatctgcccagaggagggcatctctgctggaacagagctgcggagcccctgtgaatgtgagagcctggtggagttccagggccgcaccctgggcgccctggagagcctgaccctgaacctggcccagctgacagcccggctggaggacctggagaaccagctggccaaccagaagtag

SEQ ID NO: 158906 - DNA, 1299 bp, Artificial Sequence; identical to SEQ ID NO: 158905
  Description of Artificial Sequence: Synthetic coding sequence

SEQ ID NO: 158907 - DNA, 1869 bp, Artificial Sequence; identical to SEQ ID NO: 158901
  Description of Artificial Sequence: Synthetic coding sequence

SEQ ID NO: 158908 - DNA, 1746 bp, Artificial Sequence; identical to SEQ ID NO: 158902
  Description of Artificial Sequence: Synthetic coding sequence

SEQ ID NO: 158909 - DNA, 852 bp, Artificial Sequence
  Description of Artificial Sequence: Synthetic coding sequence
atgagcaagagcttccagcagagcagcctgagccgggacagccagggccacggccgggacctgtctgctgctggcatcggcctgctggccgccgccacccagagcctgtccatgctgctggagagtgaagatgagctgctggtggatgaggaggaggccgccgccctgctggagagcggcagctctgtgggagatgaaacagacctggccaacctgggagatgtggccagtgatggcaagaaggagcccagcgacaaggctgtgaagaaggatggcagcgccagcgctgctgccaagaagaagctgaagaagaggcgcttccctggctccatggagggctttgtgaccctggatgaggtgggagatgaggaggacagcgagctgcagaagctgaggaagagcggcatggccttcaagagcggggacaagaatgatgatggcctggtggagatcaaggtggacaagattgaggagctggaccaggagaatgaagctgccctggagaatggcatcaagaatgaagaaaatacagagcctggagctgagagcagtgaaaatgctgatgaccccaacaaggacaccagtgaaaatgctgatggccagagtgatgagaacaaggatgactacaccatcccagatgagtacagaattggcccctaccagcccaacgtgcctgtgggcatcgactatgtgatccccaagacaggcttctactgcaagctgtgcagcctcttctacaccaatgaggaggtggccaagaacacccactgcagcagcctgccccactaccagaagctgaagaagttcctgaacaagctggccgaggagcggcggcagaagaaggagacctag

SEQ ID NO: 158910 - DNA, 2544 bp, Artificial Sequence
  Description of Artificial Sequence: Synthetic coding sequence
atgagcaagagcttccagcagagcagcctgagccgggacagccagggccacggccgggacctgtctgctgctggcatcggcctgctggccgccgccacccagagcctgtccatgcctgccagcctgggccgcatgaaccagggcacagcccggctggccagcctgatgaacctgggcatgagcagcagcctgaaccagcagggcgcccacagcgccctgagcagcgccagcaccagcagccacaacctgcagagcatcttcaacatcggcagccggggccccctgcccctgagcagccagcacagaggagatgctgaccaggccagcaacatcctggccagctttggcctgagcgcccgggacctggatgagctgagccgctacccagaggacaagatcaccccagagaacctgccccagatcctgctgcagctgaagagaagaagaacagaggagggccccaccctgtcctatggaagagatggccgcagcgccacccgggagcccccctacagagtgcccagagatgactgggaggagaagaggcacttcagaagagacagctttgatgaccggggccccagcctgaaccctgtgctggactatgaccacggcagccgcagccaggagagcggctactatgacaggatggactatgaagatgaccggctgagagatggagagcgctgcagagatgacagcttcttcggggagaccagccacaactaccacaagtttgacagtgaatatgaaagaatgggccggggccctggccccctgcaggagaggagcctgtttgagaagaagagaggagccccacccagcagcaacatcgaggacttccacggcctgctgcccaagggctacccccacctgtgcagcatctgtgacctgcctgtgcacagcaacaaggagtggagccagcacatcaatggagccagccacagccgccgctgccagctgctgctggagatctacccagagtggaacccagacaatgacaccggccacaccatgggagaccccttcatgctgcagcagagcaccaacccagcccctggcatcctgggccccccaccacccagcttccacctgggcggccctgctgtgggcccccggggcaacctgggcgctggaaatggaaacctgcagggccccaggcacatgcagaagggccgggtggagaccagccgggtggtgcacatcatggacttccagaggggcaagaacctgcgctaccagctgctgcagctggtggagccctttggagtcatcagcaaccacctgatcctgaacaagatcaatgaggccttcatcgagatggccaccacagaagatgcccaggccgctgtggactactacaccaccaccccagccctggtgtttgggaagcctgtgcgggtgcacctgagccagaagtacaagaggatcaagaagccagagggcaagccagaccagaagtttgaccagaagcaggagctgggccgggtcatccacctgagcaacctgccccacagcggctacagcgacagcgctgtgctgaagctggccgagccctacggcaagatcaagaactacatcctgatgaggatgaagagccaggccttcatcgagatggagaccagagaagatgccatggccatggtggaccactgcctgaagaaggccctgtggttccagggccgctgtgtgaaggtggacctgtctgagaagtacaagaagctggtgctgcgcatccccaacagaggcatcgacctgctgaagaaggacaagagcaggaagaggagctacagcccagatggcaaggagagccccagcgacaagaagagcaagacagatggcagccagaagacagagagcagcacagagggcaaggagcaggaggagaagtctggagaagatggagagaaggacaccaaggatgaccagacagagcaggagcccaacatgctgctggagagtgaagatgagctgctggtggatgaggaggaggccgccgccctgctggagagcggcagctctgtgggagatgaaacagacctggccaacctgggagatgtggccagtgatggcaagaaggagcccagcgacaaggctgtgaagaaggatggcagcgccagcgctgctgccaagaagaagctgaagaaggtggacaagattgaggagctggaccaggagaatgaagctgccctggagaatggcatcaagaatgaagaaaatacagagcctggagctgagagcagtgaaaatgctgatgaccccaacaaggacaccagtgaaaatgctgatggccagagtgatgagaacaaggatgactacaccatcccagatgagtacagaattggcccctaccagcccaacgtgcctgtgggcatcgactatgtgatccccaagacaggcttctactgcaagctgtgcagcctcttctacaccaatgaggaggtggccaagaacacccactgcagcagcctgccccactaccagaagctgaagaagttcctgaacaagctggccgaggagcggcggcagaagaaggagacctag

SEQ ID NO: 158911 - DNA, 2544 bp, Artificial Sequence; identical to SEQ ID NO: 158910
  Description of Artificial Sequence: Synthetic coding sequence

SEQ ID NO: 158912 - DNA, 300 bp, Artificial Sequence
  Description of Artificial Sequence: Synthetic coding sequence
atgagcaagagcttccagcagagcagcctgagccgggacagccagggccacggccgggacctgtctgctgctggcatcggcctgctggccgccgccacccagagcctgtccatgcctgccagcctgggccgcatgaaccagggcacagcccggctggccagcctgatgaacctgggcatgagcagcagcctgaaccagcagggcgcccacagcgccctgagcagcgccagcaccagcagccacaacctgcagagcatcttcaacatcggcagccggggccccctgcccctgagcagctag

SEQ ID NO: 158913 - DNA, 1530 bp, Artificial Sequence
  Description of Artificial Sequence: Synthetic coding sequence
atgggagaccccttcatgctgcagcagagcaccaacccagcccctggcatcctgggccccccaccacccagcttccacctgggcggccctgctgtgggcccccggggcaacctgggcgctggaaatggaaacctgcagggccccaggcacatgcagaagggccgggtggagaccagccgggtggtgcacatcatggacttccagaggggcaagaacctgcgctaccagctgctgcagctggtggagccctttggagtcatcagcaaccacctgatcctgaacaagatcaatgaggccttcatcgagatggccaccacagaagatgcccaggccgctgtggactactacaccaccaccccagccctggtgtttgggaagcctgtgcgggtgcacctgagccagaagtacaagaggatcaagaagccagagggcaagccagaccagaagtttgaccagaagcaggagctgggccgggtcatccacctgagcaacctgccccacagcggctacagcgacagcgctgtgctgaagctggccgagccctacggcaagatcaagaactacatcctgatgaggatgaagagccaggccttcatcgagatggagaccagagaagatgccatggccatggtggaccactgcctgaagaaggccctgtggttccagggccgctgtgtgaaggtggacctgtctgagaagtacaagaagctggtgctgcgcatccccaacagaggcatcgacctgctgaagaaggacaagagcaggaagaggagctacagcccagatggcaaggagagccccagcgacaagaagagcaagacagatggcagccagaagacagagagcagcacagagggcaaggagcaggaggagaagtctggagaagatggagagaaggacaccaaggatgaccagacagagcaggagcccaacatgctgctggagagtgaagatgagctgctggtggatgaggaggaggccgccgccctgctggagagcggcagctctgtgggagatgaaacagacctggccaacctgggagatgtggccagtgatggcaagaaggagcccagcgacaaggctgtgaagaaggatggcagcgccagcgctgctgccaagaagaagctgaagaaggtggacaagattgaggagctggaccaggagaatgaagctgccctggagaatggcatcaagaatgaagaaaatacagagcctggagctgagagcagtgaaaatgctgatgaccccaacaaggacaccagtgaaaatgctgatggccagagtgatgagaacaaggatgactacaccatcccagatgagtacagaattggcccctaccagcccaacgtgcctgtgggcatcgactatgtgatccccaagacaggcttctactgcaagctgtgcagcctcttctacaccaatgaggaggtggccaagaacacccactgcagcagcctgccccactaccagaagctgaagaagttcctgaacaagctggccgaggagcggcggcagaagaaggagacctag

SEQ ID NO: 158914 - DNA, 264 bp, Artificial Sequence
  Description of Artificial Sequence: Synthetic coding sequence
atgagcaagagcttccagcagagcagcctgagccgggacagccagggccacggccgggacctgtctgctgctggcatcggcctgctggccgccgccacccagagcctgtccatgcctgccagcctgggccgcatgaaccagggcacagcccggctggccagcctgatgaacctgggcatgagcagcagcctgaaccagcagggcgcccacagcgccctgagcagcgccagcaccagcagccacaacctgcagagcatcttctag

SEQ ID NO: 158915 - DNA, 1680 bp, Artificial Sequence
  Description of Artificial Sequence: Synthetic coding sequence
atgctgggcgcccagtggaggaggaaccagcccagcagagctgctgaggagtggagccagcacatcaatggagccagccacagccgccgctgccagctgctgctggagatctacccagagtggaacccagacaatgacaccggccacaccatgggagaccccttcatgctgcagcagagcaccaacccagcccctggcatcctgggccccccaccacccagcttccacctgggcggccctgctgtgggcccccggggcaacctgggcgctggaaatggaaacctgcagggccccaggcacatgcagaagggccgggtggagaccagccgggtggtgcacatcatggacttccagaggggcaagaacctgcgctaccagctgctgcagctggtggagccctttggagtcatcagcaaccacctgatcctgaacaagatcaatgaggccttcatcgagatggccaccacagaagatgcccaggccgctgtggactactacaccaccaccccagccctggtgtttgggaagcctgtgcgggtgcacctgagccagaagtacaagaggatcaagaagccagagggcaagccagaccagaagtttgaccagaagcaggagctgggccgggtcatccacctgagcaacctgccccacagcggctacagcgacagcgctgtgctgaagctggccgagccctacggcaagatcaagaactacatcctgatgaggatgaagagccaggccttcatcgagatggagaccagagaagatgccatggccatggtggaccactgcctgaagaaggccctgtggttccagggccgctgtgtgaaggtggacctgtctgagaagtacaagaagctggtgctgcgcatccccaacagaggcatcgacctgctgaagaaggacaagagcaggaagaggagctacagcccagatggcaaggagagccccagcgacaagaagagcaagacagatggcagccagaagacagagagcagcacagagggcaaggagcaggaggagaagtctggagaagatggagagaaggacaccaaggatgaccagacagagcaggagcccaacatgctgctggagagtgaagatgagctgctggtggatgaggaggaggccgccgccctgctggagagcggcagctctgtgggagatgaaacagacctggccaacctgggagatgtggccagtgatggcaagaaggagcccagcgacaaggctgtgaagaaggatggcagcgccagcgctgctgccaagaagaagctgaagaaggtggacaagattgaggagctggaccaggagaatgaagctgccctggagaatggcatcaagaatgaagaaaatacagagcctggagctgagagcagtgaaaatgctgatgaccccaacaaggacaccagtgaaaatgctgatggccagagtgatgagaacaaggatgactacaccatcccagatgagtacagaattggcccctaccagcccaacgtgcctgtgggcatcgactatgtgatccccaagacaggcttctactgcaagctgtgcagcctcttctacaccaatgaggaggtggccaagaacacccactgcagcagcctgccccactaccagaagctgaagaagttcctgaacaagctggccgaggagcggcggcagaagaaggagacctag

SEQ ID NO: 158916 - DNA, 237 bp, Artificial Sequence
  Description of Artificial Sequence: Synthetic coding sequence
atgagcaagagcttccagcagagcagcctgagccgggacagccagggccacggccgggacctgtctgctgctggcatcggcctgctggccgccgccacccagagcctgtccatgcctgccagcctgggccgcatgaaccagggcacagcccggctggccagcctgatgaacctgggcatgagcagcagcctgaaccagcagggcgcccacagcgccctgagcagcgccagcacctag

SEQ ID NO: 158917 - DNA, 1302 bp, Artificial Sequence
  Description of Artificial Sequence: Synthetic coding sequence
atgagcaagagcttccagcagagcagcctgagccgggacagccagggccacggccgggacctgtctgctgctggcatcggcctgctggccgccgccacccagagcctgtccatgcctgccagcctgggccgcatgaaccagggcacagcccggctggccagcctgatgaacctgggcatgagcagcagcctgaaccagcagggcgcccacagcgccctgagcagcgccagcaccagcagccacaacctgcagagcatcttcaacatcggcagccggggccccctgcccctgagcagccagcacagaggagatgctgaccaggccagcaacatcctggccagctttggcctgagcgcccgggacctggatgagctgagccgctacccagaggacaagatcaccccagagaacctgccccagatcctgctgcagctgaagagaagaagaacagaggagggccccaccctgtcctatggaagagatggccgcagcgccacccgggagcccccctacagagtgcccagagatgactgggaggagaagaggcacttcagaagagacagctttgatgaccggggccccagcctgaaccctgtgctggactatgaccacggcagccgcagccaggagagcggctactatgacaggatggactatgaagatgaccggctgagagatggagagcgctgcagagatgacagcttcttcggggagaccagccacaactaccacaagtttgacagtgaatatgaaagaatgggccggggccctggccccctgcaggagaggagcctgtttgagaagaagagaggagccccacccagcagcaacatcgaggacttccacggcctgctgcccaagggctacccccacctgtgcagcatctgtgacctgcctgtgcacagcaacaaggagtggagccagcacatcaatggagccagccacagccgccgctgccagctgctgctggagatctacccagagtggaacccagacaatgacaccggccacaccatgggagaccccttcatgctgcagcagagcaccaacccagcccctggcatcctgggccccccaccacccagcttccacctgggcggccctgctgtgggcccccggggcaacctgggcgctggaaatggaaacctgcagggccccaggcacatgcagaagggccgggtggagaccagccgggtggtgcacatcatggacttccagaggggcaagaacctgcgctaccagctgctgcagctggtggagccctttggagtcatcagcaaccacctgatcctgaacaagtag

SEQ ID NO: 158918 - DNA, 1530 bp, Artificial Sequence; identical to SEQ ID NO: 158913
  Description of Artificial Sequence: Synthetic coding sequence

SEQ ID NO: 158919 - DNA, 144 bp, Artificial Sequence
  Description of Artificial Sequence: Synthetic coding sequence
atgagcaagagcttccagcagagcagcctgagccgggacagccagggccacggccgggacctgtctgctgctggcatcggcctgctggccgccgccacccagagcctgtccatgcctgccagcctgggccgcatgaaccagtag

SEQ ID NO: 158920 - DNA, 237 bp, Artificial Sequence; identical to SEQ ID NO: 158916
  Description of Artificial Sequence: Synthetic coding sequence

SEQ ID NO: 158921 - DNA, 2544 bp, Artificial Sequence; identical to SEQ ID NO: 158910
  Description of Artificial Sequence: Synthetic coding sequence

SEQ ID NO: 158922 - DNA, 30 bp, Artificial Sequence; identical to SEQ ID NO: 88126
  Description of Artificial Sequence: Synthetic coding sequence

SEQ ID NO: 158923 - DNA, 303 bp, Artificial Sequence
  Description of Artificial Sequence: Synthetic coding sequence
atgagcaagagcttccagcagagcagcctgagccgggacagccagggccacggccgggacctgtctgctgctggcatcggcctgctggccgccgccacccagagcctgtccatgcctgccagcctgggccgcatgaaccagggcacagcccggctggccagcctgatgaacctgggcatgagcagcagcctgaaccagcagggcgcccacagcgccctgagcagcgccagcaccagcagccacaacctgcagagcatcttcaacatcggcagccggggccccctgcccctgagcagccagtag

SEQ ID NO: 158924 - DNA, 324 bp, Artificial Sequence
  Description of Artificial Sequence: Synthetic coding sequence
atgagcaagagcttccagcagagcagcctgagccgggacagccagggccacggccgggacctgtctgctgctggcatcggcctgctggccgccgccacccagagcctgtccatgcctgccagcctgggccgcatgaaccagggcacagcccggctggccagcctgatgaacctgggcatgagcagcagcctgaaccagcagggcgcccacagcgccctgagcagcgccagcaccagcagccacaacctgcagagcatcttcaacatcggcagccggggccccctgcccctgagcagccagcacagaggagatgctgaccagtag

SEQ ID NO: 158925 - DNA, 1578 bp, Artificial Sequence
  Description of Artificial Sequence: Synthetic coding sequence
atgagggtcttctgtgtgggcctgctgctcttctctgtgacctgggccgcccccaccttccagccccagacagagaagaccaagcagagctgtgtggaggagcagaggcaggaggagaagaacaaggacaacatcggcttccaccacctgggcaagaggatcaaccaggagctgagcagcaaggagaacatcgtgcaggagaggaagaaggacctgagcctgtctgaggcctctgaaaataaaggcagcagcaagagccagaactacttcaccaaccggcagaggctgaacaaggagtacagcatcagcaacaaggagaacacccacaacggcctgaggatgagcatctaccccaagagcactggaaacaagggctttgaagatggagatgatgccatcagcaagctgcatgaccaggaggagtatggagctgccctgatccggaacaacatgcagcacatcatgggccctgtgacagccatcaagctgctgggggaggagaacaaggagaacaccccaagaaatgtgctgaacatcatcccagcctccatgaactatgccaaggcccacagcaaggacaagaagaagccccagagggacagccaggcccagaagagccctgtgaagagcaagagcacccaccgcatccagcacaacatcgactacctgaagcacctgagcaaggtgaagaagatccccagcgactttgagggcagcggctacacagacctgcaggagcggggggacaatgacatcagccccttctctggagatggccagcccttcaaggacatccctgggaagggggaggccaccggccctgacctggagggcaaggacatccagacaggctttgctggccccagcgaggccgagagcacccacctggacaccaagaagccaggctacaatgagatccctgagcgggaggagaatggaggcaacaccatcggcaccagagatgaaacagccaaggaggctgatgctgtggatgtgtccctggtggagggcagcaatgacatcatgggcagcaccaacttcaaggagctgcccggccgggagggcaacagagtggatgctggcagccagaatgcccaccagggcaaggtggagttccactaccccccagcccccagcaaggagaagaggaaggagggcagcagtgatgctgctgagagcaccaactacaatgagatccccaagaatggcaagggcagcaccaggaaaggagtggaccacagcaacagaaaccaggccaccctgaatgagaagcagcgcttccccagcaagggcaagagccagggcctgcccatccccagccggggcctggacaatgagatcaagaatgagatggacagcttcaacggccccagccatgagaacatcatcacccacggcaggaagtaccactacgtgccccaccggcagaacaacagcaccagaaataaaggcatgccccagggcaagggctcctggggccggcagccccacagcaacagacgcttcagcagcagaagaagagatgacagcagcgagagcagtgacagcggcagcagcagcgagagtgatggagactag

SEQ ID NO: 158926 - DNA, 1578 bp, Artificial Sequence; identical to SEQ ID NO: 158925
  Description of Artificial Sequence: Synthetic coding sequence

SEQ ID NO: 158927 - DNA, 828 bp, Artificial Sequence
  Description of Artificial Sequence: Synthetic coding sequence
atgagggtcttctgtgtgggcctgctgctcttctctgtgacctgggccgcccccaccttccagccccagacagagaagaccaagcagagctgtgtggaggagcagaggcaggaggagaagaacaaggacaacatcggcttccaccacctgggcaagaggatcaaccaggagctgagcagcaaggagaacatcgtgcaggagaggaagaaggacctgagcctgtctgaggcctctgaaaataaaggcagcagcaagagccagaactacttcaccaaccggcagaggctgaacaaggagtacagcatcagcaacaaggagaacacccacaacggcctgaggatgagcatctaccccaagagcactggaaacaagggctttgaagatggagatgatgccatcagcaagctgcatgaccaggaggagtatggagctgccctgatccggaacaacatgcagcacatcatgggccctgtgacagccatcaagctgctgggggaggagaacaaggagaacaccccaagaaatgtgctgaacatcatcccagcctccatgaactatgccaaggcccacagcaaggacaagaagaagccccagagggacagccaggcccagaagagccctgtgaagagcaagagcacccaccgcatccagcacaacatcgactacctgaagcacctgagcaaggtgaagaagatccccagcgactttgagggcagcggctacacagacctgcaggagcggggggacaatgacatcagccccttcagcggcacagccaacctgctgcggaccttcctggtgaaggagaagctgctggtgctgacctag

SEQ ID NO: 158928 - DNA, 1239 bp, Artificial Sequence
  Description of Artificial Sequence: Synthetic coding sequence
atgagcatctaccccaagagcacaggcaacaagggctttgaagatggagatgatgccatcagcaagctgcatgaccaggaggagtatggagctgccctgatccggaacaacatgcagcacatcatgggccctgtgacagccatcaagctgctgggggaggagaacaaggagaacaccccaagaaatgtgctgaacatcatcccagcctccatgaactatgccaaggcccacagcaaggacaagaagaagccccagagggacagccaggcccagaagagccctgtgaagagcaagagcacccaccgcatccagcacaacatcgactacctgaagcacctgagcaaggtgaagaagatccccagcgactttgagggcagcggctacacagacctgcaggagcggggggacaatgacatcagccccttctctggagatggccagcccttcaaggacatccctggaaaaggagaggccactggaccagacctggagggcaaggacatccagacaggctttgctggccccagcgaggccgagagcacccacctggacaccaagaagccaggctacaatgagatccctgagcgggaggagaatggaggcaacaccatcggcaccagagatgaaacagccaaggaggctgatgctgtggatgtgtccctggtggagggcagcaatgacatcatgggcagcaccaacttcaaggagctgcccggccgggagggcaacagagtggatgctggcagccagaatgcccaccagggcaaggtggagttccactaccccccagcccccagcaaggagaagaggaaggagggcagcagtgatgctgctgagagcaccaactacaatgagatccccaagaatggcaagggcagcaccaggaagggcgtggaccacagcaacagaaaccaggccaccctgaatgagaagcagcgcttccccagcaagggcaagagccagggcctgcccatccccagccggggcctggacaatgagatcaagaatgagatggacagcttcaacggccccagccatgagaacatcatcacccacggcaggaagtaccactacgtgccccaccggcagaacaacagcaccaggaacaagggcatgccccagggcaagggctcctggggccggcagccccacagcaacagacgcttcagcagcagaagaagagatgacagcagcgagagcagtgacagcggcagcagcagcgagagtgatggagactag

SEQ ID NO: 158929 - DNA, 1239 bp, Artificial Sequence; identical to SEQ ID NO: 158928
  Description of Artificial Sequence: Synthetic coding sequence

SEQ ID NO: 158930 - DNA, 312 bp, Artificial Sequence
  Description of Artificial Sequence: Synthetic coding sequence
atgaagagcctcatcctgctggccatcctggccgccctggccgtggtgaccctgtgctatgagagccatgagagcatggagagctatgagctgaaccccttcatcaacagaagaaatgccaacaccttcatcagcccccagcagcgctggagggccaaggtgcaggagcgcatccgggagaggagcaagcctgtgcatgagctgaaccgggaggcctgtgatgactaccgcctgtgtgaaagatatgccatggtgtatggctacaatgctgcctacaaccgctacttcaggaagagaagaggcaccaagtag

SEQ ID NO: 158931 - DNA, 945 bp, Artificial Sequence
  Description of Artificial Sequence: Synthetic coding sequence
atgggccccctcatcaaccgctgcaagaagatcctgctgcccaccaccgtgcccccagccaccatgaggatctggctgctgggcggcctgctgcccttcctgctgctgctgagcggcctgcagaggcccacagagggcagcgaggtggccatcaagattgactttgattttgcccctggcagctttgatgaccagtaccagggctgcagcaagcaggtgatggagaagctgacccagggcgactacttcaccaaggacatcgaggcccagaagaactacttcaggatgtggcagaaggcccacctggcctggctgaaccagggcaaggtgctgccccagaacatgaccaccacccatgctgtggccatcctcttctacaccctgaacagcaatgtgcacagcgacttcacccgggccatggcctctgtggcccggaccccccagcagtatgaaagaagcttccacttcaagtacctgcactactacctgaccagcgccatccagctgctgaggaaggacagcatcatggagaatggcaccctgtgctatgaggtgcactaccgcaccaaggatgtgcacttcaatgcctacaccggggccaccatccgcttcggccagttcctgagcaccagcctgctgaaggaggaggcccaggagtttggaaaccagaccctcttcaccatcttcacctgcctgggcgcccctgtgcagtacttcagcctgaagaaggaggtgctgatccccccctatgagctgttcaaggtgatcaacatgagctaccaccccaggggggactggctgcagctgcggagcacaggcaacctgagcacctacaactgccagctgctgaaggccagcagcaagaagtgcatcccagaccccatcgccatcgccagcctgtccttcctgaccagcgtcatcatcttcagcaagagccgggtgtag

SEQ ID NO: 158932 - DNA, 1749 bp, Artificial Sequence
  Description of Artificial Sequence: Synthetic coding sequence
atgagcattgagaccctgctggaggccgcccgcttcctggagtggcaggcccagcagcagcagagggcccgggaggagcaggagcggctgcggctggagcaggagcgggagcaggagcagaagaaggccaacagcctggcccggctggcccacaccctgcctgtggaggagcccaggatggaggccccacccctgcccctgagccccccagcccctcctccagcccctcctccacccctggccaccccagcccccctgaccgtcatccccatccctgtggtgaccaacagcccccagcccctgcccccacctccacccctgcctgctgctgcccagcccctgcccctggccccccggcagcctgccctggtgggcgcccctggcctgagcatcaaggagcccgcccccctgcccagccggccccaggtgcccaccccagcccccctgctgcctgacagcaaggccaccatcccccccaacggcagccccaagcccctgcagcccctgcccacccctgtgctgaccatcgccccccaccctggggtgcagccccagctggccccccagcagcccccaccacccaccctgggcaccctgaagctggccccagctgaggaggtgaagagcagcgagcagaagaagaggcctgggggcatcggcacccgggaggtgcacaacaagctggagaagaacagaagagcccacctgaaggagtgctttgagaccctgaagaggaacatccccaacgtggatgacaagaagaccagcaacctgtctgtgctgaggacagccctgcgctacatccagagcctgaagaggaaggagaaggagtatgagcacgagatggagcggctggcccgggagaagatcgccacccagcagaggctggccgagctgaagcatgagctgagccagtggatggatgtgctggagattgacagagtgctgcggcagacaggccagccagaagatgaccaggccagcaccagcacagccagcgagggggaggacaacattgatgaggacatggaggaggaccgggccggcctgggcccccccaagctgagccaccggccccagcctgagctgctgaagagcaccctgcccccacccagcaccaccccagcccccctgcccccccacccccacccccacccccacagcgtggccctgcccccagcccacctgcctgtgcagcagcagcagccccagcagaagacccccctgcctgcccctcctcctcctcctgctgccccagcccagaccctggtgcctgccccagcccacctggtggccacagctgggggcggcagcacagtgattgcccacacagccaccacccacgccagcgtcatccagacagtgaaccacgtgctgcagggccctgggggcaagcacatcgcccacatcgcccccagcgcccccagccctgctgtgcagctggccccagccaccccacccatcggccacatcaccgtgcacccagccaccctgaaccacgtggcccacctgggcagccagctgcccctgtacccccagcctgtggccgtgagccacatcgcccacaccctgagccaccagcaggtgaatggaacagctggcctgggccccccagccaccgtgatggccaagccagctgtgggcgcccaggtggtgcaccacccccagctggtgggccagacagtgctgaaccctgtgaccatggtgaccatgcccagcttccctgtgtccaccctgaagctggcctag

SEQ ID NO: 158933 - DNA, 1749 bp, Artificial Sequence; identical to SEQ ID NO: 158932
  Description of Artificial Sequence: Synthetic coding sequence

SEQ ID NO: 158934 - DNA, 594 bp, Artificial Sequence
  Description of Artificial Sequence: Synthetic coding sequence
atggagcccctggccagcaacatccaggtgctgctgcaggccgctgagttcctggagcggcgggagcgggaggccgagcacggctacgccagcctgtgcccccacaggagccctggccccatccacaggaggaagaagaggcctccccaggcccctggggcccaggacagcggccgctggagggcccagctgaagcgctgcctggagcggctgaagcagcagatgcccctgggcgctgactgtgcccgctacaccaccctgagcctgctgcggcgggccaggatgcacatccagaagctggaggaccaggagcagagggcccggcagctgaaggagcggctgcggagcaagcagcagagcctgcagaggcagctggagcagctgcggggcctggccggggctgctgagcgggagcggctgcgggctgacagcctggacagcagcggcctgagcagcgagaggagtgacagcgaccaggaggagctggaggtggatgtggagagcctggtgtttggaggagaggccgagctgctgcggggctttgtggccggccaggagcacagctacagccatggaggaggagcctggctgtag

SEQ ID NO: 158935 - DNA, 1167 bp, Artificial Sequence
  Description of Artificial Sequence: Synthetic coding sequence
atggagcccctggccagcaacatccaggtgctgctgcaggccgctgagttcctggagcggcgggagcgggaggccgagcacggctacgccagcctgtgcccccacaggagccctggccccatccacaggaggaagaagaggcctccccaggcccctggggcccaggacagcggccgctctgtgcacaatgagctggagaagagaagaagagcccagctgaagcgctgcctggagcggctgaagcagcagatgcccctgggcgctgactgtgcccgctacaccaccctgagcctgctgcggcgggccaggatgcacatccagaagctggaggaccaggagcagagggcccggcagctgaaggagcggctgcggagcaagcagcagagcctgcagaggcagctggagcagctgcggggcctggccggggctgctgagcgggagcggctgcgggctgacagcctggacagcagcggcctgagcagcgagaggagtgacagcgaccagggcgagtgcccagaggccgagggcctgtgtggccccagaggagagcccggcctgctgaccggccccctgcctgcccagaggtcctggcgctggatgtggagggcctggtgcctgggcgtgcggcccagctgctgcggggccagcagccctgcccggagcacagccaccaggacagctgctgcccctggctatgatgtgccccaccctggccgggccagcgccctgtacagctgccaggcccacctgcccggccgcagccccccccaggccttccgggccgcccggagccacctgctggagtggaccaagaggaccctggtgtgggagcaggtgctgcccaagcaccctgctgctggctgccaggccggccccctggagggcaagggccaggacagcagcggccccccctggaccccagctggccaggccgcctgggcccgggcccaggcctttggatctgctgcccccaagggcaccggcagcctgctgggcctcttccccagctggacccggcccccagcctttgccagccacaagctgtacagcatcttcatcaagagcctcttccacaacttccccagcatcgtgctgcccaatgaaaatggaggcacccccaaccaccggcccaccggccggggcaacaacatcagcagccaccactag

SEQ ID NO: 158936 - DNA, 582 bp, Artificial Sequence
  Description of Artificial Sequence: Synthetic coding sequence
atggagcccctggccagcaacatccaggtgctgctgcaggccgctgagttcctggagcggcgggagcgggaggccgagcacggctacgccagcctgtgcccccacaggagccctggccccatccacaggaggaagaagaggcctccccaggcccctggggcccaggacagcggccgctctgtgcacaatgagctggagaagagaagaagagcccagctgaagcgctgcctggagcggctgaagcagcagatgcccctgggcgctgactgtgcccgctacaccaccctgagcctgctgcggcgggccaggatgcacatccagaagctggaggaccaggagcagagggcccggcagctgaaggagcggctgcggagcaagcagcagagcctgcagaggcagctggagcagctgcggggcctggccggggctgctgagcgggagcggctgcgggctgacagcctggacagcagcggcctgagcagcgagaggagtgacagcgaccaggtgctgcccaatgaaaatggaggcacccccaaccaccggcccaccggccggggcaacaacatcagcagccaccactag

SEQ ID NO: 158937 - DNA, 621 bp, Artificial Sequence
  Description of Artificial Sequence: Synthetic coding sequence
atggagcccctggccagcaacatccaggtgctgctgcaggccgctgagttcctggagcggcgggagcgggaggccgagcacggctacgccagcctgtgcccccacaggagccctggccccatccacaggaggaagaagaggcctccccaggcccctggggcccaggacagcggccgctctgtgcacaatgagctggagaagagaagaagagcccagctgaagcgctgcctggagcggctgaagcagcagatgcccctgggcgctgactgtgcccgctacaccaccctgagcctgctgcggcgggccaggatgcacatccagaagctggaggaccaggagcagagggcccggcagctgaaggagcggctgcggagcaagcagcagagcctgcagaggcagctggagcagctgcggggcctggccggggctgctgagcgggagcggctgcgggctgacagcctggacagcagcggcctgagcagcgagaggagtgacagcgaccaggaggagctggaggtggatgtggagagcctggtgtttggaggagaggccgagctgctgcggggctttgtggccggccaggagcacagctacagccacggcggcggggcctggctgtag

SEQ ID NO: 158938 - DNA, 621 bp, Artificial Sequence; identical to SEQ ID NO: 158937
  Description of Artificial Sequence: Synthetic coding sequence

SEQ ID NO: 158939 - DNA, 768 bp, Artificial Sequence
  Description of Artificial Sequence: Synthetic coding sequence
atgatccaggccatccaggtgctgcgcttccacctgctggagctggagaaggtgcatgagctgtgtgacaacttctgccaccgctacatcagctgcctgaagggcaagatgcccatcgacctggtgattgatgaaagagatggcagcagcaagagtgaccacgaggagctgagcggcagcagcaccaacctggccgaccacaaccccagctcctggagggaccatgatgatgccaccagcacccacagcgctggcaccccaggccccagcagcggcggccacgccagccagagcggggacaacagcagcgagcagggagatggcctggacaacagcgtggccagccctggcactggagatgatgatgatcctgacaaggacaagaagaggcagaagaagaggggcatcttccccaaggtggccaccaacatcatgagggcctggctgttccagcacctgacccacccctaccccagcgaggagcagaagaagcagctggcccaggacaccggcctgaccatcctgcaggtgaacaactggttcatcaatgcccggcggcgcatcgtgcagcccatgattgaccagagcaacagagctggcttcctgctggaccccagcgtgtcccagggcgccgcctacagccctgagggccagcccatgggcagctttgtgctggatggccagcagcacatgggcatccggcctgctggccccatgagcggcatgggcatgaacatgggcatggatggccagtggcactacatgtag

SEQ ID NO: 158940 - DNA, 9081 bp, Artificial Sequence
  Description of Artificial Sequence: Synthetic coding sequence
atggaggagaagcagcagatcatcctggccaaccaggacggcggcaccgtggccggggccgcccccaccttctttgtgatcctgaagcagcctggaaatggcaagacagaccagggcatcctggtgaccaaccaggatgcctgtgccctggccagctctgtgagcagccctgtgaagagcaagggcaagatctgcctgcctgctgactgcaccgtgggcggcatcaccgtgaccctggacaacaacagcatgtggaatgagttctaccacaggagcacagagatgatcctgaccaagcagggccgcaggatgttcccctactgccgctactggatcaccggcctggacagcaacctgaagtacatcctggtgatggacatcagccctgtggacaaccaccgctacaagtggaatggccgctggtgggagcccagcggcaaggccgagccccacgtgctgggccgggtcttcatccaccctgagagccccagcacaggccactactggatgcaccagcctgtgtccttctacaagctgaagctgaccaacaacaccctggaccaggagggccacatcatcctgcacagcatgcaccgctacctgccccggctgcacctggtgcctgctgagaaggctgtggaggtgatccagctgaatggacctggggtgcacaccttcaccttcccccagacagagttctttgctgtgacagcctaccagaacatccagatcacccagctgaagattgactacaacccctttgccaagggcttcagagatgatggcctgaacaacaagccccagagagatggcaagcagaagaacagcagtgaccaggagggcaacaacatcagcagcagcagcggccaccgggtgcggctgacagagggccagggcagcgagatccagcccggggacctggaccccctgagccggggccacgagaccagcggcaagggcctggagaagaccagcctgaacatcaagagggacttcctgggcttcatggacacagacagcgccctgtctgaggtgccccagctgaagcaggagatcagcgagtgcctgattgccagcagctttgaagatgacagccgggtggccagccccctggaccagaatggcagcttcaacgtggtgatcaaggaggagcccctggatgattatgactatgagctgggagaatgtcctgagggcgtgacagtgaagcaggaggagacagatgaggagacagatgtgtacagcaacagtgatgatgaccccatcctggagaagcagctgaagaggcacaacaaggtggacaaccctgaggccgaccacctgagcagcaagtggctgcccagcagccccagcggcgtggccaaggccaagatgttcaagctggacaccgggaagatgcctgtggtgtacctggagccctgtgctgtgaccaggagcacagtgaagatcagcgagctgcctgacaacatgctgagcaccagcaggaaggacaagagctccatgctggccgagctggagtacctgcccacctacatcgagaacagcaatgaaacagccttctgcctgggcaaggagagtgaaaatggcctgaggaagcacagcccagacctgcgggtggtgcagaagtaccccctgctgaaggagccccagtggaagtacccagacatcagtgacagcatcagcacagagcgcatcctggatgacagcaaggacagcgtgggggacagcctgagcggcaaggaggacctgggcaggaagaggaccaccatgctgaagatcgccacagctgccaaggtggtgaatgccaaccagaatgccagccccaacgtgcctgggaagaggggccggcccaggaagctgaagctgtgcaaggccggccggccccccaagaacacaggcaagagcctcatcagcaccaagaacacccctgtgtccccaggcagcaccttcccagatgtgaagccagacctggaggatgtggatggagtgctgtttgtgtcctttgagagcaaggaggccctggacatccatgctgtggatggcaccacagaggagagcagcagcctgcaggccagcaccaccaatgattctggctaccgggcccgcatcagccagctggagaaggagctgattgaggacctgaagaccctgcggcacaagcaggtgatccaccctggcctgcaggaggtgggcctgaagctgaacagcgtggaccccaccatgagcattgacctgaagtacctgggcgtgcagctgcccctggccccagccaccagcttccccttctggaacctgaccggcaccaacccagccagcccagatgctggcttcccctttgtgtccaggacaggcaagaccaatgacttcaccaagatcaagggctggaggggcaagttccacagcgccagcgccagcagaaatgaaggaggcaacagcgagagcagcctgaagaacagaagtgccttctgcagcgacaagctggatgagtacctggagaatgaaggcaagctgatggagacctccatgggcttcagcagcaatgcccccaccagccctgtggtgtaccagctgcccaccaagagcaccagctatgtgaggaccctggacagcgtgctgaagaagcagagcaccatcagccccagcaccagctacagcctgaagccccacagcgtgccccctgtgtccaggaaggccaagagccagaaccggcaggccaccttcagcggccgcaccaagagcagctacaagagcatcctgccctaccctgtgagccccaagcagaagtacagccacgtgatcctgggggacaaggtgaccaagaacagcagcggcatcatcagcgagaaccaggccaacaactttgtggtgcccaccctggatgagaacatcttccccaagcagatcagcctgcggcaggcccagcagcagcagcagcagcagcagggcagcaggcctcctggcctgagcaagagccaggtgaagctgatggacctggaggactgtgccctgtgggagggcaagcccaggacctacatcacagaggagcgggcagatgtgtccctgaccaccctgctgacagcccaggccagcctgaagaccaagcccatccacaccatcatcaggaagagggccccaccctgcaacaatgacttctgccgcctgggctgtgtgtgcagcagcctggccctggagaagaggcagcctgcccactgccggcggccagactgcatgtttggctgcacctgcctgaagaggaaggtggtgctggtgaagggcggcagcaagaccaagcacttccagaggaaggccgcccaccgggaccccgtcttctatgacaccctgggggaggaggcccgggaggaggaggagggcatccgggaggaggaggagcagctgaaggagaagaagaagaggaagaagctggagtacaccatctgtgaaacagagcctgagcagcctgtgcgccactaccccctgtgggtgaaggtggagggggaggtggaccctgagcctgtgtacatccccacccccagcgtcatcgagcccatgaagcccctgctgctgccccagcctgaggtgctgagccccaccgtgaagggcaagctgctgaccggcatcaagagccccaggagctacacccccaagcccaaccctgtgatccgggaggaggacaaggaccctgtgtacctgtactttgagagcatgatgacctgtgcccgggtgcgggtgtatgaaaggaagaaggaggaccagaggcagcccagcagcagcagcagccccagccccagcttccagcagcagaccagctgccacagcagccctgagaaccacaacaatgccaaggagccagattctgagcagcagcccctgaagcagctgacctgtgacctggaggatgacagcgacaagctgcaggagaagtcctggaagagcagctgcaatgaaggagagagcagcagcaccagctacatgcaccagaggagccctgggggccccaccaagctgattgagatcatcagtgactgcaactgggaggaggacaggaacaagatcctgagcatcctgagccagcacatcaacagcaacatgccccagagcctgaaggtgggcagcttcatcatcgagctggccagccagaggaagagcagaggagagaagaacccccctgtgtacagcagccgggtgaagatctccatgcccagctgccaggaccaggatgacatggccgagaagagcggcagcgagaccccagatggccccctgagccctgggaagatggaggacatcagccctgtgcagacagatgccctggacagcgtgcgggagcggctgcatggaggcaagggcctgcccttctacgccggcctgagccctgctgggaagctggtggcctacaagaggaagcccagcagcagcaccagcggcctcatccaggtggccagcaatgccaaggtggccgccagcaggaagcccaggaccctgctgcccagcaccagcaacagcaagatggccagcagcagcggcacagccaccaacagacctgggaagaacctgaaggcctttgtgcctgccaagaggcccatcgccgcccggcccagccctgggggcgtcttcacccagtttgtgatgagcaaggtgggcgccctgcagcagaagatccctggggtgtccaccccccagaccctggccggcacccagaagttcagcatccggcccagccctgtgatggtggtgacccctgtggtgagcagcgagcctgtgcaggtgtgcagccctgtgacagctgctgtgaccaccaccaccccccaggtgttcctggagaacaccacagctgtgacccccatgacagccatcagtgatgtggagaccaaggagaccacctacagcagcggggccaccaccactggagtggtggaggtgtctgagaccaacaccagcacctctgtgaccagcacccagagcacagccaccgtgaacctgaccaagaccaccggcatcaccacccctgtggcctctgtggccttccccaagagcctggtggccagccccagcaccatcaccctgcctgtggccagcacagccagcaccagcctggtggtggtgacagctgctgccagcagctccatggtgaccacccccaccagcagcctgggctctgtgcccatcatcctgagcggcatcaatggcagcccccctgtgtcccagaggccagaaaatgctgcccagatccctgtggccaccccccaggtgagccccaacacagtgaagagagctggcccccggctgctgcaccccaacggccagatcgtgcagctgctgcccctgcaccagctgcggggcagcaacacccagcccaacctgcagcctgtgatgttcagaaatcctggctctgtgatgggcatccggctgcctgcccccagcaagcccagcgagaccccacccagcagcaccagcagcagcgccttctctgtgatgaaccctgtgatccaggccgtgggcagcagcagcgctgtgaatgtcatcacccaggcccccagcctgctgagcagcggggccagctttgtgtcccaggccggcaccctgaccctgcgcatcagccccccagagccccagagctttgccagcaagacaggcagcgagaccaagatcacctacagcagcggcggccagcctgtgggcacagccagcctcatccccctgcagagcggcagctttgccctgctgcagctgcccggccagaagcctgtgcccagcagcatcctgcagcacgtggccagcctgcagatgaagcgggagagccagaacccagaccagaaggatgagaccaacagcatcaagcgggagcaggagaccaagaaggtgctgcagagcgagggggaggccgtggaccctgaggccaacgtcatcaagcagaacagcggggccgccaccagcgaggagaccctgaatgacagcctggaggacagaggagaccacctggatgaggagtgcctgcctgaggagggctgtgccaccgtgaagcccagcgagcacagctgcatcaccggcagccacacagaccaggactacaaggatgtgaatgaggagtatggagccaggaacaggaagagcagcaaggagaaggtggccgtgctggaggtgaggaccatcagcgagaaggccagcaacaagacagtgcagaacctgagcaaggtgcagcaccagaagctgggagatgtgaaggtggagcagcagaagggctttgacaaccctgaggagaacagcagcgagttccctgtgaccttcaaggaggagagcaagtttgagctgagcggcagcaaggtgatggagcagcagagcaacctgcagcctgaggccaaggagaaggaatgtggggacagcctggagaaggaccgggagcgctggaggaagcacctgaagggccccctgaccaggaaatgtgtgggcgccagccaggagtgcaagaaggaggctgatgagcagctgatcaaggagaccaagacctgccaggagaacagtgatgtgttccagcaggagcagggcatcagtgacctgctgggcaagagcggcatcacagaagatgcccgggtgctgaagacagaatgtgacagctggagccgcatcagcaaccccagcgccttcagcatcgtgcccaggagagctgccaagagcagcagaggaaatggccacttccagggccacctgctgctgcccggggagcagatccagcccaagcaggagaagaagggcggccgcagcagcgctgacttcaccgtgctggacctggaggaggatgatgaagatgacaatgagaagacagatgacagcattgatgagatcgtggatgtggtgtctgactaccagagcgaggaggtggatgatgtggagaagaacaactgtgtggagtacattgaagatgatgaggagcacgtggacattgaaacagtggaggagctgtctgaggagatcaacgtggcccacctgaagaccacagctgcccacacccagagcttcaagcagcccagctgcacccacatctctgcagatgagaaggctgctgagaggagcaggaaggccccacccatccccctgaagctgaagccagactactggagcgacaagctgcagaaggaggccgaggcctttgcctactacagaaggacccacacagccaatgaaagaagaagaagaggagagatgagggacctgtttgagaagctgaagatcaccctgggcctgctgcacagcagcaaggtgtccaagagcctcatcctgacccgggccttcagcgagatccagggcctgacagaccaggccgacaagctgattggccagaagaacctgctgaccaggaagaggaacatcctgatcaggaaggtgagcagcctgagcggcaagacagaggaggtggtgctgaagaagctggagtacatctatgccaagcagcaggccctggaggcccagaagaggaagaagaagatgggcagtgatgaatttgacatcagcccccgcatcagcaagcagcaggagggcagcagcgccagctctgtggacctgggccagatgttcatcaacaacagaagaggcaagcccctcatcctgagcaggaagaaggaccaggccacagagaacaccagccccctgaacaccccccacaccagcgccaacctggtgatgaccccccagggccagctgctgaccctgaagggccccctcttcagcggccctgtggtggccgtgtccccagacctgctggagagtgacctgaagccccaggtggccggcagcgctgtggccctgcctgaaaatgatgacctcttcatgatgccccgcatcgtgaatgtgaccagcctggccacagagggcggcctggtggacatgggcggcagcaagtacccccatgaggtgcctgacagcaagcccagcgaccacctgaaggacacagtgagaaatgaagacaacagcctggaggacaagggccgcatcagcagccggggcaacagagatggccgggtgaccctgggccccacccaggtgttcctggccaacaaggacagcggctacccccagatcgtggatgtgagcaacatgcagaaggcccaggagttcctgcccaagaagatcagcggggacatgaggggcatccagtacaagtggaaggagagcgagagcagaggagagcgggtgaagagcaaggacagcagcttccacaagctgaagatgaaggacctgaaggacagcagcattgagatggagctgaggaaggtgaccagcgccatcgaggaggccgccctggacagcagcgagctgctgaccaacatggaggatgaagatgacacagatgagaccctgaccagcctgctgaatgaaattgccttcctgaaccagcagctgaatgatgacagcgtgggcctggccgagctgcccagctccatggacacagagttccctggagatgcccggcgggccttcatcagcaaggtgcccccaggcagccgggccaccttccaggtggagcacctgggcaccggcctgaaggagctgcctgatgtgcagggcgagagtgacagcatcagccccctgctgctgcacctggaggatgatgacttctctgaaaatgagaagcagctggccgagcccgccagcgagccagatgtgctgaagatcgtgattgattctgagatcaaggacagcctgctgagcaacaagaaggccattgatggcggcaagaacaccagcggcctgcctgctgagcctgagagcgtgagcagcccccccaccctgcacatgaagacaggcctggagaacagcaacagcacagacaccctgtggaggcccatgcccaagctggcccccctgggcctgaaggtggccaaccccagcagtgatgctgatggccagagcctgaaggtgatgccctgcctggcccccatcgccgccaaggtgggctctgtgggccacaagatgaacctgactggaaatgaccaggagggccgggagagcaaggtgatgcccaccctggcccctgtggtggccaagctgggcaacagcggggccagccccagcagcgctgggaagtag

SEQ ID NO: 158941 - DNA, 8571 bp, Artificial Sequence
  Description of Artificial Sequence: Synthetic coding sequence
atggaggagaagcagcagatcatcctggccaaccaggacggcggcaccgtggccggggccgcccccaccttctttgtgatcctgaagcagcctggaaatggcaagacagaccagggcatcctggtgaccaaccaggatgcctgtgccctggccagctctgtgagcagccctgtgaagagcaagggcaagatctgcctgcctgctgactgcaccgtgggcggcatcaccgtgaccctggacaacaacagcatgtggaatgagttctaccacaggagcacagagatgatcctgaccaagcagggccgcaggatgttcccctactgccgctactggatcaccggcctggacagcaacctgaagtacatcctggtgatggacatcagccctgtggacaaccaccgctacaagtggaatggccgctggtgggagcccagcggcaaggccgagccccacgtgctgggccgggtcttcatccaccctgagagccccagcacaggccactactggatgcaccagcctgtgtccttctacaagctgaagctgaccaacaacaccctggaccaggagggccacatcatcctgcacagcatgcaccgctacctgccccggctgcacctggtgcctgctgagaaggctgtggaggtgatccagctgaatggacctggggtgcacaccttcaccttcccccagacagagttctttgctgtgacagcctaccagaacatccagatcacccagctgaagattgactacaacccctttgccaagggcttcagagatgatggcctgaacaacaagccccagagagatggcaagcagaagaacagcagtgaccaggagggcaacaacatcagcagcagcagcggccaccgggtgcggctgacagagggccagggcagcgagatccagcccggggacctggaccccctgagccggggccacgagaccagcggcaagggcctggagaagaccagcctgaacatcaagagggacttcctgggcttcatggacacagacagcgccctgtctgaggtgccccagctgaagcaggagatcagcgagtgcctgattgccagcagctttgaagatgacagccgggtggccagccccctggaccagaatggcagcttcaacgtggtgatcaaggaggagcccctggatgattatgactatgagctgggagaatgtcctgagggcgtgacagtgaagcaggaggagacagatgaggagacagatgtgtacagcaacagtgatgatgaccccatcctggagaagcagctgaagaggcacaacaaggtggacaaccctgaggccgaccacctgagcagcaagtggctgcccagcagccccagcggcgtggccaaggccaagatgttcaagctggacaccgggaagatgcctgtggtgtacctggagccctgtgctgtgaccaggagcacagtgaagatcagcgagctgcctgacaacatgctgagcaccagcaggaaggacaagagctccatgctggccgagctggagtacctgcccacctacatcgagaacagcaatgaaacagccttctgcctgggcaaggagagtgaaaatggcctgaggaagcacagcccagacctgcgggtggtgcagaagtaccccctgctgaaggagccccagtggaagtacccagacatcagtgacagcatcagcacagagcgcatcctggatgacagcaaggacagcgtgggggacagcctgagcggcaaggaggacctgggcaggaagaggaccaccatgctgaagatcgccacagctgccaaggtggtgaatgccaaccagaatgccagccccaacgtgcctgggaagaggggccggcccaggaagctgaagctgtgcaaggccggccggccccccaagaacacaggcaagagcctcatcagcaccaagaacacccctgtgtccccaggcagcaccttcccagatgtgaagccagacctggaggatgtggatggagtgctgtttgtgtcctttgagagcaaggaggccctggacatccatgctgtggatggcaccacagaggagagcagcagcctgcaggccagcaccaccaatgattctggctaccgggcccgcatcagccagctggagaaggagctgattgaggacctgaagaccctgcggcacaagcaggtgatccaccctggcctgcaggaggtgggcctgaagctgaacagcgtggaccccaccatgagcattgacctgaagtacctgggcgtgcagctgcccctggccccagccaccagcttccccttctggaacctgaccggcaccaacccagccagcccagatgctggcttcccctttgtgtccaggacaggcaagaccaatgacttcaccaagatcaagggctggaggggcaagttccacagcgccagcgccagcagaaatgaaggaggcaacagcgagagcagcctgaagaacagaagtgccttctgcagcgacaagctggatgagtacctggagaatgaaggcaagctgatggagacctccatgggcttcagcagcaatgcccccaccagccctgtggtgtaccagctgcccaccaagagcaccagctatgtgaggaccctggacagcgtgctgaagaagcagagcaccatcagccccagcaccagctacagcctgaagccccacagcgtgccccctgtgtccaggaaggccaagagccagaaccggcaggccaccttcagcggccgcaccaagagcagctacaagagcatcctgccctaccctgtgagccccaagcagaagtacagccacgtgatcctgggggacaaggtgaccaagaacagcagcggcatcatcagcgagaaccaggccaacaactttgtggtgcccaccctggatgagaacatcttccccaagcagatcagcctgcggcaggcccagcagcagcagcagcagcagcagggcagcaggcctcctggcctgagcaagagccaggtgaagctgatggacctggaggactgtgccctgtgggagggcaagcccaggacctacatcacagaggagcgggcagatgtgtccctgaccaccctgctgacagcccaggccagcctgaagaccaagcccatccacaccatcatcaggaagagggccccaccctgcaacaatgacttctgccgcctgggctgtgtgtgcagcagcctggccctggagaagaggcagcctgcccactgccggcggccagactgcatgtttggctgcacctgcctgaagaggaaggtggtgctggtgaagggcggcagcaagaccaagcacttccagaggaaggccgcccaccgggaccccgtcttctatgacaccctgggggaggaggcccgggaggaggaggagggcatccgggaggaggaggagcagctgaaggagaagaagaagaggaagaagctggagtacaccatctgtgaaacagagcctgagcagcctgtgcgccactaccccctgtgggtgaaggtggagggggaggtggaccctgagcctgtgtacatccccacccccagcgtcatcgagcccatgaagcccctgctgctgccccagcctgaggtgctgagccccaccgtgaagggcaagctgctgaccggcatcaagagccccaggagctacacccccaagcccaaccctgtgatccgggaggaggacaaggaccctgtgtacctgtactttgagagcatgatgacctgtgcccgggtgcgggtgtatgaaaggaagaaggaggaccagaggcagcccagcagcagcagcagccccagccccagcttccagcagcagaccagctgccacagcagccctgagaaccacaacaatgccaaggagccagattctgagcagcagcccctgaagcagctgacctgtgacctggaggatgacagcgacaagctgcaggagaagtcctggaagagcagctgcaatgaaggagagagcagcagcaccagctacatgcaccagaggagccctgggggccccaccaagctgattgagatcatcagtgactgcaactgggaggaggacaggaacaagatcctgagcatcctgagccagcacatcaacagcaacatgccccagagcctgaaggtgggcagcttcatcatcgagctggccagccagaggaagagcagaggagagaagaacccccctgtgtacagcagccgggtgaagatctccatgcccagctgccaggaccaggatgacatggccgagaagagcggcagcgagaccccagatggccccctgagccctgggaagatggaggacatcagccctgtgcagacagatgccctggacagcgtgcgggagcggctgcatggaggcaagggcctgcccttctacgccggcctgagccctgctgggaagctggtggcctacaagaggaagcccagcagcagcaccagcggcctcatccaggtggccagcaatgccaaggtggccgccagcaggaagcccaggaccctgctgcccagcaccagcaacagcaagatggccagcagcagcggcacagccaccaacagacctgggaagaacctgaaggcctttgtgcctgccaagaggcccattgaaaatgctgcccagatccctgtggccaccccccaggtgagccccaacacagtgaagagagctggcccccggctgctgctgatccctgtgcagcagggcagccccaccctgcggcctgtgagcaacacccagctgcagggccacaggatggtgctgcagcctgtgcgcagccccagcggcatgaacctcttccgccaccccaacggccagatcgtgcagctgctgcccctgcaccagctgcggggcagcaacacccagcccaacctgcagcctgtgatgttcagaaatcctggctctgtgatgggcatccggctgcctgcccccagcaagcccagcgagaccccacccagcagcaccagcagcagcgccttctctgtgatgaaccctgtgatccaggccgtgggcagcagcagcgctgtgaatgtcatcacccaggcccccagcctgctgagcagcggggccagctttgtgtcccaggccggcaccctgaccctgcgcatcagccccccagagccccagagctttgccagcaagacaggcagcgagaccaagatcacctacagcagcggcggccagcctgtgggcacagccagcctcatccccctgcagagcggcagctttgccctgctgcagctgcccggccagaagcctgtgcccagcagcatcctgcagcacgtggccagcctgcagatgaagcgggagagccagaacccagaccagaaggatgagaccaacagcatcaagcgggagcaggagaccaagaaggtgctgcagagcgagggggaggccgtggaccctgaggccaacgtcatcaagcagaacagcggggccgccaccagcgaggagaccctgaatgacagcctggaggacagaggagaccacctggatgaggagtgcctgcctgaggagggctgtgccaccgtgaagcccagcgagcacagctgcatcaccggcagccacacagaccaggactacaaggatgtgaatgaggagtatggagccaggaacaggaagagcagcaaggagaaggtggccgtgctggaggtgaggaccatcagcgagaaggccagcaacaagacagtgcagaacctgagcaaggtgcagcaccagaagctgggagatgtgaaggtggagcagcagaagggctttgacaaccctgaggagaacagcagcgagttccctgtgaccttcaaggaggagagcaagtttgagctgagcggcagcaaggtgatggagcagcagagcaacctgcagcctgaggccaaggagaaggaatgtggggacagcctggagaaggaccgggagcgctggaggaagcacctgaagggccccctgaccaggaaatgtgtgggcgccagccaggagtgcaagaaggaggctgatgagcagctgatcaaggagaccaagacctgccaggagaacagtgatgtgttccagcaggagcagggcatcagtgacctgctgggcaagagcggcatcacagaagatgcccgggtgctgaagacagaatgtgacagctggagccgcatcagcaaccccagcgccttcagcatcgtgcccaggagagctgccaagagcagcagaggaaatggccacttccagggccacctgctgctgcccggggagcagatccagcccaagcaggagaagaagggcggccgcagcagcgctgacttcaccgtgctggacctggaggaggatgatgaagatgacaatgagaagacagatgacagcattgatgagatcgtggatgtggtgtctgactaccagagcgaggaggtggatgatgtggagaagaacaactgtgtggagtacattgaagatgatgaggagcacgtggacattgaaacagtggaggagctgtctgaggagatcaacgtggcccacctgaagaccacagctgcccacacccagagcttcaagcagcccagctgcacccacatctctgcagatgagaaggctgctgagaggagcaggaaggccccacccatccccctgaagctgaagccagactactggagcgacaagctgcagaaggaggccgaggcctttgcctactacagaaggacccacacagccaatgaaagaagaagaagaggagagatgagggacctgtttgagaagctgaagatcaccctgggcctgctgcacagcagcaaggtgtccaagagcctcatcctgacccgggccttcagcgagatccagggcctgacagaccaggccgacaagctgattggccagaagaacctgctgaccaggaagaggaacatcctgatcaggaaggtgagcagcctgagcggcaagacagaggaggtggtgctgaagaagctggagtacatctatgccaagcagcaggccctggaggcccagaagaggaagaagaagatgggcagtgatgaatttgacatcagcccccgcatcagcaagcagcaggagggcagcagcgccagctctgtggacctgggccagatgttcatcaacaacagaagaggcaagcccctcatcctgagcaggaagaaggaccaggccacagagaacaccagccccctgaacaccccccacaccagcgccaacctggtgatgaccccccagggccagctgctgaccctgaagggccccctcttcagcggccctgtggtggccgtgtccccagacctgctggagagtgacctgaagccccaggtggccggcagcgctgtggccctgcctgaaaatgatgacctcttcatgatgccccgcatcgtgaatgtgaccagcctggccacagagggcggcctggtggacatgggcggcagcaagtacccccatgaggtgcctgacagcaagcccagcgaccacctgaaggacacagtgagaaatgaagacaacagcctggaggacaagggccgcatcagcagccggggcaacagagatggccgggtgaccctgggccccacccaggtgttcctggccaacaaggacagcggctacccccagatcgtggatgtgagcaacatgcagaaggcccaggagttcctgcccaagaagatcagcggggacatgaggggcatccagtacaagtggaaggagagcgagagcagaggagagcgggtgaagagcaaggacagcagcttccacaagctgaagatgaaggacctgaaggacagcagcattgagatggagctgaggaaggtgaccagcgccatcgaggaggccgccctggacagcagcgagctgctgaccaacatggaggatgaagatgacacagatgagaccctgaccagcctgctgaatgaaattgccttcctgaaccagcagctgaatgatgacagcgtgggcctggccgagctgcccagctccatggacacagagttccctggagatgcccggcgggccttcatcagcaaggtgcccccaggcagccgggccaccttccaggtggagcacctgggcaccggcctgaaggagctgcctgatgtgcagggcgagagtgacagcatcagccccctgctgctgcacctggaggatgatgacttctctgaaaatgagaagcagctggccgagcccgccagcgagccagatgtgctgaagatcgtgattgattctgagatcaaggacagcctgctgagcaacaagaaggccattgatggcggcaagaacaccagcggcctgcctgctgagcctgagagcgtgagcagcccccccaccctgcacatgaagacaggcctggagaacagcaacagcacagacaccctgtggaggcccatgcccaagctggcccccctgggcctgaaggtggccaaccccagcagtgatgctgatggccagagcctgaaggtgatgccctgcctggcccccatcgccgccaaggtgggctctgtgggccacaagatgaacctgactggaaatgaccaggagggccgggagagcaaggtgatgcccaccctggcccctgtggtggccaagctgggcaacagcggggccagccccagcagcgctgggaagtag

SEQ ID NO: 158942 - DNA, 687 bp, Artificial Sequence
  Description of Artificial Sequence: Synthetic coding sequence
atggagcgggtgaagatgatcaacgtgcagaggctgctggaggccgctgagttcctggagcggcgggagagagaatgtgagcacggctacgccagcagcttccccagcatgcccagcccccggctgcagcacagcaagccaccccggcggctgagccgggcccagaagcacagcagcggcagcagcaacaccagcacagccaacagaagcacccacaatgagctggagaagaacagaagagcccacctgcggctgtgcctggagcggctgaaggtgctgatccccctgggccctgactgcaccaggcacaccaccctgggcctgctgaacaaggccaaggcccacatcaagaagctggaggaggccgagaggaagagccagcaccagctggagaacctggagcgggagcagcgcttcctgaagtggaggctggagcagctgcagggcccccaggagatggagcgcatccgcatggacagcatcggcagcaccatcagcagtgacagaagtgacagcgagcgggaggagattgaggtggatgtggagagcacagagttcagccacggggaggtggacaacatcagcaccaccagcatcagtgacattgatgaccacagcagcctgcccagcattggaagtgatgagggctacagcagcgcctctgtgaagctgtccttcaccagctag

SEQ ID NO: 158943 - DNA, 888 bp, Artificial Sequence
  Description of Artificial Sequence: Synthetic coding sequence
atgggcaagaggggccggcccaggaaggaggcccgctgtgagggcgccggcctggccccagctgcccctcctgctgtgcccccagctgtggccgccccccagcccccagccctgcctgaggaccctgctggggccaagccccgctgccccttcagtgacatcttcaacaccagtgaaaattccatggagaagcacatcaacaccttcctgcagaatgtgcagatcctgctggaggccgccagctacctggagcagatcgagaaggagaacaagaagtgtgaacatggctacgccagcagcttccccagcatgcccagcccccggctgcagcacagcaagccaccccggcggctgagccgggcccagaagcacagcagcggcagcagcaacaccagcacagccaacagaagcacccacaatgagctggagaagaacagaagagcccacctgcggctgtgcctggagcggctgaaggtgctgatccccctgggccctgactgcaccaggcacaccaccctgggcctgctgaacaaggccaaggcccacatcaagaagctggaggaggccgagaggaagagccagcaccagctggagaacctggagcgggagcagcgcttcctgaagtggaggctggagcagctgcagggcccccaggagatggagcgcatccgcatggacagcatcggcagcaccatcagcagtgacagaagtgacagcgagcgggaggagattgaggtggatgtggagagcacagagttcagccatggagaggtggacaacatcagcaccaccagcatcagtgacattgatgaccacagcagcctgcccagcatcggcagtgatgagggctacagcagcgcctctgtgaagctgtccttcaccagctag

SEQ ID NO: 158944 - DNA, 549 bp, Artificial Sequence
  Description of Artificial Sequence: Synthetic coding sequence
atgcccagcccccggctgcagcacagcaagccaccccggcggctgagccgggcccagaagcacagcagcggcagcagcaacaccagcacagccaacagaagagcccacctgcggctgtgcctggagcggctgaaggtgctgatccccctgggccctgactgcaccaggcacaccaccctgggcctgctgaacaaggccaaggcccacatcaagaagctggaggaggccgagaggaagagccagcaccagctggagaacctggagcgggagcagcgcttcctgaagtggaggctggagcagctgcagggcccccaggagatggagcgcatccgcatggacagcatcggcagcaccatcagcagtgacagaagtgacagcgagcgggaggagattgaggtggatgtggagagcacagagttcagccacggggaggtggacaacatcagcaccaccagcatcagtgacattgatgaccacagcagcctgcccagcattggaagtgatgagggctacagcagcgcctctgtgaagctgtccttcaccagctag

SEQ ID NO: 158945 - DNA, 579 bp, Artificial Sequence
  Description of Artificial Sequence: Synthetic coding sequence
atgcccagcccccggctgcagcacagcaagccaccccggcggctgagccgggcccagaagcacagcagcggcagcagcaacaccagcacagccaacagaagcacccacaatgagctggagaagaacagaagagcccacctgcggctgtgcctggagcggctgaaggtgctgatccccctgggccctgactgcaccaggcacaccaccctgggcctgctgaacaaggccaaggcccacatcaagaagctggaggaggccgagaggaagagccagcaccagctggagaacctggagcgggagcagcgcttcctgaagtggaggctggagcagctgcagggcccccaggagatggagcgcatccgcatggacagcatcggcagcaccatcagcagtgacagaagtgacagcgagcgggaggagattgaggtggatgtggagagcacagagttcagccacggggaggtggacaacatcagcaccaccagcatcagtgacattgatgaccacagcagcctgcccagcattggaagtgatgagggctacagcagcgcctctgtgaagctgtccttcaccagctag

SEQ ID NO: 158946 - DNA, 579 bp, Artificial Sequence; identical to SEQ ID NO: 158945
  Description of Artificial Sequence: Synthetic coding sequence

SEQ ID NO: 158947 - DNA, 579 bp, Artificial Sequence; identical to SEQ ID NO: 158945
  Description of Artificial Sequence: Synthetic coding sequence

SEQ ID NO: 158948 - DNA, 657 bp, Artificial Sequence
  Description of Artificial Sequence: Synthetic coding sequence
atggagcgggtgaagatgatcaacgtgcagaggctgctggaggccgctgagttcctggagcggcgggagagagaatgtgagcacggctacgccagcagcttccccagcatgcccagcccccggctgcagcacagcaagccaccccggcggctgagccgggcccagaagcacagcagcggcagcagcaacaccagcacagccaacagaagagcccacctgcggctgtgcctggagcggctgaaggtgctgatccccctgggccctgactgcaccaggcacaccaccctgggcctgctgaacaaggccaaggcccacatcaagaagctggaggaggccgagaggaagagccagcaccagctggagaacctggagcgggagcagcgcttcctgaagtggaggctggagcagctgcagggcccccaggagatggagcgcatccgcatggacagcatcggcagcaccatcagcagtgacagaagtgacagcgagcgggaggagattgaggtggatgtggagagcacagagttcagccacggggaggtggacaacatcagcaccaccagcatcagtgacattgatgaccacagcagcctgcccagcattggaagtgatgagggctacagcagcgcctctgtgaagctgtccttcaccagctag

SEQ ID NO: 158949 - DNA, 657 bp, Artificial Sequence; identical to SEQ ID NO: 158948
  Description of Artificial Sequence: Synthetic coding sequence

SEQ ID NO: 158950 - DNA, 357 bp, Artificial Sequence
  Description of Artificial Sequence: Synthetic coding sequence
atgcccagcccccggctgcagcacagcaagccaccccggcggctgagccgggcccagaagcacagcagcggcagcagcaacaccagcacagccaacagaagcacccacaatgagctggagaagaacagaagagcccacctgcggctgtgcctggagcggctgaaggtgctgatccccctgggccctgactgcaccaggcacaccaccctgggcctgctgaacaaggccaaggcccacatcaagaagctggaggaggccgagaggaagagccagcaccagctggagaacctggagcgggagcagcgcttcctgaagtggaggctggagcagctgcagggcccccaggagatggagtag

SEQ ID NO: 158951 - DNA, 681 bp, Artificial Sequence
  Description of Artificial Sequence: Synthetic coding sequence
atgggcaagaggggccggcccaggaaggaggcccgctgtgagggcgccggcctggccccagctgcccctcctgctgtgcccccagctgtggccgccccccagcccccagccctgcctgaggaccctgctggggccaagccccgctgccccttcagtgacatcttcaacaccagtgaaaattccatggagaagcacatcaacaccttcctgcagaatgtgcagatcctgctggaggccgccagctacctggagcagatcgagaaggagaacaagaagtgtgaacatggctacgccagcagcttccccagcatgcccagcccccggctgcagcacagcaagccaccccggcggctgagccgggcccagaagcacagcagcggcagcagcaacaccagcacagccaacagaagagcccacctgcggctgtgcctggagcggctgaaggtgctgatccccctgggccctgactgcaccaggcacaccaccctgggcctgctgaacaaggccaaggcccacatcaagaagctggaggaggccgagaggaagagccagcaccagctggagaacctggagcgggagcagcgcttcctgaagtggaggctggagcagctgcagggcccccaggagatggagcgcatccgcatggacagcatcggcagcaccatcagcagtgacagatag

SEQ ID NO: 158952 - DNA, 897 bp, Artificial Sequence
  Description of Artificial Sequence: Synthetic coding sequence
atgacagagcccggggccagccctgaggacccctgggtgaaggccagccctgtgggcgcccacgccggggagggccgggccggccgggcccgggccaggagaggagctggccggcggggggccagcctgctgagccccaagagccccaccctgtctgtgccccggggctgccgggaggacagcagccacccagcctgtgccaaggtggagtatgcctacagcgacaacagcctggaccccggcctgtttgtggagagcaccaggaaaggatctgtggtgtcccgggccaacagcatcggcagcaccagcgccagctctgtgcccaacacagatgatgaagattctgactaccaccaggaggcctacaaggagagctacaaggacagaagaagaagagcccacacccaggccgagcagaagagaagagatgccatcaagaggggctatgatgacctgcagaccatcgtgcccacctgccagcagcaggacttcagcatcggcagccagaagctgagcaaggccatcgtgctgcagaagaccatcgactacatccagttcctgcacaaggagaagaagaagcaggaggaggaggtgtccaccctgaggaaggatgtgacagccctgaagatcatgaaggtgaactatgagcagatcgtgaaggcccaccaggacaacccccatgaaggagaggaccaggtgtctgaccaggtgaagttcaacgtgttccagggcatcatggacagcctcttccagagcttcaatgccagcatctctgtggccagcttccaggagctgagcgcctgtgtgttctcctggattgaggagcactgcaagccccagaccctgcgggagatcgtgattggagtgctgcaccagctgaagaaccagctgtactag

SEQ ID NO: 158953 - DNA, 645 bp, Artificial Sequence
  Description of Artificial Sequence: Synthetic coding sequence
atgacagagcccggggccagccctgaggacccctgggtgaaggtggagtatgcctacagcgacaacagcctggaccctgatgatgaagattctgactaccaccaggaggcctacaaggagagctacaaggacagaagaagaagagcccacacccaggccgagcagaagagaagagatgccatcaagaggggctatgatgacctgcagaccatcgtgcccacctgccagcagcaggacttcagcatcggcagccagaagctgagcaaggccatcgtgctgcagaagaccatcgactacatccagttcctgcacaaggagaagaagaagcaggaggaggaggtgtccaccctgaggaaggatgtgacagccctgaagatcatgaaggtgaactatgagcagatcgtgaaggcccaccaggacaacccccatgaaggagaggaccaggtgtctgaccaggtgaagttcaacgtgttccagggcatcatggacagcctcttccagagcttcaatgccagcatctctgtggccagcttccaggagctgagcgcctgtgtgttctcctggattgaggagcactgcaagccccagaccctgcgggagatcgtgattggagtgctgcaccagctgaagaaccagctgtactag

SEQ ID NO: 158954 - DNA, 735 bp, Artificial Sequence
  Description of Artificial Sequence: Synthetic coding sequence
atgacagagcccggggccagccctgaggacccctgggtgaaggtggagtatgcctacagcgacaacagcctggaccccggcctgtttgtggagagcaccaggaaaggatctgtggtgtcccgggccaacagcatcggcagcaccagcgccagctctgtgcccaacacagatgatgaagattctgactaccaccaggaggcctacaaggagagctacaaggacagaagaagaagagcccacacccaggccgagcagaagagaagagatgccatcaagaggggctatgatgacctgcagaccatcgtgcccacctgccagcagcaggacttcagcatcggcagccagaagctgagcaaggccatcgtgctgcagaagaccatcgactacatccagttcctgcacaaggagaagaagaagcaggaggaggaggtgtccaccctgaggaaggatgtgacagccctgaagatcatgaaggtgaactatgagcagatcgtgaaggcccaccaggacaacccccatgaaggagaggaccaggtgtctgaccaggtgaagttcaacgtgttccagggcatcatggacagcctcttccagagcttcaatgccagcatctctgtggccagcttccaggagctgagcgcctgtgtgttctcctggattgaggagcactgcaagccccagaccctgcgggagatcgtgattggagtgctgcaccagctgaagaaccagctgtactag

SEQ ID NO: 158955 - DNA, 2826 bp, Artificial Sequence
  Description of Artificial Sequence: Synthetic coding sequence
atggccgaggccaacccccggcggggcaagatgaggttcagaagaaatgctgccagcttccctggcaacctgcacctggtgctggtgctgcggcccaccagcttcctgcagaggaccttcacagacatcggcttctggttcagccaggaggacttcatgctgaagctgcctgtggtgatgctgagctctgtgtctgacctgctgacctacattgatgacaagcagctgaccccagagctgggcggcaccctgcagtactgccacagcgagtggatcatcttcagaaatgccattgaaaattttgccctgactgtgaaggagatggcccagatgctgcagagctttggaacagagctggccgagacagagctgcctgatgacatccccagcattgaggagatcctggccatccgggcagagcgctaccacctgctgaagaatgacatcacagctgtgaccaaggagggcaagatcctgctgaccaacctggaggtgcctgacacagagggcgctgtgagcagccggctggagtgccaccggcagatcagcggggactggcagaccatcaacaagctgctgacccaggtgcatgacatggagacagcctttgatggcttctgggagaagcaccagctgaagatggagcagtacctgcagctgtggaagtttgagcaggacttccagcagctggtgacagaggtggagttcctgctgaaccagcaggccgagctggctgatgtgacaggcaccatcgcccaggtgaagcagaagatcaagaagctggagaacctggatgagaacagccaggagctgctgagcaaggcccagtttgtgatcctgcacggccacaagctggccgccaaccaccactacgccctggacctgatctgccagcgctgcaatgagctgcgctacctgagtgacatcctggtgaatgagatcaaggccaagaggatccagctgagcaggaccttcaagatgcacaagctgctgcagcaggcccggcagtgctgtgatgaaggagagtgcctgctggccaaccaggagattgacaagttccagagcaaagaagatgcccagaaggccctgcaggacatcgagaacttcctggagatggccctgcccttcatcaactatgagcctgagaccctgcagtatgaatttgatgtgatcctgagccctgagctgaaggtgcagatgaagaccatccagctgaagctggagaacatccgcagcatctttgagaaccagcaggccggcttcaggaacctggccgacaagcacgtgcggcccatccagtttgtggtgcccaccccagagaacctggtgaccagcggcacccccttcttcagcagcaagcaggtgggcgtgggctacagcttcttccaggcctgcaagctgttcagcaagggcaagaagacctggaggcagaaccagagcaacctgaagattgaggtggtgcctgactgccaggagaagaggagcagcggccccagcagcagcctggacaatggaaacagcctggatgtgctgaagaaccacgtgctgaatgaactcatccagacagagcgggtgtatgtgcgggagctgtacacagtgctgctgggctacagagctgagatggacaaccctgagatgtttgacctgatgccacccctgctgaggaacaagaaggacatcctgtttggaaacatggccgagatctatgagttccacaatgacatcttcctgagcagcctggagaactgtgcccacgcccctgagcgggtgggcccctgcttcctggagaggaaggatgacttccagatgtatgccaagtactgccagaacaagcccaggtctgagaccatctggaggaagtacagtgaatgtgccttcttccaggagtgccagaggaagctgaagcaccggctgcggctggacagctacctgctgaagcctgtgcagaggatcaccaagtaccagctgctgctgaaggagctgctgaagtacagcaaggactgtgagggcagcgccctgctgaagaaggccctggatgccatgctggacctgctgaagtctgtgaatgacagcatgcaccagatcgccatcaatggctacatcggcaacctgaatgagctgggcaagatgatcatgcagggcggcttctctgtgtggattggccacaagaagggggccaccaagatgaaggacctggcccgcttcaagcccatgcagaggcacctgttcctgtatgagaaggccatcgtgttctgcaagagaagagtggagagcggggagggcagtgaccgctaccccagctacagcttcaagcactgctggaagatggatgaggtgggcatcacagaatatgtgaagggggacaacaggaagtttgagatctggtacggggagaaggaggaggtgtacatcgtgcaggccagcaatgtggatgtgaagatgacctggctgaaggagatccggaacatcctgctgaagcagcaggagctgctgactgtgaagaagaggaagcagcaggaccagctgacagagcgggacaagttccagatcagcctgcagcagaatgatgagaagcagcagggcgccttcatcagcacagaggagacagagctggagcacaccagcacagtggtggaggtgtgtgaggccatcgcctctgtgcaggccgaggccaacacagtgtggacagaggccagccagagcgctgagatcagcgaggagcctgctgagtggagcagcaactacttctaccccacctatgatgaaaatgaggaggagaaccggcccctgatgaggcctgtgtctgagatggccctgctgtactag

SEQ ID NO: 158956 - DNA, 2583 bp, Artificial Sequence
  Description of Artificial Sequence: Synthetic coding sequence
atggccgaggccaacccccggcggggcaagatgaggttcagaagaaatgctgccagcttccctggcaacctgcacctggtgctggtgctgcggcccaccagcttcctgcagaggaccttcacagacatcggcttctggttcagccaggaggacttcatgctgaagctgcctgtggtgatgctgagctctgtgtctgacctgctgacctacattgatgacaagcagctgaccccagagctgggcggcaccctgcagtactgccacagcgagtggatcatcttcagaaatgccattgaaaattttgccctgactgtgaaggagatggcccagatgctgcagagctttggaacagagctggccgagacagagctgcctgatgacatccccagcattgaggagatcctggccatccgggcagagcgctaccacctgctgaagaatgacatcacagctgtgaccaaggagggcaagatcctgctgaccaacctggaggtgcctgacacagagggcgctgtgagcagccggctggagtgccaccggcagatcagcggggactggcagaccatcaacaagctgctgacccaggtgcatgacatggagacagcctttgatggcttctgggagaagcaccagctgaagatggagcagtacctgcagctgtggaagtttgagcaggacttccagcagctggtgacagaggtggagttcctgctgaaccagcaggccgagctggctgatgtgacaggcaccatcgcccaggtgaagcagaagatcaagaagctggagaacctggatgagaacagccaggagctgctgagcaaggcccagtttgtgatcctgcacggccacaagctggccgccaaccaccactacgccctggacctgatctgccagcgctgcaatgagctgcgctacctgagtgacatcctggtgaatgagatcaaggccaagaggatccagctgagcaggaccttcaagatgcacaagctgctgcagcaggcccggcagtgctgtgatgaaggagagtgcctgctggccaaccaggagattgacaagttccagagcaaagaagatgcccagaaggccctgcaggacatcgagaacttcctggagatggccctgcccttcatcaactatgagcctgagaccctgcagtatgaatttgatgtgatcctgagccctgagctgaaggtgcagatgaagaccatccagctgaagctggagaacatccgcagcatctttgagaaccagcaggccggcttcaggaacctggccgacaagcacgtgcggcccatccagtttgtggtgcccaccccagagaacctggtgaccagcggcacccccttcttcagcagcaagcagggcaagaagacctggaggcagaaccagagcaacctgaagattgaggtggtgcctgactgccaggagaagaggagcagcggccccagcagcagcctggacaatggaaacagcctggatgtgctgaagaaccacgtgctgaatgaactcatccagacagagcgggtgtatgtgcgggagctgtacacagtgctgctgggctacagagctgagatggacaaccctgagatgtttgacctgatgccacccctgctgaggaacaagaaggacatcctgtttggaaacatggccgagatctatgagttccacaatgacatcttcctgagcagcctggagaactgtgcccacgcccctgagcgggtgggcccctgcttcctggagaggaaggatgacttccagatgtatgccaagtactgccagaacaagcccaggtctgagaccatctggaggaagtacagtgaatgtgccttcttccaggagtgccagaggaagctgaagcaccggctgcggctggacagctacctgctgaagcctgtgcagaggatcaccaagtaccagctgctgctgaaggagctgctgaagtacagcaaggactgtgagggcagcgccctgctgaagaaggccctggatgccatgctggacctgctgaagtctgtgaatgacagcatgcaccagatcgccatcaatggctacatcggcaacctgaatgagctgggcaagatgatcatgcagggcggcttctctgtgtggattggccacaagaagggggccaccaagatgaaggacctggcccgcttcaagcccatgcagaggcacctgttcctgtatgagaaggccatcgtgttctgcaagagaagagtggagagcggggagggcagtgaccgctaccccagctacagcttcaagcactgctggaagatggatgaggtgggcatcacagaatatgtgaagggggacaacaggaagtttgagatctggtacggggagaaggaggaggtgtacatcgtgcaggccagcaatgtggatgtgaagatgacctggctgaaggagatccggaacatcctgctgaagcagcaggagctgctgactgtgaagaagaggaagcagcaggaccagctgacagagcgggacaagttccagatcagcctgcagcagaatgatgaggacctgtgccgccgctggctgagctacattgatgaggccaccatgagcaatggcaagtag

SEQ ID NO: 158957 - DNA, 2778 bp, Artificial Sequence
  Description of Artificial Sequence: Synthetic coding sequence
atggccgaggccaacccccggcggggcaagatgaggttcagaagaaatgctgccagcttccctggcaacctgcacctggtgctggtgctgcggcccaccagcttcctgcagaggaccttcacagacatcggcttctggttcagccaggaggacttcatgctgaagctgcctgtggtgatgctgagctctgtgtctgacctgctgacctacattgatgacaagcagctgaccccagagctgggcggcaccctgcagtactgccacagcgagtggatcatcttcagaaatgccattgaaaattttgccctgactgtgaaggagatggcccagatgctgcagagctttggaacagagctggccgagacagagctgcctgatgacatccccagcattgaggagatcctggccatccgggcagagcgctaccacctgctgaagaatgacatcacagctgtgaccaaggagggcaagatcctgctgaccaacctggaggtgcctgacacagagggcgctgtgagcagccggctggagtgccaccggcagatcagcggggactggcagaccatcaacaagctgctgacccaggtgcatgacatggagacagcctttgatggcttctgggagaagcaccagctgaagatggagcagtacctgcagctgtggaagtttgagcaggacttccagcagctggtgacagaggtggagttcctgctgaaccagcaggccgagctggctgatgtgacaggcaccatcgcccaggtgaagcagaagatcaagaagctggagaacctggatgagaacagccaggagctgctgagcaaggcccagtttgtgatcctgcacggccacaagctggccgccaaccaccactacgccctggacctgatctgccagcgctgcaatgagctgcgctacctgagtgacatcctggtgaatgagatcaaggccaagaggatccagctgagcaggaccttcaagatgcacaagctgctgcagcaggcccggcagtgctgtgatgaaggagagtgcctgctggccaaccaggagattgacaagttccagagcaaagaagatgcccagaaggccctgcaggacatcgagaacttcctggagatggccctgcccttcatcaactatgagcctgagaccctgcagtatgaatttgatgtgatcctgagccctgagctgaaggtgcagatgaagaccatccagctgaagctggagaacatccgcagcatctttgagaaccagcaggccggcttcaggaacctggccgacaagcacgtgcggcccatccagtttgtggtgcccaccccagagaacctggtgaccagcggcacccccttcttcagcagcaagcagggcaagaagacctggaggcagaaccagagcaacctgaagattgaggtggtgcctgactgccaggagaagaggagcagcggccccagcagcagcctggacaatggaaacagcctggatgtgctgaagaaccacgtgctgaatgaactcatccagacagagcgggtgtatgtgcgggagctgtacacagtgctgctgggctacagagctgagatggacaaccctgagatgtttgacctgatgccacccctgctgaggaacaagaaggacatcctgtttggaaacatggccgagatctatgagttccacaatgacatcttcctgagcagcctggagaactgtgcccacgcccctgagcgggtgggcccctgcttcctggagaggaaggatgacttccagatgtatgccaagtactgccagaacaagcccaggtctgagaccatctggaggaagtacagtgaatgtgccttcttccaggagtgccagaggaagctgaagcaccggctgcggctggacagctacctgctgaagcctgtgcagaggatcaccaagtaccagctgctgctgaaggagctgctgaagtacagcaaggactgtgagggcagcgccctgctgaagaaggccctggatgccatgctggacctgctgaagtctgtgaatgacagcatgcaccagatcgccatcaatggctacatcggcaacctgaatgagctgggcaagatgatcatgcagggcggcttctctgtgtggattggccacaagaagggggccaccaagatgaaggacctggcccgcttcaagcccatgcagaggcacctgttcctgtatgagaaggccatcgtgttctgcaagagaagagtggagagcggggagggcagtgaccgctaccccagctacagcttcaagcactgctggaagatggatgaggtgggcatcacagaatatgtgaagggggacaacaggaagtttgagatctggtacggggagaaggaggaggtgtacatcgtgcaggccagcaatgtggatgtgaagatgacctggctgaaggagatccggaacatcctgctgaagcagcaggagctgctgactgtgaagaagaggaagcagcaggaccagctgacagagcgggacaagttccagatcagcctgcagcagaatgatgagaagcagcagggcgccttcatcagcacagaggagacagagctggagcacaccagcacagtggtggaggtgtgtgaggccatcgcctctgtgcaggccgaggccaacacagtgtggacagaggccagccagagcgctgagatcagcgaggagcctgctgagtggagcagcaactacttctaccccacctatgatgaaaatgaggaggagaaccggcccctgatgaggcctgtgtctgagatggccctgctgtactag

SEQ ID NO: 158958 - DNA, 3213 bp, Artificial Sequence
  Description of Artificial Sequence: Synthetic coding sequence
atgccccaggccgccgccagcgccccctggacctctgtgtcctgtggccgcatccctggcctgccccagaacccagatggctgcaccttcatgcccatcgcccaggccatccccctgcaggtggacatggccatggccctgcagagggtgagaattgctgagaagtatggcaagaactacctgtgcctgctgcaggccgtgtttgtggccgagacagacctgctgctgcgcatcaaggacatcagccacttcctgatgcaggacatcgccttcctgagcggcggccggggcaaggacaatgcctggatcatcaccttccctgagaactgcaacttccgctgcatccctgaggaggtgattgccaaggtgctgacctacctgaccagcatcgcccggcagaatggaagtgacagccgcttcaccatcatcctggaccggcggctggacacctggagcagcctgaagatcagcctgcagaagatcagcgccagcttccctggcaacctgcacctggtgctggtgctgcggcccaccagcttcctgcagaggaccttcacagacatcggcttctggttcagccaggaggacttcatgctgaagctgcctgtggtgatgctgagctctgtgtctgacctgctgacctacattgatgacaagcagctgaccccagagctgggcggcaccctgcagtactgccacagcgagtggatcatcttcagaaatgccatcgagaactttgccctgactgtgaaggagatggcccagatgctgcagagctttggaacagagctggccgagacagagctgcctgatgacatccccagcattgaggagatcctggccatccgggcagagcgctaccacctgctgaagaatgacatcacagctgtgaccaaggagggcaagatcctgctgaccaacctggaggtgcctgacacagaaggagctgtgagcagccggctggagtgccaccggcagatcagcggggactggcagaccatcaacaagctgctgacccaggtgcatgacatggagacagcctttgatggcttctgggagaagcaccagctgaagatggagcagtacctgcagctgtggaagtttgagcaggacttccagcagctggtgacagaggtggagttcctgctgaaccagcaggccgagctggctgatgtgacaggcaccatcgcccaggtgaagcagaagatcaagaagctggagaacctggatgagaacagccaggagctgctgagcaaggcccagtttgtgatcctgcacggccacaagctggccgccaaccaccactacgccctggacctgatctgccagcgctgcaatgagctgcgctacctgagtgacatcctggtgaatgagatcaaggccaagaggatccagctgagcaggaccttcaagatgcacaagctgctgcagcaggcccggcagtgctgtgatgaaggagaatgtctgctggccaaccaggagattgacaagttccagagcaaggaggatgcccagaaggccctgcaggacatcgagaacttcctggagatggccctgcccttcatcaactatgagcctgagaccctgcagtatgaatttgatgtgatcctgagccctgagctgaaggtgcagatgaagaccatccagctgaagctggagaacatccgcagcatctttgagaaccagcaggccggcttcaggaacctggccgacaagcacgtgcggcccatccagtttgtggtgcccaccccagagaacctggtgaccagcggcacccccttcttcagcagcaagcagggcaagaagacctggaggcagaaccagagcaacctgaagattgaggtggtgcctgactgccaggagaagaggagcagcggccccagcagcagcctggacaatggaaacagcctggatgtgctgaagaaccacgtgctgaatgagctgatccagacagagcgggtgtatgtgcgggagctgtacacagtgctgctgggctacagagctgagatggacaaccctgagatgtttgacctgatgccacccctgctgaggaacaagaaggacatcctgtttggaaacatggccgagatctatgagttccacaatgacatcttcctgagcagcctggagaactgtgcccacgcccctgagcgggtgggcccctgcttcctggagaggaaggatgacttccagatgtatgccaagtactgccagaacaagcccaggtctgagaccatctggaggaagtacagtgaatgtgccttcttccaggagtgccagaggaagctgaagcaccggctgcggctggacagctacctgctgaagcctgtgcagaggatcaccaagtaccagctgctgctgaaggagctgctgaagtacagcaaggactgtgagggcagcgccctgctgaagaaggccctggatgccatgctggacctgctgaagtctgtgaatgacagcatgcaccagatcgccatcaatggctacatcggcaacctgaatgagctgggcaagatgatcatgcagggcggcttctctgtgtggattggccacaagaagggggccaccaagatgaaggacctggcccgcttcaagcccatgcagaggcacctgttcctgtatgagaaggccatcgtgttctgcaagagaagagtggagagcggggagggcagtgaccgctaccccagctacagcttcaagcactgctggaagatggatgaggtgggcatcacagaatatgtgaagggggacaacaggaagtttgagatctggtatggagagaaggaggaggtgtacatcgtgcaggccagcaatgtggatgtgaagatgacctggctgaaggagatccggaacatcctgctgaagcagcaggagctgctgactgtgaagaagaggaagcagcaggaccagctgacagagcgggacaagttccagatcagcctgcagcagaatgatgagaagcagcagggcgccttcatcagcacagaggagacagagctggagcacaccagcacagtggtggaggtgtgtgaggccatcgcctctgtgcaggccgaggccaacacagtgtggacagaggccagccagagcgctgagatcagcgaggagcctgctgagtggagcagcaactacttctaccccacctatgatgaaaatgaggaggagaaccggcccctgatgaggcctgtgtctgagatggccctgctgtactag

SEQ ID NO: 158959 - DNA, 2958 bp, Artificial Sequence
  Description of Artificial Sequence: Synthetic coding sequence
atgcaggacatcgccttcctgagcggcggccggggcaaggacaatgcctggatcatcaccttccctgagaactgcaacttccgctgcatccctgaggaggtgattgccaaggtgctgacctacctgaccagcatcgcccggcagaatggaagtgacagccgcttcaccatcatcctggaccggcggctggacacctggagcagcctgaagatcagcctgcagaagatcagcgccagcttccctggcaacctgcacctggtgctggtgctgcggcccaccagcttcctgcagaggaccttcacagacatcggcttctggttcagccaggaggacttcatgctgaagctgcctgtggtgatgctgagctctgtgtctgacctgctgacctacattgatgacaagcagctgaccccagagctgggcggcaccctgcagtactgccacagcgagtggatcatcttcagaaatgccattgaaaattttgccctgactgtgaaggagatggcccagatgctgcagagctttggaacagagctggccgagacagagctgcctgatgacatccccagcattgaggagatcctggccatccgggcagagcgctaccacctgctgaagaatgacatcacagctgtgaccaaggagggcaagatcctgctgaccaacctggaggtgcctgacacagagggcgctgtgagcagccggctggagtgccaccggcagatcagcggggactggcagaccatcaacaagctgctgacccaggtgcatgacatggagacagcctttgatggcttctgggagaagcaccagctgaagatggagcagtacctgcagctgtggaagtttgagcaggacttccagcagctggtgacagaggtggagttcctgctgaaccagcaggccgagctggctgatgtgacaggcaccatcgcccaggtgaagcagaagatcaagaagctggagaacctggatgagaacagccaggagctgctgagcaaggcccagtttgtgatcctgcacggccacaagctggccgccaaccaccactacgccctggacctgatctgccagcgctgcaatgagctgcgctacctgagtgacatcctggtgaatgagatcaaggccaagaggatccagctgagcaggaccttcaagatgcacaagctgctgcagcaggcccggcagtgctgtgatgaaggagagtgcctgctggccaaccaggagattgacaagttccagagcaaagaagatgcccagaaggccctgcaggacatcgagaacttcctggagatggccctgcccttcatcaactatgagcctgagaccctgcagtatgaatttgatgtgatcctgagccctgagctgaaggtgcagatgaagaccatccagctgaagctggagaacatccgcagcatctttgagaaccagcaggccggcttcaggaacctggccgacaagcacgtgcggcccatccagtttgtggtgcccaccccagagaacctggtgaccagcggcacccccttcttcagcagcaagcagggcaagaagacctggaggcagaaccagagcaacctgaagattgaggtggtgcctgactgccaggagaagaggagcagcggccccagcagcagcctggacaatggaaacagcctggatgtgctgaagaaccacgtgctgaatgaactcatccagacagagcgggtgtatgtgcgggagctgtacacagtgctgctgggctacagagctgagatggacaaccctgagatgtttgacctgatgccacccctgctgaggaacaagaaggacatcctgtttggaaacatggccgagatctatgagttccacaatgacatcttcctgagcagcctggagaactgtgcccacgcccctgagcgggtgggcccctgcttcctggagaggaaggatgacttccagatgtatgccaagtactgccagaacaagcccaggtctgagaccatctggaggaagtacagtgaatgtgccttcttccaggagtgccagaggaagctgaagcaccggctgcggctggacagctacctgctgaagcctgtgcagaggatcaccaagtaccagctgctgctgaaggagctgctgaagtacagcaaggactgtgagggcagcgccctgctgaagaaggccctggatgccatgctggacctgctgaagtctgtgaatgacagcatgcaccagatcgccatcaatggctacatcggcaacctgaatgagctgggcaagatgatcatgcagggcggcttctctgtgtggattggccacaagaagggggccaccaagatgaaggacctggcccgcttcaagcccatgcagaggcacctgttcctgtatgagaaggccatcgtgttctgcaagagaagagtggagagcggggagggcagtgaccgctaccccagctacagcttcaagcactgctggaagatggatgaggtgggcatcacagaatatgtgaagggggacaacaggaagtttgagatctggtacggggagaaggaggaggtgtacatcgtgcaggccagcaatgtggatgtgaagatgacctggctgaaggagatccggaacatcctgctgaagcagcaggagctgctgactgtgaagaagaggaagcagcaggaccagctgacagagcgggacaagttccagatcagcctgcagcagaatgatgagaagcagcagggcgccttcatcagcacagaggagacagagctggagcacaccagcacagtggtggaggtgtgtgaggccatcgcctctgtgcaggccgaggccaacacagtgtggacagaggccagccagagcgctgagatcagcgaggagcctgctgagtggagcagcaactacttctaccccacctatgatgaaaatgaggaggagaaccggcccctgatgaggcctgtgtctgagatggccctgctgtactag

SEQ ID NO: 158960 - DNA, 1290 bp, Artificial Sequence
  Description of Artificial Sequence: Synthetic coding sequence
tgacatgtgctgaatgaactcatccagacagagcgggtgtatgtgcgggagctgtacacagtgctgctgggctacagagctgagatggacaaccctgagatgtttgacctgatgccacccctgctgaggaacaagaaggacatcctgtttggaaacatggccgagatctatgagttccacaatgacatcttcctgagcagcctggagaactgtgcccacgcccctgagcgggtgggcccctgcttcctggagaggaaggatgacttccagatgtatgccaagtactgccagaacaagcccaggtctgagaccatctggaggaagtacagtgaatgtgccttcttccaggagtgccagaggaagctgaagcaccggctgcggctggacagctacctgctgaagcctgtgcagaggatcaccaagtaccagctgctgctgaaggagctgctgaagtacagcaaggactgtgagggcagcgccctgctgaagaaggccctggatgccatgctggacctgctgaagtctgtgaatgacagcatgcaccagatcgccatcaatggctacatcggcaacctgaatgagctgggcaagatgatcatgcagggcggcttctctgtgtggattggccacaagaagggggccaccaagatgaaggacctggcccgcttcaagcccatgcagaggcacctgttcctgtatgagaaggccatcgtgttctgcaagagaagagtggagagcggggagggcagtgaccgctaccccagctacagcttcaagcactgctggaagatggatgaggtgggcatcacagaatatgtgaagggggacaacaggaagtttgagatctggtacggggagaaggaggaggtgtacatcgtgcaggccagcaatgtggatgtgaagatgacctggctgaaggagatccggaacatcctgctgaagcagcaggagctgctgactgtgaagaagaggaagcagcaggaccagctgacagagcgggacaagttccagatcagcctgcagcagaatgatgagaagcagcagggcgccttcatcagcacagaggagacagagctggagcacaccagcacagtggtggaggtgtgtgaggccatcgcctctgtgcaggccgaggccaacacagtgtggacagaggccagccagagcgctgagatcagcgaggagcctgctgagtggagcagcaactacttctaccccacctatgatgaaaatgaggaggagaaccggcccctgatgaggcctgtgtctgagatggccctgctgtactag

SEQ ID NO: 158961 - DNA, 1587 bp, Artificial Sequence
  Description of Artificial Sequence: Synthetic coding sequence
gtgcagatgaagaccatccagctgaagctggagaacatccgcagcatctttgagaaccagcaggccggcttcaggaacctggccgacaagcacgtgcggcccatccagtttgtggtgcccaccccagagaacctggtgaccagcggcacccccttcttcagcagcaagcagggcaagaagacctggaggcagaaccagagcaacctgaagattgaggtggtgcctgactgccaggagaagaggagcagcggccccagcagcagcctggacaatggaaacagcctggatgtgctgaagaaccacgtgctgaatgagctgatccagacagagcgggtgtatgtgcgggagctgtacacagtgctgctgggctacagagctgagatggacaaccctgagatgtttgacctgatgccacccctgctgaggaacaagaaggacatcctgtttggaaacatggccgagatctatgagttccacaatgacatcttcctgagcagcctggagaactgtgcccacgcccctgagcgggtgggcccctgcttcctggagaggaaggatgacttccagatgtatgccaagtactgccagaacaagcccaggtctgagaccatctggaggaagtacagtgaatgtgccttcttccaggagtgccagaggaagctgaagcaccggctgcggctggacagctacctgctgaagcctgtgcagaggatcaccaagtaccagctgctgctgaaggagctgctgaagtacagcaaggactgtgagggcagcgccctgctgaagaaggccctggatgccatgctggacctgctgaagtctgtgaatgacagcatgcaccagatcgccatcaatggctacatcggcaacctgaatgagctgggcaagatgatcatgcagggcggcttctctgtgtggattggccacaagaagggggccaccaagatgaaggacctggcccgcttcaagcccatgcagaggcacctgttcctgtatgagaaggccatcgtgttctgcaagagaagagtggagagcggggagggcagtgaccgctaccccagctacagcttcaagcactgctggaagatggatgaggtgggcatcacagaatatgtgaagggggacaacaggaagtttgagatctggtatggagagaaggaggaggtgtacatcgtgcaggccagcaatgtggatgtgaagatgacctggctgaaggagatccggaacatcctgctgaagcagcaggagctgctgactgtgaagaagaggaagcagcaggaccagctgacagagcgggacaagttccagatcagcctgcagcagaatgatgagaagcagcagggcgccttcatcagcacagaggagacagagctggagcacaccagcacagtggtggaggtgtgtgaggccatcgcctctgtgcaggccgaggccaacacagtgtggacagaggccagccagagcgctgagatcagcgaggagcctgctgagtggagcagcaactacttctaccccacctatgatgaaaatgaggaggagaaccggcccctgatgaggcctgtgtctgagatggccctgctgtactag

SEQ ID NO: 158962 - DNA, 3006 bp, Artificial Sequence
  Description of Artificial Sequence: Synthetic coding sequence
atgcaggacatcgccttcctgagcggcggccggggcaaggacaatgcctggatcatcaccttccctgagaactgcaacttccgctgcatccctgaggaggtgattgccaaggtgctgacctacctgaccagcatcgcccggcagaatggaagtgacagccgcttcaccatcatcctggaccggcggctggacacctggagcagcctgaagatcagcctgcagaagatcagcgccagcttccctggcaacctgcacctggtgctggtgctgcggcccaccagcttcctgcagaggaccttcacagacatcggcttctggttcagccaggaggacttcatgctgaagctgcctgtggtgatgctgagctctgtgtctgacctgctgacctacattgatgacaagcagctgaccccagagctgggcggcaccctgcagtactgccacagcgagtggatcatcttcagaaatgccattgaaaattttgccctgactgtgaaggagatggcccagatgctgcagagctttggaacagagctggccgagacagagctgcctgatgacatccccagcattgaggagatcctggccatccgggcagagcgctaccacctgctgaagaatgacatcacagctgtgaccaaggagggcaagatcctgctgaccaacctggaggtgcctgacacagagggcgctgtgagcagccggctggagtgccaccggcagatcagcggggactggcagaccatcaacaagctgctgacccaggtgcatgacatggagacagcctttgatggcttctgggagaagcaccagctgaagatggagcagtacctgcagctgtggaagtttgagcaggacttccagcagctggtgacagaggtggagttcctgctgaaccagcaggccgagctggctgatgtgacaggcaccatcgcccaggtgaagcagaagatcaagaagctggagaacctggatgagaacagccaggagctgctgagcaaggcccagtttgtgatcctgcacggccacaagctggccgccaaccaccactacgccctggacctgatctgccagcgctgcaatgagctgcgctacctgagtgacatcctggtgaatgagatcaaggccaagaggatccagctgagcaggaccttcaagatgcacaagctgctgcagcaggcccggcagtgctgtgatgaaggagagtgcctgctggccaaccaggagattgacaagttccagagcaaagaagatgcccagaaggccctgcaggacatcgagaacttcctggagatggccctgcccttcatcaactatgagcctgagaccctgcagtatgaatttgatgtgatcctgagccctgagctgaaggtgcagatgaagaccatccagctgaagctggagaacatccgcagcatctttgagaaccagcaggccggcttcaggaacctggccgacaagcacgtgcggcccatccagtttgtggtgcccaccccagagaacctggtgaccagcggcacccccttcttcagcagcaagcaggtgggcgtgggctacagcttcttccaggcctgcaagctgttcagcaagggcaagaagacctggaggcagaaccagagcaacctgaagattgaggtggtgcctgactgccaggagaagaggagcagcggccccagcagcagcctggacaatggaaacagcctggatgtgctgaagaaccacgtgctgaatgaactcatccagacagagcgggtgtatgtgcgggagctgtacacagtgctgctgggctacagagctgagatggacaaccctgagatgtttgacctgatgccacccctgctgaggaacaagaaggacatcctgtttggaaacatggccgagatctatgagttccacaatgacatcttcctgagcagcctggagaactgtgcccacgcccctgagcgggtgggcccctgcttcctggagaggaaggatgacttccagatgtatgccaagtactgccagaacaagcccaggtctgagaccatctggaggaagtacagtgaatgtgccttcttccaggagtgccagaggaagctgaagcaccggctgcggctggacagctacctgctgaagcctgtgcagaggatcaccaagtaccagctgctgctgaaggagctgctgaagtacagcaaggactgtgagggcagcgccctgctgaagaaggccctggatgccatgctggacctgctgaagtctgtgaatgacagcatgcaccagatcgccatcaatggctacatcggcaacctgaatgagctgggcaagatgatcatgcagggcggcttctctgtgtggattggccacaagaagggggccaccaagatgaaggacctggcccgcttcaagcccatgcagaggcacctgttcctgtatgagaaggccatcgtgttctgcaagagaagagtggagagcggggagggcagtgaccgctaccccagctacagcttcaagcactgctggaagatggatgaggtgggcatcacagaatatgtgaagggggacaacaggaagtttgagatctggtacggggagaaggaggaggtgtacatcgtgcaggccagcaatgtggatgtgaagatgacctggctgaaggagatccggaacatcctgctgaagcagcaggagctgctgactgtgaagaagaggaagcagcaggaccagctgacagagcgggacaagttccagatcagcctgcagcagaatgatgagaagcagcagggcgccttcatcagcacagaggagacagagctggagcacaccagcacagtggtggaggtgtgtgaggccatcgcctctgtgcaggccgaggccaacacagtgtggacagaggccagccagagcgctgagatcagcgaggagcctgctgagtggagcagcaactacttctaccccacctatgatgaaaatgaggaggagaaccggcccctgatgaggcctgtgtctgagatggccctgctgtactag

SEQ ID NO: 158963 - DNA, 2958 bp, Artificial Sequence; identical to SEQ ID NO: 158959
  Description of Artificial Sequence: Synthetic coding sequence

SEQ ID NO: 158964 - DNA, 2466 bp, Artificial Sequence
  Description of Artificial Sequence: Synthetic coding sequence
atggccgaggccaacccccggcggggcaagatgaggttcagaagaaatgctgccagcttccctggcaacctgcacctggtgctggtgctgcggcccaccagcttcctgcagaggaccttcacagacatcggcttctggttcagccaggaggacttcatgctgaagctgcctgccatcgagaactttgccctgactgtgaaggagatggcccagatgctgcagagctttggaacagagctggccgagacagagctgcctgatgacatccccagcattgaggagatcctggccatccgggcagagcgctaccacctgctgaagaatgacatcacagctgtgaccaaggagggcaagatcctgctgaccaacctggaggtgcctgacacagaaggagctgtgagcagccggctggagtgccaccggcagatcagcggggactggcagaccatcaacaagctgctgacccaggtgcatgacatggagacagcctttgatggcttctgggagaagcaccagctgaagatggagcagtacctgcagctgtggaagtttgagcaggacttccagcagctggtgacagaggtggagttcctgctgaaccagcaggccgagctggctgatgtgacaggcaccatcgcccaggtgaagcagaagatcaagaagctggagaacctggatgagaacagccaggagctgctgagcaaggcccagtttgtgatcctgcacggccacaagctggccgccaaccaccactacgccctggacctgatctgccagcgctgcaatgagctgcgctacctgagtgacatcctggtgaatgagatcaaggccaagaggatccagctgagcaggaccttcaagatgcacaagctgctgcagcaggcccggcagtgctgtgatgaaggagaatgtctgctggccaaccaggagattgacaagttccagagcaaggaggatgcccagaaggccctgcaggacatcgagaacttcctggagatggccctgcccttcatcaactatgagcctgagaccctgcagtatgaatttgatgtgatcctgagccctgagctgaaggtgcagatgaagaccatccagctgaagctggagaacatccgcagcatctttgagaaccagcaggccggcttcaggaacctggccgacaagcacgtgcggcccatccagtttgtggtgcccaccccagagaacctggtgaccagcggcacccccttcttcagcagcaagcagggcaagaagacctggaggcagaaccagagcaacctgaagattgaggtggtgcctgactgccaggagaagaggagcagcggccccagcagcagcctggacaatggaaacagcctggatgtgctgaagaaccacgtgctgaatgagctgatccagacagagcgggtgtatgtgcgggagctgtacacagtgctgctgggctacagagctgagatggacaaccctgagatgtttgacctgatgccacccctgctgaggaacaagaaggacatcctgtttggaaacatggccgagatctatgagttccacaatgacatcttcctgagcagcctggagaactgtgcccacgcccctgagcgggtgggcccctgcttcctggagaggaaggatgacttccagatgtatgccaagtactgccagaacaagcccaggtctgagaccatctggaggaagtacagtgaatgtgccttcttccaggagtgccagaggaagctgaagcaccggctgcggctggacagctacctgctgaagcctgtgcagaggatcaccaagtaccagctgctgctgaaggagctgctgaagtacagcaaggactgtgagggcagcgccctgctgaagaaggccctggatgccatgctggacctgctgaagtctgtgaatgacagcatgcaccagatcgccatcaatggctacatcggcaacctgaatgagctgggcaagatgatcatgcagggcggcttctctgtgtggattggccacaagaagggggccaccaagatgaaggacctggcccgcttcaagcccatgcagaggcacctgttcctgtatgagaaggccatcgtgttctgcaagagaagagtggagagcggggagggcagtgaccgctaccccagctacagcttcaagcactgctggaagatggatgaggtgggcatcacagaatatgtgaagggggacaacaggaagtttgagatctggtatggagagaaggaggaggtgtacatcgtgcaggccagcaatgtggatgtgaagatgacctggctgaaggagatccggaacatcctgctgaagcagcaggagctgctgactgtgaagaagaggaagcagcaggaccagctgacagagcgggacaagttccagatcagcctgcagcagaatgatgaggacctgtgccgccgctggctgagctacattgatgaggccaccatgagcaatggcaagtag

SEQ ID NO: 158965 - DNA, 2955 bp, Artificial Sequence
  Description of Artificial Sequence: Synthetic coding sequence
atgacagtgcggcggctgagcctgctgtgccgggacctgtgggccctgtggctgctgctgaaggccggggctgatgagatcatgcaccaggacatcgtgcccctgtgtgccgctgacatccaggaccagctgaagaagagatttgcctacctgagcggcggccggggccaggacggcagccctgtgatcaccttcccagactacccagccttcagcgagatcccagacaaggagttccagaatgtgatgacctacctgaccagcatccccagcctgcaggatgctggcatcggcttcatcctggtgattgacagaagaagagacaagtggacctctgtgaaggcctctgtgctgagaattgctgccagcttccctgccaacctgcagctggtgctggtgctgcggcccaccggcttcttccagaggaccctgagtgacatcgccttcaagttcaacagagatgacttcaagatgaaggtgcctgtgatcatgctgagctctgtgcctgacctgcacggctacatcgacaagagccagctgacagaggacctgggcggcaccctggactactgccacagccgctggctgtgccagaggacagccatcgagagctttgccctgatggtgaagcagacagcccagatgctgcagagctttggaacagagctggccgagacagagctgcccaatgatgtgcagagcaccagctctgtgctgtgtgcccacacagagaagaaggacaaggccaaggaggacctgcggctggccctgaaggagggccacagcgtgctggagagcctgcgggagctgcaggccgagggcagcgagcccagcgtgaaccaggaccagctggacaaccaggccaccgtgcagaggctgctggcccagctgaatgaaacagaggccgcctttgatgagttctgggccaagcaccagcagaagctggagcagtgcctgcagctgcggcactttgagcagggcttccgggaggtgaaggccatcctggatgctgccagccagaagatcgccaccttcacagacatcggcaacagcctggcccacgtggagcacctgctgcgggacctggccagctttgaggagaagtctggagtggccgtggagcgggcccgggccctgagcctggatggagagcagctgattggcaacaagcactatgctgtggacagcatccggcccaagtgccaggagctgcggcacctgtgtgaccagttctctgctgagatcgcccggcggcggggcctgctgagcaagagcctggagctgcaccggcggctggagacctccatgaagtggtgtgatgagggcatctacctgctggccagccagcctgtggacaagtgccagagccaggatggagctgaggccgccctgcaggagattgagaagttcctggagactggagctgagaacaagatccaggagctgaatgccatctacaaggagtatgagagcatcctgaaccaggacctgatggagcacgtgaggaaggtgttccagaagcaggcctccatggaggaggtgttccaccggcggcaggccagcctgaagaagctggccgcccggcagaccaggcctgtgcagcctgtggcccccaggcctgaggccctggccaagagcccctgccccagccctggcatccggcggggcagcgagaacagcagcagcgagggcggggccctgcggcggggcccctacagaagagccaagtctgagatgtctgagagccggcagggccggggcagcgctggggaggaggaggagagcctggccatcctgcggcggcacgtgatgtctgagctgctggacacagagcgggcctacgtggaggagctgctgtgtgtgctggagggctacgccgctgagatggacaaccccctgatggcccacctgctgagcacaggcctgcacaacaagaaggatgtgctgtttggaaacatggaggagatctaccacttccacaaccgcatcttcctgcgggagctggagaactacacagactgcccagagctggtgggccgctgcttcctggagaggatggaggacttccagatctatgagaagtactgccagaacaagcccaggtctgagagcctgtggaggcagtgcagcgactgccccttcttccaggagtgccagaggaagctggaccacaagctgagcctggacagctacctgctgaagcctgtgcagaggatcaccaagtaccagctgctgctgaaggagatgctgaagtacagcaggaactgtgagggcgctgaggacctgcaggaggccctgagcagcatcctgggcatcctgaaggctgtgaatgacagcatgcacctgattgccatcaccggctatgatggcaacctgggggacctgggcaagctgctgatgcagggcagcttctctgtgtggacagaccacaagaggggccacaccaaggtgaaggagctggcccgcttcaagcccatgcagaggcacctgttcctgcacgagaaggctgtgctcttctgcaagaagcgggaggagaatggagagggctatgagaaggcccccagctacagctacaagcagagcctgaacatggctgctgtgggcatcacagaaaatgtgaagggagatgccaagaagtttgagatctggtacaatgcccgggaggaggtgtacatcgtgcaggcccccaccccagagatcaaggccgcctgggtgaatgagatcaggaaggtgctgaccagccagctgcaggcctgccgggaggccagccagcaccgggccctggagcagagccagagcctgcccctgcctgcccccaccagcaccagccccagccggggcaacagcaggaacatcaagaagctggaggagaggaagacagaccccctgagcctggagggctacgtgtcctctgcccccctgaccaagcccccagagaagggcaaggagccctag

SEQ ID NO: 158966 - DNA, 3390 bp, Artificial Sequence
  Description of Artificial Sequence: Synthetic coding sequence
atggccgagaagggggccagccggggcaccctgcggcggctgtggagcctgcccaggagaagaagaggaacagctggccgcagcaggccagatgagatcatgcaccaggacatcgtgcccctgtgtgccgctgacatccaggaccagctgaagaagagatttgcctacctgagcggcggccggggccaggacggcagccctgtgatcaccttcccagactacccagccttcagcgagatcccagacaaggagttccagaatgtgatgacctacctgaccagcatccccagcctgcaggatgctggcatcggcttcatcctggtgattgacagaagaagagacaagtggacctctgtgaaggcctctgtgctgagaattgctgccagcttccctgccaacctgcagctggtgctggtgctgcggcccaccggcttcttccagaggaccctgagtgacatcgccttcaagttcaacagagatgacttcaagatgaaggtgcctgtgatcatgctgagctctgtgcctgacctgcacggctacatcgacaagagccagctgacagaggacctgggcggcaccctggactactgccacagccgctggctgtgccagaggacagccatcgagagctttgccctgatggtgaagcagacagcccagatgctgcagagctttggaacagagctggccgagacagagctgcccaatgatgtgcagagcaccagctctgtgctgtgtgcccacacagagaagaaggacaaggccaaggaggacctgcggctggccctgaaggagggccacagcgtgctggagagcctgcgggagctgcaggccgagggcagcgagcccagcgtgaaccaggaccagctggacaaccaggccaccgtgcagaggctgctggcccagctgaatgaaacagaggccgcctttgatgagttctgggccaagcaccagcagaagctggagcagtgcctgcagctgcggcactttgagcagggcttccgggaggtgaaggccatcctggatgctgccagccagaagatcgccaccttcacagacatcggcaacagcctggcccacgtggagcacctgctgcgggacctggccagctttgaggagaagtctggagtggccgtggagcgggcccgggccctgagcctggatggagagcagctgattggcaacaagcactatgctgtggacagcatccggcccaagtgccaggagctgcggcacctgtgtgaccagttctctgctgagatcgcccggcggcggggcctgctgagcaagagcctggagctgcaccggcggctggagacctccatgaagtggtgtgatgagggcatctacctgctggccagccagcctgtggacaagtgccagagccaggatggagctgaggccgccctgcaggagattgagaagttcctggagactggagctgagaacaagatccaggagctgaatgccatctacaaggagtatgagagcatcctgaaccaggacctgatggagcacgtgaggaaggtgttccagaagcaggcctccatggaggaggtgttccaccggcggcaggccagcctgaagaagctggccgcccggcagaccaggcctgtgcagcctgtggcccccaggcctgaggccctggccaagagcccctgccccagccctggcatccggcggggcagcgagaacagcagcagcgagggcggggccctgcggcggggcccctacagaagagccaagtctgagatgtctgagagccggcagggccggggcagcgctggggaggaggaggagagcctggccatcctgcggcggcacgtgatgtctgagctgctggacacagagcgggcctacgtggaggagctgctgtgtgtgctggagggctacgccgctgagatggacaaccccctgatggcccacctgctgagcacaggcctgcacaacaagaaggatgtgctgtttggaaacatggaggagatctaccacttccacaaccgcatcttcctgcgggagctggagaactacacagactgcccagagctggtgggccgctgcttcctggagaggatggaggacttccagatctatgagaagtactgccagaacaagcccaggtctgagagcctgtggaggcagtgcagcgactgccccttcttccaggagtgccagaggaagctggaccacaagctgagcctggacagctacctgctgaagcctgtgcagaggatcaccaagtaccagctgctgctgaaggagatgctgaagtacagcaggaactgtgagggcgctgaggacctgcaggaggccctgagcagcatcctgggcatcctgaaggctgtgaatgacagcatgcacctgattgccatcaccggctatgatggcaacctgggggacctgggcaagctgctgatgcagggcagcttctctgtgtggacagaccacaagaggggccacaccaaggtgaaggagctggcccgcttcaagcccatgcagaggcacctgttcctgcacgagaaggctgtgctcttctgcaagaagcgggaggagaatggagagggctatgagaaggcccccagctacagctacaagcagagcctgaacatggctgctgtgggcatcacagaaaatgtgaagggagatgccaagaagtttgagatctggtacaatgcccgggaggaggtgtacatcgtgcaggcccccaccccagagatcaaggccgcctgggtgaatgagatcaggaaggtgctgaccagccagctgcaggcctgccgggaggccagccagcaccgggccctggagcagagccagagcctgcccctgcctgcccccaccagcaccagccccagccggggcaacagcaggaacatcaagaagctggaggagaggaagacagaccccctgagcctggagggctacgtgtcctctgcccccctgaccaagcccccagagaagggcaagggctggagcaagaccagccacagcctggaggccccagaagatgatggcggctggagcagcgctgaggagcagatcaacagcagtgatgctgaggaggatggcggcctgggccccaagaagctggtgcctgggaagtacacagtggtggccgaccacgagaagggcggcccagatgccctgcgggtgcgctctggagatgtggtggagctggtgcaggagggagatgagggcctgtggtacgtgcgggaccccaccaccgggaaggagggctgggtgcctgccagcagcctgtctgtgcggctgggccccagcggcagcgcccagtgcctgagcagcagcgagagcagccctggcagcgctgtgctgagcaacagcagcagctgcagcgagggcggccaggcccccttcagtgacctgcagggctag

SEQ ID NO: 158967 - DNA, 3549 bp, Artificial Sequence
  Description of Artificial Sequence: Synthetic coding sequence
atggcccgggtggagagccctgtgcctgctgcccgggccagcctgaccggcagctgtgtgctgggccaggccatgcccctgcggggcggggccggccccagccctgccagccacggccccacccacggccccagcgaccccaggacctgcctgcccggccgcggggccggcggcatgaggccccacggccgcggggccctgggctgctgcggcctgtgcagcttctacacctgccacggggctgctggagatgagatcatgcaccaggacatcgtgcccctgtgtgccgctgacatccaggaccagctgaagaagagatttgcctacctgagcggcggccggggccaggacggcagccctgtgatcaccttcccagactacccagccttcagcgagatcccagacaaggagttccagaatgtgatgacctacctgaccagcatccccagcctgcaggatgctggcatcggcttcatcctggtgattgacagaagaagagacaagtggacctctgtgaaggcctctgtgctgagaattgctgccagcttccctgccaacctgcagctggtgctggtgctgcggcccaccggcttcttccagaggaccctgagtgacatcgccttcaagttcaacagagatgacttcaagatgaaggtgcctgtgatcatgctgagctctgtgcctgacctgcacggctacatcgacaagagccagctgacagaggacctgggcggcaccctggactactgccacagccgctggctgtgccagaggacagccatcgagagctttgccctgatggtgaagcagacagcccagatgctgcagagctttggaacagagctggccgagacagagctgcccaatgatgtgcagagcaccagctctgtgctgtgtgcccacacagagaagaaggacaaggccaaggaggacctgcggctggccctgaaggagggccacagcgtgctggagagcctgcgggagctgcaggccgagggcagcgagcccagcgtgaaccaggaccagctggacaaccaggccaccgtgcagaggctgctggcccagctgaatgaaacagaagctgcctttgatgagttctgggccaagcaccagcagaagctggagcagtgcctgcagctgcggcactttgagcagggcttccgggaggtgaaggccatcctggatgctgccagccagaagatcgccaccttcacagacatcggcaacagcctggcccacgtggagcacctgctgcgggacctggccagctttgaggagaagagcggcgtggccgtggagcgggcccgggccctgagcctggatggagagcagctgattggcaacaagcactatgctgtggacagcatccggcccaagtgccaggagctgcggcacctgtgtgaccagttctctgctgagatcgccaggagaagaggcctgctgagcaagagcctggagctgcaccggcggctggagacctccatgaagtggtgtgatgagggcatctacctgctggccagccagcctgtggacaagtgccagagccaggatggagctgaggccgccctgcaggagattgagaagttcctggagaccggggctgagaacaagatccaggagctgaatgccatctacaaggagtatgagagcatcctgaaccaggacctgatggagcacgtgaggaaggtgttccagaagcaggcctccatggaggaggtgttccaccggcggcaggccagcctgaagaagctggccgcccggcagaccaggcctgtgcagcctgtggcccccaggcctgaggccctggccaagagcccctgccccagccctggcatcagaagaggcagcgagaacagcagcagcgagggcggggccctgcggcggggcccctaccgccgggccaagtctgagatgtctgagagccggcagggccggggcagcgctggggaggaggaggagagcctggccatcctgcggagacatgtgatgtctgagctgctggacacagagcgggcctacgtggaggagctgctgtgtgtgctggagggctatgctgctgagatggacaaccccctgatggcccacctgctgagcacaggcctgcacaacaagaaggatgtgctgtttggaaacatggaggagatctaccacttccacaaccgcatcttcctgcgggagctggagaactacacagactgcccagagctggtgggccgctgcttcctggagaggatggaggacttccagatctatgagaagtactgccagaacaagcccaggtctgagagcctgtggaggcagtgcagcgactgccccttcttccaggagtgccagaggaagctggaccacaagctgagcctggacagctacctgctgaagcctgtgcagaggatcaccaagtaccagctgctgctgaaggagatgctgaagtacagcaggaactgtgagggcgctgaggacctgcaggaggccctgagcagcatcctgggcatcctgaaggctgtgaatgacagcatgcacctgattgccatcaccggctatgatggcaacctgggggacctgggcaagctgctgatgcagggcagcttctctgtgtggacagaccacaagaggggccacaccaaggtgaaggagctggcccgcttcaagcccatgcagaggcacctgttcctgcacgagaaggctgtgctcttctgcaagaagcgggaggagaatggagagggctatgagaaggcccccagctacagctacaagcagagcctgaacatggctgctgtgggcatcacagaaaatgtgaagggagatgccaagaagtttgagatctggtacaatgcccgggaggaggtgtacatcgtgcaggcccccaccccagagatcaaggccgcctgggtgaatgagatcaggaaggtgctgaccagccagctgcaggcctgccgggaggccagccagcaccgggccctggagcagagccagagcctgcccctgcctgcccccaccagcaccagccccagccggggcaacagcaggaacatcaagaagctggaggagaggaagacagaccccctgagcctggagggctacgtgagcagcgcccccctgaccaagcccccagagaagggcaagggctggagcaagaccagccacagcctggaggccccagaagatgatggcggctggagcagcgctgaggagcagatcaacagcagtgatgctgaagaagatggcggcctgggccccaagaagctggtgcctgggaagtacacagtggtggccgaccacgagaagggcggcccagatgccctgcgggtgcgctctggagatgtggtggagctggtgcaggagggagatgagggcctgtggtacgtgcgggaccccaccaccgggaaggagggctgggtgcctgccagcagcctgtctgtgcggctgggccccagcggcagcgcccagtgcctgagcagcagcgagagcagccctggcagcgctgtgctgagcaacagcagcagctgcagcgagggcggccaggcccccttcagtgacctgcagggctag

SEQ ID NO: 158968 - DNA, 3414 bp, Artificial Sequence
  Description of Artificial Sequence: Synthetic coding sequence
atgtttgactgctggaggttcatcctgtgcaagaggcctggcagcaacagctacagcagcccccagaggcccaatgaggccaagaaggaggagacagaccaccagattgatgtgtctgatgtgatccggctggtgcaggacaccccagaggccacagccatggccacagatgagatcatgcaccaggacatcgtgcccctgtgtgccgctgacatccaggaccagctgaagaagagatttgcctacctgagcggcggccggggccaggacggcagccctgtgatcaccttcccagactacccagccttcagcgagatcccagacaaggagttccagaatgtgatgacctacctgaccagcatccccagcctgcaggatgctggcatcggcttcatcctggtgattgacagaagaagagacaagtggacctctgtgaaggcctctgtgctgagaattgctgccagcttccctgccaacctgcagctggtgctggtgctgcggcccaccggcttcttccagaggaccctgagtgacatcgccttcaagttcaacagagatgacttcaagatgaaggtgcctgtgatcatgctgagctctgtgcctgacctgcacggctacatcgacaagagccagctgacagaggacctgggcggcaccctggactactgccacagccgctggctgtgccagaggacagccatcgagagctttgccctgatggtgaagcagacagcccagatgctgcagagctttggaacagagctggccgagacagagctgcccaatgatgtgcagagcaccagctctgtgctgtgtgcccacacagagaagaaggacaaggccaaggaggacctgcggctggccctgaaggagggccacagcgtgctggagagcctgcgggagctgcaggccgagggcagcgagcccagcgtgaaccaggaccagctggacaaccaggccaccgtgcagaggctgctggcccagctgaatgaaacagaggccgcctttgatgagttctgggccaagcaccagcagaagctggagcagtgcctgcagctgcggcactttgagcagggcttccgggaggtgaaggccatcctggatgctgccagccagaagatcgccaccttcacagacatcggcaacagcctggcccacgtggagcacctgctgcgggacctggccagctttgaggagaagtctggagtggccgtggagcgggcccgggccctgagcctggatggagagcagctgattggcaacaagcactatgctgtggacagcatccggcccaagtgccaggagctgcggcacctgtgtgaccagttctctgctgagatcgcccggcggcggggcctgctgagcaagagcctggagctgcaccggcggctggagacctccatgaagtggtgtgatgagggcatctacctgctggccagccagcctgtggacaagtgccagagccaggatggagctgaggccgccctgcaggagattgagaagttcctggagactggagctgagaacaagatccaggagctgaatgccatctacaaggagtatgagagcatcctgaaccaggacctgatggagcacgtgaggaaggtgttccagaagcaggcctccatggaggaggtgttccaccggcggcaggccagcctgaagaagctggccgcccggcagaccaggcctgtgcagcctgtggcccccaggcctgaggccctggccaagagcccctgccccagccctggcatccggcggggcagcgagaacagcagcagcgagggcggggccctgcggcggggcccctacagaagagccaagtctgagatgtctgagagccggcagggccggggcagcgctggggaggaggaggagagcctggccatcctgcggcggcacgtgatgtctgagctgctggacacagagcgggcctacgtggaggagctgctgtgtgtgctggagggctacgccgctgagatggacaaccccctgatggcccacctgctgagcacaggcctgcacaacaagaaggatgtgctgtttggaaacatggaggagatctaccacttccacaaccgcatcttcctgcgggagctggagaactacacagactgcccagagctggtgggccgctgcttcctggagaggatggaggacttccagatctatgagaagtactgccagaacaagcccaggtctgagagcctgtggaggcagtgcagcgactgccccttcttccaggagtgccagaggaagctggaccacaagctgagcctggacagctacctgctgaagcctgtgcagaggatcaccaagtaccagctgctgctgaaggagatgctgaagtacagcaggaactgtgagggcgctgaggacctgcaggaggccctgagcagcatcctgggcatcctgaaggctgtgaatgacagcatgcacctgattgccatcaccggctatgatggcaacctgggggacctgggcaagctgctgatgcagggcagcttctctgtgtggacagaccacaagaggggccacaccaaggtgaaggagctggcccgcttcaagcccatgcagaggcacctgttcctgcacgagaaggctgtgctcttctgcaagaagcgggaggagaatggagagggctatgagaaggcccccagctacagctacaagcagagcctgaacatggctgctgtgggcatcacagaaaatgtgaagggagatgccaagaagtttgagatctggtacaatgcccgggaggaggtgtacatcgtgcaggcccccaccccagagatcaaggccgcctgggtgaatgagatcaggaaggtgctgaccagccagctgcaggcctgccgggaggccagccagcaccgggccctggagcagagccagagcctgcccctgcctgcccccaccagcaccagccccagccggggcaacagcaggaacatcaagaagctggaggagaggaagacagaccccctgagcctggagggctacgtgtcctctgcccccctgaccaagcccccagagaagggcaagggctggagcaagaccagccacagcctggaggccccagaagatgatggcggctggagcagcgctgaggagcagatcaacagcagtgatgctgaggaggatggcggcctgggccccaagaagctggtgcctgggaagtacacagtggtggccgaccacgagaagggcggcccagatgccctgcgggtgcgctctggagatgtggtggagctggtgcaggagggagatgagggcctgtggtacgtgcgggaccccaccaccgggaaggagggctgggtgcctgccagcagcctgtctgtgcggctgggccccagcggcagcgcccagtgcctgagcagcagcggcaaggcccacgtgccccgggcccacccctag

SEQ ID NO: 158969 - DNA, 2382 bp, Artificial Sequence
  Description of Artificial Sequence: Synthetic coding sequence
tgaagccagaagatcgccaccttcacagacatcggcaacagcctggcccacgtggagcacctgctgcgggacctggccagctttgaggagaagagcggcgtggccgtggagcgggcccgggccctgagcctggatggagagcagctgattggcaacaagcactatgctgtggacagcatccggcccaagtgccaggagctgcggcacctgtgtgaccagttctctgctgagatcgccaggagaagaggcctgctgagcaagagcctggagctgcaccggcggctggagacctccatgaagtggtgtgatgagggcatctacctgctggccagccagcctgtggacaagtgccagagccaggatggagctgaggccgccctgcaggagattgagaagttcctggagaccggggctgagaacaagatccaggagctgaatgccatctacaaggagtatgagagcatcctgaaccaggacctgatggagcacgtgaggaaggtgttccagaagcaggcctccatggaggaggtgttccaccggcggcaggccagcctgaagaagctggccgcccggcagaccaggcctgtgcagcctgtggcccccaggcctgaggccctggccaagagcccctgccccagccctggcatcagaagaggcagcgagaacagcagcagcgagggcggggccctgcggcggggcccctaccgccgggccaagtctgagatgtctgagagccggcagggccggggcagcgctggggaggaggaggagagcctggccatcctgcggagacatgtgatgtctgagctgctggacacagagcgggcctacgtggaggagctgctgtgtgtgctggagggctatgctgctgagatggacaaccccctgatggcccacctgctgagcacaggcctgcacaacaagaaggatgtgctgtttggaaacatggaggagatctaccacttccacaaccgcatcttcctgcgggagctggagaactacacagactgcccagagctggtgggccgctgcttcctggagaggatggaggacttccagatctatgagaagtactgccagaacaagcccaggtctgagagcctgtggaggcagtgcagcgactgccccttcttccaggagtgccagaggaagctggaccacaagctgagcctggacagctacctgctgaagcctgtgcagaggatcaccaagtaccagctgctgctgaaggagatgctgaagtacagcaggaactgtgagggcgctgaggacctgcaggaggccctgagcagcatcctgggcatcctgaaggctgtgaatgacagcatgcacctgattgccatcaccggctatgatggcaacctgggggacctgggcaagctgctgatgcagggcagcttctctgtgtggacagaccacaagaggggccacaccaaggtgaaggagctggcccgcttcaagcccatgcagaggcacctgttcctgcacgagaaggctgtgctcttctgcaagaagcgggaggagaatggagagggctatgagaaggcccccagctacagctacaagcagagcctgaacatggctgctgtgggcatcacagaaaatgtgaagggagatgccaagaagtttgagatctggtacaatgcccgggaggaggtgtacatcgtgcaggcccccaccccagagatcaaggccgcctgggtgaatgagatcaggaaggtgctgaccagccagctgcaggcctgccgggaggccagccagcaccgggccctggagcagagccagagcctgcccctgcctgcccccaccagcaccagccccagccggggcaacagcaggaacatcaagaagctggaggagaggaagacagaccccctgagcctggagggctacgtgagcagcgcccccctgaccaagcccccagagaagggcaaggccagccccaccagcccagacaagaaggccaagagacatgaggtgaagagtgaccccaccccatttggagtgcggggctggagcaagaccagccacagcctggaggccccagaagatgatggcggctggagcagcgctgaggagcagatcaacagcagtgatgctgaggaggatggcggcctgggccccaagaagctggtgcctgggaagtacacagtggtggccgaccacgagaagggcggcccagatgccctgcgggtgcgctctggagatgtggtggagctggtgcaggagggagatgagggcctgtggtacgtgcgggaccccaccaccgggaaggagggctgggtgcctgccagcagcctgtctgtgcggctgggccccagcggcagcgcccagtgcctgagcagcagcggcaaggcccacgtgccccgggcccacccctag

SEQ ID NO: 158970 - DNA, 3291 bp, Artificial Sequence
  Description of Artificial Sequence: Synthetic coding sequence
atgcccctgcggggcggggccggccccagccctgccagccacggccccacccacggccccagcgaccccaggacctgcctgcccggccgcggggccggcggcatgaggccccacggccgcggggccctgggctgctgcggcctgtgcagcttctacacctgccacggggctgctggagatgagatcatgcaccaggacatcgtgcccctgtgtgccgctgacatccaggaccagctgaagaagagatttgcctacctgagcggcggccggggccaggacggcagccctgtgatcaccttcccagactacccagccttcagcgagatcccagacaaggagttccagaatgtgatgacctacctgaccagcatccccagcctgcaggatgctggcatcggcttcatcctggtgattgacagaagaagagacaagtggacctctgtgaaggcctctgtgctgagaattgctgccagcttccctgccaacctgcagctggtgctggtgctgcggcccaccggcttcttccagaggaccctgagtgacatcgccttcaagttcaacagagatgacttcaagatgaaggtgcctgtgatcatgctgagctctgtgcctgacctgcacggctacatcgacaagagccagctgacagaggacctgggcggcaccctggactactgccacagccgctggctgtgccagaggacagccatcgagagctttgccctgatggtgaagcagacagcccagatgctgcagagctttggaacagagctggccgagacagagctgcccaatgatgtgcagagcaccagctctgtgctgtgtgcccacacagagaagaaggacaaggccaaggaggacctgcggctggccctgaaggagggccacagcgtgctggagagcctgcgggagctgcaggccgagggcagcgagcccagcgtgaaccaggaccagctggacaaccaggccaccgtgcagaggctgctggcccagctgaatgaaacagaagctgcctttgatgagttctgggccaagcaccagcagaagctggagcagtgcctgcagctgcggcactttgagcagggcttccgggaggtgaaggccatcctggatgctgccagccagaagatcgccaccttcacagacatcggcaacagcctggcccacgtggagcacctgctgcgggacctggccagctttgaggagaagagcggcgtggccgtggagcgggcccgggccctgagcctggatggagagcagctgattggcaacaagcactatgctgtggacagcatccggcccaagtgccaggagctgcggcacctgtgtgaccagttctctgctgagatcgccaggagaagaggcctgctgagcaagagcctggagctgcaccggcggctggagacctccatgaagtggtgtgatgagggcatctacctgctggccagccagcctgtggacaagtgccagagccaggatggagctgaggccgccctgcaggagattgagaagttcctggagaccggggctgagaacaagatccaggagctgaatgccatctacaaggagtatgagagcatcctgaaccaggacctgatggagcacgtgaggaaggtgttccagaagcaggcctccatggaggaggtgttccaccggcggcaggccagcctgaagaagctggccgcccggcagaccaggcctgtgcagcctgtggcccccaggcctgaggccctggccaagagcccctgccccagccctggcatcagaagaggcagcgagaacagcagcagcgagggcggggccctgcggcggggcccctaccgccgggccaagtctgagatgtctgagagccggcagggccggggcagcgctggggaggaggaggagagcctggccatcctgcggagacatgtgatgtctgagctgctggacacagagcgggcctacgtggaggagctgctgtgtgtgctggagggctatgctgctgagatggacaaccccctgatggcccacctgctgagcacaggcctgcacaacaagaaggatgtgctgtttggaaacatggaggagatctaccacttccacaaccgcatcttcctgcgggagctggagaactacacagactgcccagagctggtgggccgctgcttcctggagaggatggaggacttccagatctatgagaagtactgccagaacaagcccaggtctgagagcctgtggaggcagtgcagcgactgccccttcttccaggagtgccagaggaagctggaccacaagctgagcctggacagctacctgctgaagcctgtgcagaggatcaccaagtaccagctgctgctgaaggagatgctgaagtacagcaggaactgtgagggcgctgaggacctgcaggaggccctgagcagcatcctgggcatcctgaaggctgtgaatgacagcatgcacctgattgccatcaccggctatgatggcaacctgggggacctgggcaagctgctgatgcagggcagcttctctgtgtggacagaccacaagaggggccacaccaaggtgaaggagctggcccgcttcaagcccatgcagaggcacctgttcctgcacgagaaggctgtgctcttctgcaagaagcgggaggagaatggagagggctatgagaaggcccccagctacagctacaagcagagcctgaacatggctgctgtgggcatcacagaaaatgtgaagggagatgccaagaagtttgagatctggtacaatgcccgggaggaggtgtacatcgtgcaggcccccaccccagagatcaaggccgcctgggtgaatgagatcaggaaggtgctgaccagccagctgcaggcctgccgggaggccagccagcaccgggccctggagcagagccagagcctgcccctgcctgcccccaccagcaccagccccagccggggcaacagcaggaacatcaagaagctggaggagaggaagacagaccccctgagcctggagggctacgtgagcagcgcccccctgaccaagcccccagagaagggcaagggctggagcaagaccagccacagcctggaggccccagaagatgatggcggctggagcagcgctgaggagcagatcaacagcagtgatgctgaagaagatggcggcctgggccccaagaagctggtgcctgggaagtacacagtggtggccgaccacgagaagggcggcccagatgccctgcgggtgcgctctggagatgtggtggagctggtgcaggagggagatgagggcctgtggtag

SEQ ID NO: 158971 - DNA, 411 bp, Artificial Sequence
  Description of Artificial Sequence: Synthetic coding sequence
atgcaccaggacatcgtgcccctgtgtgccgctgacatccaggaccagctgaagaagagatttgcctacctgagcggcggccggggccaggacggcagccctgtgatcaccttcccagactacccagccttcagcgagatcccagacaaggagttccagaatgtgatgacctacctgaccagcatccccagcctgcaggatgctggcatcggcttcatcctggtgattgacagaagaagagacaagtggacctctgtgaaggcctctgtgctgagaattgctgccagcttccctgccaacctgcagctggtgctggtgctgcggcccaccggcttcttccagaggaccctgagtgacatcgccttcaagttcaacagagatgacttcaagatgaaggtgcctgtgatctag

SEQ ID NO: 158972 - DNA, 3372 bp, Artificial Sequence
  Description of Artificial Sequence: Synthetic coding sequence
atgacagtgcggcggctgagcctgctgtgccgggacctgtgggccctgtggctgctgctgaaggccggggctgatgagatcatgcaccaggacatcgtgcccctgtgtgccgctgacatccaggaccagctgaagaagagatttgcctacctgagcggcggccggggccaggacggcagccctgtgatcaccttcccagactacccagccttcagcgagatcccagacaaggagttccagaatgtgatgacctacctgaccagcatccccagcctgcaggatgctggcatcggcttcatcctggtgattgacagaagaagagacaagtggacctctgtgaaggcctctgtgctgagaattgctgccagcttccctgccaacctgcagctggtgctggtgctgcggcccaccggcttcttccagaggaccctgagtgacatcgccttcaagttcaacagagatgacttcaagatgaaggtgcctgtgatcatgctgagctctgtgcctgacctgcacggctacatcgacaagagccagctgacagaggacctgggcggcaccctggactactgccacagccgctggctgtgccagaggacagccatcgagagctttgccctgatggtgaagcagacagcccagatgctgcagagctttggaacagagctggccgagacagagctgcccaatgatgtgcagagcaccagctctgtgctgtgtgcccacacagagaagaaggacaaggccaaggaggacctgcggctggccctgaaggagggccacagcgtgctggagagcctgcgggagctgcaggccgagggcagcgagcccagcgtgaaccaggaccagctggacaaccaggccaccgtgcagaggctgctggcccagctgaatgaaacagaggccgcctttgatgagttctgggccaagcaccagcagaagctggagcagtgcctgcagctgcggcactttgagcagggcttccgggaggtgaaggccatcctggatgctgccagccagaagatcgccaccttcacagacatcggcaacagcctggcccacgtggagcacctgctgcgggacctggccagctttgaggagaagtctggagtggccgtggagcgggcccgggccctgagcctggatggagagcagctgattggcaacaagcactatgctgtggacagcatccggcccaagtgccaggagctgcggcacctgtgtgaccagttctctgctgagatcgcccggcggcggggcctgctgagcaagagcctggagctgcaccggcggctggagacctccatgaagtggtgtgatgagggcatctacctgctggccagccagcctgtggacaagtgccagagccaggatggagctgaggccgccctgcaggagattgagaagttcctggagactggagctgagaacaagatccaggagctgaatgccatctacaaggagtatgagagcatcctgaaccaggacctgatggagcacgtgaggaaggtgttccagaagcaggcctccatggaggaggtgttccaccggcggcaggccagcctgaagaagctggccgcccggcagaccaggcctgtgcagcctgtggcccccaggcctgaggccctggccaagagcccctgccccagccctggcatccggcggggcagcgagaacagcagcagcgagggcggggccctgcggcggggcccctacagaagagccaagtctgagatgtctgagagccggcagggccggggcagcgctggggaggaggaggagagcctggccatcctgcggcggcacgtgatgtctgagctgctggacacagagcgggcctacgtggaggagctgctgtgtgtgctggagggctacgccgctgagatggacaaccccctgatggcccacctgctgagcacaggcctgcacaacaagaaggatgtgctgtttggaaacatggaggagatctaccacttccacaaccgcatcttcctgcgggagctggagaactacacagactgcccagagctggtgggccgctgcttcctggagaggatggaggacttccagatctatgagaagtactgccagaacaagcccaggtctgagagcctgtggaggcagtgcagcgactgccccttcttccaggagtgccagaggaagctggaccacaagctgagcctggacagctacctgctgaagcctgtgcagaggatcaccaagtaccagctgctgctgaaggagatgctgaagtacagcaggaactgtgagggcgctgaggacctgcaggaggccctgagcagcatcctgggcatcctgaaggctgtgaatgacagcatgcacctgattgccatcaccggctatgatggcaacctgggggacctgggcaagctgctgatgcagggcagcttctctgtgtggacagaccacaagaggggccacaccaaggtgaaggagctggcccgcttcaagcccatgcagaggcacctgttcctgcacgagaaggctgtgctcttctgcaagaagcgggaggagaatggagagggctatgagaaggcccccagctacagctacaagcagagcctgaacatggctgctgtgggcatcacagaaaatgtgaagggagatgccaagaagtttgagatctggtacaatgcccgggaggaggtgtacatcgtgcaggcccccaccccagagatcaaggccgcctgggtgaatgagatcaggaaggtgctgaccagccagctgcaggcctgccgggaggccagccagcaccgggccctggagcagagccagagcctgcccctgcctgcccccaccagcaccagccccagccggggcaacagcaggaacatcaagaagctggaggagaggaagacagaccccctgagcctggagggctacgtgtcctctgcccccctgaccaagcccccagagaagggcaagggctggagcaagaccagccacagcctggaggccccagaagatgatggcggctggagcagcgctgaggagcagatcaacagcagtgatgctgaggaggatggcggcctgggccccaagaagctggtgcctgggaagtacacagtggtggccgaccacgagaagggcggcccagatgccctgcgggtgcgctctggagatgtggtggagctggtgcaggagggagatgagggcctgtggtacgtgcgggaccccaccaccgggaaggagggctgggtgcctgccagcagcctgtctgtgcggctgggccccagcggcagcgcccagtgcctgagcagcagcgagagcagccctggcagcgctgtgctgagcaacagcagcagctgcagcgagggcggccaggcccccttcagtgacctgcagggctag

SEQ ID NO: 158973 - DNA, 741 bp, Artificial Sequence
  Description of Artificial Sequence: Synthetic coding sequence
atgaggttctggctgaggacagaggagatggccctggaggagatggtgcagaggctgaatgctgtgtccaagcacacagatgagatcatgcaccaggacatcgtgcccctgtgtgccgctgacatccaggaccagctgaagaagagatttgcctacctgagcggcggccggggccaggacggcagccctgtgatcaccttcccagactacccagccttcagcgagatcccagacaaggagttccagaatgtgatgacctacctgaccagcatccccagcctgcaggatgctggcatcggcttcatcctggtgattgacagaagaagagacaagtggacctctgtgaaggcctctgtgctgagaattgctgccagcttccctgccaacctgcagctggtgctggtgctgcggcccaccggcttcttccagaggaccctgagtgacatcgccttcaagttcaacagagatgacttcaagatgaaggtgcctgtgatcatgctgagctctgtgcctgacctgcacggctacatcgacaagagccagctgacagaggacctgggcggcaccctggactactgccacagccgctggctgtgccagaggacagccatcgagagctttgccctgatggtgaagcagacagcccagatgctgcagagctttggaacagagctggccgagacagagctgcccaatgatgtgcagagcaccagctctgtgctgtgtgcccacacagaatag

SEQ ID NO: 158974 - DNA, 3342 bp, Artificial Sequence
  Description of Artificial Sequence: Synthetic coding sequence
atgggagatggcaaggctgtgcgcatctctgtggccgagatgaagagctactacctgtacagcgagtggtgctcctggctgctgtctgtggccgaggatgagatcatgcaccaggacatcgtgcccctgtgtgccgctgacatccaggaccagctgaagaagagatttgcctacctgagcggcggccggggccaggacggcagccctgtgatcaccttcccagactacccagccttcagcgagatcccagacaaggagttccagaatgtgatgacctacctgaccagcatccccagcctgcaggatgctggcatcggcttcatcctggtgattgacagaagaagagacaagtggacctctgtgaaggcctctgtgctgagaattgctgccagcttccctgccaacctgcagctggtgctggtgctgcggcccaccggcttcttccagaggaccctgagtgacatcgccttcaagttcaacagagatgacttcaagatgaaggtgcctgtgatcatgctgagctctgtgcctgacctgcacggctacatcgacaagagccagctgacagaggacctgggcggcaccctggactactgccacagccgctggctgtgccagaggacagccatcgagagctttgccctgatggtgaagcagacagcccagatgctgcagagctttggaacagagctggccgagacagagctgcccaatgatgtgcagagcaccagctctgtgctgtgtgcccacacagagaagaaggacaaggccaaggaggacctgcggctggccctgaaggagggccacagcgtgctggagagcctgcgggagctgcaggccgagggcagcgagcccagcgtgaaccaggaccagctggacaaccaggccaccgtgcagaggctgctggcccagctgaatgaaacagaggccgcctttgatgagttctgggccaagcaccagcagaagctggagcagtgcctgcagctgcggcactttgagcagggcttccgggaggtgaaggccatcctggatgctgccagccagaagatcgccaccttcacagacatcggcaacagcctggcccacgtggagcacctgctgcgggacctggccagctttgaggagaagtctggagtggccgtggagcgggcccgggccctgagcctggatggagagcagctgattggcaacaagcactatgctgtggacagcatccggcccaagtgccaggagctgcggcacctgtgtgaccagttctctgctgagatcgcccggcggcggggcctgctgagcaagagcctggagctgcaccggcggctggagacctccatgaagtggtgtgatgagggcatctacctgctggccagccagcctgtggacaagtgccagagccaggatggagctgaggccgccctgcaggagattgagaagttcctggagactggagctgagaacaagatccaggagctgaatgccatctacaaggagtatgagagcatcctgaaccaggacctgatggagcacgtgaggaaggtgttccagaagcaggcctccatggaggaggtgttccaccggcggcaggccagcctgaagaagctggccgcccggcagaccaggcctgtgcagcctgtggcccccaggcctgaggccctggccaagagcccctgccccagccctggcatccggcggggcagcgagaacagcagcagcgagggcggggccctgcggcggggcccctacagaagagccaagtctgagatgtctgagagccggcagggccggggcagcgctggggaggaggaggagagcctggccatcctgcggcggcacgtgatgtctgagctgctggacacagagcgggcctacgtggaggagctgctgtgtgtgctggagggctacgccgctgagatggacaaccccctgatggcccacctgctgagcacaggcctgcacaacaagaaggatgtgctgtttggaaacatggaggagatctaccacttccacaaccgcatcttcctgcgggagctggagaactacacagactgcccagagctggtgggccgctgcttcctggagaggatggaggacttccagatctatgagaagtactgccagaacaagcccaggtctgagagcctgtggaggcagtgcagcgactgccccttcttccaggagtgccagaggaagctggaccacaagctgagcctggacagctacctgctgaagcctgtgcagaggatcaccaagtaccagctgctgctgaaggagatgctgaagtacagcaggaactgtgagggcgctgaggacctgcaggaggccctgagcagcatcctgggcatcctgaaggctgtgaatgacagcatgcacctgattgccatcaccggctatgatggcaacctgggggacctgggcaagctgctgatgcagggcagcttctctgtgtggacagaccacaagaggggccacaccaaggtgaaggagctggcccgcttcaagcccatgcagaggcacctgttcctgcacgagaaggctgtgctcttctgcaagaagcgggaggagaatggagagggctatgagaaggcccccagctacagctacaagcagagcctgaacatggctgctgtgggcatcacagaaaatgtgaagggagatgccaagaagtttgagatctggtacaatgcccgggaggaggtgtacatcgtgcaggcccccaccccagagatcaaggccgcctgggtgaatgagatcaggaaggtgctgaccagccagctgcaggcctgccgggaggccagccagcaccgggccctggagcagagccagagcctgcccctgcctgcccccaccagcaccagccccagccggggcaacagcaggaacatcaagaagctggaggagaggaagacagaccccctgagcctggagggctacgtgtcctctgcccccctgaccaagcccccagagaagggcaagggctggagcaagaccagccacagcctggaggccccagaagatgatggcggctggagcagcgctgaggagcagatcaacagcagtgatgctgaggaggatggcggcctgggccccaagaagctggtgcctgggaagtacacagtggtggccgaccacgagaagggcggcccagatgccctgcgggtgcgctctggagatgtggtggagctggtgcaggagggagatgagggcctgtggtacgtgcgggaccccaccaccgggaaggagggctgggtgcctgccagcagcctgtctgtgcggctgggccccagcggcagcgcccagtgcctgagcagcagcggcaaggcccacgtgccccgggcccacccctag

SEQ ID NO: 158975 - DNA, 2712 bp, Artificial Sequence
  Description of Artificial Sequence: Synthetic coding sequence
ctgaagatgcctgtgatcatgctgagctctgtgcctgacctgcacggctacatcgacaagagccagctgacagaggacctgggcggcaccctggactactgccacagccgctggctgtgccagaggacagccatcgagagctttgccctgatggtgaagcagacagcccagatgctgcagagctttggaacagagctggccgagacagagctgcccaatgatgtgcagagcaccagctctgtgctgtgtgcccacacagagaagaaggacaaggccaaggaggacctgcggctggccctgaaggagggccacagcgtgctggagagcctgcgggagctgcaggccgagggcagcgagcccagcgtgaaccaggaccagctggacaaccaggccaccgtgcagaggctgctggcccagctgaatgaaacagaagctgcctttgatgagttctgggccaagcaccagcagaagctggagcagtgcctgcagctgcggcactttgagcagggcttccgggaggtgaaggccatcctggatgctgccagccagaagatcgccaccttcacagacatcggcaacagcctggcccacgtggagcacctgctgcgggacctggccagctttgaggagaagagcggcgtggccgtggagcgggcccgggccctgagcctggatggagagcagctgattggcaacaagcactatgctgtggacagcatccggcccaagtgccaggagctgcggcacctgtgtgaccagttctctgctgagatcgccaggagaagaggcctgctgagcaagagcctggagctgcaccggcggctggagacctccatgaagtggtgtgatgagggcatctacctgctggccagccagcctgtggacaagtgccagagccaggatggagctgaggccgccctgcaggagattgagaagttcctggagaccggggctgagaacaagatccaggagctgaatgccatctacaaggagtatgagagcatcctgaaccaggacctgatggagcacgtgaggaaggtgttccagaagcaggcctccatggaggaggtgttccaccggcggcaggccagcctgaagaagctggccgcccggcagaccaggcctgtgcagcctgtggcccccaggcctgaggccctggccaagagcccctgccccagccctggcatcagaagaggcagcgagaacagcagcagcgagggcggggccctgcggcggggcccctaccgccgggccaagtctgagatgtctgagagccggcagggccggggcagcgctggggaggaggaggagagcctggccatcctgcggagacatgtgatgtctgagctgctggacacagagcgggcctacgtggaggagctgctgtgtgtgctggagggctatgctgctgagatggacaaccccctgatggcccacctgctgagcacaggcctgcacaacaagaaggatgtgctgtttggaaacatggaggagatctaccacttccacaaccgcatcttcctgcgggagctggagaactacacagactgcccagagctggtgggccgctgcttcctggagaggatggaggacttccagatctatgagaagtactgccagaacaagcccaggtctgagagcctgtggaggcagtgcagcgactgccccttcttccaggagtgccagaggaagctggaccacaagctgagcctggacagctacctgctgaagcctgtgcagaggatcaccaagtaccagctgctgctgaaggagatgctgaagtacagcaggaactgtgagggcgctgaggacctgcaggaggccctgagcagcatcctgggcatcctgaaggctgtgaatgacagcatgcacctgattgccatcaccggctatgatggcaacctgggggacctgggcaagctgctgatgcagggcagcttctctgtgtggacagaccacaagaggggccacaccaaggtgaaggagctggcccgcttcaagcccatgcagaggcacctgttcctgcacgagaaggctgtgctcttctgcaagaagcgggaggagaatggagagggctatgagaaggcccccagctacagctacaagcagagcctgaacatggctgctgtgggcatcacagaaaatgtgaagggagatgccaagaagtttgagatctggtacaatgcccgggaggaggtgtacatcgtgcaggcccccaccccagagatcaaggccgcctgggtgaatgagatcaggaaggtgctgaccagccagctgcaggcctgccgggaggccagccagcaccgggccctggagcagagccagagcctgcccctgcctgcccccaccagcaccagccccagccggggcaacagcaggaacatcaagaagctggaggagaggaagacagaccccctgagcctggagggctacgtgagcagcgcccccctgaccaagcccccagagaagggcaagggctggagcaagaccagccacagcctggaggccccagaagatgatggcggctggagcagcgctgaggagcagatcaacagcagtgatgctgaagaagatggcggcctgggccccaagaagctggtgcctgggaagtacacagtggtggccgaccacgagaagggcggcccagatgccctgcgggtgcgctctggagatgtggtggagctggtgcaggagggagatgagggcctgtag

SEQ ID NO: 158976 - DNA, 3414 bp, Artificial Sequence; identical to SEQ ID NO: 158968
  Description of Artificial Sequence: Synthetic coding sequence

SEQ ID NO: 158977 - DNA, 3378 bp, Artificial Sequence
  Description of Artificial Sequence: Synthetic coding sequence
atgaggttctggctgaggacagaggagatggccctggaggagatggtgcagaggctgaatgctgtgtccaagcacacagatgagatcatgcaccaggacatcgtgcccctgtgtgccgctgacatccaggaccagctgaagaagagatttgcctacctgagcggcggccggggccaggacggcagccctgtgatcaccttcccagactacccagccttcagcgagatcccagacaaggagttccagaatgtgatgacctacctgaccagcatccccagcctgcaggatgctggcatcggcttcatcctggtgattgacagaagaagagacaagtggacctctgtgaaggcctctgtgctgagaattgctgccagcttccctgccaacctgcagctggtgctggtgctgcggcccaccggcttcttccagaggaccctgagtgacatcgccttcaagttcaacagagatgacttcaagatgaaggtgcctgtgatcatgctgagctctgtgcctgacctgcacggctacatcgacaagagccagctgacagaggacctgggcggcaccctggactactgccacagccgctggctgtgccagaggacagccatcgagagctttgccctgatggtgaagcagacagcccagatgctgcagagctttggaacagagctggccgagacagagctgcccaatgatgtgcagagcaccagctctgtgctgtgtgcccacacagagaagaaggacaaggccaaggaggacctgcggctggccctgaaggagggccacagcgtgctggagagcctgcgggagctgcaggccgagggcagcgagcccagcgtgaaccaggaccagctggacaaccaggccaccgtgcagaggctgctggcccagctgaatgaaacagaggccgcctttgatgagttctgggccaagcaccagcagaagctggagcagtgcctgcagctgcggcactttgagcagggcttccgggaggtgaaggccatcctggatgctgccagccagaagatcgccaccttcacagacatcggcaacagcctggcccacgtggagcacctgctgcgggacctggccagctttgaggagaagtctggagtggccgtggagcgggcccgggccctgagcctggatggagagcagctgattggcaacaagcactatgctgtggacagcatccggcccaagtgccaggagctgcggcacctgtgtgaccagttctctgctgagatcgcccggcggcggggcctgctgagcaagagcctggagctgcaccggcggctggagacctccatgaagtggtgtgatgagggcatctacctgctggccagccagcctgtggacaagtgccagagccaggatggagctgaggccgccctgcaggagattgagaagttcctggagactggagctgagaacaagatccaggagctgaatgccatctacaaggagtatgagagcatcctgaaccaggacctgatggagcacgtgaggaaggtgttccagaagcaggcctccatggaggaggtgttccaccggcggcaggccagcctgaagaagctggccgcccggcagaccaggcctgtgcagcctgtggcccccaggcctgaggccctggccaagagcccctgccccagccctggcatccggcggggcagcgagaacagcagcagcgagggcggggccctgcggcggggcccctacagaagagccaagtctgagatgtctgagagccggcagggccggggcagcgctggggaggaggaggagagcctggccatcctgcggcggcacgtgatgtctgagctgctggacacagagcgggcctacgtggaggagctgctgtgtgtgctggagggctacgccgctgagatggacaaccccctgatggcccacctgctgagcacaggcctgcacaacaagaaggatgtgctgtttggaaacatggaggagatctaccacttccacaaccgcatcttcctgcgggagctggagaactacacagactgcccagagctggtgggccgctgcttcctggagaggatggaggacttccagatctatgagaagtactgccagaacaagcccaggtctgagagcctgtggaggcagtgcagcgactgccccttcttccaggagtgccagaggaagctggaccacaagctgagcctggacagctacctgctgaagcctgtgcagaggatcaccaagtaccagctgctgctgaaggagatgctgaagtacagcaggaactgtgagggcgctgaggacctgcaggaggccctgagcagcatcctgggcatcctgaaggctgtgaatgacagcatgcacctgattgccatcaccggctatgatggcaacctgggggacctgggcaagctgctgatgcagggcagcttctctgtgtggacagaccacaagaggggccacaccaaggtgaaggagctggcccgcttcaagcccatgcagaggcacctgttcctgcacgagaaggctgtgctcttctgcaagaagcgggaggagaatggagagggctatgagaaggcccccagctacagctacaagcagagcctgaacatggctgctgtgggcatcacagaaaatgtgaagggagatgccaagaagtttgagatctggtacaatgcccgggaggaggtgtacatcgtgcaggcccccaccccagagatcaaggccgcctgggtgaatgagatcaggaaggtgctgaccagccagctgcaggcctgccgggaggccagccagcaccgggccctggagcagagccagagcctgcccctgcctgcccccaccagcaccagccccagccggggcaacagcaggaacatcaagaagctggaggagaggaagacagaccccctgagcctggagggctacgtgtcctctgcccccctgaccaagcccccagagaagggcaagggctggagcaagaccagccacagcctggaggccccagaagatgatggcggctggagcagcgctgaggagcagatcaacagcagtgatgctgaggaggatggcggcctgggccccaagaagctggtgcctgggaagtacacagtggtggccgaccacgagaagggcggcccagatgccctgcgggtgcgctctggagatgtggtggagctggtgcaggagggagatgagggcctgtggtacgtgcgggaccccaccaccgggaaggagggctgggtgcctgccagcagcctgtctgtgcggctgggccccagcggcagcgcccagtgcctgagcagcagcgagagcagccctggcagcgctgtgctgagcaacagcagcagctgcagcgagggcggccaggcccccttcagtgacctgcagggctag

SEQ ID NO: 158978 - DNA, 1713 bp, Artificial Sequence
  Description of Artificial Sequence: Synthetic coding sequence
atgagccggctggaggccaagaagcccagcctgtgcaagtctgagcccctgaccacagagcgggtgaggaccaccctgtctgtgctgaagagaattgtgaccagctgctacggccccagcggccgcctgaagcagctgcacaacggctttggaggctacgtgtgcaccaccagccagagcagcgccctgctgagccacctgctggtgacccaccccatcctgaagatcctgacagccagcatccagaaccacgtgtcctccttcagtgactgtggcctcttcaccgccatcctgtgctgcaacctgattgaaaatgtgcagaggctgggcctgacccccaccaccgtcatccggctgaacaagcacctgctgagcctgtgcatctcctacctgaagtctgagacctgtggctgccgcatccctgtggacttcagcagcacccagatcctgctgtgcctggtgcgcagcatcctgaccagcaagccagcctgcatgctgaccaggaaggagacagaacatgtgtctgccctgatcctgcgggccttcctgctgaccatcccagaaaatgctgagggccacatcatcctgggcaagagcctgattgtgcccctgaagggccagagggtcatcgacagcacagtgctgcccggcatcctgattgagatgtctgaggtgcagctgatgaggctgctgcccatcaagaagagcacagccctgaaggtggccctcttctgcaccaccctgagcggggacaccagtgacacaggagagggcaccgtggtggtgtcctatggagtgtccctggagaatgctgtgctggaccagctgctgaacctgggccggcagctgatcagtgaccacgtggacctggtgctgtgccagaaggtgatccaccccagcctgaagcagttcctgaacatgcaccgcatcatcgccatcgaccgcatcggcgtgaccctgatggagcccctgaccaagatgacaggcacccagcccatcggcagcctgggcagcatctgccccaacagctatggctctgtgaaggatgtgtgcacagccaagtttggcagcaagcacttcttccacctgatccccaatgaggccaccatctgcagcctgctgctgtgcaacagaaatgacacagcctgggatgagctgaagctgacctgccagacagccctgcacgtgctgcagctgaccctgaaggagccctgggccctgctgggcggcggctgcacagagacccacctggccgcctacatccgccacaagacccacaatgaccctgagagcatcctgaaggatgatgaatgtacccagacagagctgcagctgattgctgaggccttctgcagcgccctggagagcgtggtgggcagcctggagcatgatggaggagagatcctgacagacatgaagtatggccacctgtggagcgtgcaggccgacagcccctgtgtggccaactggccagacctgctgagccagtgtggctgcggcctgtacaacagccaggaggagctgaactggagcttcctgcggagcacccggcggccctttgtgccccagagctgcctgccccatgaggccgtgggcagcgccagcaacctgaccctggactgcctgacagccaagctgagcggcctgcaggtggccgtggagacagccaacctgatcctggacctgtcctatgtgattgaggacaagaactag

SEQ ID NO: 158979 - DNA, 1713 bp, Artificial Sequence; identical to SEQ ID NO: 158978
  Description of Artificial Sequence: Synthetic coding sequence

SEQ ID NO: 158980 - DNA, 2145 bp, Artificial Sequence
  Description of Artificial Sequence: Synthetic coding sequence
atgcctgtgcgcttcaagggcctgtctgagtaccagaggaacttcctgtggaagaagagctacctgtctgagagctgcaacagctctgtgggcaggaagtacccctgggccggcctgcggagtgaccagctgggcatcaccaaggagcccagcttcatcagcaagagaagagtgccctaccatgacccccagatcagcaagagcctggagtggaatggagccatcagcgagagcaatgtggtggccagccctgagcctgaggcccctgagacccccaagagccaggaggccgagcagaaggatgtgacccaggagcgggtgcacagcctggaggccagccgggtgcccaagaggaccaggagccacagcgctgacagcagagctgagggcgccagtgatgtggagaacaatgaaggagtgaccaaccacacccctgtgaatgaaaatgtggagctggagcacagcaccaaggtgctgtctgaaaatgtggacaatggcctggaccggctgctgaggaagaaggccggcctgactgtggtgcccagctacaatgccctgagaaattctgagtaccagaggcagtttgtgtggaagaccagcaaggagacagccccagcctttgctgccaaccaggtgttccacaacaagagccagtttgtgccccccttcaagggcaacagcgtcatccacgagacagagtacaagaggaacttcaagggcctgagccctgtgaaggagcccaagctgagaaatgacctgagagaaaatagaaacctggagaccgtgtccccagagaggaagagcaacaagattgatgaccggctgaagctggaggccgagatggagctgaaggacctgcaccagcccaagaggaagctgaccccctggaagcaccagaggctgggcaaggtgaacagcgagtaccgggccaagttcctgagccctgcccagtacctgtacaaggccggggcctggacccacgtgaagggcaacatgcccaaccaggtgaaggagctgcgggagaaggccgagttctacaggaagagggtgcagggcacccacttcagccgggaccacctgaaccagatcctgagtgacagcaactgctgctgggatgtgagcagcaccaccagcagcgagggcaccgtgagcagcaacatccgggccctggacctggccggggaccccaccagccacaagaccctgcagaagtgccccagcacagagcctgaggagaagggcaacatcgtggaggagcagccccagaagaacaccacagagaagctgggcgtgtctgcccccaccatccctgtgagaagaaggctggcctgggacacagagaacaccagtgaagatgtgcagaagcagcctggagagaaggaggaggaggatgacaatgaggaggagggggacaggaagacaggcaagcaggccttcatgggagagcaggagaagctggatgtgcgggagaagagcaaggctgacaagatgaaggagggcagtgacagctctgtgtcctctgagaagggcggccgcctgcccacccccaagctgcgggagctgggcggcatccagaggacccaccacgacctgaccaccccagctgtgggcggcgctgtgctggtgagccccagcaagatgaagcccccagcccctgagcagaggaagaggatgaccagccaggactgcctggagaccagcaagaatgacttcaccaagaaggagagcagagctgtgtccctgctgaccagccctgctgctggcatcaagacagtggaccccctgcccctgagagaagattctgaggacaacatccacaagtttgctgaggccaccctgcctgtgtccaagatccccaagtaccccaccaaccccccaggccagctgcccagccccccccacgtgcccagctactggcaccccagccgccgcatccagggcagcctgcgggaccctgagttccagcacaacgtgggcaaggccaggatgaacaacctgcagctgccccagcacgaggccttcaatgatgaagatgaagatcggctgtctgagatcagcgcccggtctgctgccagcagcctgcgggccttccagaccctggcccgggccaagaagaggaaggagaacttctggggcaagacctag

SEQ ID NO: 158981 - DNA, 210 bp, Artificial Sequence
  Description of Artificial Sequence: Synthetic coding sequence
atgcctgtgcgcttcaagggcctgtctgagtaccagaggaacttcctgtggaagaagagctacctgtctgagagctgcaacagctctgtgggcaggaagtacccctgggccggcctgcggagtgaccagctgggcaaccagggccgctgcaggaccaagatccagcacagcgacatcagcagcctgctgatcctggtgtgcagcacctag

SEQ ID NO: 158982 - DNA, 669 bp, Artificial Sequence
  Description of Artificial Sequence: Synthetic coding sequence
atgcctgtgcgcttcaagggcctgtctgagtaccagaggaacttcctgtggaagaagagctacctgtctgagagctgcaacagctctgtgggcaggaagtacccctgggccggcctgcggagtgaccagctgggcatcaccaaggagcccagcttcatcagcaagagaagagtgccctaccatgacccccagatcagcaagagcctggagtggaatggagccatcagcgagagcaatgtggtggccagccctgagcctgaggcccctgagacccccaagagccaggaggccgagcagaaggatgtgacccaggagcgggtgcacagcctggaggccagccgggtgcccaagaggaccaggagccacagcgctgacagcagagctgagggcgccagtgatgtggagaacaatgaaggagtgaccaaccacacccctgtgaatgaaaatgtggagctggagcacagcaccaaggtgctgtctgaaaatgtggacaatggagtgggcatcttcaccgccttcctgttcaagagcattgagttcttcatcggcttcatcgtcatcagcgtcatcctgcactttgtgttccagaacttccccctgctcttcagctgcctgatgagcatccgcatcgtggacaaccggctgctgaccctggtgattgtgaactag

SEQ ID NO: 158983 - DNA, 2040 bp, Artificial Sequence
  Description of Artificial Sequence: Synthetic coding sequence
atgcctgtgcgcttcaagggcctgtctgagtaccagaggaacttcctgtggaagaagagctacctgtctgagagctgcaacagctctgtgggcaggaagtacccctgggccggcctgcggagtgaccagctgggcatcaccaaggagcccagcttcatcagcaagagaagagtgccctaccatgacccccagatcagcaagagcctggagtggaatggagccatcagcgagagcaatgtggtggccagccctgagcctgaggcccctgagacccccaagagccaggaggccgagcagaaggatgtgacccaggagcgggtgcacagcctggaggccagccgggtgcccaagaggaccaggagccacagcgctgacagcagagctgagggcgccagtgatgtggagaacaatgaaggagtgaccaaccacacccctgtgaatgaaaatgtggagctggagcacagcaccaaggtgctgtctgaaaatgtggacaatggagtcttccacaacaagagccagtttgtgccccccttcaagggcaacagcgtcatccatgaaacagagtacaagaggaacttcaagggcctgagccctgtgaaggagcccaagctgagaaatgacctgcgggagaacagaaacctggagaccgtgtccccagagaggaagagcaacaagattgatgaccggctgaagctggaggccgagatggagctgaaggacctgcaccagcccaagaggaagctgaccccctggaagcaccagaggctgggcaaggtgaacagcgagtaccgggccaagttcctgagccctgcccagtacctgtacaaggccggggcctggacccacgtgaagggcaacatgcccaaccagggcagcctgaatgccatgtggtatgcagaggtgaaggagctgcgggagaaggccgagttctacaggaagagggtgcagggcacccacttcagccgggaccacctgaaccagatcctgagtgacagcaactgctgctgggatgtgagcagcaccaccagcagcgagggcaccgtgagcagcaacatccgggccctggacctggccggggaccccaccagccacaagaccctgcagaagtgccccagcacagagcctgaggagaagggcaacatcgtggaggagcagccccagaagaacaccacagagaagctgggcgtgtctgcccccaccatccctgtgagaagaaggctggcctgggacacagagaacaccagtgaagatgtgcagaagcagcccggggagaaggaggaggaggatgacaatgaggaggagggggacaggaagacaggcaagcaggccttcatgggagagcaggagaagctggatgtgcgggagaagagcaaggctgacaagatgaaggagggcagtgacagctctgtgagcagcgagaagggcggccgcctgcccacccccaagctgcgggagctgggcggcatccagaggacccaccacgacctgaccaccccagctgtgggcggcgctgtgctggtgagccccagcaagatgaagcccccagcccctgagcagaggaagaggatgaccagccaggactgcctggagaccagcaagaatgacttcaccaagaaggagagcagagctgtgtccctgctgaccagccctgctgctggcatcaagacagtggaccccctgcccctgcgggaggacagcgaggacaacatccacaagtttgctgaggccaccctgcctgtgtccaagatccccaagtaccccaccaaccccccaggccagctgcccagcccccctcatgtgcccagctactggcaccccagccgccgcatccagggcagcctgcgggaccctgagttccagcacaacgtgggcaaggccaggatgaacaacctgcagctgccccagcacgaggccttcaatgatgaagatgaggaccggctgtctgagatcagcgcccggtctgctgccagcagcctgcgggccttccagaccctggcccgggccaagaagaggaaagaaaacttctggggcaagacctag

SEQ ID NO: 158984 - DNA, 2715 bp, Artificial Sequence
  Description of Artificial Sequence: Synthetic coding sequence
atggaccgctacctgctgctggtgatctggggcgagggcaagttccccagcgctgccagccgggaggccgagcacggccctgaggtgtcctctggagagggcacagagaaccagcctgacttcaccgctgccaacgtgtaccacctgctgaagaggagcatcagcgccagcatcaaccctgaggacagcaccttccctgcctgcagcgtgggcggcatccctggcagcaagaagtggttctttgctgtgcaggccatctacggcttctaccagttctgcagcagtgactggcaggagatccactttgacacagagaaggacaagattgaagatgtgctgcagaccaacattgaagaatgtctgggcgctgtggagtgctttgaggaggaggacagcaacagccgggagagcctgagcctggccgacctgtatgaggaggccgctgagaacctgcaccagctgagtgacaagctgcctgcccctggccgggccatggtggacatcatcctgctgctgagtgacaaggacccccccaagctgaaggactacctgcccaccgtgggcgccctgaagcacctgcgggagtggtacagcgccaagatcaccatcgccggcaaccactgtgagatcaactgccagaagattgctgagtacctgagcgccaacgtggtgtccctggaggacctgagaaatgtgattgacagcaaggagctgtggaggggcaagatccagatctgggagaggaagtttggatttgagatctccttccctgagttctgcctgaagggcgtgaccctgaagaacttcagcaccagcaacctgaacacagacttcctggccaagaagatcatccccagcaaggacaagaacatcctgcccaaggtgttccactactacggccctgccctggagtttgtgcagatgatcaagctgagtgacctgcccagctgctacatgtctgacatcgagtttgagctgggcctgaccaacagcaccaagcagaacagcgtgctgctgctggagcagatcagcagcctgtgcagcaaggtgggcgccctgtttgtgctgccctgcaccatcagcaacatcctgatccccccacccaaccagctgagcagcaggaagtggaaggagtacatcgccaagaagcccaagaccatctctgtgcctgatgtggaggtgaagggagaatgtagcagctactacctgctgctgcagggcaatggaaacagacgctgcaaggccaccctcatccacagcgccaaccagatcaatggcagctttgccctgaacctgatccacggcaagatgaagaccaagacagaggaggccaagctgtccttcccctttgacctgctgagcctgccccacttctctggagagcagatcgtgcagcgggagaagcagctggccaacgtgcaggtgctggccctggaggagtgcctgaagaggaggaagctggccaagcagcctgagaccgtgtctgtggccgagctgaagagcctgctggtgctgaccaggaagcacttcctggactactttgatgctgtgatccccaagatgatcctgaggaagatggacaagatcaagaccttcaacatcctgaatgacttcagccctgtggagcccaacagcagcagcctgatggagaccaaccccctggagtggccagagcggcacgtgctgcagaacctggagacctttgagaagaccaagcagaagatgaggacaggcagcctgccccacagcagcgagcagctgctgggccacaaggagggcccccgggacagcatcaccctgctggatgccaaggagctgctgaagtacttcaccagtgatggcctgcccatcggggacctgcagcccctgcccatccagaagggggagaagacctttgtgctgaccccagagctgagccctgggaagctgcaggtgctgccctttgagaaggcctctgtgtgccactaccatggaattgagtactgcctggatgacaggaaggccctggagagagatggcggcttcagcgagctgcagagccgcctcatccgctatgagacccagaccacctgcacccgggagagcttccctgtgcccaccgtgctgagccccctgcccagccctgtggtgtccagtgaccccggctctgtgcctgatggagaggtgctgcagaatgagctgaggacagaggtgtcccggctgaagaggaggagcaaggacctgaactgcctgtaccccaggaagaggctggtgaagtctgagagcagcgagagcctgctgagccagaccaccggcaacagcaaccactaccaccaccacgtgaccagcaggaagccccagacagagaggagcctgcctgtgacctgccccctggtgcccatccccagctgtgagacccccaagctggccaccaagaccagcagcggccagaagtccatgcatgagagcaagaccagccggcagatcaaggagagccgcagccagaagcacacccgcatcctgaaggaggtggtgacagagaccctgaagaagcacagcatcacagagacccatgagtgcttcaccgcctgcagccagaggctgtttgagatcagcaagttctacctgaaggacctgaagaccagccggggcctgtttgaggagatgaagaagacagccaacaacaatgctgtgcaggtgattgactgggtgctggagaagaccagcaagaagtag

SEQ ID NO: 158985 - DNA, 1374 bp, Artificial Sequence
  Description of Artificial Sequence: Synthetic coding sequence
tgaatggccgagaccgtgtggagcacagacacaggagaggccgtgtaccgcagccgggaccctgtgaggaacctgcggctgcgggtgcacctgcagaggatcaccagcagcaacttcctgcactaccagcctgctgctgagctgggcaaggacctgattgacctggccaccttccggccccagcccacagccagcggccacaggccagaagaagatgaggaggaggagatcgtgattggctggcaggagaagctgttcagccagtttgaggtggacctgtaccagaatgaaacagcctgccagagccccctggactaccagtaccggcaggagatcctgaagctggagaacagcggcggcaagaagaacagacgcatcttcacctacacagacagcgaccgctacaccaacctggaggagcactgccagaggatgaccacagctgccagcgaggtgcccagcttcctggtggagaggatggccaacgtgagaagaagacggcaggaccggcggggcatggagggcggcatcctgaagagccgcatcgtgacctgggagcccagcgaggagtttgtgaggaacaaccacgtgatcaacacccccctgcagaccatgcacatcatggctgacctgggcccctacaagaagctgggctacaagaagtatgagcacgtgctgtgcaccctgaaggtggacagcaatggagtcatcaccgtgaagccagacttcaccggcctgaagggcccctaccgcatcgagacagaaggagagaagcaggagctgtggaagtacaccatcgacaacgtgagcccccacgcccagcctgaggaggaggagcgggagcggcgggtcttcaaggacctgtatggccgccacaaggagtacctgagcagcctggtgggcacagactttgagatgacagtgcctggggccctgcggctgtttgtgaatggagaggtggtgtctgcccagggctatgaatatgacaacctgtatgtgcacttctttgtggagctgcccacagcccactggagcagccctgccttccagcagctgtctggagtgacccagacctgcaccaccaagagcctggccatggacaaggtggcccacttctcctaccccttcacctttgaggccttcttcctgcatgaagatgagagcagtgatgccctgcctgagtggcctgtgctgtactgtgaggtgctgagcctggacttctggcagcgctacagagtggagggctacggggctgtggtgctgcctgccaccccaggccccagctggaacagagcccccttcaggaagggctgcggcgtgtgctggacagtgtggaagggcagcgccagccgggtgcccttcaccatgtgctag

SEQ ID NO: 158986 - DNA, 1566 bp, Artificial Sequence
  Description of Artificial Sequence: Synthetic coding sequence
atggccgagaccgtgtggagcacagacaccggggaggccgtgtaccgcagccgggaccctgtgaggaacctgcggctgcgggtgcacctgcagaggatcaccagcagcaacttcctgcactaccagcctgctgctgagctgggcaaggacctgattgacctggccaccttccggccccagcccacagccagcggccacaggcctgaggaggatgaggaggaggagatcgtcatcggctggcaggagaagctgttcagccagtttgaggtggacctgtaccagaatgaaacagcctgccagagccccctggactaccagtaccggcaggagatcctgaagctggagaacagcggcggcaagaagaacagacgcatcttcacctacacagacagcgaccgctacaccaacctggaggagcactgccagaggatgaccacagctgccagcgaggtgcccagcttcctggtggagaggatggccaacgtgagaagaagacggcaggacagaagaggcatggagggcggcatcctgaagagcagaattgtgacctgggagcccagcgaggagtttgtgaggaacaaccacgtgatcaacacccccctgcagaccatgcacatcatggctgacctgggcccctacaagaagctgggctacaagaagtatgaacatgtgctgtgcaccctgaaggtggacagcaatggagtcatcaccgtgaagccagacttcaccggcctgaagggcccctacagaattgaaacagaaggagagaagcaggagctgtggaagtacaccatcgacaacgtgagcccccacgcccagcctgaggaggaggagcgggagaggagggtcttcaaggacctgtatggccgccacaaggagtacctgagcagcctggtgggcacagactttgagatgacagtgcctggggccctgcggctgtttgtgaatggagaggtggtgtctgcccagggctatgaatatgacaacctgtatgtgcacttctttgtggagctgcccacagcccactggagcagccctgccttccagcagctgagcggcgtgacccagacctgcaccaccaagagcctggccatggacaaggtggcccacttctcctaccccttcacctttgaggccttcttcctgcatgaagatgagagcagtgatgccctgcctgagtggcctgtgctgtactgtgaggtgctgagcctggacttctggcagcgctacagagtggagggctatggagctgtggtgctgcctgccaccccaggcagccacaccctgactgtgtccacctggaggcctgtggagctgggcaccgtggccgagctgcggcgcttcttcatcggcggcagcctggagctggaggacctgtcctatgtgcgcatccctggcagcttcaaggccctgctgagcagcagcaagaccaaggagggcaggaaggtggatggagagcgggtgctgaacccccagcctgtgtccctgagcctcttccctgggaagccccacagcacagcctggggcctgctgcggctgcgctatgagctgttcctgagcaagtag

SEQ ID NO: 158987 - DNA, 1680 bp, Artificial Sequence
  Description of Artificial Sequence: Synthetic coding sequence
atggccgagaccgtgtggagcacagacaccggggaggccgtgtaccgcagccgggaccctgtgaggaacctgcggctgcgggtgcacctgcagaggatcaccagcagcaacttcctgcactaccagcctgctgctgagctgggcaaggacctgattgacctggccaccttccggccccagcccacagccagcggccacaggcctgaggaggatgaggaggaggagatcgtcatcggctggcaggagaagctgttcagccagtttgaggtggacctgtaccagaatgaaacagcctgccagagccccctggactaccagtaccggcaggagatcctgaagctggagaacagcggcggcaagaagaacagacgcatcttcacctacacagacagcgaccgctacaccaacctggaggagcactgccagaggatgaccacagctgccagcgaggtgcccagcttcctggtggagaggatggccaacgtgagaagaagacggcaggacagaagaggcatggagggcggcatcctgaagagcagaattgtgacctgggagcccagcgaggagtttgtgaggaacaaccacgtgatcaacacccccctgcagaccatgcacatcatggctgacctgggcccctacaagaagctgggctacaagaagtatgaacatgtgctgtgcaccctgaaggtggacagcaatggagtcatcaccgtgaagccagacttcaccggcctgaagggcccctacagaattgaaacagaaggagagaagcaggagctgtggaagtacaccatcgacaacgtgagcccccacgcccagcctgaggaggaggagcgggagaggagggtcttcaaggacctgtatggccgccacaaggagtacctgagcagcctggtgggcacagactttgagatgacagtgcctggggccctgcggctgtttgtgaatggagaggtggtgtctgcccagggctatgaatatgacaacctgtatgtgcacttctttgtggagctgcccacagcccactggagcagccctgccttccagcagctgagcggcgtgacccagacctgcaccaccaagagcctggccatggacaaggtggcccacttctcctaccccttcacctttgaggccttcttcctgcatgaagatgagagcagtgatgccctgcctgagtggcctgtgctgtactgtgaggtgctgagcctggacttctggcagcgctacagagtggagggctatggagctgtggtgctgcctgccaccccaggcagccacaccctgactgtgtccacctggaggcctgtggagctgggcaccgtggccgagctgcggcgcttcttcatcggcggcagcctggagctggaggacctgtcctatgtgcgcatccctggcagcttcaagggggagcggctgagccgcttcggcctgaggacagagaccactggaacagtgaccttccggctgcactgcctgcagcagagccgggccttcatggagagcagcagcctgcagaagaggatgaggtctgtgctggaccggctggagggcttcagccagcagagcagcatccacaacgtgctggaggccttcagaagagcccggcggaggatgcaggaggcccgggagagcctgccccaggacctggtgagccccagcggcaccctggtgtcctag

SEQ ID NO: 158988 - DNA, 1563 bp, Artificial Sequence
  Description of Artificial Sequence: Synthetic coding sequence
atggccgagaccgtgtggagcacagacaccggggaggccgtgtaccgcagccgggaccctgtgaggaacctgcggctgcgggtgcacctgcagaggatcaccagcagcaacttcctgcactaccagcctgctgctgagctgggcaaggacctgattgacctggccaccttccggccccagcccacagccagcggccacaggcctgaggaggatgaggaggaggagatcgtcatcggctggcaggagaagctgttcagccagtttgaggtggacctgtaccagaatgaaacagcctgccagagccccctggactaccagtaccggcaggagatcctgaagctggagaacagcggcggcaagaagaacagacgcatcttcacctacacagacagcgaccgctacaccaacctggaggagcactgccagaggatgaccacagctgccagcgaggtgcccagcttcctggtggagaggatggccaacgtgagaagaagacggcaggacagaagaggcatggagggcggcatcctgaagagcagaattgtgacctgggagcccagcgaggagtttgtgaggaacaaccacgtgatcaacacccccctgcagaccatgcacatcatggctgacctgggcccctacaagaagctgggctacaagaagtatgaacatgtgctgtgcaccctgaaggtggacagcaatggagtcatcaccgtgaagccagacttcaccggcctgaagggcccctacagaattgaaacagaaggagagaagcaggagctgtggaagtacaccatcgacaacgtgagcccccacgcccagcctgaggaggaggagcgggagaggagggtcttcaaggacctgtatggccgccacaaggagtacctgagcagcctggtgggcacagactttgagatgacagtgcctggggccctgcggctgtttgtgaatggagaggtggtgtctgcccagggctatgaatatgacaacctgtatgtgcacttctttgtggagctgcccacagcccactggagcagccctgccttccagcagctgagcggcgtgacccagacctgcaccaccaagagcctggccatggacaaggtggcccacttctcctaccccttcacctttgaggccttcttcctgcatgaagatgagagcagtgatgccctgcctgagtggcctgtgctgtactgtgaggtgctgagcctggacttctggcagcgctacagagtggagggctatggagctgtggtgctgcctgccaccccaggcagccacaccctgactgtgtccacctggaggcctgtggagctgggcaccgtggccgagctgcggcgcttcttcatcggcggcagcctggagctggaggacctgtcctatgtgcgcatccctggcagcttcaagggcctgagcagcagcaagaccaaggagggcaggaaggtggatggagagcgggtgctgaacccccagcctgtgtccctgagcctcttccctgggaagccccacagcacagcctggggcctgctgcggctgcgctatgagctgttcctgagcaagtag

SEQ ID NO: 158989 - DNA, 1650 bp, Artificial Sequence
  Description of Artificial Sequence: Synthetic coding sequence
atggctgtgcctgtgtcctcctttgcccagaggaccaggagccgcttccgggtgcacctgcagaggatcaccagcagcaacttcctgcactaccagcctgctgctgagctgggcaaggacctgattgacctggccaccttccggccccagcccacagccagcggccacaggcctgaggaggatgaggaggaggagatcgtcatcggctggcaggagaagctgttcagccagtttgaggtggacctgtaccagaatgaaacagcctgccagagccccctggactaccagtaccggcaggagatcctgaagctggagaacagcggcggcaagaagaacagacgcatcttcacctacacagacagcgaccgctacaccaacctggaggagcactgccagaggatgaccacagctgccagcgaggtgcccagcttcctggtggagaggatggccaacgtgagaagaagacggcaggacagaagaggcatggagggcggcatcctgaagagcagaattgtgacctgggagcccagcgaggagtttgtgaggaacaaccacgtgatcaacacccccctgcagaccatgcacatcatggctgacctgggcccctacaagaagctgggctacaagaagtatgaacatgtgctgtgcaccctgaaggtggacagcaatggagtcatcaccgtgaagccagacttcaccggcctgaagggcccctacagaattgaaacagaaggagagaagcaggagctgtggaagtacaccatcgacaacgtgagcccccacgcccagcctgaggaggaggagcgggagaggagggtcttcaaggacctgtatggccgccacaaggagtacctgagcagcctggtgggcacagactttgagatgacagtgcctggggccctgcggctgtttgtgaatggagaggtggtgtctgcccagggctatgaatatgacaacctgtatgtgcacttctttgtggagctgcccacagcccactggagcagccctgccttccagcagctgagcggcgtgacccagacctgcaccaccaagagcctggccatggacaaggtggcccacttctcctaccccttcacctttgaggccttcttcctgcatgaagatgagagcagtgatgccctgcctgagtggcctgtgctgtactgtgaggtgctgagcctggacttctggcagcgctacagagtggagggctatggagctgtggtgctgcctgccaccccaggcagccacaccctgactgtgtccacctggaggcctgtggagctgggcaccgtggccgagctgcggcgcttcttcatcggcggcagcctggagctggaggacctgtcctatgtgcgcatccctggcagcttcaagggggagcggctgagccgcttcggcctgaggacagagaccactggaacagtgaccttccggctgcactgcctgcagcagagccgggccttcatggagagcagcagcctgcagaagaggatgaggtctgtgctggaccggctggagggcttcagccagcagagcagcatccacaacgtgctggaggccttcagaagagcccggcggaggatgcaggaggcccgggagagcctgccccaggacctggtgagccccagcggcaccctggtgtcctag

SEQ ID NO: 158990 - DNA, 1071 bp, Artificial Sequence
  Description of Artificial Sequence: Synthetic coding sequence
atgcacatcatggctgacctgggcccctacaagaagctgggctacaagaagtatgagcacgtgctgtgcaccctgaaggtggacagcaatggagtcatcaccgtgaagccagacttcaccggcctgaagggcccctaccgcatcgagacagaaggagagaagcaggagctgtggaagtacaccatcgacaacgtgagcccccacgcccagcctgaggaggaggagcgggagcggcgggtcttcaaggacctgtatggccgccacaaggagtacctgagcagcctggtgggcacagactttgagatgacagtgcctggggccctgcggctgtttgtgaatggagaggtggtgtctgcccagggctatgaatatgacaacctgtatgtgcacttctttgtggagctgcccacagcccactggagcagccctgccttccagcagctgtctggagtgacccagacctgcaccaccaagagcctggccatggacaaggtggcccacttctcctaccccttcacctttgaggccttcttcctgcatgaagatgagagcagtgatgccctgcctgagtggcctgtgctgtactgtgaggtgctgagcctggacttctggcagcgctacagagtggagggctacggggctgtggtgctgcctgccaccccaggcagccacaccctgactgtgtccacctggaggcctgtggagctgggcaccgtggccgagctgcggcgcttcttcatcggcggcagcctggagctggaggacctgtcctatgtgcgcatccctggcagcttcaagggggagcggctgagcagatttggcctgaggacagagaccaccggcaccgtgaccttccggctgcactgcctgcagcagagccgggccttcatggagagcagcagcctgcagaagaggatgaggtctgtgctggaccggctggagggcttcagccagcagagcagcatccacaacgtgctggaggccttccggcgggcccggcggaggatgcaggaggcccgggagagcctgccccaggacctggtgagccccagcggcaccctggtgtcctag

SEQ ID NO: 158991 - DNA, 4746 bp, Artificial Sequence
  Description of Artificial Sequence: Synthetic coding sequence
atgaaggcccagggcgagacagaggagagcgagaagctgagcaagatgagcagcctgctggagcggctgcacgccaagttcaaccagaaccggccctggagcgagaccatcaagctggtgcggcaggtgatggagaagagggtggtgatgagcagcggcggccaccagcacctggtgtcctgcctggagaccctgcagaaggccctgaaggtgaccagcctgcctgccatgacagaccggctggagagcatcgcccggcagaatggcctgggcagccacctgagcgccagcggcacagagtgctacatcaccagtgacatgttttatgtggaggtgcagctggaccctgctggccagctgtgtgatgtgaaggtggcccaccacggggagaaccctgtgtcctgcccagagctggtgcagcagctgcgggagaagaactttgatgagttcagcaagcacctgaagggcctggtgaacctgtacaacctgcccggggacaacaagctgaagaccaagatgtacctggccctgcagagcctggagcaggacctgagcaagatggccatcatgtactggaaggccaccaatgccggccccctggacaagatcctgcacggctctgtgggctacctgacccccaggtctgggggccacctgatgaacctgaagtactacgtgagccccagcgacctgctggatgacaagacagccagccccatcatcctgcacgagaacaacgtgagccgcagcctgggcatgaatgcctctgtgaccatcgagggcaccagcgctgtgtacaagctgcccatcgcccccctcatcatgggcagccaccctgtggacaacaagtggacccccagcttcagcagcatcaccagcgccaacagcgtggacctgcctgcctgcttcttcctgaagttcccccagcccatccctgtgtcccgggcctttgtgcagaagctgcagaactgcaccggcatccccctgtttgagacccagcccacctacgcccccctgtatgagctgatcacccagtttgagctgagcaaggaccctgaccccatccccctgaaccacaacatgaggttctatgctgccctgcccggccagcagcactgctacttcctgaacaaggatgcccccctgcctgatggccgcagcctgcagggcaccctggtgtccaagatcaccttccagcaccctggccgggtgcccctcatcctgaacctgatccgccaccaggtggcctacaacaccctgattggcagctgtgtgaagaggaccatcctgaaggaggacagccctggcctgctgcagtttgaggtgtgccccctgtctgagagccgcttctctgtgtccttccagcaccctgtgaatgacagcctggtgtgtgtggtgatggatgtgcaggacagcacccacgtgtcctgcaagctgtacaagggcctgagtgatgccctgatctgcacagatgacttcatcgccaaggtggtgcagcgctgcatgagcatccctgtgaccatgagggccatccggaggaaggccgagaccatccaggccgacaccccagccctgagcctgattgctgagaccgtggaggacatggtgaagaagaacctgcccccagccagcagccctggctacggcatgaccaccggcaacaaccccatgagcggcaccaccacccccaccaacaccttccctgggggccccatcaccaccctcttcaacatgtccatgagcatcaaggacagacatgagagcgtgggccatggagaggacttcagcaaggtgtcccagaaccccatcctgaccagcctgctgcagatcactggaaatggaggcagcaccatcggcagcagccccaccccaccccaccacaccccacctcctgtgtcctccatggccggcaacaccaagaaccaccccatgctgatgaacctgctgaaggacaacccagcccaggacttcagcaccctgtatggcagcagccccctggagcggcagaacagcagcagcggcagccccaggatggagatctgcagcggcagcaacaagaccaagaagaagaagagcagccggctgcccccagagaagcccaagcaccagacagaagatgacttccagcgggagctgttctccatggatgtggacagccagaaccccatctttgatgtgaacatgacagctgacaccctggacaccccccacatcaccccagcccccagccagtgcagcaccccacccaccacctacccccagcctgtgccccacccccagcccagcatccagaggatggtgcggctgagcagcagtgacagcattggaccagatgtgacagacatcctgagtgacattgctgaggaggccagcaagctgcccagcaccagtgatgactgcccagccatcggcacccccctgcgggacagcagcagcagcggccacagccagagcaccctgtttgacagtgatgtgttccagaccaacaacaatgaaaacccctacacagatcctgctgacctgattgctgatgctgctggcagccccagcagtgacagccccaccaaccacttcttccatgatggagtggacttcaacccagacctgctgaacagccagagccagagcggctttggagaggagtactttgatgagagcagccagagcggggacaatgatgacttcaagggctttgccagccaggccctgaacaccctgggcgtgcccatgctgggcggggacaatggagagaccaagttcaagggcaacaaccaggccgacacagtggacttcagcatcatctctgtggccggcaaggccctggccccagctgacctgatggagcaccacagcggcagccagggccccctgctgaccaccggggacctgggcaaggagaagacccagaagagggtgaaggagggcaatggcaccagcaacagcaccctgagcggccctggcctggacagcaagccaggcaagaggagcaggacccccagcaatgatggcaagagcaaggacaagccacccaagaggaagaaggctgacacagagggcaagagccccagccacagcagcagcaaccggcccttcaccccacccaccagcactggaggcagcaagagccctggcagcgctggccgcagccagaccccacctggggtggccaccccacccatccccaagatcaccatccagatccccaagggcaccgtgatggtgggcaagcccagcagccacagccagtacaccagcagcggctctgtgagcagcagcggcagcaagagccaccacagccacagcagcagcagcagcagcagcgccagcaccagcggcaagatgaagagcagcaagtctgagggcagcagcagcagcaagctgagcagctccatgtacagcagccagggcagcagcggcagcagccagagcaagaacagcagccagagcggcggcaagccaggcagcagccccatcaccaagcacggcctgagcagcggcagcagcagcaccaagatgaagccccagggcaagcccagcagcctgatgaaccccagcctgagcaagcccaacatcagccccagccacagccggcccccaggcggcagtgacaagctggccagccccatgaagcctgtgcccggcaccccacccagcagcaaggccaagagccccatcagcagcggcagcggcggcagccacatgagcggcaccagcagcagcagcggcatgaagagcagcagcggcctgggcagcagcggcagcctgagccagaagaccccacccagcagcaacagctgcacagccagcagcagcagcttcagcagcagcggcagctccatgagcagcagccagaaccagcacggcagcagcaagggcaagagccccagcaggaacaagaagcccagcctgacagctgtgattgacaagctgaagcacggcgtggtgaccagcggccctggaggagaggaccccctggatggccagatgggcgtgtccaccaacagcagcagccaccccatgagcagcaagcacaacatgtctggaggagagttccagggcaagcgggagaagagtgacaaggacaagagcaaggtgtccaccagcggcagctctgtggacagcagcaagaagaccagcgagagcaagaatgtgggcagcactggagtggccaagatcatcatcagcaagcatgatggcggcagccccagcatcaaggccaaggtgaccctgcagaagccaggagagagcagtggagagggcctgcggccccagatggccagcagcaagaactacggcagccccctcatcagcggcagcacccccaagcatgagcggggcagccccagccacagcaagagccctgcctacaccccccagaacctggacagcgagagcgagagcggcagcagcattgctgagaagagctaccagaacagccccagcagtgatgatggcatccggcccctgcctgagtacagcacagagaagcacaagaagcacaagaaggagaagaagaaggtgaaggacaaggaccgggaccgggaccgggacaaggaccgggacaagaagaagagccacagcatcaagccagagagctggagcaagagccccatcagcagtgaccagagcctgtccatgaccagcaacaccatcctgtctgctgaccggcccagccggctgagcccagacttcatgattggagaagaagatgatgacctgatggatgtggccctgattggcaactag

SEQ ID NO: 158992 - DNA, 1671 bp, Artificial Sequence
  Description of Artificial Sequence: Synthetic coding sequence
atgaaggcccagggcgagacagaggagagcgagaagctgagcaagatgagcagcctgctggagcggctgcacgccaagttcaaccagaaccggccctggagcgagaccatcaagctggtgcggcaggtgatggagaagagggtggtgatgagcagcggcggccaccagcacctggtgtcctgcctggagaccctgcagaaggccctgaaggtgaccagcctgcctgccatgacagaccggctggagagcatcgcccggcagaatggcctgggcagccacctgagcgccagcggcacagagtgctacatcaccagtgacatgttttatgtggaggtgcagctggaccctgctggccagctgtgtgatgtgaaggtggcccaccacggggagaaccctgtgtcctgcccagagctggtgcagcagctgcgggagaagaactttgatgagttcagcaagcacctgaagggcctggtgaacctgtacaacctgcccggggacaacaagctgaagaccaagatgtacctggccctgcagagcctggagcaggacctgagcaagatggccatcatgtactggaaggccaccaatgccggccccctggacaagatcctgcacggctctgtgggctacctgacccccaggtctgggggccacctgatgaacctgaagtactacgtgagccccagcgacctgctggatgacaagacagccagccccatcatcctgcacgagaacaacgtgagccgcagcctgggcatgaatgcctctgtgaccatcgagggcaccagcgctgtgtacaagctgcccatcgcccccctcatcatgggcagccaccctgtggacaacaagtggacccccagcttcagcagcatcaccagcgccaacagcgtggacctgcctgcctgcttcttcctgaagttcccccagcccatccctgtgtcccgggcctttgtgcagaagctgcagaactgcaccggcatccccctgtttgagacccagcccacctacgcccccctgtatgagctgatcacccagtttgagctgagcaaggaccctgaccccatccccctgaaccacaacatgaggttctatgctgccctgcccggccagcagcactgctacttcctgaacaaggatgcccccctgcctgatggccgcagcctgcagggcaccctggtgtccaagatcaccttccagcaccctggccgggtgcccctcatcctgaacctgatccgccaccaggtggcctacaacaccctgattggcagctgtgtgaagaggaccatcctgaaggaggacagccctggcctgctgcagtttgaggtgtgccccctgtctgagagccgcttctctgtgtccttccagcaccctgtgaatgacagcctggtgtgtgtggtgatggatgtgcaggacagcacccacgtgtcctgcaagctgtacaagggcctgagtgatgccctgatctgcacagatgacttcatcgccaaggtggtgcagcgctgcatgagcatccctgtgaccatgagggccatccggaggaaggccgagaccatccaggccgacaccccagccctgagcctgattgctgagaccgtggaggacatggtgaagaagaacctgcccccagccagcagccctggcagcaagaaccctgagctgggcagcggctag

SEQ ID NO: 158993 - DNA, 408 bp, Artificial Sequence
  Description of Artificial Sequence: Synthetic coding sequence
atggccgagaagtttgaccacctggaggagcacctggagaagtttgtggagaacatccggcagctgggcatcatcgtgtctgacttccagcccagcagccaggccggcctgaaccagaagctgaacttcatcgtgacaggcctgcaggacatcgacaagtgccggcagcagctgcatgacatcaccgtgcccctggaggtgtttgagtacatcgaccagggcaggaacccccagctgtacaccaaggaatgtctggagcgggccctggccaagaatgagcaggtgaagggcaagattgacaccatgaagaagttcaagagcctgctgatccaggagctgagcaaggtgtttcctgaggacatggccaagtaccgcagcatccggggggaggaccacccccccagctag

SEQ ID NO: 158994 - DNA, 354 bp, Artificial Sequence
  Description of Artificial Sequence: Synthetic coding sequence
atggccacctacagcctggccaatgaaaggctgcgggccctggaggacatcgagcgggagattggagccatcctgcagaatgccggcaccgtcatcctggagctgagcaaggagaagaccaatgaaaggctgctggaccggcaggccgccgccttcaccgcctctgtgcagcacgtggaggccgagctgagcgcccagatccgctacctgacccaggtggccaccggccagccccatgagggcagcagctacagcagcaggaaggactgccagatggccctgaagagggtggactatgcccggctgaagctgagtgatgtggcccggacctgtgagcagatgctggagaactag

SEQ ID NO: 158995 - DNA, 6543 bp, Artificial Sequence
  Description of Artificial Sequence: Synthetic coding sequence
atggccgccttcggcatcctgtcctatgagcaccggcccctgaagaggccccggctgggccccccagatgtgtacccccaggaccccaagcagaaggaggatgagctgacagccctgaatgtgaagcagggcttcaacaaccagcctgctgtgtctggagatgagcacggcagcgccaagaatgtgtccttcaacccagccaagatcagcagcaacttcagcagcatcatcgccgagaagctgcgctgcaacaccctgcctgacacaggaagaaggaagccccaggtgaaccagaaggacaacttctggctggtgacagcccggagccagagcgccatcaacacctggttcacagacctggccggcaccaagcccctgacccagctggccaagaaggtgcccatcttcagcaagaaggaggaggtgtttggctacctggccaagtacacagtgcctgtgatgagagctgcctggctgatcaagatgacctgtgcctactatgctgccatcagcgagaccaaggtgaagaagagacatgtggaccccttcatggagtggacccagatcatcaccaagtacctgtgggagcagctgcagaagatggccgagtactacagacctggccctgctggcagcggcggctgcggcagcaccatcggccccctgccccatgatgtggaggtggccatccggcagtgggactacacagagaagctggccatgttcatgttccaggacggcatgctggacagacatgagttcctgacctgggtgctggagtgctttgagaagatccggcctggagaagatgagctgctgaagctgctgctgcccctgctgctgcgctacagcggggagtttgtgcagagcgcctacctgagccggcggctggcctacttctgcacccggcggctggccctgcagctggatggagtgagcagccacagcagccacgtgatcagcgcccagagcaccagcaccctgcccaccaccccagccccccagccccccaccagcagcacccccagcacccccttcagtgacctgctgatgtgcccccagcaccggcccctggtgtttggcctgagctgcatcctgcagaccatcctgctgtgctgccccagcgccctggtgtggcactacagcctgacagacagccgcatcaagacaggcagccccctggaccacctgcccatcgcccccagcaacctgcccatgcctgagggcaacagcgccttcacccagcaggtgcgggccaagctgcgggagattgagcagcagatcaaggagcggggccaggccgtggaggtgcgctggagctttgacaagtgccaggaggccacagctggcttcaccatcggccgggtgctgcacaccctggaggtgctggacagccacagctttgagaggagtgacttcagcaacagcctggacagcctgtgcaaccgcatcttcggcctgggccccagcaaggatggccacgagatcagcagtgatgatgatgctgtggtgtccctgctgtgtgagtgggccgtgtcctgcaagaggagcggccgccaccgggccatggtggtggccaagctgctggagaagaggcaggccgagattgaggccgagcgctgtggggagagcgaggccgcagatgagaagggcagcatcgccagcggcagcctgagcgcccccagcgcccccatcttccaggatgtgctgctgcagttcctggacacccaggcccccatgctgacagaccccaggtctgagagcgagcgggtggagttcttcaacctggtgctgctcttctgtgagctgatcagacatgatgtgttcagccacaacatgtacacctgcaccctcatcagcagaggagacctggccttcggggcccctggccccaggcctcccagcccctttgatgatcctgcagatgatcctgagcacaaggaggccgagggcagcagcagcagcaagctggaggaccccggcctgtctgagagcatggacatcgaccccagcagctctgtgctgtttgaggacatggagaagccagacttcagcctcttcagccccaccatgccctgtgagggcaagggcagccccagccctgagaagccagatgtggagaaggaggtgaagcccccacccaaggagaagattgagggcaccctgggcgtgctgtatgaccagcccaggcatgtgcagtatgccacccacttccccatcccccaggaggagagctgcagccatgagtgcaaccagaggctggtggtgctgtttggagtgggcaagcagagagatgatgcccggcatgccatcaagaagatcaccaaggacatcctgaaggtgctgaacagaaaaggaacagctgagacagaccagctggcccccatcgtgcccctgaaccctggggacctgaccttcctgggcggggaggatggccagaagagaagaagaaacagacctgaggccttccccacagctgaggacatctttgccaagttccagcacctgagccactatgaccagcaccaggtgacagcccaggtgtccagaaatgtgctggagcagatcaccagctttgccctgggcatgagctaccacctgcccctggtgcagcacgtgcagttcatctttgacctgatggagtacagcctgagcatcagcggcctgattgactttgccatccagctgctgaatgagctgtctgtggtggaggccgagctgctgctgaagagcagtgacctggtgggcagctacaccaccagcctgtgcctgtgcatcgtggccgtgctgcggcactaccacgcctgcctgatcctgaaccaggaccagatggcccaggtgtttgagggcctgtgtggggtggtgaagcacggcatgaacagaagtgatggcagcagcgctgagcgctgcatcctggcctacctgtatgacctgtacaccagctgcagccacctgaagaacaagtttggagagctgttcagtgacttctgcagcaaggtgaagaacaccatctactgcaatgtggagcccagcgagagcaacatgcgctgggcccctgagttcatgattgacaccctggagaacccagctgcccacaccttcacctacacaggcctgggcaagagcctgtctgaaaatcctgccaaccgctacagctttgtgtgcaatgccctgatgcacgtgtgtgtgggccaccacgaccctgacagagtgaatgacatcgccatcctgtgtgccgagctgaccggctactgcaagagcctgtctgctgagtggctgggcgtgctgaaggccctgtgctgcagcagcaacaacggcacctgtggcttcaatgacctgctgtgcaatgtggatgtgtctgacctgtccttccatgacagcctggccacctttgtggccatcctgattgcccggcagtgcctgctgctggaggacctgatccgctgtgccgccatccccagcctgctgaatgctgcctgcagcgagcaggacagcgagcccggggcccggctgacctgccgcatcctgctgcacctgttcaagaccccccagctgaacccctgccagagtgatggcaacaagcccaccgtgggcatccgcagcagctgtgacagacacctgctggccgccagccagaacagaattgtggatggagctgtgtttgctgtgctgaaggctgtgtttgtgctgggagatgctgagctgaagggcagcggcttcaccgtgactggaggaacagaggagctgcctgaggaggagggcggcggcggcagcggcggccggcggcagggcggcaggaacatctctgtggagacagccagcctggatgtgtatgccaagtatgtgctgcggagcatctgccagcaggagtgggtgggggagcgctgcctgaagagcctgtgtgaggacagcaatgacctgcaggaccctgtgctgagcagcgcccaggcccagaggctgatgcagctgatctgctacccccaccggctgctggacaatgaagatggagagaacccccagaggcagaggatcaagaggatcctgcagaacctggaccagtggaccatgaggcagagcagcctggagctgcagctgatgatcaagcagacccccaacaatgagatgaacagcctgctggagaacatcgccaaggccaccatcgaggtgttccagcagagcgctgagaccggcagcagcagcggcagcacagccagcaacatgcccagcagcagcaagaccaagcctgtgctgagcagcctggagaggtctggagtgtggctggtggcccccctcatcgccaagctgcccacctctgtgcagggccacgtgctgaaggctgctggggaggagctggagaagggccagcacctgggcagcagcagcaggaaggagcgggaccggcagaagcagaagtccatgagcctgctgagccagcagcccttcctgagcctggtgctgacctgcctgaagggccaggatgagcagcgggagggcctgctgaccagcctgtacagccaggtgcaccagatcgtgaacaactggagagatgaccagtacctggatgactgcaagcccaagcagctgatgcatgaggccctgaagctgcggctgaacctggtgggcggcatgtttgacacagtgcagaggagcacccagcagaccacagagtgggccatgctgctgctggagatcatcatctctggaacagtggacatgcagagcaacaatgagctgttcaccaccgtgctggacatgctgtctgtgctgatcaatggcaccctggccgctgacatgagcagcatcagccagggctccatggaggagaacaagagggcctacatgaacctggccaagaagctgcagaaggagctgggggagcggcagagcgacagcctggagaaggtgcggcagctgctgcccctgcccaagcagaccagagatgtgatcacctgtgagccccagggcagcctgattgacaccaagggcaacaagattgctggctttgacagcatcttcaagaaggagggcctgcaggtgtccaccaagcagaagatcagcccctgggacctgtttgagggcctgaagcccagcgcccccctgtcctggggctggtttggaacagtgcgggtggaccggcgggtggcccggggggaggagcagcagaggctgctgctgtaccacacccacctgcggccccggccccgggcctactacctggagcccctgcccctgcccccagaagatgaggagcccccagcccccaccctgctggagcctgagaagaaggcccctgagccccccaagacagacaagccaggggccgccccacccagcacagaggagaggaagaagaagagcaccaagggcaagaagaggagccagcctgccaccaagacagaggactatggcatgggccctggccgcagcggcccctacggcgtgacagtgcccccagacctgctgcaccaccccaaccctggcagcatcacccacctgaactaccggcagggcagcatcggcctgtacacccagaaccagcccctgcctgctgggggcccccgggtggacccctacagacctgtgcggctgcccatgcagaagctgcccacccggcccacctacccaggagtgctgcccaccaccatgactggagtgatgggcctggagcccagcagctacaagacctctgtgtaccggcagcagcagcctgctgtgccccagggccagaggctgcggcagcagctgcaggccaagatccagagccagggcatgctgggccagagctctgtgcaccagatgacccccagcagcagctatggcctgcagaccagccagggctacaccccctacgtgagccacgtgggcctgcagcagcacacaggccctgctggcaccatggtgccccccagctacagcagccagccctaccagagcacccaccccagcaccaaccccaccctggtggaccccaccaggcacctgcagcagaggccttctggctacgtgcaccagcaggcccccacctacggccacggcctgaccagcacccagcgcttcagccaccagaccctgcagcagacccccatgatcagcaccatgacccccatgtctgcccagggcgtgcaggccggcgtgcgcagcacagccatcctgcctgagcagcagcagcagcagcagcagcagcagcagcagcagcagcagcagcagcagcagcagcagcagcagcagcagcagcagtaccacatccggcagcagcagcagcagcagatcctgcggcagcagcagcagcagcagcagcagcagcagcagcagcagcagcagcagcagcagcagcagcagcagcagcagcagcagcaccagcagcagcagcagcagcaggccgccccaccccagccccagccccagagccagccccagttccagaggcagggcctgcagcagacccagcagcagcagcagacagctgccctggtgcggcagctgcagcagcagctgagcaacacccagccccagcccagcaccaacatcttcggccgctactag

SEQ ID NO: 158996 - DNA, 6534 bp, Artificial Sequence
  Description of Artificial Sequence: Synthetic coding sequence
atggccgccttcggcatcctgtcctatgagcaccggcccctgaagaggccccggctgggccccccagatgtgtacccccaggaccccaagcagaaggaggatgagctgacagccctgaatgtgaagcagggcttcaacaaccagcctgctgtgtctggagatgagcacggcagcgccaagaatgtgtccttcaacccagccaagatcagcagcaacttcagcagcatcatcgccgagaagctgcgctgcaacaccctgcctgacacaggaagaaggaagccccaggtgaaccagaaggacaacttctggctggtgacagcccggagccagagcgccatcaacacctggttcacagacctggccggcaccaagcccctgacccagctggccaagaaggtgcccatcttcagcaagaaggaggaggtgtttggctacctggccaagtacacagtgcctgtgatgagagctgcctggctgatcaagatgacctgtgcctactatgctgccatcagcgagaccaaggtgaagaagagacatgtggaccccttcatggagtggacccagatcatcaccaagtacctgtgggagcagctgcagaagatggccgagtactacagacctggccctgctggcagcggcggctgcggcagcaccatcggccccctgccccatgatgtggaggtggccatccggcagtgggactacacagagaagctggccatgttcatgttccaggacggcatgctggacagacatgagttcctgacctgggtgctggagtgctttgagaagatccggcctggagaagatgagctgctgaagctgctgctgcccctgctgctgcgctacagcggggagtttgtgcagagcgcctacctgagccggcggctggcctacttctgcacccggcggctggccctgcagctggatggagtgagcagccacagcagccacgtgatcagcgcccagagcaccagcaccctgcccaccaccccagccccccagccccccaccagcagcacccccagcacccccttcagtgacctgctgatgtgcccccagcaccggcccctggtgtttggcctgagctgcatcctgcagaccatcctgctgtgctgccccagcgccctggtgtggcactacagcctgacagacagccgcatcaagacaggcagccccctggaccacctgcccatcgcccccagcaacctgcccatgcctgagggcaacagcgccttcacccagcaggtgcgggccaagctgcgggagattgagcagcagatcaaggagcggggccaggccgtggaggtgcgctggagctttgacaagtgccaggaggccacagctggcttcaccatcggccgggtgctgcacaccctggaggtgctggacagccacagctttgagaggagtgacttcagcaacagcctggacagcctgtgcaaccgcatcttcggcctgggccccagcaaggatggccacgagatcagcagtgatgatgatgctgtggtgtccctgctgtgtgagtgggccgtgtcctgcaagaggagcggccgccaccgggccatggtggtggccaagctgctggagaagaggcaggccgagattgaggccgagcgctgtggggagagcgaggccgcagatgagaagggcagcatcgccagcggcagcctgagcgcccccagcgcccccatcttccaggatgtgctgctgcagttcctggacacccaggcccccatgctgacagaccccaggtctgagagcgagcgggtggagttcttcaacctggtgctgctcttctgtgagctgatcagacatgatgtgttcagccacaacatgtacacctgcaccctcatcagcagaggagacctggccttcggggcccctggccccaggcctcccagcccctttgatgatcctgcagatgatcctgagcacaaggaggccgagggcagcagcagcagcaagctggaggaccccggcctgtctgagagcatggacatcgaccccagcagctctgtgctgtttgaggacatggagaagccagacttcagcctcttcagccccaccatgccctgtgagggcaagggcagccccagccctgagaagccagatgtggagaaggaggtgaagcccccacccaaggagaagattgagggcaccctgggcgtgctgtatgaccagcccaggcatgtgcagtatgccacccacttccccatcccccaggaggagagctgcagccatgagtgcaaccagaggctggtggtgctgtttggagtgggcaagcagagagatgatgcccggcatgccatcaagaagatcaccaaggacatcctgaaggtgctgaacagaaaaggaacagctgagacagaccagctggcccccatcgtgcccctgaaccctggggacctgaccttcctgggcggggaggatggccagaagagaagaagaaacagacctgaggccttccccacagctgaggacatctttgccaagttccagcacctgagccactatgaccagcaccaggtgacagcccaggtgtccagaaatgtgctggagcagatcaccagctttgccctgggcatgagctaccacctgcccctggtgcagcacgtgcagttcatctttgacctgatggagtacagcctgagcatcagcggcctgattgactttgccatccagctgctgaatgagctgtctgtggtggaggccgagctgctgctgaagagcagtgacctggtgggcagctacaccaccagcctgtgcctgtgcatcgtggccgtgctgcggcactaccacgcctgcctgatcctgaaccaggaccagatggcccaggtgtttgagggcctgtgtggggtggtgaagcacggcatgaacagaagtgatggcagcagcgctgagcgctgcatcctggcctacctgtatgacctgtacaccagctgcagccacctgaagaacaagtttggagagctgttcagtgacttctgcagcaaggtgaagaacaccatctactgcaatgtggagcccagcgagagcaacatgcgctgggcccctgagttcatgattgacaccctggagaacccagctgcccacaccttcacctacacaggcctgggcaagagcctgtctgaaaatcctgccaaccgctacagctttgtgtgcaatgccctgatgcacgtgtgtgtgggccaccacgaccctgacagagtgaatgacatcgccatcctgtgtgccgagctgaccggctactgcaagagcctgtctgctgagtggctgggcgtgctgaaggccctgtgctgcagcagcaacaacggcacctgtggcttcaatgacctgctgtgcaatgtggatgtgtctgacctgtccttccatgacagcctggccacctttgtggccatcctgattgcccggcagtgcctgctgctggaggacctgatccgctgtgccgccatccccagcctgctgaatgctgcctgcagcgagcaggacagcgagcccggggcccggctgacctgccgcatcctgctgcacctgttcaagaccccccagctgaacccctgccagagtgatggcaacaagcccaccgtgggcatccgcagcagctgtgacagacacctgctggccgccagccagaacagaattgtggatggagctgtgtttgctgtgctgaaggctgtgtttgtgctgggagatgctgagctgaagggcagcggcttcaccgtgactggaggaacagaggagctgcctgaggaggagggcggcggcggcagcggcggccggcggcagggcggcaggaacatctctgtggagacagccagcctggatgtgtatgccaagtatgtgctgcggagcatctgccagcaggagtgggtgggggagcgctgcctgaagagcctgtgtgaggacagcaatgacctgcaggaccctgtgctgagcagcgcccaggcccagaggctgatgcagctgatctgctacccccaccggctgctggacaatgaagatggagagaacccccagaggcagaggatcaagaggatcctgcagaacctggaccagtggaccatgaggcagagcagcctggagctgcagctgatgatcaagcagacccccaacaatgagatgaacagcctgctggagaacatcgccaaggccaccatcgaggtgttccagcagagcgctgagaccggcagcagcagcggcagcacagccagcaacatgcccagcagcagcaagaccaagcctgtgctgagcagcctggagaggtctggagtgtggctggtggcccccctcatcgccaagctgcccacctctgtgcagggccacgtgctgaaggctgctggggaggagctggagaagggccagcacctgggcagcagcagcaggaaggagcgggaccggcagaagcagaagtccatgagcctgctgagccagcagcccttcctgagcctggtgctgacctgcctgaagggccaggatgagcagcgggagggcctgctgaccagcctgtacagccaggtgcaccagatcgtgaacaactggagagatgaccagtacctggatgactgcaagcccaagcagctgatgcatgaggccctgaagctgcggctgaacctggtgggcggcatgtttgacacagtgcagaggagcacccagcagaccacagagtgggccatgctgctgctggagatcatcatctctggaacagtggacatgcagagcaacaatgagctgttcaccaccgtgctggacatgctgtctgtgctgatcaatggcaccctggccgctgacatgagcagcatcagccagggctccatggaggagaacaagagggcctacatgaacctggccaagaagctgcagaaggagctgggggagcggcagagcgacagcctggagaaggtgcggcagctgctgcccctgcccaagcagaccagagatgtgatcacctgtgagccccagggcagcctgattgacaccaagggcaacaagattgctggctttgacagcatcttcaagaaggagggcctgcaggtgtccaccaagcagaagatcagcccctgggacctgtttgagggcctgaagcccagcgcccccctgtcctggggctggtttggaacagtgcgggtggaccggcgggtggcccggggggaggagcagcagaggctgctgctgtaccacacccacctgcggccccggccccgggcctactacctggagcccctgcccctgcccccagaagatgaggagcccccagcccccaccctgctggagcctgagaagaaggcccctgagccccccaagacagacaagccaggggccgccccacccagcacagaggagaggaagaagaagagcaccaagggcaagaagaggagccagcctgccaccaagacagaggactatggcatgggccctggccgcagcggcccctacggcgtgacagtgcccccagacctgctgcaccaccccaaccctggcagcatcacccacctgaactaccggcagggcagcatcggcctgtacacccagaaccagcccctgcctgctgggggcccccgggtggacccctacagacctgtgcggctgcccatgcagaagctgcccacccggcccacctacccaggagtgctgcccaccaccatgactggagtgatgggcctggagcccagcagctacaagacctctgtgtaccggcagcagcagcctgctgtgccccagggccagaggctgcggcagcagctgcagcagagccagggcatgctgggccagagctctgtgcaccagatgacccccagcagcagctatggcctgcagaccagccagggctacaccccctacgtgagccacgtgggcctgcagcagcacactggacctgctggcaccatggtgcccccatcctacagcagccagccctaccagagcacccaccccagcaccaaccccaccctggtggaccccaccaggcacctgcagcagaggcccagcggctacgtgcaccagcaggcccccacctacggccacggcctgaccagcacccagcgcttcagccaccagaccctgcagcagacccccatgatcagcaccatgacccccatgtctgcccagggcgtgcaggccggcgtgcgcagcacagccatcctgcctgagcagcagcagcagcagcagcagcagcagcagcagcagcagcagcagcagcagcagcagcagcagcagcagcagcagcagtaccacatccggcagcagcagcagcagcagatcctgcggcagcagcagcagcagcagcagcagcagcagcagcagcagcagcagcagcagcagcagcagcagcagcagcagcagcagcaccagcagcagcagcagcagcaggccgccccaccccagccccagccccagagccagccccagttccagaggcagggcctgcagcagacccagcagcagcagcagacagctgccctggtgcggcagctgcagcagcagctgagcaacacccagccccagcccagcaccaacatcttcggccgctactag

SEQ ID NO: 158997 - DNA, 6531 bp, Artificial Sequence
  Description of Artificial Sequence: Synthetic coding sequence
atggccgccttcggcatcctgtcctatgagcaccggcccctgaagaggccccggctgggccccccagatgtgtacccccaggaccccaagcagaaggaggatgagctgacagccctgaatgtgaagcagggcttcaacaaccagcctgctgtgtctggagatgagcacggcagcgccaagaatgtgtccttcaacccagccaagatcagcagcaacttcagcagcatcatcgccgagaagctgcgctgcaacaccctgcctgacacaggaagaaggaagccccaggtgaaccagaaggacaacttctggctggtgacagcccggagccagagcgccatcaacacctggttcacagacctggccggcaccaagcccctgacccagctggccaagaaggtgcccatcttcagcaagaaggaggaggtgtttggctacctggccaagtacacagtgcctgtgatgagagctgcctggctgatcaagatgacctgtgcctactatgctgccatcagcgagaccaaggtgaagaagagacatgtggaccccttcatggagtggacccagatcatcaccaagtacctgtgggagcagctgcagaagatggccgagtactacagacctggccctgctggcagcggcggctgcggcagcaccatcggccccctgccccatgatgtggaggtggccatccggcagtgggactacacagagaagctggccatgttcatgttccaggacggcatgctggacagacatgagttcctgacctgggtgctggagtgctttgagaagatccggcctggagaagatgagctgctgaagctgctgctgcccctgctgctgcgctacagcggggagtttgtgcagagcgcctacctgagccggcggctggcctacttctgcacccggcggctggccctgcagctggatggagtgagcagccacagcagccacgtgatcagcgcccagagcaccagcaccctgcccaccaccccagccccccagccccccaccagcagcacccccagcacccccttcagtgacctgctgatgtgcccccagcaccggcccctggtgtttggcctgagctgcatcctgcagaccatcctgctgtgctgccccagcgccctggtgtggcactacagcctgacagacagccgcatcaagacaggcagccccctggaccacctgcccatcgcccccagcaacctgcccatgcctgagggcaacagcgccttcacccagcaggtgcgggccaagctgcgggagattgagcagcagatcaaggagcggggccaggccgtggaggtgcgctggagctttgacaagtgccaggaggccacagctggcttcaccatcggccgggtgctgcacaccctggaggtgctggacagccacagctttgagaggagtgacttcagcaacagcctggacagcctgtgcaaccgcatcttcggcctgggccccagcaaggatggccacgagatcagcagtgatgatgatgctgtggtgtccctgctgtgtgagtgggccgtgtcctgcaagaggagcggccgccaccgggccatggtggtggccaagctgctggagaagaggcaggccgagattgaggccgagcgctgtggggagagcgaggccgcagatgagaagggcagcatcgccagcggcagcctgagcgcccccagcgcccccatcttccaggatgtgctgctgcagttcctggacacccaggcccccatgctgacagaccccaggtctgagagcgagcgggtggagttcttcaacctggtgctgctcttctgtgagctgatcagacatgatgtgttcagccacaacatgtacacctgcaccctcatcagcagaggagacctggccttcggggcccctggccccaggcctcccagcccctttgatgatcctgcagatgatcctgagcacaaggaggccgagggcagcagcagcagcaagctggaggaccccggcctgtctgagagcatggacatcgaccccagcagctctgtgctgtttgaggacatggagaagccagacttcagcctcttcagccccaccatgccctgtgagggcaagggcagccccagccctgagaagccagatgtggagaaggaggtgaagcccccacccaaggagaagattgagggcaccctgggcgtgctgtatgaccagcccaggcatgtgcagtatgccacccacttccccatcccccaggaggagagctgcagccatgagtgcaaccagaggctggtggtgctgtttggagtgggcaagcagagagatgatgcccggcatgccatcaagaagatcaccaaggacatcctgaaggtgctgaacagaaaaggaacagctgagacagaccagctggcccccatcgtgcccctgaaccctggggacctgaccttcctgggcggggaggatggccagaagagaagaagaaacagacctgaggccttccccacagctgaggacatctttgccaagttccagcacctgagccactatgaccagcaccaggtgacagcccaggtgtccagaaatgtgctggagcagatcaccagctttgccctgggcatgagctaccacctgcccctggtgcagcacgtgcagttcatctttgacctgatggagtacagcctgagcatcagcggcctgattgactttgccatccagctgctgaatgagctgtctgtggtggaggccgagctgctgctgaagagcagtgacctggtgggcagctacaccaccagcctgtgcctgtgcatcgtggccgtgctgcggcactaccacgcctgcctgatcctgaaccaggaccagatggcccaggtgtttgagggcctgtgtggggtggtgaagcacggcatgaacagaagtgatggcagcagcgctgagcgctgcatcctggcctacctgtatgacctgtacaccagctgcagccacctgaagaacaagtttggagagctgttcagtgacttctgcagcaaggtgaagaacaccatctactgcaatgtggagcccagcgagagcaacatgcgctgggcccctgagttcatgattgacaccctggagaacccagctgcccacaccttcacctacacaggcctgggcaagagcctgtctgaaaatcctgccaaccgctacagctttgtgtgcaatgccctgatgcacgtgtgtgtgggccaccacgaccctgacagagtgaatgacatcgccatcctgtgtgccgagctgaccggctactgcaagagcctgtctgctgagtggctgggcgtgctgaaggccctgtgctgcagcagcaacaacggcacctgtggcttcaatgacctgctgtgcaatgtggatgtgtctgacctgtccttccatgacagcctggccacctttgtggccatcctgattgcccggcagtgcctgctgctggaggacctgatccgctgtgccgccatccccagcctgctgaatgctgcctgcagcgagcaggacagcgagcccggggcccggctgacctgccgcatcctgctgcacctgttcaagaccccccagctgaacccctgccagagtgatggcaacaagcccaccgtgggcatccgcagcagctgtgacagacacctgctggccgccagccagaacagaattgtggatggagctgtgtttgctgtgctgaaggctgtgtttgtgctgggagatgctgagctgaagggcagcggcttcaccgtgactggaggaacagaggagctgcctgaggaggagggcggcggcggcagcggcggccggcggcagggcggcaggaacatctctgtggagacagccagcctggatgtgtatgccaagtatgtgctgcggagcatctgccagcaggagtgggtgggggagcgctgcctgaagagcctgtgtgaggacagcaatgacctgcaggaccctgtgctgagcagcgcccaggcccagaggctgatgcagctgatctgctacccccaccggctgctggacaatgaagatggagagaacccccagaggcagaggatcaagaggatcctgcagaacctggaccagtggaccatgaggcagagcagcctggagctgcagctgatgatcaagcagacccccaacaatgagatgaacagcctgctggagaacatcgccaaggccaccatcgaggtgttccagcagagcgctgagaccggcagcagcagcggcagcacagccagcaacatgcccagcagcagcaagaccaagcctgtgctgagcagcctggagaggtctggagtgtggctggtggcccccctcatcgccaagctgcccacctctgtgcagggccacgtgctgaaggctgctggggaggagctggagaagggccagcacctgggcagcagcagcaggaaggagcgggaccggcagaagcagaagtccatgagcctgctgagccagcagcccttcctgagcctggtgctgacctgcctgaagggccaggatgagcagcgggagggcctgctgaccagcctgtacagccaggtgcaccagatcgtgaacaactggagagatgaccagtacctggatgactgcaagcccaagcagctgatgcatgaggccctgaagctgcggctgaacctggtgggcggcatgtttgacacagtgcagaggagcacccagcagaccacagagtgggccatgctgctgctggagatcatcatctctggaacagtggacatgcagagcaacaatgagctgttcaccaccgtgctggacatgctgtctgtgctgatcaatggcaccctggccgctgacatgagcagcatcagccagggctccatggaggagaacaagagggcctacatgaacctggccaagaagctgcagaaggagctgggggagcggcagagcgacagcctggagaaggtgcggcagctgctgcccctgcccaagcagaccagagatgtgatcacctgtgagccccagggcagcctgattgacaccaagggcaacaagattgctggctttgacagcatcttcaagaaggagggcctgcaggtgtccaccaagcagaagatcagcccctgggacctgtttgagggcctgaagcccagcgcccccctgtcctggggctggtttggaacagtgcgggtggaccggcgggtggcccggggggaggagcagcagaggctgctgctgtaccacacccacctgcggccccggccccgggcctactacctggagcccctgcccctgcccccagaagatgaggagcccccagcccccaccctgctggagcctgagaagaaggcccctgagccccccaagacagacaagccaggggccgccccacccagcacagaggagaggaagaagaagagcaccaagggcaagaagaggagccagcctgccaccaagacagaggactatggcatgggccctggccgcagcggcccctacggcgtgacagtgcccccagacctgctgcaccaccccaaccctggcagcatcacccacctgaactaccggcagggcagcatcggcctgtacacccagaaccagcccctgcctgctgggggcccccgggtggacccctacagacctgtgcggctgcccatgcagaagctgcccacccggcccacctacccaggagtgctgcccaccaccatgactggagtgatgggcctggagcccagcagctacaagacctctgtgtaccggcagcagcagcctgctgtgccccagggccagaggctgcggcagcagctgcagagccagggcatgctgggccagagctctgtgcaccagatgacccccagcagcagctatggcctgcagaccagccagggctacaccccctacgtgagccacgtgggcctgcagcagcacacaggccctgctggcaccatggtgccccccagctacagcagccagccctaccagagcacccaccccagcaccaaccccaccctggtggaccccaccaggcacctgcagcagaggccttctggctacgtgcaccagcaggcccccacctacggccacggcctgaccagcacccagcgcttcagccaccagaccctgcagcagacccccatgatcagcaccatgacccccatgtctgcccagggcgtgcaggccggcgtgcgcagcacagccatcctgcctgagcagcagcagcagcagcagcagcagcagcagcagcagcagcagcagcagcagcagcagcagcagcagcagcagcagcagtaccacatccggcagcagcagcagcagcagatcctgcggcagcagcagcagcagcagcagcagcagcagcagcagcagcagcagcagcagcagcagcagcagcagcagcagcagcagcaccagcagcagcagcagcagcaggccgccccaccccagccccagccccagagccagccccagttccagaggcagggcctgcagcagacccagcagcagcagcagacagctgccctggtgcggcagctgcagcagcagctgagcaacacccagccccagcccagcaccaacatcttcggccgctactag

SEQ ID NO: 158998 - DNA, 393 bp, Artificial Sequence
  Description of Artificial Sequence: Synthetic coding sequence
tgaacacccaacagaagaaggaagaagcagctgaatgctgccttcctgccccaggatgagctgacagccctgaatgtgaagcagggcttcaacaaccagcctgctgtgtctggagatgaacatggcagcgccaagaatgtgtccttcaacccagccaagatcagcagcaacttcagcagcatcatcgccgagaagctgcgctgcaacaccctgcctgacaccggccgcaggaagccccaggtgaaccagaaggacaacttctggctggtgacagcccggagccagagcgccatcaacacctggttcacagacctggccggcaccaagcccctgacccagctggccaagaaggtgcccatcttcagcaagaaggaggaggtgtttggctactag

SEQ ID NO: 158999 - DNA, 6384 bp, Artificial Sequence
  Description of Artificial Sequence: Synthetic coding sequence
gaagatgagctgacagccctgaatgtgaagcagggcttcaacaaccagcctgctgtgtctggagatgagcacggcagcgccaagaatgtgtccttcaacccagccaagatcagcagcaacttcagcagcatcatcgccgagaagctgcgctgcaacaccctgcctgacacaggaagaaggaagccccaggtgaaccagaaggacaacttctggctggtgacagcccggagccagagcgccatcaacacctggttcacagacctggccggcaccaagcccctgacccagctggccaagaaggtgcccatcttcagcaagaaggaggaggtgtttggctacctggccaagtacacagtgcctgtgatgagagctgcctggctgatcaagatgacctgtgcctactatgctgccatcagcgagaccaaggtgaagaagagacatgtggaccccttcatggagtggacccagatcatcaccaagtacctgtgggagcagctgcagaagatggccgagtactacagacctggccctgctggcagcggcggctgcggcagcaccatcggccccctgccccatgatgtggaggtggccatccggcagtgggactacacagagaagctggccatgttcatgttccaggacggcatgctggacagacatgagttcctgacctgggtgctggagtgctttgagaagatccggcctggagaagatgagctgctgaagctgctgctgcccctgctgctgcgctacagcggggagtttgtgcagagcgcctacctgagccggcggctggcctacttctgcacccggcggctggccctgcagctggatggagtgagcagccacagcagccacgtgatcagcgcccagagcaccagcaccctgcccaccaccccagccccccagccccccaccagcagcacccccagcacccccttcagtgacctgctgatgtgcccccagcaccggcccctggtgtttggcctgagctgcatcctgcagaccatcctgctgtgctgccccagcgccctggtgtggcactacagcctgacagacagccgcatcaagacaggcagccccctggaccacctgcccatcgcccccagcaacctgcccatgcctgagggcaacagcgccttcacccagcaggtgcgggccaagctgcgggagattgagcagcagatcaaggagcggggccaggccgtggaggtgcgctggagctttgacaagtgccaggaggccacagctggcttcaccatcggccgggtgctgcacaccctggaggtgctggacagccacagctttgagaggagtgacttcagcaacagcctggacagcctgtgcaaccgcatcttcggcctgggccccagcaaggatggccacgagatcagcagtgatgatgatgctgtggtgtccctgctgtgtgagtgggccgtgtcctgcaagaggagcggccgccaccgggccatggtggtggccaagctgctggagaagaggcaggccgagattgaggccgagcgctgtggggagagcgaggccgcagatgagaagggcagcatcgccagcggcagcctgagcgcccccagcgcccccatcttccaggatgtgctgctgcagttcctggacacccaggcccccatgctgacagaccccaggtctgagagcgagcgggtggagttcttcaacctggtgctgctcttctgtgagctgatcagacatgatgtgttcagccacaacatgtacacctgcaccctcatcagcagaggagacctggccttcggggcccctggccccaggcctcccagcccctttgatgatcctgcagatgatcctgagcacaaggaggccgagggcagcagcagcagcaagctggaggaccccggcctgtctgagagcatggacatcgaccccagcagctctgtgctgtttgaggacatggagaagccagacttcagcctcttcagccccaccatgccctgtgagggcaagggcagccccagccctgagaagccagatgtggagaaggaggtgaagcccccacccaaggagaagattgagggcaccctgggcgtgctgtatgaccagcccaggcatgtgcagtatgccacccacttccccatcccccaggaggagagctgcagccatgagtgcaaccagaggctggtggtgctgtttggagtgggcaagcagagagatgatgcccggcatgccatcaagaagatcaccaaggacatcctgaaggtgctgaacagaaaaggaacagctgagacagaccagctggcccccatcgtgcccctgaaccctggggacctgaccttcctgggcggggaggatggccagaagagaagaagaaacagacctgaggccttccccacagctgaggacatctttgccaagttccagcacctgagccactatgaccagcaccaggtgacagcccaggtgtccagaaatgtgctggagcagatcaccagctttgccctgggcatgagctaccacctgcccctggtgcagcacgtgcagttcatctttgacctgatggagtacagcctgagcatcagcggcctgattgactttgccatccagctgctgaatgagctgtctgtggtggaggccgagctgctgctgaagagcagtgacctggtgggcagctacaccaccagcctgtgcctgtgcatcgtggccgtgctgcggcactaccacgcctgcctgatcctgaaccaggaccagatggcccaggtgtttgagggcctgtgtggggtggtgaagcacggcatgaacagaagtgatggcagcagcgctgagcgctgcatcctggcctacctgtatgacctgtacaccagctgcagccacctgaagaacaagtttggagagctgttcagtgacttctgcagcaaggtgaagaacaccatctactgcaatgtggagcccagcgagagcaacatgcgctgggcccctgagttcatgattgacaccctggagaacccagctgcccacaccttcacctacacaggcctgggcaagagcctgtctgaaaatcctgccaaccgctacagctttgtgtgcaatgccctgatgcacgtgtgtgtgggccaccacgaccctgacagagtgaatgacatcgccatcctgtgtgccgagctgaccggctactgcaagagcctgtctgctgagtggctgggcgtgctgaaggccctgtgctgcagcagcaacaacggcacctgtggcttcaatgacctgctgtgcaatgtggatgtgtctgacctgtccttccatgacagcctggccacctttgtggccatcctgattgcccggcagtgcctgctgctggaggacctgatccgctgtgccgccatccccagcctgctgaatgctgcctgcagcgagcaggacagcgagcccggggcccggctgacctgccgcatcctgctgcacctgttcaagaccccccagctgaacccctgccagagtgatggcaacaagcccaccgtgggcatccgcagcagctgtgacagacacctgctggccgccagccagaacagaattgtggatggagctgtgtttgctgtgctgaaggctgtgtttgtgctgggagatgctgagctgaagggcagcggcttcaccgtgactggaggaacagaggagctgcctgaggaggagggcggcggcggcagcggcggccggcggcagggcggcaggaacatctctgtggagacagccagcctggatgtgtatgccaagtatgtgctgcggagcatctgccagcaggagtgggtgggggagcgctgcctgaagagcctgtgtgaggacagcaatgacctgcaggaccctgtgctgagcagcgcccaggcccagaggctgatgcagctgatctgctacccccaccggctgctggacaatgaagatggagagaacccccagaggcagaggatcaagaggatcctgcagaacctggaccagtggaccatgaggcagagcagcctggagctgcagctgatgatcaagcagacccccaacaatgagatgaacagcctgctggagaacatcgccaaggccaccatcgaggtgttccagcagagcgctgagaccggcagcagcagcggcagcacagccagcaacatgcccagcagcagcaagaccaagcctgtgctgagcagcctggagaggtctggagtgtggctggtggcccccctcatcgccaagctgcccacctctgtgcagggccacgtgctgaaggctgctggggaggagctggagaagggccagcacctgggcagcagcagcaggaaggagcgggaccggcagaagcagaagtccatgagcctgctgagccagcagcccttcctgagcctggtgctgacctgcctgaagggccaggatgagcagcgggagggcctgctgaccagcctgtacagccaggtgcaccagatcgtgaacaactggagagatgaccagtacctggatgactgcaagcccaagcagctgatgcatgaggccctgaagctgcggctgaacctggtgggcggcatgtttgacacagtgcagaggagcacccagcagaccacagagtgggccatgctgctgctggagatcatcatctctggaacagtggacatgcagagcaacaatgagctgttcaccaccgtgctggacatgctgtctgtgctgatcaatggcaccctggccgctgacatgagcagcatcagccagggctccatggaggagaacaagagggcctacatgaacctggccaagaagctgcagaaggagctgggggagcggcagagcgacagcctggagaaggtgcggcagctgctgcccctgcccaagcagaccagagatgtgatcacctgtgagccccagggcagcctgattgacaccaagggcaacaagattgctggctttgacagcatcttcaagaaggagggcctgcaggtgtccaccaagcagaagatcagcccctgggacctgtttgagggcctgaagcccagcgcccccctgtcctggggctggtttggaacagtgcgggtggaccggcgggtggcccggggggaggagcagcagaggctgctgctgtaccacacccacctgcggccccggccccgggcctactacctggagcccctgcccctgcccccagaagatgaggagcccccagcccccaccctgctggagcctgagaagaaggcccctgagccccccaagacagacaagccaggggccgccccacccagcacagaggagaggaagaagaagagcaccaagggcaagaagaggagccagcctgccaccaagacagaggactatggcatgggccctggccgcagcggcccctacggcgtgacagtgcccccagacctgctgcaccaccccaaccctggcagcatcacccacctgaactaccggcagggcagcatcggcctgtacacccagaaccagcccctgcctgctgggggcccccgggtggacccctacagacctgtgcggctgcccatgcagaagctgcccacccggcccacctacccaggagtgctgcccaccaccatgactggagtgatgggcctggagcccagcagctacaagacctctgtgtaccggcagcagcagcctgctgtgccccagggccagaggctgcggcagcagctgcagcagagccagggcatgctgggccagagctctgtgcaccagatgacccccagcagcagctatggcctgcagaccagccagctgagccccagcagcctgcagggctacaccccctacgtgagccacgtgggcctgcagcagcacacaggccctgctgaccccaccaggcacctgcagcagaggcccagcggctacgtgcaccagcaggcccccacctacggccacggcctgaccagcacccagcgcttcagccaccagaccctgcagcagacccccatgatcagcaccatgacccccatgtctgcccagggcgtgcaggccggcgtgcgcagcacagccatcctgcctgagcagcagcagcagcagcagcagcagcagcagcagcagcagcagcagcagcagcagcagcagcagcagcagcagcagcagtaccacatccggcagcagcagcagcagcagatcctgcggcagcagcagcagcagcagcagcagcagcagcagcagcagcagcagcagcagcagcagcagcagcagcagcagcagcagcaccagcagcagcagcagcagcaggccgccccaccccagccccagccccagagccagccccagttccagaggcagggcctgcagcagacccagcagcagcagcagacagctgccctggtgcggcagctgcagcagcagctgagcaacacccagccccagcccagcaccaacatcttcggccgctactag

SEQ ID NO: 159000 - DNA, 2778 bp, Artificial Sequence
  Description of Artificial Sequence: Synthetic coding sequence
gggggcagcggcggccggcggcagggcggcaggaacatctctgtggagacagccagcctggatgtgtatgccaagtatgtgctgcggagcatctgccagcaggagtgggtgggggagcgctgcctgaagagcctgtgtgaggacagcaatgacctgcaggaccctgtgctgagcagcgcccaggcccagaggctgatgcagctgatctgctacccccaccggctgctggacaatgaagatggagagaacccccagaggcagaggatcaagaggatcctgcagaacctggaccagtggaccatgaggcagagcagcctggagctgcagctgatgatcaagcagacccccaacaatgagatgaacagcctgctggagaacatcgccaaggccaccatcgaggtgttccagcagagcgctgagaccggcagcagcagcggcagcacagccagcaacatgcccagcagcagcaagaccaagcctgtgctgagcagcctggagaggtctggagtgtggctggtggcccccctgattgccaagctgcccacctctgtgcagggccacgtgctgaaggccgccggggaggagctggagaagggccagcacctgggcagcagcagcaggaaggagcgggaccggcagaagcagaagtccatgagcctgctgagccagcagcccttcctgagcctggtgctgacctgcctgaagggccaggatgagcagcgggagggcctgctgaccagcctgtacagccaggtgcaccagatcgtgaacaactggagagatgaccagtacctggatgactgcaagcccaagcagctgatgcatgaggccctgaagctgcggctgaacctggtgggcggcatgtttgacacagtgcagaggagcacccagcagaccacagagtgggccatgctgctgctggagatcatcatcagcggcaccgtggacatgcagagcaacaatgaactcttcaccaccgtgctggacatgctgtctgtgctgatcaatggcaccctggccgctgacatgagcagcatcagccagggctccatggaggagaacaagagggcctacatgaacctggccaagaagctgcagaaggagctgggggagcggcagagcgacagcctggagaaggtgcggcagctgctgcccctgcccaagcagaccagagatgtgatcacctgtgagccccagggcagcctgattgacaccaagggcaacaagattgctggctttgacagcatcttcaagaaggagggcctgcaggtgtccaccaagcagaagatcagcccctgggacctgtttgagggcctgaagcccagcgcccccctgtcctggggctggtttggcaccgtgcgggtggacagaagagtggcccggggggaggagcagcagaggctgctgctgtaccacacccacctgcggccccggccccgggcctactacctggagcccctgcccctgcccccagaagatgaggagcccccagcccccaccctgctggagcctgagaagaaggcccctgagccccccaagacagacaagccaggagctgccccacccagcacagaggagaggaagaagaagagcaccaagggcaagaagaggagccagcctgccaccaagacagaagattatggcatgggccctggccgcagcggcccctatggagtgacagtgcccccagacctgctgcaccaccccaaccctggcagcatcacccacctgaactaccggcagggcagcatcggcctgtacacccagaaccagcccctgcctgctgggggcccccgggtggacccctacagacctgtgcggctgcccatgcagaagctgcccacccggcccacctacccaggagtgctgcccaccaccatgactggagtgatgggcctggagcccagcagctacaagacctctgtgtaccggcagcagcagcctgctgtgccccagggccagaggctgcggcagcagctgcaggccaagatccagagccagggcatgctgggccagagctctgtgcaccagatgacccccagcagcagctatggcctgcagaccagccagggctacaccccctacgtgagccacgtgggcctgcagcagcacactggacctgctggcaccatggtgcccccatcctacagcagccagccctaccagagcacccaccccagcaccaaccccaccctggtggaccccaccaggcacctgcagcagaggcccagcggctacgtgcaccagcaggcccccacctacggccacggcctgaccagcacccagcgcttcagccaccagaccctgcagcagacccccatgatcagcaccatgacccccatgtctgcccagggcgtgcaggccggcgtgcgcagcacagccatcctgcctgagcagcagcagcagcagcagcagcagcagcagcagcagcagcagcagcagcagcagcagcagcagcagcagcagcagcagtaccacatccggcagcagcagcagcagcagatcctgcggcagcagcagcagcagcagcagcagcagcagcagcagcagcagcagcagcagcagcagcagcagcagcagcagcagcagcaccagcagcagcagcagcagcaggccgccccaccccagccccagccccagagccagccccagttccagaggcagggcctgcagcagacccagcagcagcagcagacagctgccctggtgcggcagctgcagcagcagctgagcaacacccagccccagcccagcaccaacatcttcggccgctactag

SEQ ID NO: 159001 - DNA, 756 bp, Artificial Sequence
  Description of Artificial Sequence: Synthetic coding sequence
tgagaaaggaagaagaagagcaccaagggcaagaagaggagccagcctgccaccaagacagaagattatggcatgggccctggccgcagcggcccctatggagtgacagtgcccccagacctgctgcaccaccccaaccctggcagcatcacccacctgaactaccggcagggcagcatcggcctgtacacccagaaccagcccctgcctgctgggggcccccgggtggacccctacagacctgtgcggctgcccatgcagaagctgcccacccggcccacctacccaggagtgctgcccaccaccatgactggagtgatgggcctggagcccagcagctacaagacctctgtgtaccggcagcagcagcctgctgtgccccagggccagaggctgcggcagcagctgcagcagagccagggcatgctgggccagagctctgtgcaccagatgacccccagcagcagctatggcctgcagaccagccagggctacaccccctacgtgagccacgtgggcctgcagcagcacacaggccctgctgaccccaccaggcacctgcagcagaggcccagcggctacgtgcaccagcaggcccccacctacggccacggcctgaccagcacccagcgcttcagccaccagaccctgcagcagacccccatgatcagcaccatgacccccatgtctgcccagggcgtgcaggccggcgtgcgcagcacagccatcctgcctgagcagcagcagcagcagtag

SEQ ID NO: 159002 - DNA, 6003 bp, Artificial Sequence
  Description of Artificial Sequence: Synthetic coding sequence
atggccgccttcggcatcctgtcctatgagcaccggcccctgaagaggccccggctgggccccccagatgtgtacccccaggaccccaagcagaaggaggatgagctgacagccctgaatgtgaagcagggcttcaacaaccagcctgctgtgtctggagatgagcacggcagcgccaagaatgtgtccttcaacccagccaagatcagcagcaacttcagcagcatcatcgccgagaagctgcgctgcaacaccctgcctgacacaggaagaaggaagccccaggtgaaccagaaggacaacttctggctggtgacagcccggagccagagcgccatcaacacctggttcacagacctggccggcaccaagcccctgacccagctggccaagaaggtgcccatcttcagcaagaaggaggaggtgtttggctacctggccaagtacacagtgcctgtgatgagagctgcctggctgatcaagatgacctgtgcctactatgctgccatcagcgagaccaaggtgaagaagagacatgtggaccccttcatggagtggacccagatcatcaccaagtacctgtgggagcagctgcagaagatggccgagtactacagacctggccctgctggcagcggcggctgcggcagcaccatcggccccctgccccatgatgtggaggtggccatccggcagtgggactacacagagaagctggccatgttcatgttccaggacggcatgctggacagacatgagttcctgacctgggtgctggagtgctttgagaagatccggcctggagaagatgagctgctgaagctgctgctgcccctgctgctgcgctacagcggggagtttgtgcagagcgcctacctgagccggcggctggcctacttctgcacccggcggctggccctgcagctggatggagtgagcagccacagcagccacgtgatcagcgcccagagcaccagcaccctgcccaccaccccagccccccagccccccaccagcagcacccccagcacccccttcagtgacctgctgatgtgcccccagcaccggcccctggtgtttggcctgagctgcatcctgcagaccatcctgctgtgctgccccagcgccctggtgtggcactacagcctgacagacagccgcatcaagacaggcagccccctggaccacctgcccatcgcccccagcaacctgcccatgcctgagggcaacagcgccttcacccagcaggtgcgggccaagctgcgggagattgagcagcagatcaaggagcggggccaggccgtggaggtgcgctggagctttgacaagtgccaggaggccacagctggcttcaccatcggccgggtgctgcacaccctggaggtgctggacagccacagctttgagaggagtgacttcagcaacagcctggacagcctgtgcaaccgcatcttcggcctgggccccagcaaggatggccacgagatcagcagtgatgatgatgctgtggtgtccctgctgtgtgagtgggccgtgtcctgcaagaggagcggccgccaccgggccatggtggtggccaagctgctggagaagaggcaggccgagattgaggccgagcgctgtggggagagcgaggccgcagatgagaagggcagcatcgccagcggcagcctgagcgcccccagcgcccccatcttccaggatgtgctgctgcagttcctggacacccaggcccccatgctgacagaccccaggtctgagagcgagcgggtggagttcttcaacctggtgctgctcttctgtgagctgatcagacatgatgtgttcagccacaacatgtacacctgcaccctcatcagcagaggagacctggccttcggggcccctggccccaggcctcccagcccctttgatgatcctgcagatgatcctgagcacaaggaggccgagggcagcagcagcagcaagctggaggaccccggcctgtctgagagcatggacatcgaccccagcagctctgtgctgtttgaggacatggagaagccagacttcagcctcttcagccccaccatgccctgtgagggcaagggcagccccagccctgagaagccagatgtggagaaggaggtgaagcccccacccaaggagaagattgagggcaccctgggcgtgctgtatgaccagcccaggcatgtgcagtatgccacccacttccccatcccccaggaggagagctgcagccatgagtgcaaccagaggctggtggtgctgtttggagtgggcaagcagagagatgatgcccggcatgccatcaagaagatcaccaaggacatcctgaaggtgctgaacagaaaaggaacagctgagacagaccagctggcccccatcgtgcccctgaaccctggggacctgaccttcctgggcggggaggatggccagaagagaagaagaaacagacctgaggccttccccacagctgaggacatctttgccaagttccagcacctgagccactatgaccagcaccaggtgacagcccaggtgtccagaaatgtgctggagcagatcaccagctttgccctgggcatgagctaccacctgcccctggtgcagcacgtgcagttcatctttgacctgatggagtacagcctgagcatcagcggcctgattgactttgccatccagctgctgaatgagctgtctgtggtggaggccgagctgctgctgaagagcagtgacctggtgggcagctacaccaccagcctgtgcctgtgcatcgtggccgtgctgcggcactaccacgcctgcctgatcctgaaccaggaccagatggcccaggtgtttgagggcctgtgtggggtggtgaagcacggcatgaacagaagtgatggcagcagcgctgagcgctgcatcctggcctacctgtatgacctgtacaccagctgcagccacctgaagaacaagtttggagagctgttcagtgacttctgcagcaaggtgaagaacaccatctactgcaatgtggagcccagcgagagcaacatgcgctgggcccctgagttcatgattgacaccctggagaacccagctgcccacaccttcacctacacaggcctgggcaagagcctgtctgaaaatcctgccaaccgctacagctttgtgtgcaatgccctgatgcacgtgtgtgtgggccaccacgaccctgacagagtgaatgacatcgccatcctgtgtgccgagctgaccggctactgcaagagcctgtctgctgagtggctgggcgtgctgaaggccctgtgctgcagcagcaacaacggcacctgtggcttcaatgacctgctgtgcaatgtggatgtgtctgacctgtccttccatgacagcctggccacctttgtggccatcctgattgcccggcagtgcctgctgctggaggacctgatccgctgtgccgccatccccagcctgctgaatgctgcctgcagcgagcaggacagcgagcccggggcccggctgacctgccgcatcctgctgcacctgttcaagaccccccagctgaacccctgccagagtgatggcaacaagcccaccgtgggcatccgcagcagctgtgacagacacctgctggccgccagccagaacagaattgtggatggagctgtgtttgctgtgctgaaggctgtgtttgtgctgggagatgctgagctgaagggcagcggcttcaccgtgactggaggaacagaggagctgcctgaggaggagggcggcggcggcagcggcggccggcggcagggcggcaggaacatctctgtggagacagccagcctggatgtgtatgccaagtatgtgctgcggagcatctgccagcaggagtgggtgggggagcgctgcctgaagagcctgtgtgaggacagcaatgacctgcaggaccctgtgctgagcagcgcccaggcccagaggctgatgcagctgatctgctacccccaccggctgctggacaatgaagatggagagaacccccagaggcagaggatcaagaggatcctgcagaacctggaccagtggaccatgaggcagagcagcctggagctgcagctgatgatcaagcagacccccaacaatgagatgaacagcctgctggagaacatcgccaaggccaccatcgaggtgttccagcagagcgctgagaccggcagcagcagcggcagcacagccagcaacatgcccagcagcagcaagaccaagcctgtgctgagcagcctggagaggtctggagtgtggctggtggcccccctcatcgccaagctgcccacctctgtgcagggccacgtgctgaaggctgctggggaggagctggagaagggccagcacctgggcagcagcagcaggaaggagcgggaccggcagaagcagaagtccatgagcctgctgagccagcagcccttcctgagcctggtgctgacctgcctgaagggccaggatgagcagcgggagggcctgctgaccagcctgtacagccaggtgcaccagatcgtgaacaactggagagatgaccagtacctggatgactgcaagcccaagcagctgatgcatgaggccctgaagctgcggctgaacctggtgggcggcatgtttgacacagtgcagaggagcacccagcagaccacagagtgggccatgctgctgctggagatcatcatctctggaacagtggacatgcagagcaacaatgagctgttcaccaccgtgctggacatgctgtctgtgctgatcaatggcaccctggccgctgacatgagcagcatcagccagggctccatggaggagaacaagagggcctacatgaacctggccaagaagctgcagaaggagctgggggagcggcagagcgacagcctggagaaggtgcggcagctgctgcccctgcccaagcagaccagagatgtgatcacctgtgagccccagggcagcctgattgacaccaagggcaacaagattgctggctttgacagcatcttcaagaaggagggcctgcaggtgtccaccaagcagaagatcagcccctgggacctgtttgagggcctgaagcccagcgcccccctgtcctggggctggtttggaacagtgcgggtggaccggcgggtggcccggggggaggagcagcagaggctgctgctgtaccacacccacctgcggccccggccccgggcctactacctggagcccctgcccctgcccccagaagatgaggagcccccagcccccaccctgctggagcctgagaagaaggcccctgagccccccaagacagacaagccaggggccgccccacccagcacagaggagaggaagaagaagagcaccaagggcaagaagaggagccagcctgccaccaagacagaggactatggcatgggccctggccgcagcggcccctacggcgtgacagtgcccccagacctgctgcaccaccccaaccctggcagcatcacccacctgaactaccggcagggcagcatcggcctgtacacccagaaccagcccctgcctgctgggggcccccgggtggacccctacagacctgtgcggctgcccatgcagaagctgcccacccggcccacctacccaggagtgctgcccaccaccatgactggagtgatgggcctggagcccagcagctacaagacctctgtgtaccggcagcagcagcctgctgtgccccagggccagaggctgcggcagcagctgcagcagagccagggcatgctgggccagagctctgtgcaccagatgacccccagcagcagctatggcctgcagaccagccagggctacaccccctacgtgagccacgtgggcctgcagcagcacactggacctgctgaccccaccaggcacctgcagcagaggccttctggctacgtgcaccagcaggcccccacctacggccacggcctgaccagcacccagagcttccacaccaggcactgcagccgccacccctag

SEQ ID NO: 159003 - DNA, 2271 bp, Artificial Sequence
  Description of Artificial Sequence: Synthetic coding sequence
atggccgccttcggcctgctgtcctatgagcagaggcccctgaagaggccccggctgggccccccagatgtgtacccccaggaccccaagcagaaggaggatgagctgacagctgtgaatgtgaagcagggcttcaacaaccagcctgccttcaccggagatgagcacggcagcgccaggaacatcgtcatcaaccccagcaagattggagcctacttcagcagcatcctggccgagaagctgaagctgaacaccttccaggacaccgggaagaagaagccccaggtgaatgccaaggacaactactggctggtgacagcccggagccagagcgccatccacagctggttcagtgacctggccggcaacaagcccctgagcatcctggccaagaaggtgcccatcctgagcaagaaggaggatgtgtttgcctacctggccaagtacagcgtgcccatggtgcgggccacctggctgatcaagatgacctgtgcctactacagcgccatcagcgaggccaagatcaagaagaggcaggccccagaccccaacctggagtggacccagatcagcacccgctacctgcgggagcagctggccaagatcagtgacttctaccacatggccagcagcactggagatggccctgtgcctgtgcccccagaggtggagcaggccatgaagcagtgggagtacaatgagaagctggccttccacatgttccaggagggcatgctggagaagcatgagtacctgacctggatcctggatgtgctggagaagatccggcccatggatgatgacctgctgaagctgctgctgcccctgatgctgcagtacagtgatgaatttgtgcagagcgcctacctgagccggcggctggcctacttctgtgcccggcggctgagcctgctgctgagtgacagccccaacctgctggccgcccacagcccccacatgatgattggccccaacaacagcagcattggagcccccagccctggccccccaggccctggcatgagccctgtgcagctggccttcagtgacttcctgagctgtgcccagcacggccccctggtgtatggcctgagctgcatgctgcagacagtgaccctgtgctgccccagcgccctggtgtggaactacagcaccaatgaaaacaagagcgccaaccctggcagccccctggacctgctgcaggtggcccccagcagcctgcccatgcctgggggcaacacagccttcaaccagcaggtgcgggcccgcatctatgaggtggagcagcagatcaagcagaggggccgggctgtggaggtgcgctggagctttgacaagtgccaggagagcacagctggggtgaccatcagccgggtgctgcacaccctggaggtgctggacagacactgctttgacagaacagacagcagcaacagcatggagaccctgtaccacaagatcttctgggccaaccagaacaaggacaaccaggaggtggccccaaatgatgaagctgtggtgaccctgctgtgtgagtgggccgtgtcctgcaagaggtctgggaagcaccgggccatggctgtggccaagctgctggagaagaggcaggccgagattgaagctgagcgctgtggggagagcgaggtgctggatgagaaggagagcatcagcagcagcagcctggccggcagcagcctgcctgtgttccagaatgtgctgctgcgcttcctggacacccaggcccccagcctgagtgaccccaacagtgaatgtgagaaggtggagtttgtgaacctggtgctgctcttctgtgagttcatcagacatgatgtgttcagccatgatgcctacatgtgcaccctcatcagcagaggagacctgtctgtgacagccagcacccggcccaggagccctgtgggagaaaatgctgatgagcactacagcaaggaccatgatgtgaagatggaggagcagagcatcatggcccacatgggcatcgacagcggcaccaccaacatctttgatgaggtggacaagagtgacttcaagacagactttggcagcgagttccccatcttcagccccatgcctggagagagctgtgaaaatgccaacaccagcctgggccgcaggatgtctgtgaactgtgagaagctggtgaagcgggagaagccccgggagctgatcttccccagcaactatgacctgctgcggcacctgcagtatgccacccacttccccatccccctggtgagccactgcttctcctag

SEQ ID NO: 159004 - DNA, 2166 bp, Artificial Sequence
  Description of Artificial Sequence: Synthetic coding sequence
atggccgccttcggcctgctgtcctatgagcagaggcccctgaagaggccccggctgggccccccagatgtgtacccccaggaccccaagcagaaggaggatgagctgacagctgtgaatgtgaagcagggcttcaacaaccagcctgccttcaccggagatgagcacggcagcgccaggaacatcgtcatcaaccccagcaagattggagcctacttcagcagcatcctggccgagaagctgaagctgaacaccttccaggacaccgggaagaagaagccccaggtgaatgccaaggacaactactggctggtgacagcccggagccagagcgccatccacagctggttcagtgacctggccggcaacaagcccctgagcatcctggccaagaaggtgcccatcctgagcaagaaggaggatgtgtttgcctacctggccaagtacagcgtgcccatggtgcgggccacctggctgatcaagatgacctgtgcctactacagcgccatcagcgaggccaagatcaagaagaggcaggccccagaccccaacctggagtggacccagatcagcacccgctacctgcgggagcagctggccaagatcagtgacttctaccacatggccagcagcactggagatggccctgtgcctgtgcccccagaggtggagcaggccatgaagcagtgggagtacaatgagaagctggccttccacatgttccaggagggcatgctggagaagcatgagtacctgacctggatcctggatgtgctggagaagatccggcccatggatgatgacctgctgaagctgctgctgcccctgatgctgcagtacagtgatgaatttgtgcagagcgcctacctgagccggcggctggcctacttctgtgcccggcggctgagcctgctgctgagtgacagccccaacctgctggccgcccacagcccccacatgatgattggccccaacaacagcagcattggagcccccagccctggccccccaggccctggcatgagccctgtgcagctggccttcagtgacttcctgagctgtgcccagcacggccccctggtgtatggcctgagctgcatgctgcagacagtgaccctgtgctgccccagcgccctggtgtggaactacagcaccaatgaaaacaagagcgccaaccctggcagccccctggacctgctgcaggtggcccccagcagcctgcccatgcctgggggcaacacagccttcaaccagcaggtgcgggcccgcatctatgaggtggagcagcagatcaagcagaggggccgggctgtggaggtgcgctggagctttgacaagtgccaggagagcacagctggggtgaccatcagccgggtgctgcacaccctggaggtgctggacagacactgctttgacagaacagacagcagcaacagcatggagaccctgtaccacaagatcttctgggccaaccagaacaaggacaaccaggaggtggccccaaatgatgaagctgtggtgaccctgctgtgtgagtgggccgtgtcctgcaagaggtctgggaagcaccgggccatggctgtggccaagctgctggagaagaggcaggccgagattgaagctgagcgctgtggggagagcgaggtgctggatgagaaggagagcatcagcagcagcagcctggccggcagcagcctgcctgtgttccagaatgtgctgctgcgcttcctggacacccaggcccccagcctgagtgaccccaacagtgaatgtgagaaggtggagtttgtgaacctggtgctgctcttctgtgagttcatcagacatgatgtgttcagccatgatgcctacatgtgcaccctcatcagcagaggagacctgtctgtgacagccagcacccggcccaggagccctgtgggagaaaatgctgatgagcactacagcaaggaccatgatgtgaagatggagatcttcagccccatgcctggagagagctgtgaaaatgccaacaccagcctgggccgcaggatgtctgtgaactgtgagaagctggtgaagcgggagaagccccgggagctgatcttccccagcaactatgacctgctgcggcacctgcagtatgccacccacttccccatccccctggtgagccactgcttctcctag

SEQ ID NO: 159005 - DNA, 6438 bp, Artificial Sequence
  Description of Artificial Sequence: Synthetic coding sequence
atggccgccttcggcctgctgtcctatgagcagaggcccctgaagaggccccggctgggccccccagatgtgtacccccaggaccccaagcagaaggaggatgagctgacagctgtgaatgtgaagcagggcttcaacaaccagcctgccttcaccggagatgagcacggcagcgccaggaacatcgtcatcaaccccagcaagattggagcctacttcagcagcatcctggccgagaagctgaagctgaacaccttccaggacaccgggaagaagaagccccaggtgaatgccaaggacaactactggctggtgacagcccggagccagagcgccatccacagctggttcagtgacctggccggcaacaagcccctgagcatcctggccaagaaggtgcccatcctgagcaagaaggaggatgtgtttgcctacctggccaagtacagcgtgcccatggtgcgggccacctggctgatcaagatgacctgtgcctactacagcgccatcagcgaggccaagatcaagaagaggcaggccccagaccccaacctggagtggacccagatcagcacccgctacctgcgggagcagctggccaagatcagtgacttctaccacatggccagcagcactggagatggccctgtgcctgtgcccccagaggtggagcaggccatgaagcagtgggagtacaatgagaagctggccttccacatgttccaggagggcatgctggagaagcatgagtacctgacctggatcctggatgtgctggagaagatccggcccatggatgatgacctgctgaagctgctgctgcccctgatgctgcagtacagtgatgaatttgtgcagagcgcctacctgagccggcggctggcctacttctgtgcccggcggctgagcctgctgctgagtgacagccccaacctgctggccgcccacagcccccacatgatgattggccccaacaacagcagcattggagcccccagccctggccccccaggccctggcatgagccctgtgcagctggccttcagtgacttcctgagctgtgcccagcacggccccctggtgtatggcctgagctgcatgctgcagacagtgaccctgtgctgccccagcgccctggtgtggaactacagcaccaatgaaaacaagagcgccaaccctggcagccccctggacctgctgcaggtggcccccagcagcctgcccatgcctgggggcaacacagccttcaaccagcaggtgcgggcccgcatctatgaggtggagcagcagatcaagcagaggggccgggctgtggaggtgcgctggagctttgacaagtgccaggagagcacagctggggtgaccatcagccgggtgctgcacaccctggaggtgctggacagacactgctttgacagaacagacagcagcaacagcatggagaccctgtaccacaagatcttctgggccaaccagaacaaggacaaccaggaggtggccccaaatgatgaagctgtggtgaccctgctgtgtgagtgggccgtgtcctgcaagaggtctgggaagcaccgggccatggctgtggccaagctgctggagaagaggcaggccgagattgaagctgagcgctgtggggagagcgaggtgctggatgagaaggagagcatcagcagcagcagcctggccggcagcagcctgcctgtgttccagaatgtgctgctgcgcttcctggacacccaggcccccagcctgagtgaccccaacagtgaatgtgagaaggtggagtttgtgaacctggtgctgctcttctgtgagttcatcagacatgatgtgttcagccatgatgcctacatgtgcaccctcatcagcagaggagacctgtctgtgacagccagcacccggcccaggagccctgtgggagaaaatgctgatgagcactacagcaaggaccatgatgtgaagatggagatcttcagccccatgcctggagagagctgtgaaaatgccaacaccagcctgggccgcaggatgtctgtgaactgtgagaagctggtgaagcgggagaagccccgggagctgatcttccccagcaactatgacctgctgcggcacctgcagtatgccacccacttccccatccccctggatgagagcagcagccatgagtgcaaccagaggaccatcctgctgtatggagtgggcaaggagagagatgaggcccggcaccagctgaagaagatcaccaaggacatcctgaagatcctgaacaagaagagcaccacagaaacaggagtgggagatgagggccagaaggccaggaagaacaagcaggagaccttccccaccctggagaccgtcttcaccaagctgcagctgctgagctactttgaccagcaccaggtgaccagccagatcagcaacaacgtgctggagcagatcaccagctttgccagcggcaccagctaccacctgcccctggcccaccacatccagctgatctttgacctgatggagcccgccctgaacatcaatggcctgattgactttgccatccagctgctgaatgagctgtctgtggtggaggccgagctgctgctgaagagcagcagcctggccggcagctacaccaccggcctgtgtgtgtgcatcgtggccgtgctgcggcgctaccacagctgcctgatcctgaacccagaccagacagcccaggtgtttgagggcctgtgtggggtggtgaagcacgtggtgaaccccagcgagtgcagcagccctgagcgctgcatcctggcctacctgtatgacctgtatgtgtcctgcagccacctgcggagcaagtttggagacctcttcagcagcgcctgcagcaaggtgaagcagaccatctacaacaacgtgatgcctgccaacagcaacctgcgctgggaccctgacttcatgatggacttcatcgagaaccccagcgcccggagcatcaactacagcatgctgggcaagatcctgagtgacaatgctgccaaccgctacagctttgtgtgcaacaccctgatgaatgtgtgcatgggccaccaggatgctggccgcatcaatgacatcgccaacttcagcagcgagctgacagcctgctgcaccgtgctgagcagcgagtggctgggcgtgctgaaggccctgtgctgcagcagcaaccacgtgtggggcttcaatgatgtgctgtgcaccgtggatgtgtctgacctgtccttccatgacagcctggccaccttcatcgccatcctgattgcccggcagtgcttcagcctggaggatgtggtgcagcacgtggccctgcccagcctgctggccgccgcctgtggagatgctgatgctgagcccggggccaggatgacctgccgcctgctgctgcacctgttccgggccccccaggcctgcttcctgccccaggccaccgggaagcccttccctggcatccgcagcagctgtgacagacacctgctggccgccgcccacaacagcattgaggtgggcgctgtgtttgctgtgctgaaggccatcatgatgctgggagatgccaagattggcaacaacagcgtgagcagcctgaagaatgatgacttcaccatgaggggcctgcgctgtgatggaaatgctgatgacatctggacagccagccagaaccccaagagctgtgggaagagcatcagcattgaaacagccaacctgcgggagtatgcccgctacgtgctgcggaccatctgccagcaggagtgggtgggggagcactgcctgaaggagcctgagcggctgtgcacagacaaggagctgatcctggaccctgtgctgagcaacatgcaggcccagaagctgctgcagctgatctgctacccccacggcatcaaggaatgtacagaaggagacaacctgcagaggcagcacatcaagaggatcctgcagaacctggagcagtggaccctgcggcagagctggctggagctgcagctgatgatcaagcagtgcctgaaggaccccggcagcggctctgtggccgagatgaacaacctgctggacaacatcgccaaggccaccatcgaggtgttccagcagagcgctgacctgaacaacagcagcaacagcggcatgagcctcttcaaccccaacagcatcggcagcgctgacaccagcagcacccggcagaatggcatcaagaccttcctgagcagcagcgagcggcggggcgtgtggctggtggcccccctcatcgcccggctgcccacctctgtgcagggccgggtgctgaaggctgctggggaggagctggagaagggccagcacctgggcagcagcagcaagaaggagcgggaccggcagaagcagaagtccatgagcctgctgagccagcagcccttcctgagcctggtgctgacctgcctgaagggccaggatgagcagcgggagggcctgctgaccagcctgcagaaccaggtgaaccagatcctgagcaactggagggaggagcgctaccaggatgacatcaaggcccggcagatgatgcatgaggccctgcagctgcggctgaacctggtgggcggcatgtttgacacagtgcagaggagcacccagtggaccacagactgggccctgctgctgctgcagatcatcaccagcggcaccgtggacatgcacaccaacaatgagctgttcaccaccgtgctggacatgctgggcgtgctgatcaatggcaccctggccagtgacctgagcaatgccagccctgggggcagcgaggagaacaagagggcctacatgaacctggtgaagaagctgaagaaggagctgggggacaagaggtctgagagcattgacaaggtgcggcagctgctgcccctgcccaagcagacctgtgatgtgatcacctgtgagcccatgggcagcctgattgacaccaagggcaacaagattgctggctttgacagcattgacaagaagcagggcctgcaggtgtccaccaagcagaaggtgagcccctgggacctgtttgagggccagaagaacccagcccccctgtcctgggcctggtttggaacagtgcgggtggaccggcgggtcatcaagtatgaggagcagcaccacctgctgctgtaccacacccaccccatgcccaagcccaggagctactacctgcagcccctgcccctgcccccagaggaggaggaggaggagcccaccagccctgtgtcccaggagcctgagaggaagtctgctgagctgagtgaccagggcaagaccaccacagatgaggagaagaagaccaagggcaggaagaggaagaccaagagcagcagccgggtggatgagtacccccagagcaacatctacagagtgccccccaactacagccccatcagcagccagatgatgcaccacccccagagcaccctgtggggctacaacctggtgggccagccccagcagcccggcttcttcctgcagaaccagagcctgacccctgggggcagccggctggaccctgctggcagctttgtgcccaccaacaccaagcaggccctgagcaacatgctgcagaggagaagtggggccatgatgcagccccccagcctgcacgccatcaccagccagcagcagctgatccagatgaagctgctgcagcagcagcagcagcagaggctgctgcggcaggcccagacccggcccttccagcagggccagcccggggaccaggccgccctgtttgctgcccaggcccggcccagcccccagctgccccagtacccaggcctgcagcaggcccagaccatgccccagggctacaccatgtatggcacccagatgcccctgcagcagaccagccagcagcaggccggctctgtggtgctgagccccagctacaacagccgggcctacccagctgcccacagcaaccctgtgctgatggagcggctgcggcagatccagcagcagcccagcggctacgtgcagcagcaggccagcccctacctgcagcccctgaccggcagccagaggctgaaccaccaggccctgcagcagagccccctggtgggcggcggcattgatgctgtgctgaccagcgcccaccccaacctgcccagcgtgcccctgccccaggaccccatgaggccccggcagccccaggtgcggcagcagcagaggctgctgcagatgcagcagccccagcagccccagccccagcagcccccccagccccagcagagcagccagagccagagccagaccctgggcctgcaggccatgcagccccagcagcccctcttcccccggcagggcctgcagcagacccagcagcagcagcagacagctgccctggtgcggcagctgcagaagcagctgagcagcaaccagccccagcagggcgtgaccccctacggccaccccagccacttctag

SEQ ID NO: 159006 - DNA, 6522 bp, Artificial Sequence
  Description of Artificial Sequence: Synthetic coding sequence
atgtctgccagctttgtgcccaacggggccagcctggaggactgccactgcaacctcttctgcctggccgacctgaccggcatcaagtggaagaagtatgtgtggcagggccccaccagcgcccccatcctcttccctgtgacagaggaggaccccatcctgagcagcttcagccgctgcctgaaggcagatgtgctgggcgtgtggaggcgggaccagaggcctggaagaagagagctgtggatcttctggtggggagaagatcctgtgctgctgaccctcttcaccatgacctaccagaagaagaagatggagtgtggccgcatggacttccccatgaatgctgtgctgtgcttccaggccgtgcacaacctgctggagcgctgcctgatgaacagaaactttgtgcgcatcggcaagtggtttgtgaagccctatgagaaggatgagaagcccatcaacaagtctgagcacctgagctgcagcttcaccttcttcctgcacggggacagcaatgtgtgcacctctgtggagatcaaccagcaccagcctgtgtacctgctgtctgaggagcacatcaccctggcccagcagagcaacagccccttccaggtgatcctgtgccccttcggcctgaatggcaccctgaccggccaggccttcaagatgtctgacagcgccaccaagaagctgattggagagtggaagcagttctaccccatcagctgctgcctgaaggagatgtctgaggagaagcaggaggacatggactgggaggatgacagcctggccgctgtggaggtgctggtggccggcgtgaggatgatctacccagcctgctttgtgctggtgccccagagcgacatccccacccccagccctgtgggcagcacccactgcagcagcagctgcctgggcgtgcaccaggtgcctgccagcacccgggaccctgccatgagctctgtgaccctgaccccacccaccagccctgaggaggtgcagacagtggacccccagagcgtgcagaagtgggtgaagttcagctctgtgtctgatggcttcaacagcgacagcaccagccaccacggcggcaagatccccaggaagctggccaaccacgtggtggacagagtgtggcaggagtgcaacatgaacagagcccagaacaagaggaagtacagcgccagcagcggcggcctgtgtgaggaggccacagctgccaaggtggcctcctgggactttgtggaggccacccagaggaccaactgcagctgcctgcggcacaagaacctgaagagcagaaatgccggccagcagggccaggcccccagcctgggccagcagcagcagatcctgcccaagcacaagaccaatgagaagcaggagaagtctgagaagccccagaagaggcccctgacccccttccaccaccgggtgtctgtgtctgatgatgtgggcatggatgctgacagcgccagccagaggctggtgatcagcgccccagacagccaggtgcgcttcagcaacatccgcaccaatgatgtggccaagaccccccagatgcacggcacagagatggccaacagcccccagcccccacccctgagcccccacccctgtgatgtggtggatgagggcgtgaccaagacccccagcaccccccagagccagcacttctaccagatgcccaccccagaccccctggtgcccagcaagcccatggaggacagaattgacagcctgagccagagcttccccccccagtaccaggaggccgtggagcccaccgtgtatgtgggcacagctgtgaacctggaggaggatgaggccaacatcgcctggaagtactacaagttccccaagaagaaggatgtggagttcctgcccccccagctgcccagcgacaagttcaaggatgatcctgtgggccccttcggccaggagagcgtgacctctgtgacagagctgatggtgcagtgcaagaagcccctgaaggtgtctgatgagctggtgcagcagtaccagatcaagaaccagtgcctgagcgccatcgccagtgatgctgagcaggagcccaagattgacccctatgcctttgtggagggagatgaggagttcctgttcccagacaagaaggaccggcagaacagcgagcgggaggccggcaagaagcacaaggtggaggatggcaccagctctgtgacagtgctgagccatgaagaagatgccatgagcctcttcagccccagcatcaagcaggatgccccccggcccaccagccacgcccggccccccagcaccagcctcatctatgacagcgacctggccgtgtcctacacagacctggacaacctcttcaacagtgatgaagatgagctgaccccaggcagcaagaagagcgccaacggcagtgatgacaaggccagctgcaaggagagcaagacaggcaacctggaccccctgagctgcatcagcacagctgacctgcacaagatgtaccccaccccacccagcctggagcagcacatcatgggcttcagccccatgaacatgaacaacaaggagtatggctccatggacaccaccccaggcggcaccgtgctggagggcaacagcagcagcattggagcccagttcaagattgaggtggatgagggcttctgcagccccaagcccagcgagatcaaggacttctcctatgtgtacaagccagagaactgccagatcctggtgggctgcagcatgtttgcccccctgaagaccctgcccagccagtacctgccccccatcaagctgcctgaggagtgcatctaccggcagagctggacagtgggcaagctggagctgctgagcagcggccccagcatgcccttcatcaaggagggagatggcagcaacatggaccaggagtatggaacagcctacaccccccagacccacaccagctttggcatgccacccagcagcgccccacccagcaacagcggggccggcatcctgcccagccccagcaccccccgcttccccacccccaggacccccaggacccccaggaccccaagaggagctgggggccctgccagcgcccagggctctgtgaagtatgagaacagcgacctgtacagccctgccagcacccccagcacctgccggcccctgaacagcgtggagcccgccaccgtgcccagcatccctgaggcccacagcctgtatgtgaacctgatcctgtctgagagcgtgatgaacctcttcaaggactgcaactttgacagctgctgcatctgtgtgtgcaacatgaacatcaagggagcagatgtgggcgtgtacatcccagaccccacccaggaggcccagtaccgctgcacctgtggcttctctgctgtgatgaacaggaagtttggaaacaacagcggcctcttcctggaggatgagctggacatcatcggcaggaacacagactgtgggaaggaggccgagaagagatttgaggccctgcgggccaccagcgctgagcacgtgaatggaggcctgaaggagagcgagaagctgagtgatgacctgatcctgctgctgcaggaccagtgcaccaacctcttcagcccctttggagctgctgaccaggaccccttccccaagtctggagtcatcagcaactgggtgcgggtggaggagcgggactgctgcaatgactgctacctggccctggagcacggccggcagttcatggacaacatgtctgggggcaaggtggatgaggccctggtgaagagcagctgcctgcacccctggagcaagagaaatgatgtgtccatgcagtgcagccaggacatcctgaggatgctgctgagcctgcagcctgtgctgcaggatgccatccagaagaagaggacagtgcggccctggggcgtgcagggccccctgacctggcagcagttccacaagatggccggccggggcagctatggaacagatgagagccctgagcccctgcccatccccaccttcctgctgggctatgactatgactacctggtgctgagcccctttgccctgccctactgggagcggctgatgctggagccctacggcagccagagggacatcgcctacgtggtgctgtgcccagaaaatgaggccctgctgaatggagccaagagcttcttccgggacctgacagccatctatgagagctgccgcctgggccagcacaggcctgtgtcccggctgctgacagatggcatcatgagggtgggcagcacagccagcaagaagctgtctgagaagctggtggccgagtggttcagccaggccgcagatggcaacaatgaggccttcagcaagctgaagctgtatgcccaggtgtgccgctatgacctgggcccctacctggccagcctgcccctggacagcagcctgctgagccagcccaacctggtggcccccaccagccagagcctcatcaccccaccccagatgaccaacacaggaaatgccaacacccccagcgccaccctggccagcgctgccagcagcaccatgacagtgaccagcggcgtggccatcagcacctctgtggccacagccaacagcaccctgaccacagccagcaccagcagcagcagcagcagcaacctgaacagcggcgtgagcagcaacaagctgcccagcttcccccccttcggctccatgaacagcaatgctgctggctccatgagcacccaggccaacacagtgcagagcggccagctgggcggccagcagaccagcgccctgcagacagctggcatctctggagagagcagcagcctgcccacccagccccacccagatgtgtctgagagcaccatggaccgggacaaggtgggcatccccacagatggagacagccatgctgtgacctaccccccagccatcgtggtgtacatcatcgaccccttcacctatgaaaatacagatgagagcaccaacagcagctctgtgtggaccctgggcctgctgcgctgcttcctggagatggtgcagaccctgcccccccacatcaagagcacagtgtctgtgcagatcatcccctgccagtacctgctgcagcctgtgaagcatgaagatcgggagatctacccccagcacctgaagagcctggccttcagcgccttcacccagtgccggcggcccctgcccaccagcaccaacgtgaagaccctgactggatttggacctggcctggccatggagacagccctgcggagcccagacaggcctgagtgcatccggctgtatgccccacccttcatcctggcccctgtgaaggacaagcagacagagctgggggagacctttggagaggccggccagaagtacaacgtgctgtttgtgggctactgcctgagccatgaccagcgctggatcctggccagctgcacagacctgtatggagagctgctggagacctgcatcatcaacattgatgtgcccaacagagcccggaggaagaagagcagcgccaggaagtttggcctgcagaagctgtgggagtggtgcctgggcctggtgcagatgagcagcctgccctggagggtggtgattggccgcctgggcagaattggacatggagagctgaaggactggagctgcctgctgagcagaagaaacctgcagagcctgagcaagaggctgaaggacatgtgcaggatgtgtggcatctctgctgctgacagccccagcatcctgagcgcctgcctggtggccatggagccccagggcagctttgtgatcatgccagacagcgtgtccactggatctgtgtttggccgcagcaccaccctgaacatgcagaccagccagctgaacaccccccaggacaccagctgcacccacatcctggtgttccccaccagcgcctctgtgcaggtggccagcgccacctacaccacagagaacctggacctggccttcaaccccaacaatgatggagcagatggcatgggcatctttgacctgctggacacaggagatgacctggaccctgacatcatcaacatcctgcctgccagccccaccggcagccctgtgcacagccctggcagccactacccccacggcggagatgctgggaagggccagagcacagaccggctgctgagcacagagccccatgaggaggtgcccaacatcctgcagcagcccctggccctgggctactttgtgtccacagccaaggccggccccctgcctgactggttctggagcgcctgcccccaggcccagtaccagtgccccctcttcctgaaggccagcctgcacctgcacgtgcccagcgtgcagagtgatgagctgctgcacagcaagcacagccaccccctggacagcaaccagaccagtgatgtgctgcgctttgtgctggagcagtacaatgccctgtcctggctgacctgtgaccctgccacccaggacagaagaagctgcctgcccatccactttgtggtgctgaaccagctgtacaacttcatcatgaacatgctgtag

SEQ ID NO: 159007 - DNA, 6525 bp, Artificial Sequence
  Description of Artificial Sequence: Synthetic coding sequence
atgtctgccagctttgtgcccaacggggccagcctggaggactgccactgcaacctcttctgcctggccgacctgaccggcatcaagtggaagaagtatgtgtggcagggccccaccagcgcccccatcctcttccctgtgacagaggaggaccccatcctgagcagcttcagccgctgcctgaaggcagatgtgctgggcgtgtggaggcgggaccagaggcctggaagaagagagctgtggatcttctggtggggcgaggaccccagctttgctgacctgatccaccacgacctgtctgaggaggaggatggagtgtgggagaatggcctgtcctatgagtgcaggaccctgctcttcaaggctgtgcacaacctgctggagcgctgcctgatgaacagaaactttgtgagaattggcaagtggtttgtgaagccctatgagaaggatgagaagcccatcaacaagtctgagcacctgagctgcagcttcaccttcttcctgcatggagacagcaatgtgtgcacctctgtggagatcaaccagcaccagcctgtgtacctgctgtctgaggagcacatcaccctggcccagcagagcaacagccccttccaggtgatcctgtgccccttcggcctgaatggcaccctgaccggccaggccttcaagatgtctgattctgccaccaagaagctgattggagagtggaagcagttctaccccatcagctgctgcctgaaggagatgtctgaggagaagcaggaggacatggactgggaggatgacagcctggccgctgtggaggtgctggtggccggcgtgaggatgatctacccagcctgctttgtgctggtgccccagagcgacatccccacccccagccctgtgggcagcacccactgcagcagcagctgcctgggcgtgcaccaggtgcctgccagcacccgggaccctgccatgagctctgtgaccctgaccccacccaccagccctgaggaggtgcagacagtggacccccagagcgtgcagaagtgggtgaagttcagctctgtgtctgatggcttcaacagcgacagcaccagccaccacggcggcaagatccccaggaagctggccaaccacgtggtggacagagtgtggcaggagtgcaacatgaacagagcccagaacaagaggaagtacagcgccagcagcggcggcctgtgtgaggaggccacagctgccaaggtggcctcctgggactttgtggaggccacccagaggaccaactgcagctgcctgcggcacaagaacctgaagagcagaaatgccggccagcagggccaggcccccagcctgggccagcagcagcagatcctgcccaagcacaagaccaatgagaagcaggagaagtctgagaagccccagaagaggcccctgacccccttccaccaccgggtgtctgtgtctgatgatgtgggcatggatgctgacagcgccagccagaggctggtgatcagcgccccagacagccaggtgcgcttcagcaacatccgcaccaatgatgtggccaagaccccccagatgcatggaacagagatggccaacagcccccagcccccacccctgagcccccacccctgtgatgtggtggatgaaggagtgaccaagacccccagcaccccccagagccagcacttctaccagatgcccaccccagaccccctggtgcccagcaagcccatggaggacagaattgacagcctgagccagagcttccccccccagtaccaggaggccgtggagcccaccgtgtatgtgggcacagctgtgaacctggaggaggatgaggccaacatcgcctggaagtactacaagttccccaagaagaaggatgtggagttcctgcccccccagctgcccagcgacaagttcaaggatgatcctgtgggccccttcggccaggagagcgtgacctctgtgacagagctgatggtgcagtgcaagaagcccctgaaggtgtctgatgagctggtgcagcagtaccagatcaagaaccagtgcctgagcgccatcgccagtgatgctgagcaggagcccaagattgacccctatgcctttgtggagggagatgaggagttcctgttcccagacaagaaggaccggcagaacagcgagcgggaggccggcaagaagcacaaggtggaggatggcaccagctctgtgacagtgctgagccatgaggaggatgccatgagcctcttcagccccagcatcaagcaggatgccccccggcccaccagccacgcccggccccccagcaccagcctcatctatgacagcgacctggccgtgtcctacacagacctggacaacctcttcaacagtgatgaagatgagctgaccccaggcagcaagaagagcgccaatggaagtgatgacaaggccagctgcaaggagagcaagacaggcaacctggaccccctgagctgcatcagcacagctgacctgcacaagatgtaccccaccccacccagcctggagcagcacatcatgggcttcagccccatgaacatgaacaacaaggagtatggctccatggacaccacccctgggggcaccgtgctggagggcaacagcagcagcatcggggcccagttcaagattgaggtggatgagggcttctgcagccccaagcccagcgagatcaaggacttctcctatgtgtacaagccagagaactgccagatcctggtgggctgcagcatgtttgcccccctgaagaccctgcccagccagtacctgccccccatcaagctgcctgaggagtgcatctaccggcagagctggacagtgggcaagctggagctgctgagcagcggccccagcatgcccttcatcaaggagggagatggcagcaacatggaccaggagtatggaacagcctacaccccccagacccacaccagctttggcatgccacccagcagcgccccacccagcaacagcggggccggcatcctgcccagccccagcaccccccgcttccccacccccaggacccccaggacccccaggacccccaggggggccggcggccctgccagcgcccagggctctgtgaagtatgaaaattctgacctgtacagccctgccagcacccccagcacctgccggcccctgaacagcgtggagcccgccaccgtgcccagcatccctgaggcccacagcctgtatgtgaacctgatcctgtctgagagcgtgatgaacctcttcaaggactgcaactttgacagctgctgcatctgtgtgtgcaacatgaacatcaagggagcagatgtgggcgtgtacatcccagaccccacccaggaggcccagtaccgctgcacctgtggcttctctgctgtgatgaacaggaagtttggaaacaacagcggcctcttcctggaggatgagctggacatcattggaagaaacacagactgtgggaaggaggccgagaagagatttgaggccctgcgggccaccagcgctgagcacgtgaatggaggcctgaaggagagcgagaagctgagtgatgacctgatcctgctgctgcaggaccagtgcaccaacctcttcagcccctttggagctgctgaccaggaccccttccccaagagcggggtcatcagcaactgggtgcgggtggaggagcgggactgctgcaatgactgctacctggccctggagcacggccggcagttcatggacaacatgtctgggggcaaggtggatgaggccctggtgaagagcagctgcctgcacccctggagcaagagaaatgatgtgtccatgcagtgcagccaggacatcctgaggatgctgctgagcctgcagcctgtgctgcaggatgccatccagaagaagaggacagtgcggccctggggcgtgcagggccccctgacctggcagcagttccacaagatggccggccggggcagctatggaacagatgagagccctgagcccctgcccatccccaccttcctgctgggctatgactatgactacctggtgctgagcccctttgccctgccctactgggagcggctgatgctggagccctacggcagccagagggacatcgcctacgtggtgctgtgcccagaaaatgaggccctgctgaatggagccaagagcttcttccgggacctgacagccatctatgagagctgccgcctgggccagcacaggcctgtgtcccggctgctgacagatggcatcatgagggtgggcagcacagccagcaagaagctgtctgagaagctggtggccgagtggttcagccaggccgcagatggcaacaatgaggccttcagcaagctgaagctgtatgcccaggtgtgccgctatgacctgggcccctacctggccagcctgcccctggacagcagcctgctgagccagcccaacctggtggcccccaccagccagagcctcatcaccccaccccagatgaccaacacaggaaatgccaacaccccatctgccaccctggccagcgctgccagcagcaccatgacagtgaccagcggcgtggccatcagcacctctgtggccacagccaacagcaccctgaccacagccagcaccagcagcagcagcagcagcaacctgaacagcggcgtgagcagcaacaagctgcccagcttccccccatttggctccatgaacagcaatgctgctggctccatgagcacccaggccaacacagtgcagagcggccagctgggcggccagcagaccagcgccctgcagacagctggcatcagcggggagagcagcagcctgcccacccagccccacccagatgtgtctgagagcaccatggaccgggacaaggtgggcatccccacagatggagacagccatgctgtgacctaccccccagccatcgtggtgtacatcatcgaccccttcacctatgagaacacagatgagagcaccaacagcagctctgtgtggaccctgggcctgctgcgctgcttcctggagatggtgcagaccctgcccccccacatcaagagcacagtgtctgtgcagatcatcccctgccagtacctgctgcagcctgtgaagcatgaggaccgggagatctacccccagcacctgaagagcctggccttcagcgccttcacccagtgcagaagacccctgcccaccagcaccaacgtgaagaccctgaccggcttcggccctggcctggccatggagacagccctgcggagcccagacaggcctgagtgcatccggctgtatgccccacccttcatcctggcccctgtgaaggacaagcagacagagctgggggagaccttcggggaggccggccagaagtacaacgtgctgtttgtgggctactgcctgagccatgaccagcgctggatcctggccagctgcacagacctgtatggagagctgctggagacctgcatcatcaacattgatgtgcccaacagagcccggaggaagaagagcagcgccaggaagtttggcctgcagaagctgtgggagtggtgcctgggcctggtgcagatgagcagcctgccctggagggtggtgattggccgcctgggccgcatcggccacggggagctgaaggactggagctgcctgctgagcagaagaaacctgcagagcctgagcaagaggctgaaggacatgtgcaggatgtgtggcatctctgctgctgacagccccagcatcctgagcgcctgcctggtggccatggagccccagggcagctttgtgatcatgccagattctgtgtccacaggctctgtgtttggccgcagcaccaccctgaacatgcagaccagccagctgaacaccccccaggacaccagctgcacccacatcctggtgttccccaccagcgcctctgtgcaggtggccagcgccacctacaccacagagaacctggacctggccttcaaccccaacaatgatggagcagatggcatgggcatctttgacctgctggacacaggagatgacctggaccctgacatcatcaacatcctgcctgccagccccaccggcagccctgtgcacagccctggcagccactacccccatggaggagatgctgggaagggccagagcacagaccggctgctgagcacagagccccatgaggaggtgcccaacatcctgcagcagcccctggccctgggctactttgtgtccacagccaaggccggccccctgcctgactggttctggagcgcctgcccccaggcccagtaccagtgccccctcttcctgaaggccagcctgcacctgcacgtgcccagcgtgcagagtgatgagctgctgcacagcaagcacagccaccccctggacagcaaccagaccagtgatgtgctgcgctttgtgctggagcagtacaatgccctgtcctggctgacctgtgaccctgccacccaggaccggcgcagctgcctgcccatccactttgtggtgctgaaccagctgtacaacttcatcatgaacatgctgtag

SEQ ID NO: 159008 - DNA, 6633 bp, Artificial Sequence
  Description of Artificial Sequence: Synthetic coding sequence
atgacagctgctgccaactgggtggccaacggggccagcctggaggactgccacagcaacctcttcagcctggccgagctgaccggcatcaagtggaggcgctacaactttggaggccacggggactgtggccccatcatcagcgccccagcccaggatgaccccatcctgctgtccttcatccgctgcctgcaggccaacctgctgtgtgtgtggaggagagatgtgaagccagactgcaaggagctgtggatcttctggtggggagatgagcccaacctggtgggcgtcatccaccacgagctgcaggtggtggaggagggcctgtgggagaatggcctgtcctatgaatgtaggaccctgctcttcaaggccatccacaacctgctggagcgctgcctgatggacaagaactttgtgcgcatcggcaagtggtttgtgcggccctatgagaaggatgagaagcctgtgaacaagtctgagcacctgagctgtgccttcaccttcttcctgcacggggagagcaatgtgtgcacctctgtggagatcgcccagcaccagcccatctacctgatcaatgaggagcacatccacatggcccagagcagccctgcccccttccaggtgctggtgagcccctacggcctgaatggcaccctgaccggccaggcctacaagatgtctgaccctgccaccaggaagctgattgaggagtggcagtacttctaccccatggtgctgaagaagaaggaggagagcaaggaggaggatgagctgggctatgatgatgacttccctgtggccgtggaggtgattgtgggcggcgtgaggatggtgtaccccagcgcctttgtgctgatcagccagaatgacatccctgtgccccagagcgtggccagcgctgggggccacatcgctgtgggccagcagggcctgggctctgtgaaggaccccagcaactgtggcatgcccctgaccccacccaccagccctgagcaggccatcctgggggagagcggcggcatgcagagcgctgccagccacctggtgtcccaggacggcggcatgatcaccatgcacagccccaagaggtctgggaagatcccccccaagctgcacaaccacatggtgcaccgggtgtggaaggagtgcatcctgaacagaacccagagcaagaggagccagatgagcacccccaccctggaggaggagcccgccagcaacccagccacctgggactttgtggaccccacccagagggtgtcctgcagctgcagccgccacaagctgctgaagagatgtgctgtgggccccaacagaccacccaccgtgtcccagcccggcttctctgctggccccagcagcagcagcagcctgcccccaccagccagcagcaagcacaagacagctgagcggcaggagaagggggacaagctgcagaagaggcccctcatccccttccaccaccggcccagcgtggccgaggagctgtgcatggagcaggacaccccaggccagaagctgggcctggccggcatcgacagcagcctggaggtgagcagcagcaggaaatatgacaagcagatggctgtgcccagcaggaacaccagcaagcagatgaacctgaaccccatggacagcccccacagccccatcagccccctgccccccaccctgagcccccagccccggggccaggagacagagagcctggaccccccatctgtgcctgtgaacccagccctgtatggaaatggcctggagctgcagcagctgagcaccctggatgacagaacagtgctggtgggccagaggctgcccctgatggccgaggtgtctgaaacagccctgtactgcggcatccggcccagcaaccctgagagcagcgagaagtggtggcacagctaccgcctgcccccatctgatgatgctgagttccggcccccagagctgcagggcgagcgctgtgatgccaagatggaggtgaacagcgagagcacagccctgcagaggctgctggcccagcccaacaagcgcttcaagatctggcaggacaagcagccccagctgcagcccctgcacttcctggaccccctgcccctgagccagcagcccggggacagcctgggggaggtgaatgacccctacacctttgaagatggagacatcaagtacatcttcaccgccaacaagaagtgcaagcagggcacagagaaggacagcctgaagaagaacaagtcagaagatggcttcggcaccaaggatgtgaccaccccaggccacagcacccctgtgcctgatggcaagaatgccatgagcatcttcagcagcgccaccaagacagatgtgcggcaggacaatgctgctggccgggccggcagcagcagcctgacccaggtgacagacctggcccccagcctgcatgacctggacaacatctttgacaacagtgatgatgatgagctgggcgctgtgtccccagccctgcggagcagcaagatgcctgctgtgggcacagaggaccggcccctgggcaaggatggccgggctgctgtgccctacccacccaccgtggccgacctgcagaggatgttccccaccccacccagcctggagcagcacccagccttcagccctgtgatgaactacaaggatggcatcagcagcgagaccgtgacagccctgggcatgatggagagccccatggtgtccatggtgtccacccagctgacagagttcaagatggaggtggaggatggcctgggcagccccaagccagaggagatcaaggacttctcctatgtgcacaaggtgcccagcttccagccctttgtgggcagctccatgtttgcccccctgaagatgctgcccagccactgcctgctgcccctgaagatcccagatgcctgcctcttccggcccagctgggccatcccccccaagattgagcagctgcccatgcccccagctgccaccttcatcagagatggctacaacaacgtgcccagcgtgggcagcctggccgaccctgactacctgaacaccccccagatgaacacccctgtgaccctgaacagcgctgccccagccagcaacagcggggccggcgtgctgcccagccctgccaccccccgcttctctgtgcccacccccaggacccccaggacccccaggaccccccggggcggcggcacagccagcggccagggctctgtgaagtatgacagcacagaccagggcagccctgccagcacccccagcaccacccggcccctgaacagcgtggagcccgccaccatgcagcccatccctgaggcccacagcctgtatgtgaccctcatcctgagtgacagcgtgatgaacatcttcaaggacaggaactttgacagctgctgcatctgtgcctgcaacatgaacatcaagggagcagatgtgggcctgtacatcccagacagcagcaatgaagaccagtaccgctgcacctgtggcttcagcgccatcatgaacaggaagctgggctacaacagcggcctcttcctggaggatgagctggacatctttgggaagaacagcgacatcggccaggccgctgagcggcggctgatgatgtgccagagcaccttcctgccccaggtggagggcaccaagaagccccaggagccccccatcagcctgctgctgctgctgcagaaccagcacacccagccctttgccagcctgaacttcctggactacatcagcagcaacaaccggcagaccctgccctgtgtgtcctggagctatgacagagtgcaggccgacaacaatgactactggacagagtgcttcaatgccctggagcagggccggcagtatgtggacaaccccaccggcggcaaggtggatgaggccctggtgcgcagcgccaccgtgcacagctggccccacagcaatgtgctggacatctccatgctgagcagccaggatgtggtgaggatgctgctgagcctgcagcccttcctgcaggatgccatccagaagaagaggactggaagaacctgggagaacatccagcacgtgcagggccccctgacctggcagcagttccacaagatggccggccggggcacctacggcagcgaggagagccctgagcccctgcccatccccaccctgctggtgggctatgacaaggacttcctgaccatcagccccttcagcctgcccttctgggagcggctgctgctggacccctacggcggccacagagatgtggcctacatcgtggtgtgcccagaaaatgaggccctgctggagggcgccaagaccttcttccgggacctgtctgctgtgtatgagatgtgccgcctgggccagcacaagcccatctgcaaggtgctgagagatggcatcatgagggtgggcaagacagtggcccagaagctgacagatgagctggtgtctgagtggttcaaccagccctggagcggggaggagaatgacaaccacagccggctgaagctgtatgcccaggtgtgccgccaccacctggccccctacctggccaccctgcagctggacagcagcctgctgatcccccccaagtaccagaccccacctgctgctgcccagggccaggccaccccaggaaatgccggccccctggccccaaatggatctgctgcccccccagctggcagcgccttcaaccccaccagcaacagcagcagcaccaacccagctgccagcagcagcgccagcggcagctctgtgccccctgtgagcagcagcgccagcgcccctggcatcagccagatcagcaccaccagcagcagcggcttcagcggctctgtgggcggccagaaccccagcactggaggcatctctgctgacaggacccagggcaacatcggctgcggcggggacacagaccccggccagagcagcagccagcccagccaggacggccaggagagcgtgacagagcgggagagaattggcatccccacagagccagattctgctgacagccacgcccaccccccagctgtggtgatctacatggtggaccccttcacctacgccgctgaggaggacagcaccagcggcaacttctggctgctgagcctgatgcgctgctacacagagatgctggacaacctgcctgagcacatgagaaattccttcatcctgcagatcgtgccctgccagtacatgctgcagaccatgaaggatgagcaggtgttctacatccagtacctgaagtccatggccttctctgtgtactgccagtgcagaagacccctgcccacccagatccacatcaagagcctgaccggcttcggccctgctgccagcattgagatgaccctgaagaaccctgagcggcccagccccatccagctgtacagcccccccttcatcctggcccccatcaaggacaagcagacagagctgggggagaccttcggggaggccagccagaagtacaacgtgctgtttgtgggctactgcctgagccatgaccagcgctggctgctggccagctgcacagacctgcatggagagctgctggagacctgtgtggtgaacatcgccctgcccaacagaagcagaagaagcaaggtgtctgccaggaagattggcctgcagaagctgtgggagtggtgcatcggcatcgtgcagatgaccagcctgccctggagggtggtgattggccgcctgggccgcctgggccacggggagctgaaggactggagcatcctgctgggggagtgcagcctgcagaccatcagcaagaagctgaaggatgtgtgcaggatgtgtggcatctctgctgctgacagccccagcatcctgagcgcctgcctggtggccatggagccccagggcagctttgtggtgatgccagatgctgtgaccatgggctctgtgtttggccgcagcacagccctgaacatgcagagcagccagctgaacaccccccaggatgccagctgcacccacatcctggtgttccccaccagcagcaccatccaggtggccccagccaactacccaaatgaagatggcttcagccccaacaatgatgacatgtttgtggacctgcccttcccagatgacatggacaatgacatcggcatcctgatgacaggcaacctgcacagcagccccaacagcagccctgtgcccagccctggcagccccagcggcattggagtgggcagccacttccagcacagccgcagccagggcgagcggctgctgagccgggaggcccctgaggagctgaagcagcagcccctggccctgggctactttgtgtccacagccaaggccgagaacctgccccagtggttctggagcagctgcccccaggcccagaaccagtgccccctcttcctgaaggccagcctgcaccaccacatctctgtggcccagacagatgagctgctgcctgccaggaacagccagagggtgccccaccccctggacagcaagaccaccagtgatgtgctgcgctttgtgctggagcagtacaatgccctgtcctggctgacctgcaacccagccacccaggacaggaccagctgcctgcctgtgcactttgtggtgctgacccagctgtacaatgccatcatgaacatcctgtag

SEQ ID NO: 159009 - DNA, 4365 bp, Artificial Sequence
  Description of Artificial Sequence: Synthetic coding sequence
atggcccctgtgcagctggagaaccaccagctggtgcccccaggcggcggcggcggcggcagcggcggcccccccagcgccccagcccctcctcctcctggagctgctgtggccgctgctgctgctgctgctgccagccctggctaccgcctgagcaccctgattgagttcctgctgcaccgggcctacagcgagctgatggtgctgacagacctgctgcccaggaagagtgatgtggagaggaagattgaaattgtgcagtttgccagcaggacccggcagctgtttgtgcggctgctggccctggtgaagtgggccaacaatgccggcaaggtggagaagtgtgccatgatcagcagcttcctggaccagcaggccatcctgtttgtggacacagctgaccggctggccagcctggccagagatgccctggtgcacgcccggctgcccagctttgccatcccctatgccattgatgtgctgaccaccggcagctacccccggctgcccacctgcatccgggacaagatcatccccccagaccccatcaccaagattgagaagcaggccaccctgcaccagctgaaccagatcctgcggcaccggctggtgaccacagacctgcccccccagctggccaacctgactgtggccaacggccgggtgaagttccgggtggagggggagtttgaggccaccctgactgtgatgggagatgatcctgatgtgccctggaggctgctgaagctggagatcctggtggaggacaaggagactggagatggccgggccctggtgcacagcatgcagatctccttcatccaccagctggtgcagagccggctgtttgctgatgagaagcccctgcaggacatgtacaactgcctgcacagcttctgcctgagcctgcagctggaggtgctgcacagccagaccctgatgctgatccgggagcgctggggagacctggtgcaggtggagcgctaccacgccggcaagtgcctgagcctgtctgtgtggaaccagcaggtgctgggcaggaagacaggaacagcctctgtgcacaaggtgaccatcaagattgatgaaaatgatgtgtccaagcccctgcagatcttccatgacccccccctgcctgccagtgacagcaagctggtggagcgggccatgaagattgaccacctgagcattgagaagctgctgattgacagcgtgcacgcccgggcccaccagaagctgcaggagctgaaggccatcctgcggggcttcaatgccaatgaaaacagcagcattgaaacagccctgcctgccctggtggtgcccatcctggagccctgtggcaacagcgagtgcctgcacatctttgtggacctgcacagcggcatgttccagctgatgctgtatggcctggaccaggccaccctggatgacatggagaagtctgtgaatgatgacatgaagaggatcatcccctggatccagcagctgaagttctggctgggccagcagcgctgcaagcagagcatcaagcacctgcccaccatcagcagcgagaccctgcagctgagcaactacagcacccaccccatcggcaacctgagcaagaacaagctgttcatcaagctgacccggctgccccagtactacatcgtggtggagatgctggaggtgcccaacaagcccacccagctgagctacaagtactacttcatgtctgtgaatgctgctgaccgggaggacagccctgccatggccctgctgctgcagcagttcaaggagaacatccaggacctggtgttccgcaccaagacaggcaagcagaccaggaccaatgccaagaggaagctgagtgatgacccctgccctgtggagagcaagaagaccaagagagctggggagatgtgtgccttcaacaaggtgctggcccactttgtggccatgtgtgacaccaacatgccctttgtgggcctgcggctggagctgagcaacctggagatcccccaccagggcgtgcaggtggagggagatggcttcagccacgccatccggctgctgaagatccccccctgcaagggcatcacagaggagacccagaaggccctggacaggagcctgctggactgcaccttccggctgcagggcaggaacaacagaacctgggtggccgagctggtgtttgccaactgccccctgaatggcaccagcacccgggagcagggccccagccgccacgtgtacctgacctatgagaacctgctgtctgagcctgtgggcggcaggaaggtggtggagatgttcctgaatgactggaacagcatcgcccggctgtatgaatgtgtgctggagtttgcccggagcctgcctgacatcccagcccacctgaacatcttcagcgaggtgcgggtgtacaactacaggaagctgatcctgtgctacggcaccaccaagggcagcagcatcagcatccagtggaacagcatccaccagaagttccacatcagcctgggcaccgtgggccccaacagcggctgcagcaactgccacaacaccatcctgcaccagctgcaggagatgttcaacaagacccccaacgtggtgcagctgctgcaggtgctgtttgacacccaggcccccctgaatgccatcaacaagctgcccaccgtgcccatgctgggcctgacccagaggaccaacacagcctaccagtgcttcagcatcctgccccagagcagcacccacatccggctggccttcaggaacatgtactgcatcgacatctactgccgcagccggggcgtggtggccatcagagatggagcctacagcctgtttgacaacagcaagctggtggagggcttctacccagcccctggcctgaagaccttcctgaacatgtttgtggacagcaaccaggatgccaggagaagatctgtgaatgaagatgacaacccccccagccccatcggcggggacatgatggacagcctcatcagccagctgcagcccccaccccagcagcagcccttccccaagcagcccggcaccagcggggcctaccccctgaccagcccccccaccagctaccacagcacagtgaaccagagccccagcatgatgcacacccagagccctggcaacctgcatgctgccagcagccccagcggggccctgcgggcccccagccctgccagctttgtgcccaccccaccacccagcagccacggcatcagcatcggccctggggccagctttgccagcccccacggcaccctggaccccagcagcccctacaccatggtgagccccagcggccgggccggcaactggccaggcagcccccaggtgtctggccccagccctgctgccaggatgcctggcatgagccctgccaaccccagcctgcacagccctgtgcctgatgccagccacagccccagggctggcaccagcagccagaccatgcccaccaacatgcccccacccaggaagctgccccagaggtcctgggccgccagcatccccaccatcctgacccacagcgccctgaacatcctgctgctgcccagccccaccccaggcctggtgcccggcctggccggcagctacctgtgcagccccctggagcgcttcctgggcagcgtcatcatgagaagacacctgcagaggatcatccagcaggagaccctgcagctgatcaacagcaatgaacctggggtcatcatgttcaagacagatgccctgaagtgccgggtggccctgagccccaagaccaaccagaccctgcagctgaaggtgaccccagaaaatgccggccagtggaagccagatgagctgcaggtgctggagaagttctttgagaccagggtggccggcccccccttcaaggccaacaccctcatcgccttcaccaagctgctgggcgcccccacccacatcctgcgggactgtgtgcacatcatgaagctggagctgttcccagaccaggccacccagctgaagtggaatgtgcagttctgcctgaccatccccccatctgccccacccatcgcccctcctggcaccccagctgtggtgctgaagagcaagatgctgttcttcctgcagctgacccagaagacctctgtgcccccccaggagcctgtgtccatcatcgtgcccatcatctatgacatggccagcggcaccacccagcaggccgacatcccccggcagcagaacagctctgtggccgcccccatgatggtgagcaacatcctgaagagatttgctgagatgaaccccccccggcagggcgagtgcaccatctttgctgctgtgcgggacctgatggccaacctgaccctgcccccaggcggccggccctag

SEQ ID NO: 159010 - DNA, 468 bp, Artificial Sequence
  Description of Artificial Sequence: Synthetic coding sequence
gtggccggcccccccttcaaggccaacaccctcatcgccttcaccaagctgctgggcgcccccacccacatcctgcgggactgtgtgcacatcatgaagctggagctgttcccagaccaggccacccagctgaagtggaatgtgcagttctgcctgaccatccccccatctgccccacccatcgcccctcctggcaccccagctgtggtgctgaagagcaagatgctgttcttcctgcagctgacccagaagacctctgtgcccccccaggagcctgtgtccatcatcgtgcccatcatctatgacatggccagcggcaccacccagcaggccgacatcccccggcagcagaacagctctgtggccgcccccatgatggtgagcaacatcctgaagagatttgctgagatgaaccccccccggcagggcagcatcaagggcaccggctgccccagcgacttcctgtag

SEQ ID NO: 159011 - DNA, 996 bp, Artificial Sequence
  Description of Artificial Sequence: Synthetic coding sequence
cccagcggccgggccggcaactggccaggcagcccccaggtgtctggccccagccctgctgccaggatgcctggcatgagccctgccaaccccagcctgcacagccctgtgcctgatgccagccacagcccccgggccggcaccagcagccagaccatgcccaccaacatgcccccacccaggaagctgccccagaggtcctgggccgccagcatccccaccatcctgacccacagcgccctgaacatcctgctgctgcccagccccaccccaggcctggtgcccggcctggccggcagctacctgtgcagccccctggagcgcttcctgggcagcgtcatcatgaggaggcacctgcagaggatcatccagcaggagaccctgcagctgatcaacagcaatgagcccggggtcatcatgttcaagacagatgccctgaagtgccgggtggccctgagccccaagaccaaccagaccctgcagctgaaggtgaccccagaaaatgccggccagtggaagccagatgagctgcaggtgctggagaagttctttgagaccagggtggccggcccccccttcaaggccaacaccctgattgccttcaccaagctgctgggcgcccccacccacatcctgcgggactgtgtgcacatcatgaagctggagctgttcccagaccaggccacccagctgaagtggaatgtgcagttctgcctgaccatcccccccagcgccccacccatcgcccctcctggcaccccagctgtggtgctgaagagcaagatgctgttcttcctgcagctgacccagaagacctctgtgcccccccaggagcctgtgtccatcatcgtgcccatcatctatgacatggccagcggcaccacccagcaggccgacatcccccggcagcagaacagctctgtggccgcccccatgatggtgagcaacatcctgaagagatttgctgagatgaaccccccccggcagggcacctag

SEQ ID NO: 159012 - DNA, 2367 bp, Artificial Sequence
  Description of Artificial Sequence: Synthetic coding sequence
atggatgtgtctggccaggagacagactggaggagcacagccttccggcagaagctggtgtcccagattgaagatgccatgaggaaggccggcgtggcccacagcaagagcagcaaggacatggagagccacgtgttcctgaaggccaagaccagagatgagtacctgagcctggtggcccggctcatcatccacttccgggacatccacaacaagaagagccaggcctctgtgtctgaccccatgaatgccctgcagagcctgactggaggccctgctgctggagctgctggcatcggcatgccaccccggggccctggccagagcctgggcggcatgggcagcctgggcgccatgggccagcccatgagcctgagcggccagcccccacctggcaccagcggcatggccccccacagcatggctgtggtgtccacagccaccccccagacccagctgcagctgcagcaggtggccctgcagcagcagcagcagcagcagcagttccagcagcagcagcaggccgccctgcagcagcagcagcagcagcagcagcagcagcagttccaggcccagcagagcgccatgcagcagcagttccaggccgtggtgcagcagcagcagcagctgcagcagcagcagcagcagcagcagcacctgatcaagctgcaccaccagaaccagcagcagatccagcagcagcagcagcagctgcagagaattgcccagctgcagctgcagcagcagcagcagcagcagcagcagcagcagcagcagcagcagcaggccctgcaggcccagccccccatccagcagccccccatgcagcagccccagcccccacccagccaggccctgccccagcagctgcagcagatgcaccacacccagcaccaccagcccccaccccagccccagcagccccctgtggcccagaaccagcccagccagctgcccccccagagccagacccagcccctggtgtcccaggcccaggccctgcccggccagatgctgtacacccagccccccctgaagtttgtgcgggcccccatggtggtgcagcagccccctgtgcagccccaggtgcagcagcagcagacagctgtgcagacagcccaggccgcccagatggtggcccctggggtgcagatgatcacagaggccctggcccagggcggcatgcacatccgggcccgcttcccccccaccacagctgtgtctgccatccccagcagcagcatccccctgggccggcagcccatggcccaggtgtcccagagcagcctgcccatgctgagcagccccagccctggccagcaggtgcagaccccccagagcatgcctcctccaccccagcccagcccccagcccggccagcccagcagccagcccaacagcaatgtgagcagcggccctgcccccagccccagcagcttcctgcccagccccagcccccagcccagccagagccctgtgacagcccggaccccccagaacttctctgtgcccagccctggccccctgaacacccctgtgaaccccagctctgtgatgagccctgctggcagcagccaggccgaggagcagcagtacctggacaagctgaagcagctgagcaagtacatcgagcccctgcggaggatgatcaacaagattgacaagaatgaagacaggaagaaggacctgagcaagatgaagagcctgctggacatcctgacagaccccagcaagcgctgccccctgaagaccctgcagaagtgtgagatcgccctggagaagctgaagaatgacatggctgtgcccaccccacctcctcctcctgtgccccccaccaagcagcagtacctgtgccagcccctgctggatgctgtgctggccaacatccgcagccctgtgttcaaccacagcctgtaccgcacctttgtgcctgccatgacagccatccacggcccccccatcacagcccctgtggtgtgcaccaggaagaggcggctggaggatgatgagcggcagagcatccccagcgtgctgcagggcgaggtggcccggctggaccccaagttcctggtgaacctggaccccagccactgcagcaacaatggaacagtgcacctgatctgcaagctggatgacaaggacctgcccagcgtgccccccctggagctgtctgtgcctgctgactacccagcccagagccccctgtggattgaccggcagtggcagtatgatgccaaccccttcctgcagagcgtgcaccgctgcatgaccagccggctgctgcagctgcctgacaagcacagcgtgacagccctgctgaacacctgggcccagagcgtgcaccaggcctgcctgtctgctgcctag

SEQ ID NO: 159013 - DNA, 2247 bp, Artificial Sequence
  Description of Artificial Sequence: Synthetic coding sequence
atggatgtgtctggccaggagacagactggaggagcacagccttccggcagaagctggtgtcccagattgaagatgccatgaggaaggccggcgtggcccacagcaagagcagcaaggacatggagagccacgtgttcctgaaggccaagaccagagatgagtacctgagcctggtggcccggctcatcatccacttccgggacatccacaacaagaagagccaggcctctgtgtctgaccccatgaatgccctgcagagcctgactggaggccctgctgctggagctgctggcatcggcatgccaccccggggccctggccagagcctgggcggcatgggcagcctgggcgccatgggccagcccatgagcctgagcggccagcccccacctggcaccagcggcatggccccccacagcatggctgtggtgtccacagccaccccccagacccagctgcagctgcagcaggtggccctgcagcagcagcagcagcagcagcagttccagcagcagcagcaggccgccctgcagcagcagcagcagcagcagcagcagcagcagttccaggcccagcagagcgccatgcagcagcagttccaggccgtggtgcagcagcagcagcagctgcagcagcagcagcagcagcagcagcacctgatcaagctgcaccaccagaaccagcagcagatccagcagcagcagcagcagctgcagagaattgcccagctgcagctgcagcagcagcagcagcagcagcagcagcagcagcagcagcagcagcaggccctgcaggcccagccccccatccagcagccccccatgcagcagccccagcccccacccagccaggccctgccccagcagctgcagcagatgcaccacacccagcaccaccagcccccaccccagccccagcagccccctgtggcccagaaccagcccagccagctgcccccccagagccagacccagcccctggtgtcccaggcccaggccctgcccggccagatgctgtacacccagccccccctgaagtttgtgcgggcccccatggtggtgcagcagccccctgtgcagccccaggtgcagcagcagcagacagctgtgcagacagcccaggccgcccagatggtggcccctggggtgcaggtgtcccagagcagcctgcccatgctgagcagccccagccctggccagcaggtgcagaccccccagagcatgcctcctccaccccagcccagcccccagcccggccagcccagcagccagcccaacagcaatgtgagcagcggccctgcccccagccccagcagcttcctgcccagccccagcccccagcccagccagagccctgtgacagcccggaccccccagaacttctctgtgcccagccctggccccctgaacacccctgtgaaccccagctctgtgatgagccctgctggcagcagccaggccgaggagcagcagtacctggacaagctgaagcagctgagcaagtacatcgagcccctgcggaggatgatcaacaagattgacaagaatgaagacaggaagaaggacctgagcaagatgaagagcctgctggacatcctgacagaccccagcaagcgctgccccctgaagaccctgcagaagtgtgagatcgccctggagaagctgaagaatgacatggctgtgcccaccccacctcctcctcctgtgccccccaccaagcagcagtacctgtgccagcccctgctggatgctgtgctggccaacatccgcagccctgtgttcaaccacagcctgtaccgcacctttgtgcctgccatgacagccatccacggcccccccatcacagcccctgtggtgtgcaccaggaagaggcggctggaggatgatgagcggcagagcatccccagcgtgctgcagggcgaggtggcccggctggaccccaagttcctggtgaacctggaccccagccactgcagcaacaatggaacagtgcacctgatctgcaagctggatgacaaggacctgcccagcgtgccccccctggagctgtctgtgcctgctgactacccagcccagagccccctgtggattgaccggcagtggcagtatgatgccaaccccttcctgcagagcgtgcaccgctgcatgaccagccggctgctgcagctgcctgacaagcacagcgtgacagccctgctgaacacctgggcccagagcgtgcaccaggcctgcctgtctgctgcctag

SEQ ID NO: 159014 - DNA, 2034 bp, Artificial Sequence
  Description of Artificial Sequence: Synthetic coding sequence
atggatgtgtctggccaggagacagactggaggagcacagccttccggcagaagctggtgtcccagattgaagatgccatgaggaaggccggcgtggcccacagcaagagcagcaaggacatggagagccacgtgttcctgaaggccaagaccagagatgagtacctgagcctggtggcccggctcatcatccacttccgggacatccacaacaagaagagccaggcctctgtgtctgcccagctgcagctgcagcaggtggccctgcagcagcagcagcagcagcagcagttccagcagcagcagcaggccgccctgcagcagcagcagcagcagcagcagcagcagcagttccaggcccagcagagcgccatgcagcagcagttccaggccgtggtgcagcagcagcagcagctgcagcagcagcagcagcagcagcagcacctgatcaagctgcaccaccagaaccagcagcagatccagcagcagcagcagcagctgcagagaattgcccagctgcagctgcagcagcagcagcagcagcagcagcagcagcagcagcagcagcagcaggccctgcaggcccagccccccatccagcagccccccatgcagcagccccagcccccacccagccaggccctgccccagcagctgcagcagatgcaccacacccagcaccaccagcccccaccccagccccagcagccccctgtggcccagaaccagcccagccagctgcccccccagagccagacccagcccctggtgtcccaggcccaggccctgcccggccagatgctgtacacccagccccccctgaagtttgtgcgggcccccatggtggtgcagcagccccctgtgcagccccaggtgcagcagcagcagacagctgtgcagacagcccaggccgcccagatggtggcccctggggtgcaggtgtcccagagcagcctgcccatgctgagcagccccagccctggccagcaggtgcagaccccccagagcatgcctcctccaccccagcccagcccccagcccggccagcccagcagccagcccaacagcaatgtgagcagcggccctgcccccagccccagcagcttcctgcccagccccagcccccagcccagccagagccctgtgacagcccggaccccccagaacttctctgtgcccagccctggccccctgaacacccctgtgaaccccagctctgtgatgagccctgctggcagcagccaggccgaggagcagcagtacctggacaagctgaagcagctgagcaagtacatcgagcccctgcggaggatgatcaacaagattgacaagaatgaagacaggaagaaggacctgagcaagatgaagagcctgctggacatcctgacagaccccagcaagcgctgccccctgaagaccctgcagaagtgtgaaattgccctggagaagctgaagaatgacatggctgtgcccaccccacctcctcctcctgtgccccccaccaagcagcagtacctgtgccagcccctgctggatgctgtgctggccaacatccgcagccctgtgttcaaccacagcctgtaccgcacctttgtgcctgccatgacagccatccacggcccccccatcacagcccctgtggtgtgcaccaggaagaggcggctggaggatgatgagcggcagagcatccccagcgtgctgcagggcgaggtggcccggctggaccccaagttcctggtgaacctggaccccagccactgcagcaacaacggcaccgtgcacctgatctgcaagctggatgacaaggacctgcccagcgtgccccccctggagctgtctgtgcctgctgactacccagcccagagccccctgtggattgaccggcagtggcagtatgatgccaaccccttcctgcagagcgtgcaccgctgcatgaccagccggctgctgcagctgcctgacaagcacagcgtgacagccctgctgaacacctgggcccagagcgtgcaccaggcctgcctgtctgctgcctag

SEQ ID NO: 159015 - DNA, 2169 bp, Artificial Sequence
  Description of Artificial Sequence: Synthetic coding sequence
atgaggaaggccggcgtggcccacagcaagagcagcaaggacatggagagccacgtgttcctgaaggccaagaccagagatgagtacctgagcctggtggcccggctcatcatccacttccgggacatccacaacaagaagagccaggcctctgtgtctgaccccatgaatgccctgcagagcctgactggaggccctgctgctggagctgctggcatcggcatgccaccccggggccctggccagagcctgggcggcatgggcagcctgggcgccatgggccagcccatgagcctgagcggccagcccccacctggcaccagcggcatggccccccacagcatggctgtggtgtccacagccaccccccagacccagctgcagctgcagcaggtggccctgcagcagcagcagcagcagcagcagttccagcagcagcagcaggccgccctgcagcagcagcagcagcagcagcagcagcagcagttccaggcccagcagagcgccatgcagcagcagttccaggccgtggtgcagcagcagcagcagctgcagcagcagcagcagcagcagcagcacctgatcaagctgcaccaccagaaccagcagcagatccagcagcagcagcagcagctgcagagaattgcccagctgcagctgcagcagcagcagcagcagcagcagcagcagcagcagcagcagcagcaggccctgcaggcccagccccccatccagcagccccccatgcagcagccccagcccccacccagccaggccctgccccagcagctgcagcagatgcaccacacccagcaccaccagcccccaccccagccccagcagccccctgtggcccagaaccagcccagccagctgcccccccagagccagacccagcccctggtgtcccaggcccaggccctgcccggccagatgctgtacacccagccccccctgaagtttgtgcgggcccccatggtggtgcagcagccccctgtgcagccccaggtgcagcagcagcagacagctgtgcagacagcccaggccgcccagatggtggcccctggggtgcaggtgtcccagagcagcctgcccatgctgagcagccccagccctggccagcaggtgcagaccccccagagcatgcctcctccaccccagcccagcccccagcccggccagcccagcagccagcccaacagcaatgtgagcagcggccctgcccccagccccagcagcttcctgcccagccccagcccccagcccagccagagccctgtgacagcccggaccccccagaacttctctgtgcccagccctggccccctgaacacccctgtgaaccccagctctgtgatgagccctgctggcagcagccaggccgaggagcagcagtacctggacaagctgaagcagctgagcaagtacatcgagcccctgcggaggatgatcaacaagattgacaagaatgaagacaggaagaaggacctgagcaagatgaagagcctgctggacatcctgacagaccccagcaagcgctgccccctgaagaccctgcagaagtgtgagatcgccctggagaagctgaagaatgacatggctgtgcccaccccacctcctcctcctgtgccccccaccaagcagcagtacctgtgccagcccctgctggatgctgtgctggccaacatccgcagccctgtgttcaaccacagcctgtaccgcacctttgtgcctgccatgacagccatccacggcccccccatcacagcccctgtggtgtgcaccaggaagaggcggctggaggatgatgagcggcagagcatccccagcgtgctgcagggcgaggtggcccggctggaccccaagttcctggtgaacctggaccccagccactgcagcaacaatggaacagtgcacctgatctgcaagctggatgacaaggacctgcccagcgtgccccccctggagctgtctgtgcctgctgactacccagcccagagccccctgtggattgaccggcagtggcagtatgatgccaaccccttcctgcagagcgtgcaccgctgcatgaccagccggctgctgcagctgcctgacaagcacagcgtgacagccctgctgaacacctgggcccagagcgtgcaccaggcctgcctgtctgctgcctag

SEQ ID NO: 159016 - DNA, 1914 bp, Artificial Sequence
  Description of Artificial Sequence: Synthetic coding sequence
atggagagccacgtgttcctgaaggccaagaccagagatgagtacctgagcctggtggcccggctcatcatccacttccgggacatccacaacaagaagagccaggcctctgtgtctgcccagctgcagctgcagcaggtggccctgcagcagcagcagcagcagcagcagttccagcagcagcagcaggccgccctgcagcagcagcagcagcagcagcagcagcagcagttccaggcccagcagagcgccatgcagcagcagttccaggccgtggtgcagcagcagcagcagctgcagcagcagcagcagcagcagcagcacctgatcaagctgcaccaccagaaccagcagcagatccagcagcagcagcagcagctgcagagaattgcccagctgcagctgcagcagcagcagcagcagcagcagcagcagcagcagcagcagcagcaggccctgcaggcccagccccccatccagcagccccccatgcagcagccccagcccccacccagccaggccctgccccagcagctgcagcagatgcaccacacccagcaccaccagcccccaccccagccccagcagccccctgtggcccagaaccagcccagccagctgcccccccagagccagacccagcccctggtgtcccaggcccaggccctgcccggccagatgctgtacacccagccccccctgaagtttgtgcgggcccccatggtggtgcagcagccccctgtgcagccccaggtgcagcagcagcagacagctgtgcagacagcccaggccgcccagatggtggcccctggggtgcaggtgtcccagagcagcctgcccatgctgagcagccccagccctggccagcaggtgcagaccccccagagcatgcctcctccaccccagcccagcccccagcccggccagcccagcagccagcccaacagcaatgtgagcagcggccctgcccccagccccagcagcttcctgcccagccccagcccccagcccagccagagccctgtgacagcccggaccccccagaacttctctgtgcccagccctggccccctgaacacccctgtgaaccccagctctgtgatgagccctgctggcagcagccaggccgaggagcagcagtacctggacaagctgaagcagctgagcaagtacatcgagcccctgcggaggatgatcaacaagattgacaagaatgaagacaggaagaaggacctgagcaagatgaagagcctgctggacatcctgacagaccccagcaagcgctgccccctgaagaccctgcagaagtgtgaaattgccctggagaagctgaagaatgacatggctgtgcccaccccacctcctcctcctgtgccccccaccaagcagcagtacctgtgccagcccctgctggatgctgtgctggccaacatccgcagccctgtgttcaaccacagcctgtaccgcacctttgtgcctgccatgacagccatccacggcccccccatcacagcccctgtggtgtgcaccaggaagaggcggctggaggatgatgagcggcagagcatccccagcgtgctgcagggcgaggtggcccggctggaccccaagttcctggtgaacctggaccccagccactgcagcaacaacggcaccgtgcacctgatctgcaagctggatgacaaggacctgcccagcgtgccccccctggagctgtctgtgcctgctgactacccagcccagagccccctgtggattgaccggcagtggcagtatgatgccaaccccttcctgcagagcgtgcaccgctgcatgaccagccggctgctgcagctgcctgacaagcacagcgtgacagccctgctgaacacctgggcccagagcgtgcaccaggcctgcctgtctgctgcctag

SEQ ID NO: 159017 - DNA, 2169 bp, Artificial Sequence; identical to SEQ ID NO: 159015
  Description of Artificial Sequence: Synthetic coding sequence

SEQ ID NO: 159018 - DNA, 2157 bp, Artificial Sequence
  Description of Artificial Sequence: Synthetic coding sequence
atgaggaaggccggcgtggcccacagcaagagcagcaaggacatggagagccacgtgttcctgaaggccaagaccagagatgagtacctgagcctggtggcccggctcatcatccacttccgggacatccacaacaagaagagccaggcctctgtgtctgaccccatgaatgccctgcagagcctgactggaggccctgctgctggagctgctggcatcggcatgccaccccggggccctggccagagcctgggcggcatgggcagcctgggcgccatgggccagcccatgagcctgagcggccagcccccacctggcaccagcggcatggccccccacagcatggctgtggtgtccacagccaccccccagacccagctgcagctgcagcaggtggccctgcagcagcagcagcagcagcagcagttccagcagcagcagcaggccgccctgcagcagcagcagcagcagcagcagcagcagcagttccaggcccagcagagcgccatgcagcagcagttccaggccgtggtgcagcagcagcagcagctgcagcagcagcagcagcagcagcagcacctgatcaagctgcaccaccagaaccagcagcagcagcagcagcaggccctgcaggcccagccccccatccagcagccccccatgcagcagccccagcccccacccagccaggccctgccccagcagctgcagcagatgcaccacacccagcaccaccagcccccaccccagccccagcagccccctgtggcccagaaccagcccagccagctgcccccccagagccagacccagcccctggtgtcccaggcccaggccctgcccggccagatgctgtacacccagccccccctgaagtttgtgcgggcccccatggtggtgcagcagccccctgtgcagccccaggtgcagcagcagcagacagctgtgcagacagcccaggccgcccagatggtggcccctggggtgcagatgatcacagaggccctggcccagggcggcatgcacatccgggcccgcttcccccccaccacagctgtgtctgccatccccagcagcagcatccccctgggccggcagcccatggcccagcaggtgcagaccccccagagcatgcctcctccaccccagcccagcccccagcccggccagcccagcagccagcccaacagcaatgtgagcagcggccctgcccccagccccagcagcttcctgcccagccccagcccccagcccagccagagccctgtgacagcccggaccccccagaacttctctgtgcccagccctggccccctgaacacccctgtgaaccccagctctgtgatgagccctgctggcagcagccaggccgaggagcagcagtacctggacaagctgaagcagctgagcaagtacatcgagcccctgcggaggatgatcaacaagattgacaagaatgaagacaggaagaaggacctgagcaagatgaagagcctgctggacatcctgacagaccccagcaagcgctgccccctgaagaccctgcagaagtgtgagatcgccctggagaagctgaagaatgacatggctgtgcccaccccacctcctcctcctgtgccccccaccaagcagcagtacctgtgccagcccctgctggatgctgtgctggccaacatccgcagccctgtgttcaaccacagcctgtaccgcacctttgtgcctgccatgacagccatccacggcccccccatcacagcccctgtggtgtgcaccaggaagaggcggctggaggatgatgagcggcagagcatccccagcgtgctgcagggcgaggtggcccggctggaccccaagttcctggtgaacctggaccccagccactgcagcaacaatggaacagtgcacctgatctgcaagctggatgacaaggacctgcccagcgtgccccccctggagctgtctgtgcctgctgactacccagcccagagccccctgtggattgaccggcagtggcagtatgatgccaaccccttcctgcagagcgtgcaccgctgcatgaccagccggctgctgcagctgcctgacaagcacagcgtgacagccctgctgaacacctgggcccagagcgtgcaccaggcctgcctgtctgctgcctag

SEQ ID NO: 159019 - DNA, 570 bp, Artificial Sequence
  Description of Artificial Sequence: Synthetic coding sequence
atgcagcagcagttccaggccgtggtgcagcagcagcagcagctgcagcagcagcagcagcagcagcagcacctgatcaagctgcaccaccagaaccagcagcagatccagcagcagcagcagcagctgcagagaattgcccagctgcagctgcagcagcagcagcagcagcagcagcagcagcagcagcagcagcagcaggccctgcaggcccagccccccatccagcagccccccatgcagcagccccagcccccacccagccaggccctgccccagcagctgcagcagatgcaccacacccagcaccaccagcccccaccccagccccagcagccccctgtggcccagaaccagcccagccagctgcccccccagagccagacccagcccctggtgtcccaggcccaggccctgcccggccagatgctgtacacccagccccccctgaagtttgtgcgggcccccatggtggtgcagcagccccctgtgcagccccaggtgcagcagcagcagacagctgtgcagacagcccaggccgcccagatggtggcccctggggtgcagtag

SEQ ID NO: 159020 - DNA, 1956 bp, Artificial Sequence
  Description of Artificial Sequence: Synthetic coding sequence
atgtctggagtgcgggctgtgcgcatcagcattgaaagtgcctgtgagaagcaggtgcatgaggtgggcctggatggaacagagacctacctgccccccctgtccatgagccagaacctggcccggctggcccagagaattgacttcagccagggcagcggcagcgaggaggaggaggccgccggcacagaaggagatgcccaggagtggccaggagctggcagcagcgctgaccaggatgatgaggagggcgtggtgaagttccagcccagcctgtggccctgggacagcgtgaggaacaacctgcggagcgccctgacagagatgtgtgtgctgtatgatgtgctgagcatcgtgcgggacaagaagttcatgaccctggaccctgtgtcccaggatgccctgccccccaagcagaacccccagaccctgcagctgatcagcaagaagaagagcctggccggggccgcccagatcctgctgaagggagctgagcggctgaccaagtctgtgacagagaaccaggagaacaagctgcagagggacttcaacagcgagctgctgcggctgcggcagcactggaagctgaggaaggtgggggacaagatcctgggggacctgagctacagatctgctggcagcctcttcccccaccacggcacctttgaggtgatcaagaacacagacctggacctggacaagaagatccctgaggactactgccccctggatgtgcagatccccagcgacctggagggcagcgcctacatcaaggtgtccatccagaagcaggccccagacatcggggacctgggcaccgtgaacctcttcaagaggcccctgcccaagagcaagccaggcagcccccactggcagaccaagctggaggccgcccagaatgtgctgctgtgcaaggagatctttgcccagctgagccgggaggccgtgcagatcaagagccaggtgccccacatcgtggtgaagaaccagatcatcagccagcccttccccagcctgcagctgagcatcagcctgtgccacagcagcaatgacaagaagagccagaagtttgccacagagaagcagtgcccagaggaccacctgtatgtgctggagcacaacctgcacctgctgatccgggagttccacaagcagaccctgagcagcatcatgatgccccacccagccagcgcccccttcggccacaagaggatgaggctgagcggcccccaggcctttgacaagaatgagatcaacagcctgcagagcagcgagggcctgctggagaagatcatcaagcaggccaagcacatcttcctgcggagcagagctgctgccaccatcgacagcctggccagcagaattgaggacccccagatccaggcccactggagcaacatcaatgatgtgtatgagagctctgtgaaggtgctgatcaccagccagggctatgagcagatctgcaagagcatccagctgcagctgaacattggagtggagcagatccgggtggtgcacagagatggccgggtcatcaccctgagctaccaggagcaggagctgcaggacttcctgctgagccagatgagccagcaccaggtgcatgctgtgcagcagctggccaaggtgatgggctggcaggtgctgtccttcagcaaccacgtgggcctgggccccatcgagagcattggaaatgccagcgccatcaccgtggccagccccagcggggactatgccatctctgtgagaaatggacctgagagcggcagcaagatcatggtgcagttccccaggaaccagtgcaaggacctgcccaagagtgatgtgctgcaggacaacaagtggagccacctgcggggccccttcaaggaggtgcagtggaacaagatggagggcaggaactttgtgtacaagatggagctgctgatgtctgccctgagcccctgcctgctgtag

SEQ ID NO: 159021 - DNA, 1866 bp, Artificial Sequence
  Description of Artificial Sequence: Synthetic coding sequence
atgtctggagtgcgggctgtgcgcatcagcattgaaagtgcctgtgagaagcaggtgcatgaggtgggcctggatggaacagagacctacctgccccccctgtccatgagccaggagtggccaggagctggcagcagcgctgaccaggatgatgaggagggcgtggtgaagttccagcccagcctgtggccctgggacagcgtgaggaacaacctgcggagcgccctgacagagatgtgtgtgctgtatgatgtgctgagcatcgtgcgggacaagaagttcatgaccctggaccctgtgtcccaggatgccctgccccccaagcagaacccccagaccctgcagctgatcagcaagaagaagagcctggccggggccgcccagatcctgctgaagggagctgagcggctgaccaagtctgtgacagagaaccaggagaacaagctgcagagggacttcaacagcgagctgctgcggctgcggcagcactggaagctgaggaaggtgggggacaagatcctgggggacctgagctacagatctgctggcagcctcttcccccaccacggcacctttgaggtgatcaagaacacagacctggacctggacaagaagatccctgaggactactgccccctggatgtgcagatccccagcgacctggagggcagcgcctacatcaaggtgtccatccagaagcaggccccagacatcggggacctgggcaccgtgaacctcttcaagaggcccctgcccaagagcaagccaggcagcccccactggcagaccaagctggaggccgcccagaatgtgctgctgtgcaaggagatctttgcccagctgagccgggaggccgtgcagatcaagagccaggtgccccacatcgtggtgaagaaccagatcatcagccagcccttccccagcctgcagctgagcatcagcctgtgccacagcagcaatgacaagaagagccagaagtttgccacagagaagcagtgcccagaggaccacctgtatgtgctggagcacaacctgcacctgctgatccgggagttccacaagcagaccctgagcagcatcatgatgccccacccagccagcgcccccttcggccacaagaggatgaggctgagcggcccccaggcctttgacaagaatgagatcaacagcctgcagagcagcgagggcctgctggagaagatcatcaagcaggccaagcacatcttcctgcggagcagagctgctgccaccatcgacagcctggccagcagaattgaggacccccagatccaggcccactggagcaacatcaatgatgtgtatgagagctctgtgaaggtgctgatcaccagccagggctatgagcagatctgcaagagcatccagctgcagctgaacattggagtggagcagatccgggtggtgcacagagatggccgggtcatcaccctgagctaccaggagcaggagctgcaggacttcctgctgagccagatgagccagcaccaggtgcatgctgtgcagcagctggccaaggtgatgggctggcaggtgctgtccttcagcaaccacgtgggcctgggccccatcgagagcattggaaatgccagcgccatcaccgtggccagccccagcggggactatgccatctctgtgagaaatggacctgagagcggcagcaagatcatggtgcagttccccaggaaccagtgcaaggacctgcccaagagtgatgtgctgcaggacaacaagtggagccacctgcggggccccttcaaggaggtgcagtggaacaagatggagggcaggaactttgtgtacaagatggagctgctgatgtctgccctgagcccctgcctgctgtag

SEQ ID NO: 159022 - DNA, 438 bp, Artificial Sequence
  Description of Artificial Sequence: Synthetic coding sequence
atgtctggagtgcgggctgtgcgcatcagcattgaaagtgcctgtgagaagcaggtgcatgaggtgggcctggatggaacagagacctacctgccccccctgtccatgagccagaacctggcccggctggcccagagaattgacttcagccagggcagcggcagcgaggaggaggaggccgccggcacagaaggagatgcccaggagtggccaggagctggcagcagcgctgaccaggatgatgaggagggcgtggtgaagttccagcccagcctgtggccctgggacagcgtgaggaacaacctgcggagcgccctgacagagatgtgtgtgctgtatgatgtgctgagcatcgtgcgggacaagaagttcatgaccctggaccctgtgtcccaggatgccctgccccccaagcaggtgtttgtggacttcaactag

SEQ ID NO: 159023 - DNA, 627 bp, Artificial Sequence
  Description of Artificial Sequence: Synthetic coding sequence
atggaggcccctcctgtgaccatgatgcctgtgactggaggcaccatcaacatgatggagtacctgctgcagggctctgtgctggaccacagcctggagagcctcatccaccggctgcggggcctgtgtgacaacatggagcctgagaccttcctggaccacgagatggtgttcctgctgaagggccagcaggccagcccctttgtgctgcgggcccggcgctccatggacagagctggggccccctggcacctgcgctacctgggccagcctgagatgggagacaagaacagacatgccctggtgaggaactgtgtggacatcgccaccagcgagaacctgacagacttcctgatggagatgggcttcaggatggaccatgaatttgtggccaagggccacctgttcaggaagggcatcatgaagatcatggtgtacaagatcttccgcatcctggtgcccggcaacacagacagcacagaggccctgagcctgagctacctggtggagctgtctgtggtggccccagctggccaggacatggtgtctgatgacatgaagaactttgctgagcagctgaagcccctggtgcacctggagaagattgaccccaagaggctgatgtag

SEQ ID NO: 159024 - DNA, 627 bp, Artificial Sequence; identical to SEQ ID NO: 159023
  Description of Artificial Sequence: Synthetic coding sequence

SEQ ID NO: 159025 - DNA, 585 bp, Artificial Sequence
  Description of Artificial Sequence: Synthetic coding sequence
atggagaacttcaccgccctgtttggagcccaggccgaccccccacctccacccacagccctgggctttggacctgggaagcccccacctcctcctcctcctcctgctgggggcggccctggaacagcccccccacccacagctgccacagcccctcctggagctgacaagagcggggccggctgcggccccttctacctgatgagggagctgcccggcagcacagagctgaccggcagcaccaacctgatcacccactacaacctggagcaggcctacaacaagttctgtgggaagaaggtgaaggagaagctgagcaacttcctgcctgacctgcccggcatgattgacctgcccggcagccatgacaacagcagcctgcggagcctgattgagaagccacccatcctgagcagcagcttcaaccccatcaccggcaccatgctggccggcttccggctgcacacaggccccctgcctgagcagtgccgcctgatgcacatccagccccccaagaagaagaacaagcacaagcacaagcagagcaggacccaggaccctgtgcccccaggcaagcccagctag

SEQ ID NO: 159026 - DNA, 735 bp, Artificial Sequence
  Description of Artificial Sequence: Synthetic coding sequence
atggagaacttcaccgccctgtttggagcccaggccgaccccccacctccacccacagccctgggctttggacctgggaagcccccacctcctcctcctcctcctgctgggggcggccctggaacagcccccccacccacagctgccacagcccctcctggagctgacaagagcggggccggctgcggccccttctacctgatgagggagctgcccggcagcacagagctgaccggcagcaccaacctgatcacccactacaacctggagcaggcctacaacaagttctgtgggaagaaggtgaaggagaagctgagcaacttcctgcctgacctgcccggcatgattgacctgcccggcagccatgacaacagcagcctgcggagcctgattgagaagccacccatcctgagcagcagcttcaaccccatcaccggcaccatgctggccggcttccggctgcacacaggccccctgcctgagcagtgccgcctgatgcacatccagccccccaagaagaagaacaagcacaagcacaagcagagcaggacccaggaccctgtgcccccagagacccccagcgacagcgaccacaagaagaagaagaagaagaaggaggaggaccctgagaggaagaggaagaagaaggagaagaagaagaagaagaacagacacagcccagaccaccctggcatgggcagcagccaggccagcagcagcagcagcctgaggtag

SEQ ID NO: 159027 - DNA, 639 bp, Artificial Sequence
  Description of Artificial Sequence: Synthetic coding sequence
atgggcgtgacctgtgtgtcccagatgcctgtggccgagggcaagtctgtgcagcagacagtggagctgctgaccaggaagctggagatgctgggcgctgagaagcagggcaccttctgtgtggactgtgagacctaccacacagctgccagcaccctgggcagccagggccagacaggcaagctgatgtatgtgatgcacaacagcgagtaccccctgagctgctttgccctgtttgaaaatggcccctgcctgattgctgacaccaactttgatgtgctgatggtgaagctgaagggcttcttccagagcgccaaggccagcaagattgagacccggggcacccgctaccagtactgtgacttcctggtgaaggtgggcaccgtgaccatgggccccagcgcccggggcatctctgtggaggtggagtatggcccctgtgtggtggccagtgactgctggagcctgctgctggagttcctgcagagcttcctgggcagccacacccctggggccccagctgtgtttggaaacagacatgatgctgtgtatggccctgctgacaccatggtgcagtacatggagctgttcaacaagatcaggaagcagcagcaggtgcctgtggccggcatcagatag

SEQ ID NO: 159028 - DNA, 423 bp, Artificial Sequence
  Description of Artificial Sequence: Synthetic coding sequence
atgcctgtggccgagggcaagtctgtgcagcagacagtggagctgctgaccaggaagctggagatgctgggcgctgagaagcagggcaccttctgtgtggactgtgagacctaccacacagctgccagcaccctgggcagccagggccagacaggcaagctgatgtatgtgatgcacaacagcgagtaccccctgagctgctttgccctgtttgaaaatggcccctgcctgattgctgacaccaactttgatgtgctgatggtgaagctgaagggcttcttccagagcgccaaggccagcaagattgagacccggggcacccgctaccagtactgtgacttcctggtgaaggtgggcaccgtgaccatgggccccagcgcccggggcatctctgtggaggtggagtatggcccctgtgtgtag

SEQ ID NO: 159029 - DNA, 438 bp, Artificial Sequence
  Description of Artificial Sequence: Synthetic coding sequence
atgggcgtgacctgtgtgtcccagatgcctgtggccgagggcaagtctgtgcagcagacagtggagctgctgaccaggaagctggagatgctgggcgctgagaagcagggcaccttctgtgtggactgtgagacctaccacacagctgccagcaccctgggcagccagggccagacaggcaagctgatgtatgtgatgcacaacagcgagtaccccctgagctgctttgccctgtttgaaaatggcccctgcctgattgctgacaccaactttgatgtgctgatggtgaagctgaagggcttcttccagagcgccaaggccagcaagattgagacccggggcacccgctaccagtactgtgacttcctggtgaaggtgggcaccgtgaccatgggccccagcgcccggggcatctctgtggaggtgcggccctggtag

SEQ ID NO: 159030 - DNA, 372 bp, Artificial Sequence
  Description of Artificial Sequence: Synthetic coding sequence
atgggcgtgacctgtgtgtcccagatgcctgtggccgagggcaagtctgtgcagcagacagtggagctgctgaccaggaagctggagatgctgggcgctgagaagcagggcaccttctgtgtggactgtgagacctaccacacagctgccagcaccctgggcagccagggccagacaggcaagctgatgtatgtgatgcacaacagcgagtaccccctgagctgctttgccctgtttgaaaatggcccctgcctgattgctgacaccaactttgatgtgctgatggtgaagctgaagggcttcttccagagcgccaaggccagcaagattgagacccggggcacccgctggagcatggcccctgtgtggtag

SEQ ID NO: 159031 - DNA, 435 bp, Artificial Sequence
  Description of Artificial Sequence: Synthetic coding sequence
atggctgaccggctgacccagctgcaggatgctgtgaacagcctggccgaccagttctgcaatgccatcggcgtgctgcagcagtgtggccccccagccagcttcaacaacatccagacagccatcaacaaggaccagcctgccaaccccacagaggagtatgcccagctgtttgctgccctgattgccaggacagccaaggacattgatgtgctgattgacagcctgcccagcgaggagagcacagctgccctgcaggccgccagcctgtacaagctggaggaggagaaccacgaggccgccacctgcctggaggatgtggtgtacagaggagacatgctgctggagaagatccagagcgccctggccgacatcgcccagagccagctgaagaccaggagcggcacccacagccagagcctgcctgacagctag

SEQ ID NO: 159032 - DNA, 4098 bp, Artificial Sequence
  Description of Artificial Sequence: Synthetic coding sequence
atggagacccagctgcagagcatctttgaggaggtggtgaagacagaggtgattgaggaggccttccctggcatgttcatggacaccccagaagatgagaagaccaagctgatcagctgcctgggcgccttccggcagttctggggcggcctgagccaggagagccatgagcagtgcatccagtggatcgtgaagttcatccacggccagcacagccccaagaggatctccttcctgtatgactgcctggccatggctgtggagaccggcctgctgcccccccggctggtgtgtgagagcctcatcaacagcgacaccctggagtgggagaggacccagctgtgggccctgaccttcaagctggtgaggaagatcatcggcggcgtggactacaagggcgtgcgggacctgctgaaggtgatcctggagaagatcctgaccatccccaacacagtgagcagcgctgtggtgcagcagctgctggccgcccgggaggtgattgcctacatcctggagagaaatgcctgcctgctgcctgcctactttgctgtgacagagatcaggaagctgtacccagagggcaagctgccccactggctgctgggcaacctggtgtctgactttgtggacaccttccggcccacagcccgcatcaacagcatctgtggccgctgcagcctgctgcctgtggtgaacaacagcggggccatctgcaacagctggaagctggaccctgccaccctgcgcttccccctgaagggcctgctgccctatgacaaggacctgtttgagccccagacagccctgctgcgctacgtgctggagcagccctacagccgggacatggtgtgcaacatgctgggcctgaacaagcagaccctgaacatcgcccagcacaagcagcgctgccctgtgctggaggaccagctggtggacctggtggtgtatgccatggagaggagtgaaacagaggagaagtttgatgatggcggcaccagccagctgctgtggcagcacctgagcagccagctgatcttctttgtgctcttccagtttgccagcttcccccacatggtgctgagcctgcaccagaagctggccggccggggcctcatcaagggccgggaccacctgatgtgggtgctgctgcagttcatcagcggcagcatccagaagaatgccctggccgacttcctgcctgtgatgaagctgtttgacctgctgtacccagagaaggagtacatccctgtgcctgacatcaacaagccccagagcacccacgcctttgccatgacctgcatctggatccacctgaacaggaaggcccagaatgacaacagcaagctgcagatccccatcccccacagcctgcggctgcaccacgagttcctgcagcagagcctgaggaacaagagcctgcagatgaatgactacaagatcgccctgctgtgcaatgcctacagcaccaacagcgagtgcttcaccctgcccatgggcgccctggtggagaccatctatggaaatggcatcatgaggatccccctgcccggcaccaactgcatggccagcggcagcatcacccccctgcccatgaacctgctggacagcctgactgtgcacgccaagatgagcctcatccacagcatcgccaccagggtcatcaagctggcccacgccaagagctctgtggccctggccccagccctggtggagacctacagccggctgctggtgtacatggagattgagagcctgggcatcaagggcttcatcagccagctgctgcccaccgtcttcaagagccacgcctggggcatcctgcacaccctgctggagatgttctcctacaggatgcaccacatccagccccactacagagtgcagctgctgagccacctgcacaccctggccgctgtggcccagaccaaccagaaccagctgcacctgtgtgtggagagcacagccctgcggctcatcacagccctgggcagcagcgaggtgcagccccagttcacccgcttcctgagtgaccccaagacagtgctgtctgctgagagcgaggagctgaacagagccctgatcctgaccctggcccgggccacccacgtgacagacttcttcaccggcagtgacagcatccagggcacctggtgcaaggacatcctgcagaccatcatgtccttcaccccccacaactgggccagccacaccctgagctgcttccctggccccctgcaggccttcttcaagcagaacaacgtgccccaggagagccgcttcaacctgaagaagaatgtggaggaggagtacaggaagtggaagtccatgagcaatgaaaatgacatcatcacccacttctccatgcagggcagccccccactcttcctgtgcctgctgtggaagatgctgctggagacagaccacatcaaccagatcggctacagagtgctggagcgcatcggggcccgggccctggtggcccacgtgaggacctttgctgacttcctggtgtatgagttcagcaccagcgctgggggccagcagctgaacaagtgcatcgagatcctgaatgacatggtgtggaagtacaacatcgtgaccctggacaggctcatcctgtgcctggccatgaggagccatgagggcaatgaggcccaggtgtgctacttcatcatccagctgctgctgctgaagcccaatgacttcaggaacagagtgtctgactttgtgaaggagaacagccctgagcactggctgcagaatgactggcacaccaagcacatgaactaccacaagaagtacccagagaagctgtactttgagggcctggccgagcaggtggacccccctgtgcagatccagagcccctacctgcccatctactttggaaatgtgtgcctgcgcttcctgcctgtgtttgatattgtcatccaccgcttcctggagctgctgcctgtgtccaagagcctggagaccctgctggaccacctgggcggcctgtacaagttccatgacaggcctgtgacctacctgtacaacaccctgcactactatgagatgcacctgcgggaccgggccttcctgaagaggaagctggtgcacgccatcatcggcagcctgaaggacaaccggccccagggctggtgcctgagtgacacctacctgaagtgtgccatgaatgcccgggaggagaacccctgggtgcctgatgacacctactactgccgcctcatcggccgcctggtggacaccatggccggcaagagccctggccccttccccaactgtgactggaggttcaatgagttccccaacccagctgcccacgccctgcacgtgacctgtgtggagctgatggccctggccgtgtctgggaaggaggtgggcaatgccctgctgaatgtggtgctgaagagccagcccctggtgccccgggagaacatcacagcctggatgaatgccatcggcctcatcatcacagccctgcctgagccctactggatcgtgctgcatgaccgcatcgtgtctgtcatcagcagccccagcctgaccagcgagacagagtgggtgggctaccccttccggctgtttgacttcaccgcctgccaccagagctacagcgagatgagctgcagctacaccctggccctggcccatgctgtgtggcaccacagcagcatcggccagctgagcctcatccccaagttcctgacagaggtgctgctgcccatcgtgaagacagagttccagctgctgtatgtgtaccacctggtgggccccttcctgcagcgcttccagcaggagaggacccgctgcatgattgaaattggagtggccttctatgacatgctgctgaatgtggaccagtgcagcacccacctgaactacatggaccccatctgtgacttcctgtaccacatgaagtacatgttcaccggggacagcgtgaaggagcaggtggagaagatcatctgcaacctgaagccagccctgaagctgcggctgcgcttcatcacccacatcagcaagatggagcctgctgctgtgcccccccaggccatgaacagcggcagccctgccccccagagcaaccagtag

SEQ ID NO: 159033 - DNA, 2661 bp, Artificial Sequence
  Description of Artificial Sequence: Synthetic coding sequence
atggagacccagctgcagagcatctttgaggaggtggtgaagacagaggtgattgaggaggccttccctggcatgttcatggacaccccagaagatgagaagaccaagctgatcagctgcctgggcgccttccggcagttctggggcggcctgagccaggagagccatgagcagtgcatccagtggatcgtgaagttcatccacggccagcacagccccaagaggatctccttcctgtatgactgcctggccatggctgtggagaccggcctgctgcccccccggctggtgtgtgagagcctcatcaacagcgacaccctggagtgggagaggacccagctgtgggccctgaccttcaagctggtgaggaagatcatcggcggcgtggactacaagggcgtgcgggacctgctgaaggtgatcctggagaagatcctgaccatccccaacacagtgagcagcgctgtggtgcagcagctgctggccgcccgggaggtgattgcctacatcctggagagaaatgcctgcctgctgcctgcctactttgctgtgacagagatcaggaagctgtacccagagggcaagctgccccactggctgctgggcaacctggtgtctgactttgtggacaccttccggcccacagcccgcatcaacagcatctgtggccgctgcagcctgctgcctgtggtgaacaacagcggggccatctgcaacagctggaagctggaccctgccaccctgcgcttccccctgaagggcctgctgccctatgacaaggacctgtttgagccccagacagccctgctgcgctacgtgctggagcagccctacagccgggacatggtgtgcaacatgctgggcctgaacaagcagaccctgaacatcgcccagcacaagcagcgctgccctgtgctggaggaccagctggtggacctggtggtgtatgccatggagaggagtgaaacagaggagaagtttgatgatggcggcaccagccagctgctgtggcagcacctgagcagccagctgatcttctttgtgctcttccagtttgccagcttcccccacatggtgctgagcctgcaccagaagctggccggccggggcctcatcaagggccgggaccacctgatgtgggtgctgctgcagttcatcagcggcagcatccagaagaatgccctggccgacttcctgcctgtgatgaagctgtttgacctgctgtacccagagaaggagtacatccctgtgcctgacatcaacaagccccagagcacccacgcctttgccatgacctgcatctggatccacctgaacaggaaggcccagaatgacaacagcaagctgcagatccccatcccccacagcctgcggctgcaccacgagttcctgcagcagagcctgaggaacaagagcctgcagatgaatgactacaagatcgccctgctgtgcaatgcctacagcaccaacagcgagtgcttcaccctgcccatgggcgccctggtggagaccatctatggaaatggcatcatgaggatccccctgcccggcaccaactgcatggccagcggcagcatcacccccctgcccatgaacctgctggacagcctgactgtgcacgccaagatgagcctcatccacagcatcgccaccagggtcatcaagctggcccacgccaagagctctgtggccctggccccagccctggtggagacctacagccggctgctggtgtacatggagattgagagcctgggcatcaagggcttcatcagccagctgctgcccaccgtcttcaagagccacgcctggggcatcctgcacaccctgctggagatgttctcctacaggatgcaccacatccagccccactacagagtgcagctgctgagccacctgcacaccctggccgctgtggcccagaccaaccagaaccagctgcacctgtgtgtggagagcacagccctgcggctcatcacagccctgggcagcagcgaggtgcagccccagttcacccgcttcctgagtgaccccaagacagtgctgtctgctgagagcgaggagctgaacagagccctgatcctgaccctggcccgggccacccacgtgacagacttcttcaccggcagtgacagcatccagggcacctggtgcaaggacatcctgcagaccatcatgtccttcaccccccacaactgggccagccacaccctgagctgcttccctggccccctgcaggccttcttcaagcagaacaacgtgccccaggagagccgcttcaacctgaagaagaatgtggaggaggagtacaggaagtggaagtccatgagcaatgaaaatgacatcatcacccacttctccatgcagggcagccccccactcttcctgtgcctgctgtggaagatgctgctggagacagaccacatcaaccagatcggctacagagtgctggagcgcatcggggcccgggccctggtggcccacgtgaggacctttgctgacttcctggtgtatgagttcagcaccagcgctgggggccagcagctgaacaagtgcatcgagatcctgaatgacatggtgtggaagtacaacatcgtgaccctggacaggctcatcctgtgcctggtgcgcatcaacaccttcctgagcctcttctcctag

SEQ ID NO: 159034 - DNA, 4125 bp, Artificial Sequence
  Description of Artificial Sequence: Synthetic coding sequence
atggagacccagctgcagagcatctttgaggaggtggtgaagacagaggtgattgaggaggccttccctggcatgttcatggacaccccagaagatgagaagaccaagctgatcagctgcctgggcgccttccggcagttctggggcggcctgagccaggagagccatgagcagtgcatccagtggatcgtgaagttcatccacggccagcacagccccaagaggatctccttcctgtatgactgcctggccatggctgtggagaccggcctgctgcccccccggctggtgtgtgagagcctcatcaacagcgacaccctggagtgggagaggacccagctgtgggccctgaccttcaagctggtgaggaagatcatcggcggcgtggactacaagggcgtgcgggacctgctgaaggtgatcctggagaagatcctgaccatccccaacacagtgagcagcgctgtggtgcagcagctgctggccgcccgggaggtgattgcctacatcctggagagaaatgcctgcctgctgcctgcctactttgctgtgacagagatcaggaagctgtacccagagggcaagctgccccactggctgctgggcaacctggtgtctgactttgtggacaccttccggcccacagcccgcatcaacagcatctgtggccgctgcagcctgctgcctgtggtgaacaacagcggggccatctgcaacagctggaagctggaccctgccaccctgcgcttccccctgaagggcctgctgccctatgacaaggacctgtttgagccccagacagccctgctgcgctacgtgctggagcagccctacagccgggacatggtgtgcaacatgctgggcctgaacaagcagaccctgaacatcgcccagcacaagcagcgctgccctgtgctggaggaccagctggtggacctggtggtgtatgccatggagaggagtgaaacagaggagaagtttgatgatggcggcaccagccagctgctgtggcagcacctgagcagccagctgatcttctttgtgctcttccagtttgccagcttcccccacatggtgctgagcctgcaccagaagctggccggccggggcctcatcaagggccgggaccacctgatgtgggtgctgctgcagttcatcagcggcagcatccagaagaatgccctggccgacttcctgcctgtgatgaagctgtttgacctgctgtacccagagaaggagtacatccctgtgcctgacatcaacaagccccagagcacccacgcctttgccatgacctgcatctggatccacctgaacaggaaggcccagaatgacaacagcaagctgcagatccccatcccccacagcctgcggctgcaccacgagttcctgcagcagagcctgaggaacaagagcctgcagatgaatgactacaagatcgccctgctgtgcaatgcctacagcaccaacagcgagtgcttcaccctgcccatgggcgccctggtggagaccatctatggaaatggcatcatgaggatccccctgcccggcaccaactgcatggccagcggcagcatcacccccctgcccatgaacctgctggacagcctgactgtgcacgccaagatgagcctcatccacagcatcgccaccagggtcatcaagctggcccacgccaagagctctgtggccctggccccagccctggtggagacctacagccggctgctggtgtacatggagattgagagcctgggcatcaagggcttcatcagccagctgctgcccaccgtcttcaagagccacgcctggggcatcctgcacaccctgctggagatgttctcctacaggatgcaccacatccagccccactacagagtgcagctgctgagccacctgcacaccctggccgctgtggcccagaccaaccagaaccagctgcacctgtgtgtggagagcacagccctgcggctcatcacagccctgggcagcagcgaggtgcagccccagttcacccgcttcctgagtgaccccaagacagtgctgtctgctgagagcgaggagctgaacagagccctgatcctgaccctggcccgggccacccacgtgacagacttcttcaccggcagtgacagcatccagggcacctggtgcaaggacatcctgcagaccatcatgtccttcaccccccacaactgggccagccacaccctgagctgcttccctggccccctgcaggccttcttcaagcagaacaacgtgccccaggagagccgcttcaacctgaagaagaatgtggaggaggagtacaggaagtggaagtccatgagcaatgaaaatgacatcatcacccacttctccatgcagggcagccccccactcttcctgtgcctgctgtggaagatgctgctggagacagaccacatcaaccagatcggctacagagtgctggagcgcatcggggcccgggccctggtggcccacgtgaggacctttgctgacttcctggtgtatgagttcagcaccagcgctgggggccagcagctgaacaagtgcatcgagatcctgaatgacatggtgtggaagtacaacatcgtgaccctggacaggctcatcctgtgcctggccatgaggagccatgagggcaatgaggcccaggtgtgctacttcatcatccagctgctgctgctgaagcccaatgacttcaggaacagagtgtctgactttgtgaaggagaacagccctgagcactggctgcagaatgactggcacaccaagcacatgaactaccacaagaagtacccagagaagctgtactttgagggcctggccgagcaggtggacccccctgtgcagatccagagcccctacctgcccatctactttggaaatgtgtgcctgcgcttcctgcctgtgtttgatattgtcatccaccgcttcctggagctgctgcctgtgtccaagagcctggagaccctgctggaccacctgggcggcctgtacaagttccatgacaggcctgtgacctacctgtacaacaccctgcactactatgagatgcacctgcgggaccgggccttcctgaagaggaagctggtgcacgccatcatcggcagcctgaaggacaaccggccccagggctggtgcctgagtgacacctacctgaagtgtgccatgaatgcccgggaggagaacccctgggtgcctgatgacacctactactgccgcctcatcggccgcctggtggacaccatggccggcaagagccctggccccttccccaactgtgactggaggttcaatgagttccccaacccagctgcccacgccctgcacgtgacctgtgtggagctgatggccctggccgtgtctgggaaggaggtgggcaatgccctgctgaatgtggtgctgaagagccagcccctggtgccccgggagaacatcacagcctggatgaatgccatcggcctcatcatcacagccctgcctgagccctactggatcgtgctgcatgaccgcatcgtgtctgtcatcagcagccccagcctgaccagcgagacagagtgggtgggctaccccttccggctgtttgacttcaccgcctgccaccagagctacagcgagatgagctgcagctacaccctggccctggcccatgctgtgtggcaccacagcagcatcggccagctgagcctcatccccaagttcctgacagaggtgctgctgcccatcgtgaagacagagttccagctgctgtatgtgtaccacctggtgggccccttcctgcagcgcttccagcaggagaggacccgctgcatgattgaaattggagtggccttctatgacatgctgctgaatgtggaccagtgcagcacccacctgaactacatggaccccatctgtgacttcctgtaccacatgaagtacatgttcaccggggacagcgtgaaggagcaggtgaagaagatcatctgcaacctgaagccagccctgaagctgcggctgcgcttcatcacccacatcagcaagatggagcctgctgctgtgcccccccaggccatgaacagcggcagccctgccccccagagcaaccaggtgcctgtgtccctgcctgtgacccagtag

SEQ ID NO: 159035 - DNA, 4095 bp, Artificial Sequence
  Description of Artificial Sequence: Synthetic coding sequence
atggagacccagctgcagagcatctttgaggaggtggtgaagacagaggtgattgaggaggccttccctggcatgttcatggacaccccagaagatgagaagaccaagctgatcagctgcctgggcgccttccggcagttctggggcggcctgagccaggagagccatgagcagtgcatccagtggatcgtgaagttcatccacggccagcacagccccaagaggatctccttcctgtatgactgcctggccatggctgtggagaccggcctgctgcccccccggctggtgtgtgagagcctcatcaacagcgacaccctggagtgggagaggacccagctgtgggccctgaccttcaagctggtgaggaagatcatcggcggcgtggactacaagggcgtgcgggacctgctgaaggtgatcctggagaagatcctgaccatccccaacacagtgagcagcgctgtggtgcagcagctgctggccgcccgggaggtgattgcctacatcctggagagaaatgcctgcctgctgcctgcctactttgctgtgacagagatcaggaagctgtacccagagggcaagctgccccactggctgctgggcaacctggtgtctgactttgtggacaccttccggcccacagcccgcatcaacagcatctgtggccgctgcagcctgctgcctgtggtgaacaacagcggggccatctgcaacagctggaagctggaccctgccaccctgcgcttccccctgaagggcctgctgccctatgacaaggacctgtttgagccccagacagccctgctgcgctacgtgctggagcagccctacagccgggacatggtgtgcaacatgctgggcctgaacaagcagcacaagcagcgctgccctgtgctggaggaccagctggtggacctggtggtgtatgccatggagaggagtgaaacagaggagaagtttgatgatggcggcaccagccagctgctgtggcagcacctgagcagccagctgatcttctttgtgctcttccagtttgccagcttcccccacatggtgctgagcctgcaccagaagctggccggccggggcctcatcaagggccgggaccacctgatgtgggtgctgctgcagttcatcagcggcagcatccagaagaatgccctggccgacttcctgcctgtgatgaagctgtttgacctgctgtacccagagaaggagtacatccctgtgcctgacatcaacaagccccagagcacccacgcctttgccatgacctgcatctggatccacctgaacaggaaggcccagaatgacaacagcaagctgcagatccccatcccccacagcctgcggctgcaccacgagttcctgcagcagagcctgaggaacaagagcctgcagatgaatgactacaagatcgccctgctgtgcaatgcctacagcaccaacagcgagtgcttcaccctgcccatgggcgccctggtggagaccatctatggaaatggcatcatgaggatccccctgcccggcaccaactgcatggccagcggcagcatcacccccctgcccatgaacctgctggacagcctgactgtgcacgccaagatgagcctcatccacagcatcgccaccagggtcatcaagctggcccacgccaagagctctgtggccctggccccagccctggtggagacctacagccggctgctggtgtacatggagattgagagcctgggcatcaagggcttcatcagccagctgctgcccaccgtcttcaagagccacgcctggggcatcctgcacaccctgctggagatgttctcctacaggatgcaccacatccagccccactacagagtgcagctgctgagccacctgcacaccctggccgctgtggcccagaccaaccagaaccagctgcacctgtgtgtggagagcacagccctgcggctcatcacagccctgggcagcagcgaggtgcagccccagttcacccgcttcctgagtgaccccaagacagtgctgtctgctgagagcgaggagctgaacagagccctgatcctgaccctggcccgggccacccacgtgacagacttcttcaccggcagtgacagcatccagggcacctggtgcaaggacatcctgcagaccatcatgtccttcaccccccacaactgggccagccacaccctgagctgcttccctggccccctgcaggccttcttcaagcagaacaacgtgccccaggagagccgcttcaacctgaagaagaatgtggaggaggagtacaggaagtggaagtccatgagcaatgaaaatgacatcatcacccacttctccatgcagggcagccccccactcttcctgtgcctgctgtggaagatgctgctggagacagaccacatcaaccagatcggctacagagtgctggagcgcatcggggcccgggccctggtggcccacgtgaggacctttgctgacttcctggtgtatgagttcagcaccagcgctgggggccagcagctgaacaagtgcatcgagatcctgaatgacatggtgtggaagtacaacatcgtgaccctggacaggctcatcctgtgcctggccatgaggagccatgagggcaatgaggcccaggtgtgctacttcatcatccagctgctgctgctgaagcccaatgacttcaggaacagagtgtctgactttgtgaaggagaacagccctgagcactggctgcagaatgactggcacaccaagcacatgaactaccacaagaagtacccagagaagctgtactttgagggcctggccgagcaggtggacccccctgtgcagatccagagcccctacctgcccatctactttggaaatgtgtgcctgcgcttcctgcctgtgtttgatattgtcatccaccgcttcctggagctgctgcctgtgtccaagagcctggagaccctgctggaccacctgggcggcctgtacaagttccatgacaggcctgtgacctacctgtacaacaccctgcactactatgagatgcacctgcgggaccgggccttcctgaagaggaagctggtgcacgccatcatcggcagcctgaaggacaaccggccccagggctggtgcctgagtgacacctacctgaagtgtgccatgaatgcccgggaggagaacccctgggtgcctgatgacacctactactgccgcctcatcggccgcctggtggacaccatggccggcaagagccctggccccttccccaactgtgactggaggttcaatgagttccccaacccagctgcccacgccctgcacgtgacctgtgtggagctgatggccctggccgtgtctgggaaggaggtgggcaatgccctgctgaatgtggtgctgaagagccagcccctggtgccccgggagaacatcacagcctggatgaatgccatcggcctcatcatcacagccctgcctgagccctactggatcgtgctgcatgaccgcatcgtgtctgtcatcagcagccccagcctgaccagcgagacagagtgggtgggctaccccttccggctgtttgacttcaccgcctgccaccagagctacagcgagatgagctgcagctacaccctggccctggcccatgctgtgtggcaccacagcagcatcggccagctgagcctcatccccaagttcctgacagaggtgctgctgcccatcgtgaagacagagttccagctgctgtatgtgtaccacctggtgggccccttcctgcagcgcttccagcaggagaggacccgctgcatgattgaaattggagtggccttctatgacatgctgctgaatgtggaccagtgcagcacccacctgaactacatggaccccatctgtgacttcctgtaccacatgaagtacatgttcaccggggacagcgtgaaggagcaggtggagaagatcatctgcaacctgaagccagccctgaagctgcggctgcgcttcatcacccacatcagcaagatggagcctgctgctgtgcccccccaggccatgaacagcggcagccctgccccccagagcaaccaggtggacaccctgacctag

SEQ ID NO: 159036 - DNA, 4107 bp, Artificial Sequence
  Description of Artificial Sequence: Synthetic coding sequence
atggagacccagctgcagagcatctttgaggaggtggtgaagacagaggtgattgaggaggccttccctggcatgttcatggacaccccagaagatgagaagaccaagctgatcagctgcctgggcgccttccggcagttctggggcggcctgagccaggagagccatgagcagtgcatccagtggatcgtgaagttcatccacggccagcacagccccaagaggatctccttcctgtatgactgcctggccatggctgtggagaccggcctgctgcccccccggctggtgtgtgagagcctcatcaacagcgacaccctggagtgggagaggacccagctgtgggccctgaccttcaagctggtgaggaagatcatcggcggcgtggactacaagggcgtgcgggacctgctgaaggtgatcctggagaagatcctgaccatccccaacacagtgagcagcgctgtggtgcagcagctgctggccgcccgggaggtgattgcctacatcctggagagaaatgcctgcctgctgcctgcctactttgctgtgacagagatcaggaagctgtacccagagggcaagctgccccactggctgctgggcaacctggtgtctgactttgtggacaccttccggcccacagcccgcatcaacagcatctgtggccgctgcagcctgctgcctgtggtgaacaacagcggggccatctgcaacagctggaagctggaccctgccaccctgcgcttccccctgaagggcctgctgccctatgacaaggacctgtttgagccccagacagccctgctgcgctacgtgctggagcagccctacagccgggacatggtgtgcaacatgctgggcctgaacaagcagcacaagcagcgctgccctgtgctggaggaccagctggtggacctggtggtgtatgccatggagaggagtgaaacagaggagaagtttgatgatggcggcaccagccagctgctgtggcagcacctgagcagccagctgatcttctttgtgctcttccagtttgccagcttcccccacatggtgctgagcctgcaccagaagctggccggccggggcctcatcaagggccgggaccacctgatgtgggtgctgctgcagttcatcagcggcagcatccagaagaatgccctggccgacttcctgcctgtgatgaagctgtttgacctgctgtacccagagaaggagtacatccctgtgcctgacatcaacaagccccagagcacccacgcctttgccatgacctgcatctggatccacctgaacaggaaggcccagaatgacaacagcaagctgcagatccccatcccccacagcctgcggctgcaccacgagttcctgcagcagagcctgaggaacaagagcctgcagatgaatgactacaagatcgccctgctgtgcaatgcctacagcaccaacagcgagtgcttcaccctgcccatgggcgccctggtggagaccatctatggaaatggcatcatgaggatccccctgcccggcaccaactgcatggccagcggcagcatcacccccctgcccatgaacctgctggacagcctgactgtgcacgccaagatgagcctcatccacagcatcgccaccagggtcatcaagctggcccacgccaagagctctgtggccctggccccagccctggtggagacctacagccggctgctggtgtacatggagattgagagcctgggcatcaagggcttcatcagccagctgctgcccaccgtcttcaagagccacgcctggggcatcctgcacaccctgctggagatgttctcctacaggatgcaccacatccagccccactacagagtgcagctgctgagccacctgcacaccctggccgctgtggcccagaccaaccagaaccagctgcacctgtgtgtggagagcacagccctgcggctcatcacagccctgggcagcagcgaggtgcagccccagttcacccgcttcctgagtgaccccaagacagtgctgtctgctgagagcgaggagctgaacagagccctgatcctgaccctggcccgggccacccacgtgacagacttcttcaccggcagtgacagcatccagggcacctggtgcaaggacatcctgcagaccatcatgtccttcaccccccacaactgggccagccacaccctgagctgcttccctggccccctgcaggccttcttcaagcagaacaacgtgccccaggagagccgcttcaacctgaagaagaatgtggaggaggagtacaggaagtggaagtccatgagcaatgaaaatgacatcatcacccacttctccatgcagggcagccccccactcttcctgtgcctgctgtggaagatgctgctggagacagaccacatcaaccagatcggctacagagtgctggagcgcatcggggcccgggccctggtggcccacgtgaggacctttgctgacttcctggtgtatgagttcagcaccagcgctgggggccagcagctgaacaagtgcatcgagatcctgaatgacatggtgtggaagtacaacatcgtgaccctggacaggctcatcctgtgcctggccatgaggagccatgagggcaatgaggcccaggtgtgctacttcatcatccagctgctgctgctgaagcccaatgacttcaggaacagagtgtctgactttgtgaaggagaacagccctgagcactggctgcagaatgactggcacaccaagcacatgaactaccacaagaagtacccagagaagctgtactttgagggcctggccgagcaggtggacccccctgtgcagatccagagcccctacctgcccatctactttggaaatgtgtgcctgcgcttcctgcctgtgtttgatattgtcatccaccgcttcctggagctgctgcctgtgtccaagagcctggagaccctgctggaccacctgggcggcctgtacaagttccatgacaggcctgtgacctacctgtacaacaccctgcactactatgagatgcacctgcgggaccgggccttcctgaagaggaagctggtgcacgccatcatcggcagcctgaaggacaaccggccccagggctggtgcctgagtgacacctacctgaagtgtgccatgaatgcccgggaggagaacccctgggtgcctgatgacacctactactgccgcctcatcggccgcctggtggacaccatggccggcaagagccctggccccttccccaactgtgactggaggttcaatgagttccccaacccagctgcccacgccctgcacgtgacctgtgtggagctgatggccctggccgtgtctgggaaggaggtgggcaatgccctgctgaatgtggtgctgaagagccagcccctggtgccccgggagaacatcacagcctggatgaatgccatcggcctcatcatcacagccctgcctgagccctactggatcgtgctgcatgaccgcatcgtgtctgtcatcagcagccccagcctgaccagcgagacagagtgggtgggctaccccttccggctgtttgacttcaccgcctgccaccagagctacagcgagatgagctgcagctacaccctggccctggcccatgctgtgtggcaccacagcagcatcggccagctgagcctcatccccaagttcctgacagaggtgctgctgcccatcgtgaagacagagttccagctgctgtatgtgtaccacctggtgggccccttcctgcagcgcttccagcaggagaggacccgctgcatgattgaaattggagtggccttctatgacatgctgctgaatgtggaccagtgcagcacccacctgaactacatggaccccatctgtgacttcctgtaccacatgaagtacatgttcaccggggacagcgtgaaggagcaggtggagaagatcatctgcaacctgaagccagccctgaagctgcggctgcgcttcatcacccacatcagcaagatggagcctgctgctgtgcccccccaggccatgaacagcggcagccctgccccccagagcaaccaggtgcctgtgtccctgcctgtgacccagtag

SEQ ID NO: 159037 - DNA, 4125 bp, Artificial Sequence
  Description of Artificial Sequence: Synthetic coding sequence
atggagacccagctgcagagcatctttgaggaggtggtgaagacagaggtgattgaggaggccttccctggcatgttcatggacaccccagaagatgagaagaccaagctgatcagctgcctgggcgccttccggcagttctggggcggcctgagccaggagagccatgagcagtgcatccagtggatcgtgaagttcatccacggccagcacagccccaagaggatctccttcctgtatgactgcctggccatggctgtggagaccggcctgctgcccccccggctggtgtgtgagagcctcatcaacagcgacaccctggagtgggagaggacccagctgtgggccctgaccttcaagctggtgaggaagatcatcggcggcgtggactacaagggcgtgcgggacctgctgaaggtgatcctggagaagatcctgaccatccccaacacagtgagcagcgctgtggtgcagcagctgctggccgcccgggaggtgattgcctacatcctggagagaaatgcctgcctgctgcctgcctactttgctgtgacagagatcaggaagctgtacccagagggcaagctgccccactggctgctgggcaacctggtgtctgactttgtggacaccttccggcccacagcccgcatcaacagcatctgtggccgctgcagcctgctgcctgtggtgaacaacagcggggccatctgcaacagctggaagctggaccctgccaccctgcgcttccccctgaagggcctgctgccctatgacaaggacctgtttgagccccagacagccctgctgcgctacgtgctggagcagccctacagccgggacatggtgtgcaacatgctgggcctgaacaagcagctgatcagcgccctgcagcacaagcagcgctgccctgtgctggaggaccagctggtggacctggtggtgtatgccatggagaggagtgaaacagaggagaagtttgatgatggcggcaccagccagctgctgtggcagcacctgagcagccagctgatcttctttgtgctcttccagtttgccagcttcccccacatggtgctgagcctgcaccagaagctggccggccggggcctcatcaagggccgggaccacctgatgtgggtgctgctgcagttcatcagcggcagcatccagaagaatgccctggccgacttcctgcctgtgatgaagctgtttgacctgctgtacccagagaaggagtacatccctgtgcctgacatcaacaagccccagagcacccacgcctttgccatgacctgcatctggatccacctgaacaggaaggcccagaatgacaacagcaagctgcagatccccatcccccacagcctgcggctgcaccacgagttcctgcagcagagcctgaggaacaagagcctgcagatgaatgactacaagatcgccctgctgtgcaatgcctacagcaccaacagcgagtgcttcaccctgcccatgggcgccctggtggagaccatctatggaaatggcatcatgaggatccccctgcccggcaccaactgcatggccagcggcagcatcacccccctgcccatgaacctgctggacagcctgactgtgcacgccaagatgagcctcatccacagcatcgccaccagggtcatcaagctggcccacgccaagagctctgtggccctggccccagccctggtggagacctacagccggctgctggtgtacatggagattgagagcctgggcatcaagggcttcatcagccagctgctgcccaccgtcttcaagagccacgcctggggcatcctgcacaccctgctggagatgttctcctacaggatgcaccacatccagccccactacagagtgcagctgctgagccacctgcacaccctggccgctgtggcccagaccaaccagaaccagctgcacctgtgtgtggagagcacagccctgcggctcatcacagccctgggcagcagcgaggtgcagccccagttcacccgcttcctgagtgaccccaagacagtgctgtctgctgagagcgaggagctgaacagagccctgatcctgaccctggcccgggccacccacgtgacagacttcttcaccggcagtgacagcatccagggcacctggtgcaaggacatcctgcagaccatcatgtccttcaccccccacaactgggccagccacaccctgagctgcttccctggccccctgcaggccttcttcaagcagaacaacgtgccccaggagagccgcttcaacctgaagaagaatgtggaggaggagtacaggaagtggaagtccatgagcaatgaaaatgacatcatcacccacttctccatgcagggcagccccccactcttcctgtgcctgctgtggaagatgctgctggagacagaccacatcaaccagatcggctacagagtgctggagcgcatcggggcccgggccctggtggcccacgtgaggacctttgctgacttcctggtgtatgagttcagcaccagcgctgggggccagcagctgaacaagtgcatcgagatcctgaatgacatggtgtggaagtacaacatcgtgaccctggacaggctcatcctgtgcctggccatgaggagccatgagggcaatgaggcccaggtgtgctacttcatcatccagctgctgctgctgaagcccaatgacttcaggaacagagtgtctgactttgtgaaggagaacagccctgagcactggctgcagaatgactggcacaccaagcacatgaactaccacaagaagtacccagagaagctgtactttgagggcctggccgagcaggtggacccccctgtgcagatccagagcccctacctgcccatctactttggaaatgtgtgcctgcgcttcctgcctgtgtttgatattgtcatccaccgcttcctggagctgctgcctgtgtccaagagcctggagaccctgctggaccacctgggcggcctgtacaagttccatgacaggcctgtgacctacctgtacaacaccctgcactactatgagatgcacctgcgggaccgggccttcctgaagaggaagctggtgcacgccatcatcggcagcctgaaggacaaccggccccagggctggtgcctgagtgacacctacctgaagtgtgccatgaatgcccgggaggagaacccctgggtgcctgatgacacctactactgccgcctcatcggccgcctggtggacaccatggccggcaagagccctggccccttccccaactgtgactggaggttcaatgagttccccaacccagctgcccacgccctgcacgtgacctgtgtggagctgatggccctggccgtgtctgggaaggaggtgggcaatgccctgctgaatgtggtgctgaagagccagcccctggtgccccgggagaacatcacagcctggatgaatgccatcggcctcatcatcacagccctgcctgagccctactggatcgtgctgcatgaccgcatcgtgtctgtcatcagcagccccagcctgaccagcgagacagagtgggtgggctaccccttccggctgtttgacttcaccgcctgccaccagagctacagcgagatgagctgcagctacaccctggccctggcccatgctgtgtggcaccacagcagcatcggccagctgagcctcatccccaagttcctgacagaggtgctgctgcccatcgtgaagacagagttccagctgctgtatgtgtaccacctggtgggccccttcctgcagcgcttccagcaggagaggacccgctgcatgattgaaattggagtggccttctatgacatgctgctgaatgtggaccagtgcagcacccacctgaactacatggaccccatctgtgacttcctgtaccacatgaagtacatgttcaccggggacagcgtgaaggagcaggtggagaagatcatctgcaacctgaagccagccctgaagctgcggctgcgcttcatcacccacatcagcaagatggagcctgctgctgtgcccccccaggccatgaacagcggcagccctgccccccagagcaaccaggtgcctgtgtccctgcctgtgacccagtag

SEQ ID NO: 159038 - DNA, 114 bp, Artificial Sequence
  Description of Artificial Sequence: Synthetic coding sequence
atggagacccagctgcagagcatctttgaggaggtggtgaagacagaggtgattgaggaggccttccctggcatgttcatggacaccccagaagatgagaagagcagcaagtag

SEQ ID NO: 159039 - DNA, 132 bp, Artificial Sequence
  Description of Artificial Sequence: Synthetic coding sequence
atggagacccagctgcagagcatctttgaggaggtggtgaagacagaggtgattgaggaggccttccctggcatgttcatggacaccccagaagatgagaagaccaagctgttcatggagatggagctgtag

SEQ ID NO: 159040 - DNA, 1428 bp, Artificial Sequence
  Description of Artificial Sequence: Synthetic coding sequence
atggagacccagctgcagagcatctttgaggaggtggtgaagacagaggtgattgaggaggccttccctggcatgttcatggacaccccagaagatgagaagaccaagctgatcagctgcctgggcgccttccggcagttctggggcggcctgagccaggagagccatgagcagtgcatccagtggatcgtgaagttcatccacggccagcacagccccaagaggatctccttcctgtatgactgcctggccatggctgtggagaccggcctgctgcccccccggctggtgtgtgagagcctcatcaacagcgacaccctggagtgggagaggacccagctgtgggccctgaccttcaagctggtgaggaagatcatcggcggcgtggactacaagggcgtgcgggacctgctgaaggtgatcctggagaagatcctgaccatccccaacacagtgagcagcgctgtggtgcagcagctgctggccgcccgggaggtgattgcctacatcctggagagaaatgcctgcctgctgcctgcctactttgctgtgacagagatcaggaagctgtacccagagggcaagctgccccactggctgctgggcaacctggtgtctgactttgtggacaccttccggcccacagcccgcatcaacagcatctgtggccgctgcagcctgctgcctgtggtgaacaacagcggggccatctgcaacagctggaagctggaccctgccaccctgcgcttccccctgaagggcctgctgccctatgacaaggacctgtttgagccccagacagccctgctgcgctacgtgctggagcagccctacagccgggacatggtgtgcaacatgctgggcctgaacaagcagcacaagcagcgctgccctgtgctggaggaccagctggtggacctggtggtgtatgccatggagaggagtgaaacagaggagaagtttgatgatggcggcaccagccagctgctgtggcagcacctgagcagccagctgatcttctttgtgctcttccagtttgccagcttcccccacatggtgctgagcctgcaccagaagctggccggccggggcctcatcaagggccgggaccacctgatgtgggtgctgctgcagttcatcagcggcagcatccagaagaatgccctggccgacttcctgcctgtgatgaagctgtttgacctgctgtacccagagaaggagtacatccctgtgcctgacatcaacaagccccagagcacccacgcctttgccatgacctgcatctggatccacctgaacaggaaggcccagaatgacaacagcaagctgcagatccccatcccccacagcctgcggctgcaccatgaaagtgcctttgccaactgcttccagatcacctgcatgggagacctgacccacaccccctag

SEQ ID NO: 159041 - DNA, 429 bp, Artificial Sequence
  Description of Artificial Sequence: Synthetic coding sequence
atgcaccacatccagccccactacagagtgcagctgctgagccacctgcacaccctggccgctgtggcccagaccaaccagaaccagctgcacctgtgtgtggagagcacagccctgcggctcatcacagccctgggcagcagcgaggtgcagccccagttcacccgcttcctgagtgaccccaagacagtgctgtctgctgagagcgaggagctgaacagagccctgatcctgaccctggcccgggccacccacgtgacagacttcttcaccggcagtgacagcatccagggcacctggtgcaaggacatcctgcagaccatcatgtccttcaccccccacaactgggccagccacaccctgagctgcttccctggccccctgcagaccctgctgatcctgggggagctggccctgaggaagacctag

SEQ ID NO: 159042 - DNA, 2661 bp, Artificial Sequence
  Description of Artificial Sequence: Synthetic coding sequence
atggagacccagctgcagagcatctttgaggaggtggtgaagacagaggtgattgaggaggccttccctggcatgttcatggacaccccagaagatgagaagaccaagctgatcagctgcctgggcgccttccggcagttctggggcggcctgagccaggagagccatgagcagtgcatccagtggatcgtgaagttcatccacggccagcacagccccaagaggatctccttcctgtatgactgcctggccatggctgtggagaccggcctgctgcccccccggctggtgtgtgagagcctcatcaacagcgacaccctggagtgggagaggacccagctgtgggccctgaccttcaagctggtgaggaagatcatcggcggcgtggactacaagggcgtgcgggacctgctgaaggtgatcctggagaagatcctgaccatccccaacacagtgagcagcgctgtggtgcagcagctgctggccgcccgggaggtgattgcctacatcctggagagaaatgcctgcctgctgcctgcctactttgctgtgacagagatcaggaagctgtacccagagggcaagctgccccactggctgctgggcaacctggtgtctgactttgtggacaccttccggcccacagcccgcatcaacagcatctgtggccgctgcagcctgctgcctgtggtgaacaacagcggggccatctgcaacagctggaagctggaccctgccaccctgcgcttccccctgaagggcctgctgccctatgacaaggacctgtttgagccccagacagccctgctgcgctacgtgctggagcagccctacagccgggacatggtgtgcaacatgctgggcctgaacaagcaggtgctgaagatcttcaagcacaagcagcgctgccctgtgctggaggaccagctggtggacctggtggtgtatgccatggagaggagtgaaacagaggagaagtttgatgatggcggcaccagccagctgctgtggcagcacctgagcagccagctgatcttctttgtgctcttccagtttgccagcttcccccacatggtgctgagcctgcaccagaagctggccggccggggcctcatcaagggccgggaccacctgatgtgggtgctgctgcagttcatcagcggcagcatccagaagaatgccctggccgacttcctgcctgtgatgaagctgtttgacctgctgtacccagagaaggagtacatccctgtgcctgacatcaacaagccccagagcacccacgcctttgccatgacctgcatctggatccacctgaacaggaaggcccagaatgacaacagcaagctgcagatccccatcccccacagcctgcggctgcaccacgagttcctgcagcagagcctgaggaacaagagcctgcagatgaatgactacaagatcgccctgctgtgcaatgcctacagcaccaacagcgagtgcttcaccctgcccatgggcgccctggtggagaccatctatggaaatggcatcatgaggatccccctgcccggcaccaactgcatggccagcggcagcatcacccccctgcccatgaacctgctggacagcctgactgtgcacgccaagatgagcctcatccacagcatcgccaccagggtcatcaagctggcccacgccaagagctctgtggccctggccccagccctggtggagacctacagccggctgctggtgtacatggagattgagagcctgggcatcaagggcttcatcagccagctgctgcccaccgtcttcaagagccacgcctggggcatcctgcacaccctgctggagatgttctcctacaggatgcaccacatccagccccactacagagtgcagctgctgagccacctgcacaccctggccgctgtggcccagaccaaccagaaccagctgcacctgtgtgtggagagcacagccctgcggctcatcacagccctgggcagcagcgaggtgcagccccagttcacccgcttcctgagtgaccccaagacagtgctgtctgctgagagcgaggagctgaacagagccctgatcctgaccctggcccgggccacccacgtgacagacttcttcaccggcagtgacagcatccagggcacctggtgcaaggacatcctgcagaccatcatgtccttcaccccccacaactgggccagccacaccctgagctgcttccctggccccctgcaggccttcttcaagcagaacaacgtgccccaggagagccgcttcaacctgaagaagaatgtggaggaggagtacaggaagtggaagtccatgagcaatgaaaatgacatcatcacccacttctccatgcagggcagccccccactcttcctgtgcctgctgtggaagatgctgctggagacagaccacatcaaccagatcggctacagagtgctggagcgcatcggggcccgggccctggtggcccacgtgaggacctttgctgacttcctggtgtatgagttcagcaccagcgctgggggccagcagctgaacaagtgcatcgagatcctgaatgacatggtgtggaagtacaacatcgtgaccctggacaggctcatcctgtgcctggtgcgcatcaacaccttcctgagcctcttctcctag

SEQ ID NO: 159043 - DNA, 3030 bp, Artificial Sequence
  Description of Artificial Sequence: Synthetic coding sequence
atggagaggagtgaaacagaggagaagtttgatgatggcggcaccagccagctgctgtggcagcacctgagcagccagctgatcttctttgtgctcttccagtttgccagcttcccccacatggtgctgagcctgcaccagaagtacatccctgtgcctgacatcaacaagccccagagcacccacgcctttgccatgacctgcatctggatccacctgaacaggaaggcccagaatgacaacagcaagctgcagatccccatcccccacagcctgcggctgcaccacgagttcctgcagcagagcctgaggaacaagagcctgcagatgaatgactacaagatcgccctgctgtgcaatgcctacagcaccaacagcgagtgcttcaccctgcccatgggcgccctggtggagaccatctatggaaatggcatcatgaggatccccctgcccggcaccaactgcatggccagcggcagcatcacccccctgcccatgaacctgctggacagcctgactgtgcacgccaagatgagcctcatccacagcatcgccaccagggtcatcaagctggcccacgccaagagctctgtggccctggccccagccctggtggagacctacagccggctgctggtgtacatggagattgagagcctgggcatcaagggcttcatcagccagctgctgcccaccgtcttcaagagccacgcctggggcatcctgcacaccctgctggagatgttctcctacaggatgcaccacatccagccccactacagagtgcagctgctgagccacctgcacaccctggccgctgtggcccagaccaaccagaaccagctgcacctgtgtgtggagagcacagccctgcggctcatcacagccctgggcagcagcgaggtgcagccccagttcacccgcttcctgagtgaccccaagacagtgctgtctgctgagagcgaggagctgaacagagccctgatcctgaccctggcccgggccacccacgtgacagacttcttcaccggcagtgacagcatccagggcacctggtgcaaggacatcctgcagaccatcatgtccttcaccccccacaactgggccagccacaccctgagctgcttccctggccccctgcaggccttcttcaagcagaacaacgtgccccaggagagccgcttcaacctgaagaagaatgtggaggaggagtacaggaagtggaagtccatgagcaatgaaaatgacatcatcacccacttctccatgcagggcagccccccactcttcctgtgcctgctgtggaagatgctgctggagacagaccacatcaaccagatcggctacagagtgctggagagaattggagcccgggccctggtggcccacgtgaggacctttgctgacttcctggtgtatgagttcagcaccagcgctgggggccagcagctgaacaagtgcatcgagatcctgaatgacatggtgtggaagtacaacatcgtgaccctggacaggctcatcctgtgcctggccatgaggagccatgagggcaatgaggcccaggtgtgctacttcatcatccagctgctgctgctgaagcccaatgacttcaggaacagagtgtctgactttgtgaaggagaacagccctgagcactggctgcagaatgactggcacaccaagcacatgaactaccacaagaagtacccagagaagctgtactttgagggcctggccgagcaggtggacccccctgtgcagatccagagcccctacctgcccatctactttggaaatgtgtgcctgcgcttcctgcctgtgtttgacatcgtcatccaccgcttcctggagctgctgcctgtgtccaagagcctggagaccctgctggaccacctgggcggcctgtacaagttccatgacaggcctgtgacctacctgtacaacaccctgcactactatgagatgcacctgcgggaccgggccttcctgaagaggaagctggtgcacgccatcatcggcagcctgaaggacaaccggccccagggctggtgcctgagtgacacctacctgaagtgtgccatgaatgcccgggaggagaacccctgggtgcctgatgacacctactactgccgcctgattggccgcctggtggacaccatggccggcaagagccctggccccttccccaactgtgactggaggttcaatgagttccccaacccagctgcccacgccctgcacgtgacctgtgtggagctgatggccctggccgtgtctgggaaggaggtgggcaatgccctgctgaatgtggtgctgaagagccagcccctggtgccccgggagaacatcacagcctggatgaatgccatcggcctcatcatcacagccctgcctgagccctactggatcgtgctgcatgacagaattgtgtctgtcatcagcagccccagcctgaccagcgagacagagtgggtgggctaccccttccggctgtttgacttcaccgcctgccaccagagctacagcgagatgagctgcagctacaccctggccctggcccatgctgtgtggcaccacagcagcatcggccagctgagcctcatccccaagttcctgacagaggtgctgctgcccatcgtgaagacagagttccagctgctgtatgtgtaccacctggtgggccccttcctgcagcgcttccagcaggagaggacccgctgcatgattgaaattggagtggccttctatgacatgctgctgaatgtggaccagtgcagcacccacctgaactacatggaccccatctgtgacttcctgtaccacatgaagtacatgttcaccggggacagcgtgaaggagcaggtggagaagatcatctgcaacctgaagccagccctgaagctgcggctgcgcttcatcacccacatcagcaagatggagcctgctgctgtgcccccccaggccatgaacagcggcagccctgccccccagagcaaccaggtgcctgtgtccctgcctgtgacccagtag

SEQ ID NO: 159044 - DNA, 2970 bp, Artificial Sequence
  Description of Artificial Sequence: Synthetic coding sequence
atgaaggtggtgaacctgaagcaggccatcctgcaggcctggaaggagcgctggagcgactaccagtgggccatcaacatgaagaagttcttccccaagggggccacctgggacatcctgaacctggctgatgccctgctggagcaggccatgattggccccagccccaaccccctcatcctgagctacctgaagtatgccatcagcagccagatggtgtcctacagctctgtgctgacagccatcagcaagtttgatgacttcagccgggacctgtgtgtgcaggccctgctggacatcatggacatgttctgtgaccggctgagctgccacggcaaggccgaggagtgcatcggcctgtgccgggccctgctgagcgccctgcactggctgctgcgctgcacagctgccagcgctgagcggctgcgggagggcctggaggccggcaccccagctgctggggagaagcagctggccatgtgcctgcagaggctggagaagaccctgagcagcaccaagaacagagccctgctgcacatcgccaagctggaggaggccagctcctggacagccatcgagcacagcctgctgaagctgggggagatcctggccaacctgagcaacccccagctgcggagccaggccgagcagtgtggcaccctcatccgcagcatccccaccatgctgtctgtgcatgctgagcagatgcacaagacaggcttccccaccgtgcacgccgtcatcctgctggagggcaccatgaacctgactggagagacccagagcctggtggagcagctgaccatggtgaagaggatgcagcacatccccacccccctgtttgtgctggagatctggaaggcctgctttgtgggcctcatcgagagccctgagggcacagaggagctgaagtggacagccttcaccttcctgaagatcccccaggtgctggtgaagctgaagaagtacagccatggagacaaggacttcacagaagatgtgaactgtgcctttgagttcctgctgaagctgacccccctgctggacaaggctgaccagcgctgcaactgtgactgcaccaacttcctgctgcaggagtgtgggaagcagggcctgctgtctgaggcctctgtgaacaacctgatggccaagaggaaggctgaccgggagcacgccccccagcagaagtctggagaaaatgccaacatccagcccaacatccagctgatcctgcgggcagagcccaccgtgaccaacatcctgaagaccatggatgctgaccacagcaagagccctgagggcctgctgggcgtgctgggccacatgctgagcggcaagagcctggacctgctgctggccgctgctgctgccaccgggaagctgaagagctttgccaggaagttcatcaacctgaatgagttcaccacctacggcagcgaggagagcaccaagccagcctctgtgcgggccctgctgtttgacatctccttcctgatgctgtgccacgtggcccagacctacggcagcgaggtgatcctgtctgagagcaggactggagctgaggtgcccttctttgagacctggatgcagacctgcatgcctgaggagggcaagatcctgaacccagaccacccctgcttccggccagacagcaccaaggtggagagcctggtggccctgctgaacaacagcagcgagatgaagctggtgcagatgaagtggcatgaggcctgcctgagcatctctgctgccatcctggagatcctgaatgcctgggagaatggagtgctggcctttgagagcatccagaagatcacagacaacatcaagggcaaggtgtgcagcctggccgtgtgtgctgtggcctggctggtggcccacgtgaggatgctgggcctggatgagcgggagaagagcctgcagatgatccggcagctggccggccccctcttcagcgagaacaccctgcagttctacaatgaaagagtggtgatcatgaacagcatcctggagaggatgtgtgctgatgtgctgcagcagacagccacccagatcaagttccccagcactggagtggacaccatgccctactggaacctgctgccccccaagaggcccatcaaggaggtgctgacagacatctttgccaaggtgctggagaagggctgggtggacagccgcagcatccacatctttgacaccctgctgcacatgggcggcgtgtactggttctgcaacaacctgatcaaggagctgctgaaggagaccaggaaggagcacaccctgcgggctgtggagctgctgtacagcatcttctgcctggacatgcagcaggtgaccctggtgctgctgggccacatcctgcccggcctgctgacagacagcagcaagtggcacagcctgatggaccccccaggcacagccctggccaagctggccgtgtggtgtgccctgagcagctacagcagccacaagggccaggccagcacccggcagaagaagaggcaccgggaggacatcgaggactacatcagcctcttccccctggatgatgtgcagcccagcaagctgatgaggctgctgagcagcaatgaagatgatgccaacatcctgagcagccccacagaccgctccatgagcagcagcctgagcgccagccagctgcacacagtgaacatgagggaccccctgaacagagtgctggccaacctcttcctgctgatcagcagcatcctgggcagcaggacagctggcccccacacccagtttgtgcagtggttcatggaggagtgtgtggactgcctggagcagggcggccggggctctgtgctgcagttcatgcccttcaccaccgtgtctgagctggtgaaggtgtctgccatgagcagccccaaggtggtgctggccatcacagacctgagcctgcccctgggccggcaggtggccgccaaggccatcgccgccctgtag

SEQ ID NO: 159045 - DNA, 2970 bp, Artificial Sequence; identical to SEQ ID NO: 159044
  Description of Artificial Sequence: Synthetic coding sequence

SEQ ID NO: 159046 - DNA, 2931 bp, Artificial Sequence
  Description of Artificial Sequence: Synthetic coding sequence
atgaaggtggtgaacctgaagcaggccatcctgcaggcctggaaggagcgctggagcgactaccagtgggccatcaacatgaagaagttcttccccaagggggccacctgggacatcctgaacctggctgatgccctgctggagcaggccatgattggccccagccccaaccccctcatcctgagctacctgaagtatgccatcagcagccagtttgatgacttcagccgggacctgtgtgtgcaggccctgctggacatcatggacatgttctgtgaccggctgagctgccacggcaaggccgaggagtgcatcggcctgtgccgggccctgctgagcgccctgcactggctgctgcgctgcacagctgccagcgctgagcggctgcgggagggcctggaggccggcaccccagctgctggggagaagcagctggccatgtgcctgcagaggctggagaagaccctgagcagcaccaagaacagagccctgctgcacatcgccaagctggaggaggccagctcctggacagccatcgagcacagcctgctgaagctgggggagatcctggccaacctgagcaacccccagctgcggagccaggccgagcagtgtggcaccctcatccgcagcatccccaccatgctgtctgtgcacgccgagcagatgcacaagacaggcttccccaccgtgcatgctgtgatcctgctggagggcaccatgaacctgaccggggagacccagagcctggtggagcagctgaccatggtgaagaggatgcagcacatccccacccccctgtttgtgctggagatctggaaggcctgctttgtgggcctgattgagagccctgagggcacagaggagctgaagtggacagccttcaccttcctgaagatcccccaggtgctggtgaagctgaagaagtacagccacggggacaaggacttcacagaagatgtgaactgtgcctttgagttcctgctgaagctgacccccctgctggacaaggctgaccagcgctgcaactgtgactgcaccaacttcctgctgcaggagtgtgggaagcagggcctgctgtctgaggcctctgtgaacaacctgatggccaagaggaaggctgaccgggagcacgccccccagcagaagagcggggagaatgccaacatccagcccaacatccagctgatcctgcgggcagagcccaccgtgaccaacatcctgaagaccatggatgctgaccacagcaagagccctgagggcctgctgggcgtgctgggccacatgctgagcggcaagagcctggacctgctgctggccgctgctgctgccaccgggaagctgaagagctttgccaggaagttcatcaacctgaatgagttcaccacctacggcagcgaggagagcaccaagccagcctctgtgcgggccctgctgtttgacatctccttcctgatgctgtgccacgtggcccagacctacggcagcgaggtgatcctgtctgagagcaggactggagctgaggtgcccttctttgagacctggatgcagacctgcatgcctgaggagggcaagatcctgaacccagaccacccctgcttccggccagacagcaccaaggtggagagcctggtggccctgctgaacaacagcagcgagatgaagctggtgcagatgaagtggcatgaggcctgcctgagcatctctgctgccatcctggagatcctgaatgcctgggagaatggagtgctggcctttgagagcatccagaagatcacagacaacatcaagggcaaggtgtgcagcctggccgtgtgtgctgtggcctggctggtggcccacgtgaggatgctgggcctggatgagcgggagaagagcctgcagatgatccggcagctggccggccccctcttcagcgagaacaccctgcagttctacaatgaaagagtggtgatcatgaacagcatcctggagaggatgtgtgctgatgtgctgcagcagacagccacccagatcaagttccccagcactggagtggacaccatgccctactggaacctgctgccccccaagaggcccatcaaggaggtgctgacagacatctttgccaaggtgctggagaagggctgggtggacagccgcagcatccacatctttgacaccctgctgcacatgggcggcgtgtactggttctgcaacaacctgatcaaggagctgctgaaggagaccaggaaggagcacaccctgcgggctgtggagctgctgtacagcatcttctgcctggacatgcagcaggtgaccctggtgctgctgggccacatcctgcccggcctgctgacagacagcagcaagtggcacagcctgatggaccccccaggcacagccctggccaagctggccgtgtggtgtgccctgagcagctacagcagccacaagggccaggccagcacccggcagaagaagaggcacagagaagatattgaggactacatcagcctcttccccctggatgatgtgcagcccagcaagctgatgaggctgctgagcagcaatgaagatgatgccaacatcctgagcagccccacagaccgctccatgagcagcagcctgagcgccagccagctgcacacagtgaacatgagggaccccctgaacagagtgctggccaacctcttcctgctgatcagcagcatcctgggcagcaggacagctggcccccacacccagtttgtgcagtggttcatggaggagtgtgtggactgcctggagcagggcggccggggctctgtgctgcagttcatgcccttcaccaccgtgtctgagctggtgaaggtgtctgccatgagcagccccaaggtggtgctggccatcacagacctgagcctgcccctgggccggcaggtggccgccaaggccatcgccgccctgtag

SEQ ID NO: 159047 - DNA, 2970 bp, Artificial Sequence; identical to SEQ ID NO: 159044
  Description of Artificial Sequence: Synthetic coding sequence

SEQ ID NO: 159048 - DNA, 864 bp, Artificial Sequence
  Description of Artificial Sequence: Synthetic coding sequence
tgaaacctgatcaaggagctgctgaaggagaccaggaaggagcacaccctgcgggctgtggagctgctgtacagcatcttctgcctggacatgcagcaggtgaccctggtgctgctgggccacatcctgcccggcctgctgacagacagcagcaagtggcacagcctgatggaccccccaggcacagccctggccaagctggccgtgtggtgtgccctgagcagctacagcagccacaagggccaggccagcacccggcagaagaagaggcacagagaagatattgaggactacatcagcctcttccccctggatgatgtgcagcccagcaagctgatgaggctgctgagcagcaatgaagatgatgccaacatcctgagcagccccaggagcagcctgggcagcccctgcaccagctacctgcgctgggtgaaggtgggcctgggccaccccaggggggcccccctgctgcacagcgctggctgcttccctgccctgcacctgctgcggcccacagctgaccgctccatgagcagcagcctgagcgccagccagctgcacacagtgaacatgagggaccccctgaacagagtgctggccaacctcttcctgctgatcagcagcatcctgggcagcaggacagctggcccccacacccagtttgtgcagtggttcatggaggagtgtgtggactgcctggagcagggcggccggggctctgtgctgcagttcatgcccttcaccaccgtgtctgagctggtgaaggtgtctgccatgagcagccccaaggtggtgctggccatcacagacctgagcctgcccctgggccggcaggtggccgccaaggccatcgccgccctgtag

SEQ ID NO: 159049 - DNA, 906 bp, Artificial Sequence
  Description of Artificial Sequence: Synthetic coding sequence
atgaaggtggtgaacctgaagcaggccatcctgcaggcctggaaggagcgctggagcgactaccagtgggccatcaacatgaagaagttcttccccaagggggccacctgggacatcctgaacctggctgatgccctgctggagcaggccatgattggccccagccccaaccccctcatcctgagctacctgaagtatgccatcagcagccagatggtgtcctacagctctgtgctgacagccatcagcaagtttgatgacttcagccgggacctgtgtgtgcaggccctgctggacatcatggacatgttctgtgaccggctgagctgccacggcaaggccgaggagtgcatcggcctgtgccgggccctgctgagcgccctgcactggctgctgcgctgcacagctgccagcgctgagcggctgcgggagggcctggaggccggcaccccagctgctggggagaagcagctggccatgtgcctgcagaggctggagaagaccctgagcagcaccaagaacagagccctgctgcacatcgccaagctggaggaggccagcctgcacaccagccagggcctgggccagggcggcacccgggccaaccagcccacagcctcctggacagccatcgagcacagcctgctgaagctgggggagatcctggccaacctgagcaacccccagctgcggagccaggccgagcagtgtggcaccctcatccgcagcatccccaccatgctgtctgtgcacgccgagcagatgcacaagacaggcttccccaccgtgcatgctgtgatcctgctggagggcaccatgaacctgaccggggagacccagagcctggtggagcagctgaccatggtgaagaggatgcagcacatccccacccccctgtttgtgtag

SEQ ID NO: 159050 - DNA, 2700 bp, Artificial Sequence
  Description of Artificial Sequence: Synthetic coding sequence
atgcccctggtgccccgctggtgccccaccctgctgagcagccagcccagcgtgtcctgccacggcaaggccgaggagtgcatcggcctgtgccgggccctgctgagcgccctgcactggctgctgcgctgcacagctgccagcgctgagcggctgcgggagggcctggaggccggcaccccagctgctggggagaagcagctggccatgtgcctgcagaggctggagaagaccctgagcagcaccaagaacagagccctgctgcacatcgccaagctggaggaggccagctcctggacagccatcgagcacagcctgctgaagctgggggagatcctggccaacctgagcaacccccagctgcggagccaggccgagcagtgtggcaccctcatccgcagcatccccaccatgctgtctgtgcatgctgagcagatgcacaagacaggcttccccaccgtgcacgccgtcatcctgctggagggcaccatgaacctgactggagagacccagagcctggtggagcagctgaccatggtgaagaggatgcagcacatccccacccccctgtttgtgctggagatctggaaggcctgctttgtgggcctcatcgagagccctgagggcacagaggagctgaagtggacagccttcaccttcctgaagatcccccaggtgctggtgaagctgaagaagtacagccatggagacaaggacttcacagaagatgtgaactgtgcctttgagttcctgctgaagctgacccccctgctggacaaggctgaccagcgctgcaactgtgactgcaccaacttcctgctgcaggagtgtgggaagcagggcctgctgtctgaggcctctgtgaacaacctgatggccaagaggaaggctgaccgggagcacgccccccagcagaagtctggagaaaatgccaacatccagcccaacatccagctgatcctgcgggcagagcccaccgtgaccaacatcctgaagaccatggatgctgaccacagcaagagccctgagggcctgctgggcgtgctgggccacatgctgagcggcaagagcctggacctgctgctggccgctgctgctgccaccgggaagctgaagagctttgccaggaagttcatcaacctgaatgagttcaccacctacggcagcgaggagagcaccaagccagcctctgtgcgggccctgctgtttgacatctccttcctgatgctgtgccacgtggcccagacctacggcagcgaggtgatcctgtctgagagcaggactggagctgaggtgcccttctttgagacctggatgcagacctgcatgcctgaggagggcaagatcctgaacccagaccacccctgcttccggccagacagcaccaaggtggagagcctggtggccctgctgaacaacagcagcgagatgaagctggtgcagatgaagtggcatgaggcctgcctgagcatctctgctgccatcctggagatcctgaatgcctgggagaatggagtgctggcctttgagagcatccagaagatcacagacaacatcaagggcaaggtgtgcagcctggccgtgtgtgctgtggcctggctggtggcccacgtgaggatgctgggcctggatgagcgggagaagagcctgcagatgatccggcagctggccggccccctcttcagcgagaacaccctgcagttctacaatgaaagagtggtgatcatgaacagcatcctggagaggatgtgtgctgatgtgctgcagcagacagccacccagatcaagttccccagcactggagtggacaccatgccctactggaacctgctgccccccaagaggcccatcaaggaggtgctgacagacatctttgccaaggtgctggagaagggctgggtggacagccgcagcatccacatctttgacaccctgctgcacatgggcggcgtgtactggttctgcaacaacctgatcaaggagctgctgaaggagaccaggaaggagcacaccctgcgggctgtggagctgctgtacagcatcttctgcctggacatgcagcaggtgaccctggtgctgctgggccacatcctgcccggcctgctgacagacagcagcaagtggcacagcctgatggaccccccaggcacagccctggccaagctggccgtgtggtgtgccctgagcagctacagcagccacaagggccaggccagcacccggcagaagaagaggcaccgggaggacatcgaggactacatcagcctcttccccctggatgatgtgcagcccagcaagctgatgaggctgctgagcagcaatgaagatgatgccaacatcctgagcagccccacagaccgctccatgagcagcagcctgagcgccagccagctgcacacagtgaacatgagggaccccctgaacagagtgctggccaacctcttcctgctgatcagcagcatcctgggcagcaggacagctggcccccacacccagtttgtgcagtggttcatggaggagtgtgtggactgcctggagcagggcggccggggctctgtgctgcagttcatgcccttcaccaccgtgtctgagctggtgaaggtgtctgccatgagcagccccaaggtggtgctggccatcacagacctgagcctgcccctgggccggcaggtggccgccaaggccatcgccgccctgtag

SEQ ID NO: 159051 - DNA, 756 bp, Artificial Sequence
  Description of Artificial Sequence: Synthetic coding sequence
atgaagaagttcttccccaagggggccacctgggacatcctgaacctggctgatgccctgctggagcaggccatgattggccccagccccaaccccctcatcctgagctacctgaagtatgccatcagcagccagatggtgtcctacagctctgtgctgacagccatcatggagatcctgaatgcctgggagaatggagtgctggcctttgagagcatccagaagatcacagacaacatcaagggcaaggtgtgcagcctggccgtgtgtgctgtggcctggctggtggcccacgtgaggatgctgggcctggatgagcgggagaagagcctgcagatgatccggcagctggccggccccctcttcagcgagaacaccctgcagttctacaatgaaagagtggtgatcatgaacagcatcctggagaggatgtgtgctgatgtgctgcagcagacagccacccagatcaagttccccagcactggagtggacaccatgccctactggaacctgctgccccccaagaggcccatcaaggaggtgctgacagacatctttgccaaggtgctggagaagggctgggtggacagccgcagcatccacatctttgacaccctgctgcacatgggcggcgtgtactggttctgcaacaacctgatcaaggagctgctgaaggagaccaggaaggagcacaccctgcgggctgtggagctgctgtacagcatcttctgcctggacatgcagcaggtgacctag

SEQ ID NO: 159052 - DNA, 2466 bp, Artificial Sequence
  Description of Artificial Sequence: Synthetic coding sequence
atgattggccccagccccaaccccctcatcctgagctacctgaagtatgccatcagcagccagatggtgtcctacagctctgtgctgacagccatcagcaagtttgatgacttcagccgggacctgtgtgtgcaggccctgctggacatcatggacatgttctgtgaccggctgagctgccacggcaaggccgaggagtgcatcggcctgtgccgggccctgctgagcgccctgcactggctgctgcgctgcacagctgccagcgctgagcggctgcgggagggcctggaggccggcaccccagctgctggggagaagcagctggccatgtgcctgcagaggctggagaagaccctgagcagcaccaagaacagagccctgctgcacatcgccaagctggaggaggccagctcctggacagccatcgagcacagcctgctgaagctgggggagatcctggccaacctgagcaacccccagctgcggagccaggccgagcagtgtggcaccctcatccgcagcatccccaccatgctgtctgtgcatgctgagcagatgcacaagacaggcttccccaccgtgcacgccgtcatcctgctggagggcaccatgaacctgactggagagacccagagcctggtggagcagctgaccatggtgaagaggatgcagcacatccccacccccctgtttgtgctggagatctggaaggcctgctttgtgggcctcatcgagagccctgagggcacagaggagctgaagtggacagccttcaccttcctgaagatcccccaggtgctggtgaagctgaagaagtacagccatggagacaaggacttcacagaagatgtgaactgtgcctttgagttcctgctgaagctgacccccctgctggacaaggctgaccagcgctgcaactgtgactgcaccaacttcctgctgcaggagtgtgggaagcagggcctgctgtctgaggcctctgtgaacaacctgatggccaagaggaaggctgaccgggagcacgccccccagcagaagtctggagaaaatgccaacatccagcccaacatccagctgatcctgcgggcagagcccaccgtgaccaacatcctgaagaccatggatgctgaccacagcaagagccctgagggcctgctgggcgtgctgggccacatgctgagcggcaagagcctggacctgctgctggccgctgctgctgccaccgggaagctgaagagctttgccaggaagttcatcaacctgaatgagttcaccacctacggcagcgaggagagcaccaagccagcctctgtgcgggccctgctgtttgacatctccttcctgatgctgtgccacgtggcccagacctacggcagcgaggtgatcctgtctgagagcaggactggagctgaggtgcccttctttgagacctggatgcagacctgcatgcctgaggagggcaagatcctgaacccagaccacccctgcttccggccagacagcaccaaggtggagagcctggtggccctgctgaacaacagcagcgagatgaagctggtgcagatgaagtggcatgaggcctgcctgagcatctctgctgccatcctggagatcctgaatgcctgggagaatggagtgctggcctttgagagcatccagaagatcacagacaacatcaagggcaaggtgtgcagcctggccgtgtgtgctgtggcctggctggtggcccacgtgaggatgctgggcctggatgagcgggagaagagcctgcagatgatccggcagctggccggccccctcttcagcgagaacaccctgcagttctacaatgaaagagtggtgatcatgaacagcatcctggagaggatgtgtgctgatgtgctgcagcagacagccacccagatcaagttccccagcactggagtggacaccatgccctactggaacctgctgccccccaagaggcccatcaaggaggtgctgacagacatctttgccaaggtgctggagaagggctgggtggacagccgcagcatccacatctttgacaccctgctgcacatgggcggcgtgtactggttctgcaacaacctgatcaaggagctgctgaaggagaccaggaaggagcacaccctgcgggctgtggagctgctgtacagcatcttctgcctggacatgcagcaggtgaccctggtgctgctgggccacatcctgcccggcctgctgacagacagcagcaagtggcacagcctgatggaccccccaggcacagccctggccaagctggccgtgtggtgtgccctgagcagctacagcagccacaagggccaggccagcacccggcagaagaagaggcaccgggaggacatcgaggactacatcagccccaaggtggtgctggccatcacagacctgagcctgcccctgggccggcaggtggccgccaaggccatcgccgccctgtag

SEQ ID NO: 159053 - DNA, 1026 bp, Artificial Sequence
  Description of Artificial Sequence: Synthetic coding sequence
atgaagaagttcttccccaagggggccacctgggacatcctgaacctggctgatgccctgctggagcaggccatgattggccccagccccaaccccctcatcctgagctacctgaagtatgccatcagcagccagatggtgtcctacagctctgtgctgacagccatcagcaagtttgatgacttcagccgggacctgtgtgtgcaggccctgctggacatcatggacatgttctgtgaccggctgagctgccacggcaaggccgaggagtgcatcggcctgtgccgggccctgctgagcgccctgcactggctgctgcgctgcacagctgccagcgctgagcggctgcgggagggcctggaggccggcaccccagctgctggggagaagcagctggccatgtgcctgcagaggctggagaagaccctgagcagcaccaagaacagagccctgctgcacatcgccaagctggaggaggccagctcctggacagccatcgagcacagcctgctgaagctgggggagatcctggccaacctgagcaacccccagctgcggagccaggccgagcagtgtggcaccctcatccgcagcatccccaccatgctgtctgtgcatgctgagcagatgcacaagacaggcttccccaccgtgcacgccgtcatcctgctggagggcaccatgaacctgactggagagacccagagcctggtggagcagcagacagccacccagatcaagttccccagcactggagtggacaccatgccctactggaacctgctgccccccaagaggcccatcaaggaggtgctgacagacatctttgccaaggtgctggagaagggctgggtggacagccgcagcatccacatctttgacaccctgctgcacatgggcggcgtgtactggttctgcaacaacctgatcaaggagctgctgaaggagaccaggaaggagcacaccctgcgggctgtggagctgctgtacagcatcttctgcctggacatgcagcaggtgacctag

SEQ ID NO: 159054 - DNA, 2796 bp, Artificial Sequence
  Description of Artificial Sequence: Synthetic coding sequence
atgaaggtggtgaacctgaagcaggccatcctgcaggcctggaaggagcgctggagcgactaccagtgggccatcaacatgaagaagttcttccccaagggggccacctgggacatcctgaacctggctgatgccctgctggagcaggccatgattggccccagccccaaccccctcatcctgagctacctgaagtatgccatcagcagccagatggtgtcctacagctctgtgctgacagccatcatgtgcctgcagaggctggagaagaccctgagcagcaccaagaacagagccctgctgcacatcgccaagctggaggaggccagcctgcacaccagccagggcctgggccagggcggcacccgggccaaccagcccacagcctcctggacagccatcgagcacagcctgctgaagctgggggagatcctggccaacctgagcaacccccagctgcggagccaggccgagcagtgtggcaccctcatccgcagcatccccaccatgctgtctgtgcatgctgagcagatgcacaagacaggcttccccaccgtgcacgccgtcatcctgctggagggcaccatgaacctgactggagagacccagagcctggtggagcagctgaccatggtgaagaggatgcagcacatccccacccccctgtttgtgctggagatctggaaggcctgctttgtgggcctcatcgagagccctgagggcacagaggagctgaagtggacagccttcaccttcctgaagatcccccaggtgctggtgaagctgaagaagtacagccatggagacaaggacttcacagaagatgtgaactgtgcctttgagttcctgctgaagctgacccccctgctggacaaggctgaccagcgctgcaactgtgactgcaccaacttcctgctgcaggagtgtgggaagcagggcctgctgtctgaggcctctgtgaacaacctgatggccaagaggaaggctgaccgggagcacgccccccagcagaagtctggagaaaatgccaacatccagcccaacatccagctgatcctgcgggcagagcccaccgtgaccaacatcctgaagaccatggatgctgaccacagcaagagccctgagggcctgctgggcgtgctgggccacatgctgagcggcaagagcctggacctgctgctggccgctgctgctgccaccgggaagctgaagagctttgccaggaagttcatcaacctgaatgagttcaccacctacggcagcgaggagagcaccaagccagcctctgtgcgggccctgctgtttgacatctccttcctgatgctgtgccacgtggcccagacctacggcagcgaggtgatcctgtctgagagcaggactggagctgaggtgcccttctttgagacctggatgcagacctgcatgcctgaggagggcaagatcctgaacccagaccacccctgcttccggccagacagcaccaaggtggagagcctggtggccctgctgaacaacagcagcgagatgaagctggtgcagatgaagtggcatgaggcctgcctgagcatctctgctgccatcctggagatcctgaatgcctgggagaatggagtgctggcctttgagagcatccagaagatcacagacaacatcaagggcaaggtgtgcagcctggccgtgtgtgctgtggcctggctggtggcccacgtgaggatgctgggcctggatgagcgggagaagagcctgcagatgatccggcagctggccggccccctcttcagcgagaacaccctgcagttctacaatgaaagagtggtgatcatgaacagcatcctggagaggatgtgtgctgatgtgctgcagcagacagccacccagatcaagttccccagcactggagtggacaccatgccctactggaacctgctgccccccaagaggcccatcaaggaggtgctgacagacatctttgccaaggtgctggagaagggctgggtggacagccgcagcatccacatctttgacaccctgctgcacatgggcggcgtgtactggttctgcaacaacctgatcaaggagctgctgaaggagaccaggaaggagcacaccctgcgggctgtggagctgctgtacagcatcttctgcctggacatgcagcaggtgaccctggtgctgctgggccacatcctgcccggcctgctgacagacagcagcaagtggcacagcctgatggaccccccaggcacagccctggccaagctggccgtgtggtgtgccctgagcagctacagcagccacaagggccaggccagcacccggcagaagaagaggcaccgggaggacatcgaggactacatcagcctcttccccctggatgatgtgcagcccagcaagctgatgaggctgctgagcagcaatgaagatgatgccaacatcctgagcagccccacagaccgctccatgagcagcagcctgagcgccagccagctgcacacagtgaacatgagggaccccctgaacagagtgctggccaacctcttcctgctgatcagcagcatcctgggcagcaggacagctggcccccacacccagtttgtgcagtggttcatggaggagtgtgtggactgcctggagcagggcggccggggctctgtgctgcagttcatgcccttcaccaccgtgtctgagctggtgaaggtgtctgccatgagcagccccaaggtggtgctggccatcacagacctgagcctgcccctgggccggcaggtggccgccaaggccatcgccgccctgtag

SEQ ID NO: 159055 - DNA, 444 bp, Artificial Sequence
  Description of Artificial Sequence: Synthetic coding sequence
atgaagaagttcttccccaagggggccacctgggacatcctgaacctggctgatgccctgctggagcaggccatgattggccccagccccaaccccctcatcctgagctacctgaagtatgccatcagcagccagatggtgtcctacagctctgtgctgacagccatcagcaagtttgatgacttcagccgggacctgtgtgtgcaggccctgctggacatcatggacatgttctgtgaccggctgagctgccacggcaaggccgaggagtgcatcggcctgtgccgggccctgctgagcgccctgcacttcatgcccttcaccaccgtgtctgagctggtgaaggtgtctgccatgagcagccccaaggtggtgctggccatcacagacctgagcctgcccctgggccggcaggtggccgccaaggccatcgccgccctgtag

SEQ ID NO: 159056 - DNA, 921 bp, Artificial Sequence
  Description of Artificial Sequence: Synthetic coding sequence
atgaagaagttcttccccaagggggccacctgggacatcctgaacctggctgatgccctgctggagcaggccatgattggccccagccccaaccccctcatcctgagctacctgaagtatgccatcagcagccagatggtgtcctacagctctgtgctgacagccatcagcaagtttgatgacttcagccgggacctgtgtgtgcaggccctgctggacatcatggacatgttctgtgaccggctgagctgccacggcaaggccgaggagtgcatcggcctgtgccgggccctgctgagcgccctgcactggctgctgcgctgcacagctgccagcgctgagcggctgcgggagggcctggaggccggcaccccagctgctggggagaagcagctggccatgtgcctgcagaggctggagaagaccctgagcagcaccaagaacagagccctgctgcacatcgccaagctggaggaggccagctcctggacagccatcgagcacagcctgctgaagctgggggagatcctggccaacctgagcaacccccagctgcggagccaggccgagcagtgtggcaccctcatccgcagcatccccaccatgctgtctgtgcatgctgagcagatgcacaagacaggcttccccaccgtgcacgccgtcatcctgctggagggcaccatgaacctgactggagagacccagagcctggtggagcagctgaccatggtgaagaggatgcagcacatccccacccccctgtttggccggggctctgtgctgcagttcatgcccttcaccaccgtgtctgagctggtgaaggtgtctgccatgagcagccccaaggtggtgctggccatcacagacctgagcctgcccctgggccggcaggtggccgccaaggccatcgccgccctgtag

SEQ ID NO: 159057 - DNA, 2244 bp, Artificial Sequence
  Description of Artificial Sequence: Synthetic coding sequence
atggtgcccggcagcgagggccctgcccgggccggctctgtggtggctgatgtggtgtttgtgattgagggcacagccaacctgggcccctactttgagggcctgaggaagcactacctgctgcctgccatcgagtacttcaacggcggccccccagctgagacagactttggaggagactatggaggcacccagtacagcctggtggtgttcaacacagtggactgtgcccctgagagctatgtgcagtgccacgcccccaccagcagcgcctatgaatttgtgacctggctggatggcatcaagttcatgggcggcggcggggagagctgcagcctgattgctgagggcctgagcacagccctgcagctgtttgatgacttcaagaagatgagggagcagatcggccagacccaccgggtgtgcctgctgatctgcaacagccccccctacctgctgcctgctgtggagagcaccacctacagcggctgcaccacagagaacctggtgcagcagattggagagcggggcatccacttcagcatcgtgagccccaggaagctgcctgccctgcggctgctgtttgagaaggccgcccccccagccctgctggagcccctgcagcccccaacagatgtgtcccaggaccccaggcacatggtgctggtgcggggcctggtgctgcctgtgggcggcggcagcgcccctggccccctgcagagcaagcagcctgtgcccctgcccccagctgcccccagcggggccaccctgtctgctgccccccagcagcccctgccccctgtgcccccccagtaccaggtgcccggcaacctgtctgctgcccaggtggccgcccagaatgctgtggaggccgccaagaaccagaaggccggcctgggcccccgcttcagccccatcacccccctgcagcaggccgcccctggggtgggcccccccttcagccaggccccagccccccagctgcccccaggccccccaggggcccccaagcccccaccagccagccagcccagcctggtgtccacagtggcccctggcagcggcctggcccccacagcccagcccggggcccccagcatggccggcaccgtggcccctggaggagtgtctggccccagccctgcccagctgggcgccccagccctgggcggccagcagagcgtgagcaacaagctgctggcctggagcggcgtgctggagtggcaggagaagcccaagccagcctctgtggatgccaacaccaagctgaccaggagcctgccctgccaggtgtatgtgaaccacggggagaacctgaagacagagcagtggccccagaagctgatcatgcagctgatcccccagcagctgctgaccaccctgggccccctcttcaggaacagcaggatggtgcagttccacttcaccaacaaggacctggagagcctgaagggcctgtaccgcatcatgggaaatggatttgctggctgtgtgcacttcccccacacagccccctgtgaggtgcgggtgctgatgctgctgtacagcagcaagaagaagatcttcatgggcctcatcccctatgaccagagcggctttgtgaatggcatccggcaggtgatcaccaaccacaagcaggtgcagcagcagaagctggagcagcagcagaggggcatgggcggccagcaggcccctcctggcctgggccccatcctggaggaccaggcccggcccagccagaacctgctgcagctgcggcccccccagccccagccccagggcaccgtgggcgccagcggggccaccggccagccccagccccagggcacagcccagcccccacctggggccccccagggccccccaggggccgccagcggccccccacctcctggccccatcctgcggccccagaaccctggggccaacccccagctgcggagcctgctgctgaaccccccaccaccccagacaggagtgcccccaccccaggccagcctgcaccacctgcagcccccaggggccccagccctgctgcccccaccccaccagggcctgggccagccccagctgggcccccccctgctgcaccccccaccagcccagagctggccagcccagctgcccccccgggcccccctgcccggccagatgctgctgagcggcggcccccggggccctgtgccccagcccggcctgcagcccagcgtgatggaggatgacatcctgatggacctgatctag

SEQ ID NO: 159058 - DNA, 2268 bp, Artificial Sequence
  Description of Artificial Sequence: Synthetic coding sequence
atggtgcccggcagcgagggccctgcccgggccggctctgtggtggctgatgtggtgtttgtgattgagggcacagccaacctgggcccctactttgagggcctgaggaagcactacctgctgcctgccatcgagtacttcaacggcggccccccagctgagacagactttggaggagactatggaggcacccagtacagcctggtggtgttcaacacagtggactgtgcccctgagagctatgtgcagtgccacgcccccaccagcagcgcctatgaatttgtgacctggctggatggcatcaagttcatgggcggcggcggggagagctgcagcctgattgctgagggcctgagcacagccctgcagctgtttgatgacttcaagaagatgagggagcagatcggccagacccaccgggtgtgcctgctgatctgcaacagccccccctacctgctgcctgctgtggagagcaccacctacagcggctgcaccacagagaacctggtgcagcagattggagagcggggcatccacttcagcatcgtgagccccaggaagctgcctgccctgcggctgctgtttgagaaggccgcccccccagccctgctggagcccctgcagcccccaacagatgtgtcccaggaccccaggcacatggtgctggtgcggggcctggtgctgcctgtgggcggcggcagcgcccctggccccctgcagagcaagcagcctgtgcccctgcccccagctgcccccagcggggccaccctgtctgctgccccccagcagcccctgccccctgtgcccccccagtaccaggtgcccggcaacctgtctgctgcccaggtggccgcccagaatgctgtggaggccgccaagaaccagaaggccggcctgggcccccgcttcagccccatcacccccctgcagcaggccgcccctggggtgggcccccccttcagccaggccccagccccccagctgcccccaggccccccaggggcccccaagcccccaccagccagccagcccagcctggtgtccacagtggcccctggcagcggcctggcccccacagcccagcccggggcccccagcatggccggcaccgtggcccctggaggagtgtctggccccagccctgcccagctgggcgccccagccctgggcggccagcagagcgtgagcaacaagctgctggcctggagcggcgtgctggagtggcaggagaagcccaagccagcctctgtggatgccaacaccaagctgaccaggagcctgccctgccaggtgtatgtgaaccacggggagaacctgaagacagagcagtggccccagaagctgatcatgcagctgatcccccagcagctgctgaccaccctgggccccctcttcaggaacagcaggatggtgcagttccacttcaccaacaaggacctggagagcctgaagggcctgtaccgcatcatgggaaatggatttgctggctgtgtgcacttcccccacacagccccctgtgaggtgcgggtgctgatgctgctgtacagcagcaagaagaagatcttcatgggcctcatcccctatgaccagagcggctttgtgaatggcatccggcaggtgatcaccaaccacaagcaggtgcagcagcagaagctggagcagcagcagaggggcatgggcggccagcaggcccctcctggcctgggccccatcctggaggaccaggcccggcccagccagaacctgctgcagctgcggcccccccagccccagccccagggcaccgtgggcgccagcggggccaccggccagccccagccccagggcacagcccagcccccacctggggccccccagggccccccaggggccgccagcggccccccacctcctggccccatcctgcggccccagaaccctggggccaacccccagctgcggagcctgctgctgaaccccccaccaccccagacaggagtgcccccaccccaggccagcctgcaccaccacctgcccagccctggcccccacaacttccccctgggcctgcactgccaggtgcggggccctgggggcggccagaggagcggcctgtctgtgcctgctgcccctggcctggagcaccaggacagagtgctgctgggcagcaaggacatcggcagcaagaatgaaggcagccccatccgggcctgcagccctgcctcctggaggaccaccagctcctggatcagcagcgagagccccacccccaacaaggtgcccttctag

SEQ ID NO: 159059 - DNA, 2349 bp, Artificial Sequence
  Description of Artificial Sequence: Synthetic coding sequence
atggtgcccggcagcgagggccctgcccgggccggctctgtggtggctgatgtggtgtttgtgattgagggcacagccaacctgggcccctactttgagggcctgaggaagcactacctgctgcctgccatcgagtacttcaacggcggccccccagctgagacagactttggaggagactatggaggcacccagtacagcctggtggtgttcaacacagtggactgtgcccctgagagctatgtgcagtgccacgcccccaccagcagcgcctatgaatttgtgacctggctggatggcatcaagttcatgggcggcggcggggagagctgcagcctgattgctgagggcctgagcacagccctgcagctgtttgatgacttcaagaagatgagggagcagatcggccagacccaccgggtgtgcctgctgatctgcaacagccccccctacctgctgcctgctgtggagagcaccacctacagcggctgcaccacagagaacctggtgcagcagattggagagcggggcatccacttcagcatcgtgagccccaggaagctgcctgccctgcggctgctgtttgagaaggccgcccccccagccctgctggagcccctgcagcccccaacagatgtgtcccaggaccccaggcacatggtgctggtgcggggcctggtgctgcctgtgggcggcggcagcgcccctggccccctgcagagcaagcagcctgtgcccctgcccccagctgcccccagcggggccaccctgtctgctgccccccagcagcccctgccccctgtgcccccccagtaccaggtgcccggcaacctgtctgctgcccaggtggccgcccagaatgctgtggaggccgccaagaaccagaaggccggcctgggcccccgcttcagccccatcacccccctgcagcaggccgcccctggggtgggcccccccttcagccaggccccagccccccagctgcccccaggccccccaggggcccccaagcccccaccagccagccagcccagcctggtgtccacagtggcccctggcagcggcctggcccccacagcccagcccggggcccccagcatggccggcaccgtggcccctggaggagtgtctggccccagccctgcccagctgggcgccccagccctgggcggccagcagagcgtgagcaacaagctgctggcctggagcggcgtgctggagtggcaggagaagcccaagccagcctctgtggatgccaacaccaagctgaccaggagcctgccctgccaggtgtatgtgaaccacggggagaacctgaagacagagcagtggccccagaagctgatcatgcagctgatcccccagcagctgctgaccaccctgggccccctcttcaggaacagcaggatggtgcagttccacttcaccaacaaggacctggagagcctgaagggcctgtaccgcatcatgggaaatggatttgctggctgtgtgcacttcccccacacagccccctgtgaggtgcgggtgctgatgctgctgtacagcagcaagaagaagatcttcatgggcctcatcccctatgaccagagcggctttgtgaatggcatccggcaggtgatcaccaaccacaagcaggtgcagcagcagaagctggagcagcagcagaggggcatgggcggccagcaggcccctcctggcctgggccccatcctggaggaccaggcccggcccagccagaacctgctgcagctgcggcccccccagccccagccccagggcaccgtgggcgccagcggggccaccggccagccccagccccagggcacagcccagcccccacctggggccccccagggccccccaggggccgccagcggccccccacctcctggccccatcctgcggccccagaaccctggggccaacccccagctgcggagcctgctgctgaaccccccaccaccccagacaggagtgcccccaccccaggccagcctgcaccacctgcagcccccaggggccccagccctgctgcccccaccccaccagggcctgggccagccccagctgggcccccccctgctgcaccccccaccagcccagagctggccagcccagctgcccccccgggcccccctgcctgctgccaagaggaagcgggagggggagggccgggtcttccgggagaagtgggagcgggcctacttctttgtggaggtgaagtccatgcccatgtgcctgatctgcaagcagatcgtgtctgtgctgaaggagtacaacctgaagaggcactatgagagcaagcacagcaagagctatgaccagtacacagagcagaccaggtag

SEQ ID NO: 159060 - DNA, 1449 bp, Artificial Sequence
  Description of Artificial Sequence: Synthetic coding sequence
atggtgcccggcagcgagggccctgcccgggccggctctgtggtggctgatgtggtgtttgtgattgagggcacagccaacctgggcccctactttgagggcctgaggaagcactacctgctgcctgccatcgagtacttcaacggcggccccccagcccccttcagccaggccccagccccccagctgcccccaggccccccaggggcccccaagcccccaccagccagccagcccagcctggtgtccacagtggcccctggcagcggcctggcccccacagcccagcccggggcccccagcatggccggcaccgtggcccctgggggcgtgtctggccccagccctgcccagctgggcgccccagccctgggcggccagcagagcgtgagcaacaagctgctggcctggagcggcgtgctggagtggcaggagaagcccaagccagcctctgtggatgccaacaccaagctgaccaggagcctgccctgccaggtgtatgtgaaccacggggagaacctgaagacagagcagtggccccagaagctgatcatgcagctgatcccccagcagctgctgaccaccctgggccccctcttcaggaacagcaggatggtgcagttccacttcaccaacaaggacctggagagcctgaagggcctgtaccgcatcatgggaaatggatttgctggctgtgtgcacttcccccacacagccccctgtgaggtgcgggtgctgatgctgctgtacagcagcaagaagaagatcttcatgggcctcatcccctatgaccagagcggctttgtgaatggcatccggcaggtgatcaccaaccacaagcaggtgcagcagcagaagctggagcagcagcagaggggcatgggcggccagcaggcccctcctggcctgggccccatcctggaggaccaggcccggcccagccagaacctgctgcagctgcggcccccccagccccagccccagggcaccgtgggcgccagcggggccaccggccagccccagccccagggcacagcccagcccccacctggggccccccagggccccccaggagctgccagcggccccccacctcctggccccatcctgcggccccagaaccctggggccaacccccagctgcggagcctgctgctgaaccccccaccaccccagacaggagtgcccccaccccaggccagcctgcaccacctgcagcccccaggggccccagccctgctgcccccaccccaccagggcctgggccagccccagctgggcccccccctgctgcaccccccaccagcccagagctggccagcccagctgcccccccgggcccccctgcccggccagatgctgctgagcggcggcccccggggccctgtgccccagcccggcctgcagcccagcgtgatggaggatgacatcctgatggacctgatctag

SEQ ID NO: 159061 - DNA, 2385 bp, Artificial Sequence
  Description of Artificial Sequence: Synthetic coding sequence
atggtgcccggcagcgagggccctgcccgggccggctctgtggtggctgatgtggtgtttgtgattgagggcacagccaacctgggcccctactttgagggcctgaggaagcactacctgctgcctgccatcgagtacttcaacggcggccccccagctgagacagactttggaggagactatggaggcacccagtacagcctggtggtgttcaacacagtggactgtgcccctgagagctatgtgcagtgccacgcccccaccagcagcgcctatgaatttgtgacctggctggatggcatcaagttcatgggcggcggcggggagagctgcagcctgattgctgagggcctgagcacagccctgcagctgtttgatgacttcaagaagatgagggagcagatcggccagacccaccgggtgtgcctgctgatctgcaacagccccccctacctgctgcctgctgtggagagcaccacctacagcggctgcaccacagagaacctggtgcagcagattggagagcggggcatccacttcagcatcgtgagccccaggaagctgcctgccctgcggctgctgtttgagaaggccgcccccccagccctgctggagcccctgcagcccccaacagatgtgtcccaggaccccaggcacatggtgctggtgcggggcctggtgctgcctgtgggcggcggcagcgcccctggccccctgcagagcaagcagcctgtgcccctgcccccagctgcccccagcggggccaccctgtctgctgccccccagcagcccctgccccctgtgcccccccagtaccaggtgcccggcaacctgtctgctgcccaggtggccgcccagaatgctgtggaggccgccaagaaccagaaggccggcctgggcccccgcttcagccccatcacccccctgcagcaggccgcccctggggtgggcccccccttcagccaggccccagccccccagctgcccccaggccccccaggggcccccaagcccccaccagccagccagcccagcctggtgtccacagtggcccctggcagcggcctggcccccacagcccagcccggggcccccagcatggccggcaccgtggcccctggaggagtgtctggccccagccctgcccagctgggcgccccagccctgggcggccagcagagcgtgagcaacaagctgctggcctggagcggcgtgctggagtggcaggagaagcccaagccagcctctgtggatgccaacaccaagctgaccaggagcctgccctgccaggtgtatgtgaaccacggggagaacctgaagacagagcagtggccccagaagctgatcatgcagctgatcccccagcagctgctgaccaccctgggccccctcttcaggaacagcaggatggtgcagttccacttcaccaacaaggacctggagagcctgaagggcctgtaccgcatcatgggaaatggatttgctggctgtgtgcacttcccccacacagccccctgtgaggtgcgggtgctgatgctgctgtacagcagcaagaagaagatcttcatgggcctcatcccctatgaccagagcggctttgtgaatggcatccggcaggtgatcaccaaccacaagcaggtgcagcagcagaagctggagcagcagcagaggggcatgggcggccagcaggcccctcctggcctgggccccatcctggaggaccaggcccggcccagccagaacctgctgcagctgcggcccccccagccccagccccagggcaccgtgggcgccagcggggccaccggccagccccagccccagggcacagcccagcccccacctggggccccccagggccccccaggggccgccagcggccccccacctcctggccccatcctgcggccccagaaccctggggccaacccccagctgcggagcctgctgctgaaccccccaccaccccagacaggagtgcccccaccccaggccagcctgcaccacctgcagcccccaggggccccagccctgctgcccccaccccaccagggcctgggccagccccagctgggcccccccctgctgcaccccccaccagatggagcccggcggagtgatgctgctgagcggggcagccctggccctggccgcagcccccagagcccccccctgcccctgggcttccctgtgcggcagagggtgacagccttccacgtgtccatcaccagcggcaagaccaaggagaggagaagaggcccctgtgtgtccaggaagatgggcgccagcctcttcctgtgtggcagcgaggagcacgcctacgtgttcaacatgcagaccaacagagtgtgtgtggagcgcatccagcctgagacccccctgtag

SEQ ID NO: 159062 - DNA, 2175 bp, Artificial Sequence
  Description of Artificial Sequence: Synthetic coding sequence
atggtgcccggcagcgagggccctgcccgggccggctctgtggtggctgatgtggtgtttgtgattgagggcacagccaacctgggcccctactttgagggcctgaggaagcactacctgctgcctgccatcgagtacttcaacggcggccccccagctgagacagactttggaggagactatggaggcacccagtacagcctggtggtgttcaacacagtggactgtgcccctgagagctatgtgcagtgccacgcccccaccagcagcgcctatgaatttgtgacctggctggatggcatcaagttcatgggcggcggcggggagagctgcagcctgattgctgagggcctgagcacagccctgcagctgtttgatgacttcaagaagatgagggagcagatcggccagacccaccgggtgtgcctgctgatctgcaacagccccccctacctgctgcctgctgtggagagcaccacctacagcggctgcaccacagagaacctggtgcagcagattggagagcggggcatccacttcagcatcgtgagccccaggaagctgcctgccctgcggctgctgtttgagaaggccgcccccccagccctgctggagcccctgcagcccccaacagatgtgtcccaggaccccaggcacatggtgctggtgcggggcctggtgctgcctgtgggcggcggcagcgcccctggccccctgcagagcaagcagcctgtgcccctgcccccagctgcccccagcggggccaccctgtctgctgccccccagcagcccctgccccctgtgcccccccagtaccaggtgcccggcaacctgtctgctgcccaggtggccgcccagaatgctgtggaggccgccaagaaccagaaggccggcctgggcccccgcttcagccccatcacccccctgcagcaggccgcccctggggtgggcccccccttcagccaggccccagccccccagctgcccccaggccccccaggggcccccaagcccccaccagccagccagcccagcctggtgtccacagtggcccctggcagcggcctggcccccacagcccagcccggggcccccagcatggccggcaccgtggcccctggaggagtgtctggccccagccctgcccagctgggcgccccagccctgggcggccagcagagcgtgagcaacaagctgctggcctggagcggcgtgctggagtggcaggagaagcccaagccagcctctgtggatgccaacaccaagctgaccaggagcctgccctgccaggtgtatgtgaaccacggggagaacctgaagacagagcagtggccccagaagctgatcatgcagctgatcccccagcagctgctgaccaccctgggccccctcttcaggaacagcaggatggtgcagttccacttcaccaacaaggacctggagagcctgaagggcctgtaccgcatcatgggaaatggatttgctggctgtgtgcacttcccccacacagccccctgtgaggtgcgggtgctgatgctgctgtacagcagcaagaagaagatcttcatgggcctcatcccctatgaccagagcggctttgtgaatggcatccggcaggtgatcaccaaccacaagcaggtgcagcagcagaagctggagcagcagcagaggggcatgggcggccagcaggcccctcctggcctgggccccatcctggaggaccaggcccggcccagccagaacctgctgcagctgcggcccccccagccccagcccccacctggggccccccagggccccccaggagctgccagcggccccccacctcctggccccatcctgcggccccagaaccctggggccaacccccagctgcggagcctgctgctgaaccccccaccaccccagacaggagtgcccccaccccaggccagcctgcaccacctgcagcccccaggggccccagccctgctgcccccaccccaccagggcctgggccagccccagctgggcccccccctgctgcaccccccaccagcccagagctggccagcccagctgcccccccgggcccccctgcccgggaagggcacccggggccgggcagaggtgtggacagaatgtcccagcagctcctgggcccgggccccccggcccagcgcccctgggaagtag

SEQ ID NO: 159063 - DNA, 753 bp, Artificial Sequence
  Description of Artificial Sequence: Synthetic coding sequence
atgctgctgtacagcagcaagaagaagatcttcatgggcctcatcccctatgaccagagcggctttgtgaatggcatccggcaggtgatcaccaaccacaagcaggtgcagcagcagaagctggagcagcagcagaggggcatgggcggccagcaggcccctcctggcctgggccccatcctggaggaccaggcccggcccagccagaacctgctgcagctgcggcccccccagccccagccccagggcaccgtgggcgccagcggggccaccggccagccccagccccagggcacagcccagcccccacctggggccccccagggccccccaggagctgccagcggccccccacctcctggccccatcttcggccccaggaccctgggccccaccctgagctgtgaggccagcagcagcacccaccacagaagaaggctgggctgcccccacccccggccccccagcaccaccagcagccaccagggcctgctgcgctgctgcctgcggcggcagggcctgggccagccccagctgggcccccacagctgcatccaccacctgcccagccctggcccccacaacttccccctgggcctgcactgccaggtgcggggccctgggggcggccagaggagcggcctgtctgtgcctgctgcccctggcctggagcaccaggacagagtgctgctgggcagcaaggacatcggcagcaagaatgaaggcagccccatggcctttgctgagctgtag

SEQ ID NO: 159064 - DNA, 1605 bp, Artificial Sequence
  Description of Artificial Sequence: Synthetic coding sequence
atggtgcccggcagcgagggccctgcccgggccggctctgtggtggctgatgtggtgtttgtgattgagggcacagccaacctgggcccctactttgagggcctgaggaagcactacctgctgcctgccatcgagtacttcaacggcggccccccagctgagacagactttggaggagatgtgcccggcaacctgtctgctgcccaggtggccgcccagaatgctgtggaggccgccaagaaccagaaggccggcctgggcccccgcttcagccccatcacccccctgcagcaggccgcccctggggtgggcccccccttcagccaggccccagccccccagctgcccccaggccccccaggggcccccaagcccccaccagccagccagcccagcctggtgtccacagtggcccctggcagcggcctggcccccacagcccagcccggggcccccagcatggccggcaccgtggcccctgggggcgtgtctggccccagccctgcccagctgggcgccccagccctgggcggccagcagagcgtgagcaacaagctgctggcctggagcggcgtgctggagtggcaggagaagcccaagccagcctctgtggatgccaacaccaagctgaccaggagcctgccctgccaggtgtatgtgaaccacggggagaacctgaagacagagcagtggccccagaagctgatcatgcagctgatcccccagcagctgctgaccaccctgggccccctcttcaggaacagcaggatggtgcagttccacttcaccaacaaggacctggagagcctgaagggcctgtaccgcatcatgggaaatggatttgctggctgtgtgcacttcccccacacagccccctgtgaggtgcgggtgctgatgctgctgtacagcagcaagaagaagatcttcatgggcctcatcccctatgaccagagcggctttgtgaatggcatccggcaggtgatcaccaaccacaagcaggtgcagcagcagaagctggagcagcagcagaggggcatgggcggccagcaggcccctcctggcctgggccccatcctggaggaccaggcccggcccagccagaacctgctgcagctgcggcccccccagccccagccccagggcaccgtgggcgccagcggggccaccggccagccccagccccagggcacagcccagcccccacctggggccccccagggccccccaggagctgccagcggccccccacctcctggccccatcctgcggccccagaaccctggggccaacccccagctgcggagcctgctgctgaaccccccaccaccccagacaggagtgcccccaccccaggccagcctgcaccacctgcagcccccaggggccccagccctgctgcccccaccccaccagggcctgggccagccccagctgggcccccccctgctgcaccccccaccagcccagagctggccagcccagctgcccccccgggcccccctgcccggccagatgctgctgagcggcggcccccggggccctgtgccccagcccggcctgcagcccagcgtgatggaggatgacatcctgatggacctgatctag

SEQ ID NO: 159065 - DNA, 1194 bp, Artificial Sequence
  Description of Artificial Sequence: Synthetic coding sequence
atggtgcccggcagcgagggccctgcccgggccggctctgtggtggctgatgtggtgtttgtgattgagggcacagccaacctgggcccctactttgagggcctgaggaagcactacctgctgcctgccatcgagtacttcaacggcggccccccagctgagacagactttggaggagactatggaggcacccagtacagcctggtggtgttcaacacagtggactgtgcccctgagagctatgtgcagtgccacgcccccaccagcagcgcctatgaatttgtgacctggctggatggcatcaagttcatgggcggcggcggggagagctgcagcctgattgctgagggcctgagcacagccctgcagctgtttgatgacttcaagaagatgagggagcagatcggccagacccaccgggtgtgcctgctgatctgcaacagccccccctacctgctgcctgctgtggagagcaccacctacagcggctgcaccacagagaacctggtgcagcagattggagagcggggcatccacttcagcatcgtgagccccaggaagctgcctgccctgcggctgctgtttgagaaggccgcccccccagccctgctggagcccctgcagcccccaacagatgtgtcccaggaccccaggcacatggtgctggtgcggggcctggtgctgcctgtgggcggcggcagcgcccctggccccctgcagagcaagcagcctgtgcccctgcccccagctgcccccagcggggccaccctgtctgctgccccccagcagcccctgccccctgtgcccccccagtaccaggtgcccggcaacctgtctgctgcccaggtggccgcccagaatgctgtggaggccgccaagaaccagaaggccggcctgggcccccgcttcagccccatcacccccctgcagcaggccgcccctggggtgggcccccccttcagccaggccccagccccagccctgctgcccccaccccaccagggcctgggccagccccagctgggcccccccctgctgcaccccccaccagcccagagctggccagcccagctgcccccccgggcccccctgcccggccagatgctgctgagcggcggcccccggggccctgtgccccagcccggcctgcagcccagcgtgatggaggatgacatcctgatggacctgatctag

SEQ ID NO: 159066 - DNA, 780 bp, Artificial Sequence
  Description of Artificial Sequence: Synthetic coding sequence
atggtgcccggcagcgagggccctgcccgggccggctctgtggtggctgatgtggtgtttgtgattgagggcacagccaacctgggcccctactttgagggcctgaggaagcactacctgctgcctgccatcgagtacttcaacggcggccccccagctgagacagactttggaggagactatggaggcacccagtacagcctggtggtgttcaacacagtggactgtgcccctgagagctatgtgcagtgccacgcccccaccagcagcgcctatgaatttgtgacctggctggatggcatcaagttcatgggcggcggcggggagagctgcagcctgattgctgagggcctgagcacagccctgcagctgtttgatgacttcaagaagatgagggagcagatcggccagacccaccgggtgtgcctgctgatctgcaacagccccccctacctgctgcctgctgtggagagcaccacctacagcggctgcaccacagagaacctggtgcagcagattggagagcggggcatccacttcagcatcgtgagccccaggaagctgcctgccctgcggctgctgtttgagaaggccgcccctggcctggccggggctgctgctgccagtgacagatgtgagcccggccctgaggcccatggagctggcagcggcaccagggctgcctgctggggctggctgagccccaggcctcctcctgtgaaggccgccagccccccagccagcaggaggaccctgcgctgccaggtgcgctgctgctag

SEQ ID NO: 159067 - DNA, 1803 bp, Artificial Sequence
  Description of Artificial Sequence: Synthetic coding sequence
atgacagctgccccagccagcccccagcagatccgggaccggctgctgcaggccatcgacccccagagcaacatccggaacatggtggccgtgctggaggtgatcagcagcctggagaagtaccccatcaccaaggaggccctggaggagacccggctgggcaagctgatcaatgatgtgaggaagaagaccaagaatgaggagctggccaagagggccaagaagctgctgcgctcctggcagaagctgattgagcccgcccaccagcacgaggccgccctgcggggcctggccggggccactggaagtgccaatggaggagcccacaactgcaggcctgaggtgggcgccgccggcccccccaggagcatccatgacctgaagagcagaaatgacctgcagaggctgcccggccagaggctggaccggctgggcagcaggaagagaagaggagaccagagggacctgggccaccctggccccccacccaaggtgtccaaggccagccatgaccccctggtgcccaacagcagccccctgcccaccaacggcatcagcggcagccctgagagctttgccagcagcctggatggcagcggccacgccggccctgagggcagccggctggagagagatgaaaatgacaagcacagcggcaagatccctgtgaatgctgtgcggccccacaccagcagccctggcctgggcaagcccccaggcccctgcctgcagcccaaggcctctgtgctgcagcagctggacagagtggatgagaccccaggccccccccaccccaagggccccccacgctgcagcttcagccccaggaacagcagacatgagggcagctttgcccggcagcagagcctgtatgcccccaagggctctgtgcccagccccagcccccggccccaggccctggatgccacccaggtgcccagccccctgcccctggcccagcccagcaccccacctgtgcggcggctggagctgctgcccagcgctgagagccctgtgtgctggctggagcagcctgagagccaccagaggctggccggccctggctgcaaggccggcctgagccctgctgagcccctgctgagccgggccggcttctccccagacagcagcaaggctgacagtgatgctgccagcagcggcggcagtgacagcaagaagaagaagcgctaccggccccgggactacacagtgaacctggatggccaggtggccgaggccggcgtgaagcctgtgcggctgaaggagaggaagctgacctttgaccccatgacccggcagatcaagcccctgacccagaaggagcctgtgcgggctgacagccctgtgcacatggagcagcagagcaggacagagctggacaagcaggaggccaaggccagcctgcagagcccctttgagcagaccaactggaaggagctgagcagaaatgagatcatccagagctacctgagccggcagagcagcctgctgagcagcagcggggcccagacccctggggcccaccacttcatgtctgagtacctgaagcaggaggagagcacccggcagggcgcccggcagctgcacgtgctggtgccccagagccccccaacagacctgcccggcctgacccgggaggtgacccaggatgacctggaccgcatccaggccagccagtggccaggagtgaatggctgccaggacacccagggcaactggtatgactggacccagtgcatcagcctggacccccatggagatgatggccgcctgaacatcctgccctacgtgtgcctggactag

SEQ ID NO: 159068 - DNA, 282 bp, Artificial Sequence
  Description of Artificial Sequence: Synthetic coding sequence
atgacagctgccccagccagcccccagcagatccgggaccggctgctgcaggccatcgacccccagagcaacatccggaacatggtggccgtgctggaggtgatcagcagcctggagaagtaccccatcaccaaggaggccctggaggagacccggctgggcaagctgatcaatgatgtgaggaagaagaccaagaatgaggagctggccaagagggccaagaagctgctgcccggctggcagtgggcctgccggccccggggccagcccccaggggcctag

SEQ ID NO: 159069 - DNA, 936 bp, Artificial Sequence
  Description of Artificial Sequence: Synthetic coding sequence
atggctgatgtgatcaacgtgtctgtgaacctggaggccttcagccaggccatcagcgccatccaggccctgcggagctctgtgtcccgggtgtttgactgcctgaaggatggcatgaggaacaaggagaccctggagggccgggagaaggccttcatcgcccacttccaggacaacctgcacagcgtgaacagagacctgaatgagctggagcggctgagcaacctggtgggcaagcccagcgagaaccaccccctgcacaacagcggcctgctgagcctggaccctgtgcaggacaagacccccctgtacagccagctgctgcaggcctacaagtggagcaacaagctgcagtaccacgccggcctggccagcggcctgctgaaccagcagagcctgaagaggtctgccaaccagatgggcgtgtctgccaagaggcggcccaaggcccagcccaccaccctggtgctgcccccccagtatgtggatgatgtgatcagcagaattgacaggatgtttcctgagatgagcatccacctgagccggcccaacggcaccagcgccatgctgctggtgaccctgggcaaggtgctgaaggtgattgtggtgatgaggagcctcttcatcgacaggaccatcgtgaagggctacaatgaaaatgtgtacacagaagatggcaagctggacatctggagcaagagcaactaccaggtgttccagaaggtgacagaccacgccaccacagccctgctgcactaccagctgccccagatgccagatgtggtggtgcgctccttcatgacctggctgcggagctacatcaagctgttccaggccccctgccagagatgtgggaagttcctgcaggacggcctgccccccacctggagggacttccgcaccctggaggccttccatgacacctgccggcagtag

SEQ ID NO: 159070 - DNA, 714 bp, Artificial Sequence
  Description of Artificial Sequence: Synthetic coding sequence
atgaggaacaaggagaccctggagggccgggagaaggccttcatcgcccacttccaggacaacctgcacagcgtgaacagagacctgaatgagctggagcggctgagcaacctggtgggcaagcccagcgagaaccaccccctgcacaacagcggcctgctgagcctggaccctgtgcaggacaagacccccctgtacagccagctgctgcaggcctacaagtggagcaacaagctgcagtaccacgccggcctggccagcggcctgctgaaccagcagagcctgaagaggtctgccaaccagatgggcgtgtctgccaagaggcggcccaaggcccagcccaccaccctggtgctgcccccccagtatgtggatgatgtgatcagcagaattgacaggatgtttcctgagatgagcatccacctgagccggcccaacggcaccagcgccatgctgctgctggacatctggagcaagagcaactaccaggtgttccagaaggtgacagaccacgccaccacagccctgctgcactaccagctgccccagatgccagatgtggtggtgcgctccttcatgacctggctgcggagctacatcaagctgttccaggccccctgccagagatgtgggaagttcctgcaggacggcctgccccccacctggagggacttccgcaccctggaggccttccatgacacctgccggcagtag

SEQ ID NO: 159071 - DNA, 828 bp, Artificial Sequence
  Description of Artificial Sequence: Synthetic coding sequence
atggctgatgtgatcaacgtgtctgtgaacctggaggccttcagccaggccatcagcgccatccaggccctgcggagctctgtgtcccgggtgtttgactgcctgaaggatggcatgaggaacaaggagaccctggagggccgggagaaggccttcatcgcccacttccaggacaacctgcacagcgtgaacagagacctgaatgagctggagcggctgagcaacctggtgggcaagcccagcgagaaccaccccctgcacaacagcggcctgctgagcctggaccctgtgcaggacaagacccccctgtacagccagctgctgcaggcctacaagtggagcaacaagctgcagtaccacgccggcctggccagcggcctgctgaaccagcagagcctgaagaggtctgccaaccagatgggcgtgtctgccaagaggcggcccaaggcccagcccaccaccctggtgctgcccccccagtatgtggatgatgtgatcagcagaattgacaggatgtttcctgagatgagcatccacctgagccggcccaacggcaccagcgccatgctgctgctggacatctggagcaagagcaactaccaggtgttccagaaggtgacagaccacgccaccacagccctgctgcactaccagctgccccagatgccagatgtggtggtgcgctccttcatgacctggctgcggagctacatcaagctgttccaggccccctgccagagatgtgggaagttcctgcaggacggcctgccccccacctggagggacttccgcaccctggaggccttccatgacacctgccggcagtag

SEQ ID NO: 159072 - DNA, 666 bp, Artificial Sequence
  Description of Artificial Sequence: Synthetic coding sequence
atgctgaagagcaatggagagcggcgcagcagaaatgccctgcctgctgtgtatgccaggaagatggccgccagccagcagcaggccagcgctgccagcagcgctgctggggtgtctggccccagcagcgctgggggccctggcccccagcagcagccccagcccccagcccagctggtgggccctgcccagagcggcctgctgcagcagcagcagcaggactttgatcctgtgcagcgctacaagatgctgatcccccagctgaaggagagcctgcagaccctgatgaaggtggccgcccagaacctgatccagaacaccaacatcgacaatggccagaagagcagtgatggccccatccagagatttgacaagtgcctggaggagttctacgccctgtgtgaccagctggagctgtgcctgcggctggcccacgagtgcctgagccagagctgtgacagcgccaagcacagccccaccctggtgcccacagccaccaagccagatgctgtgcagcctgacagcctgccctacccccagtacctggccgtcatcaaggcccagatcagctgtgccaaggacatccacacagccctgctggactgtgccaacaaggtgacaggcaagaccccagcccctcctgctggccctgggggcaccctgtag

SEQ ID NO: 159073 - DNA, 420 bp, Artificial Sequence
  Description of Artificial Sequence: Synthetic coding sequence
atgctgatcccccagctgaaggagagcctgcagaccctgatgaaggtggccgcccagaacctgatccagaacaccaacatcgacaatggccagaagagcagtgatggccccatccagagatttgacaagtgcctggaggagttctacgccctgtgtgaccagctggagctgtgcctgcggctggcccacgagtgcctgagccagagctgtgacagcgccaagcacagccccaccctggtgcccacagccaccaagccagatgctgtgcagcctgacagcctgccctacccccagtacctggccgtcatcaaggcccagatcagctgtgccaaggacatccacacagccctgctggactgtgccaacaaggtgacaggcaagaccccagcccctcctgctggccctgggggcaccctgtag

SEQ ID NO: 159074 - DNA, 537 bp, Artificial Sequence
  Description of Artificial Sequence: Synthetic coding sequence
atgagcaccccacccctggccgccagcggcatggcccctggcccctttgctggcccccaggcccagcaggccgcccgggaggtgaacacagccagcctgtgccgcatcggccaggagaccgtgcaggacatcgtgtaccgcaccatggagatcttccagctgctgaggaacatgcagctgcccaacggggtgacctaccacacaggcacctaccaggaccggctgaccaagctgcaggacaacctgcggcagctgtctgtgctcttcaggaagctgcggctggtgtatgacaagtgcaatgaaaactgtggcggcatggaccccatccctgtggagcagctgatcccctacgtggaggaggatggcagcaagaatgatgacagagctggccccccaagatttgccagcgaggagcggcgggagattgctgaggtgaacaagaagctgaagcagaagaaccagcagctgaagcagatcatggaccagctgaggaacctgatctgggacatcaatgccatgctggccatgagaaattag

SEQ ID NO: 159075 - DNA, 813 bp, Artificial Sequence
  Description of Artificial Sequence: Synthetic coding sequence
atggccgccagcagcagcggggagaaggagaaggagcggctgggcggcggcctgggcgtggccggcggcaacagcacccgggagcggctgctgagcgccctggaggacctggaggtgctgagccgggagctgattgagatgctggccatcagcaggaaccagaagctgctgcaggccggggaggagaaccaggtgctggagctgctgatccacagagatggagagttccaggagctgatgaagctggccctgaaccagggcaagatccaccacgagatgcaggtgctggagaaggaggtggagaagagggacagcgacatccagcagctgcagaagcagctgaaggaggccgagcagatcctggccacagctgtgtaccaggccaaggagaagctgaagagcattgagaaggccaggaagggggccatcagcagcgaggagatcatcaagtatgcccaccgcatcagcgccagcaatgctgtgtgtgcccccctgacctgggtgcctggggacccccggcggccctaccccacagacctggagatgaggagcggcctgctgggccagatgaacaaccccagcaccaacggggtgaatggccacctgcctggagatgccctggccgccggccgcctgcctgatgtgctggccccccagtacccctggcagagcaatgacatgtccatgaacatgctgccccccaaccacagcagtgacttcctgctggagcccccaggccacaacaaggaaaatgaagatgatgtggagatcatgagcacagacagcagcagcagcagcagcgagagtgactag

SEQ ID NO: 159076 - DNA, 675 bp, Artificial Sequence
  Description of Artificial Sequence: Synthetic coding sequence
atgctggccatcagcaggaaccagaagctgctgcaggccggggaggagaaccaggtgctggagctgctgatccacagagatggagagttccaggagctgatgaagctggccctgaaccagggcaagatccaccacgagatgcaggtgctggagaaggaggtggagaagagggacagcgacatccagcagctgcagaagcagctgaaggaggccgagcagatcctggccacagctgtgtaccaggccaaggagaagctgaagagcattgagaaggccaggaagggggccatcagcagcgaggagatcatcaagtatgcccaccgcatcagcgccagcaatgctgtgtgtgcccccctgacctgggtgcctggggacccccggcggccctaccccacagacctggagatgaggagcggcctgctgggccagatgaacaaccccagcaccaacggggtgaatggccacctgcctggagatgccctggccgccggccgcctgcctgatgtgctggccccccagtacccctggcagagcaatgacatgtccatgaacatgctgccccccaaccacagcagtgacttcctgctggagcccccaggccacaacaaggaaaatgaagatgatgtggagatcatgagcacagacagcagcagcagcagcagcgagagtgactag

SEQ ID NO: 159077 - DNA, 747 bp, Artificial Sequence
  Description of Artificial Sequence: Synthetic coding sequence
atgaagctgctgtggtggtgtgactggctgcctgagaggagccacgtgttcacccagcgggagctgattgagatgctggccatcagcaggaaccagaagctgctgcaggccggggaggagaaccaggtgctggagctgctgatccacagagatggagagttccaggagctgatgaagctggccctgaaccagggcaagatccaccacgagatgcaggtgctggagaaggaggtggagaagagggacagcgacatccagcagctgcagaagcagctgaaggaggccgagcagatcctggccacagctgtgtaccaggccaaggagaagctgaagagcattgagaaggccaggaagggggccatcagcagcgaggagatcatcaagtatgcccaccgcatcagcgccagcaatgctgtgtgtgcccccctgacctgggtgcctggggacccccggcggccctaccccacagacctggagatgaggagcggcctgctgggccagatgaacaaccccagcaccaacggggtgaatggccacctgcctggagatgccctggccgccggccgcctgcctgatgtgctggccccccagtacccctggcagagcaatgacatgtccatgaacatgctgccccccaaccacagcagtgacttcctgctggagcccccaggccacaacaaggaaaatgaagatgatgtggagatcatgagcacagacagcagcagcagcagcagcgagagtgactag

SEQ ID NO: 159078 - DNA, 717 bp, Artificial Sequence
  Description of Artificial Sequence: Synthetic coding sequence
atgaagctgctgtggtggtgtgactggctgcctgagaggagccacgtgttcacccagcgggagctgattgagatgctggccatcagcaggaaccagaagctgctgcaggccggggaggagaaccaggtgctggagctgctgatccacagagatggagagttccaggagctgatgaagctggccctgaaccagggcaagatccaccacgagatgcaggtgctggagaaggaggtggagaagagggacagcgacatccagcagctgcagaagcagctgaaggaggccgagcagatcctggccacagctgtgtaccaggccaaggagaagctgaagagcattgagaaggccaggaagggggccatcagcagcgaggagatcatcaagtatgcccaccgcatcagcgccagcaatgctgtgtgtgcccccctgacctgggtgcctggggacccccggcggccctaccccacagacctggagatgaggagcggcctgctgggccagatgaacaaccccagcaccaacggggtgaatggccacctgcctggagatgccctggccgccggccgcctgcctgatgtgctggccccccagtacccctggcagagcaatgacatgtccatgaacatgctgccccccaaccacagcagtgacttcctgctggagcccccaggccacaacaaggaaaatgaagatgatgtggagatcatgagcacctag

SEQ ID NO: 159079 - DNA, 702 bp, Artificial Sequence
  Description of Artificial Sequence: Synthetic coding sequence
atgggagagccccagcaggtgtctgccctgcccccaccacccatgcagtacatcaaggagtacacagatgagaacatccaggagggcctggcccccaagcccccaccacccatcaaggacagctacatgatgtttggaaaccagttccagtgtgatgacctgatcatccggcccctggagagccagggcatcgagcggctgcaccccatgcagtttgaccacaagaaggagctgaggaagctgaacatgagcatcctgatcaacttcctggacctgctggacatcctgatccgcagccctggcagcatcaagcgggaggagaagctggaggacctgaagctgctgtttgtgcacgtgcaccacctgatcaatgagtaccggccccaccaggcccgggagaccctgcgggtgatgatggaggtgcagaagaggcagaggctggagacagctgagcgcttccagaagcacctggagcgggtgattgagatgatccagaactgcctggccagcctgcctgatgacctgccccacagcgaggccggcatgagggtgaagacagagcccatggatgctgatgacagcaacaactgcaccggccagaatgagcaccagcgggagaacagcggccacagaagagaccagatcatcgagaaggatgctgccctgtgtgtgctgattgatgagatgaatgaaagaccctag

SEQ ID NO: 159080 - DNA, 702 bp, Artificial Sequence; identical to SEQ ID NO: 159079
  Description of Artificial Sequence: Synthetic coding sequence

SEQ ID NO: 159081 - DNA, 588 bp, Artificial Sequence
  Description of Artificial Sequence: Synthetic coding sequence
atgggagagccccagcaggtgtctgccctgcccccaccacccatgcagtacatcaaggagtacacagatgagaacatccaggagggcctggcccccaagcccccaccacccatcaaggacagctacatgatgtttggaaaccagttccagtgtgatgacctgatcatccggcccctggagagccagggcatcgagcggctgcaccccatgcagtttgaccacaagaaggagctgaggaagctgaacatgagcatcctgatcaacttcctggacctgctggacatcctgatccgcagccctggcagcatcaagcgggaggagaagctggaggacctgaagctgctgtttgtgcacgtgcaccacctgatcaatgagtaccggccccaccaggcccgggagaccctgcgggtgatgatggaggtgcagaagaggcagaggctggagacagctgagcgcttccagaagcacctggagcgggtgattgagatgatccagaactgcctggccagcctgcctgatgacctgccccacagcgaggccggcatgagggtgaagacagagcccatggatgctgatgacagcaactag

SEQ ID NO: 159082 - DNA, 441 bp, Artificial Sequence
  Description of Artificial Sequence: Synthetic coding sequence
atggccagcgctggggtggccgccggccggcaggctgaagatgtgctgccccccaccagtgaccagcccctgcctgacaccaagcccctgcccccaccccagcccccacctgtgcctgccccccagccccagcagagccctgccccccggccccagagccctgcccgggcccgggaggaggagaactacagcttcctgcccctggtgcacaacatcatcaagtgcatggacaaggacagccctgaggtgcaccaggacctgaatgccctgaagagcaagttccaggagatgaggaagctgatcagcaccatgcctggcatccacctgagccctgagcagcagcagcagcagctgcagagcctgcgggagcaggtgaggaccaagaatgagctgctgcagaagtacaagagcctgtgcatgtttgagatccccaaggagtag

SEQ ID NO: 159083 - DNA, 894 bp, Artificial Sequence
  Description of Artificial Sequence: Synthetic coding sequence
atgagcaacagagtggtgtgccgggaggccagccatgctggctcctggtacacagccagcggcccccagctgaatgcccagctggagggctggctgagccaggtgcagagcaccaagaggcctgcccgggccatcatcgcccctcatgctggctacacctactgcggcagctgtgccgcccacgcctacaagcaggtggaccccagcatcacccggcgcatcttcatcctgggccccagccaccacgtgcccctgagccgctgtgccctgagctctgtggacatctaccgcacccccctgtatgacctgagaattgaccagaagatctacggggagctgtggaagacaggcatgtttgagaggatgagcctgcagacagatgaagatgagcacagcattgagatgcacctgccctacacagccaaggccatggagagccacaaggatgagttcaccatcatccctgtgctggtgggcgccctgtctgagagcaaggagcaggagtttgggaagctgttcagcaagtacctggccgaccccagcaacctgtttgtggtgtccagtgacttctgccactggggccagcgcttccgctacagctactatgatgagagccagggcgagatctaccgcagcattgagcacctggacaagatgggcatgagcatcatcgagcagctggaccctgtgtccttcagcaactacctgaagaagtaccacaacaccatctgtggccgccaccccatcggcgtgctgctgaatgccatcacagagctgcagaagaatggcatgaacatgtccttctccttcctgaactatgcccagagcagccagtgcaggaactggcaggacagctctgtgtcctatgctgctggggccctgactgtgcactag

SEQ ID NO: 159084 - DNA, 903 bp, Artificial Sequence
  Description of Artificial Sequence: Synthetic coding sequence
atgcccctgtggagggctgacaagtgccaggatgtgcagagcgcctcctggaggccccggcgggcagatggcccccagctgaatgcccagctggagggctggctgagccaggtgcagagcaccaagaggcctgcccgggccatcatcgcccctcatgctggctacacctactgcggcagctgtgccgcccacgcctacaagcaggtggaccccagcatcacccggcgcatcttcatcctgggccccagccaccacgtgcccctgagccgctgtgccctgagctctgtggacatctaccgcacccccctgtatgacctgagaattgaccagaagatctatggagagctgtggaagacaggcatgtttgagaggatgagcctgcagacagatgaagatgagcacagcattgagatgcacctgccctacacagccaaggccatggagagccacaaggatgagttcaccatcatccctgtgctggtgggcgccctgtctgagagcaaggagcaggagtttgggaagctgttcagcaagtacctggccgaccccagcaacctgtttgtggtgtccagtgacttctgccactggggccagcgcttccgctacagctactatgatgagagccagggcgagatctaccgcagcattgagcacctggacaagatgggcatgagcatcatcgagcagctggaccctgtgtccttcagcaactacctgaagaagtaccacaacaccatctgtggccgccaccccatcggcgtgctgctgaatgccatcacagagctgcagaagaatggcatgaacatgtccttctccttcctgaactatgcccagagcagccagtgcaggaactggcaggacagctctgtgtcctatgctgctggggccctgactgtgcactag

SEQ ID NO: 159085 - DNA, 894 bp, Artificial Sequence; identical to SEQ ID NO: 159083
  Description of Artificial Sequence: Synthetic coding sequence

SEQ ID NO: 159086 - DNA, 825 bp, Artificial Sequence
  Description of Artificial Sequence: Synthetic coding sequence
atgagcaacagagtggtgtgccgggaggccagccatgctggctcctggtacacagccagcggcccccagctgaatgcccagctggagggctggctgagccaggtgcagagcaccaagaggcctgcccgggccatcatcgccccccggcgcatcttcatcctgggccccagccaccacgtgcccctgagccgctgtgccctgagctctgtggacatctaccgcacccccctgtatgacctgagaattgaccagaagatctatggagagctgtggaagacaggcatgtttgagaggatgagcctgcagacagatgaagatgagcacagcattgagatgcacctgccctacacagccaaggccatggagagccacaaggatgagttcaccatcatccctgtgctggtgggcgccctgtctgagagcaaggagcaggagtttgggaagctgttcagcaagtacctggccgaccccagcaacctgtttgtggtgtccagtgacttctgccactggggccagcgcttccgctacagctactatgatgagagccagggcgagatctaccgcagcattgagcacctggacaagatgggcatgagcatcatcgagcagctggaccctgtgtccttcagcaactacctgaagaagtaccacaacaccatctgtggccgccaccccatcggcgtgctgctgaatgccatcacagagctgcagaagaatggcatgaacatgtccttctccttcctgaactatgcccagagcagccagtgcaggaactggcaggacagctctgtgtcctatgctgctggggccctgactgtgcactag

SEQ ID NO: 159087 - DNA, 63 bp, Artificial Sequence
  Description of Artificial Sequence: Synthetic coding sequence
atgagcaacagagtggtgtgccgggaggccagccatgctggctcctggtacacagccagctag

SEQ ID NO: 159088 - DNA, 5478 bp, Artificial Sequence
  Description of Artificial Sequence: Synthetic coding sequence
atggaggacacccaggccatcgactgggatgtggaggaggaggaggagacagagcagagcagcgagagcctgcgctgcaatgtggagcctgtgggccgcctgcacatcttcagcggggcccacggccctgagaaggacttccccctgcacctgggcaagaatgtggtgggccgcatgccagactgcagcgtggccctgcccttccccagcatcagcaagcagcacgccgagattgagatcctggcctgggacaaggcccccatcctgcgggactgtggcagcctgaatggcacccagatcctgcggccccccaaggtgctgagccctggggtgagccaccggctgcgggaccaggagctgatcctgtttgctgacctgctgtgccagtaccaccggctggatgtgtccctgccctttgtgtcccggggccccctgactgtggaggagaccccccgggtgcagggcgagacccagccccagaggctgctgctggccgaggacagcgaggaggaggtggacttcctgtctgagaggaggatggtgaagaagagcaggaccaccagcagcagcgtcatcgtgcctgagagtgatgaggagggccacagccctgtgctgggcggcctgggccccccatttgccttcaacctgaacagcgacacagatgtggaggagggccagcagcctgccacagaggaggccagcagcgctgcccggcggggggccaccgtggaggccaagcagagcgaggccgaggtggtgacagagatccagctggagaaggaccagcccctggtgaaggagcgggacaatgacaccaaggtgaagagaggagctggaaatggagtggtgcctgctggggtcatcctggagaggagccagcccccaggagaagattctgacacagatgtggatgatgacagcaggcctcctggccggcctgctgaggtgcacctggagcgggcccagcccttcggcttcatcgacagcgacacagatgctgaggaggagcgcatcccagccacccctgtggtgatccccatgaagaagaggaagatcttccacggcgtgggcacccggggccctggggcccctggcctggcccacctgcaggagagccaggccggcagtgacacagatgtggaggagggcaaggccccccaggccgtgcccctggagaagagccaggcctccatggtgatcaacagcgacacagatgatgaggaggaggtgtctgctgccctgaccctggcccacctgaaggagagccagcctgccatctggaacagagatgctgaggaggacatgccccagagggtggtgctgctgcagaggagccagaccaccacagagcgggacagcgacacagatgtggaggaggaggagctgcctgtggagaaccgggaggccgtgctgaaggaccacaccaagatccgggccctggtgcgggcccacagcgagaaggaccagcccccatttggagacagtgatgacagcgtggaggccgacaagagcagccctggcatccacctggagaggagccaggccagcaccaccgtggacatcaacacccaggtggagaaggaggtgcccccaggcagcgccatcatccacatcaagaagcaccaggtgtctgtggagggcaccaaccagacagatgtgaaggctgtgggcggccctgccaagctgctggtggtgtccctggaggaggcctggcccctgcacggggactgtgaaacagatgctgaggagggcaccagcctgacagcctctgtggtggctgatgtgaggaagagccagctgcctgcagaaggagatgctggagctgagtgggccgctgctgtgctgaagcaggagcgggcccacgaggtgggcgcccagggcggcccccctgtggcccaggtggagcaggacctgcccatcagccgggagaacctgacagacctggtggtggacacagacaccctgggggagagcacccagccccagcgggagggcgcccaggtgcccaccggccgggagcgggagcagcacgtgggcggcaccaaggacagcgaggacaactacggggacagcgaggacctggacctgcaggccacccagtgcttcctggagaaccagggcctggaggccgtgcagagcatggaggatgagcccacccaggccttcatgctgaccccaccccaggagctgggccccagccactgcagcttccagaccaccggcctgctgaactgcaagatgcccccagctgagaaggccagccgcatccgggctgctgagaaggtgtccagaggagaccaggagagcccagatgcctgcctgcccccaacagtgcctgaggccccagccccaccccagaagcccctgaacagccagagccagaagcacctggcccccccacccctgctgagccccctgctgcccagcatcaagcccaccgtgaggaagacccggcaggacggcagccaggaggcccctgaggcccccctgagcagcgagctggagcccttccaccccaagcccaagatccgcaccaggaagagcagcaggatgacccccttccctgccaccagcgctgcccctgagccccaccccagcaccagcacagcccagcctgtgacccccaagcccaccagccaggccaccaggagcaggaccaacagaagctctgtgaagaccccagagcctgtggtgcccacagcccctgagctgcagcccagcaccagcacagaccagcctgtgaccagcgagcccaccagccaggtgacccggggcaggaagagccgcagctctgtgaagaccccagagaccgtggtgcccacagccctggagctgcagcccagcaccagcacagacaggcctgtgaccagcgagcccaccagccaggccacccggggcaggaagaacagaagctctgtgaagaccccagagcctgtggtgcccacagcccctgagctgcagcccagcaccagcacagaccagcctgtgaccagcgagcccacctaccaggccacccggggcaggaagaacagaagctctgtgaagaccccagagcctgtggtgcccacagcccctgagctgcggcccagcaccagcacagacaggcctgtgacccccaagcccaccagcaggaccaccaggagcaggaccaacatgagctctgtgaagaccccagagaccgtggtgcccacagcccctgagctgcagatcagcaccagcacagaccagcctgtgacccccaagcccaccagcaggaccaccaggagcaggaccaacatgagctctgtgaagaaccctgagagcacagtgcccatcgcccctgagctgccccccagcaccagcacagagcagcctgtgaccccagagcccaccagccgggccacccggggcaggaagaacagaagcagcggcaagaccccagagaccctggtgcccacagcccccaagctggagcccagcaccagcacagaccagcctgtgaccccagagcccaccagccaggccacccggggccgcaccaacagaagctctgtgaagaccccagagaccgtggtgcccacagcccctgagctgcagcccagcaccagcacagaccagcctgtgaccccagagcccaccagccaggccacccggggccgcacagacaggagctctgtgaagaccccagagaccgtggtgcccacagcccctgagctgcaggccagcgccagcacagaccagcctgtgaccagcgagcccaccagcaggaccacccggggcaggaagaacagaagctctgtgaagaccccagagaccgtggtgcctgctgcccctgagctgcagcccagcaccagcacagaccagcctgtgaccccagagcccaccagccgggccacccggggccgcaccaacagaagctctgtgaagaccccagagagcatcgtgcccatcgcccctgagctgcagcccagcaccagcaggaaccagctggtgaccccagagcccaccagccgggccacccgctgcaggaccaacagaagctctgtgaagaccccagagcctgtggtgcccacagcccctgagccccaccccaccaccagcacagaccagcctgtgacccccaagctgaccagccgggccaccaggaggaagaccaacagaagctctgtgaagacccccaagcctgtggagcctgctgccagtgacctggagcccttcacccccacagaccagagcgtgaccccagaggccatcgcccagggcggccagagcaagaccctgcggagcagcacagtgcgggccatgcctgtgcccaccaccccagagttccagagccctgtgaccacagaccagcccatcagccctgagcccatcacccagcccagctgcatcaagaggcagagagctgctggcaaccctggcagcctggccgcccccatcgaccacaagccctgcagcgcccccctggagcccaagagccaggccagcaggaaccagcgctggggcgctgtgcgggctgctgagagcctgacagccatccctgagcccgccagcccccagctgctggagacccccatccacgccagccagatccagaaggtggagcccgccggccgcagccgcttcaccccagagctgcagcccaaggccagccagagcaggaagaggagcctggccaccatggacagccccccccaccagaagcagccccagagaggagaggtgtcccagaagacagtcatcatcaaggaggaggaggaggacacagctgagaagccaggcaaggaggaggatgtggtgacccccaagccaggcaagaggaagagggaccaggccgaggaggagcccaaccgcatccccagccgcagcctgcggaggaccaagctgaaccaggagagcacagcccccaaggtgctcttcaccggggtggtggatgcccggggggagagagctgtgctggccctgggcggcagcctggccggcagcgctgctgaggccagccacctggtgacagaccgcatccggaggacagtgaagttcctgtgtgccctgggccggggcatccccatcctgagcctggactggctgcaccagagcaggaaggccggcttcttcctgcccccagatgaatatgtggtgacagatcctgagcaggagaagaactttggcttcagcctgcaggatgccctgagccgggcccgggagcggcggctgctggagggctatgagatctacgtgaccccaggagtgcagcccccaccaccccagatgggagagatcatcagctgctgcggcggcacctacctgcccagcatgcccaggagctacaagccccagagggtggtgatcacctgcccccaggacttcccccactgcagcatccccctgcgggtgggcctgcccctgctgagccctgagttcctgctgactggagtgctgaagcaggaggccaagccagaggcctttgtgctgagccccctggagatgagcagcacctag

SEQ ID NO: 159089 - DNA, 6270 bp, Artificial Sequence
  Description of Artificial Sequence: Synthetic coding sequence
atggaggacacccaggccatcgactgggatgtggaggaggaggaggagacagagcagagcagcgagagcctgcgctgcaatgtggagcctgtgggccgcctgcacatcttcagcggggcccacggccctgagaaggacttccccctgcacctgggcaagaatgtggtgggccgcatgccagactgcagcgtggccctgcccttccccagcatcagcaagcagcacgccgagattgagatcctggcctgggacaaggcccccatcctgcgggactgtggcagcctgaatggcacccagatcctgcggccccccaaggtgctgagccctggggtgagccaccggctgcgggaccaggagctgatcctgtttgctgacctgctgtgccagtaccaccggctggatgtgtccctgccctttgtgtcccggggccccctgactgtggaggagaccccccgggtgcagggcgagacccagccccagaggctgctgctggccgaggacagcgaggaggaggtggacttcctgtctgagaggaggatggtgaagaagagcaggaccaccagcagcagcgtcatcgtgcctgagagtgatgaggagggccacagccctgtgctgggcggcctgggccccccatttgccttcaacctgaacagcgacacagatgtggaggagggccagcagcctgccacagaggaggccagcagcgctgcccggcggggggccaccgtggaggccaagcagagcgaggccgaggtggtgacagagatccagctggagaaggaccagcccctggtgaaggagcgggacaatgacaccaaggtgaagagaggagctggaaatggagtggtgcctgctggggtcatcctggagaggagccagcccccaggagaagattctgacacagatgtggatgatgacagcaggcctcctggccggcctgctgaggtgcacctggagcgggcccagcccttcggcttcatcgacagcgacacagatgctgaggaggagcgcatcccagccacccctgtggtgatccccatgaagaagaggaagatcttccacggcgtgggcacccggggccctggggcccctggcctggcccacctgcaggagagccaggccggcagtgacacagatgtggaggagggcaaggccccccaggccgtgcccctggagaagagccaggcctccatggtgatcaacagcgacacagatgatgaggaggaggtgtctgctgccctgaccctggcccacctgaaggagagccagcctgccatctggaacagagatgctgaggaggacatgccccagagggtggtgctgctgcagaggagccagaccaccacagagcgggacagcgacacagatgtggaggaggaggagctgcctgtggagaaccgggaggccgtgctgaaggaccacaccaagatccgggccctggtgcgggcccacagcgagaaggaccagcccccatttggagacagtgatgacagcgtggaggccgacaagagcagccctggcatccacctggagaggagccaggccagcaccaccgtggacatcaacacccaggtggagaaggaggtgcccccaggcagcgccatcatccacatcaagaagcaccaggtgtctgtggagggcaccaaccagacagatgtgaaggctgtgggcggccctgccaagctgctggtggtgtccctggaggaggcctggcccctgcacggggactgtgaaacagatgctgaggagggcaccagcctgacagcctctgtggtggctgatgtgaggaagagccagctgcctgcagaaggagatgctggagctgagtgggccgctgctgtgctgaagcaggagcgggcccacgaggtgggcgcccagggcggcccccctgtggcccaggtggagcaggacctgcccatcagccgggagaacctgacagacctggtggtggacacagacaccctgggggagagcacccagccccagcgggagggcgcccaggtgcccaccggccgggagcgggagcagcacgtgggcggcaccaaggacagcgaggacaactacggggacagcgaggacctggacctgcaggccacccagtgcttcctggagaaccagggcctggaggccgtgcagagcatggaggatgagcccacccaggccttcatgctgaccccaccccaggagctgggccccagccactgcagcttccagaccaccggcaccctggatgagccctgggaggtgctggccacccagcccttctgcctgcgggagagtgaagattctgagacccagccctttgacacccacctggaggcctacggcccctgcctgagccccccccgggccatccctggggaccagcaccctgagagccctgtgcacacagagcccatgggcatccagggccggggccggcagacagtggacaaggtgatgggcatccccaaggagacagctgagcgggtgggccctgagcggggccccctggagcgggagacagagaagctgctgcctgagcggcagacagatgtgactggagaggaggagctgaccaagggcaagcaggaccgggagcagaagcagctgctggcccgggacacccagaggcaggagagtgacaagaatggagagagcgccagccctgagcgggaccgggagagcctgaaggtggagattgagaccagcgaggagatccaggagaagcaggtgcagaagcagaccctgcccagcaaggcctttgagcgggaggtggagaggcctgtggccaacagagaatgtgaccctgctgagctggaggagaaggtgcccaaggtgatcctggagcgggacacccagagaggagagcctgagggcggcagccaggaccagaagggccaggccagcagccccaccccagagcccggggtgggcgctggggacctgcccggccccaccagcgcccctgtgcccagcggcagccagagcggcggccggggcagccctgtgagcccccggcggcaccagaagggcctgctgaactgcaagatgcccccagctgagaaggccagccgcatccgggctgctgagaaggtgtccagaggagaccaggagagcccagatgcctgcctgcccccaacagtgcctgaggccccagccccaccccagaagcccctgaacagccagagccagaagcacctggcccccccacccctgctgagccccctgctgcccagcatcaagcccaccgtgaggaagacccggcaggacggcagccaggaggcccctgaggcccccctgagcagcgagctggagcccttccaccccaagcccaagatccgcaccaggaagagcagcaggatgacccccttccctgccaccagcgctgcccctgagccccaccccagcaccagcacagcccagcctgtgacccccaagcccaccagccaggccaccaggagcaggaccaacagaagctctgtgaagaccccagagcctgtggtgcccacagcccctgagctgcagcccagcaccagcacagaccagcctgtgaccagcgagcccaccagccaggtgacccggggcaggaagagccgcagctctgtgaagaccccagagaccgtggtgcccacagccctggagctgcagcccagcaccagcacagacaggcctgtgaccagcgagcccaccagccaggccacccggggcaggaagaacagaagctctgtgaagaccccagagcctgtggtgcccacagcccctgagctgcagcccagcaccagcacagaccagcctgtgaccagcgagcccacctaccaggccacccggggcaggaagaacagaagctctgtgaagaccccagagcctgtggtgcccacagcccctgagctgcggcccagcaccagcacagacaggcctgtgacccccaagcccaccagcaggaccaccaggagcaggaccaacatgagctctgtgaagaccccagagaccgtggtgcccacagcccctgagctgcagatcagcaccagcacagaccagcctgtgacccccaagcccaccagcaggaccaccaggagcaggaccaacatgagctctgtgaagaaccctgagagcacagtgcccatcgcccctgagctgccccccagcaccagcacagagcagcctgtgaccccagagcccaccagccgggccacccggggcaggaagaacagaagcagcggcaagaccccagagaccctggtgcccacagcccccaagctggagcccagcaccagcacagaccagcctgtgaccccagagcccaccagccaggccacccggggccgcaccaacagaagctctgtgaagaccccagagaccgtggtgcccacagcccctgagctgcagcccagcaccagcacagaccagcctgtgaccccagagcccaccagccaggccacccggggccgcacagacaggagctctgtgaagaccccagagaccgtggtgcccacagcccctgagctgcaggccagcgccagcacagaccagcctgtgaccagcgagcccaccagcaggaccacccggggcaggaagaacagaagctctgtgaagaccccagagaccgtggtgcctgctgcccctgagctgcagcccagcaccagcacagaccagcctgtgaccccagagcccaccagccgggccacccggggccgcaccaacagaagctctgtgaagaccccagagagcatcgtgcccatcgcccctgagctgcagcccagcaccagcaggaaccagctggtgaccccagagcccaccagccgggccacccgctgcaggaccaacagaagctctgtgaagaccccagagcctgtggtgcccacagcccctgagccccaccccaccaccagcacagaccagcctgtgacccccaagctgaccagccgggccaccaggaggaagaccaacagaagctctgtgaagacccccaagcctgtggagcctgctgccagtgacctggagcccttcacccccacagaccagagcgtgaccccagaggccatcgcccagggcggccagagcaagaccctgcggagcagcacagtgcgggccatgcctgtgcccaccaccccagagttccagagccctgtgaccacagaccagcccatcagccctgagcccatcacccagcccagctgcatcaagaggcagagagctgctggcaaccctggcagcctggccgcccccatcgaccacaagccctgcagcgcccccctggagcccaagagccaggccagcaggaaccagcgctggggcgctgtgcgggctgctgagagcctgacagccatccctgagcccgccagcccccagctgctggagacccccatccacgccagccagatccagaaggtggagcccgccggccgcagccgcttcaccccagagctgcagcccaaggccagccagagcaggaagaggagcctggccaccatggacagccccccccaccagaagcagccccagagaggagaggtgtcccagaagacagtcatcatcaaggaggaggaggaggacacagctgagaagccaggcaaggaggaggatgtggtgacccccaagccaggcaagaggaagagggaccaggccgaggaggagcccaaccgcatccccagccgcagcctgcggaggaccaagctgaaccaggagagcacagcccccaaggtgctcttcaccggggtggtggatgcccggggggagagagctgtgctggccctgggcggcagcctggccggcagcgctgctgaggccagccacctggtgacagaccgcatccggaggacagtgaagttcctgtgtgccctgggccggggcatccccatcctgagcctggactggctgcaccagagcaggaaggccggcttcttcctgcccccagatgaatatgtggtgacagatcctgagcaggagaagaactttggcttcagcctgcaggatgccctgagccgggcccgggagcggcggctgctggagggctatgagatctacgtgaccccaggagtgcagcccccaccaccccagatgggagagatcatcagctgctgcggcggcacctacctgcccagcatgcccaggagctacaagccccagagggtggtgatcacctgcccccaggacttcccccactgcagcatccccctgcgggtgggcctgcccctgctgagccctgagttcctgctgactggagtgctgaagcaggaggccaagccagaggcctttgtgctgagccccctggagatgagcagcacctag

SEQ ID NO: 159090 - DNA, 489 bp, Artificial Sequence
  Description of Artificial Sequence: Synthetic coding sequence
atggaggacacccaggccatcgactgggatgtggaggaggaggaggagacagagcagagcagcgagagcctgcgctgcaatgtggagcctgtgggccgcctgcacatcttcagcggggcccacggccctgagaaggacttccccctgcacctgggcaagaatgtggtgggccgcatgccagactgcagcgtggccctgcccttccccagcatcagcaagcagcacgccgagattgagatcctggcctgggacaaggcccccatcctgcgggactgtggcagcctgaatggcacccagatcctgcggccccccaaggtgctgagccctggggtgagccaccggctgcgggaccaggagctgatcctgtttgctgacctgctgtgccagtaccaccggctggatgtgtccctgccctttgtgtcccggggccccctgactgtggaggagaccccccgggtgcagggcgagacccagccccagaggctgtag

SEQ ID NO: 159091 - DNA, 342 bp, Artificial Sequence
  Description of Artificial Sequence: Synthetic coding sequence
atggaggacacccaggccatcgactgggatgtggaggaggaggaggagacagagcagagcagcgagagcctgcgctgcaatgtggagcctgtgggccgcctgcacatcttcagcggggcccacggccctgagaaggacttccccctgcacctgggcaagaatgtggtgggccgcatgccagactgcagcgtggccctgcccttccccagcatcagcaagcagcacgccgagattgagatcctggcctgggacaaggcccccatcctgcgggactgtggcagcctgaatggcacccagatcctgcggccccccaaggtgctgagccctggggtgagccactag

SEQ ID NO: 159092 - DNA, 384 bp, Artificial Sequence
  Description of Artificial Sequence: Synthetic coding sequence
atggaggacacccaggccatcgactgggatgtggaggaggaggaggagacagagcagagcagcgagagcctgcgctgcaatgtggagcctgtgggccgcctgcacatcttcagcggggcccacggccctgagaaggacttccccctgcacctgggcaagaatgtggtgggccgcatgccagactgcagcgtggccctgcccttccccagcatcagcaagcagcacgccgagattgagatcctggcctgggacaaggcccccatcctgcgggactgtggcagcctgaatggcacccagatcctgcggccccccaaggtgctgagccctggggtgagccaccggctgcgggaccaggagctgatcctgtttgctgacctgctgtag

SEQ ID NO: 159093 - DNA, 489 bp, Artificial Sequence; identical to SEQ ID NO: 159090
  Description of Artificial Sequence: Synthetic coding sequence

SEQ ID NO: 159094 - DNA, 921 bp, Artificial Sequence
  Description of Artificial Sequence: Synthetic coding sequence
tgacatgtgggcggcaccaaggacagcgaggacaactatggagacagcgaggacctggacctgcaggccacccagtgcttcctggagaaccagggcctggaggccgtgcagagcatggaggatgagcccacccaggccttcatgctgaccccaccccaggagctgggccccagccactgcagcttccagaccaccggcctgctgaactgcaagatgcctcctgctgagaaggccagccgcatccgggctgctgagaaggtgtccagaggagaccaggagagcccagatgcctgcctgccccccaccgtgcctgaggccccagccccaccccagaagcccctgaacagccagagccagaagcacctggcccccccacccctgctgagccccctgctgcccagcatcaagcccaccgtgaggaagacccggcaggacggcagccaggaggcccctgaggcccccctgagcagcgagctggagcccttccaccccaagcccaagatccgcaccaggaagagcagcaggatgacccccttccctgccaccagcgctgcccctgagccccaccccagcaccagcacagcccagcctgtgacccccaagcccaccagccaggccaccaggagcaggaccaacagaagctctgtgaagaccccagagcctgtggtgcccacagcccctgagctgcagcccagcaccagcacagaccagcctgtgaccagcgagcccaccagccaggtgacccggggcaggaagagccgcagctctgtgaagaccccagagaccgtggtgcccacagccctggagctgcagcccagcaccagcacagacaggcctgtgaccagcgagcccaccagccaggccacccggggcaggaagaacagaagctctgtgaagaccccagagcctgtggtgccctag

SEQ ID NO: 159095 - DNA, 384 bp, Artificial Sequence; identical to SEQ ID NO: 159092
  Description of Artificial Sequence: Synthetic coding sequence

SEQ ID NO: 159096 - DNA, 921 bp, Artificial Sequence; identical to SEQ ID NO: 159094
  Description of Artificial Sequence: Synthetic coding sequence

SEQ ID NO: 159097 - DNA, 921 bp, Artificial Sequence; identical to SEQ ID NO: 159094
  Description of Artificial Sequence: Synthetic coding sequence

SEQ ID NO: 159098 - DNA, 6270 bp, Artificial Sequence; identical to SEQ ID NO: 159089
  Description of Artificial Sequence: Synthetic coding sequence

SEQ ID NO: 159099 - DNA, 6270 bp, Artificial Sequence; identical to SEQ ID NO: 159089
  Description of Artificial Sequence: Synthetic coding sequence

SEQ ID NO: 159100 - DNA, 4968 bp, Artificial Sequence
  Description of Artificial Sequence: Synthetic coding sequence
atgtaccaccggctggatgtgtccctgccctttgtgtcccggggccccctgactgtggaggagaccccccgggtgcagggcgagacccagccccagaggctgctgctggccgaggacagcgaggaggaggtggacttcctgtctgagaggaggatggtgaagaagagcaggaccaccagcagcagcgtcatcgtgcctgagagtgatgaggagggccacagccctgtgctgggcggcctgggccccccatttgccttcaacctgaacagcgacacagatgtggaggagggccagcagcctgccacagaggaggccagcagcgctgcccggcggggggccaccgtggaggccaagcagagcgaggccgaggtggtgacagagatccagctggagaaggaccagcccctggtgaaggagcgggacaatgacaccaaggtgaagagaggagctggaaatggagtggtgcctgctggggtcatcctggagaggagccagcccccaggagaagattctgacacagatgtggatgatgacagcaggcctcctggccggcctgctgaggtgcacctggagcgggcccagcccttcggcttcatcgacagcgacacagatgctgaggaggagcgcatcccagccacccctgtggtgatccccatgaagaagaggaagatcttccacggcgtgggcacccggggccctggggcccctggcctggcccacctgcaggagagccaggccggcagtgacacagatgtggaggagggcaaggccccccaggccgtgcccctggagaagagccaggcctccatggtgatcaacagcgacacagatgatgaggaggaggtgtctgctgccctgaccctggcccacctgaaggagagccagcctgccatctggaacagagatgctgaggaggacatgccccagagggtggtgctgctgcagaggagccagaccaccacagagcgggacagcgacacagatgtggaggaggaggagctgcctgtggagaaccgggaggccgtgctgaaggaccacaccaagatccgggccctggtgcgggcccacagcgagaaggaccagcccccatttggagacagtgatgacagcgtggaggccgacaagagcagccctggcatccacctggagaggagccaggccagcaccaccgtggacatcaacacccaggtggagaaggaggtgcccccaggcagcgccatcatccacatcaagaagcaccaggtgtctgtggagggcaccaaccagacagatgtgaaggctgtgggcggccctgccaagctgctggtggtgtccctggaggaggcctggcccctgcacggggactgtgaaacagatgctgaggagggcaccagcctgacagcctctgtggtggctgatgtgaggaagagccagctgcctgcagaaggagatgctggagctgagtgggccgctgctgtgctgaagcaggagcgggcccacgaggtgggcgcccagggcggcccccctgtggcccaggtggagcaggacctgcccatcagccgggagaacctgacagacctggtggtggacacagacaccctgggggagagcacccagccccagcgggagggcgcccaggtgcccaccggccgggagcgggagcagcacgtgggcggcaccaaggacagcgaggacaactacggggacagcgaggacctggacctgcaggccacccagtgcttcctggagaaccagggcctggaggtgcagagcatggaggatgagcccacccaggccttcatgctgaccccaccccaggagctgggccccagccactgcagcttccagaccaccggcctgctgaactgcaagatgcctcctgctgagaaggccagccgcatccgggctgctgagaaggtgtccagaggagaccaggagagcccagatgcctgcctgccccccaccgtgcctgaggccccagccccaccccagaagcccctgaacagccagagccagaagcacctggcccccccacccctgctgagccccctgctgcccagcatcaagcccaccgtgaggaagacccggcaggacggcagccaggaggcccctgaggcccccctgagcagcgagctggagcccttccaccccaagcccaagatccgcaccaggaagagcagcaggatgacccccttccctgccaccagcgctgcccctgagccccaccccagcaccagcacagcccagcctgtgacccccaagcccaccagccaggccaccaggagcaggaccaacagaagctctgtgaagaccccagagcctgtggtgcccacagcccctgagctgcagcccagcaccagcacagaccagcctgtgaccagcgagcccaccagccaggtgacccggggcaggaagagccgcagctctgtgaagaccccagagaccgtggtgcccacagccctggagctgcagcccagcaccagcacagacaggcctgtgaccagcgagcccaccagccaggccacccggggcaggaagaacagaagctctgtgaagaccccagagcctgtggtgcccacagcccctgagctgcagcccagcaccagcacagaccagcctgtgaccagcgagcccacctaccaggccacccggggcaggaagaacagaagctctgtgaagaccccagagcctgtggtgcccacagcccctgagctgcggcccagcaccagcacagacaggcctgtgacccccaagcccaccagcaggaccaccaggagcaggaccaacatgagctctgtgaagaaccctgagagcacagtgcccatcgcccctgagctgccccccagcaccagcacagagcagcctgtgaccccagagcccaccagccgggccacccggggcaggaagaacagaagcagcggcaagaccccagagaccctggtgcccacagcccccaagctggagcccagcaccagcacagaccagcctgtgaccccagagcccaccagccaggccacccggggccgcaccaacagaagctctgtgaagaccccagagaccgtggtgcccacagcccctgagctgcagcccagcaccagcacagaccagcctgtgaccccagagcccaccagccaggccacccggggccgcacagacaggagctctgtgaagaccccagagaccgtggtgcccacagcccctgagctgcaggccagcgccagcacagaccagcctgtgaccagcgagcccaccagcaggaccacccggggcaggaagaacagaagctctgtgaagaccccagagaccgtggtgcctgctgcccctgagctgcagcccagcaccagcacagaccagcctgtgaccccagagcccaccagccgggccacccggggccgcaccaacagaagctctgtgaagaccccagagagcatcgtgcccatcgcccctgagctgcagcccagcaccagcaggaaccagctggtgaccccagagcccaccagccgggccacccgctgcaggaccaacagaagctctgtgaagaccccagagcctgtggtgcccacagcccctgagccccaccccaccaccagcacagaccagcctgtgacccccaagctgaccagccgggccaccaggaggaagaccaacagaagctctgtgaagacccccaagcctgtggagcctgctgccagtgacctggagcccttcacccccacagaccagagcgtgaccccagaggccatcgcccagggcggccagagcaagaccctgcggagcagcacagtgcgggccatgcctgtgcccaccaccccagagttccagagccctgtgaccacagaccagcccatcagccctgagcccatcacccagcccagctgcatcaagaggcagagagctgctggcaaccctggcagcctggccgcccccatcgaccacaagccctgcagcgcccccctggagcccaagagccaggccagcaggaaccagcgctggggcgctgtgcgggctgctgagagcctgacagccatccctgagcccgccagcccccagctgctggagacccccatccacgccagccagatccagaaggtggagcccgccggccgcagccgcttcaccccagagctgcagcccaaggccagccagagcaggaagaggagcctggccaccatggacagccccccccaccagaagcagccccagagaggagaggtgtcccagaagacagtcatcatcaaggaggaggaggaggacacagctgagaagccaggcaaggaggaggatgtggtgacccccaagccaggcaagaggaagagggaccaggccgaggaggagcccaaccgcatccccagccgcagcctgcggaggaccaagctgaaccaggagagcacagcccccaaggtgctcttcaccggggtggtggatgcccggggggagagagctgtgctggccctgggcggcagcctggccggcagcgctgctgaggccagccacctggtgacagaccgcatccggaggacagtgaagttcctgtgtgccctgggccggggcatccccatcctgagcctggactggctgcaccagagcaggaaggccggcttcttcctgcccccagatgaatatgtggtgacagatcctgagcaggagaagaactttggcttcagcctgcaggatgccctgagccgggcccgggagcggcggctgctggagggctatgagatctacgtgaccccaggagtgcagcccccaccaccccagatgggagagatcatcagctgctgcggcggcacctacctgcccagcatgcccaggagctacaagccccagagggtggtgatcacctgcccccaggacttcccccactgcagcatccccctgcgggtgggcctgcccctgctgagccctgagttcctgctgactggagtgctgaagcaggaggccaagccagaggcctttgtgctgagccccctggagatgagcagcacctag

SEQ ID NO: 159101 - DNA, 489 bp, Artificial Sequence; identical to SEQ ID NO: 159090
  Description of Artificial Sequence: Synthetic coding sequence

SEQ ID NO: 159102 - DNA, 342 bp, Artificial Sequence; identical to SEQ ID NO: 159091
  Description of Artificial Sequence: Synthetic coding sequence

SEQ ID NO: 159103 - DNA, 342 bp, Artificial Sequence; identical to SEQ ID NO: 159091
  Description of Artificial Sequence: Synthetic coding sequence

SEQ ID NO: 159104 - DNA, 384 bp, Artificial Sequence; identical to SEQ ID NO: 159092
  Description of Artificial Sequence: Synthetic coding sequence

SEQ ID NO: 159105 - DNA, 489 bp, Artificial Sequence; identical to SEQ ID NO: 159090
  Description of Artificial Sequence: Synthetic coding sequence

SEQ ID NO: 159106 - DNA, 342 bp, Artificial Sequence; identical to SEQ ID NO: 159091
  Description of Artificial Sequence: Synthetic coding sequence

SEQ ID NO: 159107 - DNA, 489 bp, Artificial Sequence; identical to SEQ ID NO: 159090
  Description of Artificial Sequence: Synthetic coding sequence

SEQ ID NO: 159108 - DNA, 384 bp, Artificial Sequence; identical to SEQ ID NO: 159092
  Description of Artificial Sequence: Synthetic coding sequence

SEQ ID NO: 159109 - DNA, 921 bp, Artificial Sequence; identical to SEQ ID NO: 159094
  Description of Artificial Sequence: Synthetic coding sequence

SEQ ID NO: 159110 - DNA, 6270 bp, Artificial Sequence; identical to SEQ ID NO: 159089
  Description of Artificial Sequence: Synthetic coding sequence

SEQ ID NO: 159111 - DNA, 5409 bp, Artificial Sequence
  Description of Artificial Sequence: Synthetic coding sequence
atggaggacacccaggccatcgactgggatgtggaggaggaggaggagacagagcagagcagcgagagcctgcgctgcaatgtggagcctgtgggccgcctgcacatcttcagcggggcccacggccctgagaaggacttccccctgcacctgggcaagaatgtggtgggccgcatgccagactgcagcgtggccctgcccttccccagcatcagcaagcagcacgccgagattgagatcctggcctgggacaaggcccccatcctgcgggactgtggcagcctgaatggcacccagatcctgcggccccccaaggtgctgagccctggggtgagccaccggctgcgggaccaggagctgatcctgtttgctgacctgctgtgccagtaccaccggctggatgtgtccctgccctttgtgtcccggggccccctgactgtggaggagaccccccgggtgcagggcgagacccagccccagaggctgctgctggccgaggacagcgaggaggaggtggacttcctgtctgagaggaggatggtgaagaagagcaggaccaccagcagcagcgtcatcgtgcctgagagtgatgaggagggccacagccctgtgctgggcggcctgggccccccatttgccttcaacctgaacagcgacacagatgtggaggagggccagcagcctgccacagaggaggccagcagcgctgcccggcggggggccaccgtggaggccaagcagagcgaggccgaggtggtgacagagatccagctggagaaggaccagcccctggtgaaggagcgggacaatgacaccaaggtgaagagaggagctggaaatggagtggtgcctgctggggtcatcctggagaggagccagcccccaggagaagattctgacacagatgtggatgatgacagcaggcctcctggccggcctgctgaggtgcacctggagcgggcccagcccttcggcttcatcgacagcgacacagatgctgaggaggagcgcatcccagccacccctgtggtgatccccatgaagaagaggaagatcttccacggcgtgggcacccggggccctggggcccctggcctggcccacctgcaggagagccaggccggcagtgacacagatgtggaggagggcaaggccccccaggccgtgcccctggagaagagccaggcctccatggtgatcaacagcgacacagatgatgaggaggaggtgtctgctgccctgaccctggcccacctgaaggagagccagcctgccatctggaacagagatgctgaggaggacatgccccagagggtggtgctgctgcagaggagccagaccaccacagagcgggacagcgacacagatgtggaggaggaggagctgcctgtggagaaccgggaggccgtgctgaaggaccacaccaagatccgggccctggtgcgggcccacagcgagaaggaccagcccccatttggagacagtgatgacagcgtggaggccgacaagagcagccctggcatccacctggagaggagccaggccagcaccaccgtggacatcaacacccaggtggagaaggaggtgcccccaggcagcgccatcatccacatcaagaagcaccaggtgtctgtggagggcaccaaccagacagatgtgaaggctgtgggcggccctgccaagctgctggtggtgtccctggaggaggcctggcccctgcacggggactgtgaaacagatgctgaggagggcaccagcctgacagcctctgtggtggctgatgtgaggaagagccagctgcctgcagaaggagatgctggagctgagtgggccgctgctgtgctgaagcaggagcgggcccacgaggtgggcgcccagggcggcccccctgtggcccaggtggagcaggacctgcccatcagccgggagaacctgacagacctggtggtggacacagacaccctgggggagagcacccagccccagcgggagggcgcccaggtgcccaccggccgggagcgggagcagcacgtgggcggcaccaaggacagcgaggacaactacggggacagcgaggacctggacctgcaggccacccagtgcttcctggagaaccagggcctggaggccgtgcagagcatggaggatgagcccacccaggccttcatgctgaccccaccccaggagctgggccccagccactgcagcttccagaccaccggcaccctggatgagccctgggaggtgctggccacccagcccttctgcctgcgggagagtgaagattctgagacccagccctttgacacccacctggaggcctacggcccctgcctgagccccccccgggccatccctggggaccagcaccctgagagccctgtgcacacagagcccatgggcatccagggccggggccggcagacagtggacaaggtgatgggcatccccaaggagacagctgagcgggtgggccctgagcggggccccctggagcgggagacagagaagctgctgcctgagcggcagacagatgtgactggagaggaggagctgaccaagggcaagcaggaccgggagcagaagcagctgctggcccgggacacccagaggcaggagagtgacaagaatggagagagcgccagccctgagcgggaccgggagagcctgaaggtggagattgagaccagcgaggagatccaggagaagcaggtgcagaagcagaccctgcccagcaaggcctttgagcgggaggtggagaggcctgtggccaacagagaatgtgaccctgctgagctggaggagaaggtgcccaaggtgatcctggagcgggacacccagagaggagagcctgagggcggcagccaggaccagaagggccaggccagcagccccaccccagagcccggggtgggcgctggggacctgcccggccccaccagcgcccctgtgcccagcggcagccagagcggcggccggggcagccctgtgagcccccggcggcaccagaagggcctgctgaactgcaagatgcccccagctgagaaggccagccgcatccgggctgctgagaaggtgtccagaggagaccaggagagcccagatgcctgcctgcccccaacagtgcctgaggccccagccccaccccagaagcccctgaacagccagagccagaagcacctggcccccccacccctgctgagccccctgctgcccagcatcaagcccaccgtgaggaagacccggcaggacggcagccaggaggcccctgaggcccccctgagcagcgagctggagcccttccaccccaagcccaagatccgcaccaggaagagcagcaggatgacccccttccctgccaccagcgctgcccccaagctggagcccagcaccagcacagaccagcctgtgaccccagagcccaccagccaggccacccggggccgcaccaacagaagctctgtgaagaccccagagaccgtggtgcccacagcccctgagctgcagcccagcaccagcacagaccagcctgtgaccccagagcccaccagccaggccacccggggccgcacagacaggagctctgtgaagaccccagagaccgtggtgcccacagcccctgagctgcaggccagcgccagcacagaccagcctgtgaccagcgagcccaccagcaggaccacccggggcaggaagaacagaagctctgtgaagaccccagagaccgtggtgcctgctgcccctgagctgcagcccagcaccagcacagaccagcctgtgaccccagagcccaccagccgggccacccggggccgcaccaacagaagctctgtgaagaccccagagagcatcgtgcccatcgcccctgagctgcagcccagcaccagcaggaaccagctggtgaccccagagcccaccagccgggccacccgctgcaggaccaacagaagctctgtgaagaccccagagcctgtggtgcccacagcccctgagccccaccccaccaccagcacagaccagcctgtgacccccaagctgaccagccgggccaccaggaggaagaccaacagaagctctgtgaagacccccaagcctgtggagcctgctgccagtgacctggagcccttcacccccacagaccagagcgtgaccccagaggccatcgcccagggcggccagagcaagaccctgcggagcagcacagtgcgggccatgcctgtgcccaccaccccagagttccagagccctgtgaccacagaccagcccatcagccctgagcccatcacccagcccagctgcatcaagaggcagagagctgctggcaaccctggcagcctggccgcccccatcgaccacaagccctgcagcgcccccctggagcccaagagccaggccagcaggaaccagcgctggggcgctgtgcgggctgctgagagcctgacagccatccctgagcccgccagcccccagctgctggagacccccatccacgccagccagatccagaaggtggagcctgctggccgcagccgcttcaccccagagctgcagcccaaggccagccagagcaggaagaggagcctggccaccatggacagccccccccaccagaagcagccccagagaggagaggtgtcccagaagacagtcatcatcaaggaggaggaggaggacacagctgagaagccaggcaaggaggaggatgtggtgacccccaagccaggcaagaggaagagggaccaggccgaggaggagcccaaccgcatccccagccgcagcctgcggaggaccaagctgaaccaggagagcacagcccccaaggtgctcttcaccggggtggtggatgcccggggggagagagctgtgctggccctgggcggcagcctggccggcagcgctgctgaggccagccacctggtgacagaccgcatcagaagaacagtgaagttcctgtgtgccctgggccggggcatccccatcctgagcctggactggctgcaccagagcaggaaggccggcttcttcctgcccccagatgaatatgtggtgacagatcctgagcaggagaagaactttggcttcagcctgcaggatgccctgagccgggcccgggagcggcggctgctggagggctatgagatctacgtgaccccaggagtgcagcccccaccaccccagatgggagagatcatcagctgctgcggcggcacctacctgcccagcatgcccaggagctacaagccccagagggtggtgatcacctgcccccaggacttcccccactgcagcatccccctgcgggtgggcctgcccctgctgagccctgagttcctgctgactggagtgctgaagcaggaggccaagccagaggcctttgtgctgagccccctggagatgagcagcacctag

SEQ ID NO: 159112 - DNA, 342 bp, Artificial Sequence; identical to SEQ ID NO: 159091
  Description of Artificial Sequence: Synthetic coding sequence

SEQ ID NO: 159113 - DNA, 6270 bp, Artificial Sequence
  Description of Artificial Sequence: Synthetic coding sequence
atggaggacacccaggccatcgactgggatgtggaggaggaggaggagacagagcagagcagcgagagcctgcgctgcaatgtggagcctgtgggccgcctgcacatcttcagcggggcccacggccctgagaaggacttccccctgcacctgggcaagaatgtggtgggccgcatgccagactgcagcgtggccctgcccttccccagcatcagcaagcagcacgccgagattgagatcctggcctgggacaaggcccccatcctgcgggactgtggcagcctgaatggcacccagatcctgcggccccccaaggtgctgagccctggggtgagccaccggctgcgggaccaggagctgatcctgtttgctgacctgctgtgccagtaccaccggctggatgtgtccctgccctttgtgtcccggggccccctgactgtggaggagaccccccgggtgcagggcgagacccagccccagaggctgctgctggccgaggacagcgaggaggaggtggacttcctgtctgagaggaggatggtgaagaagagcaggaccaccagcagcagcgtcatcgtgcctgagagtgatgaggagggccacagccctgtgctgggcggcctgggccccccatttgccttcaacctgaacagcgacacagatgtggaggagggccagcagcctgccacagaggaggccagcagcgctgcccggcggggggccaccgtggaggccaagcagagcgaggccgaggtggtgacagagatccagctggagaaggaccagcccctggtgaaggagcgggacaatgacaccaaggtgaagagaggagctggaaatggagtggtgcctgctggggtcatcctggagaggagccagcccccaggagaagattctgacacagatgtggatgatgacagcaggcctcctggccggcctgctgaggtgcacctggagcgggcccagcccttcggcttcatcgacagcgacacagatgctgaggaggagcgcatcccagccacccctgtggtgatccccatgaagaagaggaagatcttccacggcgtgggcacccggggccctggggcccctggcctggcccacctgcaggagagccaggccggcagtgacacagatgtggaggagggcaaggccccccaggccgtgcccctggagaagagccaggcctccatggtgatcaacagcgacacagatgatgaggaggaggtgtctgctgccctgaccctggcccacctgaaggagagccagcctgccatctggaacagagatgctgaggaggacatgccccagagggtggtgctgctgcagaggagccagaccaccacagagcgggacagcgacacagatgtggaggaggaggagctgcctgtggagaaccgggaggccgtgctgaaggaccacaccaagatccgggccctggtgcgggcccacagcgagaaggaccagcccccatttggagacagtgatgacagcgtggaggccgacaagagcagccctggcatccacctggagaggagccaggccagcaccaccgtggacatcaacacccaggtggagaaggaggtgcccccaggcagcgccatcatccacatcaagaagcaccaggtgtctgtggagggcaccaaccagacagatgtgaaggctgtgggcggccctgccaagctgctggtggtgtccctggaggaggcctggcccctgcacggggactgtgaaacagatgctgaggagggcaccagcctgacagcctctgtggtggctgatgtgaggaagagccagctgcctgcagaaggagatgctggagctgagtgggccgctgctgtgctgaagcaggagcgggcccacgaggtgggcgcccagggcggcccccctgtggcccaggtggagcaggacctgcccatcagccgggagaacctgacagacctggtggtggacacagacaccctgggggagagcacccagccccagcgggagggcgcccaggtgcccaccggccgggagcgggagcagcacgtgggcggcaccaaggacagcgaggacaactacggggacagcgaggacctggacctgcaggccacccagtgcttcctggagaaccagggcctggaggccgtgcagagcatggaggatgagcccacccaggccttcatgctgaccccaccccaggagctgggccccagccactgcagcttccagaccaccggcaccctggatgagccctgggaggtgctggccacccagcccttctgcctgcgggagagtgaagattctgagacccagccctttgacacccacctggaggcctacggcccctgcctgagccccccccgggccatccctggggaccagcaccctgagagccctgtgcacacagagcccatgggcatccagggccggggccggcagacagtggacaaggtgatgggcatccccaaggagacagctgagcgggtgggccctgagcggggccccctggagcgggagacagagaagctgctgcctgagcggcagacagatgtgactggagaggaggagctgaccaagggcaagcaggaccgggagcagaagcagctgctggcccgggacacccagaggcaggagagtgacaagaatggagagagcgccagccctgagcgggaccgggagagcctgaaggtggagattgagaccagcgaggagatccaggagaagcaggtgcagaagcagaccctgcccagcaaggcctttgagcgggaggtggagaggcctgtggccaacagagaatgtgaccctgctgagctggaggagaaggtgcccaaggtgatcctggagcgggacacccagagaggagagcctgagggcggcagccaggaccagaagggccaggccagcagccccaccccagagcccggggtgggcgctggggacctgcccggccccaccagcgcccctgtgcccagcggcagccagagcggcggccggggcagccctgtgagcccccggcggcaccagaagggcctgctgaactgcaagatgcccccagctgagaaggccagccgcatccgggctgctgagaaggtgtccagaggagaccaggagagcccagatgcctgcctgcccccaacagtgcctgaggccccagccccaccccagaagcccctgaacagccagagccagaagcacctggcccccccacccctgctgagccccctgctgcccagcatcaagcccaccgtgaggaagacccggcaggacggcagccaggaggcccctgaggcccccctgagcagcgagctggagcccttccaccccaagcccaagatccgcaccaggaagagcagcaggatgacccccttccctgccaccagcgctgcccctgagccccaccccagcaccagcacagcccagcctgtgacccccaagcccaccagccaggccaccaggagcaggaccaacagaagctctgtgaagaccccagagcctgtggtgcccacagcccctgagctgcagcccagcaccagcacagaccagcctgtgaccagcgagcccaccagccaggtgacccggggcaggaagagccgcagctctgtgaagaccccagagaccgtggtgcccacagccctggagctgcagcccagcaccagcacagacaggcctgtgaccagcgagcccaccagccaggccacccggggcaggaagaacagaagctctgtgaagaccccagagcctgtggtgcccacagcccctgagctgcagcccagcaccagcacagaccagcctgtgaccagcgagcccacctaccaggccacccggggcaggaagaacagaagctctgtgaagaccccagagcctgtggtgcccacagcccctgagctgcggcccagcaccagcacagacaggcctgtgacccccaagcccaccagcaggaccaccaggagcaggaccaacatgagctctgtgaagaccccagagaccgtggtgcccacagcccctgagctgcagatcagcaccagcacagaccagcctgtgacccccaagcccaccagcaggaccaccaggagcaggaccaacatgagctctgtgaagaaccctgagagcacagtgcccatcgcccctgagctgccccccagcaccagcacagagcagcctgtgaccccagagcccaccagccgggccacccggggcaggaagaacagaagcagcggcaagaccccagagaccctggtgcccacagcccccaagctggagcccagcaccagcacagaccagcctgtgaccccagagcccaccagccaggccacccggggccgcaccaacagaagctctgtgaagaccccagagaccgtggtgcccacagcccctgagctgcagcccagcaccagcacagaccagcctgtgaccccagagcccaccagccaggccacccggggccgcacagacaggagctctgtgaagaccccagagaccgtggtgcccacagcccctgagctgcaggccagcgccagcacagaccagcctgtgaccagcgagcccaccagcaggaccacccggggcaggaagaacagaagctctgtgaagaccccagagaccgtggtgcctgctgccccagccctgcagcccagcaccagcacagaccagcctgtgaccccagagcccaccagccgggccacccggggccgcaccaacagaagctctgtgaagaccccagagagcatcgtgcccatcgcccctgagctgcagcccagcaccagcaggaaccagctggtgaccccagagcccaccagccgggccacccgctgcaggaccaacagaagctctgtgaagaccccagagcctgtggtgcccacagcccctgagccccaccccaccaccagcacagaccagcctgtgacccccaagctgaccagccgggccaccaggaggaagaccaacagaagctctgtgaagacccccaagcctgtggagcctgctgccagtgacctggagcccttcacccccacagaccagagcgtgaccccagaggccatcgcccagggcggccagagcaagaccctgcggagcagcacagtgcgggccatgcctgtgcccaccaccccagagttccagagccctgtgaccacagaccagcccatcagccctgagcccatcacccagcccagctgcatcaagaggcagagagctgctggcaaccctggcagcctggccgcccccatcgaccacaagccctgcagcgcccccctggagcccaagagccaggccagcaggaaccagcgctggggcgctgtgcgggctgctgagagcctgacagccatccctgagcccgccagcccccagctgctggagacccccatccacgccagccagatccagaaggtggagcccgccggccgcagccgcttcaccccagagctgcagcccaaggccagccagagcaggaagaggagcctggccaccatggacagccccccccaccagaagcagccccagagaggagaggtgtcccagaagacagtcatcatcaaggaggaggaggaggacacagctgagaagccaggcaaggaggaggatgtggtgacccccaagccaggcaagaggaagagggaccaggccgaggaggagcccaaccgcatccccagccgcagcctgcggaggaccaagctgaaccaggagagcacagcccccaaggtgctcttcaccggggtggtggatgcccggggggagagagctgtgctggccctgggcggcagcctggccggcagcgctgctgaggccagccacctggtgacagaccgcatccggaggacagtgaagttcctgtgtgccctgggccggggcatccccatcctgagcctggactggctgcaccagagcaggaaggccggcttcttcctgcccccagatgaatatgtggtgacagatcctgagcaggagaagaactttggcttcagcctgcaggatgccctgagccgggcccgggagcggcggctgctggagggctatgagatctacgtgaccccaggagtgcagcccccaccaccccagatgggagagatcatcagctgctgcggcggcacctacctgcccagcatgcccaggagctacaagccccagagggtggtgatcacctgcccccaggacttcccccactgcagcatccccctgcgggtgggcctgcccctgctgagccctgagttcctgctgactggagtgctgaagcaggaggccaagccagaggcctttgtgctgagccccctggagatgagcagcacctag

SEQ ID NO: 159114 - DNA, 738 bp, Artificial Sequence
  Description of Artificial Sequence: Synthetic coding sequence
atggaggacacccaggccatcgactgggatgtggaggaggaggaggagacagagcagagcagcgagagcctgcgctgcaatgtggagcctgtgggccgcctgcacatcttcagcggggcccacggccctgagaaggacttccccctgcacctgggcaagaatgtggtgggccgcatgccagactgcagcgtggccctgcccttccccagcatcagcaagcagcacgccgagattgagatcctggcctgggacaaggcccccatcctgcgggactgtggcagcctgaatggcacccagatcctgcggccccccaaggtgctgagccctggggtgagccaccggctgcgggaccaggagctgatcctgtttgctgacctgctgtgccagtaccaccggctggatgtgtccctgccctttgtgtcccggggccccctgactgtggaggagaccccccgggtgcagggcgagacccagccccagaggctgctgctggccgaggacagcgaggaggaggtggacttcctgtctgagaggaggatggtgaagaagagcaggaccaccagcagcagcgtcatcgtgcctgagagtgatgaggagggccacagccctgtgctgggcggcctgggccccccatttgccttcaacctgaacagcgacacagatgtggaggagggccagcagcctgccacagaggaggccagcagcgctgcccggcggggggccaccgtggaggcctag

SEQ ID NO: 159115 - DNA, 342 bp, Artificial Sequence; identical to SEQ ID NO: 159091
  Description of Artificial Sequence: Synthetic coding sequence

SEQ ID NO: 159116 - DNA, 384 bp, Artificial Sequence; identical to SEQ ID NO: 159092
  Description of Artificial Sequence: Synthetic coding sequence

SEQ ID NO: 159117 - DNA, 6270 bp, Artificial Sequence; identical to SEQ ID NO: 159089
  Description of Artificial Sequence: Synthetic coding sequence

SEQ ID NO: 159118 - DNA, 489 bp, Artificial Sequence; identical to SEQ ID NO: 159090
  Description of Artificial Sequence: Synthetic coding sequence

SEQ ID NO: 159119 - DNA, 921 bp, Artificial Sequence; identical to SEQ ID NO: 159094
  Description of Artificial Sequence: Synthetic coding sequence

SEQ ID NO: 159120 - DNA, 921 bp, Artificial Sequence; identical to SEQ ID NO: 159094
  Description of Artificial Sequence: Synthetic coding sequence

SEQ ID NO: 159121 - DNA, 384 bp, Artificial Sequence; identical to SEQ ID NO: 159092
  Description of Artificial Sequence: Synthetic coding sequence

SEQ ID NO: 159122 - DNA, 921 bp, Artificial Sequence; identical to SEQ ID NO: 159094
  Description of Artificial Sequence: Synthetic coding sequence

SEQ ID NO: 159123 - DNA, 489 bp, Artificial Sequence; identical to SEQ ID NO: 159090
  Description of Artificial Sequence: Synthetic coding sequence

SEQ ID NO: 159124 - DNA, 6270 bp, Artificial Sequence; identical to SEQ ID NO: 159089
  Description of Artificial Sequence: Synthetic coding sequence

SEQ ID NO: 159125 - DNA, 735 bp, Artificial Sequence
  Description of Artificial Sequence: Synthetic coding sequence
atggaggacacccaggccatcgactgggatgtggaggaggaggaggagacagagcagagcagcgagagcctgcgctgcaatgtggagcctgtgggccgcctgcacatcttcagcggggcccacggccctgagaaggacttccccctgcacctgggcaagaatgtggtgggccgcatgccagactgcagcgtggccctgcccttccccagcatcagcaagcagcacgccgagattgagatcctggcctgggacaaggcccccatcctgcgggactgtggcagcctgaatggcacccagatcctgcggccccccaaggtgctgagccctggggtgagccaccggctgcgggaccaggagctgatcctgtttgctgacctgctgtgccagtaccaccggctggatgtgtccctgccctttgtgtcccggggccccctgactgtggaggagaccccccgggtgcagggcgagacccagccccagaggctgctgctggccgaggacagcgaggaggaggtggacttcctgtctgagaggaggatggtgaagaagagcaggaccaccagcagcagcgtcatcgtgcctgagagtgatgaggagggccacagccctgtgctgggcggcctgggccccccatttgccttcaacctgaacagcgacacagatgtggaggagggccagcagccccacagaggaggcctgctgagctgccagaagcgctgccactgccggggctag

SEQ ID NO: 159126 - DNA, 384 bp, Artificial Sequence; identical to SEQ ID NO: 159092
  Description of Artificial Sequence: Synthetic coding sequence

SEQ ID NO: 159127 - DNA, 342 bp, Artificial Sequence; identical to SEQ ID NO: 159091
  Description of Artificial Sequence: Synthetic coding sequence

SEQ ID NO: 159128 - DNA, 5409 bp, Artificial Sequence; identical to SEQ ID NO: 159111
  Description of Artificial Sequence: Synthetic coding sequence

SEQ ID NO: 159129 - DNA, 735 bp, Artificial Sequence; identical to SEQ ID NO: 159125
  Description of Artificial Sequence: Synthetic coding sequence

SEQ ID NO: 159130 - DNA, 5409 bp, Artificial Sequence; identical to SEQ ID NO: 159111
  Description of Artificial Sequence: Synthetic coding sequence

SEQ ID NO: 159131 - DNA, 735 bp, Artificial Sequence; identical to SEQ ID NO: 159125
  Description of Artificial Sequence: Synthetic coding sequence

SEQ ID NO: 159132 - DNA, 735 bp, Artificial Sequence; identical to SEQ ID NO: 159125
  Description of Artificial Sequence: Synthetic coding sequence

SEQ ID NO: 159133 - DNA, 738 bp, Artificial Sequence; identical to SEQ ID NO: 159114
  Description of Artificial Sequence: Synthetic coding sequence

SEQ ID NO: 159134 - DNA, 5478 bp, Artificial Sequence; identical to SEQ ID NO: 159088
  Description of Artificial Sequence: Synthetic coding sequence

SEQ ID NO: 159135 - DNA, 738 bp, Artificial Sequence; identical to SEQ ID NO: 159114
  Description of Artificial Sequence: Synthetic coding sequence

SEQ ID NO: 159136 - DNA, 5409 bp, Artificial Sequence; identical to SEQ ID NO: 159111
  Description of Artificial Sequence: Synthetic coding sequence

SEQ ID NO: 159137 - DNA, 738 bp, Artificial Sequence; identical to SEQ ID NO: 159114
  Description of Artificial Sequence: Synthetic coding sequence

SEQ ID NO: 159138 - DNA, 5409 bp, Artificial Sequence
  Description of Artificial Sequence: Synthetic coding sequence
atggaggacacccaggccatcgactgggatgtggaggaggaggaggagacagagcagagcagcgagagcctgcgctgcaatgtggagcctgtgggccgcctgcacatcttcagcggggcccacggccctgagaaggacttccccctgcacctgggcaagaatgtggtgggccgcatgccagactgcagcgtggccctgcccttccccagcatcagcaagcagcacgccgagattgagatcctggcctgggacaaggcccccatcctgcgggactgtggcagcctgaatggcacccagatcctgcggccccccaaggtgctgagccctggggtgagccaccggctgcgggaccaggagctgatcctgtttgctgacctgctgtgccagtaccaccggctggatgtgtccctgccctttgtgtcccggggccccctgactgtggaggagaccccccgggtgcagggcgagacccagccccagaggctgctgctggccgaggacagcgaggaggaggtggacttcctgtctgagaggaggatggtgaagaagagcaggaccaccagcagcagcgtcatcgtgcctgagagtgatgaggagggccacagccctgtgctgggcggcctgggccccccatttgccttcaacctgaacagcgacacagatgtggaggagggccagcagcctgccacagaggaggccagcagcgctgcccggcggggggccaccgtggaggccaagcagagcgaggccgaggtggtgacagagatccagctggagaaggaccagcccctggtgaaggagcgggacaatgacaccaaggtgaagagaggagctggaaatggagtggtgcctgctggggtcatcctggagaggagccagcccccaggagaagattctgacacagatgtggatgatgacagcaggcctcctggccggcctgctgaggtgcacctggagcgggcccagcccttcggcttcatcgacagcgacacagatgctgaggaggagcgcatcccagccacccctgtggtgatccccatgaagaagaggaagatcttccacggcgtgggcacccggggccctggggcccctggcctggcccacctgcaggagagccaggccggcagtgacacagatgtggaggagggcaaggccccccaggccgtgcccctggagaagagccaggcctccatggtgatcaacagcgacacagatgatgaggaggaggtgtctgctgccctgaccctggcccacctgaaggagagccagcctgccatctggaacagagatgctgaggaggacatgccccagagggtggtgctgctgcagaggagccagaccaccacagagcgggacagcgacacagatgtggaggaggaggagctgcctgtggagaaccgggaggccgtgctgaaggaccacaccaagatccgggccctggtgcgggcccacagcgagaaggaccagcccccatttggagacagtgatgacagcgtggaggccgacaagagcagccctggcatccacctggagaggagccaggccagcaccaccgtggacatcaacacccaggtggagaaggaggtgcccccaggcagcgccatcatccacatcaagaagcaccaggtgtctgtggagggcaccaaccagacagatgtgaaggctgtgggcggccctgccaagctgctggtggtgtccctggaggaggcctggcccctgcacggggactgtgaaacagatgctgaggagggcaccagcctgacagcctctgtggtggctgatgtgaggaagagccagctgcctgcagaaggagatgctggagctgagtgggccgctgctgtgctgaagcaggagcgggcccacgaggtgggcgcccagggcggcccccctgtggcccaggtggagcaggacctgcccatcagccgggagaacctgacagacctggtggtggacacagacaccctgggggagagcacccagccccagcgggagggcgcccaggtgcccaccggccgggagcgggagcagcacgtgggcggcaccaaggacagcgaggacaactacggggacagcgaggacctggacctgcaggccacccagtgcttcctggagaaccagggcctggaggccgtgcagagcatggaggatgagcccacccaggccttcatgctgaccccaccccaggagctgggccccagccactgcagcttccagaccaccggcaccctggatgagccctgggaggtgctggccacccagcccttctgcctgcgggagagtgaagattctgagacccagccctttgacacccacctggaggcctacggcccctgcctgagccccccccgggccatccctggggaccagcaccctgagagccctgtgcacacagagcccatgggcatccagggccggggccggcagacagtggacaaggtgatgggcatccccaaggagacagctgagcgggtgggccctgagcggggccccctggagcgggagacagagaagctgctgcctgagcggcagacagatgtgactggagaggaggagctgaccaagggcaagcaggaccgggagcagaagcagctgctggcccgggacacccagaggcaggagagtgacaagaatggagagagcgccagccctgagcgggaccgggagagcctgaaggtggagattgagaccagcgaggagatccaggagaagcaggtgcagaagcagaccctgcccagcaaggcctttgagcgggaggtggagaggcctgtggccaacagagaatgtgaccctgctgagctggaggagaaggtgcccaaggtgatcctggagcgggacacccagagaggagagcctgagggcggcagccaggaccagaagggccaggccagcagccccaccccagagcccggggtgggcgctggggacctgcccggccccaccagcgcccctgtgcccagcggcagccagagcggcggccggggcagccctgtgagcccccggcggcaccagaagggcctgctgaactgcaagatgcccccagctgagaaggccagccgcatccgggctgctgagaaggtgtccagaggagaccaggagagcccagatgcctgcctgcccccaacagtgcctgaggccccagccccaccccagaagcccctgaacagccagagccagaagcacctggcccccccacccctgctgagccccctgctgcccagcatcaagcccaccgtgaggaagacccggcaggacggcagccaggaggcccctgaggcccccctgagcagcgagctggagcccttccaccccaagcccaagatccgcaccaggaagagcagcaggatgacccccttccctgccaccagcgctgcccccaagctggagcccagcaccagcacagaccagcctgtgaccccagagcccaccagccaggccacccggggccgcaccaacagaagctctgtgaagaccccagagaccgtggtgcccacagcccctgagctgcagcccagcaccagcacagaccagcctgtgaccccagagcccaccagccaggccacccggggccgcacagacaggagctctgtgaagaccccagagaccgtggtgcccacagcccctgagctgcaggccagcgccagcacagaccagcctgtgaccagcgagcccaccagcaggaccacccggggcaggaagaacagaagctctgtgaagaccccagagaccgtggtgcctgctgccccagccctgcagcccagcaccagcacagaccagcctgtgaccccagagcccaccagccgggccacccggggccgcaccaacagaagctctgtgaagaccccagagagcatcgtgcccatcgcccctgagctgcagcccagcaccagcaggaaccagctggtgaccccagagcccaccagccgggccacccgctgcaggaccaacagaagctctgtgaagaccccagagcctgtggtgcccacagcccctgagccccaccccaccaccagcacagaccagcctgtgacccccaagctgaccagccgggccaccaggaggaagaccaacagaagctctgtgaagacccccaagcctgtggagcctgctgccagtgacctggagcccttcacccccacagaccagagcgtgaccccagaggccatcgcccagggcggccagagcaagaccctgcggagcagcacagtgcgggccatgcctgtgcccaccaccccagagttccagagccctgtgaccacagaccagcccatcagccctgagcccatcacccagcccagctgcatcaagaggcagagagctgctggcaaccctggcagcctggccgcccccatcgaccacaagccctgcagcgcccccctggagcccaagagccaggccagcaggaaccagcgctggggcgctgtgcgggctgctgagagcctgacagccatccctgagcccgccagcccccagctgctggagacccccatccacgccagccagatccagaaggtggagcctgctggccgcagccgcttcaccccagagctgcagcccaaggccagccagagcaggaagaggagcctggccaccatggacagccccccccaccagaagcagccccagagaggagaggtgtcccagaagacagtcatcatcaaggaggaggaggaggacacagctgagaagccaggcaaggaggaggatgtggtgacccccaagccaggcaagaggaagagggaccaggccgaggaggagcccaaccgcatccccagccgcagcctgcggaggaccaagctgaaccaggagagcacagcccccaaggtgctcttcaccggggtggtggatgcccggggggagagagctgtgctggccctgggcggcagcctggccggcagcgctgctgaggccagccacctggtgacagaccgcatcagaagaacagtgaagttcctgtgtgccctgggccggggcatccccatcctgagcctggactggctgcaccagagcaggaaggccggcttcttcctgcccccagatgaatatgtggtgacagatcctgagcaggagaagaactttggcttcagcctgcaggatgccctgagccgggcccgggagcggcggctgctggagggctatgagatctacgtgaccccaggagtgcagcccccaccaccccagatgggagagatcatcagctgctgcggcggcacctacctgcccagcatgcccaggagctacaagccccagagggtggtgatcacctgcccccaggacttcccccactgcagcatccccctgcgggtgggcctgcccctgctgagccctgagttcctgctgactggagtgctgaagcaggaggccaagccagaggcctttgtgctgagccccctggagatgagcagcacctag

SEQ ID NO: 159139 - DNA, 5478 bp, Artificial Sequence; identical to SEQ ID NO: 159088
  Description of Artificial Sequence: Synthetic coding sequence

SEQ ID NO: 159140 - DNA, 4968 bp, Artificial Sequence; identical to SEQ ID NO: 159100
  Description of Artificial Sequence: Synthetic coding sequence

SEQ ID NO: 159141 - DNA, 4968 bp, Artificial Sequence
  Description of Artificial Sequence: Synthetic coding sequence
atgtaccaccggctggatgtgtccctgccctttgtgtcccggggccccctgactgtggaggagaccccccgggtgcagggcgagacccagccccagaggctgctgctggccgaggacagcgaggaggaggtggacttcctgtctgagaggaggatggtgaagaagagcaggaccaccagcagcagcgtcatcgtgcctgagagtgatgaggagggccacagccctgtgctgggcggcctgggccccccatttgccttcaacctgaacagcgacacagatgtggaggagggccagcagcctgccacagaggaggccagcagcgctgcccggcggggggccaccgtggaggccaagcagagcgaggccgaggtggtgacagagatccagctggagaaggaccagcccctggtgaaggagcgggacaatgacaccaaggtgaagagaggagctggaaatggagtggtgcctgctggggtcatcctggagaggagccagcccccaggagaagattctgacacagatgtggatgatgacagcaggcctcctggccggcctgctgaggtgcacctggagcgggcccagcccttcggcttcatcgacagcgacacagatgctgaggaggagcgcatcccagccacccctgtggtgatccccatgaagaagaggaagatcttccacggcgtgggcacccggggccctggggcccctggcctggcccacctgcaggagagccaggccggcagtgacacagatgtggaggagggcaaggccccccaggccgtgcccctggagaagagccaggcctccatggtgatcaacagcgacacagatgatgaggaggaggtgtctgctgccctgaccctggcccacctgaaggagagccagcctgccatctggaacagagatgctgaggaggacatgccccagagggtggtgctgctgcagaggagccagaccaccacagagcgggacagcgacacagatgtggaggaggaggagctgcctgtggagaaccgggaggccgtgctgaaggaccacaccaagatccgggccctggtgcgggcccacagcgagaaggaccagcccccatttggagacagtgatgacagcgtggaggccgacaagagcagccctggcatccacctggagaggagccaggccagcaccaccgtggacatcaacacccaggtggagaaggaggtgcccccaggcagcgccatcatccacatcaagaagcaccaggtgtctgtggagggcaccaaccagacagatgtgaaggctgtgggcggccctgccaagctgctggtggtgtccctggaggaggcctggcccctgcacggggactgtgaaacagatgctgaggagggcaccagcctgacagcctctgtggtggctgatgtgaggaagagccagctgcctgcagaaggagatgctggagctgagtgggccgctgctgtgctgaagcaggagcgggcccacgaggtgggcgcccagggcggcccccctgtggcccaggtggagcaggacctgcccatcagccgggagaacctgacagacctggtggtggacacagacaccctgggggagagcacccagccccagcgggagggcgcccaggtgcccaccggccgggagcgggagcagcacgtgggcggcaccaaggacagcgaggacaactacggggacagcgaggacctggacctgcaggccacccagtgcttcctggagaaccagggcctggaggtgcagagcatggaggatgagcccacccaggccttcatgctgaccccaccccaggagctgggccccagccactgcagcttccagaccaccggcctgctgaactgcaagatgcctcctgctgagaaggccagccgcatccgggctgctgagaaggtgtccagaggagaccaggagagcccagatgcctgcctgccccccaccgtgcctgaggccccagccccaccccagaagcccctgaacagccagagccagaagcacctggcccccccacccctgctgagccccctgctgcccagcatcaagcccaccgtgaggaagacccggcaggacggcagccaggaggcccctgaggcccccctgagcagcgagctggagcccttccaccccaagcccaagatccgcaccaggaagagcagcaggatgacccccttccctgccaccagcgctgcccctgagccccaccccagcaccagcacagcccagcctgtgacccccaagcccaccagccaggccaccaggagcaggaccaacagaagctctgtgaagaccccagagcctgtggtgcccacagcccctgagctgcagcccagcaccagcacagaccagcctgtgaccagcgagcccaccagccaggtgacccggggcaggaagagccgcagctctgtgaagaccccagagaccgtggtgcccacagccctggagctgcagcccagcaccagcacagacaggcctgtgaccagcgagcccaccagccaggccacccggggcaggaagaacagaagctctgtgaagaccccagagcctgtggtgcccacagcccctgagctgcagcccagcaccagcacagaccagcctgtgaccagcgagcccacctaccaggccacccggggcaggaagaacagaagctctgtgaagaccccagagcctgtggtgcccacagcccctgagctgcggcccagcaccagcacagacaggcctgtgacccccaagcccaccagcaggaccaccaggagcaggaccaacatgagctctgtgaagaaccctgagagcacagtgcccatcgcccctgagctgccccccagcaccagcacagagcagcctgtgaccccagagcccaccagccgggccacccggggcaggaagaacagaagcagcggcaagaccccagagaccctggtgcccacagcccccaagctggagcccagcaccagcacagaccagcctgtgaccccagagcccaccagccaggccacccggggccgcaccaacagaagctctgtgaagaccccagagaccgtggtgcccacagcccctgagctgcagcccagcaccagcacagaccagcctgtgaccccagagcccaccagccaggccacccggggccgcacagacaggagctctgtgaagaccccagagaccgtggtgcccacagcccctgagctgcaggccagcgccagcacagaccagcctgtgaccagcgagcccaccagcaggaccacccggggcaggaagaacagaagctctgtgaagaccccagagaccgtggtgcctgctgccccagccctgcagcccagcaccagcacagaccagcctgtgaccccagagcccaccagccgggccacccggggccgcaccaacagaagctctgtgaagaccccagagagcatcgtgcccatcgcccctgagctgcagcccagcaccagcaggaaccagctggtgaccccagagcccaccagccgggccacccgctgcaggaccaacagaagctctgtgaagaccccagagcctgtggtgcccacagcccctgagccccaccccaccaccagcacagaccagcctgtgacccccaagctgaccagccgggccaccaggaggaagaccaacagaagctctgtgaagacccccaagcctgtggagcctgctgccagtgacctggagcccttcacccccacagaccagagcgtgaccccagaggccatcgcccagggcggccagagcaagaccctgcggagcagcacagtgcgggccatgcctgtgcccaccaccccagagttccagagccctgtgaccacagaccagcccatcagccctgagcccatcacccagcccagctgcatcaagaggcagagagctgctggcaaccctggcagcctggccgcccccatcgaccacaagccctgcagcgcccccctggagcccaagagccaggccagcaggaaccagcgctggggcgctgtgcgggctgctgagagcctgacagccatccctgagcccgccagcccccagctgctggagacccccatccacgccagccagatccagaaggtggagcccgccggccgcagccgcttcaccccagagctgcagcccaaggccagccagagcaggaagaggagcctggccaccatggacagccccccccaccagaagcagccccagagaggagaggtgtcccagaagacagtcatcatcaaggaggaggaggaggacacagctgagaagccaggcaaggaggaggatgtggtgacccccaagccaggcaagaggaagagggaccaggccgaggaggagcccaaccgcatccccagccgcagcctgcggaggaccaagctgaaccaggagagcacagcccccaaggtgctcttcaccggggtggtggatgcccggggggagagagctgtgctggccctgggcggcagcctggccggcagcgctgctgaggccagccacctggtgacagaccgcatccggaggacagtgaagttcctgtgtgccctgggccggggcatccccatcctgagcctggactggctgcaccagagcaggaaggccggcttcttcctgcccccagatgaatatgtggtgacagatcctgagcaggagaagaactttggcttcagcctgcaggatgccctgagccgggcccgggagcggcggctgctggagggctatgagatctacgtgaccccaggagtgcagcccccaccaccccagatgggagagatcatcagctgctgcggcggcacctacctgcccagcatgcccaggagctacaagccccagagggtggtgatcacctgcccccaggacttcccccactgcagcatccccctgcgggtgggcctgcccctgctgagccctgagttcctgctgactggagtgctgaagcaggaggccaagccagaggcctttgtgctgagccccctggagatgagcagcacctag

SEQ ID NO: 159142 - DNA, 666 bp, Artificial Sequence
  Description of Artificial Sequence: Synthetic coding sequence
atggaggacacccaggccatcgactgggatgtggaggaggaggaggagacagagcagagcagcgagagcctgcgctgcaatgtggagcctgtgggccgcctgcacatcttcagcggggcccacggccctgagaaggacttccccctgcacctgggcaagaatgtggtgggccgcatgccagactgcagcgtggccctgcccttccccagcatcagcaagcagcacgccgagattgagatcctggcctgggacaaggcccccatcctgcgggactgtggcagcctgaatggcacccagatcctgagcagcagcctgcccccaccccagaccagcctgctgcccctgagcctgcggctgcggctgctgggggaggagcagattgaccccctgagccggctgctgaagcagctgagcccccagcccctgagctaccgcctgcccccaccccagaccagcctgagccccctgagcccccacctgggccccctgggggaggagaagattggccccctgagccggcccctgaagcagctgtgcccccagcccctgagcagcagcctgcccccaccccagaccaacctgagccccctgagcccccacctgggccccctgggcgccggccagatcggccccctgagccggcccctgaaccagctgagcctgtag

SEQ ID NO: 159143 - DNA, 666 bp, Artificial Sequence; identical to SEQ ID NO: 159142
  Description of Artificial Sequence: Synthetic coding sequence

SEQ ID NO: 159144 - DNA, 738 bp, Artificial Sequence; identical to SEQ ID NO: 159114
  Description of Artificial Sequence: Synthetic coding sequence

SEQ ID NO: 159145 - DNA, 4968 bp, Artificial Sequence; identical to SEQ ID NO: 159100
  Description of Artificial Sequence: Synthetic coding sequence

SEQ ID NO: 159146 - DNA, 5478 bp, Artificial Sequence; identical to SEQ ID NO: 159088
  Description of Artificial Sequence: Synthetic coding sequence

SEQ ID NO: 159147 - DNA, 4968 bp, Artificial Sequence; identical to SEQ ID NO: 159100
  Description of Artificial Sequence: Synthetic coding sequence

SEQ ID NO: 159148 - DNA, 4968 bp, Artificial Sequence; identical to SEQ ID NO: 159100
  Description of Artificial Sequence: Synthetic coding sequence

SEQ ID NO: 159149 - DNA, 735 bp, Artificial Sequence; identical to SEQ ID NO: 159125
  Description of Artificial Sequence: Synthetic coding sequence

SEQ ID NO: 159150 - DNA, 5409 bp, Artificial Sequence; identical to SEQ ID NO: 159111
  Description of Artificial Sequence: Synthetic coding sequence

SEQ ID NO: 159151 - DNA, 4968 bp, Artificial Sequence; identical to SEQ ID NO: 159100
  Description of Artificial Sequence: Synthetic coding sequence

SEQ ID NO: 159152 - DNA, 5409 bp, Artificial Sequence; identical to SEQ ID NO: 159111
  Description of Artificial Sequence: Synthetic coding sequence

SEQ ID NO: 159153 - DNA, 666 bp, Artificial Sequence
  Description of Artificial Sequence: Synthetic coding sequence
atggaggacacccaggccatcgactgggatgtggaggaggaggaggagacagagcagagcagcgagagcctgcgctgcaatgtggagcctgtgggccgcctgcacatcttcagcggggcccacggccctgagaaggacttccccctgcacctgggcaagaatgtggtgggccgcatgccagactgcagcgtggccctgcccttccccagcatcagcaagcagcacgccgagattgagatcctggcctgggacaaggcccccatcctgcgggactgtggcagcctgaatggcacccagatcctgagcagcagcctgcccccaccccagaccagcctgctgcccctgagcctgcggctgcggctgctgggggaggagcagattgaccccctgagccggctgctgaagcagctgagcccccagcccctgagctaccgcctgcccccaccccagaccagcctgagccccctgagcccccacctgggccccctgggggaggagaagattggccccctgagccggcccctgaagcagctgtgcccccagcccctgcggagcagcctgcccccaccccagaccaacctgagccccctgagcccccacctgggccccctgggcgccggccagatcggccccctgagccggcccctgaaccagctgagcctgtag

SEQ ID NO: 159154 - DNA, 666 bp, Artificial Sequence; identical to SEQ ID NO: 159142
  Description of Artificial Sequence: Synthetic coding sequence

SEQ ID NO: 159155 - DNA, 738 bp, Artificial Sequence; identical to SEQ ID NO: 159114
  Description of Artificial Sequence: Synthetic coding sequence

SEQ ID NO: 159156 - DNA, 5478 bp, Artificial Sequence; identical to SEQ ID NO: 159088
  Description of Artificial Sequence: Synthetic coding sequence

SEQ ID NO: 159157 - DNA, 735 bp, Artificial Sequence; identical to SEQ ID NO: 159125
  Description of Artificial Sequence: Synthetic coding sequence

SEQ ID NO: 159158 - DNA, 735 bp, Artificial Sequence; identical to SEQ ID NO: 159125
  Description of Artificial Sequence: Synthetic coding sequence

SEQ ID NO: 159159 - DNA, 666 bp, Artificial Sequence; identical to SEQ ID NO: 159142
  Description of Artificial Sequence: Synthetic coding sequence

SEQ ID NO: 159160 - DNA, 666 bp, Artificial Sequence; identical to SEQ ID NO: 159142
  Description of Artificial Sequence: Synthetic coding sequence

SEQ ID NO: 159161 - DNA, 5478 bp, Artificial Sequence; identical to SEQ ID NO: 159088
  Description of Artificial Sequence: Synthetic coding sequence

SEQ ID NO: 159162 - DNA, 738 bp, Artificial Sequence; identical to SEQ ID NO: 159114
  Description of Artificial Sequence: Synthetic coding sequence

SEQ ID NO: 159163 - DNA, 2238 bp, Artificial Sequence
  Description of Artificial Sequence: Synthetic coding sequence
atggcctgccggcagagaggaggctcctggagccccagcggctggttcaatgccggctggagcacctaccgcagcatcagcctcttctttgccctggtgaccagcggcaacagcattgatgtgtcccagctggtgaacccagccttccctggcaccgtgacctgtgatgagcgggagatcaccgtggagttccccagcagccctggcaccaagaagtggcacgcctctgtggtggaccccctgggcctggacatgcccaactgcacctacatcctggaccctgagaagctgaccctgcgggccacctatgacaactgcacccggcgggtgcatggaggccaccagatgaccatccgggtgatgaacaacagcgctgccctgcggcatggagctgtgatgtaccagttcttctgcccagccatgcaggtggaggagacccagggcctgagcgccagcaccatctgccagaaggacttcatgtccttcagcctgcccagggtcttcagcggcctggctgatgacagcaagggcaccaaggtgcagatgggctggagcattgaggtgggagatggagcccgggccaagaccctgaccctgcctgaggccatgaaggagggcttcagcctgctgattgacaaccacaggatgaccttccacgtgcccttcaatgccactggagtgacccactacgtgcagggcaacagccacctgtacatggtgtccctgaagctgaccttcatcagccctggccagaaggtgatcttcagcagccaggccatctgtgccccagaccctgtgacctgcaatgccacccacatgaccctgaccatccctgagttccctgggaagctgaagtctgtgtcctttgagaaccagaacattgatgtgtcccagctgcatgacaatggcatcgacctggaggccaccaacggcatgaagctgcacttcagcaagaccctgctgaagaccaagctgtctgagaagtgcctgctgcaccagttctacctggccagcctgaagctgaccttcctgctgcggcctgagaccgtgtccatggtgatctacccagaatgtctgtgtgagagccctgtgtccatcgtgactggagagctgtgcacccaggacggcttcatggatgtggaggtgtacagctaccagacccagcctgccctggacctgggcaccctgcgggtgggcaacagcagctgccagcctgtgtttgaggcccagagccagggcctggtgcgcttccacatccccctgaatggctgcggcacccgctacaagtttgaagatgacaaggtggtgtatgaaaatgagatccacgccctgtggacagacttcccccccagcaagatcagccgggacagcgagttcaggatgacagtgaagtgcagctacagcagaaatgacatgctgctgaacatcaacgtggagagcctgaccccacctgtggcctctgtgaagctgggccccttcaccctcatcctgcagagctacccagacaacagctaccagcagccctatggagaaaatgagtaccccctggtgcgcttcctgcggcagcccatctacatggaggtgcgggtgctgaacagagatgaccccaacatcaagctggtgctggatgactgctgggccaccagcaccatggaccctgacagcttcccccagtggaatgtggtggtggatggctgtgcctatgacctggacaactaccagaccaccttccaccctgtgggcagctctgtgacccacccagaccactaccagagatttgacatgaaggcctttgcctttgtgtctgaggcccacgtgctgagcagcctggtgtacttccactgcagcgccctgatctgcaaccggctgagcccagacagccccctgtgcagcgtgacctgccctgtgagcagccgccacagaagagccaccggggccacagaagctgagaagatgacagtgtccctgcccggccccatcctgctgctgagtgatgacagcagcttccggggcgtgggcagcagtgacctgaaggccagcggcagcagtggagagaagagccgctcagaaacaggagaggaggtgggcagcagaggagccatggacaccaagggccacaagacagctggagatgtgggcagcaaggctgtggccgctgtggccgcctttgctggggtggtggccaccctgggcttcatctactacctgtatgagaagaggacagtgagcaaccactag

SEQ ID NO: 159164 - DNA, 1806 bp, Artificial Sequence
  Description of Artificial Sequence: Synthetic coding sequence
atggccaagacccccagcgaccacctgctgagcaccctggaggagctggtgccctatgactttgagaagttcaagttcaagctgcagaacacctctgtgcagaaggagcacagccgcatccccaggagccagatccagagggcccggcctgtgaagatggccaccctgctggtgacctactatggagaggagtatgctgtgcagctgaccctgcaggtgctgcgggccatcaaccagaggctgctggccgaggagctgcacagagctgccatccaggacatgggcagctgctacgtggcccaggtgggcctggagctgctgatcagcaacaacccccccatctttgccagcgagacagctggcatcaccggccggcccccagacacagctgccagcccccgctgccacgcccaggagggggaccctgtggatggcacctgtgtgcgggacagctgcagcttccctgaggccgtgtctggccacccccaggccagcggcagccgcagccctggctgcccccgctgccaggacagccatgagaggaagagccctggcagcctgagcccccagcccctgccccagtgcaagaggcacctgaagcaggtgcagctgctcttctgtgaggaccatgatgagcccatctgcctgatctgcagcctgagccaggagcaccagggccaccgggtgcggcccatcgaggaggtggccctggagcacaagaagaagatccagaagcagctggagcacctgaagaagctgaggaagagcggggaggagcagaggagctatggagaggagaaggctgtgtccttcctgaagcagacagaggccctgaagcagagggtgcagaggaagctggagcaggtgtactacttcctggagcagcaggagcacttctttgtggccagcctggaggatgtgggccagatggtgggccagatcaggaaggcctatgacaccagggtgtcccaggacatcgccctgctggatgccctgattggagagctggaggccaaggagtgccagagcgagtgggagctgctgcaggacattggagacatcctgcaccgggccaagacagtgcctgtgcctgagaagtggaccaccccccaggagatcaagcagaagatccagctgctgcaccagaagtcagaatttgtggagaagagcaccaagtacttcagcgagaccctgcggtctgagatggagatgttcaacgtgcctgagctgattggagcccaggcccatgctgtgaatgtcatcctggatgctgagacagcctaccccaacctgatcttcagtgatgacctgaagtctgtgcggctgggcaacaagtgggagcggctgcctgatggcccccagagatttgacagctgcatcatcgtgctgggcagccccagcttcctgagcggccgccgctactgggaggtggaggtgggggacaagacagcctggatcctgggcgcctgcaagaccagcatcagcaggaaaggaaacatgaccctgagcccagaaaatggctactgggtggtgatcatgatgaaggaaaatgagtaccaggccagctctgtgccccccacccggctgctgatcaaggagccccccaagagggtgggcatctttgtggactacagagtgggcagcatctccttctacaacgtgacagcccggagccacatctacacctttgccagctgcagcttcagcggccccctgcagcccatcttcagccctggcaccagagatggcggcaagaacacagcccccctgaccatctgccctgtgggcggccagggccctgactag

SEQ ID NO: 159165 - DNA, 1239 bp, Artificial Sequence
  Description of Artificial Sequence: Synthetic coding sequence
atggccaagacccccagcgaccacctgctgagcaccctggaggagctggtgccctatgactttgagaagttcaagttcaagctgcagaacacctctgtgcagaaggagcacagccgcatccccaggagccagatccagagggcccggcctgtgaagatggccaccctgctggtgacctactatggagaggagtatgctgtgcagctgaccctgcaggtgctgcgggccatcaaccagaggctgctggccgaggagctgcacagagctgccatccagggccggcccccagacacagctgccagcccccgctgccacgcccaggagggggaccctgtggatggcacctgtgtgcgggacagctgcagcttccctgaggccgtgtctggccacccccaggccagcggcagccgcagccctggctgcccccgctgccaggacagccatgagaggaagagccctggcagcctgagcccccagcccctgccccagtgcaagaggcacctgaagcaggtgcagctgctcttctgtgaagatcatgatgagcccatctgcctgatctgcagcctgagccaggagcaccagggccaccgggtgcggcccatcgaggaggtggccctggagcacaagaagaagatccagaagcagctggagcacctgaagaagctgaggaagtctggagaggagcagaggagctatggagaggagaaggctgtgtccttcctgaagcagacagaggccctgaagcagagggtgcagaggaagctggagcaggtgtactacttcctggagcagcaggagcacttctttgtggccagcctggaggatgtgggccagatggtgggccagatcaggaaggcctatgacaccagggtgtcccaggacatcgccctgctggatgccctgattggagagctggaggccaaggagtgccagagcgagtgggagctgctgcaggacatcggggacatcctgcaccgggccaagacagtgcctgtgcctgagaagtggaccaccccccaggagatcaagcagaagatccagctgctgcaccagaagtcagaatttgtggagaagagcaccaagtacttcagcgagaccctgcggtctgagatggagatgtttaatgaccacagcccccagcacggcctgggctcctgggaggagcgggactacacccagcacagcatgcagggccccaagcagggcgtgccctgcttcctggtggtgaggacagtgtag

SEQ ID NO: 159166 - DNA, 1713 bp, Artificial Sequence
  Description of Artificial Sequence: Synthetic coding sequence
atggccaagacccccagcgaccacctgctgagcaccctggaggagctggtgccctatgactttgagaagttcaagttcaagctgcagaacacctctgtgcagaaggagcacagccgcatccccaggagccagatccagagggcccggcctgtgaagatggccaccctgctggtgacctactatggagaggagtatgctgtgcagctgaccctgcaggtgctgcgggccatcaaccagaggctgctggccgaggagctgcacagagctgccatccagggccggcccccagacacagctgccagcccccgctgccacgcccaggagggggaccctgtggatggcacctgtgtgcgggacagctgcagcttccctgaggccgtgtctggccacccccaggccagcggcagccgcagccctggctgcccccgctgccaggacagccatgagaggaagagccctggcagcctgagcccccagcccctgccccagtgcaagaggcacctgaagcaggtgcagctgctcttctgtgaagatcatgatgagcccatctgcctgatctgcagcctgagccaggagcaccagggccaccgggtgcggcccatcgaggaggtggccctggagcacaagaagaagatccagaagcagctggagcacctgaagaagctgaggaagtctggagaggagcagaggagctatggagaggagaaggctgtgtccttcctgaagcagacagaggccctgaagcagagggtgcagaggaagctggagcaggtgtactacttcctggagcagcaggagcacttctttgtggccagcctggaggatgtgggccagatggtgggccagatcaggaaggcctatgacaccagggtgtcccaggacatcgccctgctggatgccctgattggagagctggaggccaaggagtgccagagcgagtgggagctgctgcaggacatcggggacatcctgcaccgggccaagacagtgcctgtgcctgagaagtggaccaccccccaggagatcaagcagaagatccagctgctgcaccagaagtcagaatttgtggagaagagcaccaagtacttcagcgagaccctgcggtctgagatggagatgtttaatgtgcctgagctgattggagcccaggcccatgctgtgaatgtcatcctggatgctgagacagcctaccccaacctgatcttcagtgatgacctgaagtctgtgcggctgggcaacaagtgggagcggctgcctgatggcccccagagatttgacagctgcatcatcgtgctgggcagccccagcttcctgtctggaagacgctactgggaggtggaggtgggggacaagacagcctggatcctgggcgcctgcaagaccagcatcagcaggaagggcaacatgaccctgagcccagaaaatggctactgggtggtgatcatgatgaaggaaaatgagtaccaggccagctctgtgccccccacccggctgctgatcaaggagccccccaagagggtgggcatctttgtggactacagagtgggcagcatctccttctacaacgtgacagcccggagccacatctacacctttgccagctgcagcttcagcggccccctgcagcccatcttcagccctggcaccagagatggcggcaagaacacagcccccctgaccatctgccctgtgggcggccagggccctgactag

SEQ ID NO: 159167 - DNA, 1209 bp, Artificial Sequence
  Description of Artificial Sequence: Synthetic coding sequence
atggccaagacccccagcgaccacctgctgagcaccctggaggagctggtgccctatgactttgagaagttcaagttcaagctgcagaacacctctgtgcagaaggagcacagccgcatccccaggagccagatccagagggcccggcctgtgaagatggccaccctgctggtgacctactatggagaggagtatgctgtgcagctgaccctgcaggtgctgcgggccatcaaccagaggctgctggccgaggagctgcacagagctgccatccagggccggcccccagacacagctgccagcccccgctgccacgcccaggagggggaccctgtggatggcacctgtgtgcgggacagctgcagcttccctgaggccgtgtctggccacccccaggccagcggcagccgcagccctggctgcccccgctgccaggacagccatgagaggaagagccctggcagcctgagcccccagcccctgccccagtgcaagaggcacctgaagcaggtgcagctgctcttctgtgaagatcatgatgagcccatctgcctgatctgcagcctgagccaggagcaccagggccaccgggtgcggcccatcgaggaggtggccctggagcacaagaagaagatccagaagcagctggagcacctgaagaagctgaggaagtctggagaggagcagaggagctatggagaggagaaggctgtgtccttcctgaagcagacagaggccctgaagcagagggtgcagaggaagctggagcaggtgtactacttcctggagcagcaggagcacttctttgtggccagcctggaggatgtgggccagatggtgggccagatcaggaaggcctatgacaccagggtgtcccaggacatcgccctgctggatgccctgattggagagctggaggccaaggagtgccagagcgagtgggagctgctgcaggacatcggggacatcctgcaccgggccaagacagtgcctgtgcctgagaagtggaccaccccccaggagatcaagcagaagatccagctgctgcaccagaagtcagaatttgtggagaagagcaccaagtacttcagcgagaccctgcggtctgagatggagatgtttaatggagagagcagtggaaatggagtgtgctggccaggagtggtggccgtgttcccctgtgctgtggacctgcggggccccatctag

SEQ ID NO: 159168 - DNA, 1338 bp, Artificial Sequence
  Description of Artificial Sequence: Synthetic coding sequence
atggccaagacccccagcgaccacctgctgagcaccctggaggagctggtgccctatgactttgagaagttcaagttcaagctgcagaacacctctgtgcagaaggagcacagccgcatccccaggagccagatccagagggcccggcctgtgaagatggccaccctgctggtgacctactatggagaggagtatgctgtgcagctgaccctgcaggtgctgcgggccatcaaccagaggctgctggccgaggagctgcacagagctgccatccagggccggcccccagacacagctgccagcccccgctgccacgcccaggagggggaccctgtggatggcacctgtgtgcgggacagctgcagcttccctgaggccgtgtctggccacccccaggccagcggcagccgcagccctggctgcccccgctgccaggacagccatgagaggaagagccctggcagcctgagcccccagcccctgccccagtgcaagaggcacctgaagcaggtgcagctgctcttctgtgaagatcatgatgagcccatctgcctgatctgcagcctgagccaggagcaccagggccaccgggtgcggcccatcgaggaggtggccctggagcacaagaagaagatccagaagcagctggagcacctgaagaagctgaggaagtctggagaggagcagaggagctatggagaggagaaggctgtgtccttcctgaagcagacagaggccctgaagcagagggtgcagaggaagctggagcaggtgtactacttcctggagcagcaggagcacttctttgtggccagcctggaggatgtgggccagatggtgggccagatcaggaaggcctatgacaccagggtgtcccaggacatcgccctgctggatgccctgattggagagctggaggccaaggagtgccagagcgagtgggagctgctgcaggacatcggggacatcctgcaccgggccaagacagtgcctgtgcctgagaagtggaccaccccccaggagatcaagcagaagatccagctgctgcaccagaagtcagaatttgtggagaagagcaccaagtacttcagcgagaccctgcggtctgagatggagatgtttaatgaccacagcccccagcacggcctgggctcctgggaggagcgggactacacccagcacagcatgcagggccccaagcagggcgtgccctgcctgagcctgctgagcggccagtgcaacctggcccccctgaatgccaatgcccaggacttcttcccctacctgatcttcctgcggagcagtggagctgactggaggagcggcacctgctgctag

SEQ ID NO: 159169 - DNA, 2067 bp, Artificial Sequence
  Description of Artificial Sequence: Synthetic coding sequence
atggccaagacccccagcgaccacctgctgagcaccctggaggagctggtgccctatgactttgagaagttcaagttcaagctgcagaacacctctgtgcagaaggagcacagccgcatccccaggagccagatccagagggcccggcctgtgaagatggccaccctgctggtgacctactatggagaggagtatgctgtgcagctgaccctgcaggtgctgcgggccatcaaccagaggctgctggccgaggagctgcacagagctgccatccaggagtacagcacccaggagaatggaacagatgacagcgctgccagcagcagcctgggggagaacaagcccaggagcctgaagaccccagaccaccctgagggcaatgaaggaaatggcccccggccctatggaggaggagctgccagcctgcgctgcagccagcctgaggccggccggggcctgagcaggaagcccctgagcaagagaagagagaaggccagcgagggcctggatgcccagggcaagcccaggaccaggagccctgccctgcccggcggccgcagccctggcccctgccgggccctggagggcggccaggccgaggtgcggctgcggagaaatgccagcagcgctggccgcctgcagggcctggccggcggggcccctggccagaaggaatgtcggccctttgaggtgtacctgcccagcggcaagatgaggcccaggagcctggaggtgaccatcagcactggagagaaggccccagccaaccctgagatcctgctgaccctggaggagaagacagctgccaacctggacagcgccacagagccccgggcccggcccaccccagatggaggagccagcgctgacctgaaggagggccctggcaaccctgagcacagcgtgacaggccggcccccagacacagctgccagcccccgctgccacgcccaggagggggaccctgtggatggcacctgtgtgcgggacagctgcagcttccctgaggccgtgtctggccacccccaggccagcggcagccgcagccctggctgcccccgctgccaggacagccatgagaggaagagccctggcagcctgagcccccagcccctgccccagtgcaagaggcacctgaagcaggtgcagctgctcttctgtgaggaccatgatgagcccatctgcctgatctgcagcctgagccaggagcaccagggccaccgggtgcggcccatcgaggaggtggccctggagcacaagaagaagatccagaagcagctggagcacctgaagaagctgaggaagagcggggaggagcagaggagctatggagaggagaaggctgtgtccttcctgaagcagacagaggccctgaagcagagggtgcagaggaagctggagcaggtgtactacttcctggagcagcaggagcacttctttgtggccagcctggaggatgtgggccagatggtgggccagatcaggaaggcctatgacaccagggtgtcccaggacatcgccctgctggatgccctgattggagagctggaggccaaggagtgccagagcgagtgggagctgctgcaggacattggagacatcctgcaccgggccaagacagtgcctgtgcctgagaagtggaccaccccccaggagatcaagcagaagatccagctgctgcaccagaagtcagaatttgtggagaagagcaccaagtacttcagcgagaccctgcggtctgagatggagatgttcaacgtgcctgagctgattggagcccaggcccatgctgtgaatgtcatcctggatgctgagacagcctaccccaacctgatcttcagtgatgacctgaagtctgtgcggctgggcaacaagtgggagcggctgcctgatggcccccagagatttgacagctgcatcatcgtgctgggcagccccagcttcctgagcggccgccgctactgggaggtggaggtgggggacaagcgcttcagctgcctgagcctgcggagctcctgggactaccgccggcccccaccctgcccagccaacttcctgcacttctag

SEQ ID NO: 159170 - DNA, 2796 bp, Artificial Sequence
  Description of Artificial Sequence: Synthetic coding sequence
atgccacccctgaagagccctgctgccttccacgagcagaggaggagcctggagcgggccaggacagaggactacctgaagaggaagatccgcagcaggcctgagaggtctgagctggtgaggatgcacatcctggaggagaccagcgctgagcccagcctgcaggccaagcagctgaagctgaagagggcccggctggctgatgacctgaatgagaagatcgcccagaggcctggccccatggagctggtggagaagaacatcctgcctgtggagagcagcctgaaggaggccatcatcgtgggccaggtgaactaccccaaggtggccgacagcagcagctttgatgaggacagcagtgatgccctgagccctgagcagcctgccagccatgagagccagggctctgtgcccagccccctggaggcccgggtgtctgagcccctgctgagcgccaccagcgccagccccacccaggtggtgtcccagctgcccatgggccgggacagccgggagatgctgttcctggccgagcagccccccctgcccccaccacccctgctgccccccagcctgaccaacggcaccaccatccccacagccaagagcacccccaccctcatcaagcagagccagcccaagagcgccagcgagaagagccagaggagcaagaaggccaaggagctgaagcccaaggtgaagaagctgaagtaccaccagtacatccccccagaccagaagcaggacagaggagccccacccatggacagcagctatgccaagatcctgcagcagcagcagctgttcctgcagctgcagatcctgaaccagcagcagcagcagcaccacaactaccaggccatcctgcctgccccacccaagtctgctggggaggccctgggcagcagcggcaccccacctgtgcgcagcctgagcaccaccaacagcagcagcagcagcggggcccctggcccctgtggcctggcccggcagaacagcaccagcctgaccgggaagccaggggccctgcctgccaacctggatgacatgaaggtggccgagctgaagcaggagctgaagctgcggagcctgcctgtgtctggcaccaagacagagctgattgaaaggctgcgggcctaccaggaccagatcagccctgtgcctggggcccccaaggccccagctgccaccagcatcctgcacaaggccggggaggtggtggtggccttccctgctgcccggctgagcactggacctgccctggtggccgccggcctggccccagctgaggtggtggtggccaccgtggccagcagtggagtggtgaagtttggcagcacaggcagcaccccacctgtgagccccacccccagcgagaggagcctgctgagcactggagatgagaacagcacccctggggacaccttcggggagatggtgaccagccccctgacccagctgaccctgcaggccagccccctgcagatcctggtgaaggaggagggccccagggctggcagctgctgcctgagccctgggggccgggcagagctggagggccgggacaaggaccagatgctgcaggagaaggacaagcagatcgaggccctgaccaggatgctgcggcagaagcagcagctggtggagcggctgaagctgcagctggagcaggagaagagggcccagcagcctgccccagccccagcccccctgggcacccctgtgaagcaggagaacagcttcagcagctgccagctgagccagcagcccctgggccctgcccaccccttcaaccccagcctggccgccccagccaccaaccacatcgacccctgtgctgtggcccctggcccccccagcgtggtggtgaagcaggaggccctgcagcctgagcctgagcctgtgcctgccccccagctgctgctgggcccccagggccccagcctcatcaagggcgtggccccacccaccctcatcacagacagcacaggcacccacctggtgctgactgtgaccaacaagaatgctgacagccctggcctgagcagcggcagcccccagcagcccagcagccagcccggcagccctgccccagcccccagcgcccagatggacctggagcaccccctgcagcccctgtttggcacccccaccagcctgctgaagaaggagcccccaggctatgaggaggccatgagccagcagcccaagcagcaggagaatggcagcagcagccagcagatggatgacctgtttgacatcctgatccagagcggggagatctctgctgacttcaaggagccccccagcctgcccgggaaggagaagcccagccccaagacagtgtgtggcagccccctggccgcccagcccagccccagcgctgagctgccccaggccgcccctcctcctcctggcagccccagcctgcccggccgcctggaggacttcctggagagcagcacaggcctgcccctgctgaccagcggccatgatggccctgagcccctgagcctgattgatgacctgcacagccagatgctgagcagcacagccatcctggaccacccccccagccccatggacaccagcgagctgcactttgtgcctgagcccagcagcaccatgggcctggacctggctgatggccacctggacagcatggactggctggagctgagcagcggcggccctgtgctgagcctggcccccctgagcaccacagcccccagcctcttcagcacagacttcctggatggccatgacctgcagctgcactgggacagctgcctgtag

SEQ ID NO: 159171 - DNA, 2397 bp, Artificial Sequence
  Description of Artificial Sequence: Synthetic coding sequence
atgccacccctgaagagccctgctgccttccacgagcagaggaggagcctggagcgggccaggacagaggactacctgaagaggaagatccgcagcaggcctgagaggtctgagctggtgaggatgcacatcctggaggagaccagcgctgagcccagcctgcaggccaagcagctgaagctgaagagggcccggctggctgatgacctgaatgagaagatcgcccagaggcctggccccatggagctggtggagaagaacatcctgcctgtggagagcagcctgaaggaggccatcatcgtgggccaggtgaactaccccaaggtggccgacagcagcagctttgatgaggacagcagtgatgccctgagccctgagcagcctgccagccatgagagccagggctctgtgcccagccccctggaggcccgggtgtctgagcccctgctgagcgccaccagcgccagccccacccaggtggtgtcccagctgcccatgggccgggacagccgggagatgctgttcctggccgagcagccccccctgcccccaccacccctgctgccccccagcctgaccaacggcaccaccatccccacagccaagagcacccccaccctcatcaagcagagccagcccaagagcgccagcgagaagagccagaggagcaagaaggccaaggagctgaagcccaaggtgaagaagctgaagtaccaccagtacatccccccagaccagaagcaggacagaggagccccacccatggacagcagctatgccaagatcctgcagcagcagcagctgttcctgcagctgcagatcctgaaccagcagcagcagcagcaccacaactaccaggccatcctgcctgccccacccaagtctgctggggaggccctgggcagcagcggcaccccacctgtgcgcagcctgagcaccaccaacagcagcagcagcagcggggcccctggcccctgtggcctggcccggcagaacagcaccagcctgaccgggaagccaggggccctgcctgccaacctggatgacatgaaggtggccgagctgaagcaggagctgaagctgcggagcctgcctgtgtctggcaccaagacagagctgattgaaaggctgcgggcctaccaggaccagatcagccctgtgcctggggcccccaaggccccagctgccaccagcatcctgcacaaggccggggaggtggtggtggccttccctgctgcccggctgagcactggacctgccctggtggccgccggcctggccccagctgaggtggtggtggccaccgtggccagcagtggagtggtgaagtttggcagcacaggcagcaccccacctgtgagccccacccccagcgagaggagcctgctgagcactggagatgagaacagcacccctggggacaccttcggggagatggtgaccagccccctgacccagctgaccctgcaggccagccccctgcagatcctggtgaaggaggagggccccagggctggcagctgctgcctgagccctgggggccgggcagagctggagggccgggacaaggaccagatgctgcaggagaaggacaagcagatcgaggccctgaccaggatgctgcggcagaagcagcagctggtggagcggctgaagctgcagctggagcaggagaagagggcccagcagcctgccccagccccagcccccctgggcacccctgtgaagcaggagaacagcttcagcagctgccagctgagccagcagcccctgggccctgcccaccccttcaaccccagcctggccgccccagccaccaaccacatcgacccctgtgctgtggcccctggcccccccagcgtggtggtgaagcaggaggccctgcagcctgagcctgagcctgtgcctgccccccagctgctgctgggcccccagggccccagcctcatcaagggcgtggccccacccaccctcatcacagacagcacaggcacccacctggtgctgactgtgaccaacaagaatgctgacagccctggcctgagcagcggcagcccccagcagcccagcagccagcccggcagccctgccccagcccccagcgcccagatggacctggagcaccccctgcagcccctgtttggcacccccaccagcctgctgaagaaggagcccccaggctatgaggaggccatgagccagcagcccaagcagcaggagaatggcagcagcagccagcagatggatgacctgtttgacatcctgatccagagcggcggcaaccccaggaacttcagccgcttccagggcgccgccatcccagcccgggagggggaggccatccctgaggacagcctgtgggtgcccccaggcagcacagccatcaccttctgctag

SEQ ID NO: 159172 - DNA, 2646 bp, Artificial Sequence
  Description of Artificial Sequence: Synthetic coding sequence
atgccacccctgaagagccctgctgccttccacgagcagaggaggagcctggagcgggccaggacagaggactacctgaagaggaagatccgcagcaggcctgagaggtctgagctggtgaggatgcacatcctggaggagaccagcgctgagcccagcctgcaggccaagcagctgaagctgaagagggcccggctggctgatgacctgaatgagaagatcgcccagaggcctggccccatggagctggtggagaagaacatcctgcctgtggagagcagcctgaaggaggccatcatcgtgggccaggtgaactaccccaaggtggccgacagcagcagctttgatgaggacagcagtgatgccctgagccctgagcagcctgccagccatgagagccagggctctgtgcccagccccctggaggcccgggtgtctgagcccctgctgagcgccaccagcgccagccccacccagcagagccagcccaagagcgccagcgagaagagccagaggagcaagaaggccaaggagctgaagcccaaggtgaagaagctgaagtaccaccagtacatccccccagaccagaagcaggacagaggagccccacccatggacagcagctatgccaagatcctgcagcagcagcagctgttcctgcagctgcagatcctgaaccagcagcagcagcagcaccacaactaccaggccatcctgcctgccccacccaagtctgctggggaggccctgggcagcagcggcaccccacctgtgcgcagcctgagcaccaccaacagcagcagcagcagcggggcccctggcccctgtggcctggcccggcagaacagcaccagcctgaccgggaagccaggggccctgcctgccaacctggatgacatgaaggtggccgagctgaagcaggagctgaagctgcggagcctgcctgtgtctggcaccaagacagagctgattgaaaggctgcgggcctaccaggaccagatcagccctgtgcctggggcccccaaggccccagctgccaccagcatcctgcacaaggccggggaggtggtggtggccttccctgctgcccggctgagcactggacctgccctggtggccgccggcctggccccagctgaggtggtggtggccaccgtggccagcagtggagtggtgaagtttggcagcacaggcagcaccccacctgtgagccccacccccagcgagaggagcctgctgagcactggagatgagaacagcacccctggggacaccttcggggagatggtgaccagccccctgacccagctgaccctgcaggccagccccctgcagatcctggtgaaggaggagggccccagggctggcagctgctgcctgagccctgggggccgggcagagctggagggccgggacaaggaccagatgctgcaggagaaggacaagcagatcgaggccctgaccaggatgctgcggcagaagcagcagctggtggagcggctgaagctgcagctggagcaggagaagagggcccagcagcctgccccagccccagcccccctgggcacccctgtgaagcaggagaacagcttcagcagctgccagctgagccagcagcccctgggccctgcccaccccttcaaccccagcctggccgccccagccaccaaccacatcgacccctgtgctgtggcccctggcccccccagcgtggtggtgaagcaggaggccctgcagcctgagcctgagcctgtgcctgccccccagctgctgctgggcccccagggccccagcctcatcaagggcgtggccccacccaccctcatcacagacagcacaggcacccacctggtgctgactgtgaccaacaagaatgctgacagccctggcctgagcagcggcagcccccagcagcccagcagccagcccggcagccctgccccagcccccagcgcccagatggacctggagcaccccctgcagcccctgtttggcacccccaccagcctgctgaagaaggagcccccaggctatgaggaggccatgagccagcagcccaagcagcaggagaatggcagcagcagccagcagatggatgacctgtttgacatcctgatccagagcggggagatctctgctgacttcaaggagccccccagcctgcccgggaaggagaagcccagccccaagacagtgtgtggcagccccctggccgcccagcccagccccagcgctgagctgccccaggccgcccctcctcctcctggcagccccagcctgcccggccgcctggaggacttcctggagagcagcacaggcctgcccctgctgaccagcggccatgatggccctgagcccctgagcctgattgatgacctgcacagccagatgctgagcagcacagccatcctggaccacccccccagccccatggacaccagcgagctgcactttgtgcctgagcccagcagcaccatgggcctggacctggctgatggccacctggacagcatggactggctggagctgagcagcggcggccctgtgctgagcctggcccccctgagcaccacagcccccagcctcttcagcacagacttcctggatggccatgacctgcagctgcactgggacagctgcctgtag

SEQ ID NO: 159173 - DNA, 2796 bp, Artificial Sequence; identical to SEQ ID NO: 159170
  Description of Artificial Sequence: Synthetic coding sequence

SEQ ID NO: 159174 - DNA, 258 bp, Artificial Sequence
  Description of Artificial Sequence: Synthetic coding sequence
atgctgagcagcacagccatcctggaccacccccccagccccatggacaccagcgagctgcactttgtgcctgagcccagcagcaccatgggcctggacctggctgatggccacctggacagcatggactggctggagctgagcagcggcggccctgtgctgagcctggcccccctgagcaccacagcccccagcctcttcagcacagacttcctggatggccatgacctgcagctgcactgggacagctgcctgtag

SEQ ID NO: 159175 - DNA, 1524 bp, Artificial Sequence
  Description of Artificial Sequence: Synthetic coding sequence
atggccggccggggcagcctggtgtcctggagggccttccacggctgtgacagcgctgaggagctgccccgggtgagcccccgcttcctgcgggcctggcaccccccacctgtgtctgccaggatgcccacccggcgctgggcccctggcacccagtgcatcaccaagtgtgagcacacccggcccaagccaggagagctggccttcagaaaaggagatgtggtgaccatcctggaggcctgtgagaacaagtcctggtacagagtgaagcaccacaccagcggccaggagggcctgctggccgccggggccctgcgggagcgggaggccctgtctgctgaccccaagctgagcctgatgccctggttccacggcaagatcagcggccaggaggccgtgcagcagctgcagcccccagaagatggcctcttcctggtgcgggagagcgcccggcaccctggggactatgtgctgtgtgtgtcctttggaagagatgtgatccactacagagtgctgcacagagatggccacctgaccattgatgaagctgtgttcttctgcaacctgatggacatggtggagcactacagcaaggacaagggggccatctgcaccaagctggtgcggcccaagaggaagcacggcaccaagtctgctgaggaggagctggcccgggccggctggctgctgaacctgcagcacctgaccctgggcgcccagattggagagggggagtttggagctgtgctgcagggcgagtacctgggccagaaggtggccgtgaagaacatcaagtgtgatgtgacagcccaggccttcctggatgaaacagctgtgatgaccaagatgcagcacgagaacctggtgcggctgctgggcgtcatcctgcaccagggcctgtacatcgtgatggagcacgtgtccaaaggaaacctggtgaacttcctgcggacccggggccgggccctggtgaacacagcccagctgctgcagttcagcctgcacgtggccgagggcatggagtacctggagagcaagaagctggtgcaccgggacctggccgccaggaacatcctggtgtctgaggacctggtggccaaggtgtctgactttggcctggccaaggccgagaggaagggcctggacagcagccggctgcctgtgaagtggacagcccctgaggccctgaagcacggcaagttcaccagcaagagtgatgtgtggagctttggagtgctgctgtgggaggtgttctcctatggccgggccccctaccccaagatgagcctgaaggaggtgtctgaggccgtggagaagggctacaggatggagcccccagagggctgccccggccctgtgcacgtgctgatgagcagctgctgggaggccgagcccgcccggcggccccccttcaggaagctggccgagaagctggcccgggagctgcggtctgctggggccccagcctctgtgtctggccaggatgctgatggcagcaccagccccaggagccaggagccctag

SEQ ID NO: 159176 - DNA, 1401 bp, Artificial Sequence
  Description of Artificial Sequence: Synthetic coding sequence
atgcccacccggcgctgggcccctggcacccagtgcatcaccaagtgtgagcacacccggcccaagccaggagagctggccttcagaaaaggagatgtggtgaccatcctggaggcctgtgagaacaagtcctggtacagagtgaagcaccacaccagcggccaggagggcctgctggccgccggggccctgcgggagcgggaggccctgtctgctgaccccaagctgagcctgatgccctggttccacggcaagatcagcggccaggaggccgtgcagcagctgcagcccccagaagatggcctcttcctggtgcgggagagcgcccggcaccctggggactatgtgctgtgtgtgtcctttggaagagatgtgatccactacagagtgctgcacagagatggccacctgaccattgatgaggccgtgttcttctgcaacctgatggacatggtggagcactacagcaaggacaagggggccatctgcaccaagctggtgcggcccaagaggaagcacggcaccaagtctgctgaggaggagctggcccgggccggctggctgctgaacctgcagcacctgaccctgggcgcccagatcggggagggggagtttggagctgtgctgcagggcgagtacctgggccagaaggtggccgtgaagaacatcaagtgtgatgtgacagcccaggccttcctggatgaaacagctgtgatgaccaagatgcagcacgagaacctggtgcggctgctgggcgtcatcctgcaccagggcctgtacatcgtgatggagcacgtgtccaagggcaacctggtgaacttcctgcggacccggggccgggccctggtgaacacagcccagctgctgcagttcagcctgcacgtggccgagggcatggagtacctggagagcaagaagctggtgcaccgggacctggccgccaggaacatcctggtgtctgaggacctggtggccaaggtgtctgactttggcctggccaaggccgagaggaagggcctggacagcagccggctgcctgtgaagtggacagcccctgaggccctgaagcacggcaagttcaccagcaagagtgatgtgtggagctttggagtgctgctgtgggaggtgttctcctatggccgggccccctaccccaagatgagcctgaaggaggtgtctgaggccgtggagaagggctacaggatggagcccccagagggctgccccggccctgtgcacgtgctgatgagcagctgctgggaggccgagcccgcccggcggccccccttcaggaagctggccgagaagctggcccgggagctgcggtctgctggggccccagcctctgtgtctggccaggatgctgatggcagcaccagccccaggagccaggagccctag

SEQ ID NO: 159177 - DNA, 1527 bp, Artificial Sequence
  Description of Artificial Sequence: Synthetic coding sequence
atgcagggccacttccctgctgagcggcgggagggccggccccggcggggcacccggggccagcagcagctgctggtgagcccccgcttcctgcgggcctggcaccccccacctgtgtctgccaggatgcccacccggcgctgggcccctggcacccagtgcatcaccaagtgtgagcacacccggcccaagccaggagagctggccttcagaaaaggagatgtggtgaccatcctggaggcctgtgagaacaagtcctggtacagagtgaagcaccacaccagcggccaggagggcctgctggccgccggggccctgcgggagcgggaggccctgtctgctgaccccaagctgagcctgatgccctggttccacggcaagatcagcggccaggaggccgtgcagcagctgcagcccccagaagatggcctcttcctggtgcgggagagcgcccggcaccctggggactatgtgctgtgtgtgtcctttggaagagatgtgatccactacagagtgctgcacagagatggccacctgaccattgatgaggccgtgttcttctgcaacctgatggacatggtggagcactacagcaaggacaagggggccatctgcaccaagctggtgcggcccaagaggaagcacggcaccaagtctgctgaggaggagctggcccgggccggctggctgctgaacctgcagcacctgaccctgggcgcccagatcggggagggggagtttggagctgtgctgcagggcgagtacctgggccagaaggtggccgtgaagaacatcaagtgtgatgtgacagcccaggccttcctggatgaaacagctgtgatgaccaagatgcagcacgagaacctggtgcggctgctgggcgtcatcctgcaccagggcctgtacatcgtgatggagcacgtgtccaagggcaacctggtgaacttcctgcggacccggggccgggccctggtgaacacagcccagctgctgcagttcagcctgcacgtggccgagggcatggagtacctggagagcaagaagctggtgcaccgggacctggccgccaggaacatcctggtgtctgaggacctggtggccaaggtgtctgactttggcctggccaaggccgagaggaagggcctggacagcagccggctgcctgtgaagtggacagcccctgaggccctgaagcacggcaagttcaccagcaagagtgatgtgtggagctttggagtgctgctgtgggaggtgttctcctatggccgggccccctaccccaagatgagcctgaaggaggtgtctgaggccgtggagaagggctacaggatggagcccccagagggctgccccggccctgtgcacgtgctgatgagcagctgctgggaggccgagcccgcccggcggccccccttcaggaagctggccgagaagctggcccgggagctgcggtctgctggggccccagcctctgtgtctggccaggatgctgatggcagcaccagccccaggagccaggagccctag

SEQ ID NO: 159178 - DNA, 1134 bp, Artificial Sequence
  Description of Artificial Sequence: Synthetic coding sequence
atgacccaggagcccttccgggaggagctggcctatgacaggatgcccaccctggagcggggccggcaggaccctgccagctatgccccagatgccaagcccagcgacctgcagctgagcaagaggctgcccccctgcttcagccacaagacctgggtgttttctgtgctgatgggcagctgcctgctggtgaccagcggcttcagcctgtacctgggcaatgtgtttcctgctgagatggactacctgcgctgtgccgccggcagctgcatccccagcgccatcgtgtccttcaccgtgtccagaagaaatgccaacgtcatccccaacttccagatcctgtttgtgtccacctttgctgtgaccaccacctgcctgatctggtttggctgcaagctggtgctgaaccccagcgccatcaacatcaacttcaacctgatcctgctgctgctgctggagctgctgatggccgccaccgtcatcatcgccgcccggagcagcgaggaggactgcaagaagaagaagggctccatgtctgattctgccaacatcctggatgaggtgcccttccctgcccgggtgctgaagagctacagcgtggtggaggtgattgctggcatctctgctgtgctgggcggcatcatcgccctgaatgtggatgacagcgtgtctggcccccacctgtctgtgaccttcttctggatcctggtggcctgcttccccagcgccatcgccagccacgtggccgcagaatgtcccagcaagtgcctggtggaggtgctgattgccatcagcagcctgaccagccccctgctcttcaccgccagcggctacctgtccttcagcatcatgagaattgtggagatgttcaaggactaccccccagccatcaagcccagctatgatgtgctgctgctgctgctgctgctggtgctgctgctgcaggccggcctgaacacaggaacagccatccagtgtgtgcgcttcaaggtgtctgcccggctgcagggcgcctcctgggacacccagaatggcccccaggagcggctggccggggaggtggcccggagccccctgaaggagtttgacaaggagaaggcctggagggctgtggtggtgcagatggcccagtag

SEQ ID NO: 159179 - DNA, 1134 bp, Artificial Sequence; identical to SEQ ID NO: 159178
  Description of Artificial Sequence: Synthetic coding sequence

SEQ ID NO: 159180 - DNA, 1044 bp, Artificial Sequence
  Description of Artificial Sequence: Synthetic coding sequence
atgacccaggagcccttccgggaggagctggcctatgacaggatgcccaccctggagcggggccggcaggaccctgccagctatgccccagatgccaagcccagcgacctgcagctgagcaagaggctgcccccctgcttcagccacaagacctgggtgttttctgtgctgatgggctgcatccccagcgccatcgtgtccttcaccgtgtccagaagaaatgccaacgtcatccccaacttccagatcctgtttgtgtccacctttgctgtgaccaccacctgcctgatctggtttggctgcaagctggtgctgaaccccagcgccatcaacatcaacttcaacctgatcctgctgctgctgctggagctgctgatggccgccaccgtcatcatcgccgcccggagcagcgaggaggactgcaagaagaagaagggctccatgtctgattctgccaacatcctggatgaggtgcccttccctgcccgggtgctgaagagctacagcgtggtggaggtgattgctggcatctctgctgtgctgggcggcatcatcgccctgaatgtggatgacagcgtgtctggcccccacctgtctgtgaccttcttctggatcctggtggcctgcttccccagcgccatcgccagccacgtggccgcagaatgtcccagcaagtgcctggtggaggtgctgattgccatcagcagcctgaccagccccctgctcttcaccgccagcggctacctgtccttcagcatcatgagaattgtggagatgttcaaggactaccccccagccatcaagcccagctatgatgtgctgctgctgctgctgctgctggtgctgctgctgcaggccggcctgaacacaggaacagccatccagtgtgtgcgcttcaaggtgtctgcccggctgcagggcgcctcctgggacacccagaatggcccccaggagcggctggccggggaggtggcccggagccccctgaaggagtttgacaaggagaaggcctggagggctgtggtggtgcagatggcccagtag

SEQ ID NO: 159181 - DNA, 672 bp, Artificial Sequence
  Description of Artificial Sequence: Synthetic coding sequence
atgacccaggagcccttccgggaggagctggcctatgacaggatgcccaccctggagcggggccggcaggaccctgccagctatgccccagatgccaagcccagcgacctgcagctgagcaagaggctgcccccctgcttcagccacaagacctgggtgttttctgtgctgatgggctgcatccccagcgccatcgtgtccttcaccgtgtccagaagaaatgccaacgtcatccccaacttccagatcctgtttgtgtccacctttgctgtgaccaccacctgcctgatctggtttggctgcaagctggtgctgaaccccagcgccatcaacatcaacttcaacctgatcctgctgctgctgctggagctgctgatggccgccaccgtcatcatcgccgcccggagcagcgaggaggactgcaagaagaagaagggctccatgtctgattctgccaacatcctggatgaggtgcccttccctgcccgggtgctgaagagctacagcgtggtggaggtgattgctggcatctctgctgtgctgggcggcatcatcgccctgaatgtggatgacagcgtgtctggcccccacctgtctgtgaccttcttctggatcctggtggcctgcttccccagcgccatcgccagccacgtggccgcagaatgtccctag

SEQ ID NO: 159182 - DNA, 978 bp, Artificial Sequence
  Description of Artificial Sequence: Synthetic coding sequence
atgacccaggagcccttccgggaggagctggcctatgacaggatgcccaccctggagcggggccggcaggaccctgccagctatgccccagatgccaagcccagcgacctgcagctgagcaagaggctgcccccctgcttcagccacaagacctgggtgttttctgtgctgatgggcagctgcctgctggtgaccagcggcttcagcctgtacctgggcaatgtgtttcctgctgagatggactacctgcgctgtgccgccggcagcatcaacttcaacctgatcctgctgctgctgctggagctgctgatggccgccaccgtcatcatcgccgcccggagcagcgaggaggactgcaagaagaagaagggctccatgtctgattctgccaacatcctggatgaggtgcccttccctgcccgggtgctgaagagctacagcgtggtggaggtgattgctggcatctctgctgtgctgggcggcatcatcgccctgaatgtggatgacagcgtgtctggcccccacctgtctgtgaccttcttctggatcctggtggcctgcttccccagcgccatcgccagccacgtggccgcagaatgtcccagcaagtgcctggtggaggtgctgattgccatcagcagcctgaccagccccctgctcttcaccgccagcggctacctgtccttcagcatcatgagaattgtggagatgttcaaggactaccccccagccatcaagcccagctatgatgtgctgctgctgctgctgctgctggtgctgctgctgcaggccggcctgaacacaggaacagccatccagtgtgtgcgcttcaaggtgtctgcccggctgcagggcgcctcctgggacacccagaatggcccccaggagcggctggccggggaggtggcccggagccccctgaaggagtttgacaaggagaaggcctggagggctgtggtggtgcagatggcccagtag

SEQ ID NO: 159183 - DNA, 897 bp, Artificial Sequence
  Description of Artificial Sequence: Synthetic coding sequence
atggactacctgcgctgtgccgccggcagctgcatccccagcgccatcgtgtccttcaccgtgtccagaagaaatgccaacgtcatccccaacttccagatcctgtttgtgtccacctttgctgtgaccaccacctgcctgatctggtttggctgcaagctggtgctgaaccccagcgccatcaacatcaacttcaacctgatcctgctgctgctgctggagctgctgatggccgccaccgtcatcatcgccgcccggagcagcgaggaggactgcaagaagaagaagggctccatgtctgacagcgccaacatcctggatgaggtgcccttccctgcccgggtgctgaagagctacagcgtggtggaggtgattgctggcatctctgctgtgctgggcggcatcatcgccctgaatgtggatgattctgtgtctggcccccacctgtctgtgaccttcttctggatcctggtggcctgcttccccagcgccatcgccagccacgtggccgctgagtgccccagcaagtgcctggtggaggtgctgattgccatcagcagcctgaccagccccctgctcttcaccgccagcggctacctgtccttcagcatcatgagaattgtggagatgttcaaggactaccccccagccatcaagcccagctatgatgtgctgctgctgctgctgctgctggtgctgctgctgcaggccggcctgaacacaggaacagccatccagtgtgtgcgcttcaaggtgtctgcccggctgcagggcgcctcctgggacacccagaatggcccccaggagcggctggccggggaggtggcccggagccccctgaaggagtttgacaaggagaaggcctggagggctgtggtggtgcagatggcccagtag

SEQ ID NO: 159184 - DNA, 1032 bp, Artificial Sequence
  Description of Artificial Sequence: Synthetic coding sequence
atgacccaggagcccttccgggaggagctggcctatgacaggatgcccaccctggagcggggccggcaggaccctgccagctatgccccagatgccaagcccagcgacctgcagctgagcaagaggctgcccccctgcttcagccacaagacctgggtgttttctgtgctgatgggcagctgcctgctggtgaccagcggcttcagcctgtacctgggcaatgtgtttcctgctgagatggactacctgcgctgtgccgccggcagctgcatccccagcgccatcgtgtccttcaccgtgtccagaagaaatgccaacgtcatcaacttcaacctgatcctgctgctgctgctggagctgctgatggccgccaccgtcatcatcgccgcccggagcagcgaggaggactgcaagaagaagaagggctccatgtctgattctgccaacatcctggatgaggtgcccttccctgcccgggtgctgaagagctacagcgtggtggaggtgattgctggcatctctgctgtgctgggcggcatcatcgccctgaatgtggatgacagcgtgtctggcccccacctgtctgtgaccttcttctggatcctggtggcctgcttccccagcgccatcgccagccacgtggccgcagaatgtcccagcaagtgcctggtggaggtgctgattgccatcagcagcctgaccagccccctgctcttcaccgccagcggctacctgtccttcagcatcatgagaattgtggagatgttcaaggactaccccccagccatcaagcccagctatgatgtgctgctgctgctgctgctgctggtgctgctgctgcaggccggcctgaacacaggaacagccatccagtgtgtgcgcttcaaggtgtctgcccggctgcagggcgcctcctgggacacccagaatggcccccaggagcggctggccggggaggtggcccggagccccctgaaggagtttgacaaggagaaggcctggagggctgtggtggtgcagatggcccagtag

SEQ ID NO: 159185 - DNA, 267 bp, Artificial Sequence
  Description of Artificial Sequence: Synthetic coding sequence
atggccagcagtgatgtgaagcccaagtctgtgtcccatgccaagaagtggagcgaggagattgagaacctgtaccgcttccagcaggccggctacagagatgaaacagagtaccggcaggtgaagcaggtgtccatggtggaccgctggccagagaccggctacgtgaagaagctgcagaggcgggacaacaccttctactactacaacaagcagcgggagtgtgatgacaaggaggtgcacaaggtgaagatctatgcctactag

SEQ ID NO: 159186 - DNA, 267 bp, Artificial Sequence; identical to SEQ ID NO: 159185
  Description of Artificial Sequence: Synthetic coding sequence

SEQ ID NO: 159187 - DNA, 1488 bp, Artificial Sequence
  Description of Artificial Sequence: Synthetic coding sequence
atgggcagcaagagaagaaacctgagctgcagcgagcggcaccagaagctggtggatgagaactactgcaagaagctgcacgtgcaggccctgaagaatgtgaacagccagatccggaaccagatggtgcagaatgaaaatgacaacagagtgcagaggaagcagttcctgcggctgctgcagaatgagcagtttgagctggacatggaggaggccatccagaaggccgaggagaacaagaggctgaaggagctgcagctgaagcaggaggagaagctggccatggagctggccaagctgaagcatgagagcctgaaggatgagaagatgaggcagcaggtgcgggagaacagcattgagctgcgggagctggagaagaagctgaaggccgcctacatgaacaaggagcgggccgcccagattgctgagaaggatgccatcaagtatgagcagatgaagagagatgctgagatcgccaagaccatgatggaggagcacaagaggatcatcaaggaggagaatgctgctgaggacaagaggaacaaggccaaggcccagtactacctggacctggagaagcagctggaggagcaggagaagaagaagcaggaggcctatgagcagctgctgaaggagaagctgatgattgatgaaattgtgaggaagatctatgaggaggaccagctggagaagcagcagaagctggagaagatgaatgccatgaggcgctacatcgaggagttccagaaggagcaggccctgtggaggaagaagaagcgggaggagatggaggaggagaacaggaagatcattgaatttgccaacatgcagcagcagcgggaggaggacaggatggccaaggtgcaggagaatgaggagaagaggctgcagctgcagaatgccctgacccagaagctggaggagatgctgcggcagcgggaggacctggagcaggtgcggcaggagctgtaccaggaggagcaggccgagatctacaagagcaagctgaaggaggaggccgagaagaagctgaggaagcagaaggagatgaagcaggactttgaggagcagatggccctgaaggagctggtgctgcaggccgccaaggaggaggaggagaacttcaggaagaccatgctggccaagtttgctgaagatgacagaattgagctgatgaatgcccagaagcagaggatgaagcagctggagcacagaagagctgtggagaagctgattgaggagcggcggcagcagttcctggccgacaagcagcgggagctggaggagtggcagctgcagcagaggcggcagggcttcatcaatgccatcatcgaggaggagcggctgaagctgctgaaggagcacgccaccaacctgctgggctacctgcccaagggcgtcttcaagaaggaggatgacatcgacctgctgggggaggagttcaggaaggtgtaccagcagaggtctgagatctgtgaggagaagtag

SEQ ID NO: 159188 - DNA, 1173 bp, Artificial Sequence
  Description of Artificial Sequence: Synthetic coding sequence
atggcccagagatatgatgacctgccccactatggaggcatggatggagtgggcatccccagcaccatgtacggggacccccatgctgcccgctccatgcagcctgtgcaccacctgaaccacggcccccccctgcacagccaccagtacccccacacagcccacaccaatgccatggcccccagcatgggcagctctgtgaatgatgccctgaagagggacaaggatgccatctacggccaccccctcttccccctgctggccctgatctttgagaagtgtgagctggccacctgcaccccccgggagcccggggtggccggaggagatgtgtgcagcagcgagagcttcaatgaagatattgctgtgtttgccaagcagatccgggcagagaagcccctcttcagcagcaaccctgagctggacaacctgatgatccaggccatccaggtgctgcgcttccacctgctggagctggagaaggtgcatgagctgtgtgacaacttctgccaccgctacatcagctgcctgaagggcaagatgcccatcgacctggtgattgatgaccgggagggcggcagcaagagtgacagcgaggacatcaccaggtctgccaacctgacagaccagcccagctggaacagagaccatgatgacacagccagcaccaggtctgggggcaccccaggccccagcagcggcggccacaccagccacagcggggacaacagcagcgagcagggagatggcctggacaacagcgtggccagccccagcactggagatgatgatgatcctgacaaggacaagaagaggcacaagaagaggggcatcttccccaaggtggccaccaacatcatgagggcctggctgttccagcacctgacccacccctaccccagcgaggagcagaagaagcagctggcccaggacaccggcctgaccatcctgcaggtgaacaactggttcatcaatgcccggcggcgcatcgtgcagcccatgattgaccagagcaacagagctgtgtcccagggcaccccctacaacccagatggccagcccatgggcggctttgtgatggatggccagcagcacatgggcatccgggcccctggccccatgagcggcatgggcatgaacatgggcatggagggccagtggcactacatgtag

SEQ ID NO: 159189 - DNA, 1392 bp, Artificial Sequence
  Description of Artificial Sequence: Synthetic coding sequence
atgcagtatgatgacctgccccactatggaggcatggatggagtgggcatccccagcaccatgtacggggacccccatgctgcccgctccatgcagcctgtgcaccacctgaaccacggcccccccctgcacagccaccagtacccccacacagcccacaccaatgccatggcccccagcatgggcagctctgtgaatgatgccctgaagagggacaaggatgccatctacggccaccccctcttccccctgctggccctgatctttgagaagtgtgagctggccacctgcaccccccgggagcccggggtggccggaggagatgtgtgcagcagcgagagcttcaatgaagatattgctgtgtttgccaagcagatccgggcagagaagcccctcttcagcagcaaccctgagctggacaacctgatgatccaggccatccaggtgctgcgcttccacctgctggagctggagaaggtgcatgagctgtgtgacaacttctgccaccgctacatcagctgcctgaagggcaagatgcccatcgacctggtgattgatgaccgggagggcggcagcaagagtgacagcgaggacatcaccaggtctgccaacctgacagaccagcccagctggaacagagaccatgatgacacagccagcaccaggtctgggggcaccccaggccccagcagcggcggccacaccagccacagcggggacaacagcagcgagcagggagatggcctggacaacagcgtggccagccccagcactggagatgatgatgatcctgacaaggacaagaagaggcacaagaagaggggcatcttccccaaggtggccaccaacatcatgagggcctggctgttccagcacctgacccacccctaccccagcgaggagcagaagaagcagctggcccaggacaccggcctgaccatcctgcaggtgaacaactggttcatcaatgcccggcggcgcatcgtgcagcccatgattgaccagagcaacagagctgtgtcccagggcaccccctacaacccagatggccagcccatgggcggctttgtgatggatggccagcagcacatgggcatccgggcccctggcctgcagagcatgcctggagaatatgtggcccggggcggccccatgggcgtgtccatgggccagcccagctacacccagccccagatgccaccccacccagcccagctgcggcacggcccccccatgcacacctacatccctggccacccccaccaccccaccgtgatgatgcacggcggccccccccaccctggcatgcccatgtctgccagcagccccaccgtgctgaacacaggagaccccaccatgagcggccaggtgatggacatccacgcccagtag

SEQ ID NO: 159190 - DNA, 762 bp, Artificial Sequence
  Description of Artificial Sequence: Synthetic coding sequence
atgatccaggccatccaggtgctgcgcttccacctgctggagctggagaaggtgcatgagctgtgtgacaacttctgccaccgctacatcagctgcctgaagggcaagatgcccatcgacctggtgattgatgaccgggagggcggcagcaagagtgacagcgaggacatcaccaggtctgccaacctgacagaccagcccagctggaacagagaccatgatgacacagccagcaccaggtctgggggcaccccaggccccagcagcggcggccacaccagccacagcggggacaacagcagcgagcagggagatggcctggacaacagcgtggccagccccagcactggagatgatgatgatcctgacaaggacaagaagaggcacaagaagaggggcatcttccccaaggtggccaccaacatcatgagggcctggctgttccagcacctgacccacccctaccccagcgaggagcagaagaagcagctggcccaggacaccggcctgaccatcctgcaggtgaacaactggttcatcaatgcccggcggcgcatcgtgcagcccatgattgaccagagcaacagagctgtgtcccagggcaccccctacaacccagatggccagcccatgggcggctttgtgatggatggccagcagcacatgggcatccgggcccctggccccatgagcggcatgggcatgaacatgggccccccctgcatccgcaccttcctggacaccctgaccacccagcagtag

SEQ ID NO: 159191 - DNA, 1398 bp, Artificial Sequence
  Description of Artificial Sequence: Synthetic coding sequence
atggcccagagatatgatgacctgccccactatggaggcatggatggagtgggcatccccagcaccatgtacggggacccccatgctgcccgctccatgcagcctgtgcaccacctgaaccacggcccccccctgcacagccaccagtacccccacacagcccacaccaatgccatggcccccagcatgggcagctctgtgaatgatgccctgaagagggacaaggatgccatctacggccaccccctcttccccctgctggccctgatctttgagaagtgtgagctggccacctgcaccccccgggagcccggggtggccggaggagatgtgtgcagcagcgagagcttcaatgaagatattgctgtgtttgccaagcagatccgggcagagaagcccctcttcagcagcaaccctgagctggacaacctgatgatccaggccatccaggtgctgcgcttccacctgctggagctggagaaggtgcatgagctgtgtgacaacttctgccaccgctacatcagctgcctgaagggcaagatgcccatcgacctggtgattgatgaccgggagggcggcagcaagagtgacagcgaggacatcaccaggtctgccaacctgacagaccagcccagctggaacagagaccatgatgacacagccagcaccaggtctgggggcaccccaggccccagcagcggcggccacaccagccacagcggggacaacagcagcgagcagggagatggcctggacaacagcgtggccagccccagcactggagatgatgatgatcctgacaaggacaagaagaggcacaagaagaggggcatcttccccaaggtggccaccaacatcatgagggcctggctgttccagcacctgacccacccctaccccagcgaggagcagaagaagcagctggcccaggacaccggcctgaccatcctgcaggtgaacaactggttcatcaatgcccggcggcgcatcgtgcagcccatgattgaccagagcaacagagctgtgtcccagggcaccccctacaacccagatggccagcccatgggcggctttgtgatggatggccagcagcacatgggcatccgggcccctggcctgcagagcatgcctggagaatatgtggcccggggcggccccatgggcgtgtccatgggccagcccagctacacccagccccagatgccaccccacccagcccagctgcggcacggcccccccatgcacacctacatccctggccacccccaccaccccaccgtgatgatgcacggcggccccccccaccctggcatgcccatgtctgccagcagccccaccgtgctgaacacaggagaccccaccatgagcggccaggtgatggacatccacgcccagtag

SEQ ID NO: 159192 - DNA, 423 bp, Artificial Sequence
  Description of Artificial Sequence: Synthetic coding sequence
atgaagaagaatggagatgagaagagccccctgggcacagagatcatgatgaccaggcacctgctggtgcaggaggagccccaggccctgcctgctgtggccaccaggcacacagtgggcaccacagctgtgtccaagcacccctaccccagcgaggagcagaagaagcagctggcccaggacaccggcctgaccatcctgcaggtgaacaactggttcatcaatgcccggcggcgcatcgtgcagcccatgattgaccagagcaacagagctgtgtcccagggcaccccctacaacccagatggccagcccatgggcggctttgtgatggatggccagcagcacatgggcatccgggcccctggccccatgagcggcatgggcatgaacatgggcatggagggccagtggcactacatgtag

SEQ ID NO: 159193 - DNA, 663 bp, Artificial Sequence
  Description of Artificial Sequence: Synthetic coding sequence
atgcagcctgtgcaccacctgaaccacggcccccccctgcacagccaccagtacccccacacagcccacaccaatgccatggcccccagcatgggcagctctgtgaatgatgccctgaagagggacaaggatgccatctacggccaccccctcttccccctgctggccctgatctttgagaagtgtgagctggccacctgcaccccccgggagcccggggtggccggaggagatgtgtgcagcagcgagagcttcaatgaagatattgctgtgtttgccaagcagatccgggcagagaagcccctcttcagcagcaaccctgagctggacaacctgatgatccaggccatccaggtgctgcgcttccacctgctggagctggagaaggtgcatgagctgtgtgacaacttctgccaccgctacatcagctgcctgaagggcaagatgcccatcgacctggtgattgatgaccgggagggcggcagcaagagtgacagcgaggacatcaccaggtctgccaacctgacagaccagcccagctggaacagagaccatgatgacacagccagcaccaggtctgggggcaccccaggccccagcagcggcggccacaccagccacagcggggacaacagcagcgagcaggcccccctgcccttctag

SEQ ID NO: 159194 - DNA, 540 bp, Artificial Sequence
  Description of Artificial Sequence: Synthetic coding sequence
atgaagagcctgctgaccttctacaagtgtggcagcgagctgctgcctgctgctgtgtggagcgctgggggcagccccagcctcttcagtgacctgaagagcaagaagggcaagaagttcagccgggaccacatcgaggtgaccatcagcaactgtggggtgaatggaaatgccaagggagatggcctggacaacagcgtggccagccccagcactggagatgatgatgatcctgacaaggacaagaagaggcacaagaagaggggcatcttccccaaggtggccaccaacatcatgagggcctggctgttccagcacctgacccacccctaccccagcgaggagcagaagaagcagctggcccaggacaccggcctgaccatcctgcaggtgaacaactggttcatcaatgcccggcggcgcatcgtgcagcccatgattgaccagagcaacagagctgtgtcccagggcaccccctacaacccagatggccagcccatgggcggctttgtgatggatggccagcagcacatgggctag

SEQ ID NO: 159195 - DNA, 978 bp, Artificial Sequence
  Description of Artificial Sequence: Synthetic coding sequence
atggcccagggcctgcggctgcagggcagcaggaggaagggccgccaccccctcttccccctgctggccctgatctttgagaagtgtgagctggccacctgcaccccccgggagcccggggtggccggaggagatgtgtgcagcagcgagagcttcaatgaagatattgctgtgtttgccaagcagatccgggcagagaagcccctcttcagcagcaaccctgagctggacaacctgatgatccaggccatccaggtgctgcgcttccacctgctggagctggagaaggtgcatgagctgtgtgacaacttctgccaccgctacatcagctgcctgaagggcaagatgcccatcgacctggtgattgatgaccgggagggcggcagcaagagtgacagcgaggacatcaccaggtctgccaacctgacagaccagcccagctggaacagagaccatgatgacacagccagcaccaggtctgggggcaccccaggccccagcagcggcggccacaccagccacagcggggacaacagcagcgagcagggagatggcctggacaacagcgtggccagccccagcactggagatgatgatgatcctgacaaggacaagaagaggcacaagaagaggggcatcttccccaaggtggccaccaacatcatgagggcctggctgttccagcacctgacccacccctaccccagcgaggagcagaagaagcagctggcccaggacaccggcctgaccatcctgcaggtgaacaactggttcatcaatgccaggagaagaattgtgcagcccatgattgaccagagcaacagagctgtgtcccagggcaccccctacaacccagatggccagcccatgggcggctttgtgatggatggccagcagcacatgggcatccgggcccctggccccatgagcggcatgggcatgaacatgggcatggagggccagtggcactacatgtag

SEQ ID NO: 159196 - DNA, 1113 bp, Artificial Sequence
  Description of Artificial Sequence: Synthetic coding sequence
atggcccagagatatgatgacctgccccactatggaggcatggatggagtgggcatccccagcaccatgtacggggacccccatgctgcccgctccatgcagcctgtgcaccacctgaaccacggcccccccctgcacagccaccagtacccccacacagcccacaccaatgccatggcccccagcatgggcagctctgtgaatgatgccctgaagagggacaaggatgccatctacggccaccccctcttccccctgctggccctgatctttgagaagtgtgagctggccacctgcaccccccgggagcccggggtggccggaggagatgtgtgcagcagcgagagcttcaatgaagatattgctgtgtttgccaagcagatccgggcagagaagcccctcttcagcagcaaccctgagctggacaacctgatgatccaggccatccaggtgctgcgcttccacctgctggagctggagaaggtgcatgagctgtgtgacaacttctgccaccgctacatcagctgcctgaagggcaagatgcccatcgacctggtgattgatgaccgggagggcggcagcaagagtgacagcgaggacatcaccaggtctgccaacctgacagaccagcccagctggaacagagaccatgatgacacagccagcaccaggtctgggggcaccccaggccccagcagcggcggccacaccagccacagcggggacaacagcagcgagcagggagatggcctggacaacagcgtggccagccccagcactggagatgatgatgatcctgacaaggacaagaagaggcacaagaagaggggcatcttccccaaggtggccaccaacatcatgagggcctggctgttccagcacctgacccacccctaccccagcgaggagcagaagaagcagctggcccaggacaccggcctgaccatcctgcaggtgaacaactggttcatcaatgcccggcggcgcatcgtgcagcccatgattgaccagagcaacagagctgggaagagccccatcgtgaccgtcttcaagagcaggaagaggaagcccagcagcagccacagccctgggggccccctgcccgggaagtag

SEQ ID NO: 159197 - DNA, 2259 bp, Artificial Sequence
  Description of Artificial Sequence: Synthetic coding sequence
accacagccatggcccacaggaagctggagagcgtgggcagcggcatgctggaccaccgggtgcggcccggccctgtgccccacagccaggagcctgagagcgaggacatggagctgcccctggagggctacgtgcctgagggcctggagctggccgccctgcggcctgagagccctgcccctgaggagcaggagtgccacaaccacagcccagatggagacagcagcagtgactatgtgaacaacaccagcgaggaggaggactatgatgagggcctgcctgaggaggaggagggcatcacctactacatccgctactgcccagaagatgacagctacctggagggcatggactgcaatggagaggagtacctggcccacagcgcccaccctgtggacacagatgagtgccaggaggccgtggaggagtggacagattctgctggcccccacccccacggccatgaagctgagggcagccaggactacccagatggccagctgcccatcccagaagatgagcccagcgtgctggaggcccatgaccaggaggaggatggccactactgtgccagcaaggagggctaccaggactactacccagaggaggccaatggaaacacaggagccagcccctaccgcctgcggagaggagatggagacctggaggaccaggaggaggacatcgaccagatcgtggccgagatcaagatgagcctgtccatgaccagcatcaccagcgccagcgaggccagccctgagcacggccctgagcccggccctgaggacagcgtggaggcctgcccccccatcaaggccagctgcagccccagcagacatgaggcccggcccaagagcctgaacctgctgcctgaggccaagcaccctggggacccccagaggggcttcaagcccaagaccaggaccccagaggagcggctgaagtggccccatgagcaggtgtgcaatggcctggagcagcccaggaagcagcagaggagtgacctgaatggacctgtggacaacaacaacatccctgagaccaagaaggtggccagcttccccagctttgtggccgtgcccggcccctgtgagcctgaggacctgattgatggcatcatctttgctgccaactacctgggcagcacccagctgctgtctgaaagaaaccccagcaagaacatccgcatgatgcaggcccaggaggccgtgtcccgggtgaagaggatgcagaaggccgccaagatcaagaagaaggccaacagtgaaggagatgcccagaccctgacagaggtggacctcttcatcagcacccagaggatcaaggtgctgaatgctgacacccaggagaccatgatggaccacgccctgcggaccatctcctacatcgctgacatcggcaacatcgtggtgctgatggcccggcggaggatgcccaggtctgccagccaggactgcatcgagaccacccctggggcccaggagggcaagaagcagtacaagatgatctgccacgtgtttgaaagtgaagatgcccagctgattgcccagagcatcggccaggccttctctgtggcctaccaggagttcctgcgggccaacggcatcaaccctgaggacctgagccagaaggagtacagcgacatcatcaacacccaggagatgtacaatgatgacctgatccacttcagcaacagcgagaactgcaaggagctgcagctggagaagcacaagggggagatcctgggcgtggtggtggtggagagcggctggggcagcatcctgcccaccgtcatcctggccaacatgatgaatggaggccctgctgcccggagcggcaagctgagcattggagaccagatcatgagcatcaatggcaccagcctggtgggcctgcccctggccacctgccagggcatcatcaagggcctgaagaaccagacccaggtgaagctgaacatcgtgtcctgcccccctgtgaccaccgtgctgatcaagaggccagacctgaagtaccagctgggcttctctgtgcagaatggcatcatctgcagcctgatgagaggaggcattgctgagcggggcggcgtgcgggtgggccaccgcatcatcgagatcaatggccagagcgtggtggccacagcccacgagaagatcgtgcaggccctgagcaacagcgtgggggagatccacatgaagaccatgcctgctgccatgttccggctgctgaccggccaggagacccccctgtacatctag

SEQ ID NO: 159198 - DNA, 1413 bp, Artificial Sequence
  Description of Artificial Sequence: Synthetic coding sequence
atggcccagagatatgatgagctgccccactatggaggcatggatggagtgggcgtgcctgcctccatgtacggggacccccacgccccccggcccatcccccctgtgcaccacctgaaccacggcccccccctgcacgccacccagcactatggagcccacgccccccaccccaacgtgatgcctgcctccatgggcagcgctgtgaatgatgccctgaagagggacaaggatgccatctacggccaccccctcttccccctgctggccctggtgtttgagaagtgtgagctggccacctgcaccccccgggagcccggggtggccggaggagatgtgtgcagcagtgacagcttcaatgaagatattgctgtgtttgccaagcaggtgcgggcagagaagcccctcttcagcagcaaccctgagctggacaacctgatgatccaggccatccaggtgctgcgcttccacctgctggagctggagaaggtgcatgagctgtgtgacaacttctgccaccgctacatcagctgcctgaagggcaagatgcccatcgacctggtgattgatgaaagagatggcagcagcaagagtgaccacgaggagctgagcggcagcagcaccaacctggccgaccacaaccccagctcctggagggaccatgatgatgccaccagcacccacagcgctggcaccccaggccccagcagcggcggccacgccagccagagcggggacaacagcagcgagcagggagatggcctggacaacagcgtggccagccctggcactggagatgatgatgatcctgacaaggacaagaagaggcagaagaagaggggcatcttccccaaggtggccaccaacatcatgagggcctggctgttccagcacctgacccacccctaccccagcgaggagcagaagaagcagctggcccaggacaccggcctgaccatcctgcaggtgaacaactggttcatcaatgcccggcggcgcatcgtgcagcccatgattgaccagagcaacagagctgtgtcccagggcgccgcctacagccctgagggccagcccatgggcagctttgtgctggatggccagcagcacatgggcatccggcctgctggcctgcagagcatgcctggggactatgtgtcccagggcggccccatgggcatgtccatggcccagcccagctacaccccaccccagatgaccccccaccccacccagctgcggcacggcccccccatgcacagctacctgcccagccacccccaccacccagccatgatgatgcacggcggcccccccacccaccctggcatgaccatgtctgcccagagccccaccatgctgaacagcgtggaccccaacgtgggcggccaggtgatggacatccacgcccagtag

SEQ ID NO: 159199 - DNA, 1146 bp, Artificial Sequence
  Description of Artificial Sequence: Synthetic coding sequence
atggatggagtgggcgtgcctgcctccatgtatggagacccccacgccccccggcccatcccccctgtgcaccacctgaaccacggcccccccctgcacgccacccagcactacggggcccacgccccccaccccaacgtgatgcctgcctccatgggcagcgctgtgaatgatgccctgaagagggacaaggatgccatctacggccaccccctcttccccctgctggccctggtgtttgagaagtgtgagctggccacctgcaccccccgggagcccggggtggccggaggagatgtgtgcagcagtgacagcttcaatgaagatattgctgtgtttgccaagcaggtgcgggcagagaagcccctcttcagcagcaaccctgagctggacaacctgatgatccaggccatccaggtgctgcgcttccacctgctggagctggagaaggtgcatgagctgtgtgacaacttctgccaccgctacatcagctgcctgaagggcaagatgcccatcgacctggtgattgatgaaagagatggcagcagcaagagtgaccacgaggagctgagcggcagcagcaccaacctggccgaccacaaccccagctcctggagggaccatgatgatgccaccagcacccacagcgctggcaccccaggccccagcagcggcggccacgccagccagagcggggacaacagcagcgagcagggagatggcctggacaacagcgtggccagccctggcactggagatgatgatgatcctgacaaggacaagaagaggcagaagaagaggggcatcttccccaaggtggccaccaacatcatgagggcctggctgttccagcacctgacccacccctaccccagcgaggagcagaagaagcagctggcccaggacaccggcctgaccatcctgcaggtgaacaactggttcatcaatgccaggagaagaattgtgcagcccatgattgaccagagcaacagagctgtgtcccagggcgccgcctacagccctgagggccagcccatgggcagctttgtgctggatggccagcagcacatgggcatccggcctgctggccccatgagcggcatgggcatgaacatgggcatggatggccagtggcactacatgtag

SEQ ID NO: 159200 - DNA, 1413 bp, Artificial Sequence; identical to SEQ ID NO: 159198
  Description of Artificial Sequence: Synthetic coding sequence

SEQ ID NO: 159201 - DNA, 921 bp, Artificial Sequence
  Description of Artificial Sequence: Synthetic coding sequence
atggccctggtgtttgagaagtgtgagctggccacctgcaccccccgggagcccggggtggccggaggagatgtgtgcagcagtgacagcttcaatgaagatattgctgtgtttgccaagcaggtgcgggcagagaagcccctcttcagcagcaaccctgagctggacaacctgatgatccaggccatccaggtgctgcgcttccacctgctggagctggagaaggtgcatgagctgtgtgacaacttctgccaccgctacatcagctgcctgaagggcaagatgcccatcgacctggtgattgatgaaagagatggcagcagcaagagtgaccacgaggagctgagcggcagcagcaccaacctggccgaccacaaccccagctcctggagggaccatgatgatgccaccagcacccacagcgctggcaccccaggccccagcagcggcggccacgccagccagagcggggacaacagcagcgagcagggagatggcctggacaacagcgtggccagccctggcactggagatgatgatgatcctgacaaggacaagaagaggcagaagaagaggggcatcttccccaaggtggccaccaacatcatgagggcctggctgttccagcacctgacccacccctaccccagcgaggagcagaagaagcagctggcccaggacaccggcctgaccatcctgcaggtgaacaactggttcatcaatgcccggcggcgcatcgtgcagcccatgattgaccagagcaacagagctgtgtcccagggcgccgcctacagccctgagggccagcccatgggcagctttgtgctggatggccagcagcacatgggcatccggcctgctggccccatgagcggcatgggcatgaacatgggcatggatggccagtggcactacatgtag

SEQ ID NO: 159202 - DNA, 921 bp, Artificial Sequence; identical to SEQ ID NO: 159201
  Description of Artificial Sequence: Synthetic coding sequence

SEQ ID NO: 159203 - DNA, 1206 bp, Artificial Sequence
  Description of Artificial Sequence: Synthetic coding sequence
atggcccagagatatgatgagctgccccactatggaggcatggatggagtgggcgtgcctgcctccatgtacggggacccccacgccccccggcccatcccccctgtgcaccacctgaaccacggcccccccctgcacgccacccagcactatggagcccacgccccccaccccaacgtgatgcctgcctccatgggcagcgctgtgaatgatgccctgaagagggacaaggatgccatctacggccaccccctcttccccctgctggccctggtgtttgagaagtgtgagctggccacctgcaccccccgggagcccggggtggccggaggagatgtgtgcagcagtgacagcttcaatgaagatattgctgtgtttgccaagcaggtgcgggcagagaagcccctcttcagcagcaaccctgagctggacaacctgatgatccaggccatccaggtgctgcgcttccacctgctggagctggagaaggtgcatgagctgtgtgacaacttctgccaccgctacatcagctgcctgaagggcaagatgcccatcgacctggtgattgatgaaagagatggcagcagcaagagtgaccacgaggagctgagcggcagcagcaccaacctggccgaccacaaccccagctcctggagggaccatgatgatgccaccagcacccacagcgctggcaccccaggccccagcagcggcggccacgccagccagagcggggacaacagcagcgagcagggagatggcctggacaacagcgtggccagccctggcactggagatgatgatgatcctgacaaggacaagaagaggcagaagaagaggggcatcttccccaaggtggccaccaacatcatgagggcctggctgttccagcacctgacccacccctaccccagcgaggagcagaagaagcagctggcccaggacaccggcctgaccatcctgcaggtgaacaactggttcatcaatgcccggcggcgcatcgtgcagcccatgattgaccagagcaacagagctggcttcctgctggaccccagcgtgtcccagggcgccgcctacagccctgagggccagcccatgggcagctttgtgctggatggccagcagcacatgggcatccggcctgctggccccatgagcggcatgggcatgaacatgggcatggatggccagtggcactacatgtag

SEQ ID NO: 159204 - DNA, 1185 bp, Artificial Sequence
  Description of Artificial Sequence: Synthetic coding sequence
atggcccagagatatgatgagctgccccactatggaggcatggatggagtgggcgtgcctgcctccatgtacggggacccccacgccccccggcccatcccccctgtgcaccacctgaaccacggcccccccctgcacgccacccagcactatggagcccacgccccccaccccaacgtgatgcctgcctccatgggcagcgctgtgaatgatgccctgaagagggacaaggatgccatctacggccaccccctcttccccctgctggccctggtgtttgagaagtgtgagctggccacctgcaccccccgggagcccggggtggccggaggagatgtgtgcagcagtgacagcttcaatgaagatattgctgtgtttgccaagcaggtgcgggcagagaagcccctcttcagcagcaaccctgagctggacaacctgatgatccaggccatccaggtgctgcgcttccacctgctggagctggagaaggtgcatgagctgtgtgacaacttctgccaccgctacatcagctgcctgaagggcaagatgcccatcgacctggtgattgatgaaagagatggcagcagcaagagtgaccacgaggagctgagcggcagcagcaccaacctggccgaccacaaccccagctcctggagggaccatgatgatgccaccagcacccacagcgctggcaccccaggccccagcagcggcggccacgccagccagagcggggacaacagcagcgagcagggagatggcctggacaacagcgtggccagccctggcactggagatgatgatgatcctgacaaggacaagaagaggcagaagaagaggggcatcttccccaaggtggccaccaacatcatgagggcctggctgttccagcacctgacccacccctaccccagcgaggagcagaagaagcagctggcccaggacaccggcctgaccatcctgcaggtgaacaactggttcatcaatgcccggcggcgcatcgtgcagcccatgattgaccagagcaacagagctgtgtcccagggcgccgcctacagccctgagggccagcccatgggcagctttgtgctggatggccagcagcacatgggcatccggcctgctggccccatgagcggcatgggcatgaacatgggcatggatggccagtggcactacatgtag

SEQ ID NO: 159205 - DNA, 717 bp, Artificial Sequence
  Description of Artificial Sequence: Synthetic coding sequence
atggatggagtgggcgtgcctgcctccatgtatggagacccccacgccccccggcccatcccccctgtgcaccacctgaaccacggcccccccctgcacgccacccagcactacggggcccacgccccccaccccaacgtgatgcctgcctccatgggcagcgctgtgaatgatgccctgaagagggacaaggatgccatctacggccaccccctcttccccctgctggccctggtgtttgagaagtgtgagctggccacctgcaccccccgggagcccggggtggccggaggagatgtgtgcagcagtgacagcttcaatgaagatattgctgtgtttgccaagcaggtgcgggcagagaagcccctcttcagcagcaaccctgagctggacaacctgatgatccaggccatccaggtgctgcgcttccacctgctggagctggagaaggtgcatgagctgtgtgacaacttctgccaccgctacatcagctgcctgaagggcaagatgcccatcgacctggtgattgatgaaagagatggcagcagcaagagtgaccacgaggagctgagcggcagcagcaccaacctggccgaccacaaccccagctcctggagggaccatgatgatgccaccagcacccacagcgctggcaccccaggccccagcagcggcggccacgccagccagagcggggacaacagcagcgagcagtag

SEQ ID NO: 159206 - DNA, 240 bp, Artificial Sequence
  Description of Artificial Sequence: Synthetic coding sequence
atggccctggtgtttgagaagtgtgagctggccacctgcaccccccgggagcccggggtggccggaggagatgtgtgcagcagtgacagcttcaatgaagatattgctgtgtttgccaagcaggtgcgggcagagaagcccctcttcagcagcaaccctgagctggacaacctgatgatccaggccatccaggtgctgcgcttccacctgctggagctggagaaggtgtccaggaagtag

SEQ ID NO: 159207 - DNA, 1167 bp, Artificial Sequence
  Description of Artificial Sequence: Synthetic coding sequence
atggatggagtgggcgtgcctgcctccatgtatggagacccccacgccccccggcccatcccccctgtgcaccacctgaaccacggcccccccctgcacgccacccagcactacggggcccacgccccccaccccaacgtgatgcctgcctccatgggcagcgctgtgaatgatgccctgaagagggacaaggatgccatctacggccaccccctcttccccctgctggccctggtgtttgagaagtgtgagctggccacctgcaccccccgggagcccggggtggccggaggagatgtgtgcagcagtgacagcttcaatgaagatattgctgtgtttgccaagcaggtgcgggcagagaagcccctcttcagcagcaaccctgagctggacaacctgatgatccaggccatccaggtgctgcgcttccacctgctggagctggagaaggtgcatgagctgtgtgacaacttctgccaccgctacatcagctgcctgaagggcaagatgcccatcgacctggtgattgatgaaagagatggcagcagcaagagtgaccacgaggagctgagcggcagcagcaccaacctggccgaccacaaccccagctcctggagggaccatgatgatgccaccagcacccacagcgctggcaccccaggccccagcagcggcggccacgccagccagagcggggacaacagcagcgagcagggagatggcctggacaacagcgtggccagccctggcactggagatgatgatgatcctgacaaggacaagaagaggcagaagaagaggggcatcttccccaaggtggccaccaacatcatgagggcctggctgttccagcacctgacccacccctaccccagcgaggagcagaagaagcagctggcccaggacaccggcctgaccatcctgcaggtgaacaactggttcatcaatgccaggagaagaattgtgcagcccatgattgaccagagcaacagagctggcttcctgctggaccccagcgtgtcccagggcgccgcctacagccctgagggccagcccatgggcagctttgtgctggatggccagcagcacatgggcatccggcctgctggccccatgagcggcatgggcatgaacatgggcatggatggccagtggcactacatgtag

SEQ ID NO: 159208 - DNA, 1185 bp, Artificial Sequence; identical to SEQ ID NO: 159204
  Description of Artificial Sequence: Synthetic coding sequence

SEQ ID NO: 159209 - DNA, 1434 bp, Artificial Sequence
  Description of Artificial Sequence: Synthetic coding sequence
atggcccagagatatgatgagctgccccactatggaggcatggatggagtgggcgtgcctgcctccatgtacggggacccccacgccccccggcccatcccccctgtgcaccacctgaaccacggcccccccctgcacgccacccagcactatggagcccacgccccccaccccaacgtgatgcctgcctccatgggcagcgctgtgaatgatgccctgaagagggacaaggatgccatctacggccaccccctcttccccctgctggccctggtgtttgagaagtgtgagctggccacctgcaccccccgggagcccggggtggccggaggagatgtgtgcagcagtgacagcttcaatgaagatattgctgtgtttgccaagcaggtgcgggcagagaagcccctcttcagcagcaaccctgagctggacaacctgatgatccaggccatccaggtgctgcgcttccacctgctggagctggagaaggtgcatgagctgtgtgacaacttctgccaccgctacatcagctgcctgaagggcaagatgcccatcgacctggtgattgatgaaagagatggcagcagcaagagtgaccacgaggagctgagcggcagcagcaccaacctggccgaccacaaccccagctcctggagggaccatgatgatgccaccagcacccacagcgctggcaccccaggccccagcagcggcggccacgccagccagagcggggacaacagcagcgagcagggagatggcctggacaacagcgtggccagccctggcactggagatgatgatgatcctgacaaggacaagaagaggcagaagaagaggggcatcttccccaaggtggccaccaacatcatgagggcctggctgttccagcacctgacccacccctaccccagcgaggagcagaagaagcagctggcccaggacaccggcctgaccatcctgcaggtgaacaactggttcatcaatgcccggcggcgcatcgtgcagcccatgattgaccagagcaacagagctggcttcctgctggaccccagcgtgtcccagggcgccgcctacagccctgagggccagcccatgggcagctttgtgctggatggccagcagcacatgggcatccggcctgctggcctgcagagcatgcctggggactatgtgtcccagggcggccccatgggcatgtccatggcccagcccagctacaccccaccccagatgaccccccaccccacccagctgcggcacggcccccccatgcacagctacctgcccagccacccccaccacccagccatgatgatgcatggaggcccccccacccaccctggcatgaccatgtctgcccagagccccaccatgctgaacagcgtggaccccaacgtgggcggccaggtgatggacatccacgcccagtag

SEQ ID NO: 159210 - DNA, 1434 bp, Artificial Sequence; identical to SEQ ID NO: 159209
  Description of Artificial Sequence: Synthetic coding sequence

SEQ ID NO: 159211 - DNA, 357 bp, Artificial Sequence
  Description of Artificial Sequence: Synthetic coding sequence
atgccccgggaggatgcccacttcatctacggctaccccaagaagggccacggccacagctacaccacagctgaggaggccgccggcatcggcatcctgaccgtcatcctgggcgtgctgctgctgattggctgctggtactgcagaagaagaaatggctaccgggccctgatggacaagagcctgcacgtgggcacccagtgtgccctgacccggcgctgcccccaggagggctttgaccaccgggacagcaaggtgtccctgcaggagaagaactgtgagcctgtggtgcccaatgcccccccagcctatgagaagctgtctgctgagcagagccccccaccctacagcccctag

SEQ ID NO: 159212 - DNA, 357 bp, Artificial Sequence; identical to SEQ ID NO: 159211
  Description of Artificial Sequence: Synthetic coding sequence

SEQ ID NO: 159213 - DNA, 357 bp, Artificial Sequence; identical to SEQ ID NO: 159211
  Description of Artificial Sequence: Synthetic coding sequence

SEQ ID NO: 159214 - DNA, 1269 bp, Artificial Sequence
  Description of Artificial Sequence: Synthetic coding sequence
atgtctgtgggcgccatgaagaagggcgtgggccgggctgtgggcctgggcggcggcagcggctgccaggccacagaggaggaccccctgcccaactgtggggcctgtgcccctggccagggcggccgccgctggaggctgccccagcctgcctgggtggagggcagcagcgcccggctgtgggagcaggccactggaacaggctggatggacctggaggccagcctgctgcccaccggccccaatgccagcaacaccagtgatggccctgacaacctgaccagcgctggcagcccccccaggacaggcagcatctcctacatcaacatcatcatgcccagcgtgtttggcaccatctgcctgctgggcatcatcggcaacagcaccgtcatctttgctgtggtgaagaagagcaagctgcactggtgcaacaacgtgcctgacatcttcatcatcaacctgtctgtggtggacctgctcttcctgctgggcatgcccttcatgatccaccagctgatgggaaatggagtgtggcactttggagagaccatgtgcaccctcatcacagccatggatgccaacagccagttcaccagcacctacatcctgacagccatggccatcgaccgctacctggccaccgtgcaccccatcagcagcaccaagttcaggaagcccagcgtggccaccctggtgatctgcctgctgtgggccctgtccttcatcagcatcacccctgtgtggctgtatgcccggctcatccccttccctggaggagctgtgggctgcggcatccggctgcccaacccagacacagacctgtactggttcaccctgtaccagttcttcctggcctttgccctgccctttgtggtgatcacagctgcctacgtgcgcatcctgcagaggatgaccagctctgtggccccagccagccagaggagcatccggctgcggaccaagagggtgaccaggacagccatcgccatctgcctggtgttctttgtgtgctgggccccctactacgtgctgcagctgacccagctgagcatcagccggcccaccctgacctttgtgtacctgtacaatgctgccatcagcctgggctacgccaacagctgcctgaacccctttgtgtacatcgtgctgtgtgagaccttcaggaagaggctggtgctgtctgtgaagccagctgcccagggccagctgcgggctgtgtccaatgcccagacagcagatgaggagaggacagagagcaagggcacctag

SEQ ID NO: 159215 - DNA, 891 bp, Artificial Sequence
  Description of Artificial Sequence: Synthetic coding sequence
atgtctgtgggcgccatgaagaagggcgtgggccgggctgtgggcctgggcggcggcagcggctgccaggccacagaggaggaccccctgcccaactgtggggcctgtgcccctggccagggcggccgccgctggaggctgccccagcctgcctgggtggagggcagcagcgcccggctgtgggagcaggccactggaacaggctggatggacctggaggccagcctgctgcccaccggccccaatgccagcaacaccagtgatggccctgacaacctgaccagcgctggcagcccccccaggacaggcagcatctcctacatcaacatcatcatgcccagcgtgtttggcaccatctgcctgctgggcatcatcggcaacagcaccgtcatctttgctgtggtgaagaagagcaagctgcactggtgcaacaacgtgcctgacatcttcatcatcaacctgtccttcttcctggcctttgccctgccctttgtggtgatcacagctgcctacgtgcgcatcctgcagaggatgaccagctctgtggccccagccagccagaggagcatccggctgcggaccaagagggtgaccaggacagccatcgccatctgcctggtgttctttgtgtgctgggccccctactacgtgctgcagctgacccagctgagcatcagccggcccaccctgacctttgtgtacctgtacaatgctgccatcagcctgggctacgccaacagctgcctgaacccctttgtgtacatcgtgctgtgtgagaccttcaggaagaggctggtgctgtctgtgaagccagctgcccagggccagctgcgggctgtgtccaatgcccagacagcagatgaggagaggacagagagcaagggcacctag

SEQ ID NO: 159216 - DNA, 1023 bp, Artificial Sequence
  Description of Artificial Sequence: Synthetic coding sequence
atgaaccccttccacgccagctgctggaacaccagcgctgagctgctgaacaagtcctggaacaaggagtttgcctaccagacagcctctgtggtggacaccgtcatcctgcccagcatgattggcatcatctgcagcacaggcctggtgggcaacatcctgattgtgttcaccatcatccgcagcaggaagaagacagtgcctgacatctacatctgcaacctggccgtggccgacctggtgcacatcgtgggcatgcccttcctgatccaccagtgggcccggggcggggagtgggtgtttggaggccccctgtgcaccatcatcaccagcctggacacctgcaaccagtttgcctgcagcgccatcatgacagtgatgtctgtggaccgctactttgccctggtgcagcccttccggctgacccgctggaggacccgctacaagaccatccgcatcaacctgggcctgtgggccgccagcttcatcctggccctgcctgtgtgggtgtacagcaaggtgatcaagttcaaggatggagtggagagctgtgcctttgacctgaccagcccagatgatgtgctgtggtacaccctgtacctgaccatcaccaccttcttcttccccctgcccctcatcctggtgtgctacatcctgatcctgtgctacacctgggagatgtaccagcagaacaaggatgcccgctgctgcaaccccagcgtgcccaagcagagggtgatgaagctgaccaagatggtgctggtgctggtggtggtgttcatcctgtctgctgccccctaccacgtgatccagctggtgaacctgcagatggagcagcccaccctggccttctacgtgggctactacctgagcatctgcctgtcctatgccagcagcagcatcaaccccttcctgtacatcctgctgagcggcaacttccagaagaggctgccccagatccagaggcgggccacagagaaggagatcaacaacatgggcaacaccctgaagagccacttctag

SEQ ID NO: 159217 - DNA, 1023 bp, Artificial Sequence; identical to SEQ ID NO: 159216
  Description of Artificial Sequence: Synthetic coding sequence

SEQ ID NO: 159218 - DNA, 1023 bp, Artificial Sequence; identical to SEQ ID NO: 159216
  Description of Artificial Sequence: Synthetic coding sequence

SEQ ID NO: 159219 - DNA, 519 bp, Artificial Sequence
  Description of Artificial Sequence: Synthetic coding sequence
atggccaacggcaccaatgccagcgccccctactacagctatgagtactacctggactacctggacctgatccctgtggatgagaagaagctgaaggcccacaagcacagcatcgtcatcgccttctgggtgtccctggccgcctttgtggtgctgctcttcctgatcctgctgtacatgtcctggagcgccagcccccagatgaggaacagccccaagcaccaccagacctgcccctggagccacggcctgaacctgcacctgtgcatccagaagtgcctgccctgccaccgggagcccctggccaccagccaggcccaggccagctctgtggagcccggcagcaggactggaccagaccagcccctgcggcaggagagcagcagcaccctgcccctgggcggcttccagacccaccccaccctgctgtgggagctgaccctgaatggaggccccctggtgcgcagcaagcccagcgagcccccacctggggacaggaccagccagctgcagagctag

SEQ ID NO: 159220 - DNA, 309 bp, Artificial Sequence
  Description of Artificial Sequence: Synthetic coding sequence
atggccaacggcaccaatgccagcgccccctactacagctatgagtactacctggactacctggacctgatccctgtggatgagaagaagctgaaggcccacaagcacagcatcgtcatcgccttctgggtgtccctggccgcctttgtggtgctgctcttcctgatcctgctgtacatgtcctggagcgccagcccccagatgtccttcaacacagatgagagcctgctgcacagcgaggtgctgccccagacccgggccatcagctgtgatgagctgcaggccccccgggaggagggcgccgcctag

SEQ ID NO: 159221 - DNA, 519 bp, Artificial Sequence; identical to SEQ ID NO: 159219
  Description of Artificial Sequence: Synthetic coding sequence

SEQ ID NO: 159222 - DNA, 309 bp, Artificial Sequence; identical to SEQ ID NO: 159220
  Description of Artificial Sequence: Synthetic coding sequence

SEQ ID NO: 159223 - DNA, 1110 bp, Artificial Sequence
  Description of Artificial Sequence: Synthetic coding sequence
atgccccgggcccccaagaggcagcgctgcatgcctgaggaggacctgcagagccagagcgagacccagggcctggagggcgcccaggcccccctggccgtggaggaggatgccagcagcagcaccagcaccagcagcagcttccccagcagcttccccagcagcagcagcagcagcagcagcagctgctaccccctcatccccagcaccccagaggaggtgtctgcagatgatgagacccccaaccccccccagagcgcccagatcgcctgcagcagccccagcgtggtggccagcctgcccctggaccagagtgatgagggcagcagcagccagaaggaggagagccccagcaccctgcaggtgctgcctgacagcgagagcctgcccaggagtgaaattgatgagaaggtgacagacctggtgcagttcctgctcttcaagtaccagatgaaggagcccatcaccaaggccgagatcctggagagcgtcatccggaactatgaggaccacttccccctgctcttcagcgaggccagcgagtgcatgctgctggtgtttggaattgatgtgaaggaggtggaccccaccggccacagctttgtgctggtgaccagcctgggcctgacctatgatggcatgctgagtgatgtgcagagcatgcccaagacaggcatcctgatcctgatcctgagcatcgtgttcatcgagggctactgcaccccagaggaggtgatctgggaggccctgaacatgatgggcctgtatgatggcatggagcacctgatctacggggagcccaggaagctgctgacccaggactgggtgcaggagaactacctggagtaccggcaggtgcccggcagtgaccctgcccgctatgagttcctgtggggcccccgggcccacgccgagatcaggaagatgagcctgctgaagttcctggccaaggtgaatggaagtgaccccaggagcttccccctgtggtatgaggaggccctgaaggatgaggaggagcgggcccaggacagaattgccaccacagatgacaccacagccatggccagcgccagcagcagcgccaccggcagcttctcctacccagagtag

SEQ ID NO: 159224 - DNA, 1110 bp, Artificial Sequence; identical to SEQ ID NO: 159223
  Description of Artificial Sequence: Synthetic coding sequence

SEQ ID NO: 159225 - DNA, 486 bp, Artificial Sequence
  Description of Artificial Sequence: Synthetic coding sequence
atgccccgggcccccaagaggcagcgctgcatgcctgaggaggacctgcagagccagagcgagacccagggcctggagggcgcccaggcccccctggccgtggaggaggatgccagcagcagcaccagcaccagcagcagcttccccagcagcttccccagcagcagcagcagcagcagcagcagctgctaccccctcatccccagcaccccagaggaggtgtctgcagatgatgagacccccaaccccccccagagcgcccagatcgcctgcagcagccccagcgtggtggccagcctgcccctggaccagagtgatgagggcagcagcagccagaaggaggagagccccagcaccctgcaggtgctgcctgacagcgagagcctgcccaggagtgaaattgatgagaaggtgacagacctggtgcagttcctgctcttcaagtaccagatgaaggagcccatcaccaaggccgagatcctgtag

SEQ ID NO: 159226 - DNA, 573 bp, Artificial Sequence
  Description of Artificial Sequence: Synthetic coding sequence
atgccccgggcccccaagaggcagcgctgcatgcctgaggaggacctgcagagccagagcgagacccagggcctggagggcgcccaggcccccctggccgtggaggaggatgccagcagcagcaccagcaccagcagcagcttccccagcagcttccccagcagcagcagcagcagcagcagcagctgctaccccctcatccccagcaccccagaggaggtgtctgcagatgatgagacccccaaccccccccagagcgcccagatcgcctgcagcagccccagcgtggtggccagcctgcccctggaccagagtgatgagggcagcagcagccagaaggaggagagccccagcaccctgcaggtgctgcctgacagcgagagcctgcccaggagtgaaattgatgagaaggtgacagacctggtgcagttcctgctcttcaagtaccagatgaaggagcccatcaccaaggccgagatcctggagagcgtcatccggaactatgaggaccacttccccctgctcttcagcgaggccagcgagtgcatgctgctggtgtttggaattgattag

SEQ ID NO: 159227 - DNA, 1203 bp, Artificial Sequence
  Description of Artificial Sequence: Synthetic coding sequence
atgagcaaggtgtccaccatgttttctgaagatgacttccagagcacagagcgggccccctacggcccccagctgcagtggagccaggacctgccccgggtgcaggtgttccgggagcaggccaacctggaggacaggagccccaggaggacccagaggatcactggaggagagcaggtgctgtggggccccatcacccagatcttccccaccgtgcggcctgctgacctgaccagggtcatcatgcccctggagcagaggagccagcactgcaagccagaggagggcctgcaggcccaggaggaggacctgggcctggtgggcgcccaggccctgcaggccgaggagcaggaggccgccttcttcagcagcaccctgaatgtgggcaccctggaggagctgcctgctgctgagagccccagccccccccagagcccccaggaggagagcttcagccccacagccatggatgccatcttcggcagcctgagtgatgagggcagcggcagccaggagaaggagggccccagcaccagcccagacctgattgatcctgagagcttcagccaggacatcctgcatgacaagatcatcgacctggtgcacctgctgctgaggaagtacagagtgaagggcctcatcaccaaggccgagatgctgggcagcgtcatcaagaactatgaggactacttccctgagatcttccgggaggcctctgtgtgcatgcagctgctgtttggaattgatgtgaaggaggtggaccccaccagccacagctatgtgctggtgaccagcctgaacctgtcctatgatggcatccagtgcaatgagcagagcatgcccaagagcggcctgctgatcatcgtgctgggcgtcatcttcatggagggcaactgcatccctgaggaggtgatgtgggaggtgctgagcatcatgggcgtgtatgccggccgggagcacttcctgtttggagagcccaagaggctgctgacccagaactgggtgcaggagaagtacctggtgtaccggcaggtgcccggcacagatcctgcctgctatgagttcctgtggggcccccgggcccatgctgagaccagcaagatgaaggtgctggagtacatcgccaatgccaacggccgggaccccaccagctaccccagcctgtatgaagatgccctgcgggaggagggggagggcgtgtag

SEQ ID NO: 159228 - DNA, 1290 bp, Artificial Sequence
  Description of Artificial Sequence: Synthetic coding sequence
atggagacccagttccggcggggcggcctgggctgcagccctgccagcatcaagaggaagaagaagcgggaggacagcggggactttggcctgcaggtgtccaccatgttttctgaagatgacttccagagcacagagcgggccccctacggcccccagctgcagtggagccaggacctgccccgggtgcaggtgttccgggagcaggccaacctggaggacaggagccccaggaggacccagaggatcaccggcggggagcaggtgctgtggggccccatcacccagatcttccccaccgtgcggcctgctgacctgaccagggtcatcatgcccctggagcagaggagccagcactgcaagccagaggagggcctgcaggcccaggaggaggacctgggcctggtgggcgcccaggccctgcaggccgaggagcaggaggccgccttcttcagcagcaccctgaatgtgggcaccctggaggagctgcctgctgctgagagccccagccccccccagagcccccaggaggagagcttcagccccacagccatggatgccatcttcggcagcctgagtgatgagggcagcggcagccaggagaaggagggccccagcaccagcccagacctgattgatcctgagagcttcagccaggacatcctgcatgacaagatcatcgacctggtgcacctgctgctgaggaagtacagagtgaagggcctcatcaccaaggccgagatgctgggcagcgtcatcaagaactatgaggactacttccctgagatcttccgggaggcctctgtgtgcatgcagctgctgtttggaattgatgtgaaggaggtggaccccaccagccacagctatgtgctggtgaccagcctgaacctgtcctatgatggcatccagtgcaatgagcagagcatgcccaagagcggcctgctgatcatcgtgctgggcgtcatcttcatggagggcaactgcatccctgaggaggtgatgtgggaggtgctgagcatcatgggcgtgtatgccggccgggagcacttcctgtttggagagcccaagaggctgctgacccagaactgggtgcaggagaagtacctggtgtaccggcaggtgcctggaacagatcctgcctgctatgagttcctgtggggcccccgggcccacgccgagaccagcaagatgaaggtgctggagtacatcgccaatgccaacggccgggaccccaccagctaccccagcctgtatgaagatgccctgcgggaggagggggagggcgtgtag

SEQ ID NO: 159229 - DNA, 945 bp, Artificial Sequence
  Description of Artificial Sequence: Synthetic coding sequence
atgcccctggagcagaggagccagcactgcaagccagaggagggcctggaggcccagggcgaggccctgggcctggtgggcgcccaggccccagccacagaggagcaggagacagccagcagcagcagcaccctggtggaggtgaccctgcgggaggtgcctgctgctgagagccccagccccccccacagcccccagggcgccagcaccctgcccaccaccatcaactacaccctgtggagccagagtgatgagggcagcagcaatgaggagcaggagggccccagcaccttcccagacctggagaccagcttccaggtggccctgagcaggaagatggccgagctggtgcacttcctgctgctgaagtaccgggcccgggagcccttcaccaaggccgagatgctgggcagcgtcatccggaacttccaggacttcttccctgtgatcttcagcaaggccagcgagtacctgcagctggtgtttggcatcgaggtggtggaggtggtgcgcatcggccacctgtacatcctggtgacctgcctgggcctgtcctatgatggcctgctgggggacaaccagatcgtgcccaagacaggcctgctgatcatcgtgctggccatcatcgccaaggagggggactgtgcccctgaggagaagatctgggaggagctgtctgtgctggaggccagtgatggaagagaagattctgtgtttgcccaccccaggaagctgctgacccaggacctggtgcaggagaactacctggagtaccggcaggtgcccggcagtgaccctgcctgctatgagttcctgtggggcccccgggccctggtggagaccagctatgtgaaggtgctgcaccacctgctgaagatcagcggcggcccccacatctcctacccacccctgcacgagtgggccttccgggagggggaggagtag

SEQ ID NO: 159230 - DNA, 945 bp, Artificial Sequence; identical to SEQ ID NO: 159229
  Description of Artificial Sequence: Synthetic coding sequence

SEQ ID NO: 159231 - DNA, 945 bp, Artificial Sequence; identical to SEQ ID NO: 159229
  Description of Artificial Sequence: Synthetic coding sequence

SEQ ID NO: 159232 - DNA, 945 bp, Artificial Sequence
  Description of Artificial Sequence: Synthetic coding sequence
atgcccctggagcagaggagccagcactgcaagccagaggagggcctggaggcccggggggaggccctgggcctggtgggcgcccaggccccagccacagaggagcagcagacagccagcagcagcagcaccctggtggaggtgaccctgggggaggtgcctgctgctgacagccccagccccccccacagcccccagggcgccagcagcttcagcaccaccatcaactacaccctgtggaggcagagtgatgagggcagcagcaaccaggaggaggagggccccaggatgtttcctgacctggagagcgagttccaggccgccatcagcaggaagatggtggagctggtgcacttcctgctgctgaagtaccgggcccgggagcctgtgaccaaggccgagatgctggagagcgtgctgaggaactgccaggacttcttccctgtgatcttcagcaaggccagcgagtacctgcagctggtgtttggcatcgaggtggtggaggtggtgcccatcagccacctgtacatcctggtgacctgcctgggcctgtcctatgatggcctgctgggggacaaccaggtgatgcccaagacaggcctgctgatcatcgtgctggccatcatcgccattgaaggagactgtgcccctgaggagaagatctgggaggagctgtccatgctggaggtgtttgagggcagagaagattctgtgtttgcccaccccaggaagctgctgatgcaggacctggtgcaggagaactacctggagtaccggcaggtgcccggcagtgaccctgcctgctatgagttcctgtggggcccccgggccctgattgagaccagctatgtgaaggtgctgcaccacaccctgaagattggaggagagccccacatctcctacccacccctgcacgagcgggccctgcgggagggggaggagtag

SEQ ID NO: 159233 - DNA, 945 bp, Artificial Sequence; identical to SEQ ID NO: 159232
  Description of Artificial Sequence: Synthetic coding sequence

SEQ ID NO: 159234 - DNA, 945 bp, Artificial Sequence; identical to SEQ ID NO: 159232
  Description of Artificial Sequence: Synthetic coding sequence

SEQ ID NO: 159235 - DNA, 945 bp, Artificial Sequence; identical to SEQ ID NO: 159232
  Description of Artificial Sequence: Synthetic coding sequence

SEQ ID NO: 159236 - DNA, 945 bp, Artificial Sequence
  Description of Artificial Sequence: Synthetic coding sequence
atgcccctggagcagaggagccagcactgcaagccagaggagggcctggaggcccggggggaggccctgggcctggtgggcgcccaggccccagccacagaggagcaggaggccgccagcagcagcagcaccctggtggaggtgaccctgggggaggtgcctgctgctgagagcccagaccccccccagagcccccagggcgccagcagcctgcccaccaccatgaactaccccctgtggagccagagctatgaggacagcagcaaccaggaggaggagggccccagcaccttcccagacctggagagcgagttccaggccgccctgagcaggaaggtggccgagctggtgcacttcctgctgctgaagtaccgggcccgggagcctgtgaccaaggccgagatgctgggctctgtggtgggcaactggcagtacttcttccctgtgatcttcagcaaggccagcagcagcctgcagctggtgtttggcatcgagctgatggaggtggaccccatcggccacctgtacatctttgccacctgcctgggcctgtcctatgatggcctgctgggggacaaccagatcatgcccaaggccggcctgctgatcatcgtgctggccatcatcgcccgggagggggactgtgcccctgaggagaagatctgggaggagctgtctgtgctggaggtgtttgagggcagagaagattccatcctgggggaccccaagaagctgctgacccagcactttgtgcaggagaactacctggagtaccggcaggtgcccggcagtgaccctgcctgctatgagttcctgtggggcccccgggccctggtggagaccagctatgtgaaggtgctgcaccacatggtgaagatcagcggcggcccccacatctcctacccacccctgcacgagtgggtgctgcgggagggggaggagtag

SEQ ID NO: 159237 - DNA, 945 bp, Artificial Sequence; identical to SEQ ID NO: 159236
  Description of Artificial Sequence: Synthetic coding sequence

SEQ ID NO: 159238 - DNA, 597 bp, Artificial Sequence
  Description of Artificial Sequence: Synthetic coding sequence
atgcccctggagcagaggagccagcactgcaagccagaggagggcctggaggcccggggggaggccctgggcctggtgggcgcccaggccccagccacagaggagcaggaggccgccagcagcagcagcaccctggtggaggtgaccctgggggaggtgcctgctgctgagagcccagaccccccccagagcccccagggcgccagcagcctgcccaccaccatgaactaccccctgtggagccagagctatgaggacagcagcaaccaggaggaggagggccccagcaccttcccagacctggagagcgagttccaggccgccctgagcaggaaggtggccgagctggtgcacttcctgctgctgaagtaccgggcccgggagcctgtgaccaaggccgagatgctgggctctgtggtgggcaactggcagtacttcttccctgtgatcttcagcaaggccagcagcagcctgcagctggtgtttggcatcgagctgatggaggtggaccccatcggccacctgtacatctttgccacctgcctgggcctgtcctatgatggcctgctgggggacaaccagatcatgcccaagtag

SEQ ID NO: 159239 - DNA, 954 bp, Artificial Sequence
  Description of Artificial Sequence: Synthetic coding sequence
atgagcagcgagcagaagagccagcactgcaagccagaggagggcgtggaggcccaggaggaggccctgggcctggtgggcgcccaggcccccaccacagaggagcaggaggccgctgtgagcagcagcagccccctggtgcccggcaccctggaggaggtgcctgctgctgagagcgctggccccccccagagcccccagggcgccagcgccctgcccaccaccatctccttcacctgctggaggcagcccaatgaaggcagcagcagccaggaggaggagggccccagcaccagcccagatgctgagagcctcttccgggaggccctgagcaacaaggtggatgagctggcccacttcctgctgaggaagtaccgggccaaggagctggtgaccaaggccgagatgctggagagggtcatcaagaactacaagcgctgcttccctgtgatctttgggaaggccagcgagagcctgaagatgatctttggaattgatgtgaaggaggtggaccctgccagcaacacctacaccctggtgacctgcctgggcctgtcctatgatggcctgctgggcaacaaccagatcttccccaagacaggcctgctgatcatcgtgctgggcaccatcgccatggagggggacagcgccagcgaggaggagatctgggaggagctgggcgtgatgggcgtgtatgatggccgggagcacacagtgtatggagagcccaggaagctgctgacccaggactgggtgcaggagaactacctggagtaccggcaggtgcccggcagcaacccagcccgctatgagttcctgtggggcccccgggccctggccgagaccagctatgtgaaggtgctggagcacgtggtgcgggtgaatgcccgggtgcgcatcgcctaccccagcctgcgggaggccgccctgctggaggaggaggagggcgtgtag

SEQ ID NO: 159240 - DNA, 954 bp, Artificial Sequence; identical to SEQ ID NO: 159239
  Description of Artificial Sequence: Synthetic coding sequence

SEQ ID NO: 159241 - DNA, 954 bp, Artificial Sequence; identical to SEQ ID NO: 159239
  Description of Artificial Sequence: Synthetic coding sequence

SEQ ID NO: 159242 - DNA, 954 bp, Artificial Sequence; identical to SEQ ID NO: 159239
  Description of Artificial Sequence: Synthetic coding sequence

SEQ ID NO: 159243 - DNA, 954 bp, Artificial Sequence; identical to SEQ ID NO: 159239
  Description of Artificial Sequence: Synthetic coding sequence

SEQ ID NO: 159244 - DNA, 954 bp, Artificial Sequence; identical to SEQ ID NO: 159239
  Description of Artificial Sequence: Synthetic coding sequence

SEQ ID NO: 159245 - DNA, 954 bp, Artificial Sequence; identical to SEQ ID NO: 159239
  Description of Artificial Sequence: Synthetic coding sequence

SEQ ID NO: 159246 - DNA, 693 bp, Artificial Sequence
  Description of Artificial Sequence: Synthetic coding sequence
atgagcagcgagcagaagagccagcactgcaagccagaggagggcgtggaggcccaggaggaggccctgggcctggtgggcgcccaggcccccaccacagaggagcaggaggccgctgtgagcagcagcagccccctggtgcccggcaccctggaggaggtgcctgctgctgagagcgctggccccccccagagcccccagggcgccagcgccctgcccaccaccatctccttcacctgctggaggcagcccaatgaaggcagcagcagccaggaggaggagggccccagcaccagcccagatgctgagagcctcttccgggaggccctgagcaacaaggtggatgagctggcccacttcctgctgaggaagtaccgggccaaggagctggtgaccaaggccgagatgctggagagggtcatcaagaactacaagcgctgcttccctgtgatctttgggaaggccagcgagagcctgaagatgatctttggaattgatgtgaaggaggtggaccctgccagcaacacctacaccctggtgacctgcctgggcctgtcctatgatggcctgctgggcaacaaccagatcttccccaagacaggcctgctgatcatcgtgctgggcaccatcgccatggagggggacagcgccagcgaggaggagatctgggaggagctgggcgtgatgggctag

SEQ ID NO: 159247 - DNA, 654 bp, Artificial Sequence
  Description of Artificial Sequence: Synthetic coding sequence
atgagcagcgagcagaagagccagcactgcaagccagaggagggcgtggaggcccaggaggaggccctgggcctggtgggcgcccaggcccccaccacagaggagcaggaggccgctgtgagcagcagcagccccctggtgcccggcaccctggaggaggtgcctgctgctgagagcgctggccccccccagagcccccagggcgccagcgccctgcccaccaccatctccttcacctgctggaggcagcccaatgaaggcagcagcagccaggaggaggagggccccagcaccagcccagatgctgagagcctcttccgggaggccctgagcaacaaggtggatgagctggcccacttcctgctgaggaagtaccgggccaaggagctggtgaccaaggccgagatgctggagagggtcatcaagaactacaagcgctgcttccctgtgatctttgggaaggccagcgagagcctgaagatgatctttggaattgatgtgaaggaggtggaccctgccagcaacacctacaccctggtgacctgcctgggcctgtcctatgatggcctgctgggcaacaaccagatcttccccaagacaggcctgctgatcatcgtgctgggcaccatcgccatggagggggacagcgcctag

SEQ ID NO: 159248 - DNA, 726 bp, Artificial Sequence
  Description of Artificial Sequence: Synthetic coding sequence
atgagcagcgagcagaagagccagcactgcaagccagaggagggcgtggaggcccaggaggaggccctgggcctggtgggcgcccaggcccccaccacagaggagcaggaggccgctgtgagcagcagcagccccctggtgcccggcaccctggaggaggtgcctgctgctgagagcgctggccccccccagagcccccagggcgccagcgccctgcccaccaccatctccttcacctgctggaggcagcccaatgaaggcagcagcagccaggaggaggagggccccagcaccagcccagatgctgagagcctcttccgggaggccctgagcaacaaggtggatgagctggcccacttcctgctgaggaagtaccgggccaaggagctggtgaccaaggccgagatgctggagagggtcatcaagaactacaagcgctgcttccctgtgatctttgggaaggccagcgagagcctgaagatgatctttggaattgatgtgaaggaggtggaccctgccagcaacacctacaccctggtgacctgcctgggcctgtcctatgatggcctgctgggcaacaaccagatcttccccaagacaggcctgctgatcatcgtgctgggcaccatcgccatggagggggacagcgccagcgaggaggagatctgggaggagctgggcgtgatgggcgtgtatgatggccgggagcacacagtgtatggatag

SEQ ID NO: 159249 - DNA, 519 bp, Artificial Sequence
  Description of Artificial Sequence: Synthetic coding sequence
atgagcagcgagcagaagagccagcactgcaagccagaggagggcgtggaggcccaggaggaggccctgggcctggtgggcgcccaggcccccaccacagaggagcaggaggccgctgtgagcagcagcagccccctggtgcccggcaccctggaggaggtgcctgctgctgagagcgctggccccccccagagcccccagggcgccagcgccctgcccaccaccatctccttcacctgctggaggcagcccaatgaaggcagcagcagccaggaggaggagggccccagcaccagcccagatgctgagagcctcttccgggaggccctgagcaacaaggtggatgagctggcccacttcctgctgaggaagtaccgggccaaggagctggtgaccaaggccgagatgctggagagggtcatcaagaactacaagcgctgcttccctgtgatctttgggaaggccagcgagagcctgaagatgatctttggaattgatgtgaaggaggtggacccctag

SEQ ID NO: 159250 - DNA, 726 bp, Artificial Sequence; identical to SEQ ID NO: 159248
  Description of Artificial Sequence: Synthetic coding sequence

SEQ ID NO: 159251 - DNA, 726 bp, Artificial Sequence; identical to SEQ ID NO: 159248
  Description of Artificial Sequence: Synthetic coding sequence

SEQ ID NO: 159252 - DNA, 654 bp, Artificial Sequence; identical to SEQ ID NO: 159247
  Description of Artificial Sequence: Synthetic coding sequence

SEQ ID NO: 159253 - DNA, 726 bp, Artificial Sequence; identical to SEQ ID NO: 159248
  Description of Artificial Sequence: Synthetic coding sequence

SEQ ID NO: 159254 - DNA, 945 bp, Artificial Sequence
  Description of Artificial Sequence: Synthetic coding sequence
atgcccctggagcagaggagccagcactgcaagccagaggagggcctggaggcccggggggaggccctgggcctggtgggcgcccaggccccagccacagaggagcaggaggccgccagcagcagcagcaccctggtggaggtgaccctgggggaggtgcctgctgctgagagcccagaccccccccagagcccccagggcgccagcagcctgcccaccaccatgaactaccccctgtggagccagagctatgaggacagcagcaaccaggaggaggagggccccagcaccttcccagacctggagagcgagttccaggccgccctgagcaggaaggtggccaagctggtgcacttcctgctgctgaagtaccgggcccgggagcctgtgaccaaggccgagatgctgggctctgtggtgggcaactggcagtacttcttccctgtgatcttcagcaaggccagtgacagcctgcagctggtgtttggcatcgagctgatggaggtggaccccatcggccacgtgtacatctttgccacctgcctgggcctgtcctatgatggcctgctgggggacaaccagatcatgcccaagacaggcttcctgatcatcatcctggccatcatcgccaaggagggggactgtgcccctgaggagaagatctgggaggagctgtctgtgctggaggtgtttgagggcagagaagattccatctttggagaccccaagaagctgctgacccagtactttgtgcaggagaactacctggagtaccggcaggtgcccggcagtgaccctgcctgctatgagttcctgtggggcccccgggccctgattgagaccagctatgtgaaggtgctgcaccacatggtgaagatcagcggcggcccccgcatctcctaccccctgctgcacgagtgggccctgcgggagggggaggagtag

SEQ ID NO: 159255 - DNA, 606 bp, Artificial Sequence
  Description of Artificial Sequence: Synthetic coding sequence
atgcccctggagcagaggagccagcactgcaagccagaggagggcctggaggcccggggggaggccctgggcctggtgggcgcccaggccccagccacagaggagcaggaggccgccagcagcagcagcaccctggtggaggtgaccctgggggaggtgcctgctgctgagagcccagaccccccccagagcccccagggcgccagcagcctgcccaccaccatgaactaccccctgtggagccagagctatgaggacagcagcaaccaggaggaggagggccccagcaccttcccagacctggagagcgagttccaggccgccctgagcaggaaggtggccaagctggtgcacttcctgctgctgaagtaccgggcccgggagcctgtgaccaaggccgagatgctgggctctgtggtgggcaactggcagtacttcttccctgtgatcttcagcaaggccagtgacagcctgcagctggtgtttggcatcgagctgatggaggtggaccccatcggccacgtgtacatctttgccacctgcctgggcctgtcctatgatggcctgctgggggacaaccagatcatgcccaagacaggcttctag

SEQ ID NO: 159256 - DNA, 708 bp, Artificial Sequence
  Description of Artificial Sequence: Synthetic coding sequence
atgcccctggagcagaggagccagcactgcaagccagaggagggcctggaggcccggggggaggccctgggcctggtgggcgcccaggccccagccacagaggagcaggaggccgccagcagcagcagcaccctggtggaggtgaccctgggggaggtgcctgctgctgagagcccagaccccccccagagcccccagggcgccagcagcctgcccaccaccatgaactaccccctgtggagccagagctatgaggacagcagcaaccaggaggaggagggccccagcaccttcccagacctggagagcgagttccaggccgccctgagcaggaaggtggccaagctggtgcacttcctgctgctgaagtaccgggcccgggagcctgtgaccaaggccgagatgctgggctctgtggtgggcaactggcagtacttcttccctgtgatcttcagcaaggccagtgacagcctgcagctggtgtttggcatcgagctgatggaggtggaccccatcggccacgtgtacatctttgccacctgcctgggcctgtcctatgatggcctgctgggggacaaccagatcatgcccaagacaggcttcctgatcatcatcctggccatcatcgccaaggagggggactgtgcccctgaggagaagatctgggaggagctgtctgtgctggaggtgtttgagggccgggagtag

SEQ ID NO: 159257 - DNA, 957 bp, Artificial Sequence
  Description of Artificial Sequence: Synthetic coding sequence
atgctgctgggccagaagagccagcgctacaaggccgaggagggcctgcaggcccagggcgaggcccctggcctgatggatgtgcagatccccacagctgaggagcagaaggccgccagcagcagcagcaccctcatcatgggcaccctggaggaggtgacagacagcggcagccccagccccccccagagccctgagggcgccagcagcagcctgactgtgacagacagcaccctgtggagccagagtgatgagggcagcagcagcaatgaggaggagggccccagcaccagcccagaccctgcccacctggagagcctcttccgggaggccctggatgagaaggtggccgagctggtgcgcttcctgctgaggaagtaccagatcaaggagcctgtgaccaaggccgagatgctggagagcgtcatcaagaactacaagaaccacttcccagacatcttcagcaaggccagcgagtgcatgcaggtgatctttggaattgatgtgaaggaggtggaccctgctggccacagctacatcctggtgacctgcctgggcctgtcctatgatggcctgctgggagatgaccagagcacccccaagacaggcctgctgatcatcgtgctgggcatgatcctgatggagggcagccgggcccctgaggaggccatctgggaggccctgtctgtgatgggcctgtatgatggccgggagcacagcgtgtactggaagctgaggaagctgctgacccaggagtgggtgcaggagaactacctggagtaccggcaggcccctggcagtgaccctgtgcgctatgagttcctgtggggcccccgggccctggccgagaccagctatgtgaaggtgctggagcacgtggtgcgggtgaatgcccgggtgcgcatctcctaccccagcctgcacgaggaggccctgggggaggagaagggcgtgtag

SEQ ID NO: 159258 - DNA, 957 bp, Artificial Sequence; identical to SEQ ID NO: 159257
  Description of Artificial Sequence: Synthetic coding sequence

SEQ ID NO: 159259 - DNA, 957 bp, Artificial Sequence; identical to SEQ ID NO: 159257
  Description of Artificial Sequence: Synthetic coding sequence

SEQ ID NO: 159260 - DNA, 948 bp, Artificial Sequence
  Description of Artificial Sequence: Synthetic coding sequence
atgagcctggagcagaggagcccccactgcaagccagatgaggacctggaggcccagggcgaggacctgggcctgatgggcgcccaggagcccaccggggaggaggaggagaccaccagcagcagtgacagcaaggaggaggaggtgtctgctgctggcagcagcagccccccccagagcccccagggcggggccagcagcagcatctctgtgtactacaccctgtggagccagtttgatgagggcagcagcagccaggaggaggaggagcccagcagctctgtggaccctgcccagctggagttcatgttccaggaggccctgaagctgaaggtggccgagctggtgcacttcctgctgcacaagtacagagtgaaggagcctgtgaccaaggccgagatgctggagagcgtcatcaagaactacaagcgctacttccctgtgatctttgggaaggccagcgagttcatgcaggtgatctttggaacagatgtgaaggaggtggaccctgctggccacagctacatcctggtgacagccctgggcctgagctgtgacagcatgctgggagatggccacagcatgcccaaggccgccctgctgatcatcgtgctgggcgtcatcctgaccaaggacaactgtgcccctgaggaggtgatctgggaggccctgtctgtgatgggcgtgtatgtgggcaaggagcacatgttctacggggagcccaggaagctgctgacccaggactgggtgcaggagaactacctggagtaccggcaggtgcccggcagtgaccctgcccactatgagttcctgtggggcagcaaggcccacgccgagaccagctatgagaaggtgatcaactacctggtgatgctgaatgcccgggagcccatctgctaccccagcctgtatgaggaggtgctgggggaggagcaggagggcgtgtag

SEQ ID NO: 159261 - DNA, 345 bp, Artificial Sequence
  Description of Artificial Sequence: Synthetic coding sequence
atgagcctggagcagaggagcccccactgcaagccagatgaggacctggaggcccagggcgaggacctgggcctgatgggcgcccaggagcccaccggggaggaggaggagaccaccagcagcagtgacagcaaggaggaggaggtgtctgctgctggcagcagcagccccccccagagcccccagggcggggccagcagcagcatctctgtgtactacaccctgtggagccagtttgatgagggcagcagcagccaggaggaggaggagcccagcagctctgtggaccctgcccagctggagttcatgttccaggaggccctgaagctgaaggtggccgagtag

SEQ ID NO: 159262 - DNA, 930 bp, Artificial Sequence
  Description of Artificial Sequence: Synthetic coding sequence
atgagcctggagcagaggagcccccactgcaagccagatgaggacctggaggcccagggcgaggacctgggcctgatgggcgcccaggagcccaccggggaggaggaggagaccaccagcagcagtgacagcaaggaggaggaggtgtctgctgctggcagcagcagccccccccagagcccccagggcggggccagcagcagcatctctgtgtactacaccctgtggagccagtttgatgagggcagcagcagccaggaggaggaggagcccagcagctctgtggaccctgcccagctggagttcatgttccaggaggccctgaagctgaaggtggccgagctggtgcacttcctgctgcacaagtacagagtgaaggagcctgtgaccaaggccgagatgctggagagcgtcatcaagaactacaagcgctacttccctgtgatctttgggaaggccagcgagttcatgcaggtgatctttggaacagatgtgaaggaggtggaccctgctggccacagctacatcctggtgacagccctgggcctgagctgtgacagcatgctgggagatggccacagcatgcccaaggccgccctgctgatcatcgtgctgggcgtcatcctgaccaaggacaactgtgcccctgaggaggtgatctgggaggccctgtctgtgatgggcgtgtatgtgggcaaggagcacatgttctacggggagcccaggaagctgctgacccaggactgggtgcaggagaactacctggagtaccggcaggtgcccggcagtgaccctgcccactatgagttcctgtggggcagcaaggcccacgccgagaccagctatgagaaggtgatcaactacctggtgatgctgaatgcccgggagcccatctgctaccccagcctgtatgaggaggtgctgggctag

SEQ ID NO: 159263 - DNA, 591 bp, Artificial Sequence
  Description of Artificial Sequence: Synthetic coding sequence
atgagcctggagcagaggagcccccactgcaagccagatgaggacctggaggcccagggcgaggacctgggcctgatgggcgcccaggagcccaccggggaggaggaggagaccaccagcagcagtgacagcaaggaggaggaggtgtctgctgctggcagcagcagccccccccagagcccccagggcggggccagcagcagcatctctgtgtactacaccctgtggagccagtttgatgagggcagcagcagccaggaggaggaggagcccagcagctctgtggaccctgcccagctggagttcatgttccaggaggccctgaagctgaaggtggccgagctggtgcacttcctgctgcacaagtacagagtgaaggagcctgtgaccaaggccgagatgctggagagcgtcatcaagaactacaagcgctacttccctgtgatctttgggaaggccagcgagttcatgcaggtgatctttggaacagatgtgaaggaggtggaccctgctggccacagctacatcctggtgacagccctgggcctgagctgtgacagcatgctgggagatggccacagcatgccctag

SEQ ID NO: 159264 - DNA, 294 bp, Artificial Sequence
  Description of Artificial Sequence: Synthetic coding sequence
atgagcctggagcagaggagcccccactgcaagccagatgaggacctggaggcccagggcgaggacctgggcctgatgggcgcccaggagcccaccggggaggaggaggagaccaccagcagcagtgacagcaaggaggaggaggtgtctgctgctggcagcagcagccccccccagagcccccagggcggggccagcagcagcatctctgtgtactacaccctgtggagccagtttgatgagggcagcagcagccaggaggaggaggagcccagcagctctgtggacccctag

SEQ ID NO: 159265 - DNA, 948 bp, Artificial Sequence; identical to SEQ ID NO: 159260
  Description of Artificial Sequence: Synthetic coding sequence

SEQ ID NO: 159266 - DNA, 1044 bp, Artificial Sequence
  Description of Artificial Sequence: Synthetic coding sequence
atgccccggggccagaagagcaagctgcgggcccgggagaagaggaggaaggcccgggaggagacccagggcctgaaggtggcccacgccacagctgctgagaaggaggagtgccccagcagcagccctgtgctgggggacacccccaccagcagccctgctgctggcatcccccagaagccccagggcgccccacccaccaccacagctgctgctgctgtgtcctgcacagaaagtgatgagggcgccaagtgccagggcgaggagaatgccagcttcagccaggccaccaccagcacagagagctctgtgaaggaccctgtggcctgggaggccggcatgctgatgcacttcatcctgaggaagtacaagatgagggagcccatcatgaaggctgacatgctgaaggtggtggatgagaagtacaaggaccacttcacagagatcctgaatggagccagccggcggctggagctggtgtttggcctggacctgaaggaggacaaccccagcggccacacctacaccctggtgtccaagctgaacctgaccaatgatggcaacctgagcaatgactgggacttccccagaaatggcctgctgatgcccctgctgggcgtcatcttcctgaagggcaacagcgccacagaggaggagatctggaagttcatgaatgtgctgggcgcctatgatggagaggagcacctgatctacggggagcccaggaagttcatcacccaggacctggtgcaggagaagtacctgaagtatgagcaggtgcccaacagcgaccccccacgctaccagttcctgtggggcccccgggcctatgcagagaccaccaagatgaaggtgctggagttcctggccaagatgaatggagccaccccccgggacttccccagccactatgaggaggccctgagagatgaggaggagcgggcccaggtgcgcagctctgtgcgggcccggcggaggaccacagccaccaccttccgggcccggagccgggcccccttcagccgcagcagccaccccatgtag

SEQ ID NO: 159267 - DNA, 1044 bp, Artificial Sequence; identical to SEQ ID NO: 159266
  Description of Artificial Sequence: Synthetic coding sequence

SEQ ID NO: 159268 - DNA, 1044 bp, Artificial Sequence; identical to SEQ ID NO: 159266
  Description of Artificial Sequence: Synthetic coding sequence

SEQ ID NO: 159269 - DNA, 1044 bp, Artificial Sequence
  Description of Artificial Sequence: Synthetic coding sequence
atgccccggggccagaagagcaagctgcgggcccgggagaagaggcggcaggcccggggcggcctggaggacctgattgatgccctggacatcctggaggaggaggaggagagccccccatctgccagcgcctgcctgaaggatgtgttccagagcagcctggatggagccagcaacaacccccacggcctgcgggaggcccagagcaccagcaccagcgccacagctgccagccacaccaggcaccctgagggcgtgaatgaccagatggaggagcggcccatctgcacccaggacctggaggccacagacagcttcccccggggccctgtggatgagaaggtgatcatcctggtgcactacctgctgtacaagtaccagatgaaggagcccatcaccaaggctgacatgctgagaaatgtgacccagatgagcaagagccagtttcctgtgatcctgagccgggccagcgagcacctggagctgatcttcggcctggacctgaaggaggtggagcccaacaagcacatctacgtgctggtgaacaagctggacctgggctgtgatgccaagctgagtgatgagaccggggtgcccaagacaggcctgctgatgacagtgctgggcatcatcttcaccaacggcaactgtgtggccgaggaggaggtgtggaaggtgttcaacaccatgggcctgtatgatggcatcgagcacttcatgtttggagagcccaggaagctgctgaccaaggacctggtgaaggagaactacctggagtaccagcaggtgcccaacagcgaccccccacgctaccagttcctgtggggcccccgggcccatgctgagaccagcaagatgaaggtgctggagttcctggccaaggtgaatgacacagcccccagcgagttcagcaactggtacacagaggccctgcaggatgaggaggagcgggcccgggcccgggtggccgccaaggcccgggtgtctgccacagctggggcccggagcaaggtgaagagcagcaagagcagccagctgcagtag

SEQ ID NO: 159270 - DNA, 975 bp, Artificial Sequence
  Description of Artificial Sequence: Synthetic coding sequence
atgagccaggaccaggagagcccccgctgcacccatgaccagcacctgcagaccttcagcgagacccagagcctggaggtggcccaggtgtccaaggccctggagaagaccctgctgagcagcagccaccccctggtgcctgggaagctgaaggaggccccagctgccaaggccgagagccccctggaggtgccccagagcttctgcagcagcagcattgctgtgaccaccaccagcagcagcgagagtgatgaggccagcagcaaccaggaggaggaggacagccccagcagcagcgaggacaccagtgaccccagaaatgtgcctgcagatgccctggaccagaaggtggccttcctggtgaacttcatgctgcacaagtgccagatgaagaagcccatcaccaaggctgacatgctgaagatcatcatcaaggatgatgagagccacttcagcgagatcctgctgcgggccagcgagcacctggagatgatcttcggcctggatgtggtggaggtggaccccaccacccactgctacggcctcttcatcaagctgggcctgacctatgatggcatgctgtctggagagaagggcgtgcccaagacaggcctgctgatcatcgtgctgggcgtcatcttcatgaagggcaacagagccacagaggaggaggtgtgggaggtgctgaacctgactggagtgtacagcggcaagaagcacttcatctttggagagcccaggatgctgatcaccaaggactttgtgaaggagaagtacctggagtaccagcaggtggccaacagcgaccctgcccgctatgagttcctgtggggcccccgggccaaggccgagaccagcaagatgaaggtgctggagtttgtggccaaggtgcacggcagctacccccacagcttccccagccagtatgcagaggccctgaaggaggaggaggagcgggcccgggcccgcatctag

SEQ ID NO: 159271 - DNA, 975 bp, Artificial Sequence; identical to SEQ ID NO: 159270
  Description of Artificial Sequence: Synthetic coding sequence

SEQ ID NO: 159272 - DNA, 975 bp, Artificial Sequence; identical to SEQ ID NO: 159270
  Description of Artificial Sequence: Synthetic coding sequence

SEQ ID NO: 159273 - DNA, 975 bp, Artificial Sequence; identical to SEQ ID NO: 159270
  Description of Artificial Sequence: Synthetic coding sequence

SEQ ID NO: 159274 - DNA, 1071 bp, Artificial Sequence
  Description of Artificial Sequence: Synthetic coding sequence
atgggcacagaggcccagcctgtggtgaaggctgtgatcctgcactgcctgcccagctgcccccacagctgcctgctgccccccaccagggtcatcatgagccaggaccaggagagcccccgctgcacccatgaccagcacctgcagaccttcagcgagacccagagcctggaggtggcccaggtgtccaaggccctggagaagaccctgctgagcagcagccaccccctggtgcctgggaagctgaaggaggccccagctgccaaggccgagagccccctggaggtgccccagagcttctgcagcagcagcattgctgtgaccaccaccagcagcagcgagagtgatgaggccagcagcaaccaggaggaggaggacagccccagcagcagcgaggacaccagtgaccccagaaatgtgcctgcagatgccctggaccagaaggtggccttcctggtgaacttcatgctgcacaagtgccagatgaagaagcccatcaccaaggctgacatgctgaagatcatcatcaaggatgatgagagccacttcagcgagatcctgctgcgggccagcgagcacctggagatgatcttcggcctggatgtggtggaggtggaccccaccacccactgctacggcctcttcatcaagctgggcctgacctatgatggcatgctgtctggagagaagggcgtgcccaagacaggcctgctgatcatcgtgctgggcgtcatcttcatgaagggcaacagagccacagaggaggaggtgtgggaggtgctgaacctgactggagtgtacagcggcaagaagcacttcatctttggagagcccaggatgctgatcaccaaggactttgtgaaggagaagtacctggagtaccagcaggtggccaacagcgaccctgcccgctatgagttcctgtggggcccccgggccaaggccgagaccagcaagatgaaggtgctggagtttgtggccaaggtgcacggcagctacccccacagcttccccagccagtatgcagaggccctgaaggaggaggaggagcgggcccgggcccgcatctag
